United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 75

SEQ ID NO: 3417637 - RNA, 19 nt, Human
aaggaugcccaaagaugca

SEQ ID NO: 3417638 - RNA, 17 nt, Human
aaggaugggguuaugaa

SEQ ID NO: 3417639 - RNA, 22 nt, Human
aaggauguagcuuuucaccuuu

SEQ ID NO: 3417640 - RNA, 17 nt, Human
aaggaugugauugugga

SEQ ID NO: 3417641 - RNA, 15 nt, Human
aaggauugcuacugu

SEQ ID NO: 3417642 - RNA, 13 nt, Human
aaggauuguaaaa

SEQ ID NO: 3417643 - RNA, 23 nt, Human
aaggauuguaaaaaaaaaugccu

SEQ ID NO: 3417644 - RNA, 17 nt, Human
aaggauugugauauuuu

SEQ ID NO: 3417645 - RNA, 16 nt, Human
aaggucuguuuugagu

SEQ ID NO: 3417646 - RNA, 22 nt, Human
aaggucuugcauuuaaaagaca

SEQ ID NO: 3417647 - RNA, 12 nt, Human
aaggucuuucag

SEQ ID NO: 3417648 - RNA, 17 nt, Human
aaggugaaacauuuucu

SEQ ID NO: 3417649 - RNA, 20 nt, Human
aaggugacagaaggaccagc

SEQ ID NO: 3417650 - RNA, 21 nt, Human
aaggugacaucggaaaaauaa

SEQ ID NO: 3417651 - RNA, 17 nt, Human
aaggugacccaaugauu

SEQ ID NO: 3417652 - RNA, 13 nt, Human
aaggugaggccug

SEQ ID NO: 3417653 - RNA, 14 nt, Human
aaggugaggccugu

SEQ ID NO: 3417654 - RNA, 19 nt, Human
aaggugaggccugucugug

SEQ ID NO: 3417655 - RNA, 19 nt, Human
aaggugauaagggaaaaga

SEQ ID NO: 3417656 - RNA, 13 nt, Human
aaggugauguugu

SEQ ID NO: 3417657 - RNA, 19 nt, Human
aaggugcucucuuucuguc

SEQ ID NO: 3417658 - RNA, 18 nt, Human
aaggugcugacggccagg

SEQ ID NO: 3417659 - RNA, 21 nt, Human
aaggugcuguugucauugcuu

SEQ ID NO: 3417660 - RNA, 16 nt, Human
aaggugcuuggaguuu

SEQ ID NO: 3417661 - RNA, 16 nt, Human
aagguggaccuuuuaa

SEQ ID NO: 3417662 - RNA, 15 nt, Human
aagguggaguggaug

SEQ ID NO: 3417663 - RNA, 19 nt, Human
aagguggauggccccagca

SEQ ID NO: 3417664 - RNA, 16 nt, Human
aaggugggcugagccc

SEQ ID NO: 3417665 - RNA, 21 nt, Human
aaggugggcugagcccuggca

SEQ ID NO: 3417666 - RNA, 21 nt, Human
aagguggggucuuugugagag

SEQ ID NO: 3417667 - RNA, 17 nt, Human
aaggugguaugugugug

SEQ ID NO: 3417668 - RNA, 20 nt, Human
aaggugguauguguguguau

SEQ ID NO: 3417669 - RNA, 21 nt, Human
aagguguauuuaaacuaucuu

SEQ ID NO: 3417670 - RNA, 13 nt, Human
aagguguuugaaa

SEQ ID NO: 3417671 - RNA, 20 nt, Human
aagguguuugaaaauaguuu

SEQ ID NO: 3417672 - RNA, 18 nt, Human
aagguuaccaagaagccu

SEQ ID NO: 3417673 - RNA, 18 nt, Human
aagguuagagaauaaauu

SEQ ID NO: 3417674 - RNA, 17 nt, Human
aagguuaggauuuaaca

SEQ ID NO: 3417675 - RNA, 22 nt, Human
aagguuauuuauuuaaaugucu

SEQ ID NO: 3417676 - RNA, 15 nt, Human
aagguuccacagagu

SEQ ID NO: 3417677 - RNA, 15 nt, Human
aagguucccuugugg

SEQ ID NO: 3417678 - RNA, 12 nt, Human
aagguucuaggu

SEQ ID NO: 3417679 - RNA, 13 nt, Human
aagguucuagguu

SEQ ID NO: 3417680 - RNA, 17 nt, Human
aagguucucauaggaaa

SEQ ID NO: 3417681 - RNA, 22 nt, Human
aagguugacaauaaaugugcuu

SEQ ID NO: 3417682 - RNA, 21 nt, Human
aagguugcauacugagccaag

SEQ ID NO: 3417683 - RNA, 13 nt, Human
aagguuguauugc

SEQ ID NO: 3417684 - RNA, 18 nt, Human
aagguuguuuugaaacug

SEQ ID NO: 3417685 - RNA, 21 nt, Human
aagguuuacaauuuacaaagu

SEQ ID NO: 3417686 - RNA, 19 nt, Human
aagguuuaggcugguggcc

SEQ ID NO: 3417687 - RNA, 20 nt, Human
aagguuuaggcugguggccc

SEQ ID NO: 3417688 - RNA, 17 nt, Human
aagguuuauuguuaaua

SEQ ID NO: 3417689 - RNA, 20 nt, Human
aagguuuauuguuaauacaa

SEQ ID NO: 3417690 - RNA, 23 nt, Human
aagguuucagaaagaagugggga

SEQ ID NO: 3417691 - RNA, 16 nt, Human
aagguuucguuucugu

SEQ ID NO: 3417692 - RNA, 16 nt, Human
aagguuucugaaaauu

SEQ ID NO: 3417693 - RNA, 18 nt, Human
aagguuuggaaggagcag

SEQ ID NO: 3417694 - RNA, 13 nt, Human
aagguuuggugug

SEQ ID NO: 3417695 - RNA, 12 nt, Human
aagguuuuaagu

SEQ ID NO: 3417696 - RNA, 15 nt, Human
aagguuuuagguucu

SEQ ID NO: 3417697 - RNA, 17 nt, Human
aagguuuuagguucuaa

SEQ ID NO: 3417698 - RNA, 23 nt, Human
aagguuuuagguucuaaaguucu

SEQ ID NO: 3417699 - RNA, 19 nt, Human
aagguuuuugauagcauug

SEQ ID NO: 3417700 - RNA, 13 nt, Human
aaguaaaaacaaa

SEQ ID NO: 3417701 - RNA, 17 nt, Human
aaguaaaaccacagcag

SEQ ID NO: 3417702 - RNA, 13 nt, Human
aaguaaaagcaaa

SEQ ID NO: 3417703 - RNA, 14 nt, Human
aaguaaaaugucuu

SEQ ID NO: 3417704 - RNA, 13 nt, Human
aaguaaaauugcu

SEQ ID NO: 3417705 - RNA, 20 nt, Human
aaguaaacuuuuuguucugg

SEQ ID NO: 3417706 - RNA, 17 nt, Human
aaguaaagccauuaaau

SEQ ID NO: 3417707 - RNA, 13 nt, Human
aaguaaauacaau

SEQ ID NO: 3417708 - RNA, 15 nt, Human
aaguaaauacaauuu

SEQ ID NO: 3417709 - RNA, 17 nt, Human
aaguaaauacaauuuuu

SEQ ID NO: 3417710 - RNA, 18 nt, Human
aaguaaauacaugcauau

SEQ ID NO: 3417711 - RNA, 12 nt, Human
aaguaacaaaaa

SEQ ID NO: 3417712 - RNA, 15 nt, Human
aaguaacauaacuag

SEQ ID NO: 3417713 - RNA, 15 nt, Human
aaguaacgcaauaaa

SEQ ID NO: 3417714 - RNA, 14 nt, Human
aaguaacugugaga

SEQ ID NO: 3417715 - RNA, 15 nt, Human
aaguaacuuuauucu

SEQ ID NO: 3417716 - RNA, 19 nt, Human
aaguaagaaaauauuuugu

SEQ ID NO: 3417717 - RNA, 15 nt, Human
aaguaaggugcaguu

SEQ ID NO: 3417718 - RNA, 21 nt, Human
aaguaaguaccacucaggcca

SEQ ID NO: 3417719 - RNA, 14 nt, Human
aaguaagucucaag

SEQ ID NO: 3417720 - RNA, 13 nt, Human
aaguaauauaaug

SEQ ID NO: 3417721 - RNA, 16 nt, Human
aaguaauauaauggaa

SEQ ID NO: 3417722 - RNA, 17 nt, Human
aaguaauaugcacacau

SEQ ID NO: 3417723 - RNA, 21 nt, Human
aaguaauaugcacacauuuuu

SEQ ID NO: 3417724 - RNA, 22 nt, Human
aaguaauauuuauuaaauuuuu

SEQ ID NO: 3417725 - RNA, 18 nt, Human
aaguaaucccgccaccua

SEQ ID NO: 3417726 - RNA, 14 nt, Human
aaguaauguggaag

SEQ ID NO: 3417727 - RNA, 23 nt, Human
aaguaauuaucgggaacaguguu

SEQ ID NO: 3417728 - RNA, 14 nt, Human
aaguaauuccucuc

SEQ ID NO: 3417729 - RNA, 16 nt, Human
aaguaauugugaaaaa

SEQ ID NO: 3417730 - RNA, 15 nt, Human
aaguaauuguuccag

SEQ ID NO: 3417731 - RNA, 16 nt, Human
aaguaauuucuucuca

SEQ ID NO: 3417732 - RNA, 18 nt, Human
aaguacaauguguuuuuc

SEQ ID NO: 3417733 - RNA, 16 nt, Human
aaguacacucugcugu

SEQ ID NO: 3417734 - RNA, 23 nt, Human
aaguacacugaauuuuuaugugu

SEQ ID NO: 3417735 - RNA, 13 nt, Human
aaguacacuguuu

SEQ ID NO: 3417736 - RNA, 19 nt, Human
aaguacacuguuucaaacu

SEQ ID NO: 3417737 - RNA, 16 nt, Human
aaguacagagaagcca

SEQ ID NO: 3417738 - RNA, 17 nt, Human
aaguacagagaagccau

SEQ ID NO: 3417739 - RNA, 15 nt, Human
aaguacagguacuuu

SEQ ID NO: 3417740 - RNA, 13 nt, Human
aaguacauauuua

SEQ ID NO: 3417741 - RNA, 17 nt, Human
aaguacauuuuuugaaa

SEQ ID NO: 3417742 - RNA, 16 nt, Human
aaguaccaaaguuuua

SEQ ID NO: 3417743 - RNA, 17 nt, Human
aaguaccacucaggcca

SEQ ID NO: 3417744 - RNA, 20 nt, Human
aaguacccguucacauuuuu

SEQ ID NO: 3417745 - RNA, 21 nt, Human
aagacugaguacguugugcau

SEQ ID NO: 3417746 - RNA, 22 nt, Human
aagacugaguacguugugcauu

SEQ ID NO: 3417747 - RNA, 16 nt, Human
aagacugcacaucaaa

SEQ ID NO: 3417748 - RNA, 17 nt, Human
aagacugcauuauauuu

SEQ ID NO: 3417749 - RNA, 22 nt, Human
aagacuggcuuuuauuaaugca

SEQ ID NO: 3417750 - RNA, 17 nt, Human
aagacugguuuucugcc

SEQ ID NO: 3417751 - RNA, 16 nt, Human
aagacuguaaugaauc

SEQ ID NO: 3417752 - RNA, 18 nt, Human
aagacuguggcugcuagc

SEQ ID NO: 3417753 - RNA, 22 nt, Human
aagacuuaaagggcccaaugaa

SEQ ID NO: 3417754 - RNA, 24 nt, Human
aagacuuaaagggcccaaugaauu

SEQ ID NO: 3417755 - RNA, 16 nt, Human
aagacuuaaugagacu

SEQ ID NO: 3417756 - RNA, 20 nt, Human
aagacuuacucuaagaucuu

SEQ ID NO: 3417757 - RNA, 21 nt, Human
aagacuucaguauguugucaa

SEQ ID NO: 3417758 - RNA, 21 nt, Human
aagacuucauugucccucuuc

SEQ ID NO: 3417759 - RNA, 14 nt, Human
aagacuucccagcu

SEQ ID NO: 3417760 - RNA, 18 nt, Human
aagacuucccuaacacuu

SEQ ID NO: 3417761 - RNA, 20 nt, Human
aagacuucucuuugccucaa

SEQ ID NO: 3417762 - RNA, 18 nt, Human
aagacuuggcaacagaag

SEQ ID NO: 3417763 - RNA, 19 nt, Human
aagacuuguaauauuuuua

SEQ ID NO: 3417764 - RNA, 17 nt, Human
aagacuuugguuauuuu

SEQ ID NO: 3417765 - RNA, 15 nt, Human
aagacuuuuaugaua

SEQ ID NO: 3417766 - RNA, 19 nt, Human
aagacuuuucuuucagcca

SEQ ID NO: 3417767 - RNA, 22 nt, Human
aagagaaaaaaaguuugccaga

SEQ ID NO: 3417768 - RNA, 13 nt, Human
aagagaaaagaaa

SEQ ID NO: 3417769 - RNA, 15 nt, Human
aagagaaaagaaaaa

SEQ ID NO: 3417770 - RNA, 16 nt, Human
aagagaaaagaaaaaa

SEQ ID NO: 3417771 - RNA, 15 nt, Human
aagagaaaagagaga

SEQ ID NO: 3417772 - RNA, 17 nt, Human
aagagaaaauguaaaua

SEQ ID NO: 3417773 - RNA, 17 nt, Human
aagagaaaauugaauuu

SEQ ID NO: 3417774 - RNA, 21 nt, Human
aagagaaaauugaauuuaaca

SEQ ID NO: 3417775 - RNA, 12 nt, Human
aagagaaacagg

SEQ ID NO: 3417776 - RNA, 19 nt, Human
aagagaaacuuuauacauu

SEQ ID NO: 3417777 - RNA, 14 nt, Human
aagagaaacuuugu

SEQ ID NO: 3417778 - RNA, 22 nt, Human
aagagaaccgagcaaagaucaa

SEQ ID NO: 3417779 - RNA, 11 nt, Human
aagagaacucg

SEQ ID NO: 3417780 - RNA, 15 nt, Human
aagagaacuuccaga

SEQ ID NO: 3417781 - RNA, 14 nt, Human
aagagaagcaauuu

SEQ ID NO: 3417782 - RNA, 18 nt, Human
aagagaagcuacuuuguu

SEQ ID NO: 3417783 - RNA, 13 nt, Human
aagagaagcugcu

SEQ ID NO: 3417784 - RNA, 14 nt, Human
aagagaagcugcug

SEQ ID NO: 3417785 - RNA, 15 nt, Human
aagagaagcugcuga

SEQ ID NO: 3417786 - RNA, 13 nt, Human
aagagaaguagaa

SEQ ID NO: 3417787 - RNA, 14 nt, Human
aagagaaguuauuu

SEQ ID NO: 3417788 - RNA, 11 nt, Human
aagagaaugag

SEQ ID NO: 3417789 - RNA, 19 nt, Human
aagagaaugccauucucuu

SEQ ID NO: 3417790 - RNA, 22 nt, Human
aagagaaugcccuucuccuuau

SEQ ID NO: 3417791 - RNA, 23 nt, Human
aagagaaugcccuucuccuuauu

SEQ ID NO: 3417792 - RNA, 10 nt, Human
aagagaaugu

SEQ ID NO: 3417793 - RNA, 13 nt, Human
aagagaauguuau

SEQ ID NO: 3417794 - RNA, 22 nt, Human
aagagaauguuauagugaauua

SEQ ID NO: 3417795 - RNA, 19 nt, Human
aagagacaaacaccuccca

SEQ ID NO: 3417796 - RNA, 13 nt, Human
aagagacaaacug

SEQ ID NO: 3417797 - RNA, 17 nt, Human
aagagacaauuucugca

SEQ ID NO: 3417798 - RNA, 13 nt, Human
aagagacacucca

SEQ ID NO: 3417799 - RNA, 16 nt, Human
aagagacagaauguau

SEQ ID NO: 3417800 - RNA, 21 nt, Human
aagagaccuaccucagguugc

SEQ ID NO: 3417801 - RNA, 19 nt, Human
aagagaccuguuuuaaaaa

SEQ ID NO: 3417802 - RNA, 19 nt, Human
aagagacucagccugcagu

SEQ ID NO: 3417803 - RNA, 18 nt, Human
aagagacugcguucugca

SEQ ID NO: 3417804 - RNA, 16 nt, Human
aagagagaaaaacaaa

SEQ ID NO: 3417805 - RNA, 12 nt, Human
aagagagaaaau

SEQ ID NO: 3417806 - RNA, 16 nt, Human
aagagagaaaauaaaa

SEQ ID NO: 3417807 - RNA, 19 nt, Human
aagagagaaaauaaaaagu

SEQ ID NO: 3417808 - RNA, 17 nt, Human
aagagagaacaggacua

SEQ ID NO: 3417809 - RNA, 11 nt, Human
aagagagaacc

SEQ ID NO: 3417810 - RNA, 19 nt, Human
aagagagagagagaaaaaa

SEQ ID NO: 3417811 - RNA, 19 nt, Human
aagagagagagagagagaa

SEQ ID NO: 3417812 - RNA, 15 nt, Human
aagagagauguuuug

SEQ ID NO: 3417813 - RNA, 15 nt, Human
aagagagcagagaau

SEQ ID NO: 3417814 - RNA, 15 nt, Human
aagagaggacacaaa

SEQ ID NO: 3417815 - RNA, 17 nt, Human
aagagaggagaggagag

SEQ ID NO: 3417816 - RNA, 19 nt, Human
aagagaggagaggagagag

SEQ ID NO: 3417817 - RNA, 11 nt, Human
aagagaggagu

SEQ ID NO: 3417818 - RNA, 16 nt, Human
aagagaggaguucaau

SEQ ID NO: 3417819 - RNA, 20 nt, Human
aagagaggaguucaaugauc

SEQ ID NO: 3417820 - RNA, 22 nt, Human
aagagagggccaugcaauucau

SEQ ID NO: 3417821 - RNA, 11 nt, Human
aagagaguuuu

SEQ ID NO: 3417822 - RNA, 14 nt, Human
aagagauaugggaa

SEQ ID NO: 3417823 - RNA, 17 nt, Human
aagagauggccugagaa

SEQ ID NO: 3417824 - RNA, 23 nt, Human
aagagauggcuuacaaaaagaaa

SEQ ID NO: 3417825 - RNA, 17 nt, Human
aagagaugggcuuguuu

SEQ ID NO: 3417826 - RNA, 20 nt, Human
aagagaugggcuuguuuucu

SEQ ID NO: 3417827 - RNA, 16 nt, Human
aagagauugugguuuc

SEQ ID NO: 3417828 - RNA, 19 nt, Human
aagagauugugguuucauu

SEQ ID NO: 3417829 - RNA, 21 nt, Human
aagagauuuaaacucugaauu

SEQ ID NO: 3417830 - RNA, 16 nt, Human
aagagauuuaauuaau

SEQ ID NO: 3417831 - RNA, 17 nt, Human
aagagauuuuucaugau

SEQ ID NO: 3417832 - RNA, 15 nt, Human
aagagcaaaagaaug

SEQ ID NO: 3417833 - RNA, 13 nt, Human
aagagcaaaguag

SEQ ID NO: 3417834 - RNA, 14 nt, Human
aagagcacagcccu

SEQ ID NO: 3417835 - RNA, 19 nt, Human
aagagcaccuuccucacuu

SEQ ID NO: 3417836 - RNA, 22 nt, Human
aagagcagcaccuccucagccu

SEQ ID NO: 3417837 - RNA, 14 nt, Human
aagagcagccugug

SEQ ID NO: 3417838 - RNA, 13 nt, Human
aagagcaggccag

SEQ ID NO: 3417839 - RNA, 22 nt, Human
aagagcaucaguacuuguuucu

SEQ ID NO: 3417840 - RNA, 18 nt, Human
aagagcaucaugccucug

SEQ ID NO: 3417841 - RNA, 19 nt, Human
aagagcaucaugccucuga

SEQ ID NO: 3417842 - RNA, 14 nt, Human
aagguucuaaggcc

SEQ ID NO: 3417843 - RNA, 17 nt, Human
aagguuggagcccaggg

SEQ ID NO: 3417844 - RNA, 16 nt, Human
aagguugggcagggug

SEQ ID NO: 3417845 - RNA, 21 nt, Human
aagguuuaggcugguggccca

SEQ ID NO: 3417846 - RNA, 17 nt, Human
aagguuuaugaaaaaga

SEQ ID NO: 3417847 - RNA, 13 nt, Human
aagguuuauuguu

SEQ ID NO: 3417848 - RNA, 21 nt, Human
aagguuuauuguuaauacaag

SEQ ID NO: 3417849 - RNA, 17 nt, Human
aagguuuauuuuucugu

SEQ ID NO: 3417850 - RNA, 21 nt, Human
aagguuuccucaaacugugau

SEQ ID NO: 3417851 - RNA, 20 nt, Human
aagguuuuagguucuaaagu

SEQ ID NO: 3417852 - RNA, 20 nt, Human
aagguuuuauaaggcugaug

SEQ ID NO: 3417853 - RNA, 16 nt, Human
aagguuuuauuuugua

SEQ ID NO: 3417854 - RNA, 20 nt, Human
aagguuuuccucuucuauuu

SEQ ID NO: 3417855 - RNA, 11 nt, Human
aagguuuuuuu

SEQ ID NO: 3417856 - RNA, 17 nt, Human
aagguuuuuuuucaguu

SEQ ID NO: 3417857 - RNA, 20 nt, Human
aaguaaaaacaaagaaauua

SEQ ID NO: 3417858 - RNA, 14 nt, Human
aaguaaaaccacag

SEQ ID NO: 3417859 - RNA, 15 nt, Human
aaguaaaaccacagc

SEQ ID NO: 3417860 - RNA, 12 nt, Human
aaguaaaacuug

SEQ ID NO: 3417861 - RNA, 12 nt, Human
aaguaaacuuuu

SEQ ID NO: 3417862 - RNA, 16 nt, Human
aaguaaagaacugcac

SEQ ID NO: 3417863 - RNA, 17 nt, Human
aaguaaaucucuucugu

SEQ ID NO: 3417864 - RNA, 13 nt, Human
aaguaacaaaaau

SEQ ID NO: 3417865 - RNA, 20 nt, Human
aaguaacaagagugauucuu

SEQ ID NO: 3417866 - RNA, 16 nt, Human
aaguaacucauuuguu

SEQ ID NO: 3417867 - RNA, 22 nt, Human
aaguaacuugucuuaaauaaaa

SEQ ID NO: 3417868 - RNA, 11 nt, Human
aaguaagaaaa

SEQ ID NO: 3417869 - RNA, 12 nt, Human
aaguaagaaaau

SEQ ID NO: 3417870 - RNA, 14 nt, Human
aaguaagaaaauau

SEQ ID NO: 3417871 - RNA, 15 nt, Human
aaguaagaaaauauu

SEQ ID NO: 3417872 - RNA, 18 nt, Human
aaguaagaaaauauuuug

SEQ ID NO: 3417873 - RNA, 20 nt, Human
aaguaagaagacaugaacca

SEQ ID NO: 3417874 - RNA, 15 nt, Human
aaguaagaggcugga

SEQ ID NO: 3417875 - RNA, 23 nt, Human
aaguaagcccuugaagauaucuu

SEQ ID NO: 3417876 - RNA, 16 nt, Human
aaguaaggaauuuuau

SEQ ID NO: 3417877 - RNA, 18 nt, Human
aaguaaggugcaguuccc

SEQ ID NO: 3417878 - RNA, 18 nt, Human
aaguaaguaccacucagg

SEQ ID NO: 3417879 - RNA, 20 nt, Human
aaguaaguaccacucaggcc

SEQ ID NO: 3417880 - RNA, 17 nt, Human
aaguaagucucaaggua

SEQ ID NO: 3417881 - RNA, 14 nt, Human
aaguaauaaaauuc

SEQ ID NO: 3417882 - RNA, 20 nt, Human
aaguaauaaaauucaacaaa

SEQ ID NO: 3417883 - RNA, 21 nt, Human
aaguaauauaauggaagagaa

SEQ ID NO: 3417884 - RNA, 16 nt, Human
aaguaauaugcacaca

SEQ ID NO: 3417885 - RNA, 15 nt, Human
aaguaaucaucuaag

SEQ ID NO: 3417886 - RNA, 16 nt, Human
aaguaauccuagggaa

SEQ ID NO: 3417887 - RNA, 19 nt, Human
aaguaaugauaacuggaaa

SEQ ID NO: 3417888 - RNA, 17 nt, Human
aaguaaugccucugucu

SEQ ID NO: 3417889 - RNA, 22 nt, Human
aaguaauucugcugucucagcc

SEQ ID NO: 3417890 - RNA, 14 nt, Human
aaguaauuucagug

SEQ ID NO: 3417891 - RNA, 21 nt, Human
aauacauacggucagguuuaa

SEQ ID NO: 3417892 - RNA, 23 nt, Human
aauacauacggucagguuuaaca

SEQ ID NO: 3417893 - RNA, 16 nt, Human
aauacauagugaaaau

SEQ ID NO: 3417894 - RNA, 17 nt, Human
aauacaugaagcuucau

SEQ ID NO: 3417895 - RNA, 19 nt, Human
aauacaugaagcuucaugc

SEQ ID NO: 3417896 - RNA, 23 nt, Human
aauacaugacauuuauuuuucau

SEQ ID NO: 3417897 - RNA, 15 nt, Human
aauacaugcauauaa

SEQ ID NO: 3417898 - RNA, 13 nt, Human
aauacaugcaucu

SEQ ID NO: 3417899 - RNA, 22 nt, Human
aauacaugcuaagagaaguaga

SEQ ID NO: 3417900 - RNA, 22 nt, Human
aauacauggauaacacauuuga

SEQ ID NO: 3417901 - RNA, 16 nt, Human
aauacauuaaagcagu

SEQ ID NO: 3417902 - RNA, 19 nt, Human
aauacauuauauuucuauu

SEQ ID NO: 3417903 - RNA, 22 nt, Human
aauacauucuuuuugcucuaaa

SEQ ID NO: 3417904 - RNA, 14 nt, Human
aauacauuuaaaac

SEQ ID NO: 3417905 - RNA, 22 nt, Human
aauacauuuaaaacauuaaaau

SEQ ID NO: 3417906 - RNA, 17 nt, Human
aauacauuuaaaacuua

SEQ ID NO: 3417907 - RNA, 20 nt, Human
aauaccaaaauuauuucaga

SEQ ID NO: 3417908 - RNA, 18 nt, Human
aauaccacucuguaauug

SEQ ID NO: 3417909 - RNA, 13 nt, Human
aauaccaguucug

SEQ ID NO: 3417910 - RNA, 18 nt, Human
aauaccauuuaguaagaa

SEQ ID NO: 3417911 - RNA, 14 nt, Human
aauacccuucuuuu

SEQ ID NO: 3417912 - RNA, 14 nt, Human
aauaccucauguuu

SEQ ID NO: 3417913 - RNA, 19 nt, Human
aauaccucauguuuaugaa

SEQ ID NO: 3417914 - RNA, 21 nt, Human
aauaccucauguuuaugaaaa

SEQ ID NO: 3417915 - RNA, 14 nt, Human
aauaccucugugug

SEQ ID NO: 3417916 - RNA, 16 nt, Human
aauaccucugugugcu

SEQ ID NO: 3417917 - RNA, 17 nt, Human
aauaccucuuagcugag

SEQ ID NO: 3417918 - RNA, 19 nt, Human
aauaccucuuugaaagaag

SEQ ID NO: 3417919 - RNA, 21 nt, Human
aauaccugucccccugacaac

SEQ ID NO: 3417920 - RNA, 16 nt, Human
aauacgcacuacaugu

SEQ ID NO: 3417921 - RNA, 20 nt, Human
aauacgccagaacugcuuua

SEQ ID NO: 3417922 - RNA, 14 nt, Human
aauacuaaaauaug

SEQ ID NO: 3417923 - RNA, 16 nt, Human
aauacuaccuugaaaa

SEQ ID NO: 3417924 - RNA, 17 nt, Human
aauacuaccuugaaaau

SEQ ID NO: 3417925 - RNA, 18 nt, Human
aauacuaccuugaaaaua

SEQ ID NO: 3417926 - RNA, 14 nt, Human
aauacuagccagag

SEQ ID NO: 3417927 - RNA, 16 nt, Human
aauacuagucacccca

SEQ ID NO: 3417928 - RNA, 15 nt, Human
aauacuauuuaagau

SEQ ID NO: 3417929 - RNA, 17 nt, Human
aauacuauuuuuacugc

SEQ ID NO: 3417930 - RNA, 19 nt, Human
aauacuauuuuuacugcca

SEQ ID NO: 3417931 - RNA, 16 nt, Human
aauacucauaauguga

SEQ ID NO: 3417932 - RNA, 17 nt, Human
aauacucauaaugugaa

SEQ ID NO: 3417933 - RNA, 18 nt, Human
aauacucauaaugugaag

SEQ ID NO: 3417934 - RNA, 23 nt, Human
aauacucauaaugugaaguguua

SEQ ID NO: 3417935 - RNA, 13 nt, Human
aauacucaugugu

SEQ ID NO: 3417936 - RNA, 16 nt, Human
aauacucuaauucuaa

SEQ ID NO: 3417937 - RNA, 17 nt, Human
aauacucugcccucuag

SEQ ID NO: 3417938 - RNA, 23 nt, Human
aauacucugcccucuagagccuu

SEQ ID NO: 3417939 - RNA, 18 nt, Human
aauacugaaccacuugua

SEQ ID NO: 3417940 - RNA, 18 nt, Human
aauacugagaaaaccugu

SEQ ID NO: 3417941 - RNA, 24 nt, Human
aauacugccagaugcugauguuca

SEQ ID NO: 3417942 - RNA, 15 nt, Human
aauacugcugagaua

SEQ ID NO: 3417943 - RNA, 14 nt, Human
aauacuguuauucu

SEQ ID NO: 3417944 - RNA, 16 nt, Human
aauacuguuauucuuu

SEQ ID NO: 3417945 - RNA, 15 nt, Human
aauacuuaaauguua

SEQ ID NO: 3417946 - RNA, 20 nt, Human
aauacuuaaauguuauguau

SEQ ID NO: 3417947 - RNA, 17 nt, Human
aauacuuagcaaaaagu

SEQ ID NO: 3417948 - RNA, 13 nt, Human
aauacuuauucau

SEQ ID NO: 3417949 - RNA, 14 nt, Human
aauacuuccagaag

SEQ ID NO: 3417950 - RNA, 17 nt, Human
aauacuucucaaaccug

SEQ ID NO: 3417951 - RNA, 22 nt, Human
aauacuucucaaaccuguuuaa

SEQ ID NO: 3417952 - RNA, 16 nt, Human
aauacuucucauuuuu

SEQ ID NO: 3417953 - RNA, 14 nt, Human
aauacuucuuuuua

SEQ ID NO: 3417954 - RNA, 17 nt, Human
aauacuugaaccauaaa

SEQ ID NO: 3417955 - RNA, 13 nt, Human
aauacuugaacuu

SEQ ID NO: 3417956 - RNA, 20 nt, Human
aauacuugaacuugccucuu

SEQ ID NO: 3417957 - RNA, 10 nt, Human
aauacuuguc

SEQ ID NO: 3417958 - RNA, 18 nt, Human
aauacuugucaauauuua

SEQ ID NO: 3417959 - RNA, 20 nt, Human
aauacuugucaauauuuaaa

SEQ ID NO: 3417960 - RNA, 15 nt, Human
aauacuugucuguuu

SEQ ID NO: 3417961 - RNA, 17 nt, Human
aauacuuuaaaggaaaa

SEQ ID NO: 3417962 - RNA, 16 nt, Human
aauacuuugaaugugu

SEQ ID NO: 3417963 - RNA, 20 nt, Human
aauacuuugaauguguuuca

SEQ ID NO: 3417964 - RNA, 23 nt, Human
aauacuuugcagcacagcugaga

SEQ ID NO: 3417965 - RNA, 23 nt, Human
aauacuuuguauacaaguacugg

SEQ ID NO: 3417966 - RNA, 13 nt, Human
aauacuuuuccuu

SEQ ID NO: 3417967 - RNA, 20 nt, Human
aauacuuuuccuuaccuuua

SEQ ID NO: 3417968 - RNA, 11 nt, Human
aauacuuuugc

SEQ ID NO: 3417969 - RNA, 17 nt, Human
aauacuuuuucuaauga

SEQ ID NO: 3417970 - RNA, 13 nt, Human
aauagaaaacuga

SEQ ID NO: 3417971 - RNA, 17 nt, Human
aauagaaaacugaaaau

SEQ ID NO: 3417972 - RNA, 18 nt, Human
aauagaaaacugaaaauc

SEQ ID NO: 3417973 - RNA, 20 nt, Human
aauagaaaacugaaaaucua

SEQ ID NO: 3417974 - RNA, 13 nt, Human
aauagaaacucac

SEQ ID NO: 3417975 - RNA, 16 nt, Human
aauagaaauccaauug

SEQ ID NO: 3417976 - RNA, 15 nt, Human
aauagaaauuuugua

SEQ ID NO: 3417977 - RNA, 13 nt, Human
aauagaaggugau

SEQ ID NO: 3417978 - RNA, 14 nt, Human
aauagaaggugaug

SEQ ID NO: 3417979 - RNA, 15 nt, Human
aauagaauaaaggca

SEQ ID NO: 3417980 - RNA, 17 nt, Human
aauagaauauaauuauc

SEQ ID NO: 3417981 - RNA, 20 nt, Human
aauagaauauaauuaucgga

SEQ ID NO: 3417982 - RNA, 14 nt, Human
aauagaauguaaau

SEQ ID NO: 3417983 - RNA, 16 nt, Human
aauagaauuauaacug

SEQ ID NO: 3417984 - RNA, 22 nt, Human
aauagaauugacauugaaaucu

SEQ ID NO: 3417985 - RNA, 18 nt, Human
aauagacaaaaaguauau

SEQ ID NO: 3417986 - RNA, 22 nt, Human
aauagacaaauagaaaaugguc

SEQ ID NO: 3417987 - RNA, 13 nt, Human
aauagacaauuua

SEQ ID NO: 3417988 - RNA, 16 nt, Human
aauagacuuaaaucuc

SEQ ID NO: 3417989 - RNA, 18 nt, Human
aauagagaugagcuuucu

SEQ ID NO: 3417990 - RNA, 15 nt, Human
aauagaguauaugca

SEQ ID NO: 3417991 - RNA, 17 nt, Human
aauagaguauaugcacu

SEQ ID NO: 3417992 - RNA, 19 nt, Human
aauagaguugggacaauug

SEQ ID NO: 3417993 - RNA, 22 nt, Human
aauagaguuugcuauuagagca

SEQ ID NO: 3417994 - RNA, 18 nt, Human
aauagauacagcagaggc

SEQ ID NO: 3417995 - RNA, 19 nt, Human
aauagaugacauugacuau

SEQ ID NO: 3417996 - RNA, 22 nt, Human
aauagaugacauugacuauuuu

SEQ ID NO: 3417997 - RNA, 11 nt, Human
aauagauguuu

SEQ ID NO: 3417998 - RNA, 12 nt, Human
aauagauucucu

SEQ ID NO: 3417999 - RNA, 19 nt, Human
aauagauugcucaaaucag

SEQ ID NO: 3418000 - RNA, 16 nt, Human
aauagcaaaagaagaa

SEQ ID NO: 3418001 - RNA, 13 nt, Human
aauagcaacuuuu

SEQ ID NO: 3418002 - RNA, 23 nt, Human
aauagcagaaaaaccaacaucua

SEQ ID NO: 3418003 - RNA, 18 nt, Human
aaguauuuuccuguaaaa

SEQ ID NO: 3418004 - RNA, 19 nt, Human
aaguauuuuuauaaauaua

SEQ ID NO: 3418005 - RNA, 14 nt, Human
aaguauuuuuucaa

SEQ ID NO: 3418006 - RNA, 15 nt, Human
aaguauuuuuucagu

SEQ ID NO: 3418007 - RNA, 18 nt, Human
aagucaaaauauuuuuaa

SEQ ID NO: 3418008 - RNA, 23 nt, Human
aagucaaagacauucugacaucu

SEQ ID NO: 3418009 - RNA, 14 nt, Human
aagucaaaguaaaa

SEQ ID NO: 3418010 - RNA, 22 nt, Human
aagucaaaguaaaacuugcugc

SEQ ID NO: 3418011 - RNA, 15 nt, Human
aagucaaauuaauaa

SEQ ID NO: 3418012 - RNA, 19 nt, Human
aagucaaauuaauaaucuu

SEQ ID NO: 3418013 - RNA, 13 nt, Human
aagucaacaguaa

SEQ ID NO: 3418014 - RNA, 14 nt, Human
aagucaacaguaaa

SEQ ID NO: 3418015 - RNA, 15 nt, Human
aagucaacaguaaac

SEQ ID NO: 3418016 - RNA, 16 nt, Human
aagucaacaguaaacc

SEQ ID NO: 3418017 - RNA, 16 nt, Human
aagucaaccugccuga

SEQ ID NO: 3418018 - RNA, 19 nt, Human
aagucaaggguaggguggg

SEQ ID NO: 3418019 - RNA, 21 nt, Human
aagucaagugaaaaaggagga

SEQ ID NO: 3418020 - RNA, 13 nt, Human
aagucacaaagga

SEQ ID NO: 3418021 - RNA, 15 nt, Human
aagucacaaaggaau

SEQ ID NO: 3418022 - RNA, 24 nt, Human
aagucacacaguauuacuucugcu

SEQ ID NO: 3418023 - RNA, 19 nt, Human
aagucacaguuaaggagaa

SEQ ID NO: 3418024 - RNA, 16 nt, Human
aagucacaucacagga

SEQ ID NO: 3418025 - RNA, 17 nt, Human
aagucacaucacaggac

SEQ ID NO: 3418026 - RNA, 16 nt, Human
aagucaccaaauagug

SEQ ID NO: 3418027 - RNA, 20 nt, Human
aagucaccacuccauuccca

SEQ ID NO: 3418028 - RNA, 19 nt, Human
aagucaccuuguguguucc

SEQ ID NO: 3418029 - RNA, 21 nt, Human
aagucacggcugcgcacugug

SEQ ID NO: 3418030 - RNA, 17 nt, Human
aagucacucccaagccc

SEQ ID NO: 3418031 - RNA, 14 nt, Human
aagucacugcacag

SEQ ID NO: 3418032 - RNA, 17 nt, Human
aagucagacugcuggga

SEQ ID NO: 3418033 - RNA, 12 nt, Human
aagucagagaca

SEQ ID NO: 3418034 - RNA, 15 nt, Human
aagucagagacagau

SEQ ID NO: 3418035 - RNA, 23 nt, Human
aagucagaggauggccagugucu

SEQ ID NO: 3418036 - RNA, 18 nt, Human
aauagggacuaucuaucu

SEQ ID NO: 3418037 - RNA, 15 nt, Human
aauaggggauauuua

SEQ ID NO: 3418038 - RNA, 20 nt, Human
aauaggguauauuuuccuau

SEQ ID NO: 3418039 - RNA, 14 nt, Human
aauagguucuucuu

SEQ ID NO: 3418040 - RNA, 15 nt, Human
aauaguaauauaaua

SEQ ID NO: 3418041 - RNA, 15 nt, Human
aauaguaauuuguaa

SEQ ID NO: 3418042 - RNA, 21 nt, Human
aauaguauccuccagguuuuu

SEQ ID NO: 3418043 - RNA, 16 nt, Human
aauagucaaauugugu

SEQ ID NO: 3418044 - RNA, 16 nt, Human
aauagucaagaaaaau

SEQ ID NO: 3418045 - RNA, 19 nt, Human
aauagucuagacuaaaaga

SEQ ID NO: 3418046 - RNA, 20 nt, Human
aauagucuagacuaaaagau

SEQ ID NO: 3418047 - RNA, 15 nt, Human
aauagucuauauuuu

SEQ ID NO: 3418048 - RNA, 13 nt, Human
aauagucugugug

SEQ ID NO: 3418049 - RNA, 19 nt, Human
aauagugcagaaucucaua

SEQ ID NO: 3418050 - RNA, 12 nt, Human
aauaguguggaa

SEQ ID NO: 3418051 - RNA, 19 nt, Human
aauaguguggaaauuaaga

SEQ ID NO: 3418052 - RNA, 20 nt, Human
aauaguguggaaauuaagaa

SEQ ID NO: 3418053 - RNA, 14 nt, Human
aauaguguguucug

SEQ ID NO: 3418054 - RNA, 23 nt, Human
aauaguguguucugauuagaaau

SEQ ID NO: 3418055 - RNA, 17 nt, Human
aauaguguuaaucaauu

SEQ ID NO: 3418056 - RNA, 22 nt, Human
aauaguguuaaucaauuuaaac

SEQ ID NO: 3418057 - RNA, 20 nt, Human
aauaguuacuccagugccaa

SEQ ID NO: 3418058 - RNA, 22 nt, Human
aauaguucaaagccaaguuuau

SEQ ID NO: 3418059 - RNA, 15 nt, Human
aauaguugaauuagu

SEQ ID NO: 3418060 - RNA, 19 nt, Human
aauaguugagccagcagac

SEQ ID NO: 3418061 - RNA, 21 nt, Human
aauaguugagccagcagacau

SEQ ID NO: 3418062 - RNA, 22 nt, Human
aauaguugagccagcagacauu

SEQ ID NO: 3418063 - RNA, 23 nt, Human
aauaguugagccagcagacauug

SEQ ID NO: 3418064 - RNA, 13 nt, Human
aauaguuggcuag

SEQ ID NO: 3418065 - RNA, 14 nt, Human
aauaguuguugauu

SEQ ID NO: 3418066 - RNA, 20 nt, Human
aauaguuuauuuuaaaacaa

SEQ ID NO: 3418067 - RNA, 20 nt, Human
aauauaaaaaaucaugccag

SEQ ID NO: 3418068 - RNA, 13 nt, Human
aauauaaaaauaa

SEQ ID NO: 3418069 - RNA, 14 nt, Human
aauauaaaauauga

SEQ ID NO: 3418070 - RNA, 21 nt, Human
aauauaaacaaagauucauga

SEQ ID NO: 3418071 - RNA, 22 nt, Human
aauauaaacaaagauucaugau

SEQ ID NO: 3418072 - RNA, 11 nt, Human
aauauaaagac

SEQ ID NO: 3418073 - RNA, 18 nt, Human
aauauaaagacguuuuau

SEQ ID NO: 3418074 - RNA, 20 nt, Human
aauauaaaguuuuauauauu

SEQ ID NO: 3418075 - RNA, 11 nt, Human
aauauaaaugc

SEQ ID NO: 3418076 - RNA, 13 nt, Human
aauauaaaugcaa

SEQ ID NO: 3418077 - RNA, 14 nt, Human
aauauaaaugcaaa

SEQ ID NO: 3418078 - RNA, 13 nt, Human
aauauaaaugugu

SEQ ID NO: 3418079 - RNA, 16 nt, Human
aauauaaaugugugua

SEQ ID NO: 3418080 - RNA, 20 nt, Human
aauauaaauguguguaugug

SEQ ID NO: 3418081 - RNA, 17 nt, Human
aauauaaauucacuuuc

SEQ ID NO: 3418082 - RNA, 15 nt, Human
aauauaacacauuuu

SEQ ID NO: 3418083 - RNA, 19 nt, Human
aauauaacaugaaaugaua

SEQ ID NO: 3418084 - RNA, 16 nt, Human
aauauaaccaauguuu

SEQ ID NO: 3418085 - RNA, 17 nt, Human
aauauaaccaauguuua

SEQ ID NO: 3418086 - RNA, 18 nt, Human
aauauaaccaauguuuaa

SEQ ID NO: 3418087 - RNA, 13 nt, Human
aauauaacugccu

SEQ ID NO: 3418088 - RNA, 22 nt, Human
aauauaagaauaaaauguugaa

SEQ ID NO: 3418089 - RNA, 23 nt, Human
aauauaaggaaagcaauaaauga

SEQ ID NO: 3418090 - RNA, 14 nt, Human
aauauaauaaauau

SEQ ID NO: 3418091 - RNA, 14 nt, Human
aauauaauacugua

SEQ ID NO: 3418092 - RNA, 19 nt, Human
aauauaauggaagagaaau

SEQ ID NO: 3418093 - RNA, 15 nt, Human
aauauaauucuguaa

SEQ ID NO: 3418094 - RNA, 18 nt, Human
aauauaauuuuuuagaga

SEQ ID NO: 3418095 - RNA, 20 nt, Human
aauauacucauuagaauuac

SEQ ID NO: 3418096 - RNA, 14 nt, Human
aauauacuguaaag

SEQ ID NO: 3418097 - RNA, 16 nt, Human
aauauacuguaaagaa

SEQ ID NO: 3418098 - RNA, 22 nt, Human
aauauacuguaaagaaagagag

SEQ ID NO: 3418099 - RNA, 13 nt, Human
aauauagaaaaaa

SEQ ID NO: 3418100 - RNA, 19 nt, Human
aauauagauuaaaucauac

SEQ ID NO: 3418101 - RNA, 15 nt, Human
aauauagcugagacu

SEQ ID NO: 3418102 - RNA, 19 nt, Human
aauauagcuguacaaauau

SEQ ID NO: 3418103 - RNA, 20 nt, Human
aauauagcuguacaaauaua

SEQ ID NO: 3418104 - RNA, 21 nt, Human
aauauagcuguacaaauauaa

SEQ ID NO: 3418105 - RNA, 21 nt, Human
aauauaggaacuuaaauaaug

SEQ ID NO: 3418106 - RNA, 18 nt, Human
aauauaguuccuaagaag

SEQ ID NO: 3418107 - RNA, 21 nt, Human
aauauaguuccuaagaagcuu

SEQ ID NO: 3418108 - RNA, 12 nt, Human
aauauauaaaaa

SEQ ID NO: 3418109 - RNA, 18 nt, Human
aauauauacgaacaaaac

SEQ ID NO: 3418110 - RNA, 13 nt, Human
aauauauagcauu

SEQ ID NO: 3418111 - RNA, 14 nt, Human
aauauauagcauuu

SEQ ID NO: 3418112 - RNA, 13 nt, Human
aauauauauaaac

SEQ ID NO: 3418113 - RNA, 19 nt, Human
aauauauauaaagaauaua

SEQ ID NO: 3418114 - RNA, 22 nt, Human
aauauauauaaagaauauauau

SEQ ID NO: 3418115 - RNA, 13 nt, Human
aauauauauaaau

SEQ ID NO: 3418116 - RNA, 16 nt, Human
aauauauauaaauaaa

SEQ ID NO: 3418117 - RNA, 15 nt, Human
aauauauauacauau

SEQ ID NO: 3418118 - RNA, 16 nt, Human
aauauauauacauaug

SEQ ID NO: 3418119 - RNA, 19 nt, Human
aauauauauacauauguag

SEQ ID NO: 3418120 - RNA, 22 nt, Human
aauauauauagugcuauauaua

SEQ ID NO: 3418121 - RNA, 18 nt, Human
aauauauauauauauaaa

SEQ ID NO: 3418122 - RNA, 21 nt, Human
aauauauauauauauaaaaua

SEQ ID NO: 3418123 - RNA, 19 nt, Human
aauauauauauauaucagu

SEQ ID NO: 3418124 - RNA, 17 nt, Human
aauauauaucugcuguc

SEQ ID NO: 3418125 - RNA, 13 nt, Human
aauauauaugaau

SEQ ID NO: 3418126 - RNA, 23 nt, Human
aauauauauuauacuuguaauua

SEQ ID NO: 3418127 - RNA, 13 nt, Human
aauauauauuauc

SEQ ID NO: 3418128 - RNA, 17 nt, Human
aauauaucuaaauugaa

SEQ ID NO: 3418129 - RNA, 20 nt, Human
aauauaucuaccccagacua

SEQ ID NO: 3418130 - RNA, 22 nt, Human
aauauauggcagaguuguaaau

SEQ ID NO: 3418131 - RNA, 23 nt, Human
aauauauggcagaguuguaaaua

SEQ ID NO: 3418132 - RNA, 18 nt, Human
aauauauggcauuugcag

SEQ ID NO: 3418133 - RNA, 12 nt, Human
aauauauguaug

SEQ ID NO: 3418134 - RNA, 13 nt, Human
aauauauguaugu

SEQ ID NO: 3418135 - RNA, 14 nt, Human
aauauauguauuuu

SEQ ID NO: 3418136 - RNA, 14 nt, Human
aauauaugugaaag

SEQ ID NO: 3418137 - RNA, 17 nt, Human
aauauaugugugccuau

SEQ ID NO: 3418138 - RNA, 12 nt, Human
aauauauguuua

SEQ ID NO: 3418139 - RNA, 13 nt, Human
aauauauguuuac

SEQ ID NO: 3418140 - RNA, 23 nt, Human
aauauauguuuuaaauauagaau

SEQ ID NO: 3418141 - RNA, 22 nt, Human
aauauauuaccagcaagaauaa

SEQ ID NO: 3418142 - RNA, 21 nt, Human
aauauauuaguaagauacugu

SEQ ID NO: 3418143 - RNA, 18 nt, Human
aauauauugaacuuuugu

SEQ ID NO: 3418144 - RNA, 15 nt, Human
aauauauuuaagaua

SEQ ID NO: 3418145 - RNA, 14 nt, Human
aauauauuuaauga

SEQ ID NO: 3418146 - RNA, 19 nt, Human
aauauauuuauuuaaagca

SEQ ID NO: 3418147 - RNA, 21 nt, Human
aauauauuucuaaauguuugg

SEQ ID NO: 3418148 - RNA, 20 nt, Human
aauauauuuuguaugcaagc

SEQ ID NO: 3418149 - RNA, 14 nt, Human
aauauauuuuuaga

SEQ ID NO: 3418150 - RNA, 18 nt, Human
aauauauuuuuagacuca

SEQ ID NO: 3418151 - RNA, 15 nt, Human
aauauauuuuuauau

SEQ ID NO: 3418152 - RNA, 19 nt, Human
aauauauuuuuauauuuag

SEQ ID NO: 3418153 - RNA, 21 nt, Human
aauaucaaagucauuaaagac

SEQ ID NO: 3418154 - RNA, 17 nt, Human
aauaucaaauuaauugu

SEQ ID NO: 3418155 - RNA, 14 nt, Human
aauaucaaucaagc

SEQ ID NO: 3418156 - RNA, 13 nt, Human
aauaucaaucauu

SEQ ID NO: 3418157 - RNA, 16 nt, Human
aauaucaaucauuuuc

SEQ ID NO: 3418158 - RNA, 18 nt, Human
aauaucaccaaaaaccua

SEQ ID NO: 3418159 - RNA, 15 nt, Human
aauaucacucauuaa

SEQ ID NO: 3418160 - RNA, 16 nt, Human
aauaucacucauuaau

SEQ ID NO: 3418161 - RNA, 15 nt, Human
aauaucacuugucaa

SEQ ID NO: 3418162 - RNA, 15 nt, Human
aauaucagacuagug

SEQ ID NO: 3418163 - RNA, 19 nt, Human
aauaucaguuacucagccc

SEQ ID NO: 3418164 - RNA, 16 nt, Human
aagugaggccacugaa

SEQ ID NO: 3418165 - RNA, 17 nt, Human
aagugagggcucacuca

SEQ ID NO: 3418166 - RNA, 18 nt, Human
aagugagggucagagagg

SEQ ID NO: 3418167 - RNA, 14 nt, Human
aagugaucaauaaa

SEQ ID NO: 3418168 - RNA, 23 nt, Human
aagugaucaauaaaaugugauuu

SEQ ID NO: 3418169 - RNA, 20 nt, Human
aagugauccucccaccucag

SEQ ID NO: 3418170 - RNA, 19 nt, Human
aagugauggagcagagcaa

SEQ ID NO: 3418171 - RNA, 16 nt, Human
aagugauucucaugcc

SEQ ID NO: 3418172 - RNA, 21 nt, Human
aagugauucuccugccucagc

SEQ ID NO: 3418173 - RNA, 15 nt, Human
aagugauuguuggca

SEQ ID NO: 3418174 - RNA, 21 nt, Human
aagugcacacagaaauauaua

SEQ ID NO: 3418175 - RNA, 15 nt, Human
aagugcacuuucuaa

SEQ ID NO: 3418176 - RNA, 19 nt, Human
aagugcagaacugcaguca

SEQ ID NO: 3418177 - RNA, 21 nt, Human
aagugcaggcuggcaccgccu

SEQ ID NO: 3418178 - RNA, 18 nt, Human
aagugcauaugaaauccu

SEQ ID NO: 3418179 - RNA, 15 nt, Human
aagugcauccaaagg

SEQ ID NO: 3418180 - RNA, 19 nt, Human
aagugcauccaaaggugcu

SEQ ID NO: 3418181 - RNA, 15 nt, Human
aagccugggggccug

SEQ ID NO: 3418182 - RNA, 17 nt, Human
aagccugggggccuggc

SEQ ID NO: 3418183 - RNA, 18 nt, Human
aagccugggggccuggcu

SEQ ID NO: 3418184 - RNA, 19 nt, Human
aagccugggggccuggcug

SEQ ID NO: 3418185 - RNA, 17 nt, Human
aagccuggucagcccaa

SEQ ID NO: 3418186 - RNA, 18 nt, Human
aagccuggucagcccaaa

SEQ ID NO: 3418187 - RNA, 17 nt, Human
aagccuguaacacuccu

SEQ ID NO: 3418188 - RNA, 18 nt, Human
aagccugugcaaaaaaau

SEQ ID NO: 3418189 - RNA, 14 nt, Human
aagccuguggauga

SEQ ID NO: 3418190 - RNA, 15 nt, Human
aagccuguggaugau

SEQ ID NO: 3418191 - RNA, 12 nt, Human
aagccuguggcu

SEQ ID NO: 3418192 - RNA, 16 nt, Human
aagccuguuccccuca

SEQ ID NO: 3418193 - RNA, 21 nt, Human
aagccuucaagcucugaggga

SEQ ID NO: 3418194 - RNA, 21 nt, Human
aagccuuccccuuauccuccc

SEQ ID NO: 3418195 - RNA, 11 nt, Human
aagccuugugu

SEQ ID NO: 3418196 - RNA, 21 nt, Human
aagccuuuaguaucaguguuu

SEQ ID NO: 3418197 - RNA, 15 nt, Human
aagccuuucauuuug

SEQ ID NO: 3418198 - RNA, 17 nt, Human
aagccuuucauuuugcu

SEQ ID NO: 3418199 - RNA, 21 nt, Human
aagccuuucauuuugcuuuaa

SEQ ID NO: 3418200 - RNA, 14 nt, Human
aagccuuuccauaa

SEQ ID NO: 3418201 - RNA, 15 nt, Human
aagccuuuccauaag

SEQ ID NO: 3418202 - RNA, 10 nt, Human
aagccuuugu

SEQ ID NO: 3418203 - RNA, 14 nt, Human
aagccuuuguugaa

SEQ ID NO: 3418204 - RNA, 23 nt, Human
aagcgaggcaugccugagagaca

SEQ ID NO: 3418205 - RNA, 18 nt, Human
aagcgaggucaacagaga

SEQ ID NO: 3418206 - RNA, 18 nt, Human
aagcgaucacuuccuaua

SEQ ID NO: 3418207 - RNA, 20 nt, Human
aagcgaugaauuuggagacu

SEQ ID NO: 3418208 - RNA, 20 nt, Human
aagcgauucuccugccucag

SEQ ID NO: 3418209 - RNA, 19 nt, Human
aagcgauucucuugccuca

SEQ ID NO: 3418210 - RNA, 21 nt, Human
aagcgauucuucugcuucagc

SEQ ID NO: 3418211 - RNA, 20 nt, Human
aauaagagagucauaaaccu

SEQ ID NO: 3418212 - RNA, 18 nt, Human
aauaagcagguggaucua

SEQ ID NO: 3418213 - RNA, 20 nt, Human
aauaagcuaguugaauacuu

SEQ ID NO: 3418214 - RNA, 23 nt, Human
aauaagcuaguugaauacuugaa

SEQ ID NO: 3418215 - RNA, 16 nt, Human
aauaagcuauuugaug

SEQ ID NO: 3418216 - RNA, 15 nt, Human
aauaaggaaaagcuu

SEQ ID NO: 3418217 - RNA, 15 nt, Human
aauaaggaaaaguuu

SEQ ID NO: 3418218 - RNA, 16 nt, Human
aauaaggaaaaguuua

SEQ ID NO: 3418219 - RNA, 12 nt, Human
aauaaggcaggg

SEQ ID NO: 3418220 - RNA, 15 nt, Human
aauaagguacaagaa

SEQ ID NO: 3418221 - RNA, 14 nt, Human
aauaagguugaaca

SEQ ID NO: 3418222 - RNA, 16 nt, Human
aauaagugcccucucc

SEQ ID NO: 3418223 - RNA, 14 nt, Human
aauaaguguauuuu

SEQ ID NO: 3418224 - RNA, 13 nt, Human
aauaaguuauugc

SEQ ID NO: 3418225 - RNA, 14 nt, Human
aauaaguuauugca

SEQ ID NO: 3418226 - RNA, 18 nt, Human
aauaaguuauugcaguuu

SEQ ID NO: 3418227 - RNA, 17 nt, Human
aauaauaaaaaauuuca

SEQ ID NO: 3418228 - RNA, 13 nt, Human
aauaauaaacuuu

SEQ ID NO: 3418229 - RNA, 21 nt, Human
aauaauaaagaucauguaaaa

SEQ ID NO: 3418230 - RNA, 18 nt, Human
aauaauaaagaugcucuu

SEQ ID NO: 3418231 - RNA, 15 nt, Human
aauaauaaauauuua

SEQ ID NO: 3418232 - RNA, 13 nt, Human
aauaauaaauugc

SEQ ID NO: 3418233 - RNA, 12 nt, Human
aauaauaauauc

SEQ ID NO: 3418234 - RNA, 15 nt, Human
aauaauaauauccag

SEQ ID NO: 3418235 - RNA, 11 nt, Human
aauaauaauua

SEQ ID NO: 3418236 - RNA, 21 nt, Human
aauaauaauuauccagaguuu

SEQ ID NO: 3418237 - RNA, 14 nt, Human
aauaauacacuaau

SEQ ID NO: 3418238 - RNA, 17 nt, Human
aauaauacauuauauuu

SEQ ID NO: 3418239 - RNA, 16 nt, Human
aauaauacugcugaga

SEQ ID NO: 3418240 - RNA, 13 nt, Human
aauaauagacugu

SEQ ID NO: 3418241 - RNA, 13 nt, Human
aauaauauacuug

SEQ ID NO: 3418242 - RNA, 16 nt, Human
aauaauauacuugugg

SEQ ID NO: 3418243 - RNA, 13 nt, Human
aauaauauauguu

SEQ ID NO: 3418244 - RNA, 19 nt, Human
aauaauauggcuaugcuua

SEQ ID NO: 3418245 - RNA, 17 nt, Human
aauaauauuguuuuucu

SEQ ID NO: 3418246 - RNA, 21 nt, Human
aauaauauuguuuuucuuucu

SEQ ID NO: 3418247 - RNA, 13 nt, Human
aauaaucaagagc

SEQ ID NO: 3418248 - RNA, 15 nt, Human
aauaauccaugaaag

SEQ ID NO: 3418249 - RNA, 19 nt, Human
aauaauccugcaaaguaca

SEQ ID NO: 3418250 - RNA, 16 nt, Human
aauaaucuauuucuau

SEQ ID NO: 3418251 - RNA, 15 nt, Human
aauaaugagaaaugu

SEQ ID NO: 3418252 - RNA, 23 nt, Human
aauaaugcaguaugguacauuuu

SEQ ID NO: 3418253 - RNA, 18 nt, Human
aauaaugccuuuguaacc

SEQ ID NO: 3418254 - RNA, 11 nt, Human
aauaaugcugc

SEQ ID NO: 3418255 - RNA, 14 nt, Human
aauaaugcuucaga

SEQ ID NO: 3418256 - RNA, 23 nt, Human
aauaauggaaaaaaaaaaaagag

SEQ ID NO: 3418257 - RNA, 20 nt, Human
aauaaugggcuuagagcagu

SEQ ID NO: 3418258 - RNA, 17 nt, Human
aauaaugguaccagaua

SEQ ID NO: 3418259 - RNA, 20 nt, Human
aauaaugguaccagauaaaa

SEQ ID NO: 3418260 - RNA, 21 nt, Human
aauaaugguaccagauaaaau

SEQ ID NO: 3418261 - RNA, 19 nt, Human
aauaauguaagacaaauau

SEQ ID NO: 3418262 - RNA, 15 nt, Human
aauaaugucuuguua

SEQ ID NO: 3418263 - RNA, 18 nt, Human
aauaaugucuuguuaaua

SEQ ID NO: 3418264 - RNA, 16 nt, Human
aauaaugugaaacugg

SEQ ID NO: 3418265 - RNA, 22 nt, Human
aauaaugugaaacuggauuaaa

SEQ ID NO: 3418266 - RNA, 15 nt, Human
aauaaugugaaucau

SEQ ID NO: 3418267 - RNA, 19 nt, Human
aauaauguuaacauggaca

SEQ ID NO: 3418268 - RNA, 22 nt, Human
aauaauuacagugccuaaaaua

SEQ ID NO: 3418269 - RNA, 20 nt, Human
aauaauuagguuaacauugu

SEQ ID NO: 3418270 - RNA, 22 nt, Human
aauaauuagguuaacauuguug

SEQ ID NO: 3418271 - RNA, 15 nt, Human
aauaauuauaugcua

SEQ ID NO: 3418272 - RNA, 16 nt, Human
aauaauuauuuauuac

SEQ ID NO: 3418273 - RNA, 22 nt, Human
aauaauucugaguuuuguguuu

SEQ ID NO: 3418274 - RNA, 14 nt, Human
aauaauucuuugau

SEQ ID NO: 3418275 - RNA, 15 nt, Human
aauaauucuuuuuua

SEQ ID NO: 3418276 - RNA, 20 nt, Human
aauaauucuuuuuuauuaau

SEQ ID NO: 3418277 - RNA, 21 nt, Human
aauaauucuuuuuuauuaauc

SEQ ID NO: 3418278 - RNA, 20 nt, Human
aauaauugauuucaagaccu

SEQ ID NO: 3418279 - RNA, 14 nt, Human
aauaauuguuguuc

SEQ ID NO: 3418280 - RNA, 16 nt, Human
aauaauuguuguucug

SEQ ID NO: 3418281 - RNA, 17 nt, Human
aauaauuguuguucugu

SEQ ID NO: 3418282 - RNA, 18 nt, Human
aauaauuguuguucuguu

SEQ ID NO: 3418283 - RNA, 13 nt, Human
aauaauuuaacua

SEQ ID NO: 3418284 - RNA, 12 nt, Human
aauaauuuagac

SEQ ID NO: 3418285 - RNA, 12 nt, Human
aauaauuuuaaa

SEQ ID NO: 3418286 - RNA, 14 nt, Human
aauaauuuuaaaaa

SEQ ID NO: 3418287 - RNA, 16 nt, Human
aauaauuuuaaacaaa

SEQ ID NO: 3418288 - RNA, 11 nt, Human
aauaauuuuau

SEQ ID NO: 3418289 - RNA, 14 nt, Human
aauaauuuuaucuc

SEQ ID NO: 3418290 - RNA, 16 nt, Human
aauaauuuuuauauuu

SEQ ID NO: 3418291 - RNA, 17 nt, Human
aauaauuuuuauauuug

SEQ ID NO: 3418292 - RNA, 14 nt, Human
aauacaaaaauuug

SEQ ID NO: 3418293 - RNA, 13 nt, Human
aauacaaauggau

SEQ ID NO: 3418294 - RNA, 22 nt, Human
aauacaacauguagcugaguuu

SEQ ID NO: 3418295 - RNA, 13 nt, Human
aauacaauaaacu

SEQ ID NO: 3418296 - RNA, 13 nt, Human
aauacaauuuugu

SEQ ID NO: 3418297 - RNA, 17 nt, Human
aauacaauuuuguuucu

SEQ ID NO: 3418298 - RNA, 14 nt, Human
aauacacauuugcu

SEQ ID NO: 3418299 - RNA, 22 nt, Human
aauacaccaccucacuccuguu

SEQ ID NO: 3418300 - RNA, 15 nt, Human
aauacaccacuacau

SEQ ID NO: 3418301 - RNA, 21 nt, Human
aauacaccagguagaacacaa

SEQ ID NO: 3418302 - RNA, 16 nt, Human
aauacacgagguauga

SEQ ID NO: 3418303 - RNA, 14 nt, Human
aauacacuugcccu

SEQ ID NO: 3418304 - RNA, 22 nt, Human
aauacacuugugauuauaaaau

SEQ ID NO: 3418305 - RNA, 15 nt, Human
aauacagaaucuugu

SEQ ID NO: 3418306 - RNA, 20 nt, Human
aauacagacacuaaguuaua

SEQ ID NO: 3418307 - RNA, 21 nt, Human
aauacagacacuaaguuauag

SEQ ID NO: 3418308 - RNA, 12 nt, Human
aauacagauaac

SEQ ID NO: 3418309 - RNA, 17 nt, Human
aauacagauaacauuag

SEQ ID NO: 3418310 - RNA, 12 nt, Human
aauacagauaua

SEQ ID NO: 3418311 - RNA, 14 nt, Human
aauacagauauauu

SEQ ID NO: 3418312 - RNA, 15 nt, Human
aauacagauauauuu

SEQ ID NO: 3418313 - RNA, 16 nt, Human
aauacagaucaucuug

SEQ ID NO: 3418314 - RNA, 19 nt, Human
aauacagccaaagauaauc

SEQ ID NO: 3418315 - RNA, 16 nt, Human
aauacagcuuucugac

SEQ ID NO: 3418316 - RNA, 19 nt, Human
aauacagcuuucugaccuu

SEQ ID NO: 3418317 - RNA, 16 nt, Human
aauacaggaaacaguu

SEQ ID NO: 3418318 - RNA, 18 nt, Human
aauacaggaaacaguugc

SEQ ID NO: 3418319 - RNA, 23 nt, Human
aauacaggaaacaguugcaugua

SEQ ID NO: 3418320 - RNA, 16 nt, Human
aauacagggcaugcau

SEQ ID NO: 3418321 - RNA, 17 nt, Human
aauacaguacaggcagc

SEQ ID NO: 3418322 - RNA, 21 nt, Human
aauacaguacaggcagcacag

SEQ ID NO: 3418323 - RNA, 21 nt, Human
aauacagucuuccacaaagaa

SEQ ID NO: 3418324 - RNA, 16 nt, Human
aauacaguucugcucu

SEQ ID NO: 3418325 - RNA, 17 nt, Human
aauacaguucugcucug

SEQ ID NO: 3418326 - RNA, 22 nt, Human
aauacauaccacgcuagggcug

SEQ ID NO: 3418327 - RNA, 22 nt, Human
aauaguguggaaauuaagaaga

SEQ ID NO: 3418328 - RNA, 21 nt, Human
aauaguguguucugauuagaa

SEQ ID NO: 3418329 - RNA, 18 nt, Human
aauaguguuaaucaauuu

SEQ ID NO: 3418330 - RNA, 22 nt, Human
aauaguguuauugagagagaug

SEQ ID NO: 3418331 - RNA, 23 nt, Human
aauaguguuauugagagagaugu

SEQ ID NO: 3418332 - RNA, 22 nt, Human
aauaguuaagacaugauuuccu

SEQ ID NO: 3418333 - RNA, 18 nt, Human
aauaguuacuccagugcc

SEQ ID NO: 3418334 - RNA, 20 nt, Human
aauaguugagccagcagaca

SEQ ID NO: 3418335 - RNA, 18 nt, Human
aauaguuguccauauuuu

SEQ ID NO: 3418336 - RNA, 19 nt, Human
aauaguuuauuuuaaaaca

SEQ ID NO: 3418337 - RNA, 14 nt, Human
aauaguuuggauau

SEQ ID NO: 3418338 - RNA, 15 nt, Human
aauaguuuguuuaau

SEQ ID NO: 3418339 - RNA, 11 nt, Human
aauauaaaaaa

SEQ ID NO: 3418340 - RNA, 22 nt, Human
aauauaaaacaaauaaaaaaua

SEQ ID NO: 3418341 - RNA, 11 nt, Human
aauauaaaacu

SEQ ID NO: 3418342 - RNA, 17 nt, Human
aauauaaaacuguacuu

SEQ ID NO: 3418343 - RNA, 23 nt, Human
aauauaaaaggcaaauguguaca

SEQ ID NO: 3418344 - RNA, 13 nt, Human
aauauaaaauagu

SEQ ID NO: 3418345 - RNA, 23 nt, Human
aauauaaacaaagauucaugauu

SEQ ID NO: 3418346 - RNA, 13 nt, Human
aauauaaacacua

SEQ ID NO: 3418347 - RNA, 21 nt, Human
aauauaaagauggcugacuuu

SEQ ID NO: 3418348 - RNA, 16 nt, Human
aauauaaagcaucuaa

SEQ ID NO: 3418349 - RNA, 17 nt, Human
aauauaaagcaucuaaa

SEQ ID NO: 3418350 - RNA, 21 nt, Human
aauauaaaguuuuauauauua

SEQ ID NO: 3418351 - RNA, 16 nt, Human
aauauaaaugcaaaua

SEQ ID NO: 3418352 - RNA, 19 nt, Human
aauauaaaugcaaauaaca

SEQ ID NO: 3418353 - RNA, 22 nt, Human
aauauaaaugcaaauaacaaau

SEQ ID NO: 3418354 - RNA, 12 nt, Human
aauauaaaugug

SEQ ID NO: 3418355 - RNA, 14 nt, Human
aauauaacacauuu

SEQ ID NO: 3418356 - RNA, 22 nt, Human
aauauaacugccuuaaaacuuu

SEQ ID NO: 3418357 - RNA, 21 nt, Human
aauauaacuuaaaaauguaaa

SEQ ID NO: 3418358 - RNA, 16 nt, Human
aauauaaguaaaguga

SEQ ID NO: 3418359 - RNA, 23 nt, Human
aauauaauggaagagaaaucuca

SEQ ID NO: 3418360 - RNA, 16 nt, Human
aauauaauucuguaaa

SEQ ID NO: 3418361 - RNA, 12 nt, Human
aauauaauuguu

SEQ ID NO: 3418362 - RNA, 14 nt, Human
aauauacaaaacuu

SEQ ID NO: 3418363 - RNA, 13 nt, Human
aauauacacacag

SEQ ID NO: 3418364 - RNA, 20 nt, Human
aauauacauguuuauguaaa

SEQ ID NO: 3418365 - RNA, 19 nt, Human
aauauacauucaaacuuaa

SEQ ID NO: 3418366 - RNA, 17 nt, Human
aauauacuauauuuaug

SEQ ID NO: 3418367 - RNA, 11 nt, Human
aauauacugua

SEQ ID NO: 3418368 - RNA, 23 nt, Human
aauauacuguaaagaaagagaga

SEQ ID NO: 3418369 - RNA, 13 nt, Human
aauauacuugugg

SEQ ID NO: 3418370 - RNA, 15 nt, Human
aauauacuuguggac

SEQ ID NO: 3418371 - RNA, 16 nt, Human
aauauacuuguggacu

SEQ ID NO: 3418372 - RNA, 22 nt, Human
aagcgcauccaaucucaaggaa

SEQ ID NO: 3418373 - RNA, 19 nt, Human
aagcgcccuggcccccaca

SEQ ID NO: 3418374 - RNA, 15 nt, Human
aagcgccuccaaccc

SEQ ID NO: 3418375 - RNA, 23 nt, Human
aagcggaaaagguuuuauuuugu

SEQ ID NO: 3418376 - RNA, 22 nt, Human
aagcggcucaagcccaggaggg

SEQ ID NO: 3418377 - RNA, 14 nt, Human
aagcgggaaacaug

SEQ ID NO: 3418378 - RNA, 21 nt, Human
aagcggugucucuccugcccc

SEQ ID NO: 3418379 - RNA, 13 nt, Human
aagcguauggcuu

SEQ ID NO: 3418380 - RNA, 17 nt, Human
aagcgugagacgccacc

SEQ ID NO: 3418381 - RNA, 16 nt, Human
aagcgugagccacugc

SEQ ID NO: 3418382 - RNA, 16 nt, Human
aagcuaaaaccugagc

SEQ ID NO: 3418383 - RNA, 23 nt, Human
aagcuaaaaccugagcuagaagc

SEQ ID NO: 3418384 - RNA, 11 nt, Human
aagcuaaagag

SEQ ID NO: 3418385 - RNA, 17 nt, Human
aagcuaagaugggugga

SEQ ID NO: 3418386 - RNA, 17 nt, Human
aagcuaagguuuagaua

SEQ ID NO: 3418387 - RNA, 17 nt, Human
aagcuaauaaaauauca

SEQ ID NO: 3418388 - RNA, 18 nt, Human
aagcuaauaaaauaucau

SEQ ID NO: 3418389 - RNA, 17 nt, Human
aagcuaauuauuuuaau

SEQ ID NO: 3418390 - RNA, 14 nt, Human
aagcuaauuugcau

SEQ ID NO: 3418391 - RNA, 15 nt, Human
aagcuaauuugcauu

SEQ ID NO: 3418392 - RNA, 18 nt, Human
aagcuacagguuacaaca

SEQ ID NO: 3418393 - RNA, 19 nt, Human
aagcuaccucaaacuucca

SEQ ID NO: 3418394 - RNA, 18 nt, Human
aagcuacuuuguuuuuaa

SEQ ID NO: 3418395 - RNA, 17 nt, Human
aagcuagacacaugaag

SEQ ID NO: 3418396 - RNA, 18 nt, Human
aagcuagacacaugaagg

SEQ ID NO: 3418397 - RNA, 20 nt, Human
aagcuagacacaugaaggua

SEQ ID NO: 3418398 - RNA, 21 nt, Human
aagcuagacacaugaagguaa

SEQ ID NO: 3418399 - RNA, 22 nt, Human
aagcuagacacaugaagguaaa

SEQ ID NO: 3418400 - RNA, 18 nt, Human
aagcuaggccuggccaga

SEQ ID NO: 3418401 - RNA, 22 nt, Human
aagcuaggguggcccuugcagu

SEQ ID NO: 3418402 - RNA, 17 nt, Human
aagcuagucaacaguac

SEQ ID NO: 3418403 - RNA, 19 nt, Human
aagcuaguggcuucaaaau

SEQ ID NO: 3418404 - RNA, 20 nt, Human
aagcuaguguaccuccucuc

SEQ ID NO: 3418405 - RNA, 18 nt, Human
aagcuauaaauuccucuu

SEQ ID NO: 3418406 - RNA, 20 nt, Human
aagcuauagacccgaggaaa

SEQ ID NO: 3418407 - RNA, 17 nt, Human
aagcuauccuggcucuu

SEQ ID NO: 3418408 - RNA, 14 nt, Human
aagcuaucuaaagu

SEQ ID NO: 3418409 - RNA, 22 nt, Human
aagcuaucuucauguaaauuga

SEQ ID NO: 3418410 - RNA, 23 nt, Human
aagcuauggugagaugcagcugg

SEQ ID NO: 3418411 - RNA, 16 nt, Human
aagcuauuagccagga

SEQ ID NO: 3418412 - RNA, 20 nt, Human
aagcuauuccuuucccuucc

SEQ ID NO: 3418413 - RNA, 23 nt, Human
aagcuauuccuuucccuuccucu

SEQ ID NO: 3418414 - RNA, 17 nt, Human
aagcuauuuaugggccc

SEQ ID NO: 3418415 - RNA, 20 nt, Human
aagcucaaagguuuggaagg

SEQ ID NO: 3418416 - RNA, 17 nt, Human
aagcucaaaugaaaugu

SEQ ID NO: 3418417 - RNA, 19 nt, Human
aagcucaaaugaaauguau

SEQ ID NO: 3418418 - RNA, 16 nt, Human
aagcucacaccaaauu

SEQ ID NO: 3418419 - RNA, 22 nt, Human
aagcucacaguuccucgcccug

SEQ ID NO: 3418420 - RNA, 15 nt, Human
aagcucacguccuga

SEQ ID NO: 3418421 - RNA, 16 nt, Human
aagcucacuugcuuua

SEQ ID NO: 3418422 - RNA, 17 nt, Human
aagcucagacugguuga

SEQ ID NO: 3418423 - RNA, 23 nt, Human
aagcucagaggcgcacugugacc

SEQ ID NO: 3418424 - RNA, 16 nt, Human
aagcucagcccacccc

SEQ ID NO: 3418425 - RNA, 17 nt, Human
aagcucagcuacugauu

SEQ ID NO: 3418426 - RNA, 16 nt, Human
aagcucagggccuggc

SEQ ID NO: 3418427 - RNA, 21 nt, Human
aagcucauauuuuguauauau

SEQ ID NO: 3418428 - RNA, 23 nt, Human
aagcucauauuuuguauauaucu

SEQ ID NO: 3418429 - RNA, 15 nt, Human
aagcucauuucaugc

SEQ ID NO: 3418430 - RNA, 18 nt, Human
aagcucauuucaugcucu

SEQ ID NO: 3418431 - RNA, 13 nt, Human
aagcuccaagccc

SEQ ID NO: 3418432 - RNA, 17 nt, Human
aagcuccaagcucccag

SEQ ID NO: 3418433 - RNA, 19 nt, Human
aagcuccacugucacccuc

SEQ ID NO: 3418434 - RNA, 19 nt, Human
aagcuccaguccugcucuc

SEQ ID NO: 3418435 - RNA, 15 nt, Human
aagcuccaucaauga

SEQ ID NO: 3418436 - RNA, 20 nt, Human
aagcuccaucuccacuccag

SEQ ID NO: 3418437 - RNA, 16 nt, Human
aagcuccaugugccuc

SEQ ID NO: 3418438 - RNA, 13 nt, Human
aagcucccaggaa

SEQ ID NO: 3418439 - RNA, 16 nt, Human
aagcuccucuccccag

SEQ ID NO: 3418440 - RNA, 20 nt, Human
aagcuccucuccccagccca

SEQ ID NO: 3418441 - RNA, 22 nt, Human
aagcuccucuccccagcccaga

SEQ ID NO: 3418442 - RNA, 14 nt, Human
aagcuccuguccuc

SEQ ID NO: 3418443 - RNA, 15 nt, Human
aagcuccuguccucc

SEQ ID NO: 3418444 - RNA, 18 nt, Human
aagcucgaaaacaauugu

SEQ ID NO: 3418445 - RNA, 20 nt, Human
aagcucuaguucuuaacaac

SEQ ID NO: 3418446 - RNA, 15 nt, Human
aagcucucugcaucu

SEQ ID NO: 3418447 - RNA, 22 nt, Human
aagcucucuugccgaggagcca

SEQ ID NO: 3418448 - RNA, 9 nt, Human
aagcucuga

SEQ ID NO: 3418449 - RNA, 16 nt, Human
aagcucugaagucaca

SEQ ID NO: 3418450 - RNA, 22 nt, Human
aagcucugaagucacaucacag

SEQ ID NO: 3418451 - RNA, 24 nt, Human
aagcucuggcugaacccugugcug

SEQ ID NO: 3418452 - RNA, 20 nt, Human
aagcucuggugacaccagcc

SEQ ID NO: 3418453 - RNA, 21 nt, Human
aagcucuggugacaccagccu

SEQ ID NO: 3418454 - RNA, 21 nt, Human
aagcucuugaagacacugaaa

SEQ ID NO: 3418455 - RNA, 11 nt, Human
aagcugaaauu

SEQ ID NO: 3418456 - RNA, 18 nt, Human
aagcugaacacauuucuu

SEQ ID NO: 3418457 - RNA, 17 nt, Human
aagcugaacacugaagu

SEQ ID NO: 3418458 - RNA, 17 nt, Human
aagcugaagugcaucca

SEQ ID NO: 3418459 - RNA, 13 nt, Human
aagcugaauacau

SEQ ID NO: 3418460 - RNA, 17 nt, Human
aagcugaccacaggcag

SEQ ID NO: 3418461 - RNA, 19 nt, Human
aagcugacgaacuuccaug

SEQ ID NO: 3418462 - RNA, 17 nt, Human
aagcugagaacuccuga

SEQ ID NO: 3418463 - RNA, 18 nt, Human
aagcugagaacuccugac

SEQ ID NO: 3418464 - RNA, 18 nt, Human
aagcugagagugcuauga

SEQ ID NO: 3418465 - RNA, 17 nt, Human
aagcugaggcgggagaa

SEQ ID NO: 3418466 - RNA, 18 nt, Human
aagcugaggugcccagga

SEQ ID NO: 3418467 - RNA, 22 nt, Human
aagcugaguuaggugucugucc

SEQ ID NO: 3418468 - RNA, 23 nt, Human
aagcugaguuaggugucuguccu

SEQ ID NO: 3418469 - RNA, 14 nt, Human
aagcugaguuuccu

SEQ ID NO: 3418470 - RNA, 21 nt, Human
aauaucuaauauauaugaaua

SEQ ID NO: 3418471 - RNA, 18 nt, Human
aauaucuaguaauauauu

SEQ ID NO: 3418472 - RNA, 14 nt, Human
aauaucuauuaaua

SEQ ID NO: 3418473 - RNA, 15 nt, Human
aauaucuauuaauau

SEQ ID NO: 3418474 - RNA, 21 nt, Human
aauaucuccgucaacucauau

SEQ ID NO: 3418475 - RNA, 20 nt, Human
aauaucugaaaauguaugug

SEQ ID NO: 3418476 - RNA, 15 nt, Human
aauaucugaacauuu

SEQ ID NO: 3418477 - RNA, 14 nt, Human
aauaucugcuguau

SEQ ID NO: 3418478 - RNA, 22 nt, Human
aauaucuguauuuaauuuugac

SEQ ID NO: 3418479 - RNA, 17 nt, Human
aauaucuucacuuguca

SEQ ID NO: 3418480 - RNA, 18 nt, Human
aauaucuucagcucuuuu

SEQ ID NO: 3418481 - RNA, 18 nt, Human
aauaucuucguuaguaau

SEQ ID NO: 3418482 - RNA, 15 nt, Human
aauaucuugcuugaa

SEQ ID NO: 3418483 - RNA, 19 nt, Human
aauaucuuuuauguuugaa

SEQ ID NO: 3418484 - RNA, 12 nt, Human
aauaugaagcuc

SEQ ID NO: 3418485 - RNA, 18 nt, Human
aauaugaauacagggcau

SEQ ID NO: 3418486 - RNA, 22 nt, Human
aauaugacagcugucccuguca

SEQ ID NO: 3418487 - RNA, 21 nt, Human
aauaugacggaagaacauaga

SEQ ID NO: 3418488 - RNA, 17 nt, Human
aauaugaugacuguuuu

SEQ ID NO: 3418489 - RNA, 20 nt, Human
aauaugauuuuuuaaaagaa

SEQ ID NO: 3418490 - RNA, 17 nt, Human
aauaugcaacauugucc

SEQ ID NO: 3418491 - RNA, 18 nt, Human
aauaugcacacagugcuu

SEQ ID NO: 3418492 - RNA, 17 nt, Human
aauaugcacacauuuuu

SEQ ID NO: 3418493 - RNA, 18 nt, Human
aauaugcacuaagucucu

SEQ ID NO: 3418494 - RNA, 20 nt, Human
aauaugcacuaagucucuuu

SEQ ID NO: 3418495 - RNA, 15 nt, Human
aauaugcaguucugc

SEQ ID NO: 3418496 - RNA, 20 nt, Human
aauaugcaucuaauaaaaaa

SEQ ID NO: 3418497 - RNA, 24 nt, Human
aauaugccccauucaacaucuagu

SEQ ID NO: 3418498 - RNA, 19 nt, Human
aauaugccucuccuuugua

SEQ ID NO: 3418499 - RNA, 23 nt, Human
aauaugccugcaaucugagccag

SEQ ID NO: 3418500 - RNA, 21 nt, Human
aauaugccugcuauuugaagu

SEQ ID NO: 3418501 - RNA, 21 nt, Human
aauaugccuguaauucagugu

SEQ ID NO: 3418502 - RNA, 17 nt, Human
aauaugccuuuuugaag

SEQ ID NO: 3418503 - RNA, 14 nt, Human
aauaugcuaauuug

SEQ ID NO: 3418504 - RNA, 21 nt, Human
aauaugcugcaacaaaaugua

SEQ ID NO: 3418505 - RNA, 22 nt, Human
aauaugcugccaaauuuuggcc

SEQ ID NO: 3418506 - RNA, 16 nt, Human
aauaugcuggcuggag

SEQ ID NO: 3418507 - RNA, 15 nt, Human
aauauggaacuuaca

SEQ ID NO: 3418508 - RNA, 14 nt, Human
aauauggaacuucu

SEQ ID NO: 3418509 - RNA, 18 nt, Human
aauauggaacuucuaaua

SEQ ID NO: 3418510 - RNA, 15 nt, Human
aauauggcuauaaau

SEQ ID NO: 3418511 - RNA, 18 nt, Human
aauauggcuauaaauaua

SEQ ID NO: 3418512 - RNA, 21 nt, Human
aauaugggggccuuuugggaa

SEQ ID NO: 3418513 - RNA, 14 nt, Human
aauauguauuguaa

SEQ ID NO: 3418514 - RNA, 20 nt, Human
aauauguauuguaaacaugu

SEQ ID NO: 3418515 - RNA, 12 nt, Human
aauauguauuuu

SEQ ID NO: 3418516 - RNA, 18 nt, Human
aauauguauuuuauguau

SEQ ID NO: 3418517 - RNA, 12 nt, Human
aauauguccugg

SEQ ID NO: 3418518 - RNA, 22 nt, Human
aauaugucucgcuagugauguu

SEQ ID NO: 3418519 - RNA, 14 nt, Human
aauaugugagauuu

SEQ ID NO: 3418520 - RNA, 19 nt, Human
aauaugugagauuuuuuau

SEQ ID NO: 3418521 - RNA, 21 nt, Human
aauaugugagauuuuuuauug

SEQ ID NO: 3418522 - RNA, 21 nt, Human
aauaugugagugccuuuugca

SEQ ID NO: 3418523 - RNA, 19 nt, Human
aauaugugauuuuuuuucc

SEQ ID NO: 3418524 - RNA, 14 nt, Human
aauauguguuuacu

SEQ ID NO: 3418525 - RNA, 22 nt, Human
aauauguuaaccucagugucau

SEQ ID NO: 3418526 - RNA, 22 nt, Human
aauauguugaugaaaaauagca

SEQ ID NO: 3418527 - RNA, 13 nt, Human
aauauguuucaaa

SEQ ID NO: 3418528 - RNA, 17 nt, Human
aauauguuucaaacuuu

SEQ ID NO: 3418529 - RNA, 15 nt, Human
aauauguuucacaca

SEQ ID NO: 3418530 - RNA, 23 nt, Human
aaugcagcaaggcccugcugccc

SEQ ID NO: 3418531 - RNA, 20 nt, Human
aaugcagcccauuucuccag

SEQ ID NO: 3418532 - RNA, 21 nt, Human
aaugcagcccauuucuccaga

SEQ ID NO: 3418533 - RNA, 14 nt, Human
aaugcagcgugaag

SEQ ID NO: 3418534 - RNA, 16 nt, Human
aaugcagcuugugugc

SEQ ID NO: 3418535 - RNA, 22 nt, Human
aaugcaguacaggacauauauu

SEQ ID NO: 3418536 - RNA, 18 nt, Human
aaugcaguacuaacauuu

SEQ ID NO: 3418537 - RNA, 17 nt, Human
aaugcaguaugguacau

SEQ ID NO: 3418538 - RNA, 23 nt, Human
aaugcaguaugguacauuuuuca

SEQ ID NO: 3418539 - RNA, 15 nt, Human
aaugcaguugucucu

SEQ ID NO: 3418540 - RNA, 16 nt, Human
aaugcauauuguauua

SEQ ID NO: 3418541 - RNA, 15 nt, Human
aaugcaucaauccug

SEQ ID NO: 3418542 - RNA, 16 nt, Human
aaugcaucuagauuau

SEQ ID NO: 3418543 - RNA, 15 nt, Human
aaugcaucuuugaug

SEQ ID NO: 3418544 - RNA, 19 nt, Human
aaugcaucuuugauguguu

SEQ ID NO: 3418545 - RNA, 18 nt, Human
aaugcaugaguaaaaaaa

SEQ ID NO: 3418546 - RNA, 16 nt, Human
aaugcaugauuuugua

SEQ ID NO: 3418547 - RNA, 13 nt, Human
aaugcauuaaacc

SEQ ID NO: 3418548 - RNA, 15 nt, Human
aaugcauuaaaccug

SEQ ID NO: 3418549 - RNA, 19 nt, Human
aaugcauugauauugugaa

SEQ ID NO: 3418550 - RNA, 22 nt, Human
aaugcauugauauugugaacau

SEQ ID NO: 3418551 - RNA, 18 nt, Human
aaugcauuuuguuuggua

SEQ ID NO: 3418552 - RNA, 16 nt, Human
aaugccaaauuaaaaa

SEQ ID NO: 3418553 - RNA, 17 nt, Human
aaugccaaauuaaaaaa

SEQ ID NO: 3418554 - RNA, 21 nt, Human
aaugccaaauuaaaaaagaua

SEQ ID NO: 3418555 - RNA, 15 nt, Human
aaugccacagcccug

SEQ ID NO: 3418556 - RNA, 22 nt, Human
aaugccacugccuucgcuucuu

SEQ ID NO: 3418557 - RNA, 14 nt, Human
aaugccauaauaca

SEQ ID NO: 3418558 - RNA, 21 nt, Human
aaugccaucaauaaaaaauua

SEQ ID NO: 3418559 - RNA, 22 nt, Human
aaugccauccucaaacacugca

SEQ ID NO: 3418560 - RNA, 17 nt, Human
aaugccaucuaucuagu

SEQ ID NO: 3418561 - RNA, 22 nt, Human
aaugccaugaugccucugucuu

SEQ ID NO: 3418562 - RNA, 13 nt, Human
aaugcccagcccc

SEQ ID NO: 3418563 - RNA, 23 nt, Human
aaugcccagccccuucugaccca

SEQ ID NO: 3418564 - RNA, 15 nt, Human
aaugcccccagcugg

SEQ ID NO: 3418565 - RNA, 18 nt, Human
aaugcccccagcuggccc

SEQ ID NO: 3418566 - RNA, 19 nt, Human
aaugcccguaaugcuuaga

SEQ ID NO: 3418567 - RNA, 18 nt, Human
aaugcccuuacacuuacu

SEQ ID NO: 3418568 - RNA, 21 nt, Human
aaugccgcccucccagcucug

SEQ ID NO: 3418569 - RNA, 24 nt, Human
aaugccuaguuuuuaguaaucugu

SEQ ID NO: 3418570 - RNA, 15 nt, Human
aaugccuccucccug

SEQ ID NO: 3418571 - RNA, 11 nt, Human
aaugccucugu

SEQ ID NO: 3418572 - RNA, 19 nt, Human
aaugccugcuuuuuggaaa

SEQ ID NO: 3418573 - RNA, 23 nt, Human
aaugccuuacccucauguucuua

SEQ ID NO: 3418574 - RNA, 17 nt, Human
aaugccuuacuuuguau

SEQ ID NO: 3418575 - RNA, 12 nt, Human
aaugccuuugag

SEQ ID NO: 3418576 - RNA, 14 nt, Human
aaugccuuugagac

SEQ ID NO: 3418577 - RNA, 16 nt, Human
aaugccuuugagacag

SEQ ID NO: 3418578 - RNA, 17 nt, Human
aaugccuuugagacagu

SEQ ID NO: 3418579 - RNA, 20 nt, Human
aaugccuuugagacaguuuc

SEQ ID NO: 3418580 - RNA, 13 nt, Human
aaugccuuuguaa

SEQ ID NO: 3418581 - RNA, 22 nt, Human
aaugcgauuuuauuacuggcgu

SEQ ID NO: 3418582 - RNA, 14 nt, Human
aaugcgcaggcugg

SEQ ID NO: 3418583 - RNA, 19 nt, Human
aaugcgcaggcuggcccug

SEQ ID NO: 3418584 - RNA, 21 nt, Human
aaugcgcaggcuggcccugcc

SEQ ID NO: 3418585 - RNA, 15 nt, Human
aaugcgccaauaaac

SEQ ID NO: 3418586 - RNA, 18 nt, Human
aaugcgggugagaguaau

SEQ ID NO: 3418587 - RNA, 21 nt, Human
aaugcgguuauaaaaaauggu

SEQ ID NO: 3418588 - RNA, 18 nt, Human
aaugcuaaagaaaaaguc

SEQ ID NO: 3418589 - RNA, 20 nt, Human
aaugcuaaagaaaaagucau

SEQ ID NO: 3418590 - RNA, 17 nt, Human
aaugcuaagggcaggcc

SEQ ID NO: 3418591 - RNA, 17 nt, Human
aaugcuaauauuaaaag

SEQ ID NO: 3418592 - RNA, 16 nt, Human
aaugcuacaauuuuaa

SEQ ID NO: 3418593 - RNA, 20 nt, Human
aaugcuacaauuuuaagagg

SEQ ID NO: 3418594 - RNA, 15 nt, Human
aaugcuacaugugag

SEQ ID NO: 3418595 - RNA, 23 nt, Human
aaugcuacgugugauuuuucugg

SEQ ID NO: 3418596 - RNA, 13 nt, Human
aaugcuacuuuau

SEQ ID NO: 3418597 - RNA, 19 nt, Human
aaugcuagguuaauuccaa

SEQ ID NO: 3418598 - RNA, 14 nt, Human
aaugcuagguucua

SEQ ID NO: 3418599 - RNA, 23 nt, Human
aaugcuauaacuauguugauaaa

SEQ ID NO: 3418600 - RNA, 17 nt, Human
aaugcuaugucauuuca

SEQ ID NO: 3418601 - RNA, 14 nt, Human
aaugcuauugaaaa

SEQ ID NO: 3418602 - RNA, 16 nt, Human
aaugcucauaacggau

SEQ ID NO: 3418603 - RNA, 21 nt, Human
aaugcucccccauccuccccu

SEQ ID NO: 3418604 - RNA, 13 nt, Human
aaugcucuccuuu

SEQ ID NO: 3418605 - RNA, 14 nt, Human
aaugcucuuauuuc

SEQ ID NO: 3418606 - RNA, 16 nt, Human
aaugcucuuauuucau

SEQ ID NO: 3418607 - RNA, 18 nt, Human
aaugcugaaaaaacaccu

SEQ ID NO: 3418608 - RNA, 15 nt, Human
aaugcugaaaauugc

SEQ ID NO: 3418609 - RNA, 15 nt, Human
aaugcugagguuaug

SEQ ID NO: 3418610 - RNA, 16 nt, Human
aaugcugcauuuuaau

SEQ ID NO: 3418611 - RNA, 21 nt, Human
aaugcugcauuuuaauuuuaa

SEQ ID NO: 3418612 - RNA, 14 nt, Human
aaugcugccugccu

SEQ ID NO: 3418613 - RNA, 14 nt, Human
aaugcuggacugga

SEQ ID NO: 3418614 - RNA, 15 nt, Human
aauuaucaagcuaau

SEQ ID NO: 3418615 - RNA, 19 nt, Human
aauuaucaagcuaauaaaa

SEQ ID NO: 3418616 - RNA, 13 nt, Human
aauuaucagcaaa

SEQ ID NO: 3418617 - RNA, 16 nt, Human
aauuaucccuuuucuu

SEQ ID NO: 3418618 - RNA, 17 nt, Human
aauuauccuauuucagu

SEQ ID NO: 3418619 - RNA, 21 nt, Human
aauuauccugaacucuucugc

SEQ ID NO: 3418620 - RNA, 15 nt, Human
aauuaucggaagcag

SEQ ID NO: 3418621 - RNA, 19 nt, Human
aauuaucuaauuuauaaaa

SEQ ID NO: 3418622 - RNA, 14 nt, Human
aauuaucuauuugu

SEQ ID NO: 3418623 - RNA, 19 nt, Human
aauuaucuugauacauuca

SEQ ID NO: 3418624 - RNA, 13 nt, Human
aauuaugaaaaua

SEQ ID NO: 3418625 - RNA, 18 nt, Human
aauuaugaaacuuuugga

SEQ ID NO: 3418626 - RNA, 17 nt, Human
aauuaugaaucugauuu

SEQ ID NO: 3418627 - RNA, 20 nt, Human
aauuaugaguuuuucaauua

SEQ ID NO: 3418628 - RNA, 17 nt, Human
aauuaugauggaagaca

SEQ ID NO: 3418629 - RNA, 18 nt, Human
aauuaugcacuaaauaug

SEQ ID NO: 3418630 - RNA, 19 nt, Human
aauuaugcacuaaauauga

SEQ ID NO: 3418631 - RNA, 22 nt, Human
aauuaugcuaagaauuuuuuau

SEQ ID NO: 3418632 - RNA, 22 nt, Human
aauuaugggaauaauugcuuuu

SEQ ID NO: 3418633 - RNA, 18 nt, Human
aauuaugguaaaauuuug

SEQ ID NO: 3418634 - RNA, 12 nt, Human
aauuauguagcu

SEQ ID NO: 3418635 - RNA, 16 nt, Human
aauuauguagcucuuu

SEQ ID NO: 3418636 - RNA, 15 nt, Human
aauuauguauguuua

SEQ ID NO: 3418637 - RNA, 22 nt, Human
aauuaugugacauuuuacauua

SEQ ID NO: 3418638 - RNA, 16 nt, Human
aauuauguuauugaaa

SEQ ID NO: 3418639 - RNA, 17 nt, Human
aauuauguuuauauaaa

SEQ ID NO: 3418640 - RNA, 21 nt, Human
aauuauguuuauauaaaugcu

SEQ ID NO: 3418641 - RNA, 17 nt, Human
aauuauuaccagugaau

SEQ ID NO: 3418642 - RNA, 23 nt, Human
aauuauuaccagugaaucuuugu

SEQ ID NO: 3418643 - RNA, 13 nt, Human
aauuauuauaaaa

SEQ ID NO: 3418644 - RNA, 18 nt, Human
aauuauuauaagcauuga

SEQ ID NO: 3418645 - RNA, 21 nt, Human
aauuauuauucuucauaacaa

SEQ ID NO: 3418646 - RNA, 21 nt, Human
aauuauuauuuauauauguau

SEQ ID NO: 3418647 - RNA, 22 nt, Human
aauuauuauuuauauauguauu

SEQ ID NO: 3418648 - RNA, 12 nt, Human
aauuauuauuug

SEQ ID NO: 3418649 - RNA, 16 nt, Human
aauuauuauuuguguu

SEQ ID NO: 3418650 - RNA, 13 nt, Human
aauuauucaguua

SEQ ID NO: 3418651 - RNA, 20 nt, Human
aauuauucaguuaagaaaaa

SEQ ID NO: 3418652 - RNA, 17 nt, Human
aauuauuccaaaccaaa

SEQ ID NO: 3418653 - RNA, 23 nt, Human
aauuauucuauaauuuccauuua

SEQ ID NO: 3418654 - RNA, 15 nt, Human
aauuauugacacuga

SEQ ID NO: 3418655 - RNA, 19 nt, Human
aauuauugacacugaacuu

SEQ ID NO: 3418656 - RNA, 13 nt, Human
aauuauugauaua

SEQ ID NO: 3418657 - RNA, 16 nt, Human
aauuauugauauauau

SEQ ID NO: 3418658 - RNA, 17 nt, Human
aauuauugauauauauu

SEQ ID NO: 3418659 - RNA, 15 nt, Human
aauuauugaugaaaa

SEQ ID NO: 3418660 - RNA, 14 nt, Human
aauuauugauugcu

SEQ ID NO: 3418661 - RNA, 12 nt, Human
aauuauuguaca

SEQ ID NO: 3418662 - RNA, 16 nt, Human
aauuauuuaauugucc

SEQ ID NO: 3418663 - RNA, 18 nt, Human
aauuauuuauuauuaaga

SEQ ID NO: 3418664 - RNA, 11 nt, Human
aauuauuucug

SEQ ID NO: 3418665 - RNA, 17 nt, Human
aauuauuucuuaauuau

SEQ ID NO: 3418666 - RNA, 12 nt, Human
aauuauuugaau

SEQ ID NO: 3418667 - RNA, 21 nt, Human
aauuauuugacuuuaauuuau

SEQ ID NO: 3418668 - RNA, 14 nt, Human
aauuauuugauuau

SEQ ID NO: 3418669 - RNA, 18 nt, Human
aauuauuuguguaauaga

SEQ ID NO: 3418670 - RNA, 13 nt, Human
aauuauuuucauc

SEQ ID NO: 3418671 - RNA, 11 nt, Human
aauuauuuugg

SEQ ID NO: 3418672 - RNA, 20 nt, Human
aauuauuuuguucauacaua

SEQ ID NO: 3418673 - RNA, 17 nt, Human
aauuauuuuuaauaugu

SEQ ID NO: 3418674 - RNA, 17 nt, Human
aauuauuuuuacaguuc

SEQ ID NO: 3418675 - RNA, 14 nt, Human
aauucaaaaagugu

SEQ ID NO: 3418676 - RNA, 22 nt, Human
aauucaaaaguuccaagagucu

SEQ ID NO: 3418677 - RNA, 23 nt, Human
aauucaaaaguuccaagagucua

SEQ ID NO: 3418678 - RNA, 13 nt, Human
aauucaaaccuaa

SEQ ID NO: 3418679 - RNA, 22 nt, Human
aauucaaauuuuaucugccucu

SEQ ID NO: 3418680 - RNA, 15 nt, Human
aauucaacaaacauu

SEQ ID NO: 3418681 - RNA, 15 nt, Human
aauucaacucagacu

SEQ ID NO: 3418682 - RNA, 16 nt, Human
aauucaacuuuguaaa

SEQ ID NO: 3418683 - RNA, 22 nt, Human
aauucaacuuuguaaaaaucuu

SEQ ID NO: 3418684 - RNA, 23 nt, Human
aauucaaggaauuucuuaacuuc

SEQ ID NO: 3418685 - RNA, 14 nt, Human
aauucaauuguaaa

SEQ ID NO: 3418686 - RNA, 17 nt, Human
aauucaauuguaaauug

SEQ ID NO: 3418687 - RNA, 13 nt, Human
aauucacaaacuu

SEQ ID NO: 3418688 - RNA, 14 nt, Human
aauucacaaacuuu

SEQ ID NO: 3418689 - RNA, 19 nt, Human
aauucacaaacuuuuauac

SEQ ID NO: 3418690 - RNA, 16 nt, Human
aauucacaagcugccu

SEQ ID NO: 3418691 - RNA, 18 nt, Human
aauucacaagcugccucc

SEQ ID NO: 3418692 - RNA, 21 nt, Human
aauucacccccuuuccuggac

SEQ ID NO: 3418693 - RNA, 23 nt, Human
aauucacucccacacccaagaag

SEQ ID NO: 3418694 - RNA, 12 nt, Human
aauucacucuga

SEQ ID NO: 3418695 - RNA, 13 nt, Human
aauucacuguacu

SEQ ID NO: 3418696 - RNA, 17 nt, Human
aauucagauauauuuuu

SEQ ID NO: 3418697 - RNA, 15 nt, Human
aauucagcaaaccau

SEQ ID NO: 3418698 - RNA, 23 nt, Human
aauucagcacugauuucacaaca

SEQ ID NO: 3418699 - RNA, 18 nt, Human
aauucaguguauuucagu

SEQ ID NO: 3418700 - RNA, 17 nt, Human
aauucaguuguuagugu

SEQ ID NO: 3418701 - RNA, 18 nt, Human
aauucaucccaacugucu

SEQ ID NO: 3418702 - RNA, 14 nt, Human
aauucaugaacuuc

SEQ ID NO: 3418703 - RNA, 23 nt, Human
aauucaugaacuucgcaucaaaa

SEQ ID NO: 3418704 - RNA, 21 nt, Human
aauucauuaaucugccucccu

SEQ ID NO: 3418705 - RNA, 13 nt, Human
aauucauuucacu

SEQ ID NO: 3418706 - RNA, 15 nt, Human
aauucauuucacugu

SEQ ID NO: 3418707 - RNA, 12 nt, Human
aauucauuucua

SEQ ID NO: 3418708 - RNA, 13 nt, Human
aauuccaaagcaa

SEQ ID NO: 3418709 - RNA, 14 nt, Human
aauuccaaagcaaa

SEQ ID NO: 3418710 - RNA, 15 nt, Human
aauuccaaagcaaaa

SEQ ID NO: 3418711 - RNA, 18 nt, Human
aauuccaacaguuuaaug

SEQ ID NO: 3418712 - RNA, 23 nt, Human
aauuccaaggaguuccaugaaga

SEQ ID NO: 3418713 - RNA, 18 nt, Human
aauuccaagugauugaaa

SEQ ID NO: 3418714 - RNA, 16 nt, Human
aauuccacaccuuuua

SEQ ID NO: 3418715 - RNA, 13 nt, Human
aauuccacagcug

SEQ ID NO: 3418716 - RNA, 15 nt, Human
aauuccacucugaua

SEQ ID NO: 3418717 - RNA, 22 nt, Human
aauuccacuuauaggaauugac

SEQ ID NO: 3418718 - RNA, 19 nt, Human
aauuccauauauccuuuuc

SEQ ID NO: 3418719 - RNA, 24 nt, Human
aauuccaucaagccaagccuccug

SEQ ID NO: 3418720 - RNA, 10 nt, Human
aauuccauga

SEQ ID NO: 3418721 - RNA, 16 nt, Human
aauucccauuuugcaa

SEQ ID NO: 3418722 - RNA, 12 nt, Human
aauuccccagau

SEQ ID NO: 3418723 - RNA, 20 nt, Human
aauucccguuuugucacuuu

SEQ ID NO: 3418724 - RNA, 20 nt, Human
aauucccucacucgucuccc

SEQ ID NO: 3418725 - RNA, 17 nt, Human
aauucccucucucugac

SEQ ID NO: 3418726 - RNA, 14 nt, Human
aauucccugcuguc

SEQ ID NO: 3418727 - RNA, 22 nt, Human
aauccccaugccuguggcugcg

SEQ ID NO: 3418728 - RNA, 18 nt, Human
aaucccccuugccacccc

SEQ ID NO: 3418729 - RNA, 14 nt, Human
aauccccuaaaaua

SEQ ID NO: 3418730 - RNA, 18 nt, Human
aauccccuccuugggcac

SEQ ID NO: 3418731 - RNA, 17 nt, Human
aauccccuuaugacuug

SEQ ID NO: 3418732 - RNA, 18 nt, Human
aauccccuucucaucacu

SEQ ID NO: 3418733 - RNA, 15 nt, Human
aauccccuucucccc

SEQ ID NO: 3418734 - RNA, 19 nt, Human
aaucccucaccuucugagu

SEQ ID NO: 3418735 - RNA, 13 nt, Human
aaucccugcucac

SEQ ID NO: 3418736 - RNA, 14 nt, Human
aaucccugcuuuuu

SEQ ID NO: 3418737 - RNA, 22 nt, Human
aaucccugcuuuuuguguuuuu

SEQ ID NO: 3418738 - RNA, 19 nt, Human
aaucccuguguuaauuuaa

SEQ ID NO: 3418739 - RNA, 20 nt, Human
aaucccuguguuaauuuaag

SEQ ID NO: 3418740 - RNA, 12 nt, Human
aaucccuguuca

SEQ ID NO: 3418741 - RNA, 18 nt, Human
aaucccuuaacaguugua

SEQ ID NO: 3418742 - RNA, 22 nt, Human
aaucccuuaacaguuguauuua

SEQ ID NO: 3418743 - RNA, 18 nt, Human
aaucccuucauacuugaa

SEQ ID NO: 3418744 - RNA, 13 nt, Human
aauccgaaccucc

SEQ ID NO: 3418745 - RNA, 17 nt, Human
aauccgcucucuuccug

SEQ ID NO: 3418746 - RNA, 15 nt, Human
aauccuaaaagaagc

SEQ ID NO: 3418747 - RNA, 16 nt, Human
aauccuaacacauuau

SEQ ID NO: 3418748 - RNA, 16 nt, Human
aauccuaauuucuccu

SEQ ID NO: 3418749 - RNA, 21 nt, Human
aauccuaauuucuccucccuu

SEQ ID NO: 3418750 - RNA, 16 nt, Human
aauccuaccaaccucu

SEQ ID NO: 3418751 - RNA, 17 nt, Human
aauccuaccucaaaauu

SEQ ID NO: 3418752 - RNA, 17 nt, Human
aauccuaccuguuuugu

SEQ ID NO: 3418753 - RNA, 16 nt, Human
aauccuagcugugugc

SEQ ID NO: 3418754 - RNA, 22 nt, Human
aauccuaugcaugguuucagca

SEQ ID NO: 3418755 - RNA, 20 nt, Human
aauccuccaaccaggcuccu

SEQ ID NO: 3418756 - RNA, 23 nt, Human
aauccuccugagugaucccauuu

SEQ ID NO: 3418757 - RNA, 21 nt, Human
aauccucucaaccaccuuuca

SEQ ID NO: 3418758 - RNA, 11 nt, Human
aauccucuggc

SEQ ID NO: 3418759 - RNA, 23 nt, Human
aaggucuggagaagcucccagga

SEQ ID NO: 3418760 - RNA, 23 nt, Human
aaggucuguuuuguguacuuuua

SEQ ID NO: 3418761 - RNA, 18 nt, Human
aaggucuuuaaaauauug

SEQ ID NO: 3418762 - RNA, 22 nt, Human
aaggugaaacauuuucucccug

SEQ ID NO: 3418763 - RNA, 11 nt, Human
aaggugaagga

SEQ ID NO: 3418764 - RNA, 14 nt, Human
aaggugaaggaaua

SEQ ID NO: 3418765 - RNA, 18 nt, Human
aaggugaaggaauauaug

SEQ ID NO: 3418766 - RNA, 15 nt, Human
aaggugaauagccau

SEQ ID NO: 3418767 - RNA, 19 nt, Human
aaggugacaucggaaaaau

SEQ ID NO: 3418768 - RNA, 20 nt, Human
aaggugacaucggaaaaaua

SEQ ID NO: 3418769 - RNA, 20 nt, Human
aaggugaggagcuugaaacc

SEQ ID NO: 3418770 - RNA, 22 nt, Human
aaggugaggccugucugugacc

SEQ ID NO: 3418771 - RNA, 17 nt, Human
aaggugauauauuuaaa

SEQ ID NO: 3418772 - RNA, 14 nt, Human
aaggugcaggcagg

SEQ ID NO: 3418773 - RNA, 14 nt, Human
aaggugccauggaa

SEQ ID NO: 3418774 - RNA, 18 nt, Human
aaggugccauggaagagg

SEQ ID NO: 3418775 - RNA, 11 nt, Human
aaggugccugu

SEQ ID NO: 3418776 - RNA, 18 nt, Human
aaggugccugugaggcag

SEQ ID NO: 3418777 - RNA, 20 nt, Human
aaggugccugugaggcaggg

SEQ ID NO: 3418778 - RNA, 19 nt, Human
aaggugcuaaaucugcgau

SEQ ID NO: 3418779 - RNA, 23 nt, Human
aaggugcuguugucauugcuuua

SEQ ID NO: 3418780 - RNA, 22 nt, Human
aagguggaccuuuuaaaguguu

SEQ ID NO: 3418781 - RNA, 22 nt, Human
aagguggauuuuguuuaaaaaa

SEQ ID NO: 3418782 - RNA, 19 nt, Human
aagguggggguuggcuggg

SEQ ID NO: 3418783 - RNA, 20 nt, Human
aagguggggguuggcugggu

SEQ ID NO: 3418784 - RNA, 23 nt, Human
aaggugggguauuuaccacagca

SEQ ID NO: 3418785 - RNA, 16 nt, Human
aagguggugugaucuu

SEQ ID NO: 3418786 - RNA, 16 nt, Human
aagguguccuacagaa

SEQ ID NO: 3418787 - RNA, 16 nt, Human
aaggugucuuccuccc

SEQ ID NO: 3418788 - RNA, 15 nt, Human
aaggugugagacugg

SEQ ID NO: 3418789 - RNA, 12 nt, Human
aagguguuugaa

SEQ ID NO: 3418790 - RNA, 15 nt, Human
aagguguuugaaaau

SEQ ID NO: 3418791 - RNA, 17 nt, Human
aagguguuuucugugua

SEQ ID NO: 3418792 - RNA, 18 nt, Human
aagguguuuucuguguaa

SEQ ID NO: 3418793 - RNA, 16 nt, Human
aagguuaauaaaguaa

SEQ ID NO: 3418794 - RNA, 20 nt, Human
aagguuaauguucaucaucc

SEQ ID NO: 3418795 - RNA, 18 nt, Human
aagguuaggauuuaacag

SEQ ID NO: 3418796 - RNA, 20 nt, Human
aagguuauuuauuuaaaugu

SEQ ID NO: 3418797 - RNA, 18 nt, Human
aagguuccaacuguauau

SEQ ID NO: 3418798 - RNA, 19 nt, Human
aagguuccaacuguauaua

SEQ ID NO: 3418799 - RNA, 21 nt, Human
aagguuccaacuguauauauu

SEQ ID NO: 3418800 - RNA, 21 nt, Human
aagguuccacagaguaagaca

SEQ ID NO: 3418801 - RNA, 16 nt, Human
aagguucccucugaga

SEQ ID NO: 3418802 - RNA, 11 nt, Human
aagguucuaag

SEQ ID NO: 3418803 - RNA, 18 nt, Human
aagguucuggugugaacu

SEQ ID NO: 3418804 - RNA, 17 nt, Human
aagguucuuacugcuug

SEQ ID NO: 3418805 - RNA, 17 nt, Human
aagguucuucaucccuu

SEQ ID NO: 3418806 - RNA, 19 nt, Human
aagguucuucaucccuuuc

SEQ ID NO: 3418807 - RNA, 13 nt, Human
aagguugaauaau

SEQ ID NO: 3418808 - RNA, 16 nt, Human
aagguuggagcccagg

SEQ ID NO: 3418809 - RNA, 18 nt, Human
aagguuggagcccagggc

SEQ ID NO: 3418810 - RNA, 14 nt, Human
aagguuggauggau

SEQ ID NO: 3418811 - RNA, 18 nt, Human
aagguuuaaaacuaguua

SEQ ID NO: 3418812 - RNA, 20 nt, Human
aagguuuaaagagucuagau

SEQ ID NO: 3418813 - RNA, 21 nt, Human
aagguuuaaagagucuagauu

SEQ ID NO: 3418814 - RNA, 14 nt, Human
aagguuuaaaugaa

SEQ ID NO: 3418815 - RNA, 16 nt, Human
aagguuuaaaugaaca

SEQ ID NO: 3418816 - RNA, 22 nt, Human
aagguuuaggcugguggcccag

SEQ ID NO: 3418817 - RNA, 14 nt, Human
aagguuuauuguua

SEQ ID NO: 3418818 - RNA, 22 nt, Human
aagguuucguuucuguauacaa

SEQ ID NO: 3418819 - RNA, 19 nt, Human
aagguuuggaaggagcaga

SEQ ID NO: 3418820 - RNA, 18 nt, Human
aagguuugguccagccug

SEQ ID NO: 3418821 - RNA, 23 nt, Human
aagguuuuaauuuaguaaaccaa

SEQ ID NO: 3418822 - RNA, 19 nt, Human
aagguuuuagguucuaaag

SEQ ID NO: 3418823 - RNA, 22 nt, Human
aagguuuuggaucuugaaugug

SEQ ID NO: 3418824 - RNA, 14 nt, Human
aagguuuuuguaaa

SEQ ID NO: 3418825 - RNA, 22 nt, Human
aaguaaaaacaaagaaauuaug

SEQ ID NO: 3418826 - RNA, 16 nt, Human
aaguaaaaccacagca

SEQ ID NO: 3418827 - RNA, 18 nt, Human
aaguaaaaccacagcagu

SEQ ID NO: 3418828 - RNA, 13 nt, Human
aaguaaaagaaac

SEQ ID NO: 3418829 - RNA, 21 nt, Human
aaguaaaagcaaaaaagaaaa

SEQ ID NO: 3418830 - RNA, 12 nt, Human
aaguaaaauguc

SEQ ID NO: 3418831 - RNA, 17 nt, Human
aaguaaacuaaugaguu

SEQ ID NO: 3418832 - RNA, 21 nt, Human
aaguaaagccauuaaaugaau

SEQ ID NO: 3418833 - RNA, 12 nt, Human
aaguaaagcuaa

SEQ ID NO: 3418834 - RNA, 21 nt, Human
aaguaaagcuaaaaugauuuu

SEQ ID NO: 3418835 - RNA, 12 nt, Human
aaguaaauacaa

SEQ ID NO: 3418836 - RNA, 15 nt, Human
aaguaaauagcaaca

SEQ ID NO: 3418837 - RNA, 15 nt, Human
aaguaaaugucugug

SEQ ID NO: 3418838 - RNA, 18 nt, Human
aaguaaaugucuguggcc

SEQ ID NO: 3418839 - RNA, 16 nt, Human
aaguaacaaaaauaaa

SEQ ID NO: 3418840 - RNA, 17 nt, Human
aaguaacaagagugauu

SEQ ID NO: 3418841 - RNA, 12 nt, Human
aaguaacucauu

SEQ ID NO: 3418842 - RNA, 15 nt, Human
aaguaacucauugcu

SEQ ID NO: 3418843 - RNA, 14 nt, Human
aaguaacucauuug

SEQ ID NO: 3418844 - RNA, 21 nt, Human
aaguaacucauuuguuaaaau

SEQ ID NO: 3418845 - RNA, 23 nt, Human
aaguaacugggauuacaggcaug

SEQ ID NO: 3418846 - RNA, 16 nt, Human
aaguaacuugucuuaa

SEQ ID NO: 3418847 - RNA, 18 nt, Human
aaguaacuuuaaauuaug

SEQ ID NO: 3418848 - RNA, 19 nt, Human
aaguaacuuuauucuugaa

SEQ ID NO: 3418849 - RNA, 16 nt, Human
aaguaagaaaauauuu

SEQ ID NO: 3418850 - RNA, 20 nt, Human
aaguaagaaagugaagcaaa

SEQ ID NO: 3418851 - RNA, 13 nt, Human
aaguaagaagaca

SEQ ID NO: 3418852 - RNA, 15 nt, Human
aaguaagaagacaug

SEQ ID NO: 3418853 - RNA, 13 nt, Human
aaguaagcaaaga

SEQ ID NO: 3418854 - RNA, 17 nt, Human
aaguaagcaacagcaua

SEQ ID NO: 3418855 - RNA, 19 nt, Human
aaguaagcaacagcauaac

SEQ ID NO: 3418856 - RNA, 20 nt, Human
aaguaagggaagcagaagga

SEQ ID NO: 3418857 - RNA, 16 nt, Human
aaguaagucucaaggu

SEQ ID NO: 3418858 - RNA, 23 nt, Human
aaguaauauaauggaagagaaau

SEQ ID NO: 3418859 - RNA, 12 nt, Human
aaguaauaugca

SEQ ID NO: 3418860 - RNA, 15 nt, Human
aaguaauaugcacac

SEQ ID NO: 3418861 - RNA, 20 nt, Human
aaguaauaugcacacauuuu

SEQ ID NO: 3418862 - RNA, 21 nt, Human
aaguaauccaccugccucggc

SEQ ID NO: 3418863 - RNA, 17 nt, Human
aaguaaugacagaacau

SEQ ID NO: 3418864 - RNA, 14 nt, Human
aaguaaugauaacu

SEQ ID NO: 3418865 - RNA, 13 nt, Human
aaguaauuaucgg

SEQ ID NO: 3418866 - RNA, 22 nt, Human
aaguaauuaucgggaacagugu

SEQ ID NO: 3418867 - RNA, 13 nt, Human
aaguaauuucagu

SEQ ID NO: 3418868 - RNA, 22 nt, Human
aaguaauuucuucucaaagggu

SEQ ID NO: 3418869 - RNA, 20 nt, Human
aaguacacuguuucaaacuu

SEQ ID NO: 3418870 - RNA, 23 nt, Human
aaguacacuguuucaaacuuuac

SEQ ID NO: 3418871 - RNA, 14 nt, Human
aaguacagaauuug

SEQ ID NO: 3418872 - RNA, 11 nt, Human
aaguacagaga

SEQ ID NO: 3418873 - RNA, 13 nt, Human
aaguacagagaag

SEQ ID NO: 3418874 - RNA, 15 nt, Human
aaguacagagaagcc

SEQ ID NO: 3418875 - RNA, 22 nt, Human
aaguacagagaagccaucaccu

SEQ ID NO: 3418876 - RNA, 18 nt, Human
aaguacauuauuguuuau

SEQ ID NO: 3418877 - RNA, 12 nt, Human
aaguacauuuaa

SEQ ID NO: 3418878 - RNA, 21 nt, Human
aaguacauuuuuugaaaugcu

SEQ ID NO: 3418879 - RNA, 16 nt, Human
aaguacguuauuguug

SEQ ID NO: 3418880 - RNA, 18 nt, Human
aaguacuacacauuuuua

SEQ ID NO: 3418881 - RNA, 19 nt, Human
aauucccuggccuuucaua

SEQ ID NO: 3418882 - RNA, 13 nt, Human
aauuccuacagca

SEQ ID NO: 3418883 - RNA, 19 nt, Human
aauuccuacagcacuacug

SEQ ID NO: 3418884 - RNA, 14 nt, Human
aauuccuagaauua

SEQ ID NO: 3418885 - RNA, 17 nt, Human
aauuccuagaauuaaac

SEQ ID NO: 3418886 - RNA, 15 nt, Human
aauuccuauaaggaa

SEQ ID NO: 3418887 - RNA, 12 nt, Human
aauuccuauugu

SEQ ID NO: 3418888 - RNA, 19 nt, Human
aauuccuauugugauuuga

SEQ ID NO: 3418889 - RNA, 22 nt, Human
aauuccucauccucagaugcuc

SEQ ID NO: 3418890 - RNA, 13 nt, Human
aauuccucuggga

SEQ ID NO: 3418891 - RNA, 13 nt, Human
aauuccuguuuuu

SEQ ID NO: 3418892 - RNA, 19 nt, Human
aauuccuguuuuuauuauu

SEQ ID NO: 3418893 - RNA, 16 nt, Human
aauuccuucaggguga

SEQ ID NO: 3418894 - RNA, 23 nt, Human
aauuccuucagggugaugccagg

SEQ ID NO: 3418895 - RNA, 19 nt, Human
aauuccuuuucuaacucuc

SEQ ID NO: 3418896 - RNA, 15 nt, Human
aauucgaaccaggaa

SEQ ID NO: 3418897 - RNA, 14 nt, Human
aauucgaccugauu

SEQ ID NO: 3418898 - RNA, 15 nt, Human
aauucgcccgagcug

SEQ ID NO: 3418899 - RNA, 14 nt, Human
aauucuaaaaugau

SEQ ID NO: 3418900 - RNA, 13 nt, Human
aauucuaaaugua

SEQ ID NO: 3418901 - RNA, 22 nt, Human
aauucuaaccagagcaagcuuu

SEQ ID NO: 3418902 - RNA, 14 nt, Human
aauucuacuuugag

SEQ ID NO: 3418903 - RNA, 16 nt, Human
aauucuagugcugcug

SEQ ID NO: 3418904 - RNA, 19 nt, Human
aauuguauuuuuguuguug

SEQ ID NO: 3418905 - RNA, 11 nt, Human
aauugucaugg

SEQ ID NO: 3418906 - RNA, 23 nt, Human
aauugucaugguuacaaacuaca

SEQ ID NO: 3418907 - RNA, 13 nt, Human
aauuguccccagu

SEQ ID NO: 3418908 - RNA, 16 nt, Human
aauugucccuuaaaca

SEQ ID NO: 3418909 - RNA, 18 nt, Human
aauugucccuuaaacaaa

SEQ ID NO: 3418910 - RNA, 14 nt, Human
aauugucuauuuau

SEQ ID NO: 3418911 - RNA, 21 nt, Human
aauugucuauuuaucuuuuau

SEQ ID NO: 3418912 - RNA, 16 nt, Human
aauugucuucauguac

SEQ ID NO: 3418913 - RNA, 19 nt, Human
aauugucuuuggugcuuuu

SEQ ID NO: 3418914 - RNA, 15 nt, Human
aauugugaugugucc

SEQ ID NO: 3418915 - RNA, 21 nt, Human
aauugugcaguacuuugugca

SEQ ID NO: 3418916 - RNA, 18 nt, Human
aauuguggcuauccugau

SEQ ID NO: 3418917 - RNA, 21 nt, Human
aauuguguagccuuuuuguau

SEQ ID NO: 3418918 - RNA, 13 nt, Human
aauugugucugca

SEQ ID NO: 3418919 - RNA, 15 nt, Human
aauugugugaacuug

SEQ ID NO: 3418920 - RNA, 15 nt, Human
aauuguguggauucu

SEQ ID NO: 3418921 - RNA, 21 nt, Human
aauugugugugcucugcuuca

SEQ ID NO: 3418922 - RNA, 16 nt, Human
aauuguuacaaauugu

SEQ ID NO: 3418923 - RNA, 16 nt, Human
aauuguuacuccauau

SEQ ID NO: 3418924 - RNA, 16 nt, Human
aauuguugaaauuuug

SEQ ID NO: 3418925 - RNA, 22 nt, Human
aauuguugaacagguguuuuuc

SEQ ID NO: 3418926 - RNA, 13 nt, Human
aauuguuguucug

SEQ ID NO: 3418927 - RNA, 16 nt, Human
aauuguuguucuguua

SEQ ID NO: 3418928 - RNA, 18 nt, Human
aauuguuguuucuuucua

SEQ ID NO: 3418929 - RNA, 15 nt, Human
aauuguuuaaguguu

SEQ ID NO: 3418930 - RNA, 17 nt, Human
aauuguuuggcuuccuc

SEQ ID NO: 3418931 - RNA, 20 nt, Human
aauuguuuggcuuccuccug

SEQ ID NO: 3418932 - RNA, 22 nt, Human
aauuguuuuaucugaauuuuua

SEQ ID NO: 3418933 - RNA, 16 nt, Human
aauuguuuugcacuuu

SEQ ID NO: 3418934 - RNA, 17 nt, Human
aauuguuuugcacuuuu

SEQ ID NO: 3418935 - RNA, 20 nt, Human
aauuguuuugcacuuuuuua

SEQ ID NO: 3418936 - RNA, 14 nt, Human
aauuguuuuuuauc

SEQ ID NO: 3418937 - RNA, 19 nt, Human
aauuguuuuuuaucuuuuc

SEQ ID NO: 3418938 - RNA, 22 nt, Human
aauuguuuuuuaucuuuucuac

SEQ ID NO: 3418939 - RNA, 14 nt, Human
aauuuaaaaaauaa

SEQ ID NO: 3418940 - RNA, 17 nt, Human
aauuuaaaaauauauuu

SEQ ID NO: 3418941 - RNA, 16 nt, Human
aauuuaaaacaaacaa

SEQ ID NO: 3418942 - RNA, 15 nt, Human
aauuuaaaaguaaaa

SEQ ID NO: 3418943 - RNA, 13 nt, Human
aauuuaaaagucu

SEQ ID NO: 3418944 - RNA, 10 nt, Human
aauuuaaaca

SEQ ID NO: 3418945 - RNA, 11 nt, Human
aauuuaaacag

SEQ ID NO: 3418946 - RNA, 19 nt, Human
aauuuaaacaggcccagca

SEQ ID NO: 3418947 - RNA, 20 nt, Human
aauuuaaagaaaaaaauguc

SEQ ID NO: 3418948 - RNA, 12 nt, Human
aauuuaaagaua

SEQ ID NO: 3418949 - RNA, 12 nt, Human
aauuuaaagcag

SEQ ID NO: 3418950 - RNA, 22 nt, Human
aauuuaaagcagguucuuguug

SEQ ID NO: 3418951 - RNA, 12 nt, Human
aauuuaaaggcu

SEQ ID NO: 3418952 - RNA, 19 nt, Human
aauuuaaaggguguacuua

SEQ ID NO: 3418953 - RNA, 12 nt, Human
aauuuaaaugaa

SEQ ID NO: 3418954 - RNA, 22 nt, Human
aauuuaaaugaaagaaaauuga

SEQ ID NO: 3418955 - RNA, 17 nt, Human
aauuuaaauuuaaagau

SEQ ID NO: 3418956 - RNA, 18 nt, Human
aauuuaaauuuaaagaua

SEQ ID NO: 3418957 - RNA, 13 nt, Human
aauuuaacaaugc

SEQ ID NO: 3418958 - RNA, 16 nt, Human
aauuuaacaaugcgaa

SEQ ID NO: 3418959 - RNA, 17 nt, Human
aauuuaacaaugcgaau

SEQ ID NO: 3418960 - RNA, 21 nt, Human
aauuuaacuacccuuaauuac

SEQ ID NO: 3418961 - RNA, 11 nt, Human
aauuuaagcau

SEQ ID NO: 3418962 - RNA, 16 nt, Human
aauuuaagcauuguuu

SEQ ID NO: 3418963 - RNA, 21 nt, Human
aauuuaaggucuguuugcugu

SEQ ID NO: 3418964 - RNA, 18 nt, Human
aauuuaaguguuggaaaa

SEQ ID NO: 3418965 - RNA, 17 nt, Human
aauuuaaguuuugacaa

SEQ ID NO: 3418966 - RNA, 23 nt, Human
aauuuaaguuuugacaagcuggc

SEQ ID NO: 3418967 - RNA, 17 nt, Human
aauuuaauaacuuuuua

SEQ ID NO: 3418968 - RNA, 14 nt, Human
aauuuaauauagcu

SEQ ID NO: 3418969 - RNA, 14 nt, Human
aauuuaaugcugcc

SEQ ID NO: 3418970 - RNA, 17 nt, Human
aauuuaaugcugccuuu

SEQ ID NO: 3418971 - RNA, 19 nt, Human
aauuuaauucauguuucuu

SEQ ID NO: 3418972 - RNA, 23 nt, Human
aauuuaauucauguuucuuaaau

SEQ ID NO: 3418973 - RNA, 21 nt, Human
aauuuacaaaaauauaaaaua

SEQ ID NO: 3418974 - RNA, 17 nt, Human
aauuuacaaagugugua

SEQ ID NO: 3418975 - RNA, 15 nt, Human
aauuuacacugccau

SEQ ID NO: 3418976 - RNA, 16 nt, Human
aauuuacaucauuucu

SEQ ID NO: 3418977 - RNA, 22 nt, Human
aauuuacccucuugaauauaau

SEQ ID NO: 3418978 - RNA, 16 nt, Human
aauuuaccuaagauua

SEQ ID NO: 3418979 - RNA, 17 nt, Human
aauuuaccuaagauuac

SEQ ID NO: 3418980 - RNA, 21 nt, Human
aauuuaccuaagauuacaaau

SEQ ID NO: 3418981 - RNA, 17 nt, Human
aauuuaccugaagucuu

SEQ ID NO: 3418982 - RNA, 16 nt, Human
aauuuaccugauuucu

SEQ ID NO: 3418983 - RNA, 12 nt, Human
aauuuacuauau

SEQ ID NO: 3418984 - RNA, 19 nt, Human
aauuuacuauauauauaug

SEQ ID NO: 3418985 - RNA, 14 nt, Human
aauuuacugugacu

SEQ ID NO: 3418986 - RNA, 15 nt, Human
aauuuacuuuggaaa

SEQ ID NO: 3418987 - RNA, 16 nt, Human
aauuuagaaaaagaac

SEQ ID NO: 3418988 - RNA, 16 nt, Human
aauuuagaaaacuuua

SEQ ID NO: 3418989 - RNA, 15 nt, Human
aauuuagaaaucauu

SEQ ID NO: 3418990 - RNA, 16 nt, Human
aauuuagcauuguagu

SEQ ID NO: 3418991 - RNA, 17 nt, Human
aauuuaggguacuaaau

SEQ ID NO: 3418992 - RNA, 15 nt, Human
aauuuaguaaauguu

SEQ ID NO: 3418993 - RNA, 14 nt, Human
aauuuaguuucaua

SEQ ID NO: 3418994 - RNA, 20 nt, Human
aauuuaguuuuuguucuuaa

SEQ ID NO: 3418995 - RNA, 14 nt, Human
aauuuauaaaauua

SEQ ID NO: 3418996 - RNA, 21 nt, Human
aauuuauaaaauuagaaagca

SEQ ID NO: 3418997 - RNA, 22 nt, Human
aauuuauaaacuuuuuucuuac

SEQ ID NO: 3418998 - RNA, 12 nt, Human
aauuuauaauuc

SEQ ID NO: 3418999 - RNA, 17 nt, Human
aauuuauaauucaguau

SEQ ID NO: 3419000 - RNA, 12 nt, Human
aauuuauaauuu

SEQ ID NO: 3419001 - RNA, 15 nt, Human
aauuuauaauuuuaa

SEQ ID NO: 3419002 - RNA, 17 nt, Human
aauuuauacaggucaua

SEQ ID NO: 3419003 - RNA, 18 nt, Human
aauuuauaguaaugaguu

SEQ ID NO: 3419004 - RNA, 16 nt, Human
aauuuauaguuuauac

SEQ ID NO: 3419005 - RNA, 17 nt, Human
aauuuauaguuuauaca

SEQ ID NO: 3419006 - RNA, 14 nt, Human
aauuuauaugaaaa

SEQ ID NO: 3419007 - RNA, 16 nt, Human
aauuuauauguauauu

SEQ ID NO: 3419008 - RNA, 14 nt, Human
aauuuaucaaagca

SEQ ID NO: 3419009 - RNA, 16 nt, Human
aauuuaucaaagcaua

SEQ ID NO: 3419010 - RNA, 12 nt, Human
aauuuaucuaaa

SEQ ID NO: 3419011 - RNA, 13 nt, Human
aauuuaucuuuga

SEQ ID NO: 3419012 - RNA, 20 nt, Human
aauuuaugaguuuuugauag

SEQ ID NO: 3419013 - RNA, 19 nt, Human
aauuuaugcacuuauaagg

SEQ ID NO: 3419014 - RNA, 19 nt, Human
aauuuauuaauugcuuuga

SEQ ID NO: 3419015 - RNA, 18 nt, Human
aauuuauuaguuaauaua

SEQ ID NO: 3419016 - RNA, 17 nt, Human
aauuuauuauggcacau

SEQ ID NO: 3419017 - RNA, 13 nt, Human
aauuuauuauuaa

SEQ ID NO: 3419018 - RNA, 16 nt, Human
aauuuauuauugaaau

SEQ ID NO: 3419019 - RNA, 23 nt, Human
aauuuauugaggaaaaauaugug

SEQ ID NO: 3419020 - RNA, 16 nt, Human
aauuuauuuauuaaga

SEQ ID NO: 3419021 - RNA, 23 nt, Human
aauuuauuuccaauguuucaagc

SEQ ID NO: 3419022 - RNA, 16 nt, Human
aauuuauuuccuaguu

SEQ ID NO: 3419023 - RNA, 18 nt, Human
aauuuauuuuauaagaaa

SEQ ID NO: 3419024 - RNA, 21 nt, Human
aauuuauuuuauaagaaaaac

SEQ ID NO: 3419025 - RNA, 23 nt, Human
aauuuauuuuauaagaaaaacuu

SEQ ID NO: 3419026 - RNA, 20 nt, Human
aauuuauuuuauuuuagcag

SEQ ID NO: 3419027 - RNA, 19 nt, Human
aauuuauuuuuaagaaaga

SEQ ID NO: 3419028 - RNA, 16 nt, Human
aauuucaaaaauauaa

SEQ ID NO: 3419029 - RNA, 17 nt, Human
aauuucaaaaauauaac

SEQ ID NO: 3419030 - RNA, 17 nt, Human
aauuucaagcuuauuuu

SEQ ID NO: 3419031 - RNA, 22 nt, Human
aauuucaagcuuauuuuggaga

SEQ ID NO: 3419032 - RNA, 17 nt, Human
aauuucaagguucuaac

SEQ ID NO: 3419033 - RNA, 14 nt, Human
aauuucacauuaau

SEQ ID NO: 3419034 - RNA, 16 nt, Human
aauuucaccuguaaac

SEQ ID NO: 3419035 - RNA, 22 nt, Human
aauuucacuacuagauugacua

SEQ ID NO: 3419036 - RNA, 16 nt, Human
aauuucacuuauaccu

SEQ ID NO: 3419037 - RNA, 13 nt, Human
aauuucagacucc

SEQ ID NO: 3419038 - RNA, 19 nt, Human
aauuucaggcuccccagau

SEQ ID NO: 3419039 - RNA, 17 nt, Human
aauuucagguuguuggu

SEQ ID NO: 3419040 - RNA, 16 nt, Human
aauuucaguaagauca

SEQ ID NO: 3419041 - RNA, 13 nt, Human
aauuucaguguaa

SEQ ID NO: 3419042 - RNA, 19 nt, Human
aauuucaguguaaagugug

SEQ ID NO: 3419043 - RNA, 13 nt, Human
aaguacuauguau

SEQ ID NO: 3419044 - RNA, 15 nt, Human
aaguacuauguauca

SEQ ID NO: 3419045 - RNA, 14 nt, Human
aaguacucuggagc

SEQ ID NO: 3419046 - RNA, 23 nt, Human
aaguacugagcagugauauucuu

SEQ ID NO: 3419047 - RNA, 23 nt, Human
aaguacugcuguaaauaaaugcu

SEQ ID NO: 3419048 - RNA, 15 nt, Human
aaguacuggagaaaa

SEQ ID NO: 3419049 - RNA, 20 nt, Human
aaguacugguaagauuguua

SEQ ID NO: 3419050 - RNA, 17 nt, Human
acaaggaaggugguggg

SEQ ID NO: 3419051 - RNA, 16 nt, Human
acaaggauagaugcug

SEQ ID NO: 3419052 - RNA, 17 nt, Human
acaaggauagaugcugg

SEQ ID NO: 3419053 - RNA, 18 nt, Human
acaaggauagaugcuggc

SEQ ID NO: 3419054 - RNA, 20 nt, Human
acaaggaugaucuaggaaga

SEQ ID NO: 3419055 - RNA, 13 nt, Human
acaaggauugaaa

SEQ ID NO: 3419056 - RNA, 15 nt, Human
acaaggauugaaaau

SEQ ID NO: 3419057 - RNA, 17 nt, Human
acaaggcaaaaacaaag

SEQ ID NO: 3419058 - RNA, 17 nt, Human
acaaggcaaggcuguca

SEQ ID NO: 3419059 - RNA, 19 nt, Human
acaaggcaaggcugucaau

SEQ ID NO: 3419060 - RNA, 15 nt, Human
acaaggcagcaaggc

SEQ ID NO: 3419061 - RNA, 21 nt, Human
acaaggcagcaaggcccgagc

SEQ ID NO: 3419062 - RNA, 13 nt, Human
acaaggccccaga

SEQ ID NO: 3419063 - RNA, 17 nt, Human
acaaggcuugcugcaga

SEQ ID NO: 3419064 - RNA, 23 nt, Human
acaagggaaaauaaaaaaagaaa

SEQ ID NO: 3419065 - RNA, 21 nt, Human
acaagggcugaccugccucuc

SEQ ID NO: 3419066 - RNA, 22 nt, Human
acaaggggcccuuggagcgugg

SEQ ID NO: 3419067 - RNA, 18 nt, Human
acaagggucuagggagag

SEQ ID NO: 3419068 - RNA, 19 nt, Human
acaagggucuagggagaga

SEQ ID NO: 3419069 - RNA, 20 nt, Human
acaagggucuagggagagac

SEQ ID NO: 3419070 - RNA, 18 nt, Human
acaaggguggcaucccag

SEQ ID NO: 3419071 - RNA, 22 nt, Human
acaagguagcccuggccagagg

SEQ ID NO: 3419072 - RNA, 14 nt, Human
acaagguaguuuuu

SEQ ID NO: 3419073 - RNA, 16 nt, Human
acaagguaguuuuuac

SEQ ID NO: 3419074 - RNA, 18 nt, Human
acaagguauaauaaaauu

SEQ ID NO: 3419075 - RNA, 15 nt, Human
acaaggucauggcca

SEQ ID NO: 3419076 - RNA, 23 nt, Human
acaaggucauggccacacuguga

SEQ ID NO: 3419077 - RNA, 20 nt, Human
acaagguucccucugagaau

SEQ ID NO: 3419078 - RNA, 22 nt, Human
acaagguucuucccuuuuacau

SEQ ID NO: 3419079 - RNA, 16 nt, Human
acaaguaaaacugugg

SEQ ID NO: 3419080 - RNA, 13 nt, Human
acaaguaacaaaa

SEQ ID NO: 3419081 - RNA, 15 nt, Human
acaaguaagagacuc

SEQ ID NO: 3419082 - RNA, 22 nt, Human
acaaguaccaaaguuuuaucaa

SEQ ID NO: 3419083 - RNA, 16 nt, Human
acaaguaguucuguau

SEQ ID NO: 3419084 - RNA, 17 nt, Human
acaaguaguucuguauu

SEQ ID NO: 3419085 - RNA, 21 nt, Human
acaaguaugaauaaagacacc

SEQ ID NO: 3419086 - RNA, 20 nt, Human
acaaguauuuguuaauuuag

SEQ ID NO: 3419087 - RNA, 20 nt, Human
acaagucagucauucagaua

SEQ ID NO: 3419088 - RNA, 23 nt, Human
acaagucauagguuaauauuuaa

SEQ ID NO: 3419089 - RNA, 21 nt, Human
acaagucauuuuaacuuuauc

SEQ ID NO: 3419090 - RNA, 16 nt, Human
acaaguccugugaauu

SEQ ID NO: 3419091 - RNA, 17 nt, Human
acaaguccugugaauuu

SEQ ID NO: 3419092 - RNA, 19 nt, Human
acaaguccugugaauuucu

SEQ ID NO: 3419093 - RNA, 13 nt, Human
acaagucuuccag

SEQ ID NO: 3419094 - RNA, 18 nt, Human
acaagugaaaaacaucca

SEQ ID NO: 3419095 - RNA, 16 nt, Human
aaguuguacaugaaau

SEQ ID NO: 3419096 - RNA, 21 nt, Human
aaguuguacuccaauggcuga

SEQ ID NO: 3419097 - RNA, 15 nt, Human
aaguuguacuuuaaa

SEQ ID NO: 3419098 - RNA, 18 nt, Human
aaguuguacuuuaaaaau

SEQ ID NO: 3419099 - RNA, 16 nt, Human
aaguuguagcagauug

SEQ ID NO: 3419100 - RNA, 16 nt, Human
aaguuguggauuucag

SEQ ID NO: 3419101 - RNA, 20 nt, Human
aaguuguggugcugacaaag

SEQ ID NO: 3419102 - RNA, 15 nt, Human
aaguuguuaauaaaa

SEQ ID NO: 3419103 - RNA, 21 nt, Human
aaguuguuacuaacuaaacuc

SEQ ID NO: 3419104 - RNA, 18 nt, Human
aaguuguuguaaccugcu

SEQ ID NO: 3419105 - RNA, 22 nt, Human
aaguuguuugagaaauuaagua

SEQ ID NO: 3419106 - RNA, 18 nt, Human
aaguuuaaaacaguauuu

SEQ ID NO: 3419107 - RNA, 14 nt, Human
aaguuuaaggaaua

SEQ ID NO: 3419108 - RNA, 15 nt, Human
aaguuuaaggaauau

SEQ ID NO: 3419109 - RNA, 14 nt, Human
aaguuuaauaaauu

SEQ ID NO: 3419110 - RNA, 18 nt, Human
aaguuuacaaucaaagga

SEQ ID NO: 3419111 - RNA, 19 nt, Human
aaguuuacaaucaaaggaa

SEQ ID NO: 3419112 - RNA, 21 nt, Human
aaguuuacaguaaauaaauug

SEQ ID NO: 3419113 - RNA, 22 nt, Human
aaguuuacaguaaauaaauugu

SEQ ID NO: 3419114 - RNA, 16 nt, Human
aaguuuaccagaaagc

SEQ ID NO: 3419115 - RNA, 14 nt, Human
aaguuuaccaucug

SEQ ID NO: 3419116 - RNA, 23 nt, Human
aaguuuagccccugaaagccaug

SEQ ID NO: 3419117 - RNA, 16 nt, Human
aaguuuagcucugaga

SEQ ID NO: 3419118 - RNA, 22 nt, Human
aaguuuaguuugaggaauucuu

SEQ ID NO: 3419119 - RNA, 15 nt, Human
aaguuuauacaguac

SEQ ID NO: 3419120 - RNA, 16 nt, Human
aaguuucaaaaaucug

SEQ ID NO: 3419121 - RNA, 19 nt, Human
aaguuucaaguuuuaaagu

SEQ ID NO: 3419122 - RNA, 20 nt, Human
aaguuucaaguuuuaaaguu

SEQ ID NO: 3419123 - RNA, 14 nt, Human
aaguuucaggugac

SEQ ID NO: 3419124 - RNA, 16 nt, Human
aaguuucaggugacau

SEQ ID NO: 3419125 - RNA, 17 nt, Human
aaguuucaggugacaug

SEQ ID NO: 3419126 - RNA, 16 nt, Human
aaguuucaguugauuu

SEQ ID NO: 3419127 - RNA, 23 nt, Human
aaguuucauucucccuuucacua

SEQ ID NO: 3419128 - RNA, 20 nt, Human
aaguuuccaagcaaauguua

SEQ ID NO: 3419129 - RNA, 22 nt, Human
aaguuuccaagcaaauguuaca

SEQ ID NO: 3419130 - RNA, 20 nt, Human
aaguuuccauagcaacagga

SEQ ID NO: 3419131 - RNA, 16 nt, Human
aaguuuccaucaucua

SEQ ID NO: 3419132 - RNA, 16 nt, Human
aaguuuccuuggcugg

SEQ ID NO: 3419133 - RNA, 18 nt, Human
aaguuuccuuggcuggug

SEQ ID NO: 3419134 - RNA, 13 nt, Human
aaguuucuaagau

SEQ ID NO: 3419135 - RNA, 15 nt, Human
aaguuucuaagauuc

SEQ ID NO: 3419136 - RNA, 19 nt, Human
aaguuucuaagauucuaaa

SEQ ID NO: 3419137 - RNA, 17 nt, Human
aaguuucucagcuccca

SEQ ID NO: 3419138 - RNA, 15 nt, Human
aaguuucucugcaga

SEQ ID NO: 3419139 - RNA, 20 nt, Human
aaguuugaaaagcaauauug

SEQ ID NO: 3419140 - RNA, 16 nt, Human
aaguuugaauguuaaa

SEQ ID NO: 3419141 - RNA, 21 nt, Human
aaguuugaauuccuaaaauua

SEQ ID NO: 3419142 - RNA, 21 nt, Human
aaguuugauaaauaguguuau

SEQ ID NO: 3419143 - RNA, 23 nt, Human
aaguuugaucuuccucugcuaaa

SEQ ID NO: 3419144 - RNA, 16 nt, Human
aaguuugauuucauua

SEQ ID NO: 3419145 - RNA, 20 nt, Human
aaguuugcacuaucuuucag

SEQ ID NO: 3419146 - RNA, 20 nt, Human
aaguuugccuuuguaccaua

SEQ ID NO: 3419147 - RNA, 16 nt, Human
aaguuugcuuagaaaa

SEQ ID NO: 3419148 - RNA, 15 nt, Human
aaguuugcuuguuuc

SEQ ID NO: 3419149 - RNA, 16 nt, Human
aaguuugcuuguuucu

SEQ ID NO: 3419150 - RNA, 15 nt, Human
aaguuuguguucugu

SEQ ID NO: 3419151 - RNA, 19 nt, Human
aaguuuguguucuguuugu

SEQ ID NO: 3419152 - RNA, 19 nt, Human
aaguuuuaaaaagccaguu

SEQ ID NO: 3419153 - RNA, 23 nt, Human
aaguuuuauauauuauauggaaa

SEQ ID NO: 3419154 - RNA, 13 nt, Human
aaguuuuaucaag

SEQ ID NO: 3419155 - RNA, 15 nt, Human
aaguuuugaaaagcu

SEQ ID NO: 3419156 - RNA, 15 nt, Human
aaguuuugacaagcu

SEQ ID NO: 3419157 - RNA, 19 nt, Human
aaguuuugacaagcuggcu

SEQ ID NO: 3419158 - RNA, 13 nt, Human
aaguuuugagaaa

SEQ ID NO: 3419159 - RNA, 20 nt, Human
aaguuuugaguagauauuac

SEQ ID NO: 3419160 - RNA, 13 nt, Human
aaguuuuguaaaa

SEQ ID NO: 3419161 - RNA, 15 nt, Human
aaguuuuguaaauuu

SEQ ID NO: 3419162 - RNA, 16 nt, Human
aaguuuugugaaauuu

SEQ ID NO: 3419163 - RNA, 20 nt, Human
aaguuuugugaaauuuuuca

SEQ ID NO: 3419164 - RNA, 22 nt, Human
aaguuuuguucuguccuggaau

SEQ ID NO: 3419165 - RNA, 22 nt, Human
aaguuuuguuguacuuaaaugg

SEQ ID NO: 3419166 - RNA, 13 nt, Human
aaguuuuuguacu

SEQ ID NO: 3419167 - RNA, 15 nt, Human
aaguuuuuguuugga

SEQ ID NO: 3419168 - RNA, 20 nt, Human
aauaaaaaaaagaaaugaaa

SEQ ID NO: 3419169 - RNA, 15 nt, Human
aauaaaaaagucucu

SEQ ID NO: 3419170 - RNA, 23 nt, Human
aauaaaaacauugccuuugaaug

SEQ ID NO: 3419171 - RNA, 22 nt, Human
aauaaaaaccaagaagaugucu

SEQ ID NO: 3419172 - RNA, 21 nt, Human
aauaaaaacccacaaaaaugu

SEQ ID NO: 3419173 - RNA, 21 nt, Human
aauaaaaacugacuccuuaga

SEQ ID NO: 3419174 - RNA, 17 nt, Human
aauaaaaagaucacuuu

SEQ ID NO: 3419175 - RNA, 11 nt, Human
aauaaaaaggc

SEQ ID NO: 3419176 - RNA, 18 nt, Human
aauaaaaaggcaccuaua

SEQ ID NO: 3419177 - RNA, 19 nt, Human
aauaaaaagugacacagca

SEQ ID NO: 3419178 - RNA, 20 nt, Human
aauaaaaagugacacagcag

SEQ ID NO: 3419179 - RNA, 13 nt, Human
aauaaaaaguuaa

SEQ ID NO: 3419180 - RNA, 14 nt, Human
aauaaaaaguuaaa

SEQ ID NO: 3419181 - RNA, 11 nt, Human
aauaaaaauau

SEQ ID NO: 3419182 - RNA, 15 nt, Human
aauaaaaauauauuu

SEQ ID NO: 3419183 - RNA, 20 nt, Human
aauaaaaauauauuuucaac

SEQ ID NO: 3419184 - RNA, 13 nt, Human
aauaaaaauucua

SEQ ID NO: 3419185 - RNA, 16 nt, Human
aauaaaaauucuagau

SEQ ID NO: 3419186 - RNA, 12 nt, Human
aauaaaacauuu

SEQ ID NO: 3419187 - RNA, 13 nt, Human
aauaaaacauuuu

SEQ ID NO: 3419188 - RNA, 13 nt, Human
aauaaaaccuuuc

SEQ ID NO: 3419189 - RNA, 14 nt, Human
aauaaaaccuuuca

SEQ ID NO: 3419190 - RNA, 22 nt, Human
aauaaaaccuuucaaauuucac

SEQ ID NO: 3419191 - RNA, 15 nt, Human
aauaaaacuuuuuaa

SEQ ID NO: 3419192 - RNA, 13 nt, Human
aauaaaagaaaau

SEQ ID NO: 3419193 - RNA, 18 nt, Human
aauaaaagcagcaucugc

SEQ ID NO: 3419194 - RNA, 17 nt, Human
aauuaauuggcagcaga

SEQ ID NO: 3419195 - RNA, 13 nt, Human
aauuaauugugug

SEQ ID NO: 3419196 - RNA, 13 nt, Human
aauuaauuucagu

SEQ ID NO: 3419197 - RNA, 13 nt, Human
aauuaauuugauu

SEQ ID NO: 3419198 - RNA, 22 nt, Human
aauuaauuugauuaacaaauau

SEQ ID NO: 3419199 - RNA, 13 nt, Human
aauuaauuuuacu

SEQ ID NO: 3419200 - RNA, 21 nt, Human
aauuaauuuuuuuauuguuua

SEQ ID NO: 3419201 - RNA, 22 nt, Human
aauuaauuuuuuuauuguuuaa

SEQ ID NO: 3419202 - RNA, 14 nt, Human
aauuacaauuguca

SEQ ID NO: 3419203 - RNA, 14 nt, Human
aauuacacccaaag

SEQ ID NO: 3419204 - RNA, 22 nt, Human
aauuacagaaauuuaauucaga

SEQ ID NO: 3419205 - RNA, 17 nt, Human
aauuacaggaaguacug

SEQ ID NO: 3419206 - RNA, 19 nt, Human
aauuacaggaaguacugga

SEQ ID NO: 3419207 - RNA, 19 nt, Human
aauuacagugccuaaaaua

SEQ ID NO: 3419208 - RNA, 14 nt, Human
aauuacauaauuuu

SEQ ID NO: 3419209 - RNA, 19 nt, Human
aauuacauuacugaaaacu

SEQ ID NO: 3419210 - RNA, 22 nt, Human
aauuacauuacugaaaacuuca

SEQ ID NO: 3419211 - RNA, 12 nt, Human
aauuacauuugu

SEQ ID NO: 3419212 - RNA, 15 nt, Human
aauuacauuuguaau

SEQ ID NO: 3419213 - RNA, 21 nt, Human
aauuaccacaccaucucccau

SEQ ID NO: 3419214 - RNA, 20 nt, Human
aauuaccaguaaaguguaac

SEQ ID NO: 3419215 - RNA, 21 nt, Human
aauuaccaugcuucacaaugu

SEQ ID NO: 3419216 - RNA, 18 nt, Human
aauuaccauuuguuaaua

SEQ ID NO: 3419217 - RNA, 14 nt, Human
aauuaccuguggau

SEQ ID NO: 3419218 - RNA, 21 nt, Human
aauuaccuuagauuagcucug

SEQ ID NO: 3419219 - RNA, 14 nt, Human
aauuaccuucuauu

SEQ ID NO: 3419220 - RNA, 17 nt, Human
aauuacgauaaggaaga

SEQ ID NO: 3419221 - RNA, 18 nt, Human
aauuacgauaaggaagaa

SEQ ID NO: 3419222 - RNA, 18 nt, Human
aauuacuaacuucuaaaa

SEQ ID NO: 3419223 - RNA, 19 nt, Human
aauuacucagcagaauggu

SEQ ID NO: 3419224 - RNA, 14 nt, Human
aauuacugguccaa

SEQ ID NO: 3419225 - RNA, 20 nt, Human
aauuacuuacguauguuugu

SEQ ID NO: 3419226 - RNA, 21 nt, Human
aauuacuuaucccugcccauu

SEQ ID NO: 3419227 - RNA, 22 nt, Human
aauuacuuuggggcuaauuuaa

SEQ ID NO: 3419228 - RNA, 13 nt, Human
aauuagaagacau

SEQ ID NO: 3419229 - RNA, 23 nt, Human
aauuagacugugauucagaaaau

SEQ ID NO: 3419230 - RNA, 14 nt, Human
aauuagagaaauau

SEQ ID NO: 3419231 - RNA, 17 nt, Human
aauuagauccauuaauu

SEQ ID NO: 3419232 - RNA, 21 nt, Human
aauuagauccauuaauuuaaa

SEQ ID NO: 3419233 - RNA, 23 nt, Human
aauuagauccauuaauuuaaaug

SEQ ID NO: 3419234 - RNA, 22 nt, Human
aauuagaugcauguugaccaug

SEQ ID NO: 3419235 - RNA, 13 nt, Human
aauuagauuuuaa

SEQ ID NO: 3419236 - RNA, 12 nt, Human
aauuagcaauug

SEQ ID NO: 3419237 - RNA, 12 nt, Human
aauuagccagua

SEQ ID NO: 3419238 - RNA, 18 nt, Human
aauuagccaguaauccug

SEQ ID NO: 3419239 - RNA, 14 nt, Human
aauuagccgggcgu

SEQ ID NO: 3419240 - RNA, 14 nt, Human
aauuagcugcuucu

SEQ ID NO: 3419241 - RNA, 22 nt, Human
aauuagcuuuuucauccccuua

SEQ ID NO: 3419242 - RNA, 13 nt, Human
aauuaggaaaaaa

SEQ ID NO: 3419243 - RNA, 17 nt, Human
aauuaggaagugauuau

SEQ ID NO: 3419244 - RNA, 20 nt, Human
aauuaggaauaaauaaaaau

SEQ ID NO: 3419245 - RNA, 21 nt, Human
aauuaggaggcucaacaauaa

SEQ ID NO: 3419246 - RNA, 15 nt, Human
aauuaggcuguaacu

SEQ ID NO: 3419247 - RNA, 16 nt, Human
aauuaggcuguaacua

SEQ ID NO: 3419248 - RNA, 21 nt, Human
aauuaggguacauuuauaauu

SEQ ID NO: 3419249 - RNA, 14 nt, Human
aauuagguuaacau

SEQ ID NO: 3419250 - RNA, 15 nt, Human
aauuagguuaacauu

SEQ ID NO: 3419251 - RNA, 18 nt, Human
aauuagguugaaacauau

SEQ ID NO: 3419252 - RNA, 17 nt, Human
aauuagguuuuguacaa

SEQ ID NO: 3419253 - RNA, 13 nt, Human
aauuaguaacauu

SEQ ID NO: 3419254 - RNA, 21 nt, Human
aauuaguaggcucauuuacug

SEQ ID NO: 3419255 - RNA, 20 nt, Human
acaagugacuguaucugugu

SEQ ID NO: 3419256 - RNA, 19 nt, Human
acaagugagacaaaaagca

SEQ ID NO: 3419257 - RNA, 22 nt, Human
acaagugaguuguugcccuggg

SEQ ID NO: 3419258 - RNA, 12 nt, Human
acaagugccacu

SEQ ID NO: 3419259 - RNA, 17 nt, Human
acaagugccgcaaauug

SEQ ID NO: 3419260 - RNA, 14 nt, Human
acaagugcugaaca

SEQ ID NO: 3419261 - RNA, 19 nt, Human
acaaguggacucagggcag

SEQ ID NO: 3419262 - RNA, 19 nt, Human
acaaguguauaucagaaaa

SEQ ID NO: 3419263 - RNA, 19 nt, Human
acaaguuaagauucuuggu

SEQ ID NO: 3419264 - RNA, 16 nt, Human
acaaguuauuuaaauc

SEQ ID NO: 3419265 - RNA, 17 nt, Human
acaaguuauuuaaaucu

SEQ ID NO: 3419266 - RNA, 22 nt, Human
acaaguucgagucaaaguugaa

SEQ ID NO: 3419267 - RNA, 17 nt, Human
acaaguugcgacggaga

SEQ ID NO: 3419268 - RNA, 22 nt, Human
acaaguuuuucugucaagaaga

SEQ ID NO: 3419269 - RNA, 20 nt, Human
acaauaaaauuuuuuuucau

SEQ ID NO: 3419270 - RNA, 22 nt, Human
acaauaaaauuuuuuuucaugu

SEQ ID NO: 3419271 - RNA, 15 nt, Human
acaauaaacccucag

SEQ ID NO: 3419272 - RNA, 20 nt, Human
acaauaaacccucagagccu

SEQ ID NO: 3419273 - RNA, 10 nt, Human
acaauaaacu

SEQ ID NO: 3419274 - RNA, 16 nt, Human
acaauaaauggcugua

SEQ ID NO: 3419275 - RNA, 13 nt, Human
acaauaaauguau

SEQ ID NO: 3419276 - RNA, 18 nt, Human
acaauaaauguauucaaa

SEQ ID NO: 3419277 - RNA, 15 nt, Human
acaauaaaugugcuu

SEQ ID NO: 3419278 - RNA, 16 nt, Human
acaauaacuacugugu

SEQ ID NO: 3419279 - RNA, 18 nt, Human
acaauaacuacuguguuc

SEQ ID NO: 3419280 - RNA, 16 nt, Human
acaauaacuccuccca

SEQ ID NO: 3419281 - RNA, 19 nt, Human
acaauaacuccucccaggg

SEQ ID NO: 3419282 - RNA, 16 nt, Human
acaauaagcaaaaaca

SEQ ID NO: 3419283 - RNA, 23 nt, Human
acaauaauauuguuguauaauuu

SEQ ID NO: 3419284 - RNA, 12 nt, Human
acaauaauuuca

SEQ ID NO: 3419285 - RNA, 12 nt, Human
acaauacaaaug

SEQ ID NO: 3419286 - RNA, 16 nt, Human
acaauacaaauggauu

SEQ ID NO: 3419287 - RNA, 13 nt, Human
acaauacaucuga

SEQ ID NO: 3419288 - RNA, 10 nt, Human
acaauaccug

SEQ ID NO: 3419289 - RNA, 14 nt, Human
acaauaccuuauuu

SEQ ID NO: 3419290 - RNA, 19 nt, Human
acaauagccgauaucagaa

SEQ ID NO: 3419291 - RNA, 19 nt, Human
acaauagcuuuacccucag

SEQ ID NO: 3419292 - RNA, 16 nt, Human
acaauagguaaagcua

SEQ ID NO: 3419293 - RNA, 19 nt, Human
acaauauaaaacuguacuu

SEQ ID NO: 3419294 - RNA, 21 nt, Human
acaauauaaccacaaagcaca

SEQ ID NO: 3419295 - RNA, 21 nt, Human
acaauauaagagcuuccaauu

SEQ ID NO: 3419296 - RNA, 15 nt, Human
acaauauauaaaaau

SEQ ID NO: 3419297 - RNA, 15 nt, Human
acaauaucauaucau

SEQ ID NO: 3419298 - RNA, 14 nt, Human
acaauaugugccaa

SEQ ID NO: 3419299 - RNA, 20 nt, Human
acaauaugugccaaucaaua

SEQ ID NO: 3419300 - RNA, 17 nt, Human
acaauauuccagaucuu

SEQ ID NO: 3419301 - RNA, 15 nt, Human
acaauauugacuuug

SEQ ID NO: 3419302 - RNA, 14 nt, Human
acaauauuuaaaau

SEQ ID NO: 3419303 - RNA, 18 nt, Human
acaauauuuaaaauuuau

SEQ ID NO: 3419304 - RNA, 15 nt, Human
acaauauuuauaaag

SEQ ID NO: 3419305 - RNA, 16 nt, Human
acaauauuuauuguau

SEQ ID NO: 3419306 - RNA, 14 nt, Human
acaauauuugugug

SEQ ID NO: 3419307 - RNA, 19 nt, Human
acaaucagccacauucuag

SEQ ID NO: 3419308 - RNA, 22 nt, Human
acaaucagcuccuuccuggaga

SEQ ID NO: 3419309 - RNA, 15 nt, Human
acaaucaguccccuc

SEQ ID NO: 3419310 - RNA, 22 nt, Human
acaaucaguccccucccaucug

SEQ ID NO: 3419311 - RNA, 17 nt, Human
acaaucaguuauacagu

SEQ ID NO: 3419312 - RNA, 13 nt, Human
acaaucauguaca

SEQ ID NO: 3419313 - RNA, 14 nt, Human
acaaucauugcuga

SEQ ID NO: 3419314 - RNA, 16 nt, Human
acaaucauuguuuuga

SEQ ID NO: 3419315 - RNA, 18 nt, Human
acaaucauuugcuuuuug

SEQ ID NO: 3419316 - RNA, 19 nt, Human
acaauccacgcuucuccgg

SEQ ID NO: 3419317 - RNA, 15 nt, Human
acaauccuagugcuu

SEQ ID NO: 3419318 - RNA, 16 nt, Human
acaauccuagugcuuu

SEQ ID NO: 3419319 - RNA, 16 nt, Human
acaaucgauggccuug

SEQ ID NO: 3419320 - RNA, 18 nt, Human
acaaucucggcucacugc

SEQ ID NO: 3419321 - RNA, 20 nt, Human
acaaucucggcucacugcau

SEQ ID NO: 3419322 - RNA, 19 nt, Human
acaaucucuuuuuguuugc

SEQ ID NO: 3419323 - RNA, 18 nt, Human
acaaucugacauucucag

SEQ ID NO: 3419324 - RNA, 18 nt, Human
acaaucuggaagaaaaaa

SEQ ID NO: 3419325 - RNA, 18 nt, Human
acaaugaaaacucuuugc

SEQ ID NO: 3419326 - RNA, 16 nt, Human
acaaugaacacuuaua

SEQ ID NO: 3419327 - RNA, 20 nt, Human
acaaugaaguugaaaaucau

SEQ ID NO: 3419328 - RNA, 23 nt, Human
acaaugaauaaaaacucaaggag

SEQ ID NO: 3419329 - RNA, 15 nt, Human
acaaugacaaagcag

SEQ ID NO: 3419330 - RNA, 20 nt, Human
acaaugacuuacuguacaug

SEQ ID NO: 3419331 - RNA, 15 nt, Human
acaaugauauaugga

SEQ ID NO: 3419332 - RNA, 21 nt, Human
acaaugaugaugauaaugaug

SEQ ID NO: 3419333 - RNA, 16 nt, Human
acaaugcaaaccauca

SEQ ID NO: 3419334 - RNA, 17 nt, Human
acaaugcaaaccaucau

SEQ ID NO: 3419335 - RNA, 18 nt, Human
acaaugcaaaccaucauu

SEQ ID NO: 3419336 - RNA, 19 nt, Human
acaaugcaaaccaucauug

SEQ ID NO: 3419337 - RNA, 19 nt, Human
acaaugcagaugccagagc

SEQ ID NO: 3419338 - RNA, 13 nt, Human
acaaugcagcaag

SEQ ID NO: 3419339 - RNA, 18 nt, Human
aauuauuauuuguguuuu

SEQ ID NO: 3419340 - RNA, 13 nt, Human
aauuauugacacu

SEQ ID NO: 3419341 - RNA, 16 nt, Human
aauuauugacacugaa

SEQ ID NO: 3419342 - RNA, 17 nt, Human
aauuauugacacugaac

SEQ ID NO: 3419343 - RNA, 14 nt, Human
aauuauugauauau

SEQ ID NO: 3419344 - RNA, 15 nt, Human
aauuauugauauaua

SEQ ID NO: 3419345 - RNA, 16 nt, Human
aauuauugaugaaaau

SEQ ID NO: 3419346 - RNA, 21 nt, Human
aauuauuguacauuuauaguu

SEQ ID NO: 3419347 - RNA, 16 nt, Human
aauuauugugauuucc

SEQ ID NO: 3419348 - RNA, 16 nt, Human
aauuauuguuuuucuu

SEQ ID NO: 3419349 - RNA, 12 nt, Human
aauuauuucaga

SEQ ID NO: 3419350 - RNA, 13 nt, Human
aauuauuucagaa

SEQ ID NO: 3419351 - RNA, 20 nt, Human
aauuauuugauuauuuaaga

SEQ ID NO: 3419352 - RNA, 15 nt, Human
aauuauuuguguaau

SEQ ID NO: 3419353 - RNA, 21 nt, Human
aauuauuuguguaauagaaaa

SEQ ID NO: 3419354 - RNA, 12 nt, Human
aauuauuuuaaa

SEQ ID NO: 3419355 - RNA, 14 nt, Human
aauuauuuuaaaca

SEQ ID NO: 3419356 - RNA, 17 nt, Human
aauuauuuuaaauuaua

SEQ ID NO: 3419357 - RNA, 21 nt, Human
aauuauuuuaaauuauaagga

SEQ ID NO: 3419358 - RNA, 22 nt, Human
aauuauuuuaaauuauaaggac

SEQ ID NO: 3419359 - RNA, 12 nt, Human
aauuauuuuaau

SEQ ID NO: 3419360 - RNA, 16 nt, Human
aauuauuuuaauuagg

SEQ ID NO: 3419361 - RNA, 18 nt, Human
aauuauuuuguucauaca

SEQ ID NO: 3419362 - RNA, 19 nt, Human
aauuauuuuguucauacau

SEQ ID NO: 3419363 - RNA, 21 nt, Human
aauuauuuuguucauacauau

SEQ ID NO: 3419364 - RNA, 16 nt, Human
aauucaaaaaguguuu

SEQ ID NO: 3419365 - RNA, 16 nt, Human
aauucaaaccuaaguu

SEQ ID NO: 3419366 - RNA, 20 nt, Human
aauucaaacuggggccucca

SEQ ID NO: 3419367 - RNA, 14 nt, Human
aauucaaagaauca

SEQ ID NO: 3419368 - RNA, 14 nt, Human
aauucaaagcucua

SEQ ID NO: 3419369 - RNA, 14 nt, Human
aauucaacccuuug

SEQ ID NO: 3419370 - RNA, 18 nt, Human
aauucaacccuuugcccc

SEQ ID NO: 3419371 - RNA, 18 nt, Human
aauucaacguuaauaauu

SEQ ID NO: 3419372 - RNA, 14 nt, Human
aauucaacuuugua

SEQ ID NO: 3419373 - RNA, 12 nt, Human
aauucaagaaaa

SEQ ID NO: 3419374 - RNA, 18 nt, Human
aauucaauaguaauauaa

SEQ ID NO: 3419375 - RNA, 13 nt, Human
aauucaauucaaa

SEQ ID NO: 3419376 - RNA, 17 nt, Human
aauucaauuuuaaagac

SEQ ID NO: 3419377 - RNA, 15 nt, Human
aauucacaaaguuaa

SEQ ID NO: 3419378 - RNA, 20 nt, Human
aauucacagugcucuuuucu

SEQ ID NO: 3419379 - RNA, 14 nt, Human
aauucaccaaagua

SEQ ID NO: 3419380 - RNA, 17 nt, Human
aauucaccacagacuuu

SEQ ID NO: 3419381 - RNA, 13 nt, Human
aauucacucccac

SEQ ID NO: 3419382 - RNA, 21 nt, Human
aauucagaaggaucuucaucu

SEQ ID NO: 3419383 - RNA, 22 nt, Human
aauucagacaucugagguuuua

SEQ ID NO: 3419384 - RNA, 20 nt, Human
aauucagauauauuuuucac

SEQ ID NO: 3419385 - RNA, 15 nt, Human
aauucagcacugauu

SEQ ID NO: 3419386 - RNA, 18 nt, Human
aauucagccauguacaga

SEQ ID NO: 3419387 - RNA, 13 nt, Human
aauucagcugccc

SEQ ID NO: 3419388 - RNA, 15 nt, Human
aauucaguuucauaa

SEQ ID NO: 3419389 - RNA, 16 nt, Human
aauucaguuucauaaa

SEQ ID NO: 3419390 - RNA, 14 nt, Human
aauucaguuuuuuu

SEQ ID NO: 3419391 - RNA, 17 nt, Human
aauucauaaucacucua

SEQ ID NO: 3419392 - RNA, 18 nt, Human
aauucauaguaagauuga

SEQ ID NO: 3419393 - RNA, 15 nt, Human
aauucauaucuauuu

SEQ ID NO: 3419394 - RNA, 11 nt, Human
aauucaugaac

SEQ ID NO: 3419395 - RNA, 22 nt, Human
aauucauggcaugcuuaaauuu

SEQ ID NO: 3419396 - RNA, 14 nt, Human
aauucauguuucuu

SEQ ID NO: 3419397 - RNA, 16 nt, Human
aauucauucauacuua

SEQ ID NO: 3419398 - RNA, 15 nt, Human
aauucauuucacauu

SEQ ID NO: 3419399 - RNA, 14 nt, Human
aauuccaaacaugg

SEQ ID NO: 3419400 - RNA, 12 nt, Human
aauuccaaaguc

SEQ ID NO: 3419401 - RNA, 20 nt, Human
aauuccaacaguuuaaugaa

SEQ ID NO: 3419402 - RNA, 14 nt, Human
aauuccacagcugc

SEQ ID NO: 3419403 - RNA, 13 nt, Human
aauuccacucaaa

SEQ ID NO: 3419404 - RNA, 21 nt, Human
aauuccacuggacuugagcuu

SEQ ID NO: 3419405 - RNA, 19 nt, Human
aauuccauaugcuguuuca

SEQ ID NO: 3419406 - RNA, 18 nt, Human
aauuccaugaaucgcuuc

SEQ ID NO: 3419407 - RNA, 16 nt, Human
aauuccaugaauguuc

SEQ ID NO: 3419408 - RNA, 21 nt, Human
aauuccauuugaggauuuaga

SEQ ID NO: 3419409 - RNA, 17 nt, Human
aauucccaacaaacauu

SEQ ID NO: 3419410 - RNA, 17 nt, Human
aauucccauuuugcaaa

SEQ ID NO: 3419411 - RNA, 21 nt, Human
aauucccauuuugcaaaauuu

SEQ ID NO: 3419412 - RNA, 21 nt, Human
aauucccguuuugucacuuuu

SEQ ID NO: 3419413 - RNA, 14 nt, Human
aauucccuaaagcc

SEQ ID NO: 3419414 - RNA, 10 nt, Human
aauucccuau

SEQ ID NO: 3419415 - RNA, 23 nt, Human
aauucccuaucuuuuaguuuuag

SEQ ID NO: 3419416 - RNA, 21 nt, Human
aauucccucucucugacucuc

SEQ ID NO: 3419417 - RNA, 22 nt, Human
acacaaagagaaaaagaaaugc

SEQ ID NO: 3419418 - RNA, 22 nt, Human
acacaaagagaguuaaucaacu

SEQ ID NO: 3419419 - RNA, 16 nt, Human
acacaaauuaugcuaa

SEQ ID NO: 3419420 - RNA, 21 nt, Human
acacaaauuaugcuaagaauu

SEQ ID NO: 3419421 - RNA, 22 nt, Human
acacaaauuaugcuaagaauuu

SEQ ID NO: 3419422 - RNA, 14 nt, Human
acacaacagccaac

SEQ ID NO: 3419423 - RNA, 18 nt, Human
acacaacuauuuuuccaa

SEQ ID NO: 3419424 - RNA, 13 nt, Human
acacaacucacuc

SEQ ID NO: 3419425 - RNA, 18 nt, Human
acacaagauugguguuuu

SEQ ID NO: 3419426 - RNA, 20 nt, Human
acacaagauugguguuuuuu

SEQ ID NO: 3419427 - RNA, 13 nt, Human
acacaagccacag

SEQ ID NO: 3419428 - RNA, 15 nt, Human
acacaagccacagaa

SEQ ID NO: 3419429 - RNA, 19 nt, Human
acacaagccacagaagcca

SEQ ID NO: 3419430 - RNA, 16 nt, Human
acacaaggucauggcc

SEQ ID NO: 3419431 - RNA, 14 nt, Human
acacaaguaaaacu

SEQ ID NO: 3419432 - RNA, 13 nt, Human
acacaaguaaaca

SEQ ID NO: 3419433 - RNA, 15 nt, Human
acacaaguaagagac

SEQ ID NO: 3419434 - RNA, 13 nt, Human
acacaagugcagu

SEQ ID NO: 3419435 - RNA, 14 nt, Human
acacaauaagcaaa

SEQ ID NO: 3419436 - RNA, 14 nt, Human
acacaauacaauaa

SEQ ID NO: 3419437 - RNA, 16 nt, Human
acacaaugguuuuuaa

SEQ ID NO: 3419438 - RNA, 17 nt, Human
acacaaugugucuuucu

SEQ ID NO: 3419439 - RNA, 15 nt, Human
acacaauuagauuuc

SEQ ID NO: 3419440 - RNA, 19 nt, Human
acacacaaaaaaugcacaa

SEQ ID NO: 3419441 - RNA, 22 nt, Human
acacacaaaauguacccaguau

SEQ ID NO: 3419442 - RNA, 14 nt, Human
acacacaaagagag

SEQ ID NO: 3419443 - RNA, 13 nt, Human
acacacaaagcag

SEQ ID NO: 3419444 - RNA, 15 nt, Human
acacacaacaaaaau

SEQ ID NO: 3419445 - RNA, 9 nt, Human
acacacaca

SEQ ID NO: 3419446 - RNA, 14 nt, Human
acacacacaaguaa

SEQ ID NO: 3419447 - RNA, 15 nt, Human
acacacacacacaca

SEQ ID NO: 3419448 - RNA, 14 nt, Human
acacacacacacag

SEQ ID NO: 3419449 - RNA, 15 nt, Human
acacacacacacagc

SEQ ID NO: 3419450 - RNA, 16 nt, Human
acacacacacacaugc

SEQ ID NO: 3419451 - RNA, 12 nt, Human
acacacacacag

SEQ ID NO: 3419452 - RNA, 12 nt, Human
acacacacacau

SEQ ID NO: 3419453 - RNA, 16 nt, Human
acacacacacgcacgc

SEQ ID NO: 3419454 - RNA, 14 nt, Human
acacacacagaaaa

SEQ ID NO: 3419455 - RNA, 13 nt, Human
acacacacagcca

SEQ ID NO: 3419456 - RNA, 11 nt, Human
acacacacauc

SEQ ID NO: 3419457 - RNA, 14 nt, Human
acacacacaugcac

SEQ ID NO: 3419458 - RNA, 14 nt, Human
acacacacaugcau

SEQ ID NO: 3419459 - RNA, 19 nt, Human
acacacacgcacgcacaca

SEQ ID NO: 3419460 - RNA, 13 nt, Human
acacacagaaaau

SEQ ID NO: 3419461 - RNA, 17 nt, Human
acacacagaaaauauac

SEQ ID NO: 3419462 - RNA, 22 nt, Human
acacacagaaaauauacuguaa

SEQ ID NO: 3419463 - RNA, 17 nt, Human
acacacagacucauauu

SEQ ID NO: 3419464 - RNA, 15 nt, Human
acacacagauacaca

SEQ ID NO: 3419465 - RNA, 19 nt, Human
acacacagauacacacaca

SEQ ID NO: 3419466 - RNA, 14 nt, Human
acacacagccacac

SEQ ID NO: 3419467 - RNA, 22 nt, Human
acacacagccacacacacagaa

SEQ ID NO: 3419468 - RNA, 17 nt, Human
acacacagcucuguccu

SEQ ID NO: 3419469 - RNA, 17 nt, Human
acacacaugcauacaca

SEQ ID NO: 3419470 - RNA, 19 nt, Human
acacacaugcauacacaca

SEQ ID NO: 3419471 - RNA, 20 nt, Human
acacacaugcauacacacac

SEQ ID NO: 3419472 - RNA, 23 nt, Human
acacacauugcugugaacaggaa

SEQ ID NO: 3419473 - RNA, 12 nt, Human
acacaccaggcu

SEQ ID NO: 3419474 - RNA, 21 nt, Human
acacaccuaagggacauguuu

SEQ ID NO: 3419475 - RNA, 23 nt, Human
acacacgcacacacacacacagg

SEQ ID NO: 3419476 - RNA, 13 nt, Human
acacacgcacgca

SEQ ID NO: 3419477 - RNA, 16 nt, Human
acacacgcacgcacac

SEQ ID NO: 3419478 - RNA, 20 nt, Human
acacacgcaggaacucccag

SEQ ID NO: 3419479 - RNA, 16 nt, Human
acacacgcgcgcacac

SEQ ID NO: 3419480 - RNA, 22 nt, Human
acacacgugcaauuuguuugug

SEQ ID NO: 3419481 - RNA, 17 nt, Human
acacacuacaccacaca

SEQ ID NO: 3419482 - RNA, 15 nt, Human
acacacucaaaucaa

SEQ ID NO: 3419483 - RNA, 20 nt, Human
acacacucaaaucaagaaac

SEQ ID NO: 3419484 - RNA, 13 nt, Human
acacacucagugc

SEQ ID NO: 3419485 - RNA, 14 nt, Human
acacacucagugca

SEQ ID NO: 3419486 - RNA, 15 nt, Human
aauauuguauuguua

SEQ ID NO: 3419487 - RNA, 13 nt, Human
aauauuguccauu

SEQ ID NO: 3419488 - RNA, 21 nt, Human
aauauugucuuuuuguauguc

SEQ ID NO: 3419489 - RNA, 23 nt, Human
aauauugugaagaaaaauaaagu

SEQ ID NO: 3419490 - RNA, 17 nt, Human
aauauuguguugugaau

SEQ ID NO: 3419491 - RNA, 15 nt, Human
aauauuguuccuaag

SEQ ID NO: 3419492 - RNA, 23 nt, Human
aauauuguuccuaaguucuuaga

SEQ ID NO: 3419493 - RNA, 16 nt, Human
aauauuguugacaacu

SEQ ID NO: 3419494 - RNA, 15 nt, Human
aauauuguuucugca

SEQ ID NO: 3419495 - RNA, 15 nt, Human
aauauuguuucuuua

SEQ ID NO: 3419496 - RNA, 20 nt, Human
aauauuguuugguaaauguu

SEQ ID NO: 3419497 - RNA, 17 nt, Human
aauauuguuuuacaaua

SEQ ID NO: 3419498 - RNA, 18 nt, Human
aauauuguuuuacaauag

SEQ ID NO: 3419499 - RNA, 16 nt, Human
aauauuuaaacagcag

SEQ ID NO: 3419500 - RNA, 17 nt, Human
aauauuuaagauaguuu

SEQ ID NO: 3419501 - RNA, 16 nt, Human
aauauuuaaggagaug

SEQ ID NO: 3419502 - RNA, 17 nt, Human
aauauuuaaggagaugu

SEQ ID NO: 3419503 - RNA, 15 nt, Human
aauauuuaauguuga

SEQ ID NO: 3419504 - RNA, 15 nt, Human
aauauuuacaaugua

SEQ ID NO: 3419505 - RNA, 17 nt, Human
aauauuuauaaaacuuc

SEQ ID NO: 3419506 - RNA, 17 nt, Human
aauauuuauauuucacu

SEQ ID NO: 3419507 - RNA, 14 nt, Human
aauauuuaugaaga

SEQ ID NO: 3419508 - RNA, 19 nt, Human
aauauuuauggaugcaaca

SEQ ID NO: 3419509 - RNA, 21 nt, Human
aauauuuaugucuauuuaagc

SEQ ID NO: 3419510 - RNA, 23 nt, Human
aauauuuaugucuauuuaagccu

SEQ ID NO: 3419511 - RNA, 21 nt, Human
aauauuuauuaaauaaaauca

SEQ ID NO: 3419512 - RNA, 22 nt, Human
aauauuuauuaaauaaaaucaa

SEQ ID NO: 3419513 - RNA, 15 nt, Human
aauauuuauuaaauu

SEQ ID NO: 3419514 - RNA, 13 nt, Human
aauauuuauuacc

SEQ ID NO: 3419515 - RNA, 15 nt, Human
aauauuuauuaccuc

SEQ ID NO: 3419516 - RNA, 12 nt, Human
aauauuuauuau

SEQ ID NO: 3419517 - RNA, 14 nt, Human
aauauuuauucauu

SEQ ID NO: 3419518 - RNA, 12 nt, Human
aauauuuauugc

SEQ ID NO: 3419519 - RNA, 17 nt, Human
aauauuuauugcuuuau

SEQ ID NO: 3419520 - RNA, 23 nt, Human
aauauuuauugcuuuauaaauaa

SEQ ID NO: 3419521 - RNA, 14 nt, Human
aauauuucagauaa

SEQ ID NO: 3419522 - RNA, 20 nt, Human
aauauuucagguucuucaga

SEQ ID NO: 3419523 - RNA, 23 nt, Human
aauauuuccauauggauuuucua

SEQ ID NO: 3419524 - RNA, 12 nt, Human
aauauuucuauu

SEQ ID NO: 3419525 - RNA, 12 nt, Human
aauauuucuuca

SEQ ID NO: 3419526 - RNA, 14 nt, Human
aauauuucuucaaa

SEQ ID NO: 3419527 - RNA, 15 nt, Human
aauauuucuucaaau

SEQ ID NO: 3419528 - RNA, 16 nt, Human
aauauuucuucaaaua

SEQ ID NO: 3419529 - RNA, 20 nt, Human
aauauuucuucaaauaucuc

SEQ ID NO: 3419530 - RNA, 21 nt, Human
aauauuugacuugcaugaaga

SEQ ID NO: 3419531 - RNA, 21 nt, Human
aauauuuggucucuauuucau

SEQ ID NO: 3419532 - RNA, 14 nt, Human
aauauuuguacaua

SEQ ID NO: 3419533 - RNA, 22 nt, Human
aauauuugucgauauuuccauc

SEQ ID NO: 3419534 - RNA, 17 nt, Human
aauauuugugacaaaaa

SEQ ID NO: 3419535 - RNA, 21 nt, Human
aauauuugugugcuaaacgug

SEQ ID NO: 3419536 - RNA, 13 nt, Human
aauauuuuaaaga

SEQ ID NO: 3419537 - RNA, 13 nt, Human
aauauuuuaagca

SEQ ID NO: 3419538 - RNA, 15 nt, Human
aauauuuuaagcauu

SEQ ID NO: 3419539 - RNA, 21 nt, Human
aauauuuuaagcauuacucuu

SEQ ID NO: 3419540 - RNA, 18 nt, Human
aauauuuuaaguauugca

SEQ ID NO: 3419541 - RNA, 21 nt, Human
aauauuuuaccacugcuguga

SEQ ID NO: 3419542 - RNA, 17 nt, Human
aauauuuuaugauccag

SEQ ID NO: 3419543 - RNA, 21 nt, Human
aauauuuuaugguuauguuuu

SEQ ID NO: 3419544 - RNA, 17 nt, Human
aauauuuuauuauauau

SEQ ID NO: 3419545 - RNA, 13 nt, Human
aauauuuuauuca

SEQ ID NO: 3419546 - RNA, 15 nt, Human
aauauuuuauucaag

SEQ ID NO: 3419547 - RNA, 17 nt, Human
aauauuuuauucaaggu

SEQ ID NO: 3419548 - RNA, 11 nt, Human
aauauuuucau

SEQ ID NO: 3419549 - RNA, 18 nt, Human
aauauuuucauacagcau

SEQ ID NO: 3419550 - RNA, 21 nt, Human
aauauuuuccaugaaaaugca

SEQ ID NO: 3419551 - RNA, 12 nt, Human
aauauuuuccuc

SEQ ID NO: 3419552 - RNA, 20 nt, Human
aauauuuuccuccugagugc

SEQ ID NO: 3419553 - RNA, 22 nt, Human
aauauuuucucuguacuuuuca

SEQ ID NO: 3419554 - RNA, 17 nt, Human
aauauuuucuguguguu

SEQ ID NO: 3419555 - RNA, 18 nt, Human
aauauuuucuguguguuc

SEQ ID NO: 3419556 - RNA, 19 nt, Human
aauauuuucuguguguucc

SEQ ID NO: 3419557 - RNA, 21 nt, Human
aauauuuucuguguguuccug

SEQ ID NO: 3419558 - RNA, 18 nt, Human
aauauuuucuuuaaugcu

SEQ ID NO: 3419559 - RNA, 19 nt, Human
aauauuuucuuuaaugcuu

SEQ ID NO: 3419560 - RNA, 14 nt, Human
aauauuuugaauca

SEQ ID NO: 3419561 - RNA, 18 nt, Human
aauauuuugaaucaauaa

SEQ ID NO: 3419562 - RNA, 23 nt, Human
aauauuuugacuuguugagggua

SEQ ID NO: 3419563 - RNA, 22 nt, Human
aauauuuugauaauaauauugu

SEQ ID NO: 3419564 - RNA, 13 nt, Human
aauauuuugaucu

SEQ ID NO: 3419565 - RNA, 23 nt, Human
aauauuuugaucuucaacaaauu

SEQ ID NO: 3419566 - RNA, 20 nt, Human
aauauuuugcuaguuuuuga

SEQ ID NO: 3419567 - RNA, 15 nt, Human
aauauuuuguauuau

SEQ ID NO: 3419568 - RNA, 20 nt, Human
aauauuuuguauuauugcug

SEQ ID NO: 3419569 - RNA, 14 nt, Human
aauauuuugucuaa

SEQ ID NO: 3419570 - RNA, 19 nt, Human
aauauuuugucuaaaaugc

SEQ ID NO: 3419571 - RNA, 20 nt, Human
aauauuuugucuaaaaugcc

SEQ ID NO: 3419572 - RNA, 15 nt, Human
aauauuuuuauauca

SEQ ID NO: 3419573 - RNA, 18 nt, Human
aauauuuuuauauuuccu

SEQ ID NO: 3419574 - RNA, 23 nt, Human
aauauuuuugaaaggcauguucc

SEQ ID NO: 3419575 - RNA, 22 nt, Human
aauauuuuuugaggcuaaagaa

SEQ ID NO: 3419576 - RNA, 18 nt, Human
aaucaaaagggccaaaga

SEQ ID NO: 3419577 - RNA, 14 nt, Human
aaucaaaagugccu

SEQ ID NO: 3419578 - RNA, 19 nt, Human
aaucaaaagugccucaaga

SEQ ID NO: 3419579 - RNA, 17 nt, Human
aaucaaacauuuucugg

SEQ ID NO: 3419580 - RNA, 23 nt, Human
aaucaaacauuuugaaagucugu

SEQ ID NO: 3419581 - RNA, 16 nt, Human
aaucaaagcaaugcau

SEQ ID NO: 3419582 - RNA, 22 nt, Human
aaucaaauaaaaauucuagauu

SEQ ID NO: 3419583 - RNA, 14 nt, Human
aaucaaauaaguau

SEQ ID NO: 3419584 - RNA, 15 nt, Human
aaucaaauaaguauu

SEQ ID NO: 3419585 - RNA, 19 nt, Human
aaucaaauaaguauuuaua

SEQ ID NO: 3419586 - RNA, 21 nt, Human
aaucaaauaauaccuuagaag

SEQ ID NO: 3419587 - RNA, 16 nt, Human
aaucaaauaugcaaag

SEQ ID NO: 3419588 - RNA, 12 nt, Human
aaucaaaugaau

SEQ ID NO: 3419589 - RNA, 15 nt, Human
aaucaaauguaaagu

SEQ ID NO: 3419590 - RNA, 20 nt, Human
aaucaaauuuguaggguuuc

SEQ ID NO: 3419591 - RNA, 22 nt, Human
aaucaaauuuguaggguuucua

SEQ ID NO: 3419592 - RNA, 16 nt, Human
aaucaacacuaccagc

SEQ ID NO: 3419593 - RNA, 20 nt, Human
aaucaacugaaaguguuucc

SEQ ID NO: 3419594 - RNA, 14 nt, Human
aaucaacugggcug

SEQ ID NO: 3419595 - RNA, 10 nt, Human
aaucaacuuu

SEQ ID NO: 3419596 - RNA, 19 nt, Human
aaucaacuuuuuauugccu

SEQ ID NO: 3419597 - RNA, 22 nt, Human
aaucaacuuuuuauugccuucu

SEQ ID NO: 3419598 - RNA, 19 nt, Human
aaucaagagccuuaaaaca

SEQ ID NO: 3419599 - RNA, 17 nt, Human
aaucaagauuaugauga

SEQ ID NO: 3419600 - RNA, 20 nt, Human
aaucaagauuuaauccuaga

SEQ ID NO: 3419601 - RNA, 22 nt, Human
aaucaagccauguauaaaugug

SEQ ID NO: 3419602 - RNA, 15 nt, Human
aaucaagggucaggc

SEQ ID NO: 3419603 - RNA, 17 nt, Human
aaucaagguuauaauuu

SEQ ID NO: 3419604 - RNA, 15 nt, Human
aaucaaguaaugaau

SEQ ID NO: 3419605 - RNA, 22 nt, Human
aaucaaguuguaacuuauauug

SEQ ID NO: 3419606 - RNA, 23 nt, Human
aaucaauaacagccgcuccagag

SEQ ID NO: 3419607 - RNA, 21 nt, Human
aaucaaucaugucagucugcu

SEQ ID NO: 3419608 - RNA, 18 nt, Human
aaucaauuuaaacccauu

SEQ ID NO: 3419609 - RNA, 14 nt, Human
aaucacaaaaauuu

SEQ ID NO: 3419610 - RNA, 19 nt, Human
aaucacagcuuguauuuug

SEQ ID NO: 3419611 - RNA, 21 nt, Human
aaucacagcuuguauuuugug

SEQ ID NO: 3419612 - RNA, 12 nt, Human
aaucacaggcug

SEQ ID NO: 3419613 - RNA, 21 nt, Human
aaucacaggcugggcugggca

SEQ ID NO: 3419614 - RNA, 15 nt, Human
aaucacaguuggccu

SEQ ID NO: 3419615 - RNA, 23 nt, Human
aaucacauauuuuaaaauuuguu

SEQ ID NO: 3419616 - RNA, 18 nt, Human
aaucaccacaaacuguaa

SEQ ID NO: 3419617 - RNA, 20 nt, Human
aaucaccacaccaaaccucu

SEQ ID NO: 3419618 - RNA, 16 nt, Human
aaucaccauguaagca

SEQ ID NO: 3419619 - RNA, 16 nt, Human
aaucacccuaccaacu

SEQ ID NO: 3419620 - RNA, 20 nt, Human
aaucaccuaauuaauuucag

SEQ ID NO: 3419621 - RNA, 13 nt, Human
acaaagacugagu

SEQ ID NO: 3419622 - RNA, 21 nt, Human
acaaagaguucaagaaauaag

SEQ ID NO: 3419623 - RNA, 22 nt, Human
acaaagaugggugaaggcuggc

SEQ ID NO: 3419624 - RNA, 22 nt, Human
acaaagauguuugucagauaug

SEQ ID NO: 3419625 - RNA, 19 nt, Human
acaaagauucucuauguau

SEQ ID NO: 3419626 - RNA, 15 nt, Human
acaaagcaauucuuu

SEQ ID NO: 3419627 - RNA, 14 nt, Human
acaaagcacagugu

SEQ ID NO: 3419628 - RNA, 15 nt, Human
acaaagcacaguguu

SEQ ID NO: 3419629 - RNA, 17 nt, Human
acaaagcacaguuugaa

SEQ ID NO: 3419630 - RNA, 19 nt, Human
acagagaaagaggaagcuu

SEQ ID NO: 3419631 - RNA, 18 nt, Human
aaucacgcuuuuugaaaa

SEQ ID NO: 3419632 - RNA, 15 nt, Human
aaucacucagagcag

SEQ ID NO: 3419633 - RNA, 12 nt, Human
aaucacucuugu

SEQ ID NO: 3419634 - RNA, 14 nt, Human
aaucacuguguaua

SEQ ID NO: 3419635 - RNA, 15 nt, Human
aaucacuguguauau

SEQ ID NO: 3419636 - RNA, 17 nt, Human
aaucacuguguauauuu

SEQ ID NO: 3419637 - RNA, 22 nt, Human
aaucacuguguauauuugauuu

SEQ ID NO: 3419638 - RNA, 23 nt, Human
aaucacuguguauauuugauuua

SEQ ID NO: 3419639 - RNA, 22 nt, Human
aaucacuguuuuuagacaccuu

SEQ ID NO: 3419640 - RNA, 15 nt, Human
aaucacuuucauaau

SEQ ID NO: 3419641 - RNA, 23 nt, Human
aaucacuuugucuaacucagaau

SEQ ID NO: 3419642 - RNA, 12 nt, Human
aaucagaacuca

SEQ ID NO: 3419643 - RNA, 20 nt, Human
aaucagaagucaucuugcua

SEQ ID NO: 3419644 - RNA, 20 nt, Human
aaucagacccuaccccacca

SEQ ID NO: 3419645 - RNA, 14 nt, Human
aaucagacuaugaa

SEQ ID NO: 3419646 - RNA, 21 nt, Human
aaucagagaccaggcccuggc

SEQ ID NO: 3419647 - RNA, 21 nt, Human
aaucagauagauauuccuauu

SEQ ID NO: 3419648 - RNA, 15 nt, Human
aaucagaucauuuca

SEQ ID NO: 3419649 - RNA, 14 nt, Human
aaucagcaagaaga

SEQ ID NO: 3419650 - RNA, 16 nt, Human
aaucagcacugaaaau

SEQ ID NO: 3419651 - RNA, 13 nt, Human
aaucagccagaca

SEQ ID NO: 3419652 - RNA, 16 nt, Human
aaucagccuaguugau

SEQ ID NO: 3419653 - RNA, 17 nt, Human
aaucagcuauuuuguga

SEQ ID NO: 3419654 - RNA, 20 nt, Human
aaucagcuccuuccuggaga

SEQ ID NO: 3419655 - RNA, 18 nt, Human
aaucagcugcuuuguuac

SEQ ID NO: 3419656 - RNA, 19 nt, Human
aaucagcugcuuuguuacc

SEQ ID NO: 3419657 - RNA, 15 nt, Human
aaucaggcuuuuguu

SEQ ID NO: 3419658 - RNA, 18 nt, Human
aaucagggaggucauuuu

SEQ ID NO: 3419659 - RNA, 22 nt, Human
aaucaggguuaguauuguccag

SEQ ID NO: 3419660 - RNA, 16 nt, Human
aaucaggguuuuuaga

SEQ ID NO: 3419661 - RNA, 22 nt, Human
aaucaguaagagguguuauuug

SEQ ID NO: 3419662 - RNA, 11 nt, Human
aaucaguaauu

SEQ ID NO: 3419663 - RNA, 17 nt, Human
aaucaguauaauucugu

SEQ ID NO: 3419664 - RNA, 15 nt, Human
aaucaguccccuccc

SEQ ID NO: 3419665 - RNA, 17 nt, Human
aaucagucuauccacag

SEQ ID NO: 3419666 - RNA, 20 nt, Human
aaucagucuauccacagaga

SEQ ID NO: 3419667 - RNA, 17 nt, Human
aaucagucucagaaugu

SEQ ID NO: 3419668 - RNA, 24 nt, Human
aaucagucucagaaugucauuuug

SEQ ID NO: 3419669 - RNA, 16 nt, Human
aaucaguguagcccca

SEQ ID NO: 3419670 - RNA, 17 nt, Human
aaucaguucauuagaaa

SEQ ID NO: 3419671 - RNA, 18 nt, Human
aaucaguucauuagaaau

SEQ ID NO: 3419672 - RNA, 20 nt, Human
aaucaguucauuagaaauau

SEQ ID NO: 3419673 - RNA, 21 nt, Human
aaucaguugcgcguucugaaa

SEQ ID NO: 3419674 - RNA, 13 nt, Human
aaucauaaaguca

SEQ ID NO: 3419675 - RNA, 14 nt, Human
aaucauaaagucag

SEQ ID NO: 3419676 - RNA, 23 nt, Human
aaucauaagauauuuuucaugau

SEQ ID NO: 3419677 - RNA, 14 nt, Human
aaucauaaguauuu

SEQ ID NO: 3419678 - RNA, 19 nt, Human
aaucauacuccuaugcuuu

SEQ ID NO: 3419679 - RNA, 22 nt, Human
aaucauaggcaccuuuuacugu

SEQ ID NO: 3419680 - RNA, 22 nt, Human
aaucauaguuacuguguaaacu

SEQ ID NO: 3419681 - RNA, 18 nt, Human
aaucauauaauaaaugua

SEQ ID NO: 3419682 - RNA, 17 nt, Human
aaucauauauaauaaau

SEQ ID NO: 3419683 - RNA, 14 nt, Human
aaucauaugugauc

SEQ ID NO: 3419684 - RNA, 17 nt, Human
aaucauauuagacuucu

SEQ ID NO: 3419685 - RNA, 23 nt, Human
aaucauauugaugaaaagauuua

SEQ ID NO: 3419686 - RNA, 14 nt, Human
aaucaucaagaagg

SEQ ID NO: 3419687 - RNA, 21 nt, Human
aaucaucaagagaauuugggg

SEQ ID NO: 3419688 - RNA, 15 nt, Human
aaucauccaaugcuc

SEQ ID NO: 3419689 - RNA, 23 nt, Human
aaucaucgaaaauucauuucaca

SEQ ID NO: 3419690 - RNA, 15 nt, Human
aaucaucuauaaaga

SEQ ID NO: 3419691 - RNA, 18 nt, Human
aaucaucuauaaagaaga

SEQ ID NO: 3419692 - RNA, 13 nt, Human
aaucaucuauuuu

SEQ ID NO: 3419693 - RNA, 15 nt, Human
aaucaucuauuuuga

SEQ ID NO: 3419694 - RNA, 19 nt, Human
aaucaucuauuuugaugca

SEQ ID NO: 3419695 - RNA, 20 nt, Human
aaucaugaagauauuuuucc

SEQ ID NO: 3419696 - RNA, 22 nt, Human
aaucauguaguaucaaauauua

SEQ ID NO: 3419697 - RNA, 16 nt, Human
aaucaugucaggccug

SEQ ID NO: 3419698 - RNA, 17 nt, Human
aaucauguuucuuugau

SEQ ID NO: 3419699 - RNA, 18 nt, Human
aaucauguuucuuugauc

SEQ ID NO: 3419700 - RNA, 17 nt, Human
aaucauuaagacaacug

SEQ ID NO: 3419701 - RNA, 12 nt, Human
aaucauuauuua

SEQ ID NO: 3419702 - RNA, 19 nt, Human
aaucauuauuuauuaaauu

SEQ ID NO: 3419703 - RNA, 23 nt, Human
aaucauucagaaauguugagucu

SEQ ID NO: 3419704 - RNA, 17 nt, Human
aaucauucuuacuaaaa

SEQ ID NO: 3419705 - RNA, 21 nt, Human
aaucauugcuuugaagcaguu

SEQ ID NO: 3419706 - RNA, 13 nt, Human
aaucauuguacag

SEQ ID NO: 3419707 - RNA, 22 nt, Human
aaucauuguacaguuuguuuac

SEQ ID NO: 3419708 - RNA, 14 nt, Human
aaucauuguaugug

SEQ ID NO: 3419709 - RNA, 15 nt, Human
aaucauuguccagag

SEQ ID NO: 3419710 - RNA, 17 nt, Human
aaucauuguuuugaaua

SEQ ID NO: 3419711 - RNA, 20 nt, Human
aaucauuguuuugaauauua

SEQ ID NO: 3419712 - RNA, 20 nt, Human
aaucauuucuauuucuccuc

SEQ ID NO: 3419713 - RNA, 18 nt, Human
aaucauuuguucaaagcu

SEQ ID NO: 3419714 - RNA, 16 nt, Human
aaucauuuguuuacau

SEQ ID NO: 3419715 - RNA, 15 nt, Human
aaucauuuuaauuau

SEQ ID NO: 3419716 - RNA, 16 nt, Human
aaucauuuuaauuauu

SEQ ID NO: 3419717 - RNA, 20 nt, Human
aaucauuuuaauuauuauuc

SEQ ID NO: 3419718 - RNA, 13 nt, Human
aaucauuuuaugu

SEQ ID NO: 3419719 - RNA, 19 nt, Human
aaucauuuugccucuuuuc

SEQ ID NO: 3419720 - RNA, 18 nt, Human
aaucauuuuuuauauaua

SEQ ID NO: 3419721 - RNA, 14 nt, Human
aauccaaacuugga

SEQ ID NO: 3419722 - RNA, 16 nt, Human
aauccaaauauuguua

SEQ ID NO: 3419723 - RNA, 20 nt, Human
aauccaaauggcgucuggaa

SEQ ID NO: 3419724 - RNA, 18 nt, Human
aauccaaccauuuucauu

SEQ ID NO: 3419725 - RNA, 22 nt, Human
aauccaagauauuuuaaaaucu

SEQ ID NO: 3419726 - RNA, 17 nt, Human
aauccaagccuccacag

SEQ ID NO: 3419727 - RNA, 22 nt, Human
aauccaagccuccacagcgagg

SEQ ID NO: 3419728 - RNA, 14 nt, Human
aauccaagcucccu

SEQ ID NO: 3419729 - RNA, 19 nt, Human
aauccaagcucccugcccc

SEQ ID NO: 3419730 - RNA, 18 nt, Human
aauccacaaucugacauu

SEQ ID NO: 3419731 - RNA, 18 nt, Human
aauccacauguuucagag

SEQ ID NO: 3419732 - RNA, 18 nt, Human
aauccaccugccucggcc

SEQ ID NO: 3419733 - RNA, 15 nt, Human
aauccacucccaggc

SEQ ID NO: 3419734 - RNA, 13 nt, Human
aauccagaaagaa

SEQ ID NO: 3419735 - RNA, 17 nt, Human
aauccagaaagaaaaaa

SEQ ID NO: 3419736 - RNA, 22 nt, Human
aauccagaauugaccuuuugac

SEQ ID NO: 3419737 - RNA, 17 nt, Human
aauccagacccggcugc

SEQ ID NO: 3419738 - RNA, 20 nt, Human
aauccaggcagauccaggac

SEQ ID NO: 3419739 - RNA, 19 nt, Human
aauccagguacgcacagac

SEQ ID NO: 3419740 - RNA, 21 nt, Human
aauccagguacgcacagacag

SEQ ID NO: 3419741 - RNA, 22 nt, Human
aauccagguacgcacagacagg

SEQ ID NO: 3419742 - RNA, 16 nt, Human
aauccauacauuugug

SEQ ID NO: 3419743 - RNA, 23 nt, Human
aauccaucuaaauaccugcccug

SEQ ID NO: 3419744 - RNA, 19 nt, Human
aauccaugaaagaacuuaa

SEQ ID NO: 3419745 - RNA, 16 nt, Human
aauccauguaagguau

SEQ ID NO: 3419746 - RNA, 17 nt, Human
aaucccacccacaugug

SEQ ID NO: 3419747 - RNA, 14 nt, Human
aaucccacuguaug

SEQ ID NO: 3419748 - RNA, 20 nt, Human
aaucccagcacuuugggagg

SEQ ID NO: 3419749 - RNA, 19 nt, Human
aaucccagcccccugacca

SEQ ID NO: 3419750 - RNA, 14 nt, Human
aaucccauuauuca

SEQ ID NO: 3419751 - RNA, 21 nt, Human
aaucccauuauucaaaguugc

SEQ ID NO: 3419752 - RNA, 18 nt, Human
aauccccaacaugcacug

SEQ ID NO: 3419753 - RNA, 23 nt, Human
aauccccaguucgccuggagccc

SEQ ID NO: 3419754 - RNA, 17 nt, Human
aauccccuaaaauaaca

SEQ ID NO: 3419755 - RNA, 14 nt, Human
aauccccucauuca

SEQ ID NO: 3419756 - RNA, 19 nt, Human
aauccccuccuugggcacu

SEQ ID NO: 3419757 - RNA, 15 nt, Human
aauccccuuaugacu

SEQ ID NO: 3419758 - RNA, 13 nt, Human
aauccccuucucc

SEQ ID NO: 3419759 - RNA, 23 nt, Human
aaucccuagacuuuaggcuuuca

SEQ ID NO: 3419760 - RNA, 13 nt, Human
aaucccugcuuuu

SEQ ID NO: 3419761 - RNA, 14 nt, Human
aaucccuggcaaag

SEQ ID NO: 3419762 - RNA, 23 nt, Human
aaucccugguuuuaaguaucaau

SEQ ID NO: 3419763 - RNA, 18 nt, Human
aaucccuguguuaauuua

SEQ ID NO: 3419764 - RNA, 13 nt, Human
aaucccuguuuaa

SEQ ID NO: 3419765 - RNA, 21 nt, Human
aaucccuuaauauccuaaaca

SEQ ID NO: 3419766 - RNA, 19 nt, Human
aaucccuuuauuacccccu

SEQ ID NO: 3419767 - RNA, 12 nt, Human
aauccgaaccuc

SEQ ID NO: 3419768 - RNA, 19 nt, Human
aauccgaaccuccucugug

SEQ ID NO: 3419769 - RNA, 21 nt, Human
aauccgaccacuaauugccaa

SEQ ID NO: 3419770 - RNA, 15 nt, Human
aauccgcucucuucc

SEQ ID NO: 3419771 - RNA, 18 nt, Human
aauccgcucucuuccugc

SEQ ID NO: 3419772 - RNA, 23 nt, Human
aauccgcucucuuccugccccuc

SEQ ID NO: 3419773 - RNA, 17 nt, Human
aauccuaagacacaaau

SEQ ID NO: 3419774 - RNA, 19 nt, Human
acaaucagcugcuuuguua

SEQ ID NO: 3419775 - RNA, 16 nt, Human
acaaucaguccccucc

SEQ ID NO: 3419776 - RNA, 20 nt, Human
acaaucaguccccucccauc

SEQ ID NO: 3419777 - RNA, 19 nt, Human
acaaucaugaaauaugcau

SEQ ID NO: 3419778 - RNA, 15 nt, Human
acaaucauguguguu

SEQ ID NO: 3419779 - RNA, 13 nt, Human
acaaucauugcug

SEQ ID NO: 3419780 - RNA, 21 nt, Human
acaaucauugcugaaaauggu

SEQ ID NO: 3419781 - RNA, 22 nt, Human
acaauccacgcuucuccggauc

SEQ ID NO: 3419782 - RNA, 17 nt, Human
acaaucuauuuauugga

SEQ ID NO: 3419783 - RNA, 21 nt, Human
acaaucucccuucacaaguuu

SEQ ID NO: 3419784 - RNA, 20 nt, Human
acaaucuuaaggggcagcuu

SEQ ID NO: 3419785 - RNA, 16 nt, Human
aauccucacugggugg

SEQ ID NO: 3419786 - RNA, 14 nt, Human
aauccucccagaaa

SEQ ID NO: 3419787 - RNA, 9 nt, Human
aauccuccu

SEQ ID NO: 3419788 - RNA, 11 nt, Human
aauccuccucc

SEQ ID NO: 3419789 - RNA, 18 nt, Human
aauccucuuccucugagg

SEQ ID NO: 3419790 - RNA, 14 nt, Human
aauccugcaaugaa

SEQ ID NO: 3419791 - RNA, 16 nt, Human
aauccugccauuuaaa

SEQ ID NO: 3419792 - RNA, 11 nt, Human
aauccugcccc

SEQ ID NO: 3419793 - RNA, 16 nt, Human
aauccuggcagcccag

SEQ ID NO: 3419794 - RNA, 20 nt, Human
aauccuguaggaagguacug

SEQ ID NO: 3419795 - RNA, 23 nt, Human
aauccuguaggaagguacuguau

SEQ ID NO: 3419796 - RNA, 20 nt, Human
aauccugucgauuagacugg

SEQ ID NO: 3419797 - RNA, 12 nt, Human
aauccugucuuu

SEQ ID NO: 3419798 - RNA, 21 nt, Human
aauccugugugguuuagugua

SEQ ID NO: 3419799 - RNA, 23 nt, Human
aauccugugugguuuaguguaaa

SEQ ID NO: 3419800 - RNA, 20 nt, Human
aauccuguugaaaagccaug

SEQ ID NO: 3419801 - RNA, 19 nt, Human
aauccuucuauucuagccu

SEQ ID NO: 3419802 - RNA, 22 nt, Human
aauccuucuauucuagccugca

SEQ ID NO: 3419803 - RNA, 13 nt, Human
aauccuugaagau

SEQ ID NO: 3419804 - RNA, 19 nt, Human
aauccuugauaauauauug

SEQ ID NO: 3419805 - RNA, 13 nt, Human
aauccuugcuuau

SEQ ID NO: 3419806 - RNA, 18 nt, Human
aauccuuuuccuguucau

SEQ ID NO: 3419807 - RNA, 13 nt, Human
aauccuuuuguag

SEQ ID NO: 3419808 - RNA, 17 nt, Human
aaucgagacugcaaugu

SEQ ID NO: 3419809 - RNA, 17 nt, Human
aaucgaggaaccagagc

SEQ ID NO: 3419810 - RNA, 14 nt, Human
aaucgauuggcuuu

SEQ ID NO: 3419811 - RNA, 17 nt, Human
aaucguuauguguguau

SEQ ID NO: 3419812 - RNA, 14 nt, Human
aaucuaaagccagu

SEQ ID NO: 3419813 - RNA, 14 nt, Human
aaucuaaaucuauu

SEQ ID NO: 3419814 - RNA, 15 nt, Human
aaucuaaaucuauuu

SEQ ID NO: 3419815 - RNA, 12 nt, Human
aaucuaaaugga

SEQ ID NO: 3419816 - RNA, 15 nt, Human
aaucuaaauggaacc

SEQ ID NO: 3419817 - RNA, 16 nt, Human
aaucuaacaauggaag

SEQ ID NO: 3419818 - RNA, 17 nt, Human
aaucuaagugauauaaa

SEQ ID NO: 3419819 - RNA, 20 nt, Human
aaucuaauauuaaaaauaug

SEQ ID NO: 3419820 - RNA, 14 nt, Human
aaucuaauuuuuuc

SEQ ID NO: 3419821 - RNA, 16 nt, Human
aaucuacccaaaggau

SEQ ID NO: 3419822 - RNA, 15 nt, Human
aaucuaccuucugua

SEQ ID NO: 3419823 - RNA, 16 nt, Human
aaucuaccuucuguag

SEQ ID NO: 3419824 - RNA, 12 nt, Human
aaucuagaagaa

SEQ ID NO: 3419825 - RNA, 13 nt, Human
aaucuagaagaaa

SEQ ID NO: 3419826 - RNA, 14 nt, Human
aaucuagaagaaau

SEQ ID NO: 3419827 - RNA, 19 nt, Human
aaucuagaggaaaagaaag

SEQ ID NO: 3419828 - RNA, 19 nt, Human
aaucuaguuuacagaaaaa

SEQ ID NO: 3419829 - RNA, 15 nt, Human
aaucuauagaaagug

SEQ ID NO: 3419830 - RNA, 20 nt, Human
aaucuaugaaguauauaaug

SEQ ID NO: 3419831 - RNA, 18 nt, Human
aaucuaugauuccaggug

SEQ ID NO: 3419832 - RNA, 21 nt, Human
aaucuauggucgggagacagc

SEQ ID NO: 3419833 - RNA, 18 nt, Human
aaucuauuauacuguauu

SEQ ID NO: 3419834 - RNA, 12 nt, Human
aaucuauucaga

SEQ ID NO: 3419835 - RNA, 18 nt, Human
aaucuauucagacaagca

SEQ ID NO: 3419836 - RNA, 13 nt, Human
aaucuauucugug

SEQ ID NO: 3419837 - RNA, 15 nt, Human
aaucuauuggguuca

SEQ ID NO: 3419838 - RNA, 17 nt, Human
aaucuauuggguucauu

SEQ ID NO: 3419839 - RNA, 20 nt, Human
aaucuauuuaauuaggaaaa

SEQ ID NO: 3419840 - RNA, 18 nt, Human
aaucuauuuauuaauauu

SEQ ID NO: 3419841 - RNA, 21 nt, Human
aaucuauuuauuaauauuuaa

SEQ ID NO: 3419842 - RNA, 16 nt, Human
aaucuauuuauuggac

SEQ ID NO: 3419843 - RNA, 23 nt, Human
aaucuauuucacuuauuuuggcu

SEQ ID NO: 3419844 - RNA, 13 nt, Human
aaucuauuuucua

SEQ ID NO: 3419845 - RNA, 19 nt, Human
aaucuauuuucuauguacu

SEQ ID NO: 3419846 - RNA, 20 nt, Human
aaucuauuuucuauguacua

SEQ ID NO: 3419847 - RNA, 13 nt, Human
aaucucaaaauua

SEQ ID NO: 3419848 - RNA, 12 nt, Human
aaucucaaauag

SEQ ID NO: 3419849 - RNA, 16 nt, Human
aaucucaaauaggcua

SEQ ID NO: 3419850 - RNA, 15 nt, Human
aaucucaaauuucua

SEQ ID NO: 3419851 - RNA, 21 nt, Human
aaucucaaggaaucuuuaagc

SEQ ID NO: 3419852 - RNA, 15 nt, Human
aaucucacauauaca

SEQ ID NO: 3419853 - RNA, 22 nt, Human
aaucucagagguagggcugcca

SEQ ID NO: 3419854 - RNA, 16 nt, Human
aaucucauaauuuaua

SEQ ID NO: 3419855 - RNA, 18 nt, Human
aaucucauaccucugacc

SEQ ID NO: 3419856 - RNA, 19 nt, Human
aaucucauaccucugacca

SEQ ID NO: 3419857 - RNA, 23 nt, Human
aaucucauagguugccaauaaua

SEQ ID NO: 3419858 - RNA, 16 nt, Human
aaucucccauuuugga

SEQ ID NO: 3419859 - RNA, 18 nt, Human
aaucucccauuuuggaau

SEQ ID NO: 3419860 - RNA, 15 nt, Human
aaucuccuauuuuuu

SEQ ID NO: 3419861 - RNA, 19 nt, Human
aaucucguuucaaaaacac

SEQ ID NO: 3419862 - RNA, 14 nt, Human
aaucucuaggaagu

SEQ ID NO: 3419863 - RNA, 19 nt, Human
aaucucuaggaagucaaua

SEQ ID NO: 3419864 - RNA, 18 nt, Human
aaucucuccacuuucagc

SEQ ID NO: 3419865 - RNA, 22 nt, Human
aaucucuccacuuucagcuguc

SEQ ID NO: 3419866 - RNA, 23 nt, Human
aaucucuccacuuucagcugucu

SEQ ID NO: 3419867 - RNA, 12 nt, Human
aaucucuguaaa

SEQ ID NO: 3419868 - RNA, 13 nt, Human
aaucucugugccu

SEQ ID NO: 3419869 - RNA, 19 nt, Human
aaucucuguuauguacugu

SEQ ID NO: 3419870 - RNA, 15 nt, Human
aaucucuuuuugacu

SEQ ID NO: 3419871 - RNA, 15 nt, Human
aaucugaaauucuaa

SEQ ID NO: 3419872 - RNA, 16 nt, Human
aaucugaaauucuaaa

SEQ ID NO: 3419873 - RNA, 12 nt, Human
aaucugaaugua

SEQ ID NO: 3419874 - RNA, 13 nt, Human
aaucugaauguaa

SEQ ID NO: 3419875 - RNA, 17 nt, Human
aaucugacccagugccc

SEQ ID NO: 3419876 - RNA, 17 nt, Human
aaucugaggccuccucu

SEQ ID NO: 3419877 - RNA, 21 nt, Human
aaucugagggaaauguuuugu

SEQ ID NO: 3419878 - RNA, 19 nt, Human
aaucugaucguucuuucua

SEQ ID NO: 3419879 - RNA, 21 nt, Human
aaucugaucguucuuucuagc

SEQ ID NO: 3419880 - RNA, 15 nt, Human
aaucugaucugagug

SEQ ID NO: 3419881 - RNA, 15 nt, Human
aaucugauggccuua

SEQ ID NO: 3419882 - RNA, 19 nt, Human
aaucugauggccuuaauuu

SEQ ID NO: 3419883 - RNA, 23 nt, Human
aaucugauggccuuaauuuccuu

SEQ ID NO: 3419884 - RNA, 23 nt, Human
aaucugauuuuuaugaugaugaa

SEQ ID NO: 3419885 - RNA, 23 nt, Human
aaucugcaaagcauguuuugcau

SEQ ID NO: 3419886 - RNA, 23 nt, Human
aaucugcagaaggaaaaaugugu

SEQ ID NO: 3419887 - RNA, 19 nt, Human
aaucugccuauugcagcug

SEQ ID NO: 3419888 - RNA, 21 nt, Human
aaucugcugguuuuaacaacu

SEQ ID NO: 3419889 - RNA, 19 nt, Human
aaucugcuuguauuccaag

SEQ ID NO: 3419890 - RNA, 17 nt, Human
aaucuggacuccucugu

SEQ ID NO: 3419891 - RNA, 16 nt, Human
aaucugggaagggaag

SEQ ID NO: 3419892 - RNA, 17 nt, Human
aaucugggccagaauuu

SEQ ID NO: 3419893 - RNA, 14 nt, Human
aaucuggucuuguu

SEQ ID NO: 3419894 - RNA, 11 nt, Human
aaucuguaaac

SEQ ID NO: 3419895 - RNA, 15 nt, Human
aaucuguaaacugug

SEQ ID NO: 3419896 - RNA, 21 nt, Human
aaucuguaacagguauuuugu

SEQ ID NO: 3419897 - RNA, 18 nt, Human
aaucuguaagcucuuuga

SEQ ID NO: 3419898 - RNA, 15 nt, Human
aaucuguagggcugg

SEQ ID NO: 3419899 - RNA, 12 nt, Human
aaucugucaaaa

SEQ ID NO: 3419900 - RNA, 19 nt, Human
aaucugucaaaacacugug

SEQ ID NO: 3419901 - RNA, 20 nt, Human
aaucugucaaaacacugugg

SEQ ID NO: 3419902 - RNA, 23 nt, Human
aaucugucaaaacacuguggaac

SEQ ID NO: 3419903 - RNA, 19 nt, Human
aaucugucaagaguaguua

SEQ ID NO: 3419904 - RNA, 20 nt, Human
aaucugucaagaguaguuau

SEQ ID NO: 3419905 - RNA, 22 nt, Human
aaucugugaacuugaaauuuga

SEQ ID NO: 3419906 - RNA, 12 nt, Human
aaucugugauga

SEQ ID NO: 3419907 - RNA, 19 nt, Human
aaucugugcuguuucaaag

SEQ ID NO: 3419908 - RNA, 22 nt, Human
aaucugugcuguuucaaaguuc

SEQ ID NO: 3419909 - RNA, 17 nt, Human
aaucuguguacaaagaa

SEQ ID NO: 3419910 - RNA, 21 nt, Human
aaucuguguauauuauuuggc

SEQ ID NO: 3419911 - RNA, 20 nt, Human
aaucugugugaaacuuucau

SEQ ID NO: 3419912 - RNA, 23 nt, Human
aaucuguuauguacuaguguucu

SEQ ID NO: 3419913 - RNA, 16 nt, Human
aaucuguuuuucuaac

SEQ ID NO: 3419914 - RNA, 15 nt, Human
aaucuuaaaaaguug

SEQ ID NO: 3419915 - RNA, 15 nt, Human
aaucuuaauacuguu

SEQ ID NO: 3419916 - RNA, 16 nt, Human
aaucuuaauacuguua

SEQ ID NO: 3419917 - RNA, 17 nt, Human
aaucuuaauacuguuau

SEQ ID NO: 3419918 - RNA, 18 nt, Human
aaucuuaauacuguuauu

SEQ ID NO: 3419919 - RNA, 19 nt, Human
acaguguauguagaagcau

SEQ ID NO: 3419920 - RNA, 12 nt, Human
acagugucuuuu

SEQ ID NO: 3419921 - RNA, 21 nt, Human
acagugucuuuuuuuguauag

SEQ ID NO: 3419922 - RNA, 16 nt, Human
acagugugaaguuaga

SEQ ID NO: 3419923 - RNA, 19 nt, Human
acagugugaauaaagugcu

SEQ ID NO: 3419924 - RNA, 14 nt, Human
acaguguguaaaca

SEQ ID NO: 3419925 - RNA, 19 nt, Human
acaguguuaggccuggcac

SEQ ID NO: 3419926 - RNA, 22 nt, Human
acaguguuauuuucuuugaaau

SEQ ID NO: 3419927 - RNA, 16 nt, Human
acaguguucuguuuaa

SEQ ID NO: 3419928 - RNA, 19 nt, Human
acaguguugaaaauguuca

SEQ ID NO: 3419929 - RNA, 20 nt, Human
acaguguuuacacuuuggac

SEQ ID NO: 3419930 - RNA, 20 nt, Human
acaguguuuauccuuucaua

SEQ ID NO: 3419931 - RNA, 18 nt, Human
acaguguuucccauaauu

SEQ ID NO: 3419932 - RNA, 16 nt, Human
acaguguuuucagaag

SEQ ID NO: 3419933 - RNA, 18 nt, Human
acaguuaaggagaaucau

SEQ ID NO: 3419934 - RNA, 13 nt, Human
acaguuacauaau

SEQ ID NO: 3419935 - RNA, 14 nt, Human
acaguuacuuuucc

SEQ ID NO: 3419936 - RNA, 23 nt, Human
acaguuagcaaacuuuguauguc

SEQ ID NO: 3419937 - RNA, 14 nt, Human
acaguuauaaaauu

SEQ ID NO: 3419938 - RNA, 16 nt, Human
acaguuauagaaagca

SEQ ID NO: 3419939 - RNA, 15 nt, Human
acaguuaucuaaguu

SEQ ID NO: 3419940 - RNA, 23 nt, Human
acaguuaucuaaguuaauuuaaa

SEQ ID NO: 3419941 - RNA, 14 nt, Human
acaguuauuuauag

SEQ ID NO: 3419942 - RNA, 17 nt, Human
acaguucacacccugca

SEQ ID NO: 3419943 - RNA, 20 nt, Human
acaguucacacccugcaagg

SEQ ID NO: 3419944 - RNA, 13 nt, Human
acaguucaguggc

SEQ ID NO: 3419945 - RNA, 21 nt, Human
acaguucaguuccucuuugca

SEQ ID NO: 3419946 - RNA, 15 nt, Human
acaguucauauguac

SEQ ID NO: 3419947 - RNA, 18 nt, Human
acaguuccucgcccuggg

SEQ ID NO: 3419948 - RNA, 23 nt, Human
acaguucggugagcuacaaaugc

SEQ ID NO: 3419949 - RNA, 18 nt, Human
acaguucuacagaaaaac

SEQ ID NO: 3419950 - RNA, 16 nt, Human
acaguucucuccuucu

SEQ ID NO: 3419951 - RNA, 17 nt, Human
acaguucucuccuucuu

SEQ ID NO: 3419952 - RNA, 19 nt, Human
acaguucuucgggaagaga

SEQ ID NO: 3419953 - RNA, 19 nt, Human
acaguucuuugggccagac

SEQ ID NO: 3419954 - RNA, 16 nt, Human
acaguugaaaaacagc

SEQ ID NO: 3419955 - RNA, 14 nt, Human
acaguugcacagca

SEQ ID NO: 3419956 - RNA, 13 nt, Human
acaguugcaugua

SEQ ID NO: 3419957 - RNA, 20 nt, Human
acaguugccaccaccucugu

SEQ ID NO: 3419958 - RNA, 22 nt, Human
acaguugccaccaccucugugg

SEQ ID NO: 3419959 - RNA, 19 nt, Human
acaguugcucuaugcuuuc

SEQ ID NO: 3419960 - RNA, 22 nt, Human
acaguugcugucauaagaauga

SEQ ID NO: 3419961 - RNA, 16 nt, Human
acaguuggccuucaga

SEQ ID NO: 3419962 - RNA, 15 nt, Human
acaguugggaaaaua

SEQ ID NO: 3419963 - RNA, 24 nt, Human
acaguugguaacuuuugugaauua

SEQ ID NO: 3419964 - RNA, 12 nt, Human
acaguuguauuu

SEQ ID NO: 3419965 - RNA, 13 nt, Human
acaguuguauuua

SEQ ID NO: 3419966 - RNA, 17 nt, Human
acaguugucuagagaua

SEQ ID NO: 3419967 - RNA, 12 nt, Human
acaguugugcag

SEQ ID NO: 3419968 - RNA, 11 nt, Human
acaguuguuug

SEQ ID NO: 3419969 - RNA, 13 nt, Human
acaguuguuugau

SEQ ID NO: 3419970 - RNA, 15 nt, Human
acaguuguuugaugc

SEQ ID NO: 3419971 - RNA, 20 nt, Human
acaguuuagagugaaauaua

SEQ ID NO: 3419972 - RNA, 16 nt, Human
acaguuuaucaugaag

SEQ ID NO: 3419973 - RNA, 17 nt, Human
acaguuuaucaugaagc

SEQ ID NO: 3419974 - RNA, 22 nt, Human
acaguuuaucaugaagccugug

SEQ ID NO: 3419975 - RNA, 15 nt, Human
acaguuuauuuguug

SEQ ID NO: 3419976 - RNA, 18 nt, Human
acaguuugaaauaagcua

SEQ ID NO: 3419977 - RNA, 16 nt, Human
acaguuugaugucauu

SEQ ID NO: 3419978 - RNA, 20 nt, Human
acaguuugaugucauuaaug

SEQ ID NO: 3419979 - RNA, 17 nt, Human
acaguuuguaaauguua

SEQ ID NO: 3419980 - RNA, 15 nt, Human
acaguuuguuuacac

SEQ ID NO: 3419981 - RNA, 13 nt, Human
acaguuuuaaaga

SEQ ID NO: 3419982 - RNA, 19 nt, Human
acaguuuuaacuguggaua

SEQ ID NO: 3419983 - RNA, 14 nt, Human
acaguuuuccauga

SEQ ID NO: 3419984 - RNA, 20 nt, Human
acaguuuuccuaugcuuuga

SEQ ID NO: 3419985 - RNA, 14 nt, Human
acaguuuuccuucu

SEQ ID NO: 3419986 - RNA, 13 nt, Human
aaugccauaauac

SEQ ID NO: 3419987 - RNA, 16 nt, Human
aaugccauaauacaaa

SEQ ID NO: 3419988 - RNA, 16 nt, Human
aaugccaucaauaaaa

SEQ ID NO: 3419989 - RNA, 15 nt, Human
aaugccaucaucucc

SEQ ID NO: 3419990 - RNA, 21 nt, Human
aaugccauccucaaacacugc

SEQ ID NO: 3419991 - RNA, 21 nt, Human
aaugccauggacagaagaagg

SEQ ID NO: 3419992 - RNA, 12 nt, Human
aaugcccagccc

SEQ ID NO: 3419993 - RNA, 16 nt, Human
aaugcccuuaaaucau

SEQ ID NO: 3419994 - RNA, 13 nt, Human
aaugcccuucacu

SEQ ID NO: 3419995 - RNA, 16 nt, Human
aaugccuaauaaacaa

SEQ ID NO: 3419996 - RNA, 15 nt, Human
aaugccuauuguaau

SEQ ID NO: 3419997 - RNA, 20 nt, Human
aaugccucaaugugaccagg

SEQ ID NO: 3419998 - RNA, 23 nt, Human
aaugccucaguguauuuguauuu

SEQ ID NO: 3419999 - RNA, 12 nt, Human
aaugccuccucc

SEQ ID NO: 3420000 - RNA, 13 nt, Human
aaugccuccugug

SEQ ID NO: 3420001 - RNA, 20 nt, Human
aaugccucuccuuaaaugcu

SEQ ID NO: 3420002 - RNA, 23 nt, Human
aaugccucuggcucuacacauau

SEQ ID NO: 3420003 - RNA, 16 nt, Human
aaugccucuugucuuc

SEQ ID NO: 3420004 - RNA, 22 nt, Human
aaugccugacuagggagccaug

SEQ ID NO: 3420005 - RNA, 16 nt, Human
aaugccugagugccug

SEQ ID NO: 3420006 - RNA, 17 nt, Human
aaugccugagugccugg

SEQ ID NO: 3420007 - RNA, 17 nt, Human
aaugccugcuuuuugga

SEQ ID NO: 3420008 - RNA, 21 nt, Human
aaugccugcuuuuuggaaagu

SEQ ID NO: 3420009 - RNA, 19 nt, Human
aaugccuuacuuuguauga

SEQ ID NO: 3420010 - RNA, 13 nt, Human
aaugccuuugaga

SEQ ID NO: 3420011 - RNA, 19 nt, Human
aaugcgaaugguagucuaa

SEQ ID NO: 3420012 - RNA, 13 nt, Human
aaugcgauuuuau

SEQ ID NO: 3420013 - RNA, 18 nt, Human
aaugcgcaggcuggcccu

SEQ ID NO: 3420014 - RNA, 14 nt, Human
aaugcguaauuaaa

SEQ ID NO: 3420015 - RNA, 19 nt, Human
aaugcgugcauaccacuuu

SEQ ID NO: 3420016 - RNA, 21 nt, Human
aaugcuaaauguaagaaucau

SEQ ID NO: 3420017 - RNA, 14 nt, Human
aaugcuaauauuaa

SEQ ID NO: 3420018 - RNA, 23 nt, Human
aaugcuaccgccccaaaguaaaa

SEQ ID NO: 3420019 - RNA, 21 nt, Human
aaugcuagguuaauuccaauu

SEQ ID NO: 3420020 - RNA, 21 nt, Human
aaugcuaugucauuucauguc

SEQ ID NO: 3420021 - RNA, 15 nt, Human
aaugcuauugaaaau

SEQ ID NO: 3420022 - RNA, 16 nt, Human
aaugcuauuugaacaa

SEQ ID NO: 3420023 - RNA, 23 nt, Human
aaugcuauuuuuguuuuuagaau

SEQ ID NO: 3420024 - RNA, 20 nt, Human
aaugcuauuuuuuauuuuac

SEQ ID NO: 3420025 - RNA, 14 nt, Human
aaugcucaaagaaa

SEQ ID NO: 3420026 - RNA, 15 nt, Human
aaugcucagaccagc

SEQ ID NO: 3420027 - RNA, 11 nt, Human
aaugcucuagu

SEQ ID NO: 3420028 - RNA, 23 nt, Human
aaugcucuuuacuucauggacuu

SEQ ID NO: 3420029 - RNA, 23 nt, Human
aaugcugacccaugggcaggaga

SEQ ID NO: 3420030 - RNA, 18 nt, Human
aaugcugaugaaucacug

SEQ ID NO: 3420031 - RNA, 22 nt, Human
aaugcugcaaguuaugaaauau

SEQ ID NO: 3420032 - RNA, 20 nt, Human
aaugcugcagauuugggcug

SEQ ID NO: 3420033 - RNA, 17 nt, Human
aaugcugccagugugga

SEQ ID NO: 3420034 - RNA, 22 nt, Human
aaugcugcccaugccaccgcuu

SEQ ID NO: 3420035 - RNA, 23 nt, Human
aaugcugccuuuucuuuaacuuu

SEQ ID NO: 3420036 - RNA, 19 nt, Human
aaugcugcgcccuucccca

SEQ ID NO: 3420037 - RNA, 14 nt, Human
aaugcugcuggcca

SEQ ID NO: 3420038 - RNA, 17 nt, Human
aaugcuggacuggaggc

SEQ ID NO: 3420039 - RNA, 20 nt, Human
aaugcuggcuggccuugugg

SEQ ID NO: 3420040 - RNA, 22 nt, Human
aaugcuggcuguuggcuggggg

SEQ ID NO: 3420041 - RNA, 15 nt, Human
aaugcugguuuuccu

SEQ ID NO: 3420042 - RNA, 23 nt, Human
aaugcugguuuuccuaaaugcag

SEQ ID NO: 3420043 - RNA, 23 nt, Human
aaugcuguacaucuauuuuggau

SEQ ID NO: 3420044 - RNA, 17 nt, Human
aaugcugucaacuauga

SEQ ID NO: 3420045 - RNA, 21 nt, Human
aaugcugucuuucuugcuccc

SEQ ID NO: 3420046 - RNA, 13 nt, Human
aaugcugugcccu

SEQ ID NO: 3420047 - RNA, 15 nt, Human
aaugcuuagaaauuc

SEQ ID NO: 3420048 - RNA, 18 nt, Human
aaugcuucagauauuauu

SEQ ID NO: 3420049 - RNA, 21 nt, Human
aaugcuuccugacaaucaacu

SEQ ID NO: 3420050 - RNA, 19 nt, Human
aaugcuucuaaguaaauac

SEQ ID NO: 3420051 - RNA, 17 nt, Human
aaugcuucugacuucau

SEQ ID NO: 3420052 - RNA, 21 nt, Human
aaugcuucugacuucauagau

SEQ ID NO: 3420053 - RNA, 13 nt, Human
aaugcuugaaaaa

SEQ ID NO: 3420054 - RNA, 22 nt, Human
aaugcuugcugcugauuuaaac

SEQ ID NO: 3420055 - RNA, 23 nt, Human
aaugcuugcugcugauuuaaaca

SEQ ID NO: 3420056 - RNA, 23 nt, Human
aaugcuuggaauaucugcuguau

SEQ ID NO: 3420057 - RNA, 18 nt, Human
aaugcuuuagaaagguuu

SEQ ID NO: 3420058 - RNA, 17 nt, Human
aaugcuuuauuuguaaa

SEQ ID NO: 3420059 - RNA, 12 nt, Human
aaugcuuucgau

SEQ ID NO: 3420060 - RNA, 14 nt, Human
aaugcuuugaaauu

SEQ ID NO: 3420061 - RNA, 22 nt, Human
aaugcuuugaaauugaaccuuu

SEQ ID NO: 3420062 - RNA, 16 nt, Human
aaugcuuuuagugugu

SEQ ID NO: 3420063 - RNA, 22 nt, Human
acauacggucagguuuaacauu

SEQ ID NO: 3420064 - RNA, 15 nt, Human
acauacgugugcaug

SEQ ID NO: 3420065 - RNA, 16 nt, Human
acauacgugugcaugu

SEQ ID NO: 3420066 - RNA, 22 nt, Human
acauacgugugcaugugucuuu

SEQ ID NO: 3420067 - RNA, 21 nt, Human
acauacuaaccagcagaaaug

SEQ ID NO: 3420068 - RNA, 12 nt, Human
acauacucauuu

SEQ ID NO: 3420069 - RNA, 14 nt, Human
acauacucauuuuu

SEQ ID NO: 3420070 - RNA, 17 nt, Human
acauacucauuuuucau

SEQ ID NO: 3420071 - RNA, 17 nt, Human
acauacucccaucugug

SEQ ID NO: 3420072 - RNA, 12 nt, Human
acauacugcugu

SEQ ID NO: 3420073 - RNA, 18 nt, Human
acauacuggccuggacug

SEQ ID NO: 3420074 - RNA, 20 nt, Human
acauacuugaagggccagag

SEQ ID NO: 3420075 - RNA, 23 nt, Human
acauacuugaagggccagagcca

SEQ ID NO: 3420076 - RNA, 13 nt, Human
acauacuuuuugg

SEQ ID NO: 3420077 - RNA, 17 nt, Human
acauacuuuuuggguuu

SEQ ID NO: 3420078 - RNA, 22 nt, Human
acauagaaauggaaauuuugcu

SEQ ID NO: 3420079 - RNA, 14 nt, Human
acauagaauuaaca

SEQ ID NO: 3420080 - RNA, 13 nt, Human
acauagauguccc

SEQ ID NO: 3420081 - RNA, 15 nt, Human
acauagaugucccuu

SEQ ID NO: 3420082 - RNA, 16 nt, Human
acauagcccacuuaca

SEQ ID NO: 3420083 - RNA, 21 nt, Human
acauagcccacuuacauuuac

SEQ ID NO: 3420084 - RNA, 18 nt, Human
acauagcccaucccugcc

SEQ ID NO: 3420085 - RNA, 19 nt, Human
acauagcgaauacaaaauu

SEQ ID NO: 3420086 - RNA, 21 nt, Human
acauagcuuacaagccagcug

SEQ ID NO: 3420087 - RNA, 14 nt, Human
acauaguauucaug

SEQ ID NO: 3420088 - RNA, 19 nt, Human
acauaguauucaugacuau

SEQ ID NO: 3420089 - RNA, 18 nt, Human
acauagucugaagugaag

SEQ ID NO: 3420090 - RNA, 14 nt, Human
acauagugaaaauu

SEQ ID NO: 3420091 - RNA, 21 nt, Human
acauagugaugguuccccugu

SEQ ID NO: 3420092 - RNA, 19 nt, Human
acauaguguaggcuuuacu

SEQ ID NO: 3420093 - RNA, 23 nt, Human
acauaguguaggcuuuacuuagc

SEQ ID NO: 3420094 - RNA, 15 nt, Human
acauaguuauuuauu

SEQ ID NO: 3420095 - RNA, 23 nt, Human
acauaguucuccaguuguaugga

SEQ ID NO: 3420096 - RNA, 13 nt, Human
acauaguuuuuaa

SEQ ID NO: 3420097 - RNA, 13 nt, Human
acauauaaaauaa

SEQ ID NO: 3420098 - RNA, 15 nt, Human
acauauacaacacca

SEQ ID NO: 3420099 - RNA, 17 nt, Human
acauauacauacuuaca

SEQ ID NO: 3420100 - RNA, 22 nt, Human
acauauacauacuuacaugugu

SEQ ID NO: 3420101 - RNA, 16 nt, Human
acauauagaaugcaga

SEQ ID NO: 3420102 - RNA, 14 nt, Human
acauauaguguaca

SEQ ID NO: 3420103 - RNA, 16 nt, Human
acauauauauauauaa

SEQ ID NO: 3420104 - RNA, 20 nt, Human
acauauauauauuuuuuaau

SEQ ID NO: 3420105 - RNA, 17 nt, Human
acauaucgcugacuuca

SEQ ID NO: 3420106 - RNA, 17 nt, Human
acauaucuaguaugaaa

SEQ ID NO: 3420107 - RNA, 15 nt, Human
acauaucuuagaugg

SEQ ID NO: 3420108 - RNA, 19 nt, Human
acauaucuuuauuaaucac

SEQ ID NO: 3420109 - RNA, 18 nt, Human
acauaugaucugucugug

SEQ ID NO: 3420110 - RNA, 17 nt, Human
acauaugcaaaaauaua

SEQ ID NO: 3420111 - RNA, 17 nt, Human
acauaugcaccuugugu

SEQ ID NO: 3420112 - RNA, 20 nt, Human
acauaugcaccuugugucug

SEQ ID NO: 3420113 - RNA, 16 nt, Human
acauauggauguuacu

SEQ ID NO: 3420114 - RNA, 16 nt, Human
acauauguaaacauaa

SEQ ID NO: 3420115 - RNA, 16 nt, Human
acauauguagacuaua

SEQ ID NO: 3420116 - RNA, 23 nt, Human
acauauguagacuauauacaugu

SEQ ID NO: 3420117 - RNA, 16 nt, Human
acauauguauacaugu

SEQ ID NO: 3420118 - RNA, 17 nt, Human
acauauguauacaugug

SEQ ID NO: 3420119 - RNA, 18 nt, Human
acauauguauacaugugc

SEQ ID NO: 3420120 - RNA, 21 nt, Human
acauaugugcuggaauucuaa

SEQ ID NO: 3420121 - RNA, 14 nt, Human
acauauugauuucc

SEQ ID NO: 3420122 - RNA, 18 nt, Human
acauauuuaacuggugca

SEQ ID NO: 3420123 - RNA, 12 nt, Human
acauauuuaaug

SEQ ID NO: 3420124 - RNA, 13 nt, Human
acauauuuaaugu

SEQ ID NO: 3420125 - RNA, 14 nt, Human
acauauuuaauguu

SEQ ID NO: 3420126 - RNA, 17 nt, Human
acauauuuaauguuuua

SEQ ID NO: 3420127 - RNA, 19 nt, Human
acauauuuauauaacguga

SEQ ID NO: 3420128 - RNA, 17 nt, Human
acauauuuguggaauaa

SEQ ID NO: 3420129 - RNA, 19 nt, Human
acauauuuguuaaauauuu

SEQ ID NO: 3420130 - RNA, 20 nt, Human
acauauuuguuaaauauuua

SEQ ID NO: 3420131 - RNA, 19 nt, Human
acauauuuuauuaagaacu

SEQ ID NO: 3420132 - RNA, 21 nt, Human
acauauuuuuuauaucuggaa

SEQ ID NO: 3420133 - RNA, 17 nt, Human
acaucaaaccuuugagu

SEQ ID NO: 3420134 - RNA, 20 nt, Human
acaucaaacucaaugcuuua

SEQ ID NO: 3420135 - RNA, 12 nt, Human
acaucaaagagg

SEQ ID NO: 3420136 - RNA, 18 nt, Human
acaucaaauaagaaauaa

SEQ ID NO: 3420137 - RNA, 13 nt, Human
acaucaacagaua

SEQ ID NO: 3420138 - RNA, 14 nt, Human
acaucaaucuuuaa

SEQ ID NO: 3420139 - RNA, 14 nt, Human
acaucaauguucau

SEQ ID NO: 3420140 - RNA, 16 nt, Human
acaucaauguucauug

SEQ ID NO: 3420141 - RNA, 13 nt, Human
acaucacacacac

SEQ ID NO: 3420142 - RNA, 14 nt, Human
acaucacagcagcc

SEQ ID NO: 3420143 - RNA, 16 nt, Human
acaucacagcccagcc

SEQ ID NO: 3420144 - RNA, 14 nt, Human
acaucacagggugg

SEQ ID NO: 3420145 - RNA, 21 nt, Human
acaucaccgacgcgucuccug

SEQ ID NO: 3420146 - RNA, 19 nt, Human
acaucacucucaccuucca

SEQ ID NO: 3420147 - RNA, 23 nt, Human
acaucacugaaaccuuuaagaaa

SEQ ID NO: 3420148 - RNA, 14 nt, Human
acaucacugcuuga

SEQ ID NO: 3420149 - RNA, 21 nt, Human
acaucacugcuugaugaagca

SEQ ID NO: 3420150 - RNA, 12 nt, Human
acaucacuggca

SEQ ID NO: 3420151 - RNA, 14 nt, Human
acaucacuggcaug

SEQ ID NO: 3420152 - RNA, 15 nt, Human
acaucacuuguacaa

SEQ ID NO: 3420153 - RNA, 19 nt, Human
acaucacuuguacaaaaua

SEQ ID NO: 3420154 - RNA, 22 nt, Human
acaucagagugacauccaggag

SEQ ID NO: 3420155 - RNA, 12 nt, Human
acaucagcaaac

SEQ ID NO: 3420156 - RNA, 13 nt, Human
acaucagcaaaca

SEQ ID NO: 3420157 - RNA, 17 nt, Human
acaucagcacgauuucu

SEQ ID NO: 3420158 - RNA, 21 nt, Human
acaucagcacgauuucuguuu

SEQ ID NO: 3420159 - RNA, 22 nt, Human
acaucagcacgauuucuguuua

SEQ ID NO: 3420160 - RNA, 12 nt, Human
acaucagccagc

SEQ ID NO: 3420161 - RNA, 13 nt, Human
acaucagccagcu

SEQ ID NO: 3420162 - RNA, 16 nt, Human
acaucagccagcugcc

SEQ ID NO: 3420163 - RNA, 12 nt, Human
acaucagcuuga

SEQ ID NO: 3420164 - RNA, 21 nt, Human
acaucagcuugaccaguauaa

SEQ ID NO: 3420165 - RNA, 20 nt, Human
acaucagguuaggcaguaua

SEQ ID NO: 3420166 - RNA, 16 nt, Human
acaucagguuuuuccc

SEQ ID NO: 3420167 - RNA, 20 nt, Human
acaucaguuacucugaaggg

SEQ ID NO: 3420168 - RNA, 15 nt, Human
acaucaguuuuaacg

SEQ ID NO: 3420169 - RNA, 13 nt, Human
acaucaucuguaa

SEQ ID NO: 3420170 - RNA, 14 nt, Human
acaucaugaauuua

SEQ ID NO: 3420171 - RNA, 15 nt, Human
acaucauuacuauaa

SEQ ID NO: 3420172 - RNA, 21 nt, Human
acaucauuucuuuuugggaga

SEQ ID NO: 3420173 - RNA, 12 nt, Human
acaucauuuugu

SEQ ID NO: 3420174 - RNA, 22 nt, Human
acauccaaggagaaacagagac

SEQ ID NO: 3420175 - RNA, 23 nt, Human
acauccaaggagaaacagagaca

SEQ ID NO: 3420176 - RNA, 19 nt, Human
acauccacagucuccccca

SEQ ID NO: 3420177 - RNA, 13 nt, Human
acauccacucucu

SEQ ID NO: 3420178 - RNA, 19 nt, Human
acauccacucucucuuguu

SEQ ID NO: 3420179 - RNA, 22 nt, Human
acauccacucucucuuguucuu

SEQ ID NO: 3420180 - RNA, 13 nt, Human
acauccauaaaga

SEQ ID NO: 3420181 - RNA, 15 nt, Human
acauccauaaagaag

SEQ ID NO: 3420182 - RNA, 17 nt, Human
acauccauaaagaagca

SEQ ID NO: 3420183 - RNA, 11 nt, Human
acauccauguc

SEQ ID NO: 3420184 - RNA, 18 nt, Human
acauccauguuuguaaaa

SEQ ID NO: 3420185 - RNA, 18 nt, Human
acauccauucccaagaaa

SEQ ID NO: 3420186 - RNA, 20 nt, Human
acaucccacucacaacagcu

SEQ ID NO: 3420187 - RNA, 20 nt, Human
acaucccauguaacagaaag

SEQ ID NO: 3420188 - RNA, 14 nt, Human
acauccccacccuu

SEQ ID NO: 3420189 - RNA, 16 nt, Human
acauccccgcuggcug

SEQ ID NO: 3420190 - RNA, 18 nt, Human
acaucccgggacgcagca

SEQ ID NO: 3420191 - RNA, 23 nt, Human
acaucccuacaaaaaauuagaaa

SEQ ID NO: 3420192 - RNA, 15 nt, Human
acaucccucucugcu

SEQ ID NO: 3420193 - RNA, 16 nt, Human
acaucccucucugcug

SEQ ID NO: 3420194 - RNA, 15 nt, Human
acaucccugccagcu

SEQ ID NO: 3420195 - RNA, 14 nt, Human
acaucccugggccu

SEQ ID NO: 3420196 - RNA, 15 nt, Human
acaucccugggccug

SEQ ID NO: 3420197 - RNA, 17 nt, Human
acaucccugggccugcu

SEQ ID NO: 3420198 - RNA, 18 nt, Human
acaucccugggccugcug

SEQ ID NO: 3420199 - RNA, 19 nt, Human
acaucccugggccugcugc

SEQ ID NO: 3420200 - RNA, 16 nt, Human
acauccgccuuuugua

SEQ ID NO: 3420201 - RNA, 21 nt, Human
acauccgcgugugccugugug

SEQ ID NO: 3420202 - RNA, 23 nt, Human
acauccgcgugugccugugugcg

SEQ ID NO: 3420203 - RNA, 14 nt, Human
acauccuccgucca

SEQ ID NO: 3420204 - RNA, 17 nt, Human
acauccuccguccagcc

SEQ ID NO: 3420205 - RNA, 15 nt, Human
acauccuccucccac

SEQ ID NO: 3420206 - RNA, 18 nt, Human
acauccugccagccccac

SEQ ID NO: 3420207 - RNA, 23 nt, Human
acauccugucaucugagaaugaa

SEQ ID NO: 3420208 - RNA, 14 nt, Human
aauguaauuugugu

SEQ ID NO: 3420209 - RNA, 16 nt, Human
aauguaauuuguguaa

SEQ ID NO: 3420210 - RNA, 15 nt, Human
aauguacaacuuuuu

SEQ ID NO: 3420211 - RNA, 22 nt, Human
aauguacacacugguacuuaga

SEQ ID NO: 3420212 - RNA, 15 nt, Human
aauguacagacauau

SEQ ID NO: 3420213 - RNA, 21 nt, Human
aauguacagacauauuuaacu

SEQ ID NO: 3420214 - RNA, 14 nt, Human
aauguacauguauu

SEQ ID NO: 3420215 - RNA, 16 nt, Human
aauguacauguauuaa

SEQ ID NO: 3420216 - RNA, 15 nt, Human
aauguacauuaauua

SEQ ID NO: 3420217 - RNA, 21 nt, Human
aauguaccuucuuucacucug

SEQ ID NO: 3420218 - RNA, 19 nt, Human
aauguacugauuucaguaa

SEQ ID NO: 3420219 - RNA, 14 nt, Human
aauguacugcauau

SEQ ID NO: 3420220 - RNA, 21 nt, Human
aauguagaguuuuuaaacauc

SEQ ID NO: 3420221 - RNA, 16 nt, Human
aauguagauaaguguu

SEQ ID NO: 3420222 - RNA, 12 nt, Human
aauguagauuuu

SEQ ID NO: 3420223 - RNA, 13 nt, Human
aauguagccaugg

SEQ ID NO: 3420224 - RNA, 14 nt, Human
aauguaggcuggcu

SEQ ID NO: 3420225 - RNA, 16 nt, Human
aauguaggcuuaguuu

SEQ ID NO: 3420226 - RNA, 19 nt, Human
aauguaggcuuaguuugug

SEQ ID NO: 3420227 - RNA, 15 nt, Human
aauguaguugaugua

SEQ ID NO: 3420228 - RNA, 18 nt, Human
aauguaguugauguaucc

SEQ ID NO: 3420229 - RNA, 19 nt, Human
aauguauacuauaguacca

SEQ ID NO: 3420230 - RNA, 13 nt, Human
aauguauaguaaa

SEQ ID NO: 3420231 - RNA, 14 nt, Human
aauguauauaaaaa

SEQ ID NO: 3420232 - RNA, 21 nt, Human
aauguauauacacauauaccu

SEQ ID NO: 3420233 - RNA, 13 nt, Human
aauguauauauuu

SEQ ID NO: 3420234 - RNA, 16 nt, Human
aauguaucauagaaau

SEQ ID NO: 3420235 - RNA, 21 nt, Human
aauguaucccuucucacagca

SEQ ID NO: 3420236 - RNA, 14 nt, Human
aauguaucuaagaa

SEQ ID NO: 3420237 - RNA, 13 nt, Human
aauguaucuguga

SEQ ID NO: 3420238 - RNA, 13 nt, Human
aauguaucuuauu

SEQ ID NO: 3420239 - RNA, 19 nt, Human
aauguaugcauguugucua

SEQ ID NO: 3420240 - RNA, 14 nt, Human
aauguauguaaaua

SEQ ID NO: 3420241 - RNA, 18 nt, Human
aauguaugugcacuguca

SEQ ID NO: 3420242 - RNA, 19 nt, Human
aauguauguguaaguauuc

SEQ ID NO: 3420243 - RNA, 23 nt, Human
aauguauuaagcccacaguauau

SEQ ID NO: 3420244 - RNA, 14 nt, Human
aauguauuauucug

SEQ ID NO: 3420245 - RNA, 16 nt, Human
aauguauucauauuug

SEQ ID NO: 3420246 - RNA, 23 nt, Human
aauguauuguaccuuuuaacacc

SEQ ID NO: 3420247 - RNA, 13 nt, Human
aauguauuuguuc

SEQ ID NO: 3420248 - RNA, 13 nt, Human
aauguauuuuaug

SEQ ID NO: 3420249 - RNA, 21 nt, Human
aauguauuuuauuguaacaga

SEQ ID NO: 3420250 - RNA, 23 nt, Human
aauguauuuuauuguaacagaca

SEQ ID NO: 3420251 - RNA, 23 nt, Human
aauguauuuucuucaccucugcu

SEQ ID NO: 3420252 - RNA, 14 nt, Human
aauguauuuuucua

SEQ ID NO: 3420253 - RNA, 18 nt, Human
aaugucaaaaauauuuag

SEQ ID NO: 3420254 - RNA, 15 nt, Human
aaugucaaaugugaa

SEQ ID NO: 3420255 - RNA, 15 nt, Human
aaugucacaggcagg

SEQ ID NO: 3420256 - RNA, 15 nt, Human
aaugucaccaccuuc

SEQ ID NO: 3420257 - RNA, 16 nt, Human
aaugucaccaccuucc

SEQ ID NO: 3420258 - RNA, 22 nt, Human
aaugucacguacugucugauug

SEQ ID NO: 3420259 - RNA, 19 nt, Human
aaugucacuuuuugaggca

SEQ ID NO: 3420260 - RNA, 20 nt, Human
aaugucacuuuuugaggcaa

SEQ ID NO: 3420261 - RNA, 13 nt, Human
aaugucagaaaaa

SEQ ID NO: 3420262 - RNA, 19 nt, Human
aaugucagaaaccaguuau

SEQ ID NO: 3420263 - RNA, 18 nt, Human
aaugucagauacaaugua

SEQ ID NO: 3420264 - RNA, 21 nt, Human
aaugucagauacaauguauuu

SEQ ID NO: 3420265 - RNA, 16 nt, Human
aaugucagauuccuuu

SEQ ID NO: 3420266 - RNA, 20 nt, Human
aaugucagauuccuuucccu

SEQ ID NO: 3420267 - RNA, 16 nt, Human
aaugucaguaugugga

SEQ ID NO: 3420268 - RNA, 13 nt, Human
aaugucaguauuu

SEQ ID NO: 3420269 - RNA, 16 nt, Human
aaugucagugugacug

SEQ ID NO: 3420270 - RNA, 18 nt, Human
aaugucaguucugauaug

SEQ ID NO: 3420271 - RNA, 23 nt, Human
aaugucaguucugauauggaagc

SEQ ID NO: 3420272 - RNA, 20 nt, Human
aaugucaguuguuauuuauu

SEQ ID NO: 3420273 - RNA, 16 nt, Human
aaugucaugcugccuu

SEQ ID NO: 3420274 - RNA, 14 nt, Human
aaugucauugaaaa

SEQ ID NO: 3420275 - RNA, 19 nt, Human
aaugucauuuugguacuuu

SEQ ID NO: 3420276 - RNA, 22 nt, Human
aauguccaguaagaucacuguu

SEQ ID NO: 3420277 - RNA, 18 nt, Human
aauguccuccagaagccu

SEQ ID NO: 3420278 - RNA, 16 nt, Human
aauguccugccuuuua

SEQ ID NO: 3420279 - RNA, 15 nt, Human
aaugucuaaaauugu

SEQ ID NO: 3420280 - RNA, 20 nt, Human
aaugucuaauguauuuuauu

SEQ ID NO: 3420281 - RNA, 20 nt, Human
aaugucucuuuaaugucaca

SEQ ID NO: 3420282 - RNA, 21 nt, Human
aaugucugcagcccugagaaa

SEQ ID NO: 3420283 - RNA, 20 nt, Human
aaugucuggagaccaccagg

SEQ ID NO: 3420284 - RNA, 12 nt, Human
aaugucugugcu

SEQ ID NO: 3420285 - RNA, 13 nt, Human
aaugucugugcua

SEQ ID NO: 3420286 - RNA, 18 nt, Human
aaugucuucaaggcuuca

SEQ ID NO: 3420287 - RNA, 12 nt, Human
aaugucuucaua

SEQ ID NO: 3420288 - RNA, 22 nt, Human
aaugucuucuguauucacuuau

SEQ ID NO: 3420289 - RNA, 15 nt, Human
aaugucuugagcucu

SEQ ID NO: 3420290 - RNA, 20 nt, Human
aaugucuugaugcaugcacu

SEQ ID NO: 3420291 - RNA, 19 nt, Human
aaugucuugcuguugacau

SEQ ID NO: 3420292 - RNA, 22 nt, Human
aaugucuugcuguugacauauu

SEQ ID NO: 3420293 - RNA, 23 nt, Human
aaugucuugcuguugacauauuu

SEQ ID NO: 3420294 - RNA, 16 nt, Human
aaugucuuguuaauau

SEQ ID NO: 3420295 - RNA, 17 nt, Human
aaugucuuguuaauauu

SEQ ID NO: 3420296 - RNA, 21 nt, Human
aaugucuuguuaauauucuuu

SEQ ID NO: 3420297 - RNA, 21 nt, Human
aaugucuuuaaugcaauauac

SEQ ID NO: 3420298 - RNA, 17 nt, Human
aaugugaaaagaaaaau

SEQ ID NO: 3420299 - RNA, 15 nt, Human
aaugugaaacuggau

SEQ ID NO: 3420300 - RNA, 17 nt, Human
aaugugaacuagcugga

SEQ ID NO: 3420301 - RNA, 17 nt, Human
aaugugaacuuguagcu

SEQ ID NO: 3420302 - RNA, 22 nt, Human
aaugugaacuuguagcuguaaa

SEQ ID NO: 3420303 - RNA, 24 nt, Human
acagaguggucuuucuggagaggu

SEQ ID NO: 3420304 - RNA, 20 nt, Human
acagaguguagccagguccc

SEQ ID NO: 3420305 - RNA, 17 nt, Human
acagagugugcuggagg

SEQ ID NO: 3420306 - RNA, 19 nt, Human
acagagugugcuggaggac

SEQ ID NO: 3420307 - RNA, 18 nt, Human
acagaguguggacucugg

SEQ ID NO: 3420308 - RNA, 19 nt, Human
acagaguuguuacauuuuu

SEQ ID NO: 3420309 - RNA, 18 nt, Human
acagaguuuucacucuua

SEQ ID NO: 3420310 - RNA, 13 nt, Human
acagauaaaaagu

SEQ ID NO: 3420311 - RNA, 13 nt, Human
acagauaaagauu

SEQ ID NO: 3420312 - RNA, 15 nt, Human
acagauaauaauggg

SEQ ID NO: 3420313 - RNA, 20 nt, Human
acagauagauauaugcucug

SEQ ID NO: 3420314 - RNA, 13 nt, Human
acagauaguugug

SEQ ID NO: 3420315 - RNA, 19 nt, Human
acagauauacuuuguggac

SEQ ID NO: 3420316 - RNA, 12 nt, Human
acagauauauuu

SEQ ID NO: 3420317 - RNA, 15 nt, Human
acagaucaagcugug

SEQ ID NO: 3420318 - RNA, 16 nt, Human
acagaucaagcuguga

SEQ ID NO: 3420319 - RNA, 18 nt, Human
acagaucaagcugugaga

SEQ ID NO: 3420320 - RNA, 17 nt, Human
acagauccccaagccug

SEQ ID NO: 3420321 - RNA, 23 nt, Human
acagaucgaaccguuuugaagcu

SEQ ID NO: 3420322 - RNA, 17 nt, Human
acagaucuccuggcaaa

SEQ ID NO: 3420323 - RNA, 22 nt, Human
acagaucucugcuuuggaaauc

SEQ ID NO: 3420324 - RNA, 21 nt, Human
acagaucuggaaccucagccu

SEQ ID NO: 3420325 - RNA, 20 nt, Human
acagaugaaacacaaacaau

SEQ ID NO: 3420326 - RNA, 19 nt, Human
acagaugaacucuuucugg

SEQ ID NO: 3420327 - RNA, 14 nt, Human
acagaugaauguau

SEQ ID NO: 3420328 - RNA, 18 nt, Human
acagaugaccccugccca

SEQ ID NO: 3420329 - RNA, 13 nt, Human
acagaugagucac

SEQ ID NO: 3420330 - RNA, 19 nt, Human
acagaugaugagaauuucu

SEQ ID NO: 3420331 - RNA, 17 nt, Human
acagaugcaaugugcua

SEQ ID NO: 3420332 - RNA, 20 nt, Human
acagaugcaaugugcuacug

SEQ ID NO: 3420333 - RNA, 18 nt, Human
acagaugccccagagcug

SEQ ID NO: 3420334 - RNA, 12 nt, Human
acagaugccucc

SEQ ID NO: 3420335 - RNA, 19 nt, Human
acagaugccuuuuuuguag

SEQ ID NO: 3420336 - RNA, 12 nt, Human
acagaugcucca

SEQ ID NO: 3420337 - RNA, 21 nt, Human
acagaugcuuuucugucucug

SEQ ID NO: 3420338 - RNA, 16 nt, Human
acagauggauuugccu

SEQ ID NO: 3420339 - RNA, 16 nt, Human
acagaugggcaaauua

SEQ ID NO: 3420340 - RNA, 16 nt, Human
acagauguccaucaga

SEQ ID NO: 3420341 - RNA, 21 nt, Human
acagauguucgguuuuuuucc

SEQ ID NO: 3420342 - RNA, 12 nt, Human
acagauguugaa

SEQ ID NO: 3420343 - RNA, 13 nt, Human
acagauuaauauu

SEQ ID NO: 3420344 - RNA, 17 nt, Human
acagauucacacugucu

SEQ ID NO: 3420345 - RNA, 19 nt, Human
acagauucacacugucugg

SEQ ID NO: 3420346 - RNA, 15 nt, Human
acagauucagucuug

SEQ ID NO: 3420347 - RNA, 18 nt, Human
acagauucagucuugccu

SEQ ID NO: 3420348 - RNA, 21 nt, Human
acagauucuuucaguucuuug

SEQ ID NO: 3420349 - RNA, 12 nt, Human
acagauugaauu

SEQ ID NO: 3420350 - RNA, 16 nt, Human
acagauugcugcuucu

SEQ ID NO: 3420351 - RNA, 17 nt, Human
acagauuggauuuuaug

SEQ ID NO: 3420352 - RNA, 13 nt, Human
acagauuguuucu

SEQ ID NO: 3420353 - RNA, 16 nt, Human
accagagaccguccuc

SEQ ID NO: 3420354 - RNA, 20 nt, Human
accagagcaaccucucacuc

SEQ ID NO: 3420355 - RNA, 12 nt, Human
aauuauguaaau

SEQ ID NO: 3420356 - RNA, 13 nt, Human
aauuauguagcuc

SEQ ID NO: 3420357 - RNA, 22 nt, Human
aauuauguagcucuuugucagg

SEQ ID NO: 3420358 - RNA, 18 nt, Human
aauuauguauguuuacau

SEQ ID NO: 3420359 - RNA, 21 nt, Human
aauuauguauguuuacauauc

SEQ ID NO: 3420360 - RNA, 15 nt, Human
aauuaugugacauuu

SEQ ID NO: 3420361 - RNA, 14 nt, Human
aauuauguuaaacu

SEQ ID NO: 3420362 - RNA, 15 nt, Human
aauuauguuaaacua

SEQ ID NO: 3420363 - RNA, 17 nt, Human
aauuauguuauugaaaa

SEQ ID NO: 3420364 - RNA, 19 nt, Human
aauuauguuauugaaaaaa

SEQ ID NO: 3420365 - RNA, 18 nt, Human
aauuauguuuauauaaau

SEQ ID NO: 3420366 - RNA, 19 nt, Human
aauuauuaacuacauuuau

SEQ ID NO: 3420367 - RNA, 20 nt, Human
aauuauuaacuacauuuaug

SEQ ID NO: 3420368 - RNA, 14 nt, Human
aauuauuacagugu

SEQ ID NO: 3420369 - RNA, 20 nt, Human
aauuauuaguuuacaucauu

SEQ ID NO: 3420370 - RNA, 17 nt, Human
aauuauuauaaaaauau

SEQ ID NO: 3420371 - RNA, 16 nt, Human
aauuauuauuuggccc

SEQ ID NO: 3420372 - RNA, 14 nt, Human
aauuauucaauuua

SEQ ID NO: 3420373 - RNA, 17 nt, Human
aauuauucaguuaagaa

SEQ ID NO: 3420374 - RNA, 20 nt, Human
aauuauucuauaauuuccau

SEQ ID NO: 3420375 - RNA, 18 nt, Human
aauuauugauauauauua

SEQ ID NO: 3420376 - RNA, 12 nt, Human
aauuauugguaa

SEQ ID NO: 3420377 - RNA, 10 nt, Human
aauuauuguu

SEQ ID NO: 3420378 - RNA, 21 nt, Human
aauuauuuauuaaaugcccag

SEQ ID NO: 3420379 - RNA, 22 nt, Human
aauuauuuauuaaaugcccagc

SEQ ID NO: 3420380 - RNA, 20 nt, Human
aauuauuuauuuauggagga

SEQ ID NO: 3420381 - RNA, 19 nt, Human
aauuauuucacaaauaaua

SEQ ID NO: 3420382 - RNA, 17 nt, Human
aauuauuucagaaaugu

SEQ ID NO: 3420383 - RNA, 22 nt, Human
aauuauuucaugauuagaaauu

SEQ ID NO: 3420384 - RNA, 12 nt, Human
aauuauuugcau

SEQ ID NO: 3420385 - RNA, 19 nt, Human
aauuauuuguguaauagaa

SEQ ID NO: 3420386 - RNA, 18 nt, Human
aauuauuuuaaacaaaau

SEQ ID NO: 3420387 - RNA, 18 nt, Human
aauuauuuuaaauuauaa

SEQ ID NO: 3420388 - RNA, 18 nt, Human
aauuauuuuggauuuugu

SEQ ID NO: 3420389 - RNA, 19 nt, Human
aauuauuuugguacuuuua

SEQ ID NO: 3420390 - RNA, 20 nt, Human
aauuauuuugguacuuuuau

SEQ ID NO: 3420391 - RNA, 16 nt, Human
aauuauuuuuuuucuu

SEQ ID NO: 3420392 - RNA, 19 nt, Human
aauuauuuuuuuucuuuua

SEQ ID NO: 3420393 - RNA, 15 nt, Human
aauucaaaaaguguu

SEQ ID NO: 3420394 - RNA, 14 nt, Human
aauucaaaaaugua

SEQ ID NO: 3420395 - RNA, 16 nt, Human
aauucaaaaauguaca

SEQ ID NO: 3420396 - RNA, 17 nt, Human
aauucaaaaauguacaa

SEQ ID NO: 3420397 - RNA, 16 nt, Human
aauucaaaaguuccaa

SEQ ID NO: 3420398 - RNA, 13 nt, Human
aauucaaagcaug

SEQ ID NO: 3420399 - RNA, 19 nt, Human
aauucaaagcauggacauu

SEQ ID NO: 3420400 - RNA, 22 nt, Human
aauucaaagcuguguguuugga

SEQ ID NO: 3420401 - RNA, 21 nt, Human
aauucaacguuaauaauucug

SEQ ID NO: 3420402 - RNA, 12 nt, Human
aauucaacuuaa

SEQ ID NO: 3420403 - RNA, 21 nt, Human
aauucaacuuaacuaucaucu

SEQ ID NO: 3420404 - RNA, 15 nt, Human
aauucaacuuuguaa

SEQ ID NO: 3420405 - RNA, 17 nt, Human
aauucaaggaauuucuu

SEQ ID NO: 3420406 - RNA, 15 nt, Human
aauucaauacaaaca

SEQ ID NO: 3420407 - RNA, 16 nt, Human
aauucaauaguaauau

SEQ ID NO: 3420408 - RNA, 19 nt, Human
aauucaauuguaaauugaa

SEQ ID NO: 3420409 - RNA, 23 nt, Human
aauucaauuguaaauugaaucag

SEQ ID NO: 3420410 - RNA, 17 nt, Human
aauucaauuuggauuua

SEQ ID NO: 3420411 - RNA, 15 nt, Human
aauucaauuuuaaag

SEQ ID NO: 3420412 - RNA, 17 nt, Human
aauucacaaaguaauuu

SEQ ID NO: 3420413 - RNA, 15 nt, Human
aauucacaagcugcc

SEQ ID NO: 3420414 - RNA, 21 nt, Human
aauucacaucuaaccucaucu

SEQ ID NO: 3420415 - RNA, 22 nt, Human
aauucacaucuaaccucaucuu

SEQ ID NO: 3420416 - RNA, 21 nt, Human
aauucacaugaugcacuucaa

SEQ ID NO: 3420417 - RNA, 18 nt, Human
aauucaccacagacuuua

SEQ ID NO: 3420418 - RNA, 20 nt, Human
aauucacucaagcacugaua

SEQ ID NO: 3420419 - RNA, 23 nt, Human
aauucacucugaguguuuuauga

SEQ ID NO: 3420420 - RNA, 15 nt, Human
aauucacuuaggguc

SEQ ID NO: 3420421 - RNA, 23 nt, Human
aauucacuuagggucgagcaucc

SEQ ID NO: 3420422 - RNA, 16 nt, Human
aauucacuuucauuuu

SEQ ID NO: 3420423 - RNA, 16 nt, Human
aauucagacaucugag

SEQ ID NO: 3420424 - RNA, 20 nt, Human
aauucaggcauauuuuaacu

SEQ ID NO: 3420425 - RNA, 16 nt, Human
aauucaguauguuuua

SEQ ID NO: 3420426 - RNA, 23 nt, Human
aauucaguauguuuuacacugua

SEQ ID NO: 3420427 - RNA, 23 nt, Human
aauucagugaugugccuaaauaa

SEQ ID NO: 3420428 - RNA, 16 nt, Human
aauucagugcuguacu

SEQ ID NO: 3420429 - RNA, 17 nt, Human
aauucaguguauuucag

SEQ ID NO: 3420430 - RNA, 14 nt, Human
aauucaguuucaua

SEQ ID NO: 3420431 - RNA, 13 nt, Human
aauucauauucuu

SEQ ID NO: 3420432 - RNA, 16 nt, Human
aauucauauuuaugaa

SEQ ID NO: 3420433 - RNA, 17 nt, Human
aauucauucuggucucu

SEQ ID NO: 3420434 - RNA, 18 nt, Human
aauucauuuuuuaaauuc

SEQ ID NO: 3420435 - RNA, 14 nt, Human
aauuccaaaggaau

SEQ ID NO: 3420436 - RNA, 13 nt, Human
aauuccaaagucu

SEQ ID NO: 3420437 - RNA, 12 nt, Human
aauuccaaggag

SEQ ID NO: 3420438 - RNA, 16 nt, Human
aauuccaauaugauga

SEQ ID NO: 3420439 - RNA, 17 nt, Human
aauuccaauuauaugag

SEQ ID NO: 3420440 - RNA, 20 nt, Human
aauuccacaccuuuuauuga

SEQ ID NO: 3420441 - RNA, 13 nt, Human
aauuccacuggac

SEQ ID NO: 3420442 - RNA, 14 nt, Human
aauuccacugucaa

SEQ ID NO: 3420443 - RNA, 22 nt, Human
aauuccacugucaagaaagagc

SEQ ID NO: 3420444 - RNA, 20 nt, Human
aauuccagaaaggauauuua

SEQ ID NO: 3420445 - RNA, 14 nt, Human
aauuccagaaugaa

SEQ ID NO: 3420446 - RNA, 22 nt, Human
aauuccauauauccuuuucuuc

SEQ ID NO: 3420447 - RNA, 21 nt, Human
aauucccagcugucuguguca

SEQ ID NO: 3420448 - RNA, 19 nt, Human
aauucccauuuugcaaaau

SEQ ID NO: 3420449 - RNA, 22 nt, Human
aauucccauuuugcaaaauuuc

SEQ ID NO: 3420450 - RNA, 14 nt, Human
aauuccccacccug

SEQ ID NO: 3420451 - RNA, 16 nt, Human
aauucccucucucuga

SEQ ID NO: 3420452 - RNA, 13 nt, Human
aauucccugcugu

SEQ ID NO: 3420453 - RNA, 20 nt, Human
aauucccuggccuuucauau

SEQ ID NO: 3420454 - RNA, 14 nt, Human
aauucccuggggaa

SEQ ID NO: 3420455 - RNA, 15 nt, Human
aauuccuaaaauuau

SEQ ID NO: 3420456 - RNA, 21 nt, Human
aauuccuauauccugugacug

SEQ ID NO: 3420457 - RNA, 15 nt, Human
aauuccuauugugau

SEQ ID NO: 3420458 - RNA, 14 nt, Human
aauuccucugggaa

SEQ ID NO: 3420459 - RNA, 17 nt, Human
aauuccucuuugcuuug

SEQ ID NO: 3420460 - RNA, 18 nt, Human
aauuccucuuugcuuugc

SEQ ID NO: 3420461 - RNA, 19 nt, Human
aauuccucuuugcuuugcu

SEQ ID NO: 3420462 - RNA, 21 nt, Human
aauuccugguuugaagaaaua

SEQ ID NO: 3420463 - RNA, 17 nt, Human
aauuccuguagcaucuu

SEQ ID NO: 3420464 - RNA, 22 nt, Human
aauuccuguuuuuauuauuaac

SEQ ID NO: 3420465 - RNA, 13 nt, Human
aauuccuuagcuu

SEQ ID NO: 3420466 - RNA, 23 nt, Human
aauuccuuagcuuagaccucagc

SEQ ID NO: 3420467 - RNA, 21 nt, Human
aauuccuuggcaugccuucca

SEQ ID NO: 3420468 - RNA, 23 nt, Human
aauucgaaccaggaaauggaacc

SEQ ID NO: 3420469 - RNA, 18 nt, Human
aauucgcugcaaccuguu

SEQ ID NO: 3420470 - RNA, 13 nt, Human
aauucguguguuu

SEQ ID NO: 3420471 - RNA, 22 nt, Human
aauucguguguuuuuuuaugaa

SEQ ID NO: 3420472 - RNA, 18 nt, Human
aauucuaaauaaaauaua

SEQ ID NO: 3420473 - RNA, 19 nt, Human
aauucuaaaugaauguuua

SEQ ID NO: 3420474 - RNA, 15 nt, Human
aauucuaaucuaaca

SEQ ID NO: 3420475 - RNA, 23 nt, Human
aauucuaccaaggucuucuuaau

SEQ ID NO: 3420476 - RNA, 22 nt, Human
aauucuagcuuugagcuuaaga

SEQ ID NO: 3420477 - RNA, 12 nt, Human
aauucuagugcu

SEQ ID NO: 3420478 - RNA, 17 nt, Human
aauucuagugcugcuga

SEQ ID NO: 3420479 - RNA, 21 nt, Human
aauucuagugcugcugaagau

SEQ ID NO: 3420480 - RNA, 16 nt, Human
aauucuauaaggccau

SEQ ID NO: 3420481 - RNA, 15 nt, Human
aauucuauuaaagug

SEQ ID NO: 3420482 - RNA, 22 nt, Human
aauucucaaccuaccaccccuu

SEQ ID NO: 3420483 - RNA, 19 nt, Human
aauucucagaaucucaaau

SEQ ID NO: 3420484 - RNA, 18 nt, Human
aauucucauuaaaagaau

SEQ ID NO: 3420485 - RNA, 14 nt, Human
aauucuccacugug

SEQ ID NO: 3420486 - RNA, 14 nt, Human
aauucuccugccuc

SEQ ID NO: 3420487 - RNA, 15 nt, Human
aauucuccugccuca

SEQ ID NO: 3420488 - RNA, 13 nt, Human
aauucuccuggag

SEQ ID NO: 3420489 - RNA, 15 nt, Human
aauucuccuggaggu

SEQ ID NO: 3420490 - RNA, 21 nt, Human
aauucugaaguuauauuuccu

SEQ ID NO: 3420491 - RNA, 16 nt, Human
aauucugaauuugcaa

SEQ ID NO: 3420492 - RNA, 18 nt, Human
aauucugaauuugcaaag

SEQ ID NO: 3420493 - RNA, 15 nt, Human
aauucugauugauuu

SEQ ID NO: 3420494 - RNA, 11 nt, Human
aauucugauuu

SEQ ID NO: 3420495 - RNA, 13 nt, Human
aauucugauuucu

SEQ ID NO: 3420496 - RNA, 15 nt, Human
aauucugauuucuuu

SEQ ID NO: 3420497 - RNA, 16 nt, Human
aauucugauuucuuuu

SEQ ID NO: 3420498 - RNA, 15 nt, Human
acaucaauguucauu

SEQ ID NO: 3420499 - RNA, 15 nt, Human
acaucacaggguggg

SEQ ID NO: 3420500 - RNA, 18 nt, Human
acaucacagggugggccu

SEQ ID NO: 3420501 - RNA, 22 nt, Human
acaucaccgacgcgucuccugu

SEQ ID NO: 3420502 - RNA, 16 nt, Human
acaucacucugcugcu

SEQ ID NO: 3420503 - RNA, 19 nt, Human
acaucacucugcugcuuag

SEQ ID NO: 3420504 - RNA, 23 nt, Human
acaucacuggcauggugguuggg

SEQ ID NO: 3420505 - RNA, 16 nt, Human
acaucacuuguacaaa

SEQ ID NO: 3420506 - RNA, 11 nt, Human
acaucagaaag

SEQ ID NO: 3420507 - RNA, 20 nt, Human
acaucagaaauaauaaaaaa

SEQ ID NO: 3420508 - RNA, 15 nt, Human
acaucagcacgauuu

SEQ ID NO: 3420509 - RNA, 19 nt, Human
acaucagcacgauuucugu

SEQ ID NO: 3420510 - RNA, 20 nt, Human
acaucagcacgauuucuguu

SEQ ID NO: 3420511 - RNA, 14 nt, Human
acaucaggaguuca

SEQ ID NO: 3420512 - RNA, 15 nt, Human
acaucagguuuuucc

SEQ ID NO: 3420513 - RNA, 15 nt, Human
acaucaguaauguau

SEQ ID NO: 3420514 - RNA, 15 nt, Human
acaucaguuacucug

SEQ ID NO: 3420515 - RNA, 18 nt, Human
acaucaguuacucugaag

SEQ ID NO: 3420516 - RNA, 11 nt, Human
acaucaguucc

SEQ ID NO: 3420517 - RNA, 19 nt, Human
acaucaucaaggcacugcc

SEQ ID NO: 3420518 - RNA, 19 nt, Human
acaucaucuguaagcuguu

SEQ ID NO: 3420519 - RNA, 15 nt, Human
acaucaugaauuuua

SEQ ID NO: 3420520 - RNA, 21 nt, Human
acaucauuacuauaagaacuu

SEQ ID NO: 3420521 - RNA, 13 nt, Human
acaucauuccuuu

SEQ ID NO: 3420522 - RNA, 15 nt, Human
acaucauucuugaga

SEQ ID NO: 3420523 - RNA, 17 nt, Human
acaucauuuuguuuucc

SEQ ID NO: 3420524 - RNA, 21 nt, Human
acauccaaaauaguuaagaca

SEQ ID NO: 3420525 - RNA, 17 nt, Human
acauccaaagcagacag

SEQ ID NO: 3420526 - RNA, 18 nt, Human
acauccaaagcagacagc

SEQ ID NO: 3420527 - RNA, 13 nt, Human
acauccaaggaga

SEQ ID NO: 3420528 - RNA, 12 nt, Human
acauccacccca

SEQ ID NO: 3420529 - RNA, 19 nt, Human
acauccaggcaauggccua

SEQ ID NO: 3420530 - RNA, 19 nt, Human
acauccauaaagaagcaau

SEQ ID NO: 3420531 - RNA, 13 nt, Human
acauccauuccca

SEQ ID NO: 3420532 - RNA, 17 nt, Human
acauccauucccaagaa

SEQ ID NO: 3420533 - RNA, 20 nt, Human
acauccauucccaagaaaug

SEQ ID NO: 3420534 - RNA, 14 nt, Human
acaucccagcccaa

SEQ ID NO: 3420535 - RNA, 18 nt, Human
acaucccauguaacagaa

SEQ ID NO: 3420536 - RNA, 17 nt, Human
acauccccgcuggcugg

SEQ ID NO: 3420537 - RNA, 12 nt, Human
acauccccugcu

SEQ ID NO: 3420538 - RNA, 21 nt, Human
acaucccugggccugcugcug

SEQ ID NO: 3420539 - RNA, 20 nt, Human
acauccgccuuuuguauaca

SEQ ID NO: 3420540 - RNA, 22 nt, Human
acauccgcgugugccugugugc

SEQ ID NO: 3420541 - RNA, 18 nt, Human
acauccggggccagcucc

SEQ ID NO: 3420542 - RNA, 21 nt, Human
acauccuccacguucugcuca

SEQ ID NO: 3420543 - RNA, 13 nt, Human
acauccuggguaa

SEQ ID NO: 3420544 - RNA, 16 nt, Human
acauccuguauaagca

SEQ ID NO: 3420545 - RNA, 17 nt, Human
acauccuguauaagcac

SEQ ID NO: 3420546 - RNA, 16 nt, Human
acauccuguguuucua

SEQ ID NO: 3420547 - RNA, 23 nt, Human
acauccuguguuucuagggaaau

SEQ ID NO: 3420548 - RNA, 14 nt, Human
acauccuuccuucc

SEQ ID NO: 3420549 - RNA, 15 nt, Human
acauccuuccuuccc

SEQ ID NO: 3420550 - RNA, 15 nt, Human
acauccuuguggcac

SEQ ID NO: 3420551 - RNA, 20 nt, Human
acauccuuguggcacauuuu

SEQ ID NO: 3420552 - RNA, 19 nt, Human
acauccuuugcagggcagc

SEQ ID NO: 3420553 - RNA, 21 nt, Human
acauccuuugcagggcagccc

SEQ ID NO: 3420554 - RNA, 15 nt, Human
acaucggaaaaauaa

SEQ ID NO: 3420555 - RNA, 15 nt, Human
acaucuaagccugaa

SEQ ID NO: 3420556 - RNA, 18 nt, Human
acaucuaauaaguauaua

SEQ ID NO: 3420557 - RNA, 17 nt, Human
acaucuacaaaacauua

SEQ ID NO: 3420558 - RNA, 14 nt, Human
acaucuaugauaua

SEQ ID NO: 3420559 - RNA, 18 nt, Human
acaucuauuuuggauugu

SEQ ID NO: 3420560 - RNA, 22 nt, Human
acaucucagacccuuuagccaa

SEQ ID NO: 3420561 - RNA, 11 nt, Human
acaucucagag

SEQ ID NO: 3420562 - RNA, 24 nt, Human
acaucucaucaugucuauugucca

SEQ ID NO: 3420563 - RNA, 16 nt, Human
acaucucauccaucaa

SEQ ID NO: 3420564 - RNA, 15 nt, Human
acaucuccuuagaaa

SEQ ID NO: 3420565 - RNA, 12 nt, Human
acaucucucccc

SEQ ID NO: 3420566 - RNA, 21 nt, Human
acaucucuccccaacccuagg

SEQ ID NO: 3420567 - RNA, 23 nt, Human
acaucucuuccuccgaggccagu

SEQ ID NO: 3420568 - RNA, 14 nt, Human
acaucucuuugaau

SEQ ID NO: 3420569 - RNA, 17 nt, Human
acaucucuuugaauuuu

SEQ ID NO: 3420570 - RNA, 20 nt, Human
acaucucuuugaugucauau

SEQ ID NO: 3420571 - RNA, 18 nt, Human
acaucugaccuggcaucu

SEQ ID NO: 3420572 - RNA, 12 nt, Human
acaucugccuua

SEQ ID NO: 3420573 - RNA, 23 nt, Human
acaucugccuuaaaaccaaagag

SEQ ID NO: 3420574 - RNA, 18 nt, Human
acaucuggcuuauuuuaa

SEQ ID NO: 3420575 - RNA, 19 nt, Human
acaucuggcuuauuuuaau

SEQ ID NO: 3420576 - RNA, 20 nt, Human
acaucuggcuuauuuuaaug

SEQ ID NO: 3420577 - RNA, 15 nt, Human
acaucuguccuguga

SEQ ID NO: 3420578 - RNA, 13 nt, Human
acaucuucaaagc

SEQ ID NO: 3420579 - RNA, 23 nt, Human
acaucuugaucugcucagcccug

SEQ ID NO: 3420580 - RNA, 19 nt, Human
acaucuugcucugcugaca

SEQ ID NO: 3420581 - RNA, 21 nt, Human
acaucuugcucugcugacaga

SEQ ID NO: 3420582 - RNA, 13 nt, Human
acaucuuggcaca

SEQ ID NO: 3420583 - RNA, 14 nt, Human
acaucuuggcaggg

SEQ ID NO: 3420584 - RNA, 19 nt, Human
acaucuuggucagauuuga

SEQ ID NO: 3420585 - RNA, 20 nt, Human
acaucuuuaaggggaggaac

SEQ ID NO: 3420586 - RNA, 13 nt, Human
acaucuuuauccg

SEQ ID NO: 3420587 - RNA, 18 nt, Human
acaucuuuauugaaauuc

SEQ ID NO: 3420588 - RNA, 19 nt, Human
acaucuuuauugaaauucu

SEQ ID NO: 3420589 - RNA, 20 nt, Human
acaucuuucacacuuccacc

SEQ ID NO: 3420590 - RNA, 15 nt, Human
acaucuuucacauug

SEQ ID NO: 3420591 - RNA, 18 nt, Human
acaucuuuuaagacaaau

SEQ ID NO: 3420592 - RNA, 20 nt, Human
acaucuuuuacauucugcaa

SEQ ID NO: 3420593 - RNA, 18 nt, Human
acaucuuuuuaaagcuua

SEQ ID NO: 3420594 - RNA, 22 nt, Human
acaucuuuuuaaagcuuaucca

SEQ ID NO: 3420595 - RNA, 19 nt, Human
acaucuuuuuucacaaauu

SEQ ID NO: 3420596 - RNA, 23 nt, Human
acaugaaaaaaggacaauuucaa

SEQ ID NO: 3420597 - RNA, 16 nt, Human
acaugaaaacacauuu

SEQ ID NO: 3420598 - RNA, 18 nt, Human
acaugaaaacacauuuuu

SEQ ID NO: 3420599 - RNA, 22 nt, Human
acaugaaaacacauuuuucuua

SEQ ID NO: 3420600 - RNA, 23 nt, Human
acaugaaaacacauuuuucuuag

SEQ ID NO: 3420601 - RNA, 18 nt, Human
acaugaaaccuacacacu

SEQ ID NO: 3420602 - RNA, 17 nt, Human
acaugaaaggacccugu

SEQ ID NO: 3420603 - RNA, 13 nt, Human
acaugaaaugaua

SEQ ID NO: 3420604 - RNA, 18 nt, Human
acaugaaauuuuuguaaa

SEQ ID NO: 3420605 - RNA, 19 nt, Human
acaugaaauuuuuguaaau

SEQ ID NO: 3420606 - RNA, 19 nt, Human
acaugaacuuagauuuuac

SEQ ID NO: 3420607 - RNA, 13 nt, Human
acaugaagaagcu

SEQ ID NO: 3420608 - RNA, 20 nt, Human
acaugaagaccuuuuucugc

SEQ ID NO: 3420609 - RNA, 13 nt, Human
acaugaagcuguu

SEQ ID NO: 3420610 - RNA, 16 nt, Human
acaugaagcuucaugc

SEQ ID NO: 3420611 - RNA, 15 nt, Human
acaugaagguaaaua

SEQ ID NO: 3420612 - RNA, 21 nt, Human
acaugaagguaaauaaaaaga

SEQ ID NO: 3420613 - RNA, 22 nt, Human
acaugaagguaaauaaaaagaa

SEQ ID NO: 3420614 - RNA, 15 nt, Human
acaugaauacaaauu

SEQ ID NO: 3420615 - RNA, 20 nt, Human
acaugaauauuuaguguuca

SEQ ID NO: 3420616 - RNA, 15 nt, Human
acaugaaugcacacu

SEQ ID NO: 3420617 - RNA, 19 nt, Human
acaugaauuauuacagugu

SEQ ID NO: 3420618 - RNA, 18 nt, Human
acaugaauugcauuuuac

SEQ ID NO: 3420619 - RNA, 14 nt, Human
acaugacacagcuu

SEQ ID NO: 3420620 - RNA, 14 nt, Human
acaugacacugacc

SEQ ID NO: 3420621 - RNA, 15 nt, Human
acaugacacugaccu

SEQ ID NO: 3420622 - RNA, 16 nt, Human
acaugacacugaccuu

SEQ ID NO: 3420623 - RNA, 18 nt, Human
acaugacauuuaccagca

SEQ ID NO: 3420624 - RNA, 13 nt, Human
acaugagaacaga

SEQ ID NO: 3420625 - RNA, 13 nt, Human
acaugagcaucag

SEQ ID NO: 3420626 - RNA, 22 nt, Human
acaugagcuauuuccauuccag

SEQ ID NO: 3420627 - RNA, 17 nt, Human
acaugaggaacuguaga

SEQ ID NO: 3420628 - RNA, 18 nt, Human
acaugaggaacuguagau

SEQ ID NO: 3420629 - RNA, 21 nt, Human
acaugaggacucuauucuuua

SEQ ID NO: 3420630 - RNA, 22 nt, Human
acaugaggacucuauucuuuaa

SEQ ID NO: 3420631 - RNA, 23 nt, Human
acaugagguacugagagugaaca

SEQ ID NO: 3420632 - RNA, 13 nt, Human
acaugagucccag

SEQ ID NO: 3420633 - RNA, 18 nt, Human
acaugagucccaguggga

SEQ ID NO: 3420634 - RNA, 19 nt, Human
acaugauccugcaauucca

SEQ ID NO: 3420635 - RNA, 20 nt, Human
acaugaucuguuuuucacca

SEQ ID NO: 3420636 - RNA, 15 nt, Human
acaugaucuucuuua

SEQ ID NO: 3420637 - RNA, 17 nt, Human
acaugaucuucuuuaua

SEQ ID NO: 3420638 - RNA, 19 nt, Human
acaugauuccagccaucac

SEQ ID NO: 3420639 - RNA, 14 nt, Human
acaugauuccuucc

SEQ ID NO: 3420640 - RNA, 15 nt, Human
acaugauuccuuccu

SEQ ID NO: 3420641 - RNA, 22 nt, Human
acaugauuccuuccuguucuga

SEQ ID NO: 3420642 - RNA, 13 nt, Human
acauuaacaggca

SEQ ID NO: 3420643 - RNA, 11 nt, Human
acauuaacagu

SEQ ID NO: 3420644 - RNA, 12 nt, Human
acauuaacaguu

SEQ ID NO: 3420645 - RNA, 18 nt, Human
acauuaacaguuuuccau

SEQ ID NO: 3420646 - RNA, 20 nt, Human
acauuaacaguuuuccauga

SEQ ID NO: 3420647 - RNA, 14 nt, Human
acauuaagaaaauc

SEQ ID NO: 3420648 - RNA, 20 nt, Human
acauuaagauugaggccugc

SEQ ID NO: 3420649 - RNA, 19 nt, Human
acauuaagcaucacaaaug

SEQ ID NO: 3420650 - RNA, 17 nt, Human
acauuaagccuuccaca

SEQ ID NO: 3420651 - RNA, 22 nt, Human
acauuaauguuaauucagcacu

SEQ ID NO: 3420652 - RNA, 22 nt, Human
acauuaauguugauuucuaguu

SEQ ID NO: 3420653 - RNA, 23 nt, Human
acauuaauguugauuucuaguua

SEQ ID NO: 3420654 - RNA, 16 nt, Human
acauuaccuuacugug

SEQ ID NO: 3420655 - RNA, 19 nt, Human
acauuaccuuacuguggag

SEQ ID NO: 3420656 - RNA, 15 nt, Human
acauuacugaaaacu

SEQ ID NO: 3420657 - RNA, 14 nt, Human
acauuagaagacaa

SEQ ID NO: 3420658 - RNA, 20 nt, Human
acauuagaagacaauugaca

SEQ ID NO: 3420659 - RNA, 18 nt, Human
acauuagcaguuugcuuu

SEQ ID NO: 3420660 - RNA, 19 nt, Human
acauuaggaaaaguugcua

SEQ ID NO: 3420661 - RNA, 16 nt, Human
acauuaguaaaugucu

SEQ ID NO: 3420662 - RNA, 21 nt, Human
acauuaguaaaugucuuugua

SEQ ID NO: 3420663 - RNA, 23 nt, Human
acauuaguaaaugucuuuguaag

SEQ ID NO: 3420664 - RNA, 24 nt, Human
acauuaguaaaugucuuuguaagu

SEQ ID NO: 3420665 - RNA, 23 nt, Human
acauuaguacuuuauagaagaau

SEQ ID NO: 3420666 - RNA, 18 nt, Human
acauuaguucuauuucua

SEQ ID NO: 3420667 - RNA, 19 nt, Human
acauuaguucuauuucuau

SEQ ID NO: 3420668 - RNA, 11 nt, Human
acauuauaaac

SEQ ID NO: 3420669 - RNA, 12 nt, Human
aauucuguuucu

SEQ ID NO: 3420670 - RNA, 21 nt, Human
aauucuguuuuagguuaaaaa

SEQ ID NO: 3420671 - RNA, 19 nt, Human
aauucuguuuuuaaugcua

SEQ ID NO: 3420672 - RNA, 13 nt, Human
aauucuuacaugu

SEQ ID NO: 3420673 - RNA, 19 nt, Human
aauucuuaugccauauaau

SEQ ID NO: 3420674 - RNA, 15 nt, Human
aauucuuaugcuuau

SEQ ID NO: 3420675 - RNA, 19 nt, Human
aauucuuauuccauauuag

SEQ ID NO: 3420676 - RNA, 12 nt, Human
aauucuuauuuu

SEQ ID NO: 3420677 - RNA, 13 nt, Human
aauucuuauuuug

SEQ ID NO: 3420678 - RNA, 19 nt, Human
aauucuuauuuuuuaaaaa

SEQ ID NO: 3420679 - RNA, 22 nt, Human
aauucuucaccuaagucucugu

SEQ ID NO: 3420680 - RNA, 11 nt, Human
aauucuucagu

SEQ ID NO: 3420681 - RNA, 20 nt, Human
aauucuucaguugguugugu

SEQ ID NO: 3420682 - RNA, 22 nt, Human
aauucuucuccacuuucuagcc

SEQ ID NO: 3420683 - RNA, 13 nt, Human
aauucuucugaac

SEQ ID NO: 3420684 - RNA, 18 nt, Human
aauucuucugaacucaaa

SEQ ID NO: 3420685 - RNA, 23 nt, Human
aauucuucugaacucaaacugag

SEQ ID NO: 3420686 - RNA, 21 nt, Human
aauucuugaaggaaaaugaua

SEQ ID NO: 3420687 - RNA, 13 nt, Human
aauucuugcauau

SEQ ID NO: 3420688 - RNA, 19 nt, Human
aauucuugguugaggaaac

SEQ ID NO: 3420689 - RNA, 20 nt, Human
aauucuugguugaggaaaca

SEQ ID NO: 3420690 - RNA, 14 nt, Human
aauucuuguauauu

SEQ ID NO: 3420691 - RNA, 16 nt, Human
aauucuuguauauuau

SEQ ID NO: 3420692 - RNA, 22 nt, Human
aauucuuuaaaauuacaacuaa

SEQ ID NO: 3420693 - RNA, 19 nt, Human
aauucuuuaaugauuccua

SEQ ID NO: 3420694 - RNA, 13 nt, Human
aauucuuuauaca

SEQ ID NO: 3420695 - RNA, 16 nt, Human
aauucuuuauuucugu

SEQ ID NO: 3420696 - RNA, 20 nt, Human
aauucuuuauuucugucauu

SEQ ID NO: 3420697 - RNA, 13 nt, Human
aauucuuucaagu

SEQ ID NO: 3420698 - RNA, 22 nt, Human
aauucuuugaccuguugggagu

SEQ ID NO: 3420699 - RNA, 18 nt, Human
aauucuuugcaaaaaucc

SEQ ID NO: 3420700 - RNA, 17 nt, Human
aauucuuuugaauuguu

SEQ ID NO: 3420701 - RNA, 18 nt, Human
aauucuuuuuuaaauuuu

SEQ ID NO: 3420702 - RNA, 22 nt, Human
aauucuuuuuuauuaaucacug

SEQ ID NO: 3420703 - RNA, 22 nt, Human
aauugaaaggcauucucugaag

SEQ ID NO: 3420704 - RNA, 13 nt, Human
aauugaaauguaa

SEQ ID NO: 3420705 - RNA, 16 nt, Human
aauugaaauguaaggc

SEQ ID NO: 3420706 - RNA, 24 nt, Human
aauugaaauguaaggcuguguaag

SEQ ID NO: 3420707 - RNA, 23 nt, Human
aauugaagagagauauaucugaa

SEQ ID NO: 3420708 - RNA, 13 nt, Human
aauugaaggaaag

SEQ ID NO: 3420709 - RNA, 22 nt, Human
aauugaaguguauaauauaaaa

SEQ ID NO: 3420710 - RNA, 20 nt, Human
aauugaaguuucaaguuuua

SEQ ID NO: 3420711 - RNA, 14 nt, Human
aauugaauaauggu

SEQ ID NO: 3420712 - RNA, 16 nt, Human
aauugaauacuuugaa

SEQ ID NO: 3420713 - RNA, 15 nt, Human
aauugaauauuauuc

SEQ ID NO: 3420714 - RNA, 19 nt, Human
aauugaauggucagcguug

SEQ ID NO: 3420715 - RNA, 21 nt, Human
aauugaauuuaacaaugcgaa

SEQ ID NO: 3420716 - RNA, 21 nt, Human
aauugacagaucaagcuguga

SEQ ID NO: 3420717 - RNA, 13 nt, Human
aauugacccacaa

SEQ ID NO: 3420718 - RNA, 22 nt, Human
aauugacccacaagaaaugaaa

SEQ ID NO: 3420719 - RNA, 14 nt, Human
aauugacugucacu

SEQ ID NO: 3420720 - RNA, 14 nt, Human
aauugacuuauuua

SEQ ID NO: 3420721 - RNA, 23 nt, Human
aauugagaaaaauauauacuaaa

SEQ ID NO: 3420722 - RNA, 15 nt, Human
aauugagaaggaaaa

SEQ ID NO: 3420723 - RNA, 15 nt, Human
aauugagauuagagg

SEQ ID NO: 3420724 - RNA, 18 nt, Human
aauugaggacacugauau

SEQ ID NO: 3420725 - RNA, 19 nt, Human
aauugaggacuauggaaau

SEQ ID NO: 3420726 - RNA, 17 nt, Human
aauugaggggauuaaua

SEQ ID NO: 3420727 - RNA, 18 nt, Human
aauugaguugcacuuauu

SEQ ID NO: 3420728 - RNA, 17 nt, Human
aauugaguuuucagugg

SEQ ID NO: 3420729 - RNA, 21 nt, Human
aauugaucauagguauuucaa

SEQ ID NO: 3420730 - RNA, 17 nt, Human
aauugaucgacuugcca

SEQ ID NO: 3420731 - RNA, 14 nt, Human
aauugauguugaug

SEQ ID NO: 3420732 - RNA, 16 nt, Human
aauugauguugaugca

SEQ ID NO: 3420733 - RNA, 14 nt, Human
aauugauuauucug

SEQ ID NO: 3420734 - RNA, 22 nt, Human
aauugauuauucugauuccacu

SEQ ID NO: 3420735 - RNA, 23 nt, Human
aauugauuauucugauuccacuu

SEQ ID NO: 3420736 - RNA, 19 nt, Human
aauugauugggcacaucau

SEQ ID NO: 3420737 - RNA, 15 nt, Human
aauugauuucaagac

SEQ ID NO: 3420738 - RNA, 19 nt, Human
aauugauuucccuucuucu

SEQ ID NO: 3420739 - RNA, 22 nt, Human
aauugauuucuuuucuuccugg

SEQ ID NO: 3420740 - RNA, 14 nt, Human
aauugauuugcauu

SEQ ID NO: 3420741 - RNA, 22 nt, Human
aauugauuugcauugaacacaa

SEQ ID NO: 3420742 - RNA, 23 nt, Human
aauugauuugcauugaacacaaa

SEQ ID NO: 3420743 - RNA, 21 nt, Human
aauugcacaauauugaacuuu

SEQ ID NO: 3420744 - RNA, 18 nt, Human
aauugcacagaaguccug

SEQ ID NO: 3420745 - RNA, 15 nt, Human
aauugcacucuaaaa

SEQ ID NO: 3420746 - RNA, 14 nt, Human
aauugcacuuuuaa

SEQ ID NO: 3420747 - RNA, 14 nt, Human
aauugcagaacuaa

SEQ ID NO: 3420748 - RNA, 13 nt, Human
aauugcagacugu

SEQ ID NO: 3420749 - RNA, 16 nt, Human
aauugcaugcugcuuu

SEQ ID NO: 3420750 - RNA, 17 nt, Human
aauugcaugcugcuuua

SEQ ID NO: 3420751 - RNA, 21 nt, Human
aauugcaugcugcuuuaauug

SEQ ID NO: 3420752 - RNA, 22 nt, Human
aauugcauggguuuuguaggua

SEQ ID NO: 3420753 - RNA, 21 nt, Human
aauugcauugacuuuccccac

SEQ ID NO: 3420754 - RNA, 23 nt, Human
aauugcauugacuuuccccacca

SEQ ID NO: 3420755 - RNA, 20 nt, Human
aauugcauuuuuuaaaacaa

SEQ ID NO: 3420756 - RNA, 14 nt, Human
aauugccaaagcug

SEQ ID NO: 3420757 - RNA, 16 nt, Human
aauugccauauugcac

SEQ ID NO: 3420758 - RNA, 23 nt, Human
aauugccugacgaacuccuugau

SEQ ID NO: 3420759 - RNA, 19 nt, Human
aauugccuuucuguguuua

SEQ ID NO: 3420760 - RNA, 14 nt, Human
aauugcucaaguuc

SEQ ID NO: 3420761 - RNA, 22 nt, Human
aauugcucacaguuauuacaua

SEQ ID NO: 3420762 - RNA, 20 nt, Human
aauugcuccuaagcuucaaa

SEQ ID NO: 3420763 - RNA, 12 nt, Human
aauugcuccuug

SEQ ID NO: 3420764 - RNA, 21 nt, Human
aauugcugaagggcauucuuu

SEQ ID NO: 3420765 - RNA, 19 nt, Human
aauugcugacuguagcuuu

SEQ ID NO: 3420766 - RNA, 12 nt, Human
aauugcugugcc

SEQ ID NO: 3420767 - RNA, 22 nt, Human
aauugcugugccucccaaaauu

SEQ ID NO: 3420768 - RNA, 13 nt, Human
aauugcuguguau

SEQ ID NO: 3420769 - RNA, 16 nt, Human
aauugcuguugaaagc

SEQ ID NO: 3420770 - RNA, 18 nt, Human
aauugcuguugaaagcaa

SEQ ID NO: 3420771 - RNA, 20 nt, Human
aauugcuuacauuuuuacaa

SEQ ID NO: 3420772 - RNA, 21 nt, Human
aauugcuuacauuuuuacaau

SEQ ID NO: 3420773 - RNA, 17 nt, Human
aauugcuugaaagaaaa

SEQ ID NO: 3420774 - RNA, 16 nt, Human
aauugcuuguuugcuu

SEQ ID NO: 3420775 - RNA, 11 nt, Human
aauugcuuuga

SEQ ID NO: 3420776 - RNA, 19 nt, Human
aauuggaaaagacuaagau

SEQ ID NO: 3420777 - RNA, 16 nt, Human
aauuggaacaaaguga

SEQ ID NO: 3420778 - RNA, 17 nt, Human
aauuggaacaaagugaa

SEQ ID NO: 3420779 - RNA, 18 nt, Human
aauuggaaugcacucaga

SEQ ID NO: 3420780 - RNA, 23 nt, Human
aauuggacagauugccuguuucu

SEQ ID NO: 3420781 - RNA, 19 nt, Human
aauuggacuuucaaaauua

SEQ ID NO: 3420782 - RNA, 15 nt, Human
aauuggagcucgugg

SEQ ID NO: 3420783 - RNA, 16 nt, Human
aauuggcauuaaaacu

SEQ ID NO: 3420784 - RNA, 21 nt, Human
aauuggguggggggcuucaua

SEQ ID NO: 3420785 - RNA, 22 nt, Human
accagggccagaaguagcuuug

SEQ ID NO: 3420786 - RNA, 19 nt, Human
accagggccugagccaagc

SEQ ID NO: 3420787 - RNA, 16 nt, Human
accagggccuuuucug

SEQ ID NO: 3420788 - RNA, 23 nt, Human
accagggccuuuucuggcaccgc

SEQ ID NO: 3420789 - RNA, 17 nt, Human
accaggggcaggcacag

SEQ ID NO: 3420790 - RNA, 20 nt, Human
accaggggcaggcacagcac

SEQ ID NO: 3420791 - RNA, 21 nt, Human
accaggguuggcaccuucccc

SEQ ID NO: 3420792 - RNA, 19 nt, Human
accagguccaaugagcuuu

SEQ ID NO: 3420793 - RNA, 19 nt, Human
accaggucuccuccaccgc

SEQ ID NO: 3420794 - RNA, 20 nt, Human
accaggucuccuccaccgcc

SEQ ID NO: 3420795 - RNA, 13 nt, Human
accaggugccuuu

SEQ ID NO: 3420796 - RNA, 23 nt, Human
accaggugccuuucaaauuuaga

SEQ ID NO: 3420797 - RNA, 19 nt, Human
accagguguucuacacuca

SEQ ID NO: 3420798 - RNA, 14 nt, Human
accagguugaaaga

SEQ ID NO: 3420799 - RNA, 15 nt, Human
accaguaaaguguaa

SEQ ID NO: 3420800 - RNA, 18 nt, Human
accaguacauucucaguu

SEQ ID NO: 3420801 - RNA, 16 nt, Human
accaguauaaaauuac

SEQ ID NO: 3420802 - RNA, 14 nt, Human
accaguauuguaca

SEQ ID NO: 3420803 - RNA, 11 nt, Human
accaguauuua

SEQ ID NO: 3420804 - RNA, 18 nt, Human
accaguauuuagaagcca

SEQ ID NO: 3420805 - RNA, 19 nt, Human
accaguauuuagaagccaa

SEQ ID NO: 3420806 - RNA, 19 nt, Human
accagucaucagcuauuca

SEQ ID NO: 3420807 - RNA, 15 nt, Human
accagucauuuuuca

SEQ ID NO: 3420808 - RNA, 15 nt, Human
accagucccagagca

SEQ ID NO: 3420809 - RNA, 14 nt, Human
accagucugaaguu

SEQ ID NO: 3420810 - RNA, 19 nt, Human
accagucugaaguuucauu

SEQ ID NO: 3420811 - RNA, 21 nt, Human
accagucugaaguuucauuua

SEQ ID NO: 3420812 - RNA, 19 nt, Human
accagucuuuaaaggccca

SEQ ID NO: 3420813 - RNA, 20 nt, Human
accagucuuuaaaggcccag

SEQ ID NO: 3420814 - RNA, 22 nt, Human
accagucuuuaaaggcccagcc

SEQ ID NO: 3420815 - RNA, 18 nt, Human
accagugaaccaaagaga

SEQ ID NO: 3420816 - RNA, 19 nt, Human
accagugaauuuuugcaau

SEQ ID NO: 3420817 - RNA, 17 nt, Human
accagugcaacagcacu

SEQ ID NO: 3420818 - RNA, 20 nt, Human
accagugcaggcuggccagc

SEQ ID NO: 3420819 - RNA, 23 nt, Human
accagugccucucccugcugcuc

SEQ ID NO: 3420820 - RNA, 21 nt, Human
accaguguagccuugcccgga

SEQ ID NO: 3420821 - RNA, 18 nt, Human
accaguguuguggauuua

SEQ ID NO: 3420822 - RNA, 17 nt, Human
accaguuaugugaauga

SEQ ID NO: 3420823 - RNA, 15 nt, Human
accaguucugggcaa

SEQ ID NO: 3420824 - RNA, 21 nt, Human
accaguugcacuuggccucug

SEQ ID NO: 3420825 - RNA, 21 nt, Human
accaguugcagucacucuagu

SEQ ID NO: 3420826 - RNA, 13 nt, Human
accaguugccuuu

SEQ ID NO: 3420827 - RNA, 14 nt, Human
accaguugccuuuu

SEQ ID NO: 3420828 - RNA, 15 nt, Human
accaguugccuuuua

SEQ ID NO: 3420829 - RNA, 20 nt, Human
accaguuuaaccugaugcag

SEQ ID NO: 3420830 - RNA, 21 nt, Human
accaguuuaaccugaugcagu

SEQ ID NO: 3420831 - RNA, 13 nt, Human
accauaacccagg

SEQ ID NO: 3420832 - RNA, 18 nt, Human
accauaagcuacugccau

SEQ ID NO: 3420833 - RNA, 16 nt, Human
accauaccuuccuucc

SEQ ID NO: 3420834 - RNA, 13 nt, Human
accauacuaauua

SEQ ID NO: 3420835 - RNA, 23 nt, Human
accauaguaccauuuauacaaau

SEQ ID NO: 3420836 - RNA, 14 nt, Human
accauauagcaaaa

SEQ ID NO: 3420837 - RNA, 12 nt, Human
accauaugaauu

SEQ ID NO: 3420838 - RNA, 19 nt, Human
accauaugcccacauuuag

SEQ ID NO: 3420839 - RNA, 20 nt, Human
accauauuaccacagacaua

SEQ ID NO: 3420840 - RNA, 13 nt, Human
accauauuuagca

SEQ ID NO: 3420841 - RNA, 20 nt, Human
accauauuuauccauuugua

SEQ ID NO: 3420842 - RNA, 14 nt, Human
accaucaagccacc

SEQ ID NO: 3420843 - RNA, 15 nt, Human
accaucaagccacca

SEQ ID NO: 3420844 - RNA, 15 nt, Human
accaucacagcuugu

SEQ ID NO: 3420845 - RNA, 16 nt, Human
accaucacagcuuguu

SEQ ID NO: 3420846 - RNA, 17 nt, Human
accaucaugucuggcua

SEQ ID NO: 3420847 - RNA, 23 nt, Human
accaucauugaaaucuuuuugcu

SEQ ID NO: 3420848 - RNA, 15 nt, Human
accauccaccaggcc

SEQ ID NO: 3420849 - RNA, 12 nt, Human
accauccccucc

SEQ ID NO: 3420850 - RNA, 21 nt, Human
accaucccugaaggccccgcc

SEQ ID NO: 3420851 - RNA, 19 nt, Human
accaucccuuuuugaagug

SEQ ID NO: 3420852 - RNA, 13 nt, Human
accauccuggcug

SEQ ID NO: 3420853 - RNA, 13 nt, Human
accaucucaggcc

SEQ ID NO: 3420854 - RNA, 15 nt, Human
accaucucaggccac

SEQ ID NO: 3420855 - RNA, 14 nt, Human
accaucucuuuacc

SEQ ID NO: 3420856 - RNA, 13 nt, Human
accaucugcuguc

SEQ ID NO: 3420857 - RNA, 14 nt, Human
accaucugcugucu

SEQ ID NO: 3420858 - RNA, 16 nt, Human
accaucuggccuggcc

SEQ ID NO: 3420859 - RNA, 23 nt, Human
accaugaagucucuaacaaugua

SEQ ID NO: 3420860 - RNA, 17 nt, Human
accaugacgcaaagaga

SEQ ID NO: 3420861 - RNA, 20 nt, Human
accaugagaagagggccugu

SEQ ID NO: 3420862 - RNA, 22 nt, Human
accaugaguggcauggccacca

SEQ ID NO: 3420863 - RNA, 17 nt, Human
aauuuuguaauuuucuu

SEQ ID NO: 3420864 - RNA, 13 nt, Human
aauuuuguacaaa

SEQ ID NO: 3420865 - RNA, 14 nt, Human
aauuuuguacaaau

SEQ ID NO: 3420866 - RNA, 16 nt, Human
aauuuuguaugaaaaa

SEQ ID NO: 3420867 - RNA, 16 nt, Human
aauuuuguauguuaaa

SEQ ID NO: 3420868 - RNA, 16 nt, Human
aauuuuguauuuucca

SEQ ID NO: 3420869 - RNA, 22 nt, Human
aauuuugucugccccaaguuuu

SEQ ID NO: 3420870 - RNA, 13 nt, Human
aauuuugugaagc

SEQ ID NO: 3420871 - RNA, 18 nt, Human
aauuuugugaagcaaaau

SEQ ID NO: 3420872 - RNA, 14 nt, Human
aauuuuguguaaga

SEQ ID NO: 3420873 - RNA, 22 nt, Human
aauuuuguguaagaaauacaga

SEQ ID NO: 3420874 - RNA, 20 nt, Human
aauuuuguucuaguuuucag

SEQ ID NO: 3420875 - RNA, 14 nt, Human
aauuuuguuucugu

SEQ ID NO: 3420876 - RNA, 16 nt, Human
aauuuuguuucuguac

SEQ ID NO: 3420877 - RNA, 19 nt, Human
aauuuuguuuucuugauuu

SEQ ID NO: 3420878 - RNA, 12 nt, Human
aauuuuuaaaaa

SEQ ID NO: 3420879 - RNA, 13 nt, Human
aauuuuuaaagua

SEQ ID NO: 3420880 - RNA, 20 nt, Human
aauuuuuaaaguauauauuu

SEQ ID NO: 3420881 - RNA, 14 nt, Human
aauuuuuaagagaa

SEQ ID NO: 3420882 - RNA, 17 nt, Human
aauuuuuaagcugcaaa

SEQ ID NO: 3420883 - RNA, 14 nt, Human
aauuuuuacagaau

SEQ ID NO: 3420884 - RNA, 20 nt, Human
aauuuuuacccuaaugucuu

SEQ ID NO: 3420885 - RNA, 16 nt, Human
aauuuuuaggaaguuu

SEQ ID NO: 3420886 - RNA, 13 nt, Human
aauuuuuaugugu

SEQ ID NO: 3420887 - RNA, 14 nt, Human
aauuuuuauuucuu

SEQ ID NO: 3420888 - RNA, 18 nt, Human
aauuuuuauuuucacccu

SEQ ID NO: 3420889 - RNA, 16 nt, Human
aauuuuuauuuuucua

SEQ ID NO: 3420890 - RNA, 19 nt, Human
aauuuuucagaugcuucug

SEQ ID NO: 3420891 - RNA, 21 nt, Human
aauuuuucagcucucuguaua

SEQ ID NO: 3420892 - RNA, 13 nt, Human
aauuuuucauauu

SEQ ID NO: 3420893 - RNA, 20 nt, Human
aauuuuucauugauaugaaa

SEQ ID NO: 3420894 - RNA, 14 nt, Human
aauuuuuccaacua

SEQ ID NO: 3420895 - RNA, 12 nt, Human
aauuuuucugca

SEQ ID NO: 3420896 - RNA, 16 nt, Human
aauuuuucugcacuga

SEQ ID NO: 3420897 - RNA, 23 nt, Human
aauuuuucugcacugagcagagu

SEQ ID NO: 3420898 - RNA, 12 nt, Human
aauuuuucugua

SEQ ID NO: 3420899 - RNA, 13 nt, Human
aauuuuucuguau

SEQ ID NO: 3420900 - RNA, 21 nt, Human
aauuuuucuguauagacagga

SEQ ID NO: 3420901 - RNA, 21 nt, Human
aauuuuucuuauuucauuucu

SEQ ID NO: 3420902 - RNA, 13 nt, Human
aauuuuucuucuu

SEQ ID NO: 3420903 - RNA, 13 nt, Human
aauuuuugauacu

SEQ ID NO: 3420904 - RNA, 17 nt, Human
aauuuuugccuucauua

SEQ ID NO: 3420905 - RNA, 23 nt, Human
aauuuuuggauugacaguaacuu

SEQ ID NO: 3420906 - RNA, 16 nt, Human
aauuuuugguugaaua

SEQ ID NO: 3420907 - RNA, 14 nt, Human
aauuuuuguaauuu

SEQ ID NO: 3420908 - RNA, 13 nt, Human
aauuuuuguagua

SEQ ID NO: 3420909 - RNA, 17 nt, Human
aauuuuuuauucuugug

SEQ ID NO: 3420910 - RNA, 16 nt, Human
aauuuuuugguacaaa

SEQ ID NO: 3420911 - RNA, 19 nt, Human
aauuuuuuguucuucagag

SEQ ID NO: 3420912 - RNA, 20 nt, Human
aauuuuuuguucuucagaga

SEQ ID NO: 3420913 - RNA, 20 nt, Human
aauuuuuuuaaccaaaggug

SEQ ID NO: 3420914 - RNA, 18 nt, Human
aauuuuuuuaauuuugua

SEQ ID NO: 3420915 - RNA, 20 nt, Human
aauuuuuuuagaaagcauuu

SEQ ID NO: 3420916 - RNA, 22 nt, Human
aauuuuuuuaucgucacugcuu

SEQ ID NO: 3420917 - RNA, 15 nt, Human
aauuuuuuuauuacu

SEQ ID NO: 3420918 - RNA, 16 nt, Human
aauuuuuuuauuguuu

SEQ ID NO: 3420919 - RNA, 19 nt, Human
aauuuuuuuauuguuuaaa

SEQ ID NO: 3420920 - RNA, 19 nt, Human
aauuuuuuucaauauuuau

SEQ ID NO: 3420921 - RNA, 16 nt, Human
aauuuuuuuguaauaa

SEQ ID NO: 3420922 - RNA, 12 nt, Human
aauuuuuuuuac

SEQ ID NO: 3420923 - RNA, 16 nt, Human
aauuuuuuuuacauuu

SEQ ID NO: 3420924 - RNA, 15 nt, Human
aauuuuuuuuaguau

SEQ ID NO: 3420925 - RNA, 20 nt, Human
aauuuuuuuuaguauuuauu

SEQ ID NO: 3420926 - RNA, 13 nt, Human
aauuuuuuuucau

SEQ ID NO: 3420927 - RNA, 23 nt, Human
aauuuuuuuucauguuuuaacaa

SEQ ID NO: 3420928 - RNA, 17 nt, Human
acaaaaaaaaaguuuua

SEQ ID NO: 3420929 - RNA, 22 nt, Human
acaaaaaaaaaguuuuauuuuu

SEQ ID NO: 3420930 - RNA, 17 nt, Human
acccuagcccucucccu

SEQ ID NO: 3420931 - RNA, 17 nt, Human
acccuagccuugcuugu

SEQ ID NO: 3420932 - RNA, 18 nt, Human
acccuagguucccuguuc

SEQ ID NO: 3420933 - RNA, 19 nt, Human
acccuagguucccuguucu

SEQ ID NO: 3420934 - RNA, 23 nt, Human
acccuagguucccuguucuuccu

SEQ ID NO: 3420935 - RNA, 21 nt, Human
acccuaguuaguguuuugccu

SEQ ID NO: 3420936 - RNA, 14 nt, Human
acccuaucuccuga

SEQ ID NO: 3420937 - RNA, 13 nt, Human
acccuauugcugc

SEQ ID NO: 3420938 - RNA, 21 nt, Human
acccucaaccucuucuggcuc

SEQ ID NO: 3420939 - RNA, 17 nt, Human
acccucacucugccagg

SEQ ID NO: 3420940 - RNA, 18 nt, Human
acccucacucugccaggg

SEQ ID NO: 3420941 - RNA, 21 nt, Human
acccucacucugccagggcag

SEQ ID NO: 3420942 - RNA, 15 nt, Human
acccucacuggcucu

SEQ ID NO: 3420943 - RNA, 18 nt, Human
acccucagagccaccccu

SEQ ID NO: 3420944 - RNA, 16 nt, Human
acccucagcaccccuu

SEQ ID NO: 3420945 - RNA, 19 nt, Human
acccucagcaccccuucca

SEQ ID NO: 3420946 - RNA, 22 nt, Human
acccucagcaccccuuccaugu

SEQ ID NO: 3420947 - RNA, 19 nt, Human
acccucaggcauaggccug

SEQ ID NO: 3420948 - RNA, 21 nt, Human
acccucaggggaaaacuguua

SEQ ID NO: 3420949 - RNA, 19 nt, Human
acccucagugagcauggua

SEQ ID NO: 3420950 - RNA, 15 nt, Human
acccucaucugucug

SEQ ID NO: 3420951 - RNA, 16 nt, Human
acccucaucugucugg

SEQ ID NO: 3420952 - RNA, 13 nt, Human
acccucaucuuuc

SEQ ID NO: 3420953 - RNA, 14 nt, Human
acccucaucuuucu

SEQ ID NO: 3420954 - RNA, 19 nt, Human
acccucaucuuucuuccaa

SEQ ID NO: 3420955 - RNA, 22 nt, Human
acccucaugcugccaauauccu

SEQ ID NO: 3420956 - RNA, 13 nt, Human
acccucaugcugu

SEQ ID NO: 3420957 - RNA, 16 nt, Human
acccucauuguguuuc

SEQ ID NO: 3420958 - RNA, 22 nt, Human
acccuccaaauggagaagcugc

SEQ ID NO: 3420959 - RNA, 11 nt, Human
acccuccaagg

SEQ ID NO: 3420960 - RNA, 12 nt, Human
acccuccaaggc

SEQ ID NO: 3420961 - RNA, 13 nt, Human
acccuccacccug

SEQ ID NO: 3420962 - RNA, 14 nt, Human
acccuccacccugu

SEQ ID NO: 3420963 - RNA, 20 nt, Human
acccuccaccgcagaaggaa

SEQ ID NO: 3420964 - RNA, 21 nt, Human
acccuccaccgcagaaggaag

SEQ ID NO: 3420965 - RNA, 15 nt, Human
acccuccacucuccu

SEQ ID NO: 3420966 - RNA, 14 nt, Human
acccucccaccccc

SEQ ID NO: 3420967 - RNA, 16 nt, Human
acccucccagaccugc

SEQ ID NO: 3420968 - RNA, 15 nt, Human
acccucccagcucug

SEQ ID NO: 3420969 - RNA, 22 nt, Human
acccuccccaaaggcuuugccc

SEQ ID NO: 3420970 - RNA, 10 nt, Human
acccuccccc

SEQ ID NO: 3420971 - RNA, 13 nt, Human
acccuccccuccc

SEQ ID NO: 3420972 - RNA, 19 nt, Human
acccuccccucucuugcac

SEQ ID NO: 3420973 - RNA, 21 nt, Human
acccuccccuucccagggcaa

SEQ ID NO: 3420974 - RNA, 12 nt, Human
acccucccucag

SEQ ID NO: 3420975 - RNA, 20 nt, Human
acccucccucagccccucuu

SEQ ID NO: 3420976 - RNA, 23 nt, Human
acccucccucagccccucuugcc

SEQ ID NO: 3420977 - RNA, 11 nt, Human
acccucccucc

SEQ ID NO: 3420978 - RNA, 17 nt, Human
acccucccucccuaccc

SEQ ID NO: 3420979 - RNA, 23 nt, Human
acccucccucuacugggagccua

SEQ ID NO: 3420980 - RNA, 13 nt, Human
acccucccugcug

SEQ ID NO: 3420981 - RNA, 15 nt, Human
acccucccugcuguc

SEQ ID NO: 3420982 - RNA, 15 nt, Human
acccucccuguucau

SEQ ID NO: 3420983 - RNA, 22 nt, Human
acccuccgccuucacuccggug

SEQ ID NO: 3420984 - RNA, 16 nt, Human
acccuccugucuuccc

SEQ ID NO: 3420985 - RNA, 20 nt, Human
acccuccugucuucccaggg

SEQ ID NO: 3420986 - RNA, 20 nt, Human
acccuccuguugcacccagc

SEQ ID NO: 3420987 - RNA, 21 nt, Human
acccuccuguugcacccagcc

SEQ ID NO: 3420988 - RNA, 24 nt, Human
acccuccuguugcacccagcccug

SEQ ID NO: 3420989 - RNA, 22 nt, Human
acccucgcuggcccccacuggc

SEQ ID NO: 3420990 - RNA, 20 nt, Human
acccucgggcccaccuggcc

SEQ ID NO: 3420991 - RNA, 17 nt, Human
acccucguggacaccug

SEQ ID NO: 3420992 - RNA, 19 nt, Human
acccucguggacaccugcc

SEQ ID NO: 3420993 - RNA, 14 nt, Human
acccucguggccuu

SEQ ID NO: 3420994 - RNA, 23 nt, Human
acccucuaaccucgcccucuccu

SEQ ID NO: 3420995 - RNA, 15 nt, Human
acccucuccacccca

SEQ ID NO: 3420996 - RNA, 14 nt, Human
acccucugaaauac

SEQ ID NO: 3420997 - RNA, 22 nt, Human
acccucugaaugguccaggguu

SEQ ID NO: 3420998 - RNA, 13 nt, Human
acccucugagcuu

SEQ ID NO: 3420999 - RNA, 18 nt, Human
acccucugagcuuugcau

SEQ ID NO: 3421000 - RNA, 21 nt, Human
acccucugagcuuugcauguu

SEQ ID NO: 3421001 - RNA, 17 nt, Human
acccucugccaccagag

SEQ ID NO: 3421002 - RNA, 20 nt, Human
acccucugccaccagagacc

SEQ ID NO: 3421003 - RNA, 15 nt, Human
acccucugcugaaga

SEQ ID NO: 3421004 - RNA, 17 nt, Human
acccucugcugaagacu

SEQ ID NO: 3421005 - RNA, 23 nt, Human
acccucugggaaccucccagagg

SEQ ID NO: 3421006 - RNA, 21 nt, Human
acccucuguuccuucccugug

SEQ ID NO: 3421007 - RNA, 13 nt, Human
acccucuucaugg

SEQ ID NO: 3421008 - RNA, 18 nt, Human
acccucuugcccauccug

SEQ ID NO: 3421009 - RNA, 11 nt, Human
acccugaaaug

SEQ ID NO: 3421010 - RNA, 23 nt, Human
acccugaacaacgagccuuuuca

SEQ ID NO: 3421011 - RNA, 12 nt, Human
acccugaagggg

SEQ ID NO: 3421012 - RNA, 17 nt, Human
acccugaaggggccaug

SEQ ID NO: 3421013 - RNA, 21 nt, Human
acccugaaugguuccaugccu

SEQ ID NO: 3421014 - RNA, 21 nt, Human
acccugacaaauuuuaauuau

SEQ ID NO: 3421015 - RNA, 16 nt, Human
acccugagccccuucc

SEQ ID NO: 3421016 - RNA, 13 nt, Human
acccugaggccca

SEQ ID NO: 3421017 - RNA, 23 nt, Human
acccugaggcccagagggccugc

SEQ ID NO: 3421018 - RNA, 21 nt, Human
acaaacuuuaggguaaaaauu

SEQ ID NO: 3421019 - RNA, 22 nt, Human
acaaacuuuaggguaaaaauug

SEQ ID NO: 3421020 - RNA, 19 nt, Human
acaaacuuugcaucucagu

SEQ ID NO: 3421021 - RNA, 17 nt, Human
acaaagaaacaaagaug

SEQ ID NO: 3421022 - RNA, 12 nt, Human
acaaagaaauau

SEQ ID NO: 3421023 - RNA, 22 nt, Human
acaaagaaauccggagaagcug

SEQ ID NO: 3421024 - RNA, 15 nt, Human
acaaagaagacaugu

SEQ ID NO: 3421025 - RNA, 19 nt, Human
acaaagaagacauguuuua

SEQ ID NO: 3421026 - RNA, 21 nt, Human
acaaagaagacauguuuuaga

SEQ ID NO: 3421027 - RNA, 14 nt, Human
acaaagaauuuaaa

SEQ ID NO: 3421028 - RNA, 17 nt, Human
acaaagacaaaagucug

SEQ ID NO: 3421029 - RNA, 15 nt, Human
acaaagacauugauu

SEQ ID NO: 3421030 - RNA, 14 nt, Human
acaaagagaaaaag

SEQ ID NO: 3421031 - RNA, 20 nt, Human
acaaagagaaaaagaaaugc

SEQ ID NO: 3421032 - RNA, 17 nt, Human
acaaagagacaaagcuu

SEQ ID NO: 3421033 - RNA, 16 nt, Human
acaaagaguucaagaa

SEQ ID NO: 3421034 - RNA, 19 nt, Human
acaaagaguucaagaaaua

SEQ ID NO: 3421035 - RNA, 23 nt, Human
acaaagaguucuggaaaagaacu

SEQ ID NO: 3421036 - RNA, 14 nt, Human
acaaagauaucuuu

SEQ ID NO: 3421037 - RNA, 17 nt, Human
acaaagauaucuuuucu

SEQ ID NO: 3421038 - RNA, 16 nt, Human
acaaagcacaguguua

SEQ ID NO: 3421039 - RNA, 17 nt, Human
acaaagcacuagagaau

SEQ ID NO: 3421040 - RNA, 21 nt, Human
acaaagcagaauaguauuuuu

SEQ ID NO: 3421041 - RNA, 14 nt, Human
acaaagcagccacg

SEQ ID NO: 3421042 - RNA, 17 nt, Human
acaaagccaacagucaa

SEQ ID NO: 3421043 - RNA, 15 nt, Human
acaaagcccuuuuau

SEQ ID NO: 3421044 - RNA, 18 nt, Human
acaaagccuuaucaagug

SEQ ID NO: 3421045 - RNA, 19 nt, Human
acaaagccuuaucaagugu

SEQ ID NO: 3421046 - RNA, 23 nt, Human
acaaagccuuaucaagugucuuc

SEQ ID NO: 3421047 - RNA, 16 nt, Human
acaaagcugcuaaauc

SEQ ID NO: 3421048 - RNA, 14 nt, Human
acaaagcuguuaaa

SEQ ID NO: 3421049 - RNA, 17 nt, Human
acaaagcuguuaaacug

SEQ ID NO: 3421050 - RNA, 19 nt, Human
acaaagcuguuaaacuguu

SEQ ID NO: 3421051 - RNA, 19 nt, Human
acaaagcuuagcaggagag

SEQ ID NO: 3421052 - RNA, 20 nt, Human
acaaagcuucuaucccagga

SEQ ID NO: 3421053 - RNA, 23 nt, Human
acaaagcuucuaucccaggaggu

SEQ ID NO: 3421054 - RNA, 11 nt, Human
acaaaggaaaa

SEQ ID NO: 3421055 - RNA, 22 nt, Human
acaaaggaugcccaaagaugca

SEQ ID NO: 3421056 - RNA, 18 nt, Human
acaaaggcaaagggucca

SEQ ID NO: 3421057 - RNA, 14 nt, Human
acaaaggccaaacu

SEQ ID NO: 3421058 - RNA, 16 nt, Human
acaaaggcuguauuca

SEQ ID NO: 3421059 - RNA, 17 nt, Human
acaaaggggaaagaaca

SEQ ID NO: 3421060 - RNA, 18 nt, Human
acaaaggggaaagaacau

SEQ ID NO: 3421061 - RNA, 18 nt, Human
acaaaggguuuuaaugua

SEQ ID NO: 3421062 - RNA, 22 nt, Human
acaaaggugaaaauuguuugua

SEQ ID NO: 3421063 - RNA, 14 nt, Human
acaaagguuuaaau

SEQ ID NO: 3421064 - RNA, 16 nt, Human
acaaagguuuaaauga

SEQ ID NO: 3421065 - RNA, 14 nt, Human
acaaaguaauuccu

SEQ ID NO: 3421066 - RNA, 16 nt, Human
acaaaguauuaagcau

SEQ ID NO: 3421067 - RNA, 18 nt, Human
acaaaguauuaagcauau

SEQ ID NO: 3421068 - RNA, 16 nt, Human
acaaagucuuuggggu

SEQ ID NO: 3421069 - RNA, 14 nt, Human
acaaagugccaaag

SEQ ID NO: 3421070 - RNA, 16 nt, Human
acaaagugccaaagaa

SEQ ID NO: 3421071 - RNA, 23 nt, Human
acaaagugccaaagaaagugguc

SEQ ID NO: 3421072 - RNA, 14 nt, Human
acaaaguguauuca

SEQ ID NO: 3421073 - RNA, 12 nt, Human
acaaagugugua

SEQ ID NO: 3421074 - RNA, 22 nt, Human
acccuguacuguucugugucuu

SEQ ID NO: 3421075 - RNA, 21 nt, Human
acccugucucuacuaaaaaua

SEQ ID NO: 3421076 - RNA, 20 nt, Human
acccugugcagaagggagcu

SEQ ID NO: 3421077 - RNA, 19 nt, Human
acccugugcugguguccug

SEQ ID NO: 3421078 - RNA, 14 nt, Human
acccuguggcccug

SEQ ID NO: 3421079 - RNA, 17 nt, Human
acccuguggucuuccuc

SEQ ID NO: 3421080 - RNA, 18 nt, Human
acccuguuccugcugcug

SEQ ID NO: 3421081 - RNA, 18 nt, Human
acccuguuccuggagguc

SEQ ID NO: 3421082 - RNA, 15 nt, Human
acccuuaacccaagg

SEQ ID NO: 3421083 - RNA, 17 nt, Human
acccuuaacccaaggag

SEQ ID NO: 3421084 - RNA, 18 nt, Human
acccuuaccccuuagccu

SEQ ID NO: 3421085 - RNA, 19 nt, Human
acccuuaccccuuagccuc

SEQ ID NO: 3421086 - RNA, 22 nt, Human
acccuuacuggcuuaccuccuc

SEQ ID NO: 3421087 - RNA, 12 nt, Human
acccuuagaaaa

SEQ ID NO: 3421088 - RNA, 15 nt, Human
acccuuauaaaaucc

SEQ ID NO: 3421089 - RNA, 18 nt, Human
acccuucaucuuccugug

SEQ ID NO: 3421090 - RNA, 20 nt, Human
acccuucaucuuccuguguc

SEQ ID NO: 3421091 - RNA, 21 nt, Human
acccuucaucuuccugugucc

SEQ ID NO: 3421092 - RNA, 21 nt, Human
acccuucccaaucagcacuga

SEQ ID NO: 3421093 - RNA, 22 nt, Human
acccuucccaaucagcacugaa

SEQ ID NO: 3421094 - RNA, 23 nt, Human
acccuucccaaucagcacugaaa

SEQ ID NO: 3421095 - RNA, 13 nt, Human
acccuucccugca

SEQ ID NO: 3421096 - RNA, 15 nt, Human
acccuucccugcacu

SEQ ID NO: 3421097 - RNA, 17 nt, Human
acccuuccugagcuuua

SEQ ID NO: 3421098 - RNA, 17 nt, Human
acccuucucccacucuc

SEQ ID NO: 3421099 - RNA, 18 nt, Human
acccuucucccacucucc

SEQ ID NO: 3421100 - RNA, 21 nt, Human
acccuucugugcccagcucag

SEQ ID NO: 3421101 - RNA, 13 nt, Human
acccuucuuuucu

SEQ ID NO: 3421102 - RNA, 13 nt, Human
acccuugaaaaga

SEQ ID NO: 3421103 - RNA, 15 nt, Human
acccuugagcccucc

SEQ ID NO: 3421104 - RNA, 20 nt, Human
acccuugccgucuaccugag

SEQ ID NO: 3421105 - RNA, 12 nt, Human
acccuuggccug

SEQ ID NO: 3421106 - RNA, 17 nt, Human
acccuuggccugucuca

SEQ ID NO: 3421107 - RNA, 17 nt, Human
acccuugggccagaagu

SEQ ID NO: 3421108 - RNA, 15 nt, Human
acccuugugguccca

SEQ ID NO: 3421109 - RNA, 16 nt, Human
acccuuguggucccac

SEQ ID NO: 3421110 - RNA, 19 nt, Human
acccuuguggucccacccc

SEQ ID NO: 3421111 - RNA, 23 nt, Human
acccuuguggucccaccccacac

SEQ ID NO: 3421112 - RNA, 20 nt, Human
acccuuuccuccuuuaucac

SEQ ID NO: 3421113 - RNA, 18 nt, Human
acccuuucuacuuccaag

SEQ ID NO: 3421114 - RNA, 17 nt, Human
acccuuucuucagcucu

SEQ ID NO: 3421115 - RNA, 20 nt, Human
acccuuugaauuggacaaua

SEQ ID NO: 3421116 - RNA, 22 nt, Human
acccuuugcugugaggcugucc

SEQ ID NO: 3421117 - RNA, 23 nt, Human
acccuuuggggggggcccgccug

SEQ ID NO: 3421118 - RNA, 17 nt, Human
acccuuuggggguugaa

SEQ ID NO: 3421119 - RNA, 12 nt, Human
acccuuuuccag

SEQ ID NO: 3421120 - RNA, 15 nt, Human
acccuuuuccauuuu

SEQ ID NO: 3421121 - RNA, 10 nt, Human
acccuuuucu

SEQ ID NO: 3421122 - RNA, 14 nt, Human
acccuuuuggcccc

SEQ ID NO: 3421123 - RNA, 21 nt, Human
acccuuuuggguuucugcccu

SEQ ID NO: 3421124 - RNA, 17 nt, Human
acccuuuuucuccagcu

SEQ ID NO: 3421125 - RNA, 21 nt, Human
accgaacugauguaaguaaac

SEQ ID NO: 3421126 - RNA, 21 nt, Human
accgaacugggcauauuucua

SEQ ID NO: 3421127 - RNA, 23 nt, Human
accgaaguggacuggccccuggg

SEQ ID NO: 3421128 - RNA, 15 nt, Human
accgaaugugucuuu

SEQ ID NO: 3421129 - RNA, 22 nt, Human
accgaaugugucuuuagauagc

SEQ ID NO: 3421130 - RNA, 15 nt, Human
accgacuagacacac

SEQ ID NO: 3421131 - RNA, 17 nt, Human
accgacuagccaggaag

SEQ ID NO: 3421132 - RNA, 15 nt, Human
accgagcaaagauca

SEQ ID NO: 3421133 - RNA, 17 nt, Human
accgagcaaagaucaaa

SEQ ID NO: 3421134 - RNA, 15 nt, Human
accgaggacaugaaa

SEQ ID NO: 3421135 - RNA, 13 nt, Human
accgaggcaggga

SEQ ID NO: 3421136 - RNA, 17 nt, Human
accgaggcgcgggggcc

SEQ ID NO: 3421137 - RNA, 14 nt, Human
accgaggggccuuu

SEQ ID NO: 3421138 - RNA, 15 nt, Human
accgaggggccuuug

SEQ ID NO: 3421139 - RNA, 21 nt, Human
accgaggggccuuuguucugg

SEQ ID NO: 3421140 - RNA, 21 nt, Human
accgagucucuucuccacugg

SEQ ID NO: 3421141 - RNA, 24 nt, Human
accgagucucuucuccacuggaug

SEQ ID NO: 3421142 - RNA, 20 nt, Human
accgaugcaaacauuggaag

SEQ ID NO: 3421143 - RNA, 15 nt, Human
accgaugcuccagcc

SEQ ID NO: 3421144 - RNA, 23 nt, Human
accgaugcuccagccaaccccug

SEQ ID NO: 3421145 - RNA, 15 nt, Human
accgaugcuuuacca

SEQ ID NO: 3421146 - RNA, 22 nt, Human
accgauucaucucucagaaggg

SEQ ID NO: 3421147 - RNA, 24 nt, Human
accgauucuuuggaguugucacau

SEQ ID NO: 3421148 - RNA, 18 nt, Human
accgcacagcucaggagg

SEQ ID NO: 3421149 - RNA, 14 nt, Human
accgcagaaggaag

SEQ ID NO: 3421150 - RNA, 12 nt, Human
accgcagacagg

SEQ ID NO: 3421151 - RNA, 20 nt, Human
accgcagacaggaccaggga

SEQ ID NO: 3421152 - RNA, 16 nt, Human
accgcaggaagcugcu

SEQ ID NO: 3421153 - RNA, 21 nt, Human
accgcagucgucgcacagucu

SEQ ID NO: 3421154 - RNA, 21 nt, Human
accgccacacacacaggagca

SEQ ID NO: 3421155 - RNA, 20 nt, Human
accgccagauggggccucug

SEQ ID NO: 3421156 - RNA, 13 nt, Human
accgccagcucug

SEQ ID NO: 3421157 - RNA, 21 nt, Human
accgccagcucuguucuuccu

SEQ ID NO: 3421158 - RNA, 19 nt, Human
accgcccccugucucucag

SEQ ID NO: 3421159 - RNA, 16 nt, Human
accgcccuuuuccccu

SEQ ID NO: 3421160 - RNA, 19 nt, Human
accgccuccuacagcccac

SEQ ID NO: 3421161 - RNA, 16 nt, Human
accgcgacuaauuuca

SEQ ID NO: 3421162 - RNA, 19 nt, Human
accgcgucuacccugggau

SEQ ID NO: 3421163 - RNA, 13 nt, Human
accgcguuguaaa

SEQ ID NO: 3421164 - RNA, 13 nt, Human
accgcuaaaagaa

SEQ ID NO: 3421165 - RNA, 16 nt, Human
accgcuaaaagaaacu

SEQ ID NO: 3421166 - RNA, 17 nt, Human
accgcuacaccacucug

SEQ ID NO: 3421167 - RNA, 12 nt, Human
accgcuccaggu

SEQ ID NO: 3421168 - RNA, 19 nt, Human
accgcuccccagcccaggg

SEQ ID NO: 3421169 - RNA, 16 nt, Human
accgcucucuuuucug

SEQ ID NO: 3421170 - RNA, 21 nt, Human
accgcuuguggggacccaggc

SEQ ID NO: 3421171 - RNA, 16 nt, Human
accgcuuuggccugag

SEQ ID NO: 3421172 - RNA, 17 nt, Human
accgcuuuggccugagu

SEQ ID NO: 3421173 - RNA, 16 nt, Human
accggaagcuccuggu

SEQ ID NO: 3421174 - RNA, 15 nt, Human
accggaccagccugg

SEQ ID NO: 3421175 - RNA, 12 nt, Human
accggaccaucu

SEQ ID NO: 3421176 - RNA, 15 nt, Human
accggacuuuucugc

SEQ ID NO: 3421177 - RNA, 16 nt, Human
accggacuuuucugca

SEQ ID NO: 3421178 - RNA, 13 nt, Human
acaacggaggccu

SEQ ID NO: 3421179 - RNA, 14 nt, Human
acaacgugcauugu

SEQ ID NO: 3421180 - RNA, 18 nt, Human
acaacgugcauugugcuu

SEQ ID NO: 3421181 - RNA, 22 nt, Human
acaacgugcucuuuguuuugug

SEQ ID NO: 3421182 - RNA, 19 nt, Human
acaacuaggcuucagcaua

SEQ ID NO: 3421183 - RNA, 15 nt, Human
acaacuauuuucaga

SEQ ID NO: 3421184 - RNA, 16 nt, Human
acaacuauuuuuccaa

SEQ ID NO: 3421185 - RNA, 17 nt, Human
acaacucacuccuuuua

SEQ ID NO: 3421186 - RNA, 14 nt, Human
acaacucauacacu

SEQ ID NO: 3421187 - RNA, 13 nt, Human
acaacugaguccu

SEQ ID NO: 3421188 - RNA, 14 nt, Human
acaacugaguccuu

SEQ ID NO: 3421189 - RNA, 18 nt, Human
acaacugcaauaacuucu

SEQ ID NO: 3421190 - RNA, 20 nt, Human
acaacugcaauaacuucuga

SEQ ID NO: 3421191 - RNA, 16 nt, Human
acaacuggcaggcagg

SEQ ID NO: 3421192 - RNA, 19 nt, Human
acaacugucuaacuuuaga

SEQ ID NO: 3421193 - RNA, 14 nt, Human
acaacuuaguguaa

SEQ ID NO: 3421194 - RNA, 14 nt, Human
acaacuucuuugua

SEQ ID NO: 3421195 - RNA, 24 nt, Human
acaacuugcacguauuuuaauagc

SEQ ID NO: 3421196 - RNA, 22 nt, Human
acaacuugucuauuaccuguua

SEQ ID NO: 3421197 - RNA, 13 nt, Human
acaacuuugccag

SEQ ID NO: 3421198 - RNA, 15 nt, Human
acaacuuuuaaccaa

SEQ ID NO: 3421199 - RNA, 16 nt, Human
acaagaaaaauaaaga

SEQ ID NO: 3421200 - RNA, 18 nt, Human
acaagaaaaauaaagaaa

SEQ ID NO: 3421201 - RNA, 10 nt, Human
acaagaaaau

SEQ ID NO: 3421202 - RNA, 13 nt, Human
acaagaaaaucag

SEQ ID NO: 3421203 - RNA, 20 nt, Human
acaagaaacucaaugcacaa

SEQ ID NO: 3421204 - RNA, 15 nt, Human
acaagaaaguuuccc

SEQ ID NO: 3421205 - RNA, 16 nt, Human
acaagaaaugaaagca

SEQ ID NO: 3421206 - RNA, 15 nt, Human
acaagaacugaaacc

SEQ ID NO: 3421207 - RNA, 14 nt, Human
acaagaagaagggc

SEQ ID NO: 3421208 - RNA, 19 nt, Human
acaagaagaauuugaagac

SEQ ID NO: 3421209 - RNA, 18 nt, Human
acaagaagcauuuuguaa

SEQ ID NO: 3421210 - RNA, 20 nt, Human
acaagaagccacagaccuag

SEQ ID NO: 3421211 - RNA, 17 nt, Human
acaagaaucacuugaac

SEQ ID NO: 3421212 - RNA, 14 nt, Human
acaagaauggauca

SEQ ID NO: 3421213 - RNA, 23 nt, Human
acaagaauggaucacaagaugga

SEQ ID NO: 3421214 - RNA, 14 nt, Human
acaagacacaguga

SEQ ID NO: 3421215 - RNA, 15 nt, Human
acaagacccccagca

SEQ ID NO: 3421216 - RNA, 19 nt, Human
acaagaccccgucucaaaa

SEQ ID NO: 3421217 - RNA, 13 nt, Human
acaagacugcaca

SEQ ID NO: 3421218 - RNA, 14 nt, Human
acaagacuucagua

SEQ ID NO: 3421219 - RNA, 16 nt, Human
acacuacaccacacac

SEQ ID NO: 3421220 - RNA, 14 nt, Human
acacuacacccagc

SEQ ID NO: 3421221 - RNA, 17 nt, Human
acacuacacccagcaau

SEQ ID NO: 3421222 - RNA, 21 nt, Human
acacuagccagacacucugcu

SEQ ID NO: 3421223 - RNA, 20 nt, Human
acacuagcccaaugaaauga

SEQ ID NO: 3421224 - RNA, 20 nt, Human
acacuagucugugugcugug

SEQ ID NO: 3421225 - RNA, 17 nt, Human
acacuauaucuguauau

SEQ ID NO: 3421226 - RNA, 19 nt, Human
acacuaugguauuugagug

SEQ ID NO: 3421227 - RNA, 22 nt, Human
acacuaugguauuugaguguuu

SEQ ID NO: 3421228 - RNA, 16 nt, Human
acacuauucacuaaaa

SEQ ID NO: 3421229 - RNA, 15 nt, Human
acccuggggaaggag

SEQ ID NO: 3421230 - RNA, 16 nt, Human
acccuggggagaaagu

SEQ ID NO: 3421231 - RNA, 14 nt, Human
acccuggggccuga

SEQ ID NO: 3421232 - RNA, 18 nt, Human
acccugggggcacaggag

SEQ ID NO: 3421233 - RNA, 22 nt, Human
acccugggggcacaggaggcag

SEQ ID NO: 3421234 - RNA, 18 nt, Human
acccugggugggcucugu

SEQ ID NO: 3421235 - RNA, 19 nt, Human
acccugggugggcucugug

SEQ ID NO: 3421236 - RNA, 23 nt, Human
acccuggguguccccgcugcugu

SEQ ID NO: 3421237 - RNA, 20 nt, Human
acccuggugaggaagcucca

SEQ ID NO: 3421238 - RNA, 15 nt, Human
acccuggugggccaa

SEQ ID NO: 3421239 - RNA, 16 nt, Human
acccuguaccucaucc

SEQ ID NO: 3421240 - RNA, 18 nt, Human
acccuguauauagcccag

SEQ ID NO: 3421241 - RNA, 20 nt, Human
acccuguauauagcccagcc

SEQ ID NO: 3421242 - RNA, 18 nt, Human
acccugucaaacauuagu

SEQ ID NO: 3421243 - RNA, 16 nt, Human
acccugucccccagcu

SEQ ID NO: 3421244 - RNA, 20 nt, Human
acccugucccccagcucugg

SEQ ID NO: 3421245 - RNA, 14 nt, Human
acccugucucuacu

SEQ ID NO: 3421246 - RNA, 21 nt, Human
acccugucugccccgcccuca

SEQ ID NO: 3421247 - RNA, 22 nt, Human
acccugucuguagagggcccug

SEQ ID NO: 3421248 - RNA, 19 nt, Human
acccugugacauggugccu

SEQ ID NO: 3421249 - RNA, 21 nt, Human
acccugugacauggugccuga

SEQ ID NO: 3421250 - RNA, 15 nt, Human
acccugugcuggugu

SEQ ID NO: 3421251 - RNA, 16 nt, Human
acccuguggcccuggc

SEQ ID NO: 3421252 - RNA, 15 nt, Human
acccuguuccugcug

SEQ ID NO: 3421253 - RNA, 12 nt, Human
acccuguugcua

SEQ ID NO: 3421254 - RNA, 14 nt, Human
acccuguuuccuga

SEQ ID NO: 3421255 - RNA, 15 nt, Human
acccuguuuccugag

SEQ ID NO: 3421256 - RNA, 18 nt, Human
acccuguuuggauuuuua

SEQ ID NO: 3421257 - RNA, 23 nt, Human
acccuuaaacaguugcacagcau

SEQ ID NO: 3421258 - RNA, 14 nt, Human
acccuuaacccaag

SEQ ID NO: 3421259 - RNA, 16 nt, Human
acccuuaacccaagga

SEQ ID NO: 3421260 - RNA, 23 nt, Human
acccuuaacccaaggagcacagg

SEQ ID NO: 3421261 - RNA, 16 nt, Human
acccuuaagucacccu

SEQ ID NO: 3421262 - RNA, 18 nt, Human
acccuuacagccucugac

SEQ ID NO: 3421263 - RNA, 18 nt, Human
acccuuaccaugugccug

SEQ ID NO: 3421264 - RNA, 13 nt, Human
acccuuagaaaau

SEQ ID NO: 3421265 - RNA, 23 nt, Human
acccuuaucaccagcugccucuu

SEQ ID NO: 3421266 - RNA, 15 nt, Human
acccuucaucuuccu

SEQ ID NO: 3421267 - RNA, 13 nt, Human
acccuucccaauc

SEQ ID NO: 3421268 - RNA, 16 nt, Human
acccuucccugcacua

SEQ ID NO: 3421269 - RNA, 14 nt, Human
acccuucucccacu

SEQ ID NO: 3421270 - RNA, 20 nt, Human
acccuucucccacucuccua

SEQ ID NO: 3421271 - RNA, 15 nt, Human
acccuucuccucuug

SEQ ID NO: 3421272 - RNA, 17 nt, Human
acccuucuccucuugua

SEQ ID NO: 3421273 - RNA, 19 nt, Human
acccuucuccucuuguaaa

SEQ ID NO: 3421274 - RNA, 23 nt, Human
acccuucuccucuuguaaauaaa

SEQ ID NO: 3421275 - RNA, 18 nt, Human
acccuucuggaaacugug

SEQ ID NO: 3421276 - RNA, 13 nt, Human
acccuucuuucca

SEQ ID NO: 3421277 - RNA, 20 nt, Human
acccuucuuuccauuucucu

SEQ ID NO: 3421278 - RNA, 14 nt, Human
acccuucuuuccuc

SEQ ID NO: 3421279 - RNA, 12 nt, Human
acccuucuuuuc

SEQ ID NO: 3421280 - RNA, 17 nt, Human
acccuugccgucuaccu

SEQ ID NO: 3421281 - RNA, 16 nt, Human
acccuugcugugaauu

SEQ ID NO: 3421282 - RNA, 18 nt, Human
acccuuggacuugaggau

SEQ ID NO: 3421283 - RNA, 21 nt, Human
acccuuggaggcugucuucuc

SEQ ID NO: 3421284 - RNA, 17 nt, Human
acccuuggcuugcccac

SEQ ID NO: 3421285 - RNA, 20 nt, Human
acccuuguggucccacccca

SEQ ID NO: 3421286 - RNA, 14 nt, Human
acccuuuauuugaa

SEQ ID NO: 3421287 - RNA, 21 nt, Human
acccuuuccagguucugaaag

SEQ ID NO: 3421288 - RNA, 20 nt, Human
acccuuucccccuucucuua

SEQ ID NO: 3421289 - RNA, 15 nt, Human
acccuuuccuuccuu

SEQ ID NO: 3421290 - RNA, 17 nt, Human
acccuuuccuuccuucc

SEQ ID NO: 3421291 - RNA, 23 nt, Human
acccuuugcugugaggcuguccu

SEQ ID NO: 3421292 - RNA, 12 nt, Human
acccuuugguuu

SEQ ID NO: 3421293 - RNA, 23 nt, Human
acccuuugguuuuuuucuucugu

SEQ ID NO: 3421294 - RNA, 17 nt, Human
acccuuuuaaaguugau

SEQ ID NO: 3421295 - RNA, 19 nt, Human
acccuuuuccuuugugguu

SEQ ID NO: 3421296 - RNA, 20 nt, Human
accgaaaacguggcugcuuc

SEQ ID NO: 3421297 - RNA, 22 nt, Human
accgaaaacguggcugcuucaa

SEQ ID NO: 3421298 - RNA, 13 nt, Human
accgaagcccaga

SEQ ID NO: 3421299 - RNA, 21 nt, Human
accgaaguggacuggccccug

SEQ ID NO: 3421300 - RNA, 13 nt, Human
accgaauaaaugu

SEQ ID NO: 3421301 - RNA, 19 nt, Human
accgaaugugucuuuagau

SEQ ID NO: 3421302 - RNA, 17 nt, Human
accgacgcgucuccugu

SEQ ID NO: 3421303 - RNA, 23 nt, Human
accgagaguagccgagagccugc

SEQ ID NO: 3421304 - RNA, 23 nt, Human
accgagccucugucacugcaggc

SEQ ID NO: 3421305 - RNA, 17 nt, Human
accgaggagggagaguc

SEQ ID NO: 3421306 - RNA, 21 nt, Human
accgaggagggagagucuccc

SEQ ID NO: 3421307 - RNA, 16 nt, Human
accgaggcgcgggggc

SEQ ID NO: 3421308 - RNA, 19 nt, Human
accgaggggcucaggaaaa

SEQ ID NO: 3421309 - RNA, 18 nt, Human
accgaguagaaaauguga

SEQ ID NO: 3421310 - RNA, 20 nt, Human
accgaguagaaaaugugacc

SEQ ID NO: 3421311 - RNA, 16 nt, Human
accgagucucuucucc

SEQ ID NO: 3421312 - RNA, 18 nt, Human
accgagucucuucuccac

SEQ ID NO: 3421313 - RNA, 14 nt, Human
accgagugaaccua

SEQ ID NO: 3421314 - RNA, 12 nt, Human
accgcacagcuc

SEQ ID NO: 3421315 - RNA, 14 nt, Human
accgcacagcucag

SEQ ID NO: 3421316 - RNA, 13 nt, Human
accgcagaaggaa

SEQ ID NO: 3421317 - RNA, 15 nt, Human
accgcagaaggaagg

SEQ ID NO: 3421318 - RNA, 16 nt, Human
accgcagacaggacca

SEQ ID NO: 3421319 - RNA, 17 nt, Human
accgcagacaggaccag

SEQ ID NO: 3421320 - RNA, 12 nt, Human
accgcaggaagc

SEQ ID NO: 3421321 - RNA, 13 nt, Human
accgcaggaagcu

SEQ ID NO: 3421322 - RNA, 14 nt, Human
accgcaggaagcug

SEQ ID NO: 3421323 - RNA, 19 nt, Human
accgcaggaagcugcuccg

SEQ ID NO: 3421324 - RNA, 23 nt, Human
accgcagucgucgcacagucucu

SEQ ID NO: 3421325 - RNA, 14 nt, Human
accgcaugcccccu

SEQ ID NO: 3421326 - RNA, 22 nt, Human
accgcaugcccccucgugccag

SEQ ID NO: 3421327 - RNA, 17 nt, Human
accgccagauggggccu

SEQ ID NO: 3421328 - RNA, 14 nt, Human
accgccagcucugu

SEQ ID NO: 3421329 - RNA, 23 nt, Human
accgcccagcggcuugccugccu

SEQ ID NO: 3421330 - RNA, 15 nt, Human
accgccccuggccgc

SEQ ID NO: 3421331 - RNA, 16 nt, Human
accgccccuggccgcg

SEQ ID NO: 3421332 - RNA, 11 nt, Human
accgcccgucu

SEQ ID NO: 3421333 - RNA, 13 nt, Human
accgcccgucugu

SEQ ID NO: 3421334 - RNA, 18 nt, Human
accgcccuuuuccccuac

SEQ ID NO: 3421335 - RNA, 18 nt, Human
accgccgacuuuguaccc

SEQ ID NO: 3421336 - RNA, 18 nt, Human
accgccggccagcuggga

SEQ ID NO: 3421337 - RNA, 20 nt, Human
accgccuccccaccuccagg

SEQ ID NO: 3421338 - RNA, 21 nt, Human
accgccuccccaccuccaggc

SEQ ID NO: 3421339 - RNA, 16 nt, Human
accgccugucucuuua

SEQ ID NO: 3421340 - RNA, 15 nt, Human
accgccuugcccagc

SEQ ID NO: 3421341 - RNA, 16 nt, Human
accgccuugcccagcc

SEQ ID NO: 3421342 - RNA, 16 nt, Human
accgcgcccagccuca

SEQ ID NO: 3421343 - RNA, 19 nt, Human
accgcgggugugggaaagc

SEQ ID NO: 3421344 - RNA, 17 nt, Human
accgcgucuacccuggg

SEQ ID NO: 3421345 - RNA, 15 nt, Human
accgcguuguaaaau

SEQ ID NO: 3421346 - RNA, 18 nt, Human
accgcguuguaaaauaua

SEQ ID NO: 3421347 - RNA, 19 nt, Human
accgcuacaccacucuggc

SEQ ID NO: 3421348 - RNA, 19 nt, Human
accgcucaccuagagccag

SEQ ID NO: 3421349 - RNA, 17 nt, Human
accgcuccccagcccag

SEQ ID NO: 3421350 - RNA, 22 nt, Human
accgcucucuuuucuguacuuc

SEQ ID NO: 3421351 - RNA, 13 nt, Human
accgcugaauaug

SEQ ID NO: 3421352 - RNA, 17 nt, Human
accgcugauucucaggg

SEQ ID NO: 3421353 - RNA, 20 nt, Human
accgcugccuaaguggcugc

SEQ ID NO: 3421354 - RNA, 16 nt, Human
accgcuuccggcuccu

SEQ ID NO: 3421355 - RNA, 18 nt, Human
accgcuuguggggaccca

SEQ ID NO: 3421356 - RNA, 13 nt, Human
accgcuuuggccu

SEQ ID NO: 3421357 - RNA, 24 nt, Human
accggagugucuggaauuguggcu

SEQ ID NO: 3421358 - RNA, 14 nt, Human
accggauccugggu

SEQ ID NO: 3421359 - RNA, 14 nt, Human
accggauggcggac

SEQ ID NO: 3421360 - RNA, 18 nt, Human
accggccgauggagacac

SEQ ID NO: 3421361 - RNA, 16 nt, Human
accggccugccaggag

SEQ ID NO: 3421362 - RNA, 20 nt, Human
accggcugcuuuucccuaag

SEQ ID NO: 3421363 - RNA, 12 nt, Human
accgggcacuca

SEQ ID NO: 3421364 - RNA, 23 nt, Human
accucagccaugaggaguugcug

SEQ ID NO: 3421365 - RNA, 15 nt, Human
accucagccuagacc

SEQ ID NO: 3421366 - RNA, 15 nt, Human
accucagccuccugu

SEQ ID NO: 3421367 - RNA, 20 nt, Human
accucagccugcacaguguc

SEQ ID NO: 3421368 - RNA, 15 nt, Human
accucagccuggcca

SEQ ID NO: 3421369 - RNA, 21 nt, Human
accucagccuggccagacaca

SEQ ID NO: 3421370 - RNA, 15 nt, Human
accucagccugggcg

SEQ ID NO: 3421371 - RNA, 16 nt, Human
accucagccugugcug

SEQ ID NO: 3421372 - RNA, 19 nt, Human
accucagccugugcugccc

SEQ ID NO: 3421373 - RNA, 14 nt, Human
accucagccuugga

SEQ ID NO: 3421374 - RNA, 15 nt, Human
accucaggcagcuca

SEQ ID NO: 3421375 - RNA, 13 nt, Human
accucaggccagg

SEQ ID NO: 3421376 - RNA, 20 nt, Human
accucaggccaggugcagug

SEQ ID NO: 3421377 - RNA, 13 nt, Human
accucaggccugg

SEQ ID NO: 3421378 - RNA, 22 nt, Human
accucaggccugggggcugggc

SEQ ID NO: 3421379 - RNA, 19 nt, Human
accucaggcuuccuuggca

SEQ ID NO: 3421380 - RNA, 12 nt, Human
accucagggcac

SEQ ID NO: 3421381 - RNA, 13 nt, Human
accucagggcucc

SEQ ID NO: 3421382 - RNA, 23 nt, Human
accucagguaaucgaccugccuc

SEQ ID NO: 3421383 - RNA, 18 nt, Human
accucaggugagaagcag

SEQ ID NO: 3421384 - RNA, 23 nt, Human
accugcugagggaccagccaaga

SEQ ID NO: 3421385 - RNA, 13 nt, Human
accugcugaugug

SEQ ID NO: 3421386 - RNA, 15 nt, Human
accugcugcuucucc

SEQ ID NO: 3421387 - RNA, 17 nt, Human
accugcugcuucuccaa

SEQ ID NO: 3421388 - RNA, 13 nt, Human
accugcuggcccc

SEQ ID NO: 3421389 - RNA, 15 nt, Human
accugcuggccccuc

SEQ ID NO: 3421390 - RNA, 17 nt, Human
accugcuggccccucac

SEQ ID NO: 3421391 - RNA, 19 nt, Human
accugcuggccccucaccu

SEQ ID NO: 3421392 - RNA, 17 nt, Human
accugcuggguaaacug

SEQ ID NO: 3421393 - RNA, 20 nt, Human
accugcugugauacgaugcu

SEQ ID NO: 3421394 - RNA, 21 nt, Human
accugcuucucugcccagcuu

SEQ ID NO: 3421395 - RNA, 21 nt, Human
accugcuuggguggagaagcc

SEQ ID NO: 3421396 - RNA, 23 nt, Human
accugcuuggguggagaagccau

SEQ ID NO: 3421397 - RNA, 16 nt, Human
accugcuuuucaaugu

SEQ ID NO: 3421398 - RNA, 18 nt, Human
accuggaacuuggggagu

SEQ ID NO: 3421399 - RNA, 23 nt, Human
accuggaagcauuuguuucuacu

SEQ ID NO: 3421400 - RNA, 17 nt, Human
accuggaauauauaacc

SEQ ID NO: 3421401 - RNA, 17 nt, Human
accuggacacaggccug

SEQ ID NO: 3421402 - RNA, 20 nt, Human
accuggaccccugcauugga

SEQ ID NO: 3421403 - RNA, 22 nt, Human
accuggacuuaagcaucuggcu

SEQ ID NO: 3421404 - RNA, 23 nt, Human
accuggagagccagaaccuggag

SEQ ID NO: 3421405 - RNA, 13 nt, Human
accuggagagcua

SEQ ID NO: 3421406 - RNA, 23 nt, Human
accuggagagcuagaaccuggag

SEQ ID NO: 3421407 - RNA, 15 nt, Human
accuggagccccugg

SEQ ID NO: 3421408 - RNA, 17 nt, Human
accuggagccccugggu

SEQ ID NO: 3421409 - RNA, 14 nt, Human
accuggagggaaga

SEQ ID NO: 3421410 - RNA, 13 nt, Human
accuggagggcua

SEQ ID NO: 3421411 - RNA, 22 nt, Human
accuggaggggcuagaaccuag

SEQ ID NO: 3421412 - RNA, 23 nt, Human
accuggcaagcuagaaccuggag

SEQ ID NO: 3421413 - RNA, 18 nt, Human
accuggccaccugaggug

SEQ ID NO: 3421414 - RNA, 21 nt, Human
accuggccaccugaggugggc

SEQ ID NO: 3421415 - RNA, 21 nt, Human
accuggccccaugucucucag

SEQ ID NO: 3421416 - RNA, 15 nt, Human
accuggcccucucug

SEQ ID NO: 3421417 - RNA, 19 nt, Human
accuggcccugcuuccugc

SEQ ID NO: 3421418 - RNA, 13 nt, Human
accuggcccuggg

SEQ ID NO: 3421419 - RNA, 16 nt, Human
accuggcccuggggcc

SEQ ID NO: 3421420 - RNA, 16 nt, Human
accuggccucugcacu

SEQ ID NO: 3421421 - RNA, 18 nt, Human
accuggccucugcacucc

SEQ ID NO: 3421422 - RNA, 20 nt, Human
accuggccucugcacucccc

SEQ ID NO: 3421423 - RNA, 23 nt, Human
accuggccucugcacuccccugc

SEQ ID NO: 3421424 - RNA, 15 nt, Human
accuggcucucaccu

SEQ ID NO: 3421425 - RNA, 17 nt, Human
accuggcucucaccucu

SEQ ID NO: 3421426 - RNA, 15 nt, Human
accuggcuuguuuau

SEQ ID NO: 3421427 - RNA, 20 nt, Human
accuggcuuguuuauuuugu

SEQ ID NO: 3421428 - RNA, 15 nt, Human
accugggacagggag

SEQ ID NO: 3421429 - RNA, 16 nt, Human
accugggacagggagc

SEQ ID NO: 3421430 - RNA, 17 nt, Human
accugggauuauauauc

SEQ ID NO: 3421431 - RNA, 18 nt, Human
accugggcaccuggggag

SEQ ID NO: 3421432 - RNA, 19 nt, Human
accugggcaccuggggagu

SEQ ID NO: 3421433 - RNA, 21 nt, Human
accugggcauacuaauaaagu

SEQ ID NO: 3421434 - RNA, 16 nt, Human
accugggcccuggggc

SEQ ID NO: 3421435 - RNA, 19 nt, Human
accugggcccuggggccug

SEQ ID NO: 3421436 - RNA, 23 nt, Human
accugggcccuggggccuguacu

SEQ ID NO: 3421437 - RNA, 21 nt, Human
accugggcucucgcggccucu

SEQ ID NO: 3421438 - RNA, 15 nt, Human
accuggggaguggga

SEQ ID NO: 3421439 - RNA, 14 nt, Human
accuggggcacagu

SEQ ID NO: 3421440 - RNA, 20 nt, Human
accuggggcacaguccagga

SEQ ID NO: 3421441 - RNA, 22 nt, Human
accuggggcacaguccaggaac

SEQ ID NO: 3421442 - RNA, 16 nt, Human
accuggguccaaauaa

SEQ ID NO: 3421443 - RNA, 21 nt, Human
accuggguccaaauaaaaacu

SEQ ID NO: 3421444 - RNA, 16 nt, Human
accuggguugcagaca

SEQ ID NO: 3421445 - RNA, 18 nt, Human
accugguacccuccuggc

SEQ ID NO: 3421446 - RNA, 17 nt, Human
accugguccacagggca

SEQ ID NO: 3421447 - RNA, 18 nt, Human
accugguccacagggcac

SEQ ID NO: 3421448 - RNA, 14 nt, Human
accuggucucuccu

SEQ ID NO: 3421449 - RNA, 14 nt, Human
accuggugcuggau

SEQ ID NO: 3421450 - RNA, 22 nt, Human
accuggugcuggauauuuucaa

SEQ ID NO: 3421451 - RNA, 20 nt, Human
accuguaaaacuuuauuuua

SEQ ID NO: 3421452 - RNA, 15 nt, Human
accuguaacuuuugu

SEQ ID NO: 3421453 - RNA, 15 nt, Human
accuguaagugucuu

SEQ ID NO: 3421454 - RNA, 15 nt, Human
accuguaauaaauau

SEQ ID NO: 3421455 - RNA, 18 nt, Human
accuguaauaaauaugag

SEQ ID NO: 3421456 - RNA, 21 nt, Human
accuguaauaaauaugagugc

SEQ ID NO: 3421457 - RNA, 23 nt, Human
accuguaauaaauaugagugcca

SEQ ID NO: 3421458 - RNA, 11 nt, Human
accuguaauca

SEQ ID NO: 3421459 - RNA, 16 nt, Human
accuguaaucccagca

SEQ ID NO: 3421460 - RNA, 17 nt, Human
accuguaaucccagcac

SEQ ID NO: 3421461 - RNA, 15 nt, Human
accuguaaugacagg

SEQ ID NO: 3421462 - RNA, 16 nt, Human
accuguacacugacuu

SEQ ID NO: 3421463 - RNA, 18 nt, Human
accuguagucccagcuac

SEQ ID NO: 3421464 - RNA, 20 nt, Human
accuguauaacccuguuaca

SEQ ID NO: 3421465 - RNA, 23 nt, Human
accuguauaaguggaggcacuuu

SEQ ID NO: 3421466 - RNA, 11 nt, Human
accuguaucuu

SEQ ID NO: 3421467 - RNA, 17 nt, Human
accuguauuuaaaaaua

SEQ ID NO: 3421468 - RNA, 14 nt, Human
accuguauuuaagc

SEQ ID NO: 3421469 - RNA, 21 nt, Human
accuguauuuaagcaaauacu

SEQ ID NO: 3421470 - RNA, 24 nt, Human
accugucaaacaaagccagaagcu

SEQ ID NO: 3421471 - RNA, 19 nt, Human
accugucaccgugagcagc

SEQ ID NO: 3421472 - RNA, 17 nt, Human
accugucaugccccccu

SEQ ID NO: 3421473 - RNA, 11 nt, Human
accuguccaau

SEQ ID NO: 3421474 - RNA, 15 nt, Human
accugucccaccuca

SEQ ID NO: 3421475 - RNA, 21 nt, Human
accuguccccacccuccacuc

SEQ ID NO: 3421476 - RNA, 22 nt, Human
accuguccccacccuccacuca

SEQ ID NO: 3421477 - RNA, 12 nt, Human
accugucuccuu

SEQ ID NO: 3421478 - RNA, 22 nt, Human
accugucuccuuucaccccagg

SEQ ID NO: 3421479 - RNA, 17 nt, Human
accugucuccuuucuca

SEQ ID NO: 3421480 - RNA, 13 nt, Human
accugucugcucc

SEQ ID NO: 3421481 - RNA, 14 nt, Human
accugucugcucca

SEQ ID NO: 3421482 - RNA, 19 nt, Human
accugucugcuccagcucu

SEQ ID NO: 3421483 - RNA, 21 nt, Human
accugucuugccuuuuucauu

SEQ ID NO: 3421484 - RNA, 17 nt, Human
accugugagcccagcug

SEQ ID NO: 3421485 - RNA, 19 nt, Human
accugugaugaggggagga

SEQ ID NO: 3421486 - RNA, 22 nt, Human
accugugcuucgggcccuuccc

SEQ ID NO: 3421487 - RNA, 23 nt, Human
accugugcuucgggcccuuccca

SEQ ID NO: 3421488 - RNA, 20 nt, Human
accuguggaacauaaaaagg

SEQ ID NO: 3421489 - RNA, 10 nt, Human
accuguggau

SEQ ID NO: 3421490 - RNA, 15 nt, Human
accuguggcucuaca

SEQ ID NO: 3421491 - RNA, 13 nt, Human
accugugggugua

SEQ ID NO: 3421492 - RNA, 13 nt, Human
accugugucacua

SEQ ID NO: 3421493 - RNA, 11 nt, Human
accugugugcu

SEQ ID NO: 3421494 - RNA, 16 nt, Human
accuguguggacagga

SEQ ID NO: 3421495 - RNA, 20 nt, Human
accugugugguacucugaaa

SEQ ID NO: 3421496 - RNA, 22 nt, Human
accugugugguacucugaaaca

SEQ ID NO: 3421497 - RNA, 17 nt, Human
accuguguuucuugccu

SEQ ID NO: 3421498 - RNA, 21 nt, Human
accuguguuucuugccucauu

SEQ ID NO: 3421499 - RNA, 17 nt, Human
accuguuaccuacuuug

SEQ ID NO: 3421500 - RNA, 17 nt, Human
accuguuagcagacagg

SEQ ID NO: 3421501 - RNA, 20 nt, Human
accuguucagugucccgggc

SEQ ID NO: 3421502 - RNA, 14 nt, Human
accuguugagcauc

SEQ ID NO: 3421503 - RNA, 20 nt, Human
accuguugagcaucacagaa

SEQ ID NO: 3421504 - RNA, 21 nt, Human
accuguugcuuacaauuuuuu

SEQ ID NO: 3421505 - RNA, 14 nt, Human
accuguugguucca

SEQ ID NO: 3421506 - RNA, 15 nt, Human
accuguuuaaauugc

SEQ ID NO: 3421507 - RNA, 16 nt, Human
accuguuuuuaagcug

SEQ ID NO: 3421508 - RNA, 15 nt, Human
accucugaagucucu

SEQ ID NO: 3421509 - RNA, 15 nt, Human
accucugacagcagc

SEQ ID NO: 3421510 - RNA, 20 nt, Human
accucugacagcagcaucuc

SEQ ID NO: 3421511 - RNA, 23 nt, Human
accucugauuuauuuuguaugaa

SEQ ID NO: 3421512 - RNA, 21 nt, Human
accucugcacuacugacaugu

SEQ ID NO: 3421513 - RNA, 21 nt, Human
accucugcagcaauaaagcag

SEQ ID NO: 3421514 - RNA, 13 nt, Human
accucugccucaa

SEQ ID NO: 3421515 - RNA, 12 nt, Human
accucugccuga

SEQ ID NO: 3421516 - RNA, 19 nt, Human
accucugcuucccagguuc

SEQ ID NO: 3421517 - RNA, 19 nt, Human
accucugcuuuuaucucag

SEQ ID NO: 3421518 - RNA, 14 nt, Human
accucuggacuggc

SEQ ID NO: 3421519 - RNA, 15 nt, Human
accucuggacuggcu

SEQ ID NO: 3421520 - RNA, 19 nt, Human
accucuggacuggcuagag

SEQ ID NO: 3421521 - RNA, 13 nt, Human
accucuggcugac

SEQ ID NO: 3421522 - RNA, 16 nt, Human
accucuggcugacuaa

SEQ ID NO: 3421523 - RNA, 21 nt, Human
accucuguauuugaaucagcc

SEQ ID NO: 3421524 - RNA, 13 nt, Human
accucugucucau

SEQ ID NO: 3421525 - RNA, 15 nt, Human
accucugucucaucc

SEQ ID NO: 3421526 - RNA, 23 nt, Human
accucugucucauccuccuggaa

SEQ ID NO: 3421527 - RNA, 19 nt, Human
accucugucuuggcuuuca

SEQ ID NO: 3421528 - RNA, 18 nt, Human
accucugugaccucaggc

SEQ ID NO: 3421529 - RNA, 21 nt, Human
accucugugaggaaagcacac

SEQ ID NO: 3421530 - RNA, 15 nt, Human
accucugugugcucc

SEQ ID NO: 3421531 - RNA, 15 nt, Human
accucuguucagugu

SEQ ID NO: 3421532 - RNA, 17 nt, Human
accucuguucaguguaa

SEQ ID NO: 3421533 - RNA, 18 nt, Human
accucuguucaguguaaa

SEQ ID NO: 3421534 - RNA, 19 nt, Human
accucuguucaguguaaau

SEQ ID NO: 3421535 - RNA, 16 nt, Human
accucuguuguccucc

SEQ ID NO: 3421536 - RNA, 22 nt, Human
accucuguuguccuccccuugg

SEQ ID NO: 3421537 - RNA, 16 nt, Human
accucuuaauauucug

SEQ ID NO: 3421538 - RNA, 14 nt, Human
accucuuagcugag

SEQ ID NO: 3421539 - RNA, 15 nt, Human
acacuauuuuaugca

SEQ ID NO: 3421540 - RNA, 17 nt, Human
acacucaaaucaagaaa

SEQ ID NO: 3421541 - RNA, 15 nt, Human
acacucaagaagcag

SEQ ID NO: 3421542 - RNA, 16 nt, Human
acacucaagaagcagg

SEQ ID NO: 3421543 - RNA, 17 nt, Human
acacucaagaagcaggc

SEQ ID NO: 3421544 - RNA, 22 nt, Human
acacucacauuuauucugcuca

SEQ ID NO: 3421545 - RNA, 18 nt, Human
acacucaccucuaaaaca

SEQ ID NO: 3421546 - RNA, 21 nt, Human
acacucacuccugagaccccu

SEQ ID NO: 3421547 - RNA, 16 nt, Human
acacucagaagccugg

SEQ ID NO: 3421548 - RNA, 19 nt, Human
acacucagaagccuggggg

SEQ ID NO: 3421549 - RNA, 19 nt, Human
acacucagaccugaauucu

SEQ ID NO: 3421550 - RNA, 13 nt, Human
acacucagcacaa

SEQ ID NO: 3421551 - RNA, 20 nt, Human
acacucagcacccccuucuc

SEQ ID NO: 3421552 - RNA, 19 nt, Human
acacucaugcauuguccuc

SEQ ID NO: 3421553 - RNA, 16 nt, Human
acacucauucauuacu

SEQ ID NO: 3421554 - RNA, 21 nt, Human
acacucauugaccugaggccc

SEQ ID NO: 3421555 - RNA, 23 nt, Human
acacucauugaccugaggcccuu

SEQ ID NO: 3421556 - RNA, 14 nt, Human
acacuccaagauau

SEQ ID NO: 3421557 - RNA, 16 nt, Human
acacuccaagauaugg

SEQ ID NO: 3421558 - RNA, 15 nt, Human
acacuccaauuaagg

SEQ ID NO: 3421559 - RNA, 12 nt, Human
acacuccagccu

SEQ ID NO: 3421560 - RNA, 14 nt, Human
acacuccagccuga

SEQ ID NO: 3421561 - RNA, 14 nt, Human
acacuccagugaga

SEQ ID NO: 3421562 - RNA, 21 nt, Human
acacuccagugccagcaauga

SEQ ID NO: 3421563 - RNA, 15 nt, Human
acacuccccgaaguc

SEQ ID NO: 3421564 - RNA, 15 nt, Human
acacuccccugcacu

SEQ ID NO: 3421565 - RNA, 17 nt, Human
acacuccccugcacugg

SEQ ID NO: 3421566 - RNA, 14 nt, Human
acacucccuugggc

SEQ ID NO: 3421567 - RNA, 20 nt, Human
acacuccuagagaacgcagc

SEQ ID NO: 3421568 - RNA, 12 nt, Human
acacuccucugc

SEQ ID NO: 3421569 - RNA, 14 nt, Human
acacuccucugcgu

SEQ ID NO: 3421570 - RNA, 11 nt, Human
acacuccuuca

SEQ ID NO: 3421571 - RNA, 13 nt, Human
acacuccuucaca

SEQ ID NO: 3421572 - RNA, 20 nt, Human
acacucucaaagcaaauaau

SEQ ID NO: 3421573 - RNA, 12 nt, Human
acacucuccugg

SEQ ID NO: 3421574 - RNA, 21 nt, Human
acacucuccugggccccuccc

SEQ ID NO: 3421575 - RNA, 15 nt, Human
acacucuccuugcag

SEQ ID NO: 3421576 - RNA, 20 nt, Human
acacucugaauuccaaguag

SEQ ID NO: 3421577 - RNA, 13 nt, Human
acacucugagacu

SEQ ID NO: 3421578 - RNA, 13 nt, Human
acacucugcucug

SEQ ID NO: 3421579 - RNA, 12 nt, Human
acacucugcugu

SEQ ID NO: 3421580 - RNA, 16 nt, Human
acacucuuuguaagag

SEQ ID NO: 3421581 - RNA, 21 nt, Human
acacucuuuugcuuuauucca

SEQ ID NO: 3421582 - RNA, 21 nt, Human
acacugaaagcucuguugcaa

SEQ ID NO: 3421583 - RNA, 17 nt, Human
acacugaaaguuuugua

SEQ ID NO: 3421584 - RNA, 12 nt, Human
acacugaaauaa

SEQ ID NO: 3421585 - RNA, 18 nt, Human
acacugaaauauacacac

SEQ ID NO: 3421586 - RNA, 21 nt, Human
acacugaaauauacacacagc

SEQ ID NO: 3421587 - RNA, 22 nt, Human
acacugaaauauacacacagca

SEQ ID NO: 3421588 - RNA, 12 nt, Human
acacugaagaag

SEQ ID NO: 3421589 - RNA, 20 nt, Human
acacugaauuuuuaugugug

SEQ ID NO: 3421590 - RNA, 22 nt, Human
acacugacaccuuugcaggcau

SEQ ID NO: 3421591 - RNA, 22 nt, Human
acacugaccuuggagagacaca

SEQ ID NO: 3421592 - RNA, 22 nt, Human
acacugagaauguaagaacuac

SEQ ID NO: 3421593 - RNA, 14 nt, Human
acacugagcuguca

SEQ ID NO: 3421594 - RNA, 14 nt, Human
acacugaggcaggg

SEQ ID NO: 3421595 - RNA, 16 nt, Human
acacugaggcagggaa

SEQ ID NO: 3421596 - RNA, 17 nt, Human
acacugaggcagggaag

SEQ ID NO: 3421597 - RNA, 21 nt, Human
acacugauuuccccuuuugca

SEQ ID NO: 3421598 - RNA, 16 nt, Human
acacugcaaucauaug

SEQ ID NO: 3421599 - RNA, 16 nt, Human
acacugcaggcaucac

SEQ ID NO: 3421600 - RNA, 15 nt, Human
acacugcauguuugu

SEQ ID NO: 3421601 - RNA, 21 nt, Human
acacugccaacugaucuguua

SEQ ID NO: 3421602 - RNA, 16 nt, Human
acacugccugccuuaa

SEQ ID NO: 3421603 - RNA, 16 nt, Human
acacugccuguauacu

SEQ ID NO: 3421604 - RNA, 19 nt, Human
acacugccuguauacuuua

SEQ ID NO: 3421605 - RNA, 19 nt, Human
acacugccuuuuuauuuau

SEQ ID NO: 3421606 - RNA, 21 nt, Human
acacugcgcuuuauuuucuua

SEQ ID NO: 3421607 - RNA, 18 nt, Human
acacugcuaggugggcca

SEQ ID NO: 3421608 - RNA, 13 nt, Human
acacugcucuaac

SEQ ID NO: 3421609 - RNA, 17 nt, Human
acacugcucuaacagcc

SEQ ID NO: 3421610 - RNA, 16 nt, Human
acacuggacuccggcc

SEQ ID NO: 3421611 - RNA, 19 nt, Human
acacuggaggagagaagaa

SEQ ID NO: 3421612 - RNA, 17 nt, Human
acacuggcuaaagauaa

SEQ ID NO: 3421613 - RNA, 21 nt, Human
acacuggcucacccaguccug

SEQ ID NO: 3421614 - RNA, 14 nt, Human
acacuggcugccag

SEQ ID NO: 3421615 - RNA, 16 nt, Human
acacuggcugccagcu

SEQ ID NO: 3421616 - RNA, 14 nt, Human
acacugggaaacag

SEQ ID NO: 3421617 - RNA, 19 nt, Human
acacugggacuugcaaaaa

SEQ ID NO: 3421618 - RNA, 20 nt, Human
acacugggagaaaugaaaaa

SEQ ID NO: 3421619 - RNA, 17 nt, Human
acacuggggacuuggcc

SEQ ID NO: 3421620 - RNA, 19 nt, Human
acacugguauuccugccuc

SEQ ID NO: 3421621 - RNA, 15 nt, Human
acacuggucugcugu

SEQ ID NO: 3421622 - RNA, 17 nt, Human
acacugguucucaauga

SEQ ID NO: 3421623 - RNA, 18 nt, Human
acacugguucucaaugaa

SEQ ID NO: 3421624 - RNA, 22 nt, Human
acacuguaguaaauaaugcuuu

SEQ ID NO: 3421625 - RNA, 18 nt, Human
acacuguauguuauagaa

SEQ ID NO: 3421626 - RNA, 19 nt, Human
acacugugacacacuacac

SEQ ID NO: 3421627 - RNA, 15 nt, Human
acacugugcccuggu

SEQ ID NO: 3421628 - RNA, 13 nt, Human
acacugugcuaua

SEQ ID NO: 3421629 - RNA, 17 nt, Human
acacuguggguguguga

SEQ ID NO: 3421630 - RNA, 18 nt, Human
acacuguguacugcaguu

SEQ ID NO: 3421631 - RNA, 11 nt, Human
acacugugucc

SEQ ID NO: 3421632 - RNA, 18 nt, Human
acacuguguccuggugcu

SEQ ID NO: 3421633 - RNA, 16 nt, Human
acacuguuagaacacu

SEQ ID NO: 3421634 - RNA, 20 nt, Human
acacuguuagaacacuauuu

SEQ ID NO: 3421635 - RNA, 22 nt, Human
acacuguuagaacacuauuuuc

SEQ ID NO: 3421636 - RNA, 14 nt, Human
acacuguucucugc

SEQ ID NO: 3421637 - RNA, 15 nt, Human
acacuguucucugcc

SEQ ID NO: 3421638 - RNA, 14 nt, Human
acacuguucugaaa

SEQ ID NO: 3421639 - RNA, 20 nt, Human
acacuguucugaaagugacu

SEQ ID NO: 3421640 - RNA, 12 nt, Human
acacuguucuua

SEQ ID NO: 3421641 - RNA, 21 nt, Human
acacuguucuuagcucaauga

SEQ ID NO: 3421642 - RNA, 23 nt, Human
acacuguucuuagcucaaugagc

SEQ ID NO: 3421643 - RNA, 17 nt, Human
acacuguugauaaaaac

SEQ ID NO: 3421644 - RNA, 19 nt, Human
acacuguugauaaaaacuc

SEQ ID NO: 3421645 - RNA, 18 nt, Human
acacuguuucaaacuuua

SEQ ID NO: 3421646 - RNA, 15 nt, Human
acacuuaaaaauggu

SEQ ID NO: 3421647 - RNA, 16 nt, Human
acacuuaacagaugca

SEQ ID NO: 3421648 - RNA, 23 nt, Human
acacuuaagguugggugcugcua

SEQ ID NO: 3421649 - RNA, 14 nt, Human
acacuuaauacuac

SEQ ID NO: 3421650 - RNA, 16 nt, Human
acacuuacacuuuaug

SEQ ID NO: 3421651 - RNA, 20 nt, Human
acacuuauuggaacucugcu

SEQ ID NO: 3421652 - RNA, 18 nt, Human
acacuucaaggugacaga

SEQ ID NO: 3421653 - RNA, 21 nt, Human
acgccugagcccagggaggcc

SEQ ID NO: 3421654 - RNA, 13 nt, Human
acgccugaggaac

SEQ ID NO: 3421655 - RNA, 15 nt, Human
acgccugaggcaauu

SEQ ID NO: 3421656 - RNA, 19 nt, Human
acgccugcaaacgcugccu

SEQ ID NO: 3421657 - RNA, 22 nt, Human
acgccugcaaacgcugccugcc

SEQ ID NO: 3421658 - RNA, 23 nt, Human
acgccugcaaacgcugccugccc

SEQ ID NO: 3421659 - RNA, 15 nt, Human
acgccugccuccccu

SEQ ID NO: 3421660 - RNA, 17 nt, Human
acgccugcuugucccug

SEQ ID NO: 3421661 - RNA, 11 nt, Human
acgccuggcua

SEQ ID NO: 3421662 - RNA, 14 nt, Human
acgccuuccccuca

SEQ ID NO: 3421663 - RNA, 17 nt, Human
acgccuuccccucagcc

SEQ ID NO: 3421664 - RNA, 19 nt, Human
acgcgaaaccaauuccuca

SEQ ID NO: 3421665 - RNA, 23 nt, Human
acgcgaaaguaucaccagggugc

SEQ ID NO: 3421666 - RNA, 22 nt, Human
acgcgcagaugugcagcagauu

SEQ ID NO: 3421667 - RNA, 18 nt, Human
acgcgccccccucccaga

SEQ ID NO: 3421668 - RNA, 16 nt, Human
acgcgcgcgcacacac

SEQ ID NO: 3421669 - RNA, 18 nt, Human
acgcgguacaaaggaaaa

SEQ ID NO: 3421670 - RNA, 12 nt, Human
acgcguauuuac

SEQ ID NO: 3421671 - RNA, 14 nt, Human
acgcguugaaauug

SEQ ID NO: 3421672 - RNA, 20 nt, Human
acgcguugaaauuguaauua

SEQ ID NO: 3421673 - RNA, 18 nt, Human
acgcuaaagagcccuugc

SEQ ID NO: 3421674 - RNA, 21 nt, Human
acgcuaaagagcccuugccuc

SEQ ID NO: 3421675 - RNA, 18 nt, Human
acgcuacccgggaagggg

SEQ ID NO: 3421676 - RNA, 20 nt, Human
acgcuaccucucugucccuu

SEQ ID NO: 3421677 - RNA, 13 nt, Human
acgcuccaaaguc

SEQ ID NO: 3421678 - RNA, 16 nt, Human
acgcuccagcugcccc

SEQ ID NO: 3421679 - RNA, 18 nt, Human
acgcuccccgccuguucc

SEQ ID NO: 3421680 - RNA, 20 nt, Human
acgcuccuuucugaucuuca

SEQ ID NO: 3421681 - RNA, 14 nt, Human
acgcucucuggccu

SEQ ID NO: 3421682 - RNA, 14 nt, Human
acgcugagccaccu

SEQ ID NO: 3421683 - RNA, 15 nt, Human
acgcugccugcccac

SEQ ID NO: 3421684 - RNA, 17 nt, Human
acgcugcucugccccag

SEQ ID NO: 3421685 - RNA, 23 nt, Human
acgcuggaccuugaacuggguac

SEQ ID NO: 3421686 - RNA, 18 nt, Human
acgcuggagugcagugag

SEQ ID NO: 3421687 - RNA, 20 nt, Human
acgcugguagagauggagga

SEQ ID NO: 3421688 - RNA, 11 nt, Human
acgcugucucc

SEQ ID NO: 3421689 - RNA, 12 nt, Human
acgcugucucca

SEQ ID NO: 3421690 - RNA, 17 nt, Human
acgcugucuccagaccc

SEQ ID NO: 3421691 - RNA, 20 nt, Human
acgcugucuccagaccccca

SEQ ID NO: 3421692 - RNA, 19 nt, Human
acgcugugcugcccugccc

SEQ ID NO: 3421693 - RNA, 21 nt, Human
acgcuuaaaggugucuuccuc

SEQ ID NO: 3421694 - RNA, 14 nt, Human
acgcuuaaauacag

SEQ ID NO: 3421695 - RNA, 16 nt, Human
acgcuucacagugauc

SEQ ID NO: 3421696 - RNA, 13 nt, Human
acgcuucugaaug

SEQ ID NO: 3421697 - RNA, 18 nt, Human
acgcuucugaaugcugcu

SEQ ID NO: 3421698 - RNA, 13 nt, Human
acgcuucuucuuu

SEQ ID NO: 3421699 - RNA, 21 nt, Human
acgcuuguagaacucacucug

SEQ ID NO: 3421700 - RNA, 23 nt, Human
acgcuuguagaacucacucuggg

SEQ ID NO: 3421701 - RNA, 22 nt, Human
acgcuuuuaaugaaaaggaauc

SEQ ID NO: 3421702 - RNA, 15 nt, Human
acggaaagugcuguc

SEQ ID NO: 3421703 - RNA, 22 nt, Human
acggaagaagagaucaggaaga

SEQ ID NO: 3421704 - RNA, 19 nt, Human
acggaaggaccuauguuug

SEQ ID NO: 3421705 - RNA, 20 nt, Human
acggaauaagagaccuguuu

SEQ ID NO: 3421706 - RNA, 15 nt, Human
acggaauaguuggcu

SEQ ID NO: 3421707 - RNA, 23 nt, Human
acggaccaaagggagucugccag

SEQ ID NO: 3421708 - RNA, 15 nt, Human
acggacgcuggcucc

SEQ ID NO: 3421709 - RNA, 13 nt, Human
acggagagcgccu

SEQ ID NO: 3421710 - RNA, 20 nt, Human
acggagcccagcccucccca

SEQ ID NO: 3421711 - RNA, 18 nt, Human
acggagccccaggccucu

SEQ ID NO: 3421712 - RNA, 19 nt, Human
acggagcggauugcaaagc

SEQ ID NO: 3421713 - RNA, 21 nt, Human
acggagcggauugcaaagcaa

SEQ ID NO: 3421714 - RNA, 17 nt, Human
acggaggagaauuaagu

SEQ ID NO: 3421715 - RNA, 20 nt, Human
acggaggccugcgacccugg

SEQ ID NO: 3421716 - RNA, 21 nt, Human
acggagucccaccuuggcugc

SEQ ID NO: 3421717 - RNA, 16 nt, Human
acggaucagaaauaca

SEQ ID NO: 3421718 - RNA, 20 nt, Human
acggauccauguagcaggac

SEQ ID NO: 3421719 - RNA, 16 nt, Human
acggaugauuggauua

SEQ ID NO: 3421720 - RNA, 14 nt, Human
acggaugauuucua

SEQ ID NO: 3421721 - RNA, 13 nt, Human
acggauuauuuuu

SEQ ID NO: 3421722 - RNA, 17 nt, Human
acggauuauuuuuucag

SEQ ID NO: 3421723 - RNA, 20 nt, Human
acggauuauuuuuucagacc

SEQ ID NO: 3421724 - RNA, 12 nt, Human
acggauuccaaa

SEQ ID NO: 3421725 - RNA, 14 nt, Human
acggauuuucaguu

SEQ ID NO: 3421726 - RNA, 15 nt, Human
acggcacuguggccu

SEQ ID NO: 3421727 - RNA, 21 nt, Human
acggcaggacaacgaggaagc

SEQ ID NO: 3421728 - RNA, 22 nt, Human
acggcaggacaacgaggaagcc

SEQ ID NO: 3421729 - RNA, 18 nt, Human
acggcaggcucacugcca

SEQ ID NO: 3421730 - RNA, 20 nt, Human
acggcaggcucacugccagg

SEQ ID NO: 3421731 - RNA, 16 nt, Human
acggccaagaauguac

SEQ ID NO: 3421732 - RNA, 19 nt, Human
acggccacacagcugccgg

SEQ ID NO: 3421733 - RNA, 20 nt, Human
acggccacacagcugccggu

SEQ ID NO: 3421734 - RNA, 18 nt, Human
acggccacaucaaagagg

SEQ ID NO: 3421735 - RNA, 13 nt, Human
acggccaggccag

SEQ ID NO: 3421736 - RNA, 16 nt, Human
acggccaggccagagg

SEQ ID NO: 3421737 - RNA, 15 nt, Human
acggccaucucuuug

SEQ ID NO: 3421738 - RNA, 12 nt, Human
acggcccugcaa

SEQ ID NO: 3421739 - RNA, 13 nt, Human
acggcccugcaau

SEQ ID NO: 3421740 - RNA, 15 nt, Human
acggccgcuccaggg

SEQ ID NO: 3421741 - RNA, 16 nt, Human
acggcgcccccagugu

SEQ ID NO: 3421742 - RNA, 19 nt, Human
acggcucgauuucuccagg

SEQ ID NO: 3421743 - RNA, 19 nt, Human
acggcucuagguggggcgg

SEQ ID NO: 3421744 - RNA, 19 nt, Human
acuacaugugguuuauaga

SEQ ID NO: 3421745 - RNA, 20 nt, Human
acuacauuagguugugaaug

SEQ ID NO: 3421746 - RNA, 22 nt, Human
acuacauugaguagacacauuu

SEQ ID NO: 3421747 - RNA, 14 nt, Human
acuacauuuuuuca

SEQ ID NO: 3421748 - RNA, 15 nt, Human
acuaccaaaggacac

SEQ ID NO: 3421749 - RNA, 21 nt, Human
acuacccacguucucacaccc

SEQ ID NO: 3421750 - RNA, 22 nt, Human
acuacccagguuaagaaaauaa

SEQ ID NO: 3421751 - RNA, 19 nt, Human
acuacccauagacaugaaa

SEQ ID NO: 3421752 - RNA, 20 nt, Human
acuacccaucgguguccauu

SEQ ID NO: 3421753 - RNA, 16 nt, Human
acuacccuuaauuacu

SEQ ID NO: 3421754 - RNA, 19 nt, Human
acuaccuccucagggaugg

SEQ ID NO: 3421755 - RNA, 14 nt, Human
acuaccuggcugcg

SEQ ID NO: 3421756 - RNA, 22 nt, Human
acuaccuguaaugacaggccug

SEQ ID NO: 3421757 - RNA, 13 nt, Human
acuaccugucaag

SEQ ID NO: 3421758 - RNA, 13 nt, Human
acuacgccuggcu

SEQ ID NO: 3421759 - RNA, 18 nt, Human
acuacggaauaguuggcu

SEQ ID NO: 3421760 - RNA, 20 nt, Human
acuacgggggggagaaggaa

SEQ ID NO: 3421761 - RNA, 15 nt, Human
acuacguuaagggaa

SEQ ID NO: 3421762 - RNA, 19 nt, Human
acuacuagaugucuuuagg

SEQ ID NO: 3421763 - RNA, 19 nt, Human
acuacuaguuuuuacuuuu

SEQ ID NO: 3421764 - RNA, 13 nt, Human
acuacuauucaaa

SEQ ID NO: 3421765 - RNA, 16 nt, Human
acuacucaaagcaaaa

SEQ ID NO: 3421766 - RNA, 21 nt, Human
acuacucauacuuaagcaaaa

SEQ ID NO: 3421767 - RNA, 14 nt, Human
acuacuccucugca

SEQ ID NO: 3421768 - RNA, 13 nt, Human
acuacucugugcc

SEQ ID NO: 3421769 - RNA, 22 nt, Human
acuacugccuuuagaaaauaua

SEQ ID NO: 3421770 - RNA, 18 nt, Human
acuacugggacucuucag

SEQ ID NO: 3421771 - RNA, 13 nt, Human
acuacuggguguc

SEQ ID NO: 3421772 - RNA, 20 nt, Human
acuacugggugucauuucau

SEQ ID NO: 3421773 - RNA, 21 nt, Human
acuacugggugucauuucauu

SEQ ID NO: 3421774 - RNA, 18 nt, Human
acuacuguggaaaaauau

SEQ ID NO: 3421775 - RNA, 16 nt, Human
acuacuguguuccugg

SEQ ID NO: 3421776 - RNA, 18 nt, Human
acuacuguguuccuggca

SEQ ID NO: 3421777 - RNA, 21 nt, Human
acuacuguguuccuggcaaua

SEQ ID NO: 3421778 - RNA, 20 nt, Human
acuacuuuaauaaagaauua

SEQ ID NO: 3421779 - RNA, 15 nt, Human
acuagaacacagaaa

SEQ ID NO: 3421780 - RNA, 15 nt, Human
acuagaaccuggagg

SEQ ID NO: 3421781 - RNA, 13 nt, Human
acuagaacucucc

SEQ ID NO: 3421782 - RNA, 15 nt, Human
acuagaauuuauuca

SEQ ID NO: 3421783 - RNA, 15 nt, Human
acuagacaagccaga

SEQ ID NO: 3421784 - RNA, 21 nt, Human
acuagacaagccagaacuuga

SEQ ID NO: 3421785 - RNA, 18 nt, Human
acuagacaccaaaguucu

SEQ ID NO: 3421786 - RNA, 16 nt, Human
acuagacauucugucg

SEQ ID NO: 3421787 - RNA, 11 nt, Human
acuagagaaac

SEQ ID NO: 3421788 - RNA, 20 nt, Human
acuagagaaugcacagauau

SEQ ID NO: 3421789 - RNA, 23 nt, Human
acuagagaaugcacagauauacu

SEQ ID NO: 3421790 - RNA, 16 nt, Human
acuagagauauuuugu

SEQ ID NO: 3421791 - RNA, 17 nt, Human
acuagagauauuuugua

SEQ ID NO: 3421792 - RNA, 21 nt, Human
acuagagauauuuuguaaaau

SEQ ID NO: 3421793 - RNA, 18 nt, Human
acuagagggaccucuccc

SEQ ID NO: 3421794 - RNA, 14 nt, Human
acuagaggugagaa

SEQ ID NO: 3421795 - RNA, 21 nt, Human
acuagaggugagaaauuuaaa

SEQ ID NO: 3421796 - RNA, 15 nt, Human
acuagagucugaaca

SEQ ID NO: 3421797 - RNA, 14 nt, Human
acguauuuuaaaag

SEQ ID NO: 3421798 - RNA, 14 nt, Human
acgucaaacaugaa

SEQ ID NO: 3421799 - RNA, 18 nt, Human
acgucagauguuuaaaac

SEQ ID NO: 3421800 - RNA, 20 nt, Human
acgucagauguuuaaaacac

SEQ ID NO: 3421801 - RNA, 13 nt, Human
acgucccccuggg

SEQ ID NO: 3421802 - RNA, 16 nt, Human
acguccugccaccugg

SEQ ID NO: 3421803 - RNA, 21 nt, Human
acgucuauuucaucagaacag

SEQ ID NO: 3421804 - RNA, 13 nt, Human
acgucugacaggc

SEQ ID NO: 3421805 - RNA, 12 nt, Human
acgucugugcca

SEQ ID NO: 3421806 - RNA, 14 nt, Human
acgucuuaaauauu

SEQ ID NO: 3421807 - RNA, 15 nt, Human
acgucuuucuuuuuu

SEQ ID NO: 3421808 - RNA, 19 nt, Human
acgugacacaaacacacac

SEQ ID NO: 3421809 - RNA, 21 nt, Human
acgugacacaaacacacacaa

SEQ ID NO: 3421810 - RNA, 17 nt, Human
acgugacagugccuggg

SEQ ID NO: 3421811 - RNA, 15 nt, Human
acgugacccucugcu

SEQ ID NO: 3421812 - RNA, 14 nt, Human
acgugacugcccca

SEQ ID NO: 3421813 - RNA, 18 nt, Human
acgugacugccccaacuc

SEQ ID NO: 3421814 - RNA, 21 nt, Human
acgugacuguggcacacgccu

SEQ ID NO: 3421815 - RNA, 16 nt, Human
acgugagaucauucac

SEQ ID NO: 3421816 - RNA, 23 nt, Human
acgugagccagguaaugagggac

SEQ ID NO: 3421817 - RNA, 11 nt, Human
acgugaguccu

SEQ ID NO: 3421818 - RNA, 19 nt, Human
acgugcaauuuguuugugc

SEQ ID NO: 3421819 - RNA, 22 nt, Human
acgugcaauuuguuugugcuuc

SEQ ID NO: 3421820 - RNA, 20 nt, Human
acgugcaccuguacucagga

SEQ ID NO: 3421821 - RNA, 12 nt, Human
acgugcauugug

SEQ ID NO: 3421822 - RNA, 17 nt, Human
acgugccuuuugcaccc

SEQ ID NO: 3421823 - RNA, 22 nt, Human
acgugccuuuugcaccccuccc

SEQ ID NO: 3421824 - RNA, 18 nt, Human
acguggaaccucugucuc

SEQ ID NO: 3421825 - RNA, 18 nt, Human
acguggagagcuggugcc

SEQ ID NO: 3421826 - RNA, 19 nt, Human
acguggagagcuggugccc

SEQ ID NO: 3421827 - RNA, 22 nt, Human
acguggagcgggguaugaagag

SEQ ID NO: 3421828 - RNA, 13 nt, Human
acguggcaccucc

SEQ ID NO: 3421829 - RNA, 15 nt, Human
acguggcaccuccuc

SEQ ID NO: 3421830 - RNA, 18 nt, Human
acguggcacuauauucug

SEQ ID NO: 3421831 - RNA, 19 nt, Human
acguggcucagccagcacu

SEQ ID NO: 3421832 - RNA, 15 nt, Human
acguggcucugcugg

SEQ ID NO: 3421833 - RNA, 14 nt, Human
acguggcugcuuca

SEQ ID NO: 3421834 - RNA, 17 nt, Human
acguggcugcuucaagg

SEQ ID NO: 3421835 - RNA, 23 nt, Human
acguggcugcuucaaggauccug

SEQ ID NO: 3421836 - RNA, 23 nt, Human
acgugggaguucagcugcuucuc

SEQ ID NO: 3421837 - RNA, 19 nt, Human
acgugggcaaacaggcagu

SEQ ID NO: 3421838 - RNA, 16 nt, Human
acgugggcuccccucu

SEQ ID NO: 3421839 - RNA, 23 nt, Human
acgugggcugggcccacaaaggc

SEQ ID NO: 3421840 - RNA, 14 nt, Human
acguggggcagcac

SEQ ID NO: 3421841 - RNA, 19 nt, Human
acguggggcagcacagaga

SEQ ID NO: 3421842 - RNA, 22 nt, Human
acgugggucuucagggggccag

SEQ ID NO: 3421843 - RNA, 11 nt, Human
acguguagugu

SEQ ID NO: 3421844 - RNA, 20 nt, Human
acguguaguguccauuuugu

SEQ ID NO: 3421845 - RNA, 13 nt, Human
acguguauguuuu

SEQ ID NO: 3421846 - RNA, 19 nt, Human
acgugucuuccacuuugca

SEQ ID NO: 3421847 - RNA, 12 nt, Human
acgugugauuuu

SEQ ID NO: 3421848 - RNA, 11 nt, Human
acguguuuaaa

SEQ ID NO: 3421849 - RNA, 21 nt, Human
acguuaagggaaggaacucug

SEQ ID NO: 3421850 - RNA, 17 nt, Human
acguuagaccacaaaua

SEQ ID NO: 3421851 - RNA, 18 nt, Human
acguuagaccacaaauag

SEQ ID NO: 3421852 - RNA, 11 nt, Human
acguuccagcc

SEQ ID NO: 3421853 - RNA, 12 nt, Human
acguuccagccg

SEQ ID NO: 3421854 - RNA, 12 nt, Human
acguuggugacg

SEQ ID NO: 3421855 - RNA, 15 nt, Human
acguugugcauuugg

SEQ ID NO: 3421856 - RNA, 14 nt, Human
acguuuaaagugua

SEQ ID NO: 3421857 - RNA, 22 nt, Human
acguuuaaaguucuguguauuu

SEQ ID NO: 3421858 - RNA, 16 nt, Human
acguuuacuuaucuua

SEQ ID NO: 3421859 - RNA, 22 nt, Human
acguuuagcugacaaaauacuu

SEQ ID NO: 3421860 - RNA, 14 nt, Human
acguuuauaaacag

SEQ ID NO: 3421861 - RNA, 21 nt, Human
acguuuauaaacagaaaugga

SEQ ID NO: 3421862 - RNA, 10 nt, Human
acguuucuuu

SEQ ID NO: 3421863 - RNA, 20 nt, Human
acguuucuuuaaccuuguau

SEQ ID NO: 3421864 - RNA, 22 nt, Human
acguuugaagacauugcaccag

SEQ ID NO: 3421865 - RNA, 16 nt, Human
acguuuucuaauugcu

SEQ ID NO: 3421866 - RNA, 22 nt, Human
acguuuuuguaaauuaaucuuu

SEQ ID NO: 3421867 - RNA, 15 nt, Human
acuaaaaacaaaccc

SEQ ID NO: 3421868 - RNA, 16 nt, Human
acuaaaacuacaaaaa

SEQ ID NO: 3421869 - RNA, 17 nt, Human
acuaaaagacauuuguu

SEQ ID NO: 3421870 - RNA, 16 nt, Human
acuaaaagauauaagu

SEQ ID NO: 3421871 - RNA, 19 nt, Human
acuaaaagauauaagugcu

SEQ ID NO: 3421872 - RNA, 12 nt, Human
acuaaaagaucg

SEQ ID NO: 3421873 - RNA, 15 nt, Human
acuaaaauaauuuug

SEQ ID NO: 3421874 - RNA, 12 nt, Human
acuaaaauauau

SEQ ID NO: 3421875 - RNA, 14 nt, Human
acuaaaauaugucu

SEQ ID NO: 3421876 - RNA, 14 nt, Human
acuaaaauguucua

SEQ ID NO: 3421877 - RNA, 18 nt, Human
acuaaacauaugauuuca

SEQ ID NO: 3421878 - RNA, 20 nt, Human
acuaaacuacauuguucuua

SEQ ID NO: 3421879 - RNA, 16 nt, Human
acuaaacucucuuugg

SEQ ID NO: 3421880 - RNA, 13 nt, Human
acuaaacuuaauu

SEQ ID NO: 3421881 - RNA, 18 nt, Human
acuaaacuuggugcuuau

SEQ ID NO: 3421882 - RNA, 19 nt, Human
acuaaacuuggugcuuauu

SEQ ID NO: 3421883 - RNA, 22 nt, Human
acuaaacuuggugcuuauugau

SEQ ID NO: 3421884 - RNA, 23 nt, Human
acuaaacuuggugcuuauugaua

SEQ ID NO: 3421885 - RNA, 16 nt, Human
acuaaacuuucacacc

SEQ ID NO: 3421886 - RNA, 19 nt, Human
acuaaacuuuuuuucugua

SEQ ID NO: 3421887 - RNA, 22 nt, Human
acuaaacuuuuuuucuguacca

SEQ ID NO: 3421888 - RNA, 15 nt, Human
acuaaagaaagauua

SEQ ID NO: 3421889 - RNA, 20 nt, Human
acuaaagaagaucuguaauu

SEQ ID NO: 3421890 - RNA, 14 nt, Human
acuaaagagagaau

SEQ ID NO: 3421891 - RNA, 21 nt, Human
acuaaagagagaauguagaua

SEQ ID NO: 3421892 - RNA, 19 nt, Human
acuaaagcaauagaaacaa

SEQ ID NO: 3421893 - RNA, 20 nt, Human
acuaaaguuguacuuuaaaa

SEQ ID NO: 3421894 - RNA, 19 nt, Human
acuaaauaagaaaauaaca

SEQ ID NO: 3421895 - RNA, 18 nt, Human
acuaaauacuugcuccau

SEQ ID NO: 3421896 - RNA, 15 nt, Human
acuaaauagcaugua

SEQ ID NO: 3421897 - RNA, 15 nt, Human
acuaaaugccuaguu

SEQ ID NO: 3421898 - RNA, 20 nt, Human
acuaaaugccuaguuuuuag

SEQ ID NO: 3421899 - RNA, 13 nt, Human
acuaaauguuaaa

SEQ ID NO: 3421900 - RNA, 18 nt, Human
acuaaauguuaaagaugu

SEQ ID NO: 3421901 - RNA, 19 nt, Human
acuaaauguuaaagaugua

SEQ ID NO: 3421902 - RNA, 12 nt, Human
acuaaauuuaaa

SEQ ID NO: 3421903 - RNA, 19 nt, Human
acuaaauuuaaauuuaaag

SEQ ID NO: 3421904 - RNA, 22 nt, Human
acuaaauuuaaauuuaaagaua

SEQ ID NO: 3421905 - RNA, 13 nt, Human
acuaugaaucuau

SEQ ID NO: 3421906 - RNA, 15 nt, Human
acuaugauuauuaac

SEQ ID NO: 3421907 - RNA, 19 nt, Human
acuaugauuuaauuugaaa

SEQ ID NO: 3421908 - RNA, 15 nt, Human
acuaugauuuggaaa

SEQ ID NO: 3421909 - RNA, 20 nt, Human
acuaugcauggugccccagg

SEQ ID NO: 3421910 - RNA, 21 nt, Human
acuaugcauggugccccagga

SEQ ID NO: 3421911 - RNA, 22 nt, Human
acuaugcauggugccccaggac

SEQ ID NO: 3421912 - RNA, 23 nt, Human
acuaugcauggugccccaggacc

SEQ ID NO: 3421913 - RNA, 19 nt, Human
acuaugccugugucuucuc

SEQ ID NO: 3421914 - RNA, 13 nt, Human
acuauggaaaauc

SEQ ID NO: 3421915 - RNA, 21 nt, Human
acuauggaaaaucagcugcuc

SEQ ID NO: 3421916 - RNA, 19 nt, Human
acuauggagccuggcacag

SEQ ID NO: 3421917 - RNA, 23 nt, Human
acuauggagccuggcacaggacu

SEQ ID NO: 3421918 - RNA, 24 nt, Human
acuauggauaaacuaaacacguga

SEQ ID NO: 3421919 - RNA, 22 nt, Human
acuauggcccuggccuagcaua

SEQ ID NO: 3421920 - RNA, 22 nt, Human
acuaugguagccagaugauaaa

SEQ ID NO: 3421921 - RNA, 17 nt, Human
acuauguaaaaauaacc

SEQ ID NO: 3421922 - RNA, 12 nt, Human
acuauguaaacu

SEQ ID NO: 3421923 - RNA, 22 nt, Human
acuauguacaauauuuuaagca

SEQ ID NO: 3421924 - RNA, 15 nt, Human
acuauguauauacau

SEQ ID NO: 3421925 - RNA, 18 nt, Human
acuauguguuuuucucau

SEQ ID NO: 3421926 - RNA, 17 nt, Human
acuauguugcccaggca

SEQ ID NO: 3421927 - RNA, 19 nt, Human
acuauguugcccaggcagg

SEQ ID NO: 3421928 - RNA, 23 nt, Human
acuauguugcccaggcaggucuu

SEQ ID NO: 3421929 - RNA, 22 nt, Human
acuauuaaaaagguuuacagaa

SEQ ID NO: 3421930 - RNA, 20 nt, Human
acuauuaagcaguaaaaacu

SEQ ID NO: 3421931 - RNA, 22 nt, Human
acuauuaagcaguaaaaacugu

SEQ ID NO: 3421932 - RNA, 22 nt, Human
acuauuaggugcaauuucaagg

SEQ ID NO: 3421933 - RNA, 21 nt, Human
acuauuauaauuuaaugcaug

SEQ ID NO: 3421934 - RNA, 18 nt, Human
acuauuauccccauuucu

SEQ ID NO: 3421935 - RNA, 20 nt, Human
acuauuauuauagguaauca

SEQ ID NO: 3421936 - RNA, 16 nt, Human
acuauucaaacagucu

SEQ ID NO: 3421937 - RNA, 21 nt, Human
acuauucaaacagucucagga

SEQ ID NO: 3421938 - RNA, 18 nt, Human
acuauucauuaaauguuu

SEQ ID NO: 3421939 - RNA, 20 nt, Human
acuauucauuaaauguuuga

SEQ ID NO: 3421940 - RNA, 20 nt, Human
acuauuccccagcagggucu

SEQ ID NO: 3421941 - RNA, 16 nt, Human
acaugucuccuauccu

SEQ ID NO: 3421942 - RNA, 18 nt, Human
acaugucuguucuacaua

SEQ ID NO: 3421943 - RNA, 15 nt, Human
acaugucuuaaugaa

SEQ ID NO: 3421944 - RNA, 20 nt, Human
acaugucuuaaugaaguuug

SEQ ID NO: 3421945 - RNA, 21 nt, Human
acaugucuuaaugaaguuuga

SEQ ID NO: 3421946 - RNA, 13 nt, Human
acaugucuuccau

SEQ ID NO: 3421947 - RNA, 23 nt, Human
acaugucuuuucuugcaugaggc

SEQ ID NO: 3421948 - RNA, 18 nt, Human
acaugugaaaagaauaga

SEQ ID NO: 3421949 - RNA, 14 nt, Human
acaugugacacaua

SEQ ID NO: 3421950 - RNA, 21 nt, Human
acaugugacauuuauauauug

SEQ ID NO: 3421951 - RNA, 15 nt, Human
acaugugauacauuu

SEQ ID NO: 3421952 - RNA, 18 nt, Human
acaugugcacaugcacgu

SEQ ID NO: 3421953 - RNA, 19 nt, Human
acaugugccgaaugugcag

SEQ ID NO: 3421954 - RNA, 18 nt, Human
acauguggaaagugaauu

SEQ ID NO: 3421955 - RNA, 19 nt, Human
acauguggaaagugaauuu

SEQ ID NO: 3421956 - RNA, 19 nt, Human
acauguggcuccucccagc

SEQ ID NO: 3421957 - RNA, 20 nt, Human
acauguggcuugaauuaaga

SEQ ID NO: 3421958 - RNA, 16 nt, Human
acauguggggccaggu

SEQ ID NO: 3421959 - RNA, 13 nt, Human
acaugugguuuau

SEQ ID NO: 3421960 - RNA, 20 nt, Human
acauguguagccugugcaug

SEQ ID NO: 3421961 - RNA, 13 nt, Human
acaugugucaagc

SEQ ID NO: 3421962 - RNA, 19 nt, Human
acaugugucaagcugcuug

SEQ ID NO: 3421963 - RNA, 17 nt, Human
acauguguguauauaug

SEQ ID NO: 3421964 - RNA, 17 nt, Human
acauguguuggcagccu

SEQ ID NO: 3421965 - RNA, 16 nt, Human
acugaaaaccucuccu

SEQ ID NO: 3421966 - RNA, 17 nt, Human
acugaaaagaaggaaag

SEQ ID NO: 3421967 - RNA, 19 nt, Human
acugaaaagaaggaaagau

SEQ ID NO: 3421968 - RNA, 13 nt, Human
acugaaaagagag

SEQ ID NO: 3421969 - RNA, 17 nt, Human
acugaaaagagagcaga

SEQ ID NO: 3421970 - RNA, 18 nt, Human
acugaaaauauuguuuua

SEQ ID NO: 3421971 - RNA, 22 nt, Human
acugaaaauucgaaccaggaaa

SEQ ID NO: 3421972 - RNA, 18 nt, Human
acugaaacagauuucaua

SEQ ID NO: 3421973 - RNA, 17 nt, Human
acugaaacauggcugug

SEQ ID NO: 3421974 - RNA, 16 nt, Human
acugaaaggcuuuuca

SEQ ID NO: 3421975 - RNA, 14 nt, Human
acugaaagugguuu

SEQ ID NO: 3421976 - RNA, 17 nt, Human
acugaaaguguuuccuu

SEQ ID NO: 3421977 - RNA, 15 nt, Human
acugaaaguuuugua

SEQ ID NO: 3421978 - RNA, 16 nt, Human
acugaaauauacacac

SEQ ID NO: 3421979 - RNA, 21 nt, Human
acugaaaugccuuacuuugua

SEQ ID NO: 3421980 - RNA, 23 nt, Human
acugaaaugccuuacuuuguaug

SEQ ID NO: 3421981 - RNA, 13 nt, Human
acugaacaaaaaa

SEQ ID NO: 3421982 - RNA, 22 nt, Human
acugaacaccauugaaggcuua

SEQ ID NO: 3421983 - RNA, 20 nt, Human
acugaacaucugaguccugg

SEQ ID NO: 3421984 - RNA, 18 nt, Human
acugaaccacuuguagau

SEQ ID NO: 3421985 - RNA, 21 nt, Human
acugaaccacuuguagauuug

SEQ ID NO: 3421986 - RNA, 19 nt, Human
acugaaccggcuuuaccaa

SEQ ID NO: 3421987 - RNA, 20 nt, Human
acugaacucugacaacagac

SEQ ID NO: 3421988 - RNA, 13 nt, Human
acugaacuuugaa

SEQ ID NO: 3421989 - RNA, 15 nt, Human
acugaagaggaggag

SEQ ID NO: 3421990 - RNA, 18 nt, Human
acugaagauagaagaaaa

SEQ ID NO: 3421991 - RNA, 19 nt, Human
acugaagauagaagaaaaa

SEQ ID NO: 3421992 - RNA, 21 nt, Human
acugaagauagaagaaaaaag

SEQ ID NO: 3421993 - RNA, 23 nt, Human
acugaagauagaagaaaaaagaa

SEQ ID NO: 3421994 - RNA, 16 nt, Human
acugaagccugcagga

SEQ ID NO: 3421995 - RNA, 18 nt, Human
acugaaggaaaaacacaa

SEQ ID NO: 3421996 - RNA, 22 nt, Human
acugaaggaaaaacacaagcaa

SEQ ID NO: 3421997 - RNA, 17 nt, Human
acugaaggccuggccca

SEQ ID NO: 3421998 - RNA, 20 nt, Human
acugaaggcuaaaaagcaac

SEQ ID NO: 3421999 - RNA, 16 nt, Human
acugaaggugauucac

SEQ ID NO: 3422000 - RNA, 20 nt, Human
acugaaguaaaacaaacaau

SEQ ID NO: 3422001 - RNA, 14 nt, Human
acugaagucugaaa

SEQ ID NO: 3422002 - RNA, 15 nt, Human
acugaagucugaaau

SEQ ID NO: 3422003 - RNA, 13 nt, Human
acugaagugcuua

SEQ ID NO: 3422004 - RNA, 16 nt, Human
acugaaguuucacaug

SEQ ID NO: 3422005 - RNA, 19 nt, Human
acugaaguuucacaugagc

SEQ ID NO: 3422006 - RNA, 18 nt, Human
acugaauaccacucugua

SEQ ID NO: 3422007 - RNA, 19 nt, Human
acugaauaccacucuguaa

SEQ ID NO: 3422008 - RNA, 21 nt, Human
acugaauauuuauauuucacu

SEQ ID NO: 3422009 - RNA, 14 nt, Human
acugaaucuguaca

SEQ ID NO: 3422010 - RNA, 15 nt, Human
acugaaucuguacag

SEQ ID NO: 3422011 - RNA, 21 nt, Human
acugaaugaaacccccacaca

SEQ ID NO: 3422012 - RNA, 14 nt, Human
acugaaugucauug

SEQ ID NO: 3422013 - RNA, 21 nt, Human
acugaauuaaucaucuauaaa

SEQ ID NO: 3422014 - RNA, 19 nt, Human
acugaauuauaagaggcug

SEQ ID NO: 3422015 - RNA, 23 nt, Human
acugaauuauaagaggcugauaa

SEQ ID NO: 3422016 - RNA, 17 nt, Human
acugaauuguccccagu

SEQ ID NO: 3422017 - RNA, 15 nt, Human
acugaauuuguacuu

SEQ ID NO: 3422018 - RNA, 16 nt, Human
acugaauuuuuuugua

SEQ ID NO: 3422019 - RNA, 18 nt, Human
acugaauuuuuuuguaau

SEQ ID NO: 3422020 - RNA, 20 nt, Human
acugacaagcuccauuuaaa

SEQ ID NO: 3422021 - RNA, 14 nt, Human
acugacacaaagga

SEQ ID NO: 3422022 - RNA, 21 nt, Human
acugacacaggaaaccaacac

SEQ ID NO: 3422023 - RNA, 16 nt, Human
acugacacccauguuu

SEQ ID NO: 3422024 - RNA, 21 nt, Human
acugacacccauguuucucug

SEQ ID NO: 3422025 - RNA, 18 nt, Human
acugacagccucccaccc

SEQ ID NO: 3422026 - RNA, 15 nt, Human
acugacauuucuucu

SEQ ID NO: 3422027 - RNA, 14 nt, Human
acugaccagaacua

SEQ ID NO: 3422028 - RNA, 14 nt, Human
acugaccagacaag

SEQ ID NO: 3422029 - RNA, 14 nt, Human
acugaccagcagcu

SEQ ID NO: 3422030 - RNA, 14 nt, Human
acugaccagccucc

SEQ ID NO: 3422031 - RNA, 16 nt, Human
acugaccauccacucu

SEQ ID NO: 3422032 - RNA, 15 nt, Human
acugacccacagccu

SEQ ID NO: 3422033 - RNA, 15 nt, Human
acugacccuggggcu

SEQ ID NO: 3422034 - RNA, 17 nt, Human
acugacccuggggcugg

SEQ ID NO: 3422035 - RNA, 13 nt, Human
acugacccuucca

SEQ ID NO: 3422036 - RNA, 19 nt, Human
acugacccuuccagacaua

SEQ ID NO: 3422037 - RNA, 21 nt, Human
acugaccugucaugccccccu

SEQ ID NO: 3422038 - RNA, 20 nt, Human
acugaccuuggagagacaca

SEQ ID NO: 3422039 - RNA, 13 nt, Human
acugacggacuca

SEQ ID NO: 3422040 - RNA, 18 nt, Human
acugacuaucauaaaauc

SEQ ID NO: 3422041 - RNA, 17 nt, Human
acugacucuuaagaaga

SEQ ID NO: 3422042 - RNA, 20 nt, Human
acugacucuuaagaagacug

SEQ ID NO: 3422043 - RNA, 15 nt, Human
acugacugcagggac

SEQ ID NO: 3422044 - RNA, 22 nt, Human
acugacugucgggcuuuaaaaa

SEQ ID NO: 3422045 - RNA, 16 nt, Human
acugagacaaugccuu

SEQ ID NO: 3422046 - RNA, 22 nt, Human
acugagacagcccgggcucugc

SEQ ID NO: 3422047 - RNA, 16 nt, Human
acugagaccaaggcuu

SEQ ID NO: 3422048 - RNA, 16 nt, Human
acugagagaucugcug

SEQ ID NO: 3422049 - RNA, 15 nt, Human
acugagagccuuuuu

SEQ ID NO: 3422050 - RNA, 18 nt, Human
acugagauaccagcgagg

SEQ ID NO: 3422051 - RNA, 20 nt, Human
acugagauccuuccuuuuga

SEQ ID NO: 3422052 - RNA, 21 nt, Human
acugagcaacgcuauuccagc

SEQ ID NO: 3422053 - RNA, 22 nt, Human
acugagcaacgcuauuccagcu

SEQ ID NO: 3422054 - RNA, 15 nt, Human
acugagcacuguuuu

SEQ ID NO: 3422055 - RNA, 16 nt, Human
acugagcagugauauu

SEQ ID NO: 3422056 - RNA, 15 nt, Human
acugagcauaagucc

SEQ ID NO: 3422057 - RNA, 15 nt, Human
acugagcccccccaa

SEQ ID NO: 3422058 - RNA, 22 nt, Human
acugagcccccccaacacugug

SEQ ID NO: 3422059 - RNA, 13 nt, Human
acugagcuccucu

SEQ ID NO: 3422060 - RNA, 19 nt, Human
acugagcuccucugggcag

SEQ ID NO: 3422061 - RNA, 13 nt, Human
acugagcuuggaa

SEQ ID NO: 3422062 - RNA, 17 nt, Human
acugaggaauuucaccu

SEQ ID NO: 3422063 - RNA, 19 nt, Human
acugaggaauuucaccugu

SEQ ID NO: 3422064 - RNA, 16 nt, Human
acugaggaauuuucuu

SEQ ID NO: 3422065 - RNA, 15 nt, Human
acugaggauauucag

SEQ ID NO: 3422066 - RNA, 23 nt, Human
acugaggauauucagauguaugu

SEQ ID NO: 3422067 - RNA, 12 nt, Human
acugaggcaggg

SEQ ID NO: 3422068 - RNA, 15 nt, Human
acugaggcagggaag

SEQ ID NO: 3422069 - RNA, 21 nt, Human
acugaggccuaaaaguaaaca

SEQ ID NO: 3422070 - RNA, 20 nt, Human
acugaggccugagacccagg

SEQ ID NO: 3422071 - RNA, 21 nt, Human
acugagggaccaacugggccc

SEQ ID NO: 3422072 - RNA, 12 nt, Human
acugagggcagu

SEQ ID NO: 3422073 - RNA, 23 nt, Human
acugagggcagucgauagagcug

SEQ ID NO: 3422074 - RNA, 12 nt, Human
acugagggccac

SEQ ID NO: 3422075 - RNA, 22 nt, Human
acugagggccacacuauuacca

SEQ ID NO: 3422076 - RNA, 16 nt, Human
acugagggggccugga

SEQ ID NO: 3422077 - RNA, 18 nt, Human
acugagggggccuggaug

SEQ ID NO: 3422078 - RNA, 20 nt, Human
acugaggggggauccaguuu

SEQ ID NO: 3422079 - RNA, 21 nt, Human
acugaggggucuccaggagga

SEQ ID NO: 3422080 - RNA, 20 nt, Human
acugaguaagaaaugcugcc

SEQ ID NO: 3422081 - RNA, 21 nt, Human
acugaguacguugugcauuug

SEQ ID NO: 3422082 - RNA, 20 nt, Human
acugaguagcucuccugacu

SEQ ID NO: 3422083 - RNA, 15 nt, Human
acugaguuacauugu

SEQ ID NO: 3422084 - RNA, 17 nt, Human
acugauaguguccaaau

SEQ ID NO: 3422085 - RNA, 23 nt, Human
acauugagcugauauaaauucug

SEQ ID NO: 3422086 - RNA, 14 nt, Human
acauugcaauagaa

SEQ ID NO: 3422087 - RNA, 15 nt, Human
acauugcaauagaaa

SEQ ID NO: 3422088 - RNA, 18 nt, Human
acauugcaucaaagcauc

SEQ ID NO: 3422089 - RNA, 14 nt, Human
acauugcauucuau

SEQ ID NO: 3422090 - RNA, 17 nt, Human
acauugcauucuauugc

SEQ ID NO: 3422091 - RNA, 19 nt, Human
acauugcauucuauugccu

SEQ ID NO: 3422092 - RNA, 23 nt, Human
acauugccaaaaaggauacauaa

SEQ ID NO: 3422093 - RNA, 12 nt, Human
acauugccuuug

SEQ ID NO: 3422094 - RNA, 18 nt, Human
acauugccuuugaauguu

SEQ ID NO: 3422095 - RNA, 18 nt, Human
acauugcuuuacugucaa

SEQ ID NO: 3422096 - RNA, 21 nt, Human
acauugcuuuacugucaaaau

SEQ ID NO: 3422097 - RNA, 23 nt, Human
acauugcuuugaccacucuuccu

SEQ ID NO: 3422098 - RNA, 15 nt, Human
acauugcuuuuaaaa

SEQ ID NO: 3422099 - RNA, 17 nt, Human
acauugcuuuuaaaacu

SEQ ID NO: 3422100 - RNA, 12 nt, Human
acauugcuuuuc

SEQ ID NO: 3422101 - RNA, 15 nt, Human
acauuggaaagcaca

SEQ ID NO: 3422102 - RNA, 12 nt, Human
acauuggaagca

SEQ ID NO: 3422103 - RNA, 23 nt, Human
acauuggaagcagguuaaauguu

SEQ ID NO: 3422104 - RNA, 21 nt, Human
acauuggcaccuaauccaggc

SEQ ID NO: 3422105 - RNA, 22 nt, Human
acauuggcaccuaauccaggca

SEQ ID NO: 3422106 - RNA, 17 nt, Human
acauugggaaaucuuau

SEQ ID NO: 3422107 - RNA, 20 nt, Human
acauugggucuauuccagcu

SEQ ID NO: 3422108 - RNA, 23 nt, Human
acauugggucuauuccagcucau

SEQ ID NO: 3422109 - RNA, 14 nt, Human
acauugguguugua

SEQ ID NO: 3422110 - RNA, 14 nt, Human
acauugguucuugu

SEQ ID NO: 3422111 - RNA, 18 nt, Human
acauugguucuuguauua

SEQ ID NO: 3422112 - RNA, 22 nt, Human
acauugguucuuguauuaagaa

SEQ ID NO: 3422113 - RNA, 22 nt, Human
acauugguucuuucauuugcuu

SEQ ID NO: 3422114 - RNA, 19 nt, Human
acauuguaaauaguauuug

SEQ ID NO: 3422115 - RNA, 13 nt, Human
acauugucaauaa

SEQ ID NO: 3422116 - RNA, 17 nt, Human
acauugucauuuauaua

SEQ ID NO: 3422117 - RNA, 23 nt, Human
acauuguccccaaugaauauacu

SEQ ID NO: 3422118 - RNA, 13 nt, Human
acauugucucccg

SEQ ID NO: 3422119 - RNA, 16 nt, Human
acauugucucccgccc

SEQ ID NO: 3422120 - RNA, 19 nt, Human
acauugucuccuauauauu

SEQ ID NO: 3422121 - RNA, 22 nt, Human
acauugugauguauauuccuuu

SEQ ID NO: 3422122 - RNA, 17 nt, Human
acauuguggcacauucu

SEQ ID NO: 3422123 - RNA, 12 nt, Human
acauugugucua

SEQ ID NO: 3422124 - RNA, 13 nt, Human
acugauucuucag

SEQ ID NO: 3422125 - RNA, 22 nt, Human
acugauucuucagcaaaaauau

SEQ ID NO: 3422126 - RNA, 14 nt, Human
acugauuucaguaa

SEQ ID NO: 3422127 - RNA, 12 nt, Human
acugauuucccc

SEQ ID NO: 3422128 - RNA, 22 nt, Human
acugauuugacauagucuggcu

SEQ ID NO: 3422129 - RNA, 23 nt, Human
acugauuugggcugaauguaugu

SEQ ID NO: 3422130 - RNA, 14 nt, Human
acugauuuuuguaa

SEQ ID NO: 3422131 - RNA, 16 nt, Human
acugauuuuuuuuucc

SEQ ID NO: 3422132 - RNA, 18 nt, Human
acugcaaaucaggcuuuu

SEQ ID NO: 3422133 - RNA, 20 nt, Human
acugcaaaucaggcuuuugu

SEQ ID NO: 3422134 - RNA, 22 nt, Human
acugcaaaugucaucagaacuu

SEQ ID NO: 3422135 - RNA, 17 nt, Human
acugcaaccuccaccuc

SEQ ID NO: 3422136 - RNA, 22 nt, Human
acugcaaccuccgccucuuggg

SEQ ID NO: 3422137 - RNA, 15 nt, Human
acugcaaccuucacc

SEQ ID NO: 3422138 - RNA, 23 nt, Human
acugcaaccuucgccaccugggu

SEQ ID NO: 3422139 - RNA, 17 nt, Human
acugcaagaggcuccug

SEQ ID NO: 3422140 - RNA, 17 nt, Human
acugcaagucacaaagg

SEQ ID NO: 3422141 - RNA, 18 nt, Human
acugcaagucacaaagga

SEQ ID NO: 3422142 - RNA, 15 nt, Human
acugcaauagagacu

SEQ ID NO: 3422143 - RNA, 17 nt, Human
acugcaauuaaagugau

SEQ ID NO: 3422144 - RNA, 19 nt, Human
acugcacagagcucuccag

SEQ ID NO: 3422145 - RNA, 20 nt, Human
acugcacagcggccccugca

SEQ ID NO: 3422146 - RNA, 22 nt, Human
acugcacagcggccccugcauc

SEQ ID NO: 3422147 - RNA, 18 nt, Human
acugcacagcguccuguc

SEQ ID NO: 3422148 - RNA, 23 nt, Human
acugcacaugauuucacaaauau

SEQ ID NO: 3422149 - RNA, 14 nt, Human
acugcacccaggag

SEQ ID NO: 3422150 - RNA, 15 nt, Human
acugcacccccuccu

SEQ ID NO: 3422151 - RNA, 17 nt, Human
acugcacccccuccugc

SEQ ID NO: 3422152 - RNA, 19 nt, Human
acugcacguggcuucugau

SEQ ID NO: 3422153 - RNA, 14 nt, Human
acugcacuccagcc

SEQ ID NO: 3422154 - RNA, 15 nt, Human
acugcacuccagccu

SEQ ID NO: 3422155 - RNA, 19 nt, Human
acugcacuccagccugggg

SEQ ID NO: 3422156 - RNA, 13 nt, Human
acugcacuguuuu

SEQ ID NO: 3422157 - RNA, 12 nt, Human
acugcagaacag

SEQ ID NO: 3422158 - RNA, 21 nt, Human
acugcagaauacaguaagcug

SEQ ID NO: 3422159 - RNA, 12 nt, Human
acugcagcaccu

SEQ ID NO: 3422160 - RNA, 22 nt, Human
acugcagcaccuccaggccugu

SEQ ID NO: 3422161 - RNA, 19 nt, Human
acugcagccucaaccuccu

SEQ ID NO: 3422162 - RNA, 23 nt, Human
acugcaggccccgcuuguccagc

SEQ ID NO: 3422163 - RNA, 17 nt, Human
acugcaggcccuggccu

SEQ ID NO: 3422164 - RNA, 23 nt, Human
acugcagggaaaauuauuugcau

SEQ ID NO: 3422165 - RNA, 13 nt, Human
acugcagggccag

SEQ ID NO: 3422166 - RNA, 15 nt, Human
acugcagggccagga

SEQ ID NO: 3422167 - RNA, 16 nt, Human
acugcagggccaggac

SEQ ID NO: 3422168 - RNA, 15 nt, Human
acugcaggggccgag

SEQ ID NO: 3422169 - RNA, 18 nt, Human
acugcagguuggacccca

SEQ ID NO: 3422170 - RNA, 19 nt, Human
acugcagguuggaccccag

SEQ ID NO: 3422171 - RNA, 21 nt, Human
acugcagugaaagacaagcug

SEQ ID NO: 3422172 - RNA, 16 nt, Human
acugcauacuuuuuaa

SEQ ID NO: 3422173 - RNA, 18 nt, Human
acugcauacuuuuuaaau

SEQ ID NO: 3422174 - RNA, 20 nt, Human
acugcauacuuuuuaaaugu

SEQ ID NO: 3422175 - RNA, 23 nt, Human
acugcauacuuuuuaaauguaaa

SEQ ID NO: 3422176 - RNA, 21 nt, Human
acugcaucuugguuauuucug

SEQ ID NO: 3422177 - RNA, 17 nt, Human
acugcauggaccuaaca

SEQ ID NO: 3422178 - RNA, 21 nt, Human
acugcauggagacgcauuucg

SEQ ID NO: 3422179 - RNA, 17 nt, Human
acugcaugguaauuuau

SEQ ID NO: 3422180 - RNA, 20 nt, Human
acugcauuauucucuuuuau

SEQ ID NO: 3422181 - RNA, 17 nt, Human
acugcauuauuugagaa

SEQ ID NO: 3422182 - RNA, 23 nt, Human
acugcauucuucugagcacuguu

SEQ ID NO: 3422183 - RNA, 16 nt, Human
acugcauucuucugau

SEQ ID NO: 3422184 - RNA, 18 nt, Human
acugccaaaaugcucuag

SEQ ID NO: 3422185 - RNA, 21 nt, Human
acugccaaagggaaauaucau

SEQ ID NO: 3422186 - RNA, 18 nt, Human
acugccaagacugcugug

SEQ ID NO: 3422187 - RNA, 12 nt, Human
acugccaagcca

SEQ ID NO: 3422188 - RNA, 17 nt, Human
acugccacaaggaagaa

SEQ ID NO: 3422189 - RNA, 17 nt, Human
acugccacuuugcacau

SEQ ID NO: 3422190 - RNA, 18 nt, Human
acugccacuuugcacauu

SEQ ID NO: 3422191 - RNA, 20 nt, Human
acugccacuuugcacauuuu

SEQ ID NO: 3422192 - RNA, 15 nt, Human
acugccagaugcuga

SEQ ID NO: 3422193 - RNA, 17 nt, Human
acugccagaugcugaug

SEQ ID NO: 3422194 - RNA, 19 nt, Human
acugccagcagcagcaggu

SEQ ID NO: 3422195 - RNA, 16 nt, Human
acugccagcucuuccu

SEQ ID NO: 3422196 - RNA, 17 nt, Human
acugccagcucuuccua

SEQ ID NO: 3422197 - RNA, 15 nt, Human
acugccaggagggac

SEQ ID NO: 3422198 - RNA, 21 nt, Human
acugccaggagggacaaagga

SEQ ID NO: 3422199 - RNA, 17 nt, Human
acugccaggccagccuc

SEQ ID NO: 3422200 - RNA, 19 nt, Human
acugccaggccagccuccg

SEQ ID NO: 3422201 - RNA, 18 nt, Human
acugccaggcucucuuug

SEQ ID NO: 3422202 - RNA, 14 nt, Human
acugccauaaaaca

SEQ ID NO: 3422203 - RNA, 16 nt, Human
acugccauauuaaauu

SEQ ID NO: 3422204 - RNA, 15 nt, Human
acugccaucaaacug

SEQ ID NO: 3422205 - RNA, 19 nt, Human
acugccauccuggcccagg

SEQ ID NO: 3422206 - RNA, 21 nt, Human
acugccauguacuaguuuuag

SEQ ID NO: 3422207 - RNA, 13 nt, Human
acugcccaccccc

SEQ ID NO: 3422208 - RNA, 14 nt, Human
acugcccacccccu

SEQ ID NO: 3422209 - RNA, 16 nt, Human
acugcccacccccuca

SEQ ID NO: 3422210 - RNA, 23 nt, Human
acugcccagcggacaguggcagg

SEQ ID NO: 3422211 - RNA, 19 nt, Human
acugcccaggccugccugu

SEQ ID NO: 3422212 - RNA, 21 nt, Human
acugccccaacuccuggaagc

SEQ ID NO: 3422213 - RNA, 20 nt, Human
acugcccccucugcccugcg

SEQ ID NO: 3422214 - RNA, 17 nt, Human
acugcccccugcugcca

SEQ ID NO: 3422215 - RNA, 15 nt, Human
acugcccgagcuggu

SEQ ID NO: 3422216 - RNA, 21 nt, Human
acugcccgagcuggugcauua

SEQ ID NO: 3422217 - RNA, 22 nt, Human
acugcccgagcuggugcauuac

SEQ ID NO: 3422218 - RNA, 16 nt, Human
acugcccgcacacccu

SEQ ID NO: 3422219 - RNA, 22 nt, Human
acugcccggcacagaugcucca

SEQ ID NO: 3422220 - RNA, 11 nt, Human
acugcccuggu

SEQ ID NO: 3422221 - RNA, 22 nt, Human
acugccgcaagucugcagcccg

SEQ ID NO: 3422222 - RNA, 20 nt, Human
acugccgugcauuagcacag

SEQ ID NO: 3422223 - RNA, 14 nt, Human
acugccuaagcccu

SEQ ID NO: 3422224 - RNA, 16 nt, Human
acugccuagaaacaac

SEQ ID NO: 3422225 - RNA, 22 nt, Human
acugccuagaaacaacacugua

SEQ ID NO: 3422226 - RNA, 16 nt, Human
acugccucagguuccu

SEQ ID NO: 3422227 - RNA, 19 nt, Human
acugccucgaaacacagaa

SEQ ID NO: 3422228 - RNA, 15 nt, Human
acugccccaacuccu

SEQ ID NO: 3422229 - RNA, 19 nt, Human
acugccccccaugaggaag

SEQ ID NO: 3422230 - RNA, 14 nt, Human
acugcccccucugc

SEQ ID NO: 3422231 - RNA, 15 nt, Human
acugcccccucugcc

SEQ ID NO: 3422232 - RNA, 17 nt, Human
acugcccccucugcccu

SEQ ID NO: 3422233 - RNA, 19 nt, Human
acugcccccucugcccugc

SEQ ID NO: 3422234 - RNA, 19 nt, Human
acugcccccugcugccaug

SEQ ID NO: 3422235 - RNA, 23 nt, Human
acugccccgugcagacuggaggg

SEQ ID NO: 3422236 - RNA, 19 nt, Human
acugcccgagcuggugcau

SEQ ID NO: 3422237 - RNA, 20 nt, Human
acugcccgagcuggugcauu

SEQ ID NO: 3422238 - RNA, 15 nt, Human
acugcccggcagggu

SEQ ID NO: 3422239 - RNA, 17 nt, Human
acugcccggggcagcug

SEQ ID NO: 3422240 - RNA, 21 nt, Human
acugcccucuguucaguaaca

SEQ ID NO: 3422241 - RNA, 22 nt, Human
acugcccucuguucaguaacag

SEQ ID NO: 3422242 - RNA, 13 nt, Human
acugcccugucua

SEQ ID NO: 3422243 - RNA, 19 nt, Human
acugccgaccgaggcugga

SEQ ID NO: 3422244 - RNA, 22 nt, Human
acugccgaccgaggcuggagcu

SEQ ID NO: 3422245 - RNA, 20 nt, Human
acugccgucagugcugugcu

SEQ ID NO: 3422246 - RNA, 15 nt, Human
acugccuaagcccuc

SEQ ID NO: 3422247 - RNA, 14 nt, Human
acugccuacugcau

SEQ ID NO: 3422248 - RNA, 13 nt, Human
acugccuagaaac

SEQ ID NO: 3422249 - RNA, 14 nt, Human
acugccuagaaaca

SEQ ID NO: 3422250 - RNA, 19 nt, Human
acugccuagaaacaacacu

SEQ ID NO: 3422251 - RNA, 20 nt, Human
acugccuagaaacaacacug

SEQ ID NO: 3422252 - RNA, 15 nt, Human
acugccucagguucc

SEQ ID NO: 3422253 - RNA, 13 nt, Human
acugccuccccca

SEQ ID NO: 3422254 - RNA, 18 nt, Human
acugccucccccaggguc

SEQ ID NO: 3422255 - RNA, 12 nt, Human
acugccucuccc

SEQ ID NO: 3422256 - RNA, 14 nt, Human
acugccucucccuc

SEQ ID NO: 3422257 - RNA, 17 nt, Human
acugccucucccuggcc

SEQ ID NO: 3422258 - RNA, 14 nt, Human
acugccucugccac

SEQ ID NO: 3422259 - RNA, 18 nt, Human
acugccucugccuuagag

SEQ ID NO: 3422260 - RNA, 9 nt, Human
acugccugc

SEQ ID NO: 3422261 - RNA, 12 nt, Human
acugccugccca

SEQ ID NO: 3422262 - RNA, 14 nt, Human
acugccugcccacc

SEQ ID NO: 3422263 - RNA, 19 nt, Human
acugccugcccacccgugg

SEQ ID NO: 3422264 - RNA, 15 nt, Human
acugccugccuuaag

SEQ ID NO: 3422265 - RNA, 14 nt, Human
acugccugcuuggg

SEQ ID NO: 3422266 - RNA, 14 nt, Human
acugccuuaaaacu

SEQ ID NO: 3422267 - RNA, 16 nt, Human
acugccuucgcuucuu

SEQ ID NO: 3422268 - RNA, 17 nt, Human
acugccuucgcuucuug

SEQ ID NO: 3422269 - RNA, 23 nt, Human
acugccuucgcuucuugccucug

SEQ ID NO: 3422270 - RNA, 22 nt, Human
acugccuucucaacuccaaacu

SEQ ID NO: 3422271 - RNA, 21 nt, Human
acugccuugaaccugugagua

SEQ ID NO: 3422272 - RNA, 21 nt, Human
acugccuugaauauccccucc

SEQ ID NO: 3422273 - RNA, 19 nt, Human
acugccuuuagaaaauaua

SEQ ID NO: 3422274 - RNA, 11 nt, Human
acugccuuuga

SEQ ID NO: 3422275 - RNA, 22 nt, Human
acugcgaagacccucuugccca

SEQ ID NO: 3422276 - RNA, 19 nt, Human
acugcgaucuucagagcag

SEQ ID NO: 3422277 - RNA, 23 nt, Human
acugcggagaaccuugugccugg

SEQ ID NO: 3422278 - RNA, 21 nt, Human
acugcgggaugguccuggggc

SEQ ID NO: 3422279 - RNA, 18 nt, Human
acugcggggcuuggcuga

SEQ ID NO: 3422280 - RNA, 16 nt, Human
acugcuaaauaaaauu

SEQ ID NO: 3422281 - RNA, 20 nt, Human
acugcuaaauaaaauuuguu

SEQ ID NO: 3422282 - RNA, 16 nt, Human
acugcuaagaauauuu

SEQ ID NO: 3422283 - RNA, 21 nt, Human
acugcuaaggauuagucccug

SEQ ID NO: 3422284 - RNA, 20 nt, Human
acugcuaaguauuucccagc

SEQ ID NO: 3422285 - RNA, 14 nt, Human
acugcuacagcaau

SEQ ID NO: 3422286 - RNA, 19 nt, Human
acugcuaccuuucaaagcu

SEQ ID NO: 3422287 - RNA, 18 nt, Human
acugcuaggcgagugcca

SEQ ID NO: 3422288 - RNA, 22 nt, Human
acugcuaggcgagugccaggac

SEQ ID NO: 3422289 - RNA, 22 nt, Human
acugcuaggugggccagccccu

SEQ ID NO: 3422290 - RNA, 19 nt, Human
acugcuaguguucugucua

SEQ ID NO: 3422291 - RNA, 21 nt, Human
acugcuauuuuucauccuaaa

SEQ ID NO: 3422292 - RNA, 18 nt, Human
acugcucaagaagacaug

SEQ ID NO: 3422293 - RNA, 18 nt, Human
acugcucaggcugcagcu

SEQ ID NO: 3422294 - RNA, 23 nt, Human
acugcucaucauuccuugagaaa

SEQ ID NO: 3422295 - RNA, 15 nt, Human
acugcucccaccucc

SEQ ID NO: 3422296 - RNA, 18 nt, Human
acugcuccccagcccugg

SEQ ID NO: 3422297 - RNA, 19 nt, Human
acugcuccccagcccuggc

SEQ ID NO: 3422298 - RNA, 18 nt, Human
acugcucccugaagccag

SEQ ID NO: 3422299 - RNA, 20 nt, Human
acugcucccugaagccagcc

SEQ ID NO: 3422300 - RNA, 14 nt, Human
acugcuccguggag

SEQ ID NO: 3422301 - RNA, 13 nt, Human
acugcuccugagc

SEQ ID NO: 3422302 - RNA, 19 nt, Human
acugcuccugagcccccag

SEQ ID NO: 3422303 - RNA, 13 nt, Human
acugcucucaccu

SEQ ID NO: 3422304 - RNA, 21 nt, Human
acugcucuccuccaccucaac

SEQ ID NO: 3422305 - RNA, 12 nt, Human
acugcucugaug

SEQ ID NO: 3422306 - RNA, 18 nt, Human
acugcugcaaggccuuuc

SEQ ID NO: 3422307 - RNA, 12 nt, Human
acugcugccacu

SEQ ID NO: 3422308 - RNA, 17 nt, Human
acugcugcccagccucc

SEQ ID NO: 3422309 - RNA, 21 nt, Human
acugcugcccagccuccaagc

SEQ ID NO: 3422310 - RNA, 12 nt, Human
acugcugcccca

SEQ ID NO: 3422311 - RNA, 14 nt, Human
acugcugcugccug

SEQ ID NO: 3422312 - RNA, 18 nt, Human
acugcugcugccuggcca

SEQ ID NO: 3422313 - RNA, 14 nt, Human
acugcugcuucucc

SEQ ID NO: 3422314 - RNA, 12 nt, Human
acugcugcuuuu

SEQ ID NO: 3422315 - RNA, 21 nt, Human
acugcuggagaggccccagcc

SEQ ID NO: 3422316 - RNA, 13 nt, Human
acugcuggcugcc

SEQ ID NO: 3422317 - RNA, 19 nt, Human
acugcuggguggcccaucc

SEQ ID NO: 3422318 - RNA, 20 nt, Human
acugcuggguggcccauccc

SEQ ID NO: 3422319 - RNA, 22 nt, Human
acugcuguaaauaaaugcuuua

SEQ ID NO: 3422320 - RNA, 16 nt, Human
acugcugugaacaagu

SEQ ID NO: 3422321 - RNA, 15 nt, Human
accacucuggcagcc

SEQ ID NO: 3422322 - RNA, 17 nt, Human
accacugaaaaaauaua

SEQ ID NO: 3422323 - RNA, 22 nt, Human
accacugcaaguccuuuuguaa

SEQ ID NO: 3422324 - RNA, 18 nt, Human
accacugcacucuagccu

SEQ ID NO: 3422325 - RNA, 15 nt, Human
accacugcucugaug

SEQ ID NO: 3422326 - RNA, 14 nt, Human
accacuggccacca

SEQ ID NO: 3422327 - RNA, 16 nt, Human
accacuggccaccagg

SEQ ID NO: 3422328 - RNA, 17 nt, Human
accacuggccaccaggc

SEQ ID NO: 3422329 - RNA, 19 nt, Human
accacuggccaccaggcug

SEQ ID NO: 3422330 - RNA, 21 nt, Human
accacuggccaccaggcuggc

SEQ ID NO: 3422331 - RNA, 19 nt, Human
accacuguaaaaugaaauu

SEQ ID NO: 3422332 - RNA, 17 nt, Human
accacuguuucuugcuu

SEQ ID NO: 3422333 - RNA, 18 nt, Human
accacuguuucuugcuug

SEQ ID NO: 3422334 - RNA, 18 nt, Human
accacuuaaaaaaugucc

SEQ ID NO: 3422335 - RNA, 13 nt, Human
accacuucacuga

SEQ ID NO: 3422336 - RNA, 14 nt, Human
accacuuccagggg

SEQ ID NO: 3422337 - RNA, 13 nt, Human
accacuucgaaac

SEQ ID NO: 3422338 - RNA, 17 nt, Human
accacuucuuuuauaac

SEQ ID NO: 3422339 - RNA, 13 nt, Human
accacuuguagau

SEQ ID NO: 3422340 - RNA, 14 nt, Human
accacuuguagauu

SEQ ID NO: 3422341 - RNA, 22 nt, Human
accacuuuccuuuucuauuccu

SEQ ID NO: 3422342 - RNA, 21 nt, Human
accacuuuuguucuugguuug

SEQ ID NO: 3422343 - RNA, 22 nt, Human
accacuuuuguucuugguuugu

SEQ ID NO: 3422344 - RNA, 14 nt, Human
accacuuuuugcag

SEQ ID NO: 3422345 - RNA, 17 nt, Human
accagaaaagcccaagu

SEQ ID NO: 3422346 - RNA, 16 nt, Human
accagaaaaugagggc

SEQ ID NO: 3422347 - RNA, 24 nt, Human
accagaaagcaguugagacaagaa

SEQ ID NO: 3422348 - RNA, 13 nt, Human
accagaacaaggu

SEQ ID NO: 3422349 - RNA, 19 nt, Human
accagaaccagucuuucaa

SEQ ID NO: 3422350 - RNA, 14 nt, Human
accagaagccaaag

SEQ ID NO: 3422351 - RNA, 13 nt, Human
accagaagggaaa

SEQ ID NO: 3422352 - RNA, 16 nt, Human
accagaagggaaacag

SEQ ID NO: 3422353 - RNA, 21 nt, Human
accagaauugugcaaauggaa

SEQ ID NO: 3422354 - RNA, 16 nt, Human
accagacaagcuguug

SEQ ID NO: 3422355 - RNA, 23 nt, Human
accagacaaggaaauacccuucu

SEQ ID NO: 3422356 - RNA, 16 nt, Human
accagacacccaggac

SEQ ID NO: 3422357 - RNA, 17 nt, Human
accagacacccaggacu

SEQ ID NO: 3422358 - RNA, 17 nt, Human
accagacaccuugacag

SEQ ID NO: 3422359 - RNA, 22 nt, Human
accagacaccuugacagggcac

SEQ ID NO: 3422360 - RNA, 23 nt, Human
accagacaccuugacagggcaca

SEQ ID NO: 3422361 - RNA, 16 nt, Human
accagacagaggguca

SEQ ID NO: 3422362 - RNA, 19 nt, Human
accagacagagggucacag

SEQ ID NO: 3422363 - RNA, 22 nt, Human
accagacagagggucacagugu

SEQ ID NO: 3422364 - RNA, 11 nt, Human
accagacaggu

SEQ ID NO: 3422365 - RNA, 15 nt, Human
accagacggggcugg

SEQ ID NO: 3422366 - RNA, 16 nt, Human
accagacucuugccug

SEQ ID NO: 3422367 - RNA, 16 nt, Human
accagacugcagguug

SEQ ID NO: 3422368 - RNA, 18 nt, Human
accagacuuuuuuaaaca

SEQ ID NO: 3422369 - RNA, 15 nt, Human
accagagagaguugu

SEQ ID NO: 3422370 - RNA, 15 nt, Human
accagagcacuguau

SEQ ID NO: 3422371 - RNA, 20 nt, Human
accagagcauuuccaacacc

SEQ ID NO: 3422372 - RNA, 14 nt, Human
accagagcccaccu

SEQ ID NO: 3422373 - RNA, 23 nt, Human
acuggacucaggaugcccagggc

SEQ ID NO: 3422374 - RNA, 14 nt, Human
acuggacuccggcc

SEQ ID NO: 3422375 - RNA, 19 nt, Human
acuggacucuucaaaaacu

SEQ ID NO: 3422376 - RNA, 14 nt, Human
acuggagaaaaugg

SEQ ID NO: 3422377 - RNA, 15 nt, Human
acuggagaaaaugga

SEQ ID NO: 3422378 - RNA, 17 nt, Human
acuggagaagucuuaga

SEQ ID NO: 3422379 - RNA, 17 nt, Human
acuggagaggcuagaac

SEQ ID NO: 3422380 - RNA, 12 nt, Human
acuggagcacaa

SEQ ID NO: 3422381 - RNA, 15 nt, Human
acuggagcaccaggc

SEQ ID NO: 3422382 - RNA, 16 nt, Human
acuggagcaccaggca

SEQ ID NO: 3422383 - RNA, 15 nt, Human
acuggagcagaaggg

SEQ ID NO: 3422384 - RNA, 17 nt, Human
acuggagcaucugacuc

SEQ ID NO: 3422385 - RNA, 15 nt, Human
acuggagcucaucug

SEQ ID NO: 3422386 - RNA, 16 nt, Human
acuggaggagagaaga

SEQ ID NO: 3422387 - RNA, 14 nt, Human
acuggaggucacau

SEQ ID NO: 3422388 - RNA, 19 nt, Human
acuggaggucacauucagg

SEQ ID NO: 3422389 - RNA, 18 nt, Human
acuggagguugaagccaa

SEQ ID NO: 3422390 - RNA, 17 nt, Human
acuggaguccagucucu

SEQ ID NO: 3422391 - RNA, 14 nt, Human
acuggaguggagca

SEQ ID NO: 3422392 - RNA, 16 nt, Human
acuggaguuacauuaa

SEQ ID NO: 3422393 - RNA, 19 nt, Human
acuggaguucuaugcucuc

SEQ ID NO: 3422394 - RNA, 22 nt, Human
acuggaugaaauaacuccuucu

SEQ ID NO: 3422395 - RNA, 13 nt, Human
acuggaugaagau

SEQ ID NO: 3422396 - RNA, 14 nt, Human
acuggaugaagauu

SEQ ID NO: 3422397 - RNA, 18 nt, Human
acuggaugcagaaacagu

SEQ ID NO: 3422398 - RNA, 13 nt, Human
acuggauuuguug

SEQ ID NO: 3422399 - RNA, 22 nt, Human
acuggcaaaaggaucuuugugg

SEQ ID NO: 3422400 - RNA, 16 nt, Human
acuggcaaacuucaga

SEQ ID NO: 3422401 - RNA, 20 nt, Human
acuggcaaacuucagacuga

SEQ ID NO: 3422402 - RNA, 21 nt, Human
acuggcaaacuucagacugaa

SEQ ID NO: 3422403 - RNA, 13 nt, Human
acuggcaaagcag

SEQ ID NO: 3422404 - RNA, 19 nt, Human
acuggcaauugucuauuua

SEQ ID NO: 3422405 - RNA, 13 nt, Human
acuggcacaguuu

SEQ ID NO: 3422406 - RNA, 14 nt, Human
acuggcagccccag

SEQ ID NO: 3422407 - RNA, 16 nt, Human
acuggcagccccagca

SEQ ID NO: 3422408 - RNA, 21 nt, Human
acuggcaucugacacaaaaaa

SEQ ID NO: 3422409 - RNA, 17 nt, Human
acuggccaagcugaggu

SEQ ID NO: 3422410 - RNA, 22 nt, Human
acuggccaccaggcuggcgcag

SEQ ID NO: 3422411 - RNA, 22 nt, Human
acuggccagggccacgcuccag

SEQ ID NO: 3422412 - RNA, 13 nt, Human
acuggccaucucc

SEQ ID NO: 3422413 - RNA, 14 nt, Human
acuggccaucucca

SEQ ID NO: 3422414 - RNA, 21 nt, Human
acuggccauggccugcaaacu

SEQ ID NO: 3422415 - RNA, 19 nt, Human
acuggccccggaucagagc

SEQ ID NO: 3422416 - RNA, 20 nt, Human
acuggccccggaucagagca

SEQ ID NO: 3422417 - RNA, 15 nt, Human
acuggccccuggguc

SEQ ID NO: 3422418 - RNA, 23 nt, Human
acuggccggucugcaagucagag

SEQ ID NO: 3422419 - RNA, 23 nt, Human
acuggccucugcugauccuccca

SEQ ID NO: 3422420 - RNA, 18 nt, Human
acuggccugacuuggggg

SEQ ID NO: 3422421 - RNA, 22 nt, Human
acuggccugcacggugggccuu

SEQ ID NO: 3422422 - RNA, 15 nt, Human
acuggcguggauuaa

SEQ ID NO: 3422423 - RNA, 20 nt, Human
acuggcguggauuaaacuua

SEQ ID NO: 3422424 - RNA, 21 nt, Human
acuggcuagaguccucacucc

SEQ ID NO: 3422425 - RNA, 13 nt, Human
acuggcucuccaa

SEQ ID NO: 3422426 - RNA, 15 nt, Human
acuggcucuccuggc

SEQ ID NO: 3422427 - RNA, 17 nt, Human
acuggcucuccuggccc

SEQ ID NO: 3422428 - RNA, 15 nt, Human
acuggcucucuccag

SEQ ID NO: 3422429 - RNA, 16 nt, Human
acuggcuguccuuucc

SEQ ID NO: 3422430 - RNA, 17 nt, Human
acuggcugugggcuccc

SEQ ID NO: 3422431 - RNA, 21 nt, Human
acuggcugugggcucccuucc

SEQ ID NO: 3422432 - RNA, 22 nt, Human
acuggcugugggcucccuuccu

SEQ ID NO: 3422433 - RNA, 20 nt, Human
acuggcuuugucccacagcu

SEQ ID NO: 3422434 - RNA, 14 nt, Human
acuggcuuuuauua

SEQ ID NO: 3422435 - RNA, 19 nt, Human
acuggcuuuuauuaaugca

SEQ ID NO: 3422436 - RNA, 19 nt, Human
acugggaaccccuuuccca

SEQ ID NO: 3422437 - RNA, 19 nt, Human
acugggaagauaggcucug

SEQ ID NO: 3422438 - RNA, 11 nt, Human
acugggaaggc

SEQ ID NO: 3422439 - RNA, 20 nt, Human
acugggaaggcuugggauuu

SEQ ID NO: 3422440 - RNA, 15 nt, Human
acugggaccaggcac

SEQ ID NO: 3422441 - RNA, 22 nt, Human
acugggagaggugccagcaacu

SEQ ID NO: 3422442 - RNA, 21 nt, Human
acugggagcccccagccuguc

SEQ ID NO: 3422443 - RNA, 12 nt, Human
acugggagccua

SEQ ID NO: 3422444 - RNA, 20 nt, Human
acugggaggccgaggcaggg

SEQ ID NO: 3422445 - RNA, 14 nt, Human
acugggaggggaga

SEQ ID NO: 3422446 - RNA, 17 nt, Human
acugggaucacaggugu

SEQ ID NO: 3422447 - RNA, 16 nt, Human
acugggaugagccgcu

SEQ ID NO: 3422448 - RNA, 13 nt, Human
acugggcccugcc

SEQ ID NO: 3422449 - RNA, 16 nt, Human
acugggcccugccucu

SEQ ID NO: 3422450 - RNA, 21 nt, Human
acugggccuguugcccuuucu

SEQ ID NO: 3422451 - RNA, 20 nt, Human
acugggccuuagugggccag

SEQ ID NO: 3422452 - RNA, 14 nt, Human
acugggcugaggga

SEQ ID NO: 3422453 - RNA, 21 nt, Human
acugggcuuggggaccagagc

SEQ ID NO: 3422454 - RNA, 15 nt, Human
acuggggacuuggcc

SEQ ID NO: 3422455 - RNA, 17 nt, Human
acuggggagcccgucuc

SEQ ID NO: 3422456 - RNA, 15 nt, Human
acuggggagucuuug

SEQ ID NO: 3422457 - RNA, 21 nt, Human
acuggggauugggugggcagg

SEQ ID NO: 3422458 - RNA, 21 nt, Human
acuggggccuacagcuuugau

SEQ ID NO: 3422459 - RNA, 15 nt, Human
acuggggcucagagc

SEQ ID NO: 3422460 - RNA, 14 nt, Human
acuggggcugaagg

SEQ ID NO: 3422461 - RNA, 15 nt, Human
acuggggcuggcaca

SEQ ID NO: 3422462 - RNA, 22 nt, Human
acuggggcuggggaaggaagcc

SEQ ID NO: 3422463 - RNA, 13 nt, Human
acuggggggcuug

SEQ ID NO: 3422464 - RNA, 20 nt, Human
acugggguccuggggccucg

SEQ ID NO: 3422465 - RNA, 21 nt, Human
acuggggugggaggucuugcu

SEQ ID NO: 3422466 - RNA, 15 nt, Human
acugggguugagggc

SEQ ID NO: 3422467 - RNA, 21 nt, Human
acuggguaaaugcaaaguucu

SEQ ID NO: 3422468 - RNA, 22 nt, Human
acuggguggggugaggaccacu

SEQ ID NO: 3422469 - RNA, 14 nt, Human
acugggugucauuu

SEQ ID NO: 3422470 - RNA, 17 nt, Human
acugggugucauuucau

SEQ ID NO: 3422471 - RNA, 21 nt, Human
acugggugucauuucauucca

SEQ ID NO: 3422472 - RNA, 14 nt, Human
acuggguuccugca

SEQ ID NO: 3422473 - RNA, 14 nt, Human
acuggguuucuagc

SEQ ID NO: 3422474 - RNA, 20 nt, Human
acuggguuucucuguauagu

SEQ ID NO: 3422475 - RNA, 19 nt, Human
acuggguuuggaccccagc

SEQ ID NO: 3422476 - RNA, 18 nt, Human
acugguaggaaacuaggu

SEQ ID NO: 3422477 - RNA, 20 nt, Human
acugguaggaacuugagaac

SEQ ID NO: 3422478 - RNA, 18 nt, Human
acugguagguugggacac

SEQ ID NO: 3422479 - RNA, 18 nt, Human
acugguauuccugccucc

SEQ ID NO: 3422480 - RNA, 13 nt, Human
acugguccaucug

SEQ ID NO: 3422481 - RNA, 14 nt, Human
accagggguuucuc

SEQ ID NO: 3422482 - RNA, 16 nt, Human
accagggguuucucgc

SEQ ID NO: 3422483 - RNA, 14 nt, Human
accaggguuuaguu

SEQ ID NO: 3422484 - RNA, 18 nt, Human
accagguccaaugagcuu

SEQ ID NO: 3422485 - RNA, 21 nt, Human
accagguccaaugagcuuucu

SEQ ID NO: 3422486 - RNA, 17 nt, Human
accagguccagaugugc

SEQ ID NO: 3422487 - RNA, 16 nt, Human
accaggucuuggagcu

SEQ ID NO: 3422488 - RNA, 22 nt, Human
accaggucuuggagcugagccu

SEQ ID NO: 3422489 - RNA, 22 nt, Human
accaggugccuuucaaauuuag

SEQ ID NO: 3422490 - RNA, 14 nt, Human
accaggugggagcg

SEQ ID NO: 3422491 - RNA, 22 nt, Human
accaggugggagcguuuuguug

SEQ ID NO: 3422492 - RNA, 20 nt, Human
accagguguucuacacucau

SEQ ID NO: 3422493 - RNA, 23 nt, Human
accagguguucuacacucaucuu

SEQ ID NO: 3422494 - RNA, 19 nt, Human
accagguuuuguuccgccc

SEQ ID NO: 3422495 - RNA, 20 nt, Human
accaguaggggcuuauaaua

SEQ ID NO: 3422496 - RNA, 18 nt, Human
accaguauuuaacuucug

SEQ ID NO: 3422497 - RNA, 14 nt, Human
accaguauuuagaa

SEQ ID NO: 3422498 - RNA, 16 nt, Human
accaguauuuuugcug

SEQ ID NO: 3422499 - RNA, 18 nt, Human
accaguauuuuugcugcu

SEQ ID NO: 3422500 - RNA, 21 nt, Human
accaguauuuuugcugcuucu

SEQ ID NO: 3422501 - RNA, 23 nt, Human
accaguauuuuugcugcuucuga

SEQ ID NO: 3422502 - RNA, 14 nt, Human
accagucacaugac

SEQ ID NO: 3422503 - RNA, 14 nt, Human
accagucauuuuuc

SEQ ID NO: 3422504 - RNA, 21 nt, Human
accagucuuuaaaggcccagc

SEQ ID NO: 3422505 - RNA, 20 nt, Human
accagucuuucaacucauug

SEQ ID NO: 3422506 - RNA, 14 nt, Human
accagugaaccaaa

SEQ ID NO: 3422507 - RNA, 18 nt, Human
accagugaauuuuugcaa

SEQ ID NO: 3422508 - RNA, 22 nt, Human
accagugcaggcuggccagccg

SEQ ID NO: 3422509 - RNA, 14 nt, Human
accagugccaagga

SEQ ID NO: 3422510 - RNA, 17 nt, Human
accagugccaaggaccu

SEQ ID NO: 3422511 - RNA, 22 nt, Human
accagugcccaaagucugugug

SEQ ID NO: 3422512 - RNA, 12 nt, Human
accagugccuua

SEQ ID NO: 3422513 - RNA, 13 nt, Human
accaguguccccu

SEQ ID NO: 3422514 - RNA, 20 nt, Human
accaguguccccuccacugu

SEQ ID NO: 3422515 - RNA, 13 nt, Human
accaguuaauuuu

SEQ ID NO: 3422516 - RNA, 14 nt, Human
accaguuaauuuuu

SEQ ID NO: 3422517 - RNA, 22 nt, Human
acuguaagaauaauuuauagua

SEQ ID NO: 3422518 - RNA, 21 nt, Human
acuguaagacucauucccuag

SEQ ID NO: 3422519 - RNA, 16 nt, Human
acuguaauaaagauga

SEQ ID NO: 3422520 - RNA, 18 nt, Human
acuguaauaauaccucaa

SEQ ID NO: 3422521 - RNA, 23 nt, Human
acuguaaugaaccgcugaauaug

SEQ ID NO: 3422522 - RNA, 16 nt, Human
acuguaauuauuugaa

SEQ ID NO: 3422523 - RNA, 17 nt, Human
acuguaauuuuauauga

SEQ ID NO: 3422524 - RNA, 15 nt, Human
acuguacaaaguaga

SEQ ID NO: 3422525 - RNA, 17 nt, Human
acuguacaauaaaaaca

SEQ ID NO: 3422526 - RNA, 15 nt, Human
acuguacacacuuua

SEQ ID NO: 3422527 - RNA, 17 nt, Human
acuguacacacuuuauu

SEQ ID NO: 3422528 - RNA, 15 nt, Human
acuguacacauaagc

SEQ ID NO: 3422529 - RNA, 20 nt, Human
acuguacagacagaaaaaac

SEQ ID NO: 3422530 - RNA, 11 nt, Human
acuguacagug

SEQ ID NO: 3422531 - RNA, 16 nt, Human
acuguacagugucuuu

SEQ ID NO: 3422532 - RNA, 15 nt, Human
acuguacauaaacaa

SEQ ID NO: 3422533 - RNA, 16 nt, Human
acuguacaugaaaaca

SEQ ID NO: 3422534 - RNA, 12 nt, Human
acuguacaugug

SEQ ID NO: 3422535 - RNA, 15 nt, Human
acuguacauuuaaaa

SEQ ID NO: 3422536 - RNA, 16 nt, Human
acuguacccaaaugga

SEQ ID NO: 3422537 - RNA, 22 nt, Human
acuguacuaauucuuacacugc

SEQ ID NO: 3422538 - RNA, 15 nt, Human
acuguacuucacugu

SEQ ID NO: 3422539 - RNA, 23 nt, Human
acuguacuugcucuugaugccug

SEQ ID NO: 3422540 - RNA, 16 nt, Human
acuguacuuugauuca

SEQ ID NO: 3422541 - RNA, 15 nt, Human
acuguagaaaugaug

SEQ ID NO: 3422542 - RNA, 20 nt, Human
acuguagaaugauuucaugc

SEQ ID NO: 3422543 - RNA, 23 nt, Human
acuguagauaauuaaccaaggua

SEQ ID NO: 3422544 - RNA, 17 nt, Human
acuguagauugcuucug

SEQ ID NO: 3422545 - RNA, 18 nt, Human
acuguagauugcuucugu

SEQ ID NO: 3422546 - RNA, 20 nt, Human
acuguagauugcuucuguag

SEQ ID NO: 3422547 - RNA, 15 nt, Human
acuguagcuuuggaa

SEQ ID NO: 3422548 - RNA, 18 nt, Human
acuguagcuuugugaaau

SEQ ID NO: 3422549 - RNA, 19 nt, Human
acuguaggaagaguagcau

SEQ ID NO: 3422550 - RNA, 20 nt, Human
acuguaguaaauaaugcuuu

SEQ ID NO: 3422551 - RNA, 22 nt, Human
acuguaguaaauaaugcuuuga

SEQ ID NO: 3422552 - RNA, 13 nt, Human
acuguagucucag

SEQ ID NO: 3422553 - RNA, 13 nt, Human
acuguaguucuaa

SEQ ID NO: 3422554 - RNA, 20 nt, Human
acuguaguuuuucuucaaca

SEQ ID NO: 3422555 - RNA, 16 nt, Human
acuguauagacaguuu

SEQ ID NO: 3422556 - RNA, 17 nt, Human
acuguauagacaguuug

SEQ ID NO: 3422557 - RNA, 13 nt, Human
acuguauauaaag

SEQ ID NO: 3422558 - RNA, 15 nt, Human
acuguauauuuguau

SEQ ID NO: 3422559 - RNA, 18 nt, Human
acuguauauuuuaagaag

SEQ ID NO: 3422560 - RNA, 14 nt, Human
acuguaucauuuuc

SEQ ID NO: 3422561 - RNA, 16 nt, Human
acuguaucauuuucuu

SEQ ID NO: 3422562 - RNA, 15 nt, Human
acuguaucuguguag

SEQ ID NO: 3422563 - RNA, 19 nt, Human
acuguaugaucaaauguuu

SEQ ID NO: 3422564 - RNA, 21 nt, Human
acuguaugaucaaauguuuaa

SEQ ID NO: 3422565 - RNA, 16 nt, Human
acuguauguuauagaa

SEQ ID NO: 3422566 - RNA, 21 nt, Human
acuguauguuauagaacuuca

SEQ ID NO: 3422567 - RNA, 13 nt, Human
acuguauuaagag

SEQ ID NO: 3422568 - RNA, 17 nt, Human
acuguauuugugacuaa

SEQ ID NO: 3422569 - RNA, 22 nt, Human
acuguauuugugacuaauugua

SEQ ID NO: 3422570 - RNA, 15 nt, Human
acugucaaaauaauu

SEQ ID NO: 3422571 - RNA, 19 nt, Human
acugucaaaauaauuuuau

SEQ ID NO: 3422572 - RNA, 16 nt, Human
acugucaaagaaucaa

SEQ ID NO: 3422573 - RNA, 22 nt, Human
acugucaaaugaugugcaaaac

SEQ ID NO: 3422574 - RNA, 22 nt, Human
acugucaaggcugcuuagaauc

SEQ ID NO: 3422575 - RNA, 14 nt, Human
acugucacccucca

SEQ ID NO: 3422576 - RNA, 15 nt, Human
acugucacccuccac

SEQ ID NO: 3422577 - RNA, 23 nt, Human
acugucacucauugcugagccuc

SEQ ID NO: 3422578 - RNA, 24 nt, Human
acugucacucauugcugagccucu

SEQ ID NO: 3422579 - RNA, 16 nt, Human
acugucacuguuucuc

SEQ ID NO: 3422580 - RNA, 15 nt, Human
acugucacuuugcuc

SEQ ID NO: 3422581 - RNA, 19 nt, Human
acugucacuuugcucuggg

SEQ ID NO: 3422582 - RNA, 16 nt, Human
acugucagccgggccc

SEQ ID NO: 3422583 - RNA, 18 nt, Human
acugucagccgggcccug

SEQ ID NO: 3422584 - RNA, 21 nt, Human
acugucagcuccccucggaga

SEQ ID NO: 3422585 - RNA, 22 nt, Human
acugucagcuccccucggagaa

SEQ ID NO: 3422586 - RNA, 13 nt, Human
acugucauagaaa

SEQ ID NO: 3422587 - RNA, 15 nt, Human
acugucaugcuucau

SEQ ID NO: 3422588 - RNA, 15 nt, Human
acuguccccuugaag

SEQ ID NO: 3422589 - RNA, 23 nt, Human
acugucccucaaaugacccaaag

SEQ ID NO: 3422590 - RNA, 13 nt, Human
acugucccuccug

SEQ ID NO: 3422591 - RNA, 17 nt, Human
acuguccuacccacccu

SEQ ID NO: 3422592 - RNA, 21 nt, Human
acuguccucuuucagaaaaca

SEQ ID NO: 3422593 - RNA, 17 nt, Human
acuguccugcuccacag

SEQ ID NO: 3422594 - RNA, 20 nt, Human
acuguccugcuccacagugu

SEQ ID NO: 3422595 - RNA, 18 nt, Human
acuguccugggcgcccug

SEQ ID NO: 3422596 - RNA, 19 nt, Human
acuguccugggcgcccugg

SEQ ID NO: 3422597 - RNA, 20 nt, Human
acuguccugggcgcccugga

SEQ ID NO: 3422598 - RNA, 22 nt, Human
acuguccugggcgcccuggaag

SEQ ID NO: 3422599 - RNA, 23 nt, Human
acuguccugggcgcccuggaagc

SEQ ID NO: 3422600 - RNA, 15 nt, Human
acuguccuguccugc

SEQ ID NO: 3422601 - RNA, 21 nt, Human
acuguccuuuccuuggcuuua

SEQ ID NO: 3422602 - RNA, 16 nt, Human
acugucggaggaaaga

SEQ ID NO: 3422603 - RNA, 19 nt, Human
acugucggaggaaagacaa

SEQ ID NO: 3422604 - RNA, 19 nt, Human
acugucuagcacuuccuug

SEQ ID NO: 3422605 - RNA, 13 nt, Human
acugucuauuucu

SEQ ID NO: 3422606 - RNA, 16 nt, Human
acugucuauuucugcu

SEQ ID NO: 3422607 - RNA, 18 nt, Human
acugucuauuucugcuga

SEQ ID NO: 3422608 - RNA, 23 nt, Human
acugucuauuucugcugaauuuu

SEQ ID NO: 3422609 - RNA, 20 nt, Human
acugucucaagagggcacug

SEQ ID NO: 3422610 - RNA, 12 nt, Human
acugucucacug

SEQ ID NO: 3422611 - RNA, 17 nt, Human
acugucucucaugaacc

SEQ ID NO: 3422612 - RNA, 20 nt, Human
acugucugagaguuuaguug

SEQ ID NO: 3422613 - RNA, 19 nt, Human
acugucuggccccccuggu

SEQ ID NO: 3422614 - RNA, 22 nt, Human
acugucuggccccccugguccc

SEQ ID NO: 3422615 - RNA, 20 nt, Human
acugucuggggagcgggucu

SEQ ID NO: 3422616 - RNA, 18 nt, Human
acugucugguuuuaacaa

SEQ ID NO: 3422617 - RNA, 12 nt, Human
acugucugucug

SEQ ID NO: 3422618 - RNA, 15 nt, Human
acugucugugaacag

SEQ ID NO: 3422619 - RNA, 11 nt, Human
acugucuuaau

SEQ ID NO: 3422620 - RNA, 18 nt, Human
acugucuuccucaaaaua

SEQ ID NO: 3422621 - RNA, 22 nt, Human
acugucuuuggaaaaauguuug

SEQ ID NO: 3422622 - RNA, 22 nt, Human
acugucuuuuuucuaaaguaaa

SEQ ID NO: 3422623 - RNA, 16 nt, Human
acugugaagagaacca

SEQ ID NO: 3422624 - RNA, 16 nt, Human
acugugaaggacccuu

SEQ ID NO: 3422625 - RNA, 13 nt, Human
acugugacaggca

SEQ ID NO: 3422626 - RNA, 16 nt, Human
acugugacaggcagca

SEQ ID NO: 3422627 - RNA, 19 nt, Human
acugugacaggcagcagag

SEQ ID NO: 3422628 - RNA, 14 nt, Human
acugugacaucucu

SEQ ID NO: 3422629 - RNA, 16 nt, Human
acugugaccaaguaua

SEQ ID NO: 3422630 - RNA, 19 nt, Human
acugugacccccagcuccg

SEQ ID NO: 3422631 - RNA, 21 nt, Human
acugugacccccagcuccggc

SEQ ID NO: 3422632 - RNA, 12 nt, Human
acugugaccugu

SEQ ID NO: 3422633 - RNA, 21 nt, Human
acugugaugaagccgaccuua

SEQ ID NO: 3422634 - RNA, 22 nt, Human
acugugaugccacacagagugg

SEQ ID NO: 3422635 - RNA, 15 nt, Human
acugugcacaucugu

SEQ ID NO: 3422636 - RNA, 21 nt, Human
acugugcagagucuagaaguu

SEQ ID NO: 3422637 - RNA, 22 nt, Human
acugugcaggugcuauuguuac

SEQ ID NO: 3422638 - RNA, 23 nt, Human
acugugcaggugcuauuguuacu

SEQ ID NO: 3422639 - RNA, 14 nt, Human
accauuucagagag

SEQ ID NO: 3422640 - RNA, 16 nt, Human
accauuuccccagggc

SEQ ID NO: 3422641 - RNA, 13 nt, Human
accauuuguaaua

SEQ ID NO: 3422642 - RNA, 14 nt, Human
accauuuguaauaa

SEQ ID NO: 3422643 - RNA, 18 nt, Human
accauuuguaauaaagua

SEQ ID NO: 3422644 - RNA, 15 nt, Human
accauuuguuaauau

SEQ ID NO: 3422645 - RNA, 22 nt, Human
accauuuugggguacccacugc

SEQ ID NO: 3422646 - RNA, 23 nt, Human
accauuuuuuaauuuacuuguuu

SEQ ID NO: 3422647 - RNA, 14 nt, Human
acccaaaagagaaa

SEQ ID NO: 3422648 - RNA, 16 nt, Human
acccaaaagagaaaaa

SEQ ID NO: 3422649 - RNA, 13 nt, Human
acccaaaaggcag

SEQ ID NO: 3422650 - RNA, 15 nt, Human
acccaaaaggcagaa

SEQ ID NO: 3422651 - RNA, 15 nt, Human
acccaaaccuggaga

SEQ ID NO: 3422652 - RNA, 13 nt, Human
acccaaagcagug

SEQ ID NO: 3422653 - RNA, 16 nt, Human
acccaaagcugagccu

SEQ ID NO: 3422654 - RNA, 20 nt, Human
acccaaauguucaucaauga

SEQ ID NO: 3422655 - RNA, 21 nt, Human
acccaaauguucaucaaugaa

SEQ ID NO: 3422656 - RNA, 12 nt, Human
acccaaccacuc

SEQ ID NO: 3422657 - RNA, 22 nt, Human
acccaacccuaucuccugacag

SEQ ID NO: 3422658 - RNA, 16 nt, Human
acccaacgcuccaaag

SEQ ID NO: 3422659 - RNA, 13 nt, Human
acccaagcuccuc

SEQ ID NO: 3422660 - RNA, 15 nt, Human
acccaagcuuagaac

SEQ ID NO: 3422661 - RNA, 14 nt, Human
agaaauuggcugga

SEQ ID NO: 3422662 - RNA, 15 nt, Human
agaaauuggcuggau

SEQ ID NO: 3422663 - RNA, 14 nt, Human
agaaauugguaccu

SEQ ID NO: 3422664 - RNA, 21 nt, Human
agaaauugguaccuugcacac

SEQ ID NO: 3422665 - RNA, 17 nt, Human
agaaauuuaauucaugu

SEQ ID NO: 3422666 - RNA, 22 nt, Human
agaaauuuaauucauguuucuu

SEQ ID NO: 3422667 - RNA, 16 nt, Human
agaaauuuacuauaua

SEQ ID NO: 3422668 - RNA, 17 nt, Human
agaaauuuacuauauau

SEQ ID NO: 3422669 - RNA, 17 nt, Human
agaaauuuauaaacuuu

SEQ ID NO: 3422670 - RNA, 15 nt, Human
agaaauuuauuuccu

SEQ ID NO: 3422671 - RNA, 14 nt, Human
agaaauuuccagag

SEQ ID NO: 3422672 - RNA, 21 nt, Human
agaaauuucugugaaaccugu

SEQ ID NO: 3422673 - RNA, 16 nt, Human
agaaauuuuguaagaa

SEQ ID NO: 3422674 - RNA, 15 nt, Human
agaaauuuuuaucag

SEQ ID NO: 3422675 - RNA, 17 nt, Human
agaaauuuuuaucaguu

SEQ ID NO: 3422676 - RNA, 13 nt, Human
agaaauuuuuauu

SEQ ID NO: 3422677 - RNA, 22 nt, Human
agaaauuuuucagaugcuucug

SEQ ID NO: 3422678 - RNA, 23 nt, Human
agaaauuuuucagaugcuucugg

SEQ ID NO: 3422679 - RNA, 23 nt, Human
agaacaaaaaaaucugcagaagg

SEQ ID NO: 3422680 - RNA, 19 nt, Human
agaacaaagcuguuaaacu

SEQ ID NO: 3422681 - RNA, 20 nt, Human
agaacaaaggggcuuaauua

SEQ ID NO: 3422682 - RNA, 12 nt, Human
agaacaaauauu

SEQ ID NO: 3422683 - RNA, 12 nt, Human
agaacaaaugaa

SEQ ID NO: 3422684 - RNA, 15 nt, Human
agaacaaaugaagac

SEQ ID NO: 3422685 - RNA, 19 nt, Human
agaacaagguaguuuuuac

SEQ ID NO: 3422686 - RNA, 15 nt, Human
agaacaauuuucuug

SEQ ID NO: 3422687 - RNA, 22 nt, Human
agaacacaaagcggggggaggg

SEQ ID NO: 3422688 - RNA, 17 nt, Human
agaacaccaagacuuga

SEQ ID NO: 3422689 - RNA, 17 nt, Human
acuugcgagaaauucgu

SEQ ID NO: 3422690 - RNA, 20 nt, Human
acuugcgguuccggcaugga

SEQ ID NO: 3422691 - RNA, 15 nt, Human
acuugcucuggaccu

SEQ ID NO: 3422692 - RNA, 17 nt, Human
acuugcucuggaccugc

SEQ ID NO: 3422693 - RNA, 19 nt, Human
acuugcucuggaccugccc

SEQ ID NO: 3422694 - RNA, 18 nt, Human
acuugcucuugaugccug

SEQ ID NO: 3422695 - RNA, 22 nt, Human
acuugcugcaguaugaaaauaa

SEQ ID NO: 3422696 - RNA, 15 nt, Human
acuugcugcuauuuu

SEQ ID NO: 3422697 - RNA, 14 nt, Human
acuugcugugacuu

SEQ ID NO: 3422698 - RNA, 14 nt, Human
acuugcuuaaaugu

SEQ ID NO: 3422699 - RNA, 15 nt, Human
acuugcuuaaaugug

SEQ ID NO: 3422700 - RNA, 14 nt, Human
acuugcuuuuaaaa

SEQ ID NO: 3422701 - RNA, 15 nt, Human
acuuggaaauauuaa

SEQ ID NO: 3422702 - RNA, 19 nt, Human
acuuggaaauauuaaaaga

SEQ ID NO: 3422703 - RNA, 23 nt, Human
acuuggaagcacaccaaucuuac

SEQ ID NO: 3422704 - RNA, 18 nt, Human
acuuggaauuuguaaccu

SEQ ID NO: 3422705 - RNA, 14 nt, Human
acuuggagccaagg

SEQ ID NO: 3422706 - RNA, 19 nt, Human
acuuggagccaaggguuca

SEQ ID NO: 3422707 - RNA, 14 nt, Human
acuuggagccccag

SEQ ID NO: 3422708 - RNA, 11 nt, Human
acuuggagccg

SEQ ID NO: 3422709 - RNA, 20 nt, Human
acuuggaggguugguccucu

SEQ ID NO: 3422710 - RNA, 15 nt, Human
acuuggaguuugcau

SEQ ID NO: 3422711 - RNA, 14 nt, Human
acuuggaugaguuu

SEQ ID NO: 3422712 - RNA, 13 nt, Human
acuuggauucucu

SEQ ID NO: 3422713 - RNA, 16 nt, Human
acuuggauucuuucca

SEQ ID NO: 3422714 - RNA, 18 nt, Human
acuuggauucuuuccauu

SEQ ID NO: 3422715 - RNA, 14 nt, Human
acuuggcagccuug

SEQ ID NO: 3422716 - RNA, 19 nt, Human
acuuggccaagcagggagg

SEQ ID NO: 3422717 - RNA, 18 nt, Human
acuuggcucgaaucucug

SEQ ID NO: 3422718 - RNA, 21 nt, Human
acuuggcucgaaucucugugc

SEQ ID NO: 3422719 - RNA, 23 nt, Human
acuuggcucgaaucucugugccu

SEQ ID NO: 3422720 - RNA, 16 nt, Human
acuuggcugcaggaau

SEQ ID NO: 3422721 - RNA, 13 nt, Human
acuuggcuggugu

SEQ ID NO: 3422722 - RNA, 23 nt, Human
acuuggcuggugugguacagaga

SEQ ID NO: 3422723 - RNA, 16 nt, Human
acuugggaggcugagg

SEQ ID NO: 3422724 - RNA, 13 nt, Human
acuugggcacccc

SEQ ID NO: 3422725 - RNA, 23 nt, Human
acuugggcacccccagccugggc

SEQ ID NO: 3422726 - RNA, 17 nt, Human
acuugggccauagcucc

SEQ ID NO: 3422727 - RNA, 18 nt, Human
acuugggccauagcuccu

SEQ ID NO: 3422728 - RNA, 18 nt, Human
acuuggggcacagggaga

SEQ ID NO: 3422729 - RNA, 21 nt, Human
acuugggggcucagcaaggcc

SEQ ID NO: 3422730 - RNA, 23 nt, Human
acuuggggggcugaggugggagg

SEQ ID NO: 3422731 - RNA, 16 nt, Human
acuugggugacggcag

SEQ ID NO: 3422732 - RNA, 18 nt, Human
acuuggucacagccaggc

SEQ ID NO: 3422733 - RNA, 19 nt, Human
acuuggucugccaggcccc

SEQ ID NO: 3422734 - RNA, 13 nt, Human
acuuggucuguga

SEQ ID NO: 3422735 - RNA, 21 nt, Human
acuuggucugugagaugcuag

SEQ ID NO: 3422736 - RNA, 13 nt, Human
acuuggugcuggg

SEQ ID NO: 3422737 - RNA, 21 nt, Human
acuugguguccuuucccucca

SEQ ID NO: 3422738 - RNA, 16 nt, Human
acuugguucugcuuca

SEQ ID NO: 3422739 - RNA, 18 nt, Human
acuugguuggguccucac

SEQ ID NO: 3422740 - RNA, 20 nt, Human
acuugguugguaggguggga

SEQ ID NO: 3422741 - RNA, 17 nt, Human
acuugguuuuaugguua

SEQ ID NO: 3422742 - RNA, 20 nt, Human
acuuguaaaggaauuuaaaa

SEQ ID NO: 3422743 - RNA, 15 nt, Human
acuuguaaauacacc

SEQ ID NO: 3422744 - RNA, 12 nt, Human
acuuguaaauau

SEQ ID NO: 3422745 - RNA, 16 nt, Human
acuuguaaauauaaag

SEQ ID NO: 3422746 - RNA, 17 nt, Human
acuuguaaauauaaaga

SEQ ID NO: 3422747 - RNA, 14 nt, Human
acuuguaaguugcu

SEQ ID NO: 3422748 - RNA, 18 nt, Human
acuuguaauuuuuuuaau

SEQ ID NO: 3422749 - RNA, 16 nt, Human
acuuguagcuguaaaa

SEQ ID NO: 3422750 - RNA, 14 nt, Human
acuuguaggauaag

SEQ ID NO: 3422751 - RNA, 14 nt, Human
acuuguauaaaugu

SEQ ID NO: 3422752 - RNA, 19 nt, Human
acuuguauaaauguauaua

SEQ ID NO: 3422753 - RNA, 18 nt, Human
acuuguauauucuauuuu

SEQ ID NO: 3422754 - RNA, 19 nt, Human
acuuguauauuuguacaaa

SEQ ID NO: 3422755 - RNA, 18 nt, Human
acuuguauuaaagacaga

SEQ ID NO: 3422756 - RNA, 13 nt, Human
acuuguauuaugu

SEQ ID NO: 3422757 - RNA, 13 nt, Human
acuugucaaagaa

SEQ ID NO: 3422758 - RNA, 18 nt, Human
acuugucacugacacaaa

SEQ ID NO: 3422759 - RNA, 16 nt, Human
acuugucacuugcaug

SEQ ID NO: 3422760 - RNA, 19 nt, Human
acuugucaggagugugugu

SEQ ID NO: 3422761 - RNA, 21 nt, Human
acuugucaggaguguguguga

SEQ ID NO: 3422762 - RNA, 13 nt, Human
acuugucauguga

SEQ ID NO: 3422763 - RNA, 22 nt, Human
acuuguccccaaauccgaaccu

SEQ ID NO: 3422764 - RNA, 18 nt, Human
acuuguccuagcacagau

SEQ ID NO: 3422765 - RNA, 15 nt, Human
acuugucggcuccag

SEQ ID NO: 3422766 - RNA, 20 nt, Human
acuugucuaaauaaguuugc

SEQ ID NO: 3422767 - RNA, 20 nt, Human
acuugucucuucaucuaaua

SEQ ID NO: 3422768 - RNA, 23 nt, Human
acuugucuuucugggguuuuucu

SEQ ID NO: 3422769 - RNA, 20 nt, Human
acuugucuuuggacccugag

SEQ ID NO: 3422770 - RNA, 21 nt, Human
acuugucuuuggacccugagg

SEQ ID NO: 3422771 - RNA, 10 nt, Human
acuugugaau

SEQ ID NO: 3422772 - RNA, 15 nt, Human
acuugugaauaaaga

SEQ ID NO: 3422773 - RNA, 14 nt, Human
acuugugacuuuug

SEQ ID NO: 3422774 - RNA, 19 nt, Human
acuugugacuuuugcuuua

SEQ ID NO: 3422775 - RNA, 23 nt, Human
acuugugacuuuugcuuuaauuc

SEQ ID NO: 3422776 - RNA, 20 nt, Human
acuugugauuauuuauuauu

SEQ ID NO: 3422777 - RNA, 20 nt, Human
acuugugcccucccuguccu

SEQ ID NO: 3422778 - RNA, 22 nt, Human
acuugugcugaucgugcuaaau

SEQ ID NO: 3422779 - RNA, 15 nt, Human
acuugugcuuugcuc

SEQ ID NO: 3422780 - RNA, 15 nt, Human
acuuguggacuaaaa

SEQ ID NO: 3422781 - RNA, 18 nt, Human
acuuguggacuaaaagau

SEQ ID NO: 3422782 - RNA, 16 nt, Human
acuugugguuuucaaa

SEQ ID NO: 3422783 - RNA, 23 nt, Human
acuugugucccaugaucccugug

SEQ ID NO: 3422784 - RNA, 14 nt, Human
acuugugucucugu

SEQ ID NO: 3422785 - RNA, 22 nt, Human
acuugugucucugugcuuuuaa

SEQ ID NO: 3422786 - RNA, 22 nt, Human
acuugugugugggcugugagug

SEQ ID NO: 3422787 - RNA, 10 nt, Human
acuuguguuu

SEQ ID NO: 3422788 - RNA, 16 nt, Human
acuuguguuuugcaag

SEQ ID NO: 3422789 - RNA, 15 nt, Human
acuuguuagaucuag

SEQ ID NO: 3422790 - RNA, 23 nt, Human
acuuguuagaucuaguucacucu

SEQ ID NO: 3422791 - RNA, 16 nt, Human
acuuguuauugugaau

SEQ ID NO: 3422792 - RNA, 17 nt, Human
acuuguuauugugaaug

SEQ ID NO: 3422793 - RNA, 19 nt, Human
acuuguuauugugaaugau

SEQ ID NO: 3422794 - RNA, 21 nt, Human
acuuguucaaaauauguucuu

SEQ ID NO: 3422795 - RNA, 15 nt, Human
acuuguuccagcucu

SEQ ID NO: 3422796 - RNA, 16 nt, Human
acuuguuccagcucuu

SEQ ID NO: 3422797 - RNA, 14 nt, Human
acuuguugaauuua

SEQ ID NO: 3422798 - RNA, 20 nt, Human
acuuguugaggguauguuuu

SEQ ID NO: 3422799 - RNA, 23 nt, Human
acuuguuggcguaggcuacagag

SEQ ID NO: 3422800 - RNA, 13 nt, Human
acuuguuguuuaa

SEQ ID NO: 3422801 - RNA, 20 nt, Human
acuuguuguuuaauguuuaa

SEQ ID NO: 3422802 - RNA, 13 nt, Human
acuuguuuccaau

SEQ ID NO: 3422803 - RNA, 12 nt, Human
acuuguuucuau

SEQ ID NO: 3422804 - RNA, 19 nt, Human
acuuguuuuggauggcuug

SEQ ID NO: 3422805 - RNA, 20 nt, Human
acuuguuuuggauggcuugu

SEQ ID NO: 3422806 - RNA, 20 nt, Human
agaacucgguguccccacca

SEQ ID NO: 3422807 - RNA, 23 nt, Human
agaacucugccugcccuuugucc

SEQ ID NO: 3422808 - RNA, 20 nt, Human
agaacucuggcuuuuggaag

SEQ ID NO: 3422809 - RNA, 20 nt, Human
agaacucugggcugccaugu

SEQ ID NO: 3422810 - RNA, 12 nt, Human
agaacucuuccu

SEQ ID NO: 3422811 - RNA, 16 nt, Human
agaacugaaaacauaa

SEQ ID NO: 3422812 - RNA, 15 nt, Human
agaacugaaaagaga

SEQ ID NO: 3422813 - RNA, 23 nt, Human
agaacugaaccggcuuuaccaaa

SEQ ID NO: 3422814 - RNA, 22 nt, Human
agaacugagcuccucugggcag

SEQ ID NO: 3422815 - RNA, 16 nt, Human
agaacugcaggcccug

SEQ ID NO: 3422816 - RNA, 21 nt, Human
agaacugcauauguuucgcug

SEQ ID NO: 3422817 - RNA, 16 nt, Human
agaacugcauggaccu

SEQ ID NO: 3422818 - RNA, 23 nt, Human
agaacugcauggaccuaacauuc

SEQ ID NO: 3422819 - RNA, 14 nt, Human
agaacugccauuau

SEQ ID NO: 3422820 - RNA, 17 nt, Human
agaacugccauuauuuu

SEQ ID NO: 3422821 - RNA, 23 nt, Human
agaacugccauuauuuucuguca

SEQ ID NO: 3422822 - RNA, 16 nt, Human
agaacuggacucagga

SEQ ID NO: 3422823 - RNA, 18 nt, Human
agaacuggguaaaugcaa

SEQ ID NO: 3422824 - RNA, 16 nt, Human
agaacugucggaggaa

SEQ ID NO: 3422825 - RNA, 19 nt, Human
agaacuguguuucaaguuc

SEQ ID NO: 3422826 - RNA, 15 nt, Human
agaacuucagaaaga

SEQ ID NO: 3422827 - RNA, 24 nt, Human
agaacuuccccauacaaauaagca

SEQ ID NO: 3422828 - RNA, 15 nt, Human
agaacuugcugccuc

SEQ ID NO: 3422829 - RNA, 17 nt, Human
agaacuuguuuaauaaa

SEQ ID NO: 3422830 - RNA, 15 nt, Human
agaacuuugagcuac

SEQ ID NO: 3422831 - RNA, 12 nt, Human
agaacuuuguau

SEQ ID NO: 3422832 - RNA, 13 nt, Human
agaacuuuguaua

SEQ ID NO: 3422833 - RNA, 17 nt, Human
agaacuuuguauaguua

SEQ ID NO: 3422834 - RNA, 20 nt, Human
agaacuuuuucuuuucccuc

SEQ ID NO: 3422835 - RNA, 13 nt, Human
agaacuuuuuuaa

SEQ ID NO: 3422836 - RNA, 22 nt, Human
agaacuuuuuuaaauaaacuuu

SEQ ID NO: 3422837 - RNA, 21 nt, Human
agaagaaaaaaacgaaaacag

SEQ ID NO: 3422838 - RNA, 14 nt, Human
agaagaaaaaagaa

SEQ ID NO: 3422839 - RNA, 17 nt, Human
agaagaaaaaagaaugu

SEQ ID NO: 3422840 - RNA, 15 nt, Human
agaagaaaacaucua

SEQ ID NO: 3422841 - RNA, 13 nt, Human
agaagaaaagaga

SEQ ID NO: 3422842 - RNA, 19 nt, Human
agaagaaaagguucuuacu

SEQ ID NO: 3422843 - RNA, 20 nt, Human
agaagaaaauggaaccaggc

SEQ ID NO: 3422844 - RNA, 22 nt, Human
agaagaaaauggaaccaggcuu

SEQ ID NO: 3422845 - RNA, 16 nt, Human
agaagaaaauucuccu

SEQ ID NO: 3422846 - RNA, 19 nt, Human
agaagaaaauugcugugcc

SEQ ID NO: 3422847 - RNA, 15 nt, Human
agaagaaagaacuau

SEQ ID NO: 3422848 - RNA, 18 nt, Human
acuuuauagaagaaugca

SEQ ID NO: 3422849 - RNA, 19 nt, Human
acuuuauaguuguuuuaua

SEQ ID NO: 3422850 - RNA, 19 nt, Human
acuuuaucaaugugucuuu

SEQ ID NO: 3422851 - RNA, 14 nt, Human
acuuuaucaauuaa

SEQ ID NO: 3422852 - RNA, 15 nt, Human
acuuuaucacuuaaa

SEQ ID NO: 3422853 - RNA, 13 nt, Human
acuuuaucaugaa

SEQ ID NO: 3422854 - RNA, 22 nt, Human
acuuuauccucauuccauaaau

SEQ ID NO: 3422855 - RNA, 23 nt, Human
acuuuaugccggaugugcuuuuc

SEQ ID NO: 3422856 - RNA, 18 nt, Human
acuuuauguuugucuuuu

SEQ ID NO: 3422857 - RNA, 21 nt, Human
acuuuauucuugaaagaagaa

SEQ ID NO: 3422858 - RNA, 17 nt, Human
acuuuauugccaaaacc

SEQ ID NO: 3422859 - RNA, 13 nt, Human
acuuuauuuacuu

SEQ ID NO: 3422860 - RNA, 20 nt, Human
acuuucaaucuucaauccuu

SEQ ID NO: 3422861 - RNA, 15 nt, Human
acuuucacauagaug

SEQ ID NO: 3422862 - RNA, 20 nt, Human
acuuucacauagaugucccu

SEQ ID NO: 3422863 - RNA, 21 nt, Human
acuuucacauagaugucccuu

SEQ ID NO: 3422864 - RNA, 21 nt, Human
acuuucacuauaaugugaaau

SEQ ID NO: 3422865 - RNA, 15 nt, Human
acuuucagcugucuu

SEQ ID NO: 3422866 - RNA, 16 nt, Human
acuuucaguaaacaua

SEQ ID NO: 3422867 - RNA, 17 nt, Human
acuuucaguaaacauaa

SEQ ID NO: 3422868 - RNA, 19 nt, Human
acuuucauccugacucugc

SEQ ID NO: 3422869 - RNA, 18 nt, Human
acuuucauuccuucagau

SEQ ID NO: 3422870 - RNA, 13 nt, Human
acuuucauugcca

SEQ ID NO: 3422871 - RNA, 16 nt, Human
acuuucauugccagug

SEQ ID NO: 3422872 - RNA, 21 nt, Human
acuuucauugccagugucuuu

SEQ ID NO: 3422873 - RNA, 23 nt, Human
acuuucauuuuuuuccaggcugg

SEQ ID NO: 3422874 - RNA, 19 nt, Human
acuuuccaauucuccuuua

SEQ ID NO: 3422875 - RNA, 18 nt, Human
acuuuccacccccucccu

SEQ ID NO: 3422876 - RNA, 17 nt, Human
acuuuccacuucuuccu

SEQ ID NO: 3422877 - RNA, 19 nt, Human
acuuuccccaccagaugcu

SEQ ID NO: 3422878 - RNA, 19 nt, Human
acuuuccccauacucuguc

SEQ ID NO: 3422879 - RNA, 14 nt, Human
acuuucccuugcuu

SEQ ID NO: 3422880 - RNA, 17 nt, Human
acuuuccuccuggcaga

SEQ ID NO: 3422881 - RNA, 18 nt, Human
acuuuccuggaugucuga

SEQ ID NO: 3422882 - RNA, 23 nt, Human
acuuuccuggaugucugaacuuu

SEQ ID NO: 3422883 - RNA, 18 nt, Human
acuuuccuuuccccagcc

SEQ ID NO: 3422884 - RNA, 22 nt, Human
acuuucuauagcagauugugua

SEQ ID NO: 3422885 - RNA, 17 nt, Human
acuuucuauccucugua

SEQ ID NO: 3422886 - RNA, 13 nt, Human
acuuucucaguuu

SEQ ID NO: 3422887 - RNA, 18 nt, Human
acuuucucuaauaauaaa

SEQ ID NO: 3422888 - RNA, 21 nt, Human
acuuucucuaauaauaaauag

SEQ ID NO: 3422889 - RNA, 23 nt, Human
acuuucucuaauaauaaauaguu

SEQ ID NO: 3422890 - RNA, 19 nt, Human
acuuucucuucauacuuuu

SEQ ID NO: 3422891 - RNA, 15 nt, Human
acuuucucuuguaaa

SEQ ID NO: 3422892 - RNA, 14 nt, Human
acuuucugaaauaa

SEQ ID NO: 3422893 - RNA, 20 nt, Human
acuuucugaaauaacauggc

SEQ ID NO: 3422894 - RNA, 14 nt, Human
acuuucuguaaacu

SEQ ID NO: 3422895 - RNA, 19 nt, Human
acuuucuguuaaaaugcau

SEQ ID NO: 3422896 - RNA, 22 nt, Human
acuuucuguuaaaaugcaugau

SEQ ID NO: 3422897 - RNA, 23 nt, Human
acuuucuguuggauuccaugcua

SEQ ID NO: 3422898 - RNA, 17 nt, Human
acuuucuucaaaauaua

SEQ ID NO: 3422899 - RNA, 16 nt, Human
acuuucuucuucccau

SEQ ID NO: 3422900 - RNA, 18 nt, Human
acuuucuuuaaauuaugu

SEQ ID NO: 3422901 - RNA, 13 nt, Human
acuuucuuucuca

SEQ ID NO: 3422902 - RNA, 16 nt, Human
acuuucuuucucacua

SEQ ID NO: 3422903 - RNA, 17 nt, Human
acuuucuuucuguaggu

SEQ ID NO: 3422904 - RNA, 20 nt, Human
acuuucuuuucgccguggcu

SEQ ID NO: 3422905 - RNA, 18 nt, Human
acuuucuuuuuguagcug

SEQ ID NO: 3422906 - RNA, 17 nt, Human
acuuucuuuuuugauau

SEQ ID NO: 3422907 - RNA, 23 nt, Human
acuuucuuuuuugauauagaagu

SEQ ID NO: 3422908 - RNA, 10 nt, Human
acuuugaaau

SEQ ID NO: 3422909 - RNA, 17 nt, Human
acuuugaaauaccucau

SEQ ID NO: 3422910 - RNA, 17 nt, Human
acuuugaaauguguuuc

SEQ ID NO: 3422911 - RNA, 12 nt, Human
acuuugaaggac

SEQ ID NO: 3422912 - RNA, 18 nt, Human
acuuugaauaaagaauac

SEQ ID NO: 3422913 - RNA, 21 nt, Human
acuuugaauaaagaauacuug

SEQ ID NO: 3422914 - RNA, 23 nt, Human
acuuugaauaaagaauacuugaa

SEQ ID NO: 3422915 - RNA, 18 nt, Human
acuuugacacuuuucaua

SEQ ID NO: 3422916 - RNA, 14 nt, Human
acuuugacaguguu

SEQ ID NO: 3422917 - RNA, 20 nt, Human
acuuugaccuaaauuauuua

SEQ ID NO: 3422918 - RNA, 12 nt, Human
acuuugaccucu

SEQ ID NO: 3422919 - RNA, 13 nt, Human
acuuugaccucug

SEQ ID NO: 3422920 - RNA, 15 nt, Human
acuuugacuuuuugc

SEQ ID NO: 3422921 - RNA, 17 nt, Human
acuuugagaucuaaaaa

SEQ ID NO: 3422922 - RNA, 21 nt, Human
acuuugagaucuaaaaauaac

SEQ ID NO: 3422923 - RNA, 17 nt, Human
acuuugaguuaagucua

SEQ ID NO: 3422924 - RNA, 19 nt, Human
acuuugaugucauguguuc

SEQ ID NO: 3422925 - RNA, 18 nt, Human
acuuugauucacauguuu

SEQ ID NO: 3422926 - RNA, 21 nt, Human
acuuugcacacuuuggcccag

SEQ ID NO: 3422927 - RNA, 18 nt, Human
acuuugcacugauauauc

SEQ ID NO: 3422928 - RNA, 13 nt, Human
acuuugcauuguc

SEQ ID NO: 3422929 - RNA, 23 nt, Human
acuuugccagcuuuuccucccuu

SEQ ID NO: 3422930 - RNA, 15 nt, Human
acuuugccuccugug

SEQ ID NO: 3422931 - RNA, 15 nt, Human
acuuugcuccucaca

SEQ ID NO: 3422932 - RNA, 15 nt, Human
acuuugcugauuucc

SEQ ID NO: 3422933 - RNA, 20 nt, Human
acuuugcugauuuccccucu

SEQ ID NO: 3422934 - RNA, 14 nt, Human
acuuugcuugcuuu

SEQ ID NO: 3422935 - RNA, 18 nt, Human
acuuugcuuuaauauaaa

SEQ ID NO: 3422936 - RNA, 15 nt, Human
acuuuggaaaaugca

SEQ ID NO: 3422937 - RNA, 23 nt, Human
acuuuggaaagacuuuuccaacc

SEQ ID NO: 3422938 - RNA, 14 nt, Human
acuuuggaaagagu

SEQ ID NO: 3422939 - RNA, 19 nt, Human
acuuuggaaaguagaaaag

SEQ ID NO: 3422940 - RNA, 15 nt, Human
acuuuggaaccagac

SEQ ID NO: 3422941 - RNA, 21 nt, Human
acuuuggaaccagacucuugc

SEQ ID NO: 3422942 - RNA, 17 nt, Human
acuuuggaaguuugugu

SEQ ID NO: 3422943 - RNA, 18 nt, Human
acuuuggaaguuuguguu

SEQ ID NO: 3422944 - RNA, 15 nt, Human
acuuuggaauacauu

SEQ ID NO: 3422945 - RNA, 12 nt, Human
acuuuggauaau

SEQ ID NO: 3422946 - RNA, 17 nt, Human
acuuuggcugcaugcga

SEQ ID NO: 3422947 - RNA, 22 nt, Human
acuuuggcuuauaauucuuuca

SEQ ID NO: 3422948 - RNA, 14 nt, Human
acuuugggaggcca

SEQ ID NO: 3422949 - RNA, 15 nt, Human
acuuugggaggccaa

SEQ ID NO: 3422950 - RNA, 10 nt, Human
agaagccugc

SEQ ID NO: 3422951 - RNA, 12 nt, Human
agaagccugggg

SEQ ID NO: 3422952 - RNA, 19 nt, Human
agaagccugggggccuggc

SEQ ID NO: 3422953 - RNA, 21 nt, Human
agaagccugggggccuggcug

SEQ ID NO: 3422954 - RNA, 19 nt, Human
agaagccuguaacacuccu

SEQ ID NO: 3422955 - RNA, 20 nt, Human
agaagccuguaacacuccuc

SEQ ID NO: 3422956 - RNA, 11 nt, Human
agaagccuuca

SEQ ID NO: 3422957 - RNA, 21 nt, Human
agaagccuucaagcucugagg

SEQ ID NO: 3422958 - RNA, 17 nt, Human
agaagccuucagcucca

SEQ ID NO: 3422959 - RNA, 16 nt, Human
agaagcggauuuccag

SEQ ID NO: 3422960 - RNA, 15 nt, Human
agaagcggcuggcag

SEQ ID NO: 3422961 - RNA, 16 nt, Human
agaagcggcuggcagc

SEQ ID NO: 3422962 - RNA, 23 nt, Human
agaagcgggacgagacccuacag

SEQ ID NO: 3422963 - RNA, 18 nt, Human
agaagcuaaaaccugagc

SEQ ID NO: 3422964 - RNA, 17 nt, Human
agaagcucagcugcauu

SEQ ID NO: 3422965 - RNA, 14 nt, Human
agaagcuccaggua

SEQ ID NO: 3422966 - RNA, 18 nt, Human
agaagcucccaggaacaa

SEQ ID NO: 3422967 - RNA, 13 nt, Human
agaagcuccccca

SEQ ID NO: 3422968 - RNA, 17 nt, Human
agaagcuccucucccca

SEQ ID NO: 3422969 - RNA, 20 nt, Human
agaagcuccucuccccagcc

SEQ ID NO: 3422970 - RNA, 23 nt, Human
agaagcuccucuccccagcccag

SEQ ID NO: 3422971 - RNA, 20 nt, Human
agaagcucuuacucuuuccu

SEQ ID NO: 3422972 - RNA, 19 nt, Human
agaagcugcauccagaggc

SEQ ID NO: 3422973 - RNA, 13 nt, Human
agaagcugcucca

SEQ ID NO: 3422974 - RNA, 18 nt, Human
agaagcugcuccaggccu

SEQ ID NO: 3422975 - RNA, 20 nt, Human
agaagcugcuccaggccugc

SEQ ID NO: 3422976 - RNA, 23 nt, Human
agaagcugcuccaggccugcagc

SEQ ID NO: 3422977 - RNA, 14 nt, Human
agaagcugcugacc

SEQ ID NO: 3422978 - RNA, 13 nt, Human
agaagcuggagga

SEQ ID NO: 3422979 - RNA, 16 nt, Human
agaagcuggaggacua

SEQ ID NO: 3422980 - RNA, 19 nt, Human
agaagcuguuguacauuua

SEQ ID NO: 3422981 - RNA, 22 nt, Human
agaagcuguuguacauuuauga

SEQ ID NO: 3422982 - RNA, 17 nt, Human
agaagcuuaggcagggc

SEQ ID NO: 3422983 - RNA, 16 nt, Human
agaagcuucagaaguu

SEQ ID NO: 3422984 - RNA, 16 nt, Human
agaagcuucuaauaaa

SEQ ID NO: 3422985 - RNA, 16 nt, Human
agaagcuuuauuucua

SEQ ID NO: 3422986 - RNA, 18 nt, Human
agaaggaaaaauguguaa

SEQ ID NO: 3422987 - RNA, 21 nt, Human
agaaggaaaauuuuagcgugc

SEQ ID NO: 3422988 - RNA, 17 nt, Human
agaaggaaauugagauu

SEQ ID NO: 3422989 - RNA, 14 nt, Human
agaaggaagacuuu

SEQ ID NO: 3422990 - RNA, 21 nt, Human
agaaggaaggcagggaggagg

SEQ ID NO: 3422991 - RNA, 17 nt, Human
agaaggaagugaagagg

SEQ ID NO: 3422992 - RNA, 16 nt, Human
agaaggagacaggcag

SEQ ID NO: 3422993 - RNA, 14 nt, Human
agaaggagagaaag

SEQ ID NO: 3422994 - RNA, 18 nt, Human
agaaggaggagagggaaa

SEQ ID NO: 3422995 - RNA, 20 nt, Human
agaaggagucagaaacuguu

SEQ ID NO: 3422996 - RNA, 13 nt, Human
agaaggaugaugu

SEQ ID NO: 3422997 - RNA, 20 nt, Human
agaaggcaaaugacuuugga

SEQ ID NO: 3422998 - RNA, 22 nt, Human
agaaggcaaguuucuagcuaga

SEQ ID NO: 3422999 - RNA, 14 nt, Human
agaaggcaauauua

SEQ ID NO: 3423000 - RNA, 13 nt, Human
agaaggcagcagg

SEQ ID NO: 3423001 - RNA, 13 nt, Human
agaaggccaagaa

SEQ ID NO: 3423002 - RNA, 17 nt, Human
agaaggccaagaggcug

SEQ ID NO: 3423003 - RNA, 11 nt, Human
agaaggcucuu

SEQ ID NO: 3423004 - RNA, 16 nt, Human
agaagggaaacaguca

SEQ ID NO: 3423005 - RNA, 12 nt, Human
agaagggaaagc

SEQ ID NO: 3423006 - RNA, 19 nt, Human
agaagggagcuagccagag

SEQ ID NO: 3423007 - RNA, 23 nt, Human
agaagggagggcagagcuggugc

SEQ ID NO: 3423008 - RNA, 21 nt, Human
agaagggauaacccuacaccc

SEQ ID NO: 3423009 - RNA, 23 nt, Human
acuuuucaaggcuuauauucaac

SEQ ID NO: 3423010 - RNA, 22 nt, Human
acuuuucaccuccuucaauucc

SEQ ID NO: 3423011 - RNA, 20 nt, Human
acuuuucauaaccuagccuu

SEQ ID NO: 3423012 - RNA, 17 nt, Human
acuuuucauaucauuuc

SEQ ID NO: 3423013 - RNA, 19 nt, Human
acuuuucauauuugcacua

SEQ ID NO: 3423014 - RNA, 17 nt, Human
acuuuuccaauauguga

SEQ ID NO: 3423015 - RNA, 20 nt, Human
acuuuuccaauaugugauuu

SEQ ID NO: 3423016 - RNA, 19 nt, Human
acuuuuccaguauuuuagu

SEQ ID NO: 3423017 - RNA, 22 nt, Human
acuuuuccauguaucuaccuca

SEQ ID NO: 3423018 - RNA, 15 nt, Human
acuuuuccuuaccuu

SEQ ID NO: 3423019 - RNA, 22 nt, Human
acuuuuccuugcauacaaacaa

SEQ ID NO: 3423020 - RNA, 18 nt, Human
acuuuuccuuugaauccu

SEQ ID NO: 3423021 - RNA, 11 nt, Human
acuuuucugua

SEQ ID NO: 3423022 - RNA, 17 nt, Human
acuuuucuguaauucag

SEQ ID NO: 3423023 - RNA, 16 nt, Human
acuuuucuuaaaccuu

SEQ ID NO: 3423024 - RNA, 18 nt, Human
acuuuucuucuauugccu

SEQ ID NO: 3423025 - RNA, 12 nt, Human
acuuuugacaaa

SEQ ID NO: 3423026 - RNA, 20 nt, Human
acuuuugagugugugugugc

SEQ ID NO: 3423027 - RNA, 18 nt, Human
acuuuuggaaccaugccu

SEQ ID NO: 3423028 - RNA, 21 nt, Human
acuuuuggaaucuagaagaaa

SEQ ID NO: 3423029 - RNA, 22 nt, Human
acuuuugguuaagucuguuuua

SEQ ID NO: 3423030 - RNA, 21 nt, Human
acuuuuguaaagaaauuuacu

SEQ ID NO: 3423031 - RNA, 12 nt, Human
acuuuuguaaga

SEQ ID NO: 3423032 - RNA, 17 nt, Human
acuuuuguaagacaaag

SEQ ID NO: 3423033 - RNA, 13 nt, Human
acuuuuguacauc

SEQ ID NO: 3423034 - RNA, 18 nt, Human
acuuuuguacugaauuuu

SEQ ID NO: 3423035 - RNA, 18 nt, Human
acuuuuguguaaugaaaa

SEQ ID NO: 3423036 - RNA, 12 nt, Human
acuuuuguucuu

SEQ ID NO: 3423037 - RNA, 15 nt, Human
acuuuuguucuuggu

SEQ ID NO: 3423038 - RNA, 21 nt, Human
acuuuuuaaaaucuuuucuau

SEQ ID NO: 3423039 - RNA, 18 nt, Human
acuuuuuaauucaccaaa

SEQ ID NO: 3423040 - RNA, 15 nt, Human
acuuuuuaguaauuu

SEQ ID NO: 3423041 - RNA, 12 nt, Human
acuuuuuauaua

SEQ ID NO: 3423042 - RNA, 13 nt, Human
acuuuuuauauau

SEQ ID NO: 3423043 - RNA, 15 nt, Human
acuuuuuauauucuc

SEQ ID NO: 3423044 - RNA, 16 nt, Human
acuuuuuauauucuca

SEQ ID NO: 3423045 - RNA, 15 nt, Human
acuuuuuauugauuu

SEQ ID NO: 3423046 - RNA, 13 nt, Human
acuuuuuauugcc

SEQ ID NO: 3423047 - RNA, 12 nt, Human
acuuuuucugau

SEQ ID NO: 3423048 - RNA, 15 nt, Human
acuuuuucuuuaugu

SEQ ID NO: 3423049 - RNA, 18 nt, Human
acuuuuucuuuuguaagu

SEQ ID NO: 3423050 - RNA, 12 nt, Human
acuuuuugcagc

SEQ ID NO: 3423051 - RNA, 17 nt, Human
acuuuuugcagcuuucu

SEQ ID NO: 3423052 - RNA, 13 nt, Human
acuuuuugcauuu

SEQ ID NO: 3423053 - RNA, 18 nt, Human
acuuuuugguuugcagau

SEQ ID NO: 3423054 - RNA, 18 nt, Human
acuuuuuguucugguccu

SEQ ID NO: 3423055 - RNA, 14 nt, Human
acuuuuuuaaauaa

SEQ ID NO: 3423056 - RNA, 17 nt, Human
acuuuuuuaaauaaacu

SEQ ID NO: 3423057 - RNA, 18 nt, Human
acuuuuuuaaauaaacuu

SEQ ID NO: 3423058 - RNA, 16 nt, Human
acuuuuuuaaauauuu

SEQ ID NO: 3423059 - RNA, 21 nt, Human
acuuuuuugaaauaauaaauc

SEQ ID NO: 3423060 - RNA, 18 nt, Human
acuuuuuugaaaucagua

SEQ ID NO: 3423061 - RNA, 22 nt, Human
acuuuuuuggggauaugcuuag

SEQ ID NO: 3423062 - RNA, 22 nt, Human
acuuuuuugguacuauaaaagc

SEQ ID NO: 3423063 - RNA, 14 nt, Human
acuuuuuuucaaug

SEQ ID NO: 3423064 - RNA, 19 nt, Human
acuuuuuuucuauauuauu

SEQ ID NO: 3423065 - RNA, 20 nt, Human
acuuuuuuucuguaccaguu

SEQ ID NO: 3423066 - RNA, 21 nt, Human
acuuuuuuucuguaccaguua

SEQ ID NO: 3423067 - RNA, 23 nt, Human
acuuuuuuucuguaccaguuaau

SEQ ID NO: 3423068 - RNA, 13 nt, Human
acuuuuuuuguau

SEQ ID NO: 3423069 - RNA, 16 nt, Human
acuuuuuuuguaugug

SEQ ID NO: 3423070 - RNA, 17 nt, Human
acuuuuuuuguaugugu

SEQ ID NO: 3423071 - RNA, 15 nt, Human
acuuuuuuuugagaa

SEQ ID NO: 3423072 - RNA, 18 nt, Human
acuuuuuuuuuauuuuau

SEQ ID NO: 3423073 - RNA, 22 nt, Human
acuuuuuuuuuuuaagaguaaa

SEQ ID NO: 3423074 - RNA, 14 nt, Human
agaaaaaaaaaaga

SEQ ID NO: 3423075 - RNA, 15 nt, Human
agaaaaaaaaaugcc

SEQ ID NO: 3423076 - RNA, 23 nt, Human
agaaaaaaaaaugccauaauaca

SEQ ID NO: 3423077 - RNA, 17 nt, Human
agaaaaaaaauaacaca

SEQ ID NO: 3423078 - RNA, 16 nt, Human
agaaaaaaauguauuu

SEQ ID NO: 3423079 - RNA, 19 nt, Human
agaaaaaaaugucaaaagu

SEQ ID NO: 3423080 - RNA, 16 nt, Human
agaaaaaaauugaaau

SEQ ID NO: 3423081 - RNA, 18 nt, Human
agaaaaaaauugaaaugu

SEQ ID NO: 3423082 - RNA, 12 nt, Human
agaaaaaagaag

SEQ ID NO: 3423083 - RNA, 14 nt, Human
agaaaaaagaaugu

SEQ ID NO: 3423084 - RNA, 16 nt, Human
agaaaaaagaauguca

SEQ ID NO: 3423085 - RNA, 10 nt, Human
agaaaaaagu

SEQ ID NO: 3423086 - RNA, 12 nt, Human
agaaaaaaguug

SEQ ID NO: 3423087 - RNA, 15 nt, Human
agaaaaaauaaaugg

SEQ ID NO: 3423088 - RNA, 16 nt, Human
agaaaaaauaaaugga

SEQ ID NO: 3423089 - RNA, 13 nt, Human
agaaaaaauaaua

SEQ ID NO: 3423090 - RNA, 22 nt, Human
agaaaaaauacauuuuauauua

SEQ ID NO: 3423091 - RNA, 23 nt, Human
agaaaaaauauuuuccugccagg

SEQ ID NO: 3423092 - RNA, 14 nt, Human
agaaaaacaggcac

SEQ ID NO: 3423093 - RNA, 13 nt, Human
agaaaaagaaaaa

SEQ ID NO: 3423094 - RNA, 14 nt, Human
agaaaaagaaaugc

SEQ ID NO: 3423095 - RNA, 18 nt, Human
agaaaaagaacaugcagu

SEQ ID NO: 3423096 - RNA, 18 nt, Human
agaaguugauauagaaca

SEQ ID NO: 3423097 - RNA, 13 nt, Human
agaaguugauaug

SEQ ID NO: 3423098 - RNA, 19 nt, Human
agaaguuguggauuucagu

SEQ ID NO: 3423099 - RNA, 15 nt, Human
agaaguuuagauuuu

SEQ ID NO: 3423100 - RNA, 17 nt, Human
agaaguuuauucucauu

SEQ ID NO: 3423101 - RNA, 18 nt, Human
agaaguuucccuuccucc

SEQ ID NO: 3423102 - RNA, 21 nt, Human
agaaguuucugccgcagcccu

SEQ ID NO: 3423103 - RNA, 16 nt, Human
agaaguuucuggcccu

SEQ ID NO: 3423104 - RNA, 13 nt, Human
agaaguuucuguc

SEQ ID NO: 3423105 - RNA, 19 nt, Human
agaaguuucuuuaaagacg

SEQ ID NO: 3423106 - RNA, 22 nt, Human
agaaguuugagaucagccuggg

SEQ ID NO: 3423107 - RNA, 16 nt, Human
agaaguuugcacuauc

SEQ ID NO: 3423108 - RNA, 22 nt, Human
agaaguuuggcugcugucauaa

SEQ ID NO: 3423109 - RNA, 19 nt, Human
agaaguuuguccauuugua

SEQ ID NO: 3423110 - RNA, 21 nt, Human
agaaguuuguccauuuguaaa

SEQ ID NO: 3423111 - RNA, 22 nt, Human
agaaguuuguccauuuguaaaa

SEQ ID NO: 3423112 - RNA, 16 nt, Human
agaaguuuuguacaga

SEQ ID NO: 3423113 - RNA, 14 nt, Human
agaaguuuuuguac

SEQ ID NO: 3423114 - RNA, 17 nt, Human
agaaguuuuuguacugu

SEQ ID NO: 3423115 - RNA, 22 nt, Human
agaaguuuuuguacuguaaaga

SEQ ID NO: 3423116 - RNA, 15 nt, Human
agaauaaaagaaauu

SEQ ID NO: 3423117 - RNA, 13 nt, Human
agaauaaaauguu

SEQ ID NO: 3423118 - RNA, 16 nt, Human
agaauaaaauguugaa

SEQ ID NO: 3423119 - RNA, 20 nt, Human
agaauaaaauguugaaaagu

SEQ ID NO: 3423120 - RNA, 13 nt, Human
agaauaaaauugu

SEQ ID NO: 3423121 - RNA, 12 nt, Human
agaauaaaauuu

SEQ ID NO: 3423122 - RNA, 17 nt, Human
agaauaaacauuuguua

SEQ ID NO: 3423123 - RNA, 14 nt, Human
agaauaaagcaauu

SEQ ID NO: 3423124 - RNA, 16 nt, Human
agaauaaagcaauuuu

SEQ ID NO: 3423125 - RNA, 23 nt, Human
agaauaaagcaauuuuccuugaa

SEQ ID NO: 3423126 - RNA, 13 nt, Human
agaauaaaggcag

SEQ ID NO: 3423127 - RNA, 15 nt, Human
agaauaaaggcaguu

SEQ ID NO: 3423128 - RNA, 20 nt, Human
agaauaaagguaugaaaggg

SEQ ID NO: 3423129 - RNA, 15 nt, Human
agaauaaauugauuu

SEQ ID NO: 3423130 - RNA, 15 nt, Human
agaauaagaaaacaa

SEQ ID NO: 3423131 - RNA, 20 nt, Human
agaauaagaaaacaaucaca

SEQ ID NO: 3423132 - RNA, 18 nt, Human
agaauaagaauuugcaua

SEQ ID NO: 3423133 - RNA, 22 nt, Human
agaauaagagagucauaaaccu

SEQ ID NO: 3423134 - RNA, 15 nt, Human
agaauaaggcaggca

SEQ ID NO: 3423135 - RNA, 15 nt, Human
agaauaagucauguu

SEQ ID NO: 3423136 - RNA, 18 nt, Human
agaauaagucauguuccu

SEQ ID NO: 3423137 - RNA, 20 nt, Human
agaauaaguuauugcaguuu

SEQ ID NO: 3423138 - RNA, 12 nt, Human
agaauaauaaau

SEQ ID NO: 3423139 - RNA, 16 nt, Human
agaauaauaaauauuu

SEQ ID NO: 3423140 - RNA, 17 nt, Human
agaauaaucaaauacau

SEQ ID NO: 3423141 - RNA, 17 nt, Human
agaauaaucacgcuuuc

SEQ ID NO: 3423142 - RNA, 21 nt, Human
agaauaaucacgcuuuccuga

SEQ ID NO: 3423143 - RNA, 15 nt, Human
agaauaaugaaugga

SEQ ID NO: 3423144 - RNA, 22 nt, Human
agaauaaugugggaagaaacaa

SEQ ID NO: 3423145 - RNA, 15 nt, Human
agaauaauucuuuga

SEQ ID NO: 3423146 - RNA, 13 nt, Human
agaauaauuuaua

SEQ ID NO: 3423147 - RNA, 16 nt, Human
agaauacaaacauauu

SEQ ID NO: 3423148 - RNA, 12 nt, Human
agaauacagaaa

SEQ ID NO: 3423149 - RNA, 22 nt, Human
agaauacaguaagcugcucuau

SEQ ID NO: 3423150 - RNA, 16 nt, Human
agaauaccacaucaaa

SEQ ID NO: 3423151 - RNA, 17 nt, Human
agaauacugauggaauu

SEQ ID NO: 3423152 - RNA, 21 nt, Human
agaauacugauggaauuuuuu

SEQ ID NO: 3423153 - RNA, 13 nt, Human
agaauagcaucug

SEQ ID NO: 3423154 - RNA, 21 nt, Human
agaauagcaucuguacaaagg

SEQ ID NO: 3423155 - RNA, 22 nt, Human
agaauagcaucuguacaaaggg

SEQ ID NO: 3423156 - RNA, 15 nt, Human
agaauagcauguugu

SEQ ID NO: 3423157 - RNA, 20 nt, Human
agaauagccuagauaugaau

SEQ ID NO: 3423158 - RNA, 22 nt, Human
agaauauaacaugaaaugauag

SEQ ID NO: 3423159 - RNA, 14 nt, Human
agaauauaauuauc

SEQ ID NO: 3423160 - RNA, 13 nt, Human
agaauauauacau

SEQ ID NO: 3423161 - RNA, 14 nt, Human
agaauauauuuauu

SEQ ID NO: 3423162 - RNA, 11 nt, Human
agaauaucugg

SEQ ID NO: 3423163 - RNA, 13 nt, Human
agaauaugaaaca

SEQ ID NO: 3423164 - RNA, 20 nt, Human
agaauaugcaucuuaaaaug

SEQ ID NO: 3423165 - RNA, 13 nt, Human
agaauaugucugc

SEQ ID NO: 3423166 - RNA, 21 nt, Human
agaauauuagcuuuacuguuu

SEQ ID NO: 3423167 - RNA, 23 nt, Human
agaauauuagcuuuacuguuugu

SEQ ID NO: 3423168 - RNA, 23 nt, Human
agaauauucagacaaaauggaua

SEQ ID NO: 3423169 - RNA, 13 nt, Human
agaauauugcaaa

SEQ ID NO: 3423170 - RNA, 16 nt, Human
agaauauugcaaaaua

SEQ ID NO: 3423171 - RNA, 19 nt, Human
agaauauuuauuaccucug

SEQ ID NO: 3423172 - RNA, 20 nt, Human
agaauauuuuaaguauugca

SEQ ID NO: 3423173 - RNA, 21 nt, Human
agaauauuuuuauauuuccuu

SEQ ID NO: 3423174 - RNA, 15 nt, Human
agaaucacaggcugg

SEQ ID NO: 3423175 - RNA, 19 nt, Human
agaaucaccuaauuaauuu

SEQ ID NO: 3423176 - RNA, 17 nt, Human
agaaucagaucauuuca

SEQ ID NO: 3423177 - RNA, 21 nt, Human
agaaucagucuauccacagag

SEQ ID NO: 3423178 - RNA, 19 nt, Human
agaaucagucuugcagcug

SEQ ID NO: 3423179 - RNA, 14 nt, Human
agaaucauacuuag

SEQ ID NO: 3423180 - RNA, 13 nt, Human
agaaucauguuuc

SEQ ID NO: 3423181 - RNA, 14 nt, Human
agaaucauguuucu

SEQ ID NO: 3423182 - RNA, 21 nt, Human
agaaucauuauuuauuaaauu

SEQ ID NO: 3423183 - RNA, 13 nt, Human
agaaucauugcuu

SEQ ID NO: 3423184 - RNA, 14 nt, Human
agaaucauugcuua

SEQ ID NO: 3423185 - RNA, 14 nt, Human
agaauccaaacuug

SEQ ID NO: 3423186 - RNA, 22 nt, Human
agaauccacauuucuaaaaucu

SEQ ID NO: 3423187 - RNA, 17 nt, Human
agaaucccaaauuugau

SEQ ID NO: 3423188 - RNA, 23 nt, Human
agaaucccagccggccaauggaa

SEQ ID NO: 3423189 - RNA, 14 nt, Human
agaaucccuguuca

SEQ ID NO: 3423190 - RNA, 22 nt, Human
agaaucccuuaacaguuguauu

SEQ ID NO: 3423191 - RNA, 21 nt, Human
agaauccuaggcuccacccca

SEQ ID NO: 3423192 - RNA, 17 nt, Human
agaauccuuuuguagaa

SEQ ID NO: 3423193 - RNA, 22 nt, Human
agaaucgaugggggaugcuuca

SEQ ID NO: 3423194 - RNA, 16 nt, Human
agaaucuaaagccagu

SEQ ID NO: 3423195 - RNA, 21 nt, Human
agaaucuaacugguggacaug

SEQ ID NO: 3423196 - RNA, 18 nt, Human
agaaucuauauuuaacaa

SEQ ID NO: 3423197 - RNA, 12 nt, Human
agaaucuauuuu

SEQ ID NO: 3423198 - RNA, 15 nt, Human
agaaucuauuuucua

SEQ ID NO: 3423199 - RNA, 17 nt, Human
agaaucugcaauucaaa

SEQ ID NO: 3423200 - RNA, 20 nt, Human
agaaucuugguuugccuucc

SEQ ID NO: 3423201 - RNA, 12 nt, Human
agaaucuuuccu

SEQ ID NO: 3423202 - RNA, 14 nt, Human
agaaugaaaaauga

SEQ ID NO: 3423203 - RNA, 22 nt, Human
agaaugaaaaaugaaagaugau

SEQ ID NO: 3423204 - RNA, 12 nt, Human
agaaugaaagag

SEQ ID NO: 3423205 - RNA, 19 nt, Human
agaaugaaagaguaaagga

SEQ ID NO: 3423206 - RNA, 18 nt, Human
agaaugaaagggcccaga

SEQ ID NO: 3423207 - RNA, 16 nt, Human
agaaugaaauacuguu

SEQ ID NO: 3423208 - RNA, 19 nt, Human
agaaugaaauacuguuuga

SEQ ID NO: 3423209 - RNA, 20 nt, Human
agaaugaaauacuguuugag

SEQ ID NO: 3423210 - RNA, 22 nt, Human
agaaugaagguuuuuguaaaga

SEQ ID NO: 3423211 - RNA, 12 nt, Human
agaaugaccuug

SEQ ID NO: 3423212 - RNA, 21 nt, Human
agaaugacuauauaauuuauu

SEQ ID NO: 3423213 - RNA, 14 nt, Human
agaaugagacaucc

SEQ ID NO: 3423214 - RNA, 17 nt, Human
agaaugagagacacacu

SEQ ID NO: 3423215 - RNA, 14 nt, Human
agaaugaggcugcu

SEQ ID NO: 3423216 - RNA, 22 nt, Human
agacaggcaagcaccuccugcc

SEQ ID NO: 3423217 - RNA, 23 nt, Human
agacaggcaagcaccuccugccu

SEQ ID NO: 3423218 - RNA, 22 nt, Human
agacaggcccaagagaugaaga

SEQ ID NO: 3423219 - RNA, 23 nt, Human
agacaggcccaagagaugaagag

SEQ ID NO: 3423220 - RNA, 20 nt, Human
agacaggcucuuagcagcuu

SEQ ID NO: 3423221 - RNA, 23 nt, Human
agacaggguuucaccauguugcc

SEQ ID NO: 3423222 - RNA, 16 nt, Human
agacaggguuuggcug

SEQ ID NO: 3423223 - RNA, 18 nt, Human
agacagguuuucacauaa

SEQ ID NO: 3423224 - RNA, 21 nt, Human
agacagguuuucacauaaaug

SEQ ID NO: 3423225 - RNA, 22 nt, Human
agacagguuuucacauaaaugc

SEQ ID NO: 3423226 - RNA, 17 nt, Human
agacaguaaguaucuuc

SEQ ID NO: 3423227 - RNA, 22 nt, Human
agacaguaaguaucuucguucu

SEQ ID NO: 3423228 - RNA, 14 nt, Human
agacaguauacagu

SEQ ID NO: 3423229 - RNA, 17 nt, Human
agacaguauacaguccu

SEQ ID NO: 3423230 - RNA, 21 nt, Human
agacaguauacaguccugugg

SEQ ID NO: 3423231 - RNA, 17 nt, Human
agacagucaaggagugg

SEQ ID NO: 3423232 - RNA, 18 nt, Human
agacagucacaaauuucu

SEQ ID NO: 3423233 - RNA, 17 nt, Human
agacagucccugccaau

SEQ ID NO: 3423234 - RNA, 19 nt, Human
agacagugauauuggaacu

SEQ ID NO: 3423235 - RNA, 12 nt, Human
agacagugaucu

SEQ ID NO: 3423236 - RNA, 17 nt, Human
agacagugaucuccaua

SEQ ID NO: 3423237 - RNA, 20 nt, Human
agacagugaucuccauaugu

SEQ ID NO: 3423238 - RNA, 13 nt, Human
agacaguuucuua

SEQ ID NO: 3423239 - RNA, 14 nt, Human
agacaguuucuuag

SEQ ID NO: 3423240 - RNA, 22 nt, Human
accuuagcuggcauuacagcug

SEQ ID NO: 3423241 - RNA, 16 nt, Human
accuuaggcagggaag

SEQ ID NO: 3423242 - RNA, 22 nt, Human
accuuaggcccggagcugcccc

SEQ ID NO: 3423243 - RNA, 21 nt, Human
accuuaggccuuccucucucc

SEQ ID NO: 3423244 - RNA, 17 nt, Human
accuuagugcaguuauu

SEQ ID NO: 3423245 - RNA, 21 nt, Human
accuuagugcaguuauuugcu

SEQ ID NO: 3423246 - RNA, 14 nt, Human
accuuaguggcuuu

SEQ ID NO: 3423247 - RNA, 14 nt, Human
accuuaguguuucu

SEQ ID NO: 3423248 - RNA, 19 nt, Human
accuuaguguuucugugca

SEQ ID NO: 3423249 - RNA, 21 nt, Human
accuuaguguuucugugcaug

SEQ ID NO: 3423250 - RNA, 22 nt, Human
accuuaguguuucugugcaugg

SEQ ID NO: 3423251 - RNA, 19 nt, Human
accuuaucacugcauuauu

SEQ ID NO: 3423252 - RNA, 18 nt, Human
accuuauccugcauuguu

SEQ ID NO: 3423253 - RNA, 11 nt, Human
accuuaucugu

SEQ ID NO: 3423254 - RNA, 23 nt, Human
accuuaucugugcgugaaacaca

SEQ ID NO: 3423255 - RNA, 11 nt, Human
accuuaucuua

SEQ ID NO: 3423256 - RNA, 16 nt, Human
accuuauuuuuuccca

SEQ ID NO: 3423257 - RNA, 19 nt, Human
accuucaaacuagggccaa

SEQ ID NO: 3423258 - RNA, 17 nt, Human
accuucaauaaaguauc

SEQ ID NO: 3423259 - RNA, 17 nt, Human
accuucaauuccugggc

SEQ ID NO: 3423260 - RNA, 23 nt, Human
accuucacacacagacuguuguc

SEQ ID NO: 3423261 - RNA, 18 nt, Human
accuucacucuaagaugu

SEQ ID NO: 3423262 - RNA, 22 nt, Human
accuucacucuaagauguuaua

SEQ ID NO: 3423263 - RNA, 17 nt, Human
accuucagacuuugcuu

SEQ ID NO: 3423264 - RNA, 16 nt, Human
accuucagcucacgcu

SEQ ID NO: 3423265 - RNA, 20 nt, Human
accuucauucugagaccaaa

SEQ ID NO: 3423266 - RNA, 15 nt, Human
accuucauuucaugu

SEQ ID NO: 3423267 - RNA, 17 nt, Human
accuuccaagagccuga

SEQ ID NO: 3423268 - RNA, 12 nt, Human
accuuccaccca

SEQ ID NO: 3423269 - RNA, 23 nt, Human
accuuccagaaauacuacugugu

SEQ ID NO: 3423270 - RNA, 17 nt, Human
accuuccagucaggaug

SEQ ID NO: 3423271 - RNA, 14 nt, Human
accuucccaaacgc

SEQ ID NO: 3423272 - RNA, 11 nt, Human
accuucccagc

SEQ ID NO: 3423273 - RNA, 13 nt, Human
accuucccagcuc

SEQ ID NO: 3423274 - RNA, 19 nt, Human
accuucccagcucucccuc

SEQ ID NO: 3423275 - RNA, 17 nt, Human
accuucccaugcccugg

SEQ ID NO: 3423276 - RNA, 16 nt, Human
accuuccucacuucca

SEQ ID NO: 3423277 - RNA, 14 nt, Human
accuuccucaucua

SEQ ID NO: 3423278 - RNA, 24 nt, Human
accuuccuucccugggcugugcua

SEQ ID NO: 3423279 - RNA, 12 nt, Human
accuuccuuccu

SEQ ID NO: 3423280 - RNA, 14 nt, Human
accuuccuuccugu

SEQ ID NO: 3423281 - RNA, 17 nt, Human
accuucgccaccugggu

SEQ ID NO: 3423282 - RNA, 14 nt, Human
accuucgggcugug

SEQ ID NO: 3423283 - RNA, 16 nt, Human
accuucgggcugugcc

SEQ ID NO: 3423284 - RNA, 18 nt, Human
accuucgggcugugcccg

SEQ ID NO: 3423285 - RNA, 18 nt, Human
accuucuagucuuggcca

SEQ ID NO: 3423286 - RNA, 15 nt, Human
accuucuccccagcu

SEQ ID NO: 3423287 - RNA, 22 nt, Human
accuucuccccagcucccagga

SEQ ID NO: 3423288 - RNA, 22 nt, Human
accuucucuauggggcauccuc

SEQ ID NO: 3423289 - RNA, 22 nt, Human
accuucucuggagccaagucca

SEQ ID NO: 3423290 - RNA, 23 nt, Human
accuucugcccauccugucuguu

SEQ ID NO: 3423291 - RNA, 12 nt, Human
accuucugccuu

SEQ ID NO: 3423292 - RNA, 22 nt, Human
accuucuggccucccacagacu

SEQ ID NO: 3423293 - RNA, 19 nt, Human
accuucuggcuuccuucuc

SEQ ID NO: 3423294 - RNA, 16 nt, Human
accuucuguggcucac

SEQ ID NO: 3423295 - RNA, 15 nt, Human
accuucuuauuauau

SEQ ID NO: 3423296 - RNA, 19 nt, Human
accuucuucaggcugccua

SEQ ID NO: 3423297 - RNA, 18 nt, Human
accuugaaaaaaaacagu

SEQ ID NO: 3423298 - RNA, 15 nt, Human
accuugaaugaugcc

SEQ ID NO: 3423299 - RNA, 17 nt, Human
accuugaaugcugccag

SEQ ID NO: 3423300 - RNA, 15 nt, Human
accuugacagggcac

SEQ ID NO: 3423301 - RNA, 19 nt, Human
accuugacuguugauguac

SEQ ID NO: 3423302 - RNA, 17 nt, Human
accuugacuugauuagu

SEQ ID NO: 3423303 - RNA, 19 nt, Human
accuugaggagucuugugu

SEQ ID NO: 3423304 - RNA, 22 nt, Human
accuugaggucuuuugacaugu

SEQ ID NO: 3423305 - RNA, 17 nt, Human
accuugaugagcugugc

SEQ ID NO: 3423306 - RNA, 23 nt, Human
accuugauuggggaauuaaaagu

SEQ ID NO: 3423307 - RNA, 16 nt, Human
accuugcaacacacag

SEQ ID NO: 3423308 - RNA, 19 nt, Human
accuugcaacacacagaca

SEQ ID NO: 3423309 - RNA, 15 nt, Human
accuugcaacuucau

SEQ ID NO: 3423310 - RNA, 17 nt, Human
accuugccaauuaguaa

SEQ ID NO: 3423311 - RNA, 20 nt, Human
accuugcuaauuuucucaaa

SEQ ID NO: 3423312 - RNA, 11 nt, Human
accuugcuguc

SEQ ID NO: 3423313 - RNA, 14 nt, Human
accuugcuguccug

SEQ ID NO: 3423314 - RNA, 17 nt, Human
accuugcuguccugauc

SEQ ID NO: 3423315 - RNA, 23 nt, Human
accuugcuguccugaucugugau

SEQ ID NO: 3423316 - RNA, 12 nt, Human
accuugcuucuu

SEQ ID NO: 3423317 - RNA, 13 nt, Human
accuugcuuuugc

SEQ ID NO: 3423318 - RNA, 19 nt, Human
accuuggacauccuccucc

SEQ ID NO: 3423319 - RNA, 14 nt, Human
accuuggcaccaga

SEQ ID NO: 3423320 - RNA, 16 nt, Human
accuuggcaccagaca

SEQ ID NO: 3423321 - RNA, 18 nt, Human
accuuggcaccagacacc

SEQ ID NO: 3423322 - RNA, 16 nt, Human
accuuggccugggccg

SEQ ID NO: 3423323 - RNA, 17 nt, Human
accuuggcuuggcccug

SEQ ID NO: 3423324 - RNA, 17 nt, Human
accuuggguuagaccua

SEQ ID NO: 3423325 - RNA, 23 nt, Human
accuugguguaguugaacugaua

SEQ ID NO: 3423326 - RNA, 13 nt, Human
accuugguuccug

SEQ ID NO: 3423327 - RNA, 12 nt, Human
accuuguaaaag

SEQ ID NO: 3423328 - RNA, 15 nt, Human
accuuguaaaagaca

SEQ ID NO: 3423329 - RNA, 14 nt, Human
accuuguaauguaa

SEQ ID NO: 3423330 - RNA, 18 nt, Human
accuugucauuuuggucu

SEQ ID NO: 3423331 - RNA, 14 nt, Human
accuugugccuggc

SEQ ID NO: 3423332 - RNA, 20 nt, Human
accuuguggcaagccccugc

SEQ ID NO: 3423333 - RNA, 12 nt, Human
accuugugucug

SEQ ID NO: 3423334 - RNA, 21 nt, Human
accuugugucuguacacgugu

SEQ ID NO: 3423335 - RNA, 16 nt, Human
accuuguuacuucuga

SEQ ID NO: 3423336 - RNA, 21 nt, Human
accuuguucacacucucacau

SEQ ID NO: 3423337 - RNA, 22 nt, Human
accuuguugcaugauguauuuu

SEQ ID NO: 3423338 - RNA, 16 nt, Human
accuuguuggagccug

SEQ ID NO: 3423339 - RNA, 18 nt, Human
accuuguuggagccugca

SEQ ID NO: 3423340 - RNA, 19 nt, Human
accuuguuggagccugcag

SEQ ID NO: 3423341 - RNA, 13 nt, Human
accuuuacuuuag

SEQ ID NO: 3423342 - RNA, 15 nt, Human
accuuuauuaaaauc

SEQ ID NO: 3423343 - RNA, 18 nt, Human
accuuuauuaaaaucuua

SEQ ID NO: 3423344 - RNA, 14 nt, Human
accuuuauucuuuu

SEQ ID NO: 3423345 - RNA, 17 nt, Human
accuuuauuuuagaauu

SEQ ID NO: 3423346 - RNA, 14 nt, Human
accuuucaaagcuu

SEQ ID NO: 3423347 - RNA, 17 nt, Human
accuuucaaauuucaca

SEQ ID NO: 3423348 - RNA, 23 nt, Human
accuuucaauaggaaaaacugau

SEQ ID NO: 3423349 - RNA, 15 nt, Human
accuuucacauagag

SEQ ID NO: 3423350 - RNA, 18 nt, Human
accuuucaccuuugugua

SEQ ID NO: 3423351 - RNA, 17 nt, Human
accuuucagcugugaac

SEQ ID NO: 3423352 - RNA, 11 nt, Human
accuuucauac

SEQ ID NO: 3423353 - RNA, 18 nt, Human
accuuucccucacccccu

SEQ ID NO: 3423354 - RNA, 19 nt, Human
accuuucccucacccccuc

SEQ ID NO: 3423355 - RNA, 15 nt, Human
accuuucuaguugaa

SEQ ID NO: 3423356 - RNA, 13 nt, Human
accuuucucucuc

SEQ ID NO: 3423357 - RNA, 20 nt, Human
accuuugaguagauccauuu

SEQ ID NO: 3423358 - RNA, 23 nt, Human
accuuugcacaggaugcuggccu

SEQ ID NO: 3423359 - RNA, 18 nt, Human
accuuuggagcaaagcug

SEQ ID NO: 3423360 - RNA, 15 nt, Human
accuuuggcuuaauu

SEQ ID NO: 3423361 - RNA, 18 nt, Human
accuuuggcuuaauucca

SEQ ID NO: 3423362 - RNA, 17 nt, Human
accuuuguacagcccag

SEQ ID NO: 3423363 - RNA, 17 nt, Human
accuuuguccccaccgc

SEQ ID NO: 3423364 - RNA, 13 nt, Human
accuuugugcccu

SEQ ID NO: 3423365 - RNA, 18 nt, Human
accuuugugcccuaucac

SEQ ID NO: 3423366 - RNA, 19 nt, Human
accuuuuaaaguguuucag

SEQ ID NO: 3423367 - RNA, 20 nt, Human
accuuuuaaauccuguugaa

SEQ ID NO: 3423368 - RNA, 12 nt, Human
accuuuuaacac

SEQ ID NO: 3423369 - RNA, 21 nt, Human
accuuuuaacaccugaugugu

SEQ ID NO: 3423370 - RNA, 14 nt, Human
accuuuuaacucac

SEQ ID NO: 3423371 - RNA, 11 nt, Human
accuuuuacug

SEQ ID NO: 3423372 - RNA, 13 nt, Human
accuuuuacugug

SEQ ID NO: 3423373 - RNA, 15 nt, Human
accuuuuauccacuu

SEQ ID NO: 3423374 - RNA, 20 nt, Human
accuuuuauguaguaauuga

SEQ ID NO: 3423375 - RNA, 14 nt, Human
accuuuuauuacau

SEQ ID NO: 3423376 - RNA, 18 nt, Human
agacaauaugugagugcc

SEQ ID NO: 3423377 - RNA, 19 nt, Human
agacaaucauguacagaaa

SEQ ID NO: 3423378 - RNA, 13 nt, Human
agacaaucuucug

SEQ ID NO: 3423379 - RNA, 13 nt, Human
agacaaugacuua

SEQ ID NO: 3423380 - RNA, 17 nt, Human
agacaaugacuuacugu

SEQ ID NO: 3423381 - RNA, 19 nt, Human
agacaaugacuuacuguac

SEQ ID NO: 3423382 - RNA, 20 nt, Human
agacaaugcaccuagcugug

SEQ ID NO: 3423383 - RNA, 16 nt, Human
agacaaugcagaugcc

SEQ ID NO: 3423384 - RNA, 22 nt, Human
agacaaugcagaugccagagca

SEQ ID NO: 3423385 - RNA, 20 nt, Human
agagaagucacagggcagua

SEQ ID NO: 3423386 - RNA, 14 nt, Human
agagaagugacagg

SEQ ID NO: 3423387 - RNA, 20 nt, Human
agagaagugacagggaagcu

SEQ ID NO: 3423388 - RNA, 17 nt, Human
agagaagugccccugcu

SEQ ID NO: 3423389 - RNA, 15 nt, Human
agagaauaugucugc

SEQ ID NO: 3423390 - RNA, 20 nt, Human
agagaaucaacauuucucaa

SEQ ID NO: 3423391 - RNA, 15 nt, Human
agagaaucauacuua

SEQ ID NO: 3423392 - RNA, 23 nt, Human
agagaaucccuagucuucaagca

SEQ ID NO: 3423393 - RNA, 10 nt, Human
agagaaugag

SEQ ID NO: 3423394 - RNA, 17 nt, Human
agagaauggaaaacaga

SEQ ID NO: 3423395 - RNA, 16 nt, Human
agagaaugucugaucu

SEQ ID NO: 3423396 - RNA, 13 nt, Human
agagaauguuaua

SEQ ID NO: 3423397 - RNA, 21 nt, Human
agagaauguuauagugaauua

SEQ ID NO: 3423398 - RNA, 12 nt, Human
agagaauuggcu

SEQ ID NO: 3423399 - RNA, 14 nt, Human
agagaauuggcuca

SEQ ID NO: 3423400 - RNA, 19 nt, Human
agagaauuguuugaacccg

SEQ ID NO: 3423401 - RNA, 22 nt, Human
agagaauuucuaccauuucaga

SEQ ID NO: 3423402 - RNA, 20 nt, Human
agagacaaacaccucccagg

SEQ ID NO: 3423403 - RNA, 20 nt, Human
agagacaaacuguaaaaaau

SEQ ID NO: 3423404 - RNA, 15 nt, Human
agagacaaguaauuu

SEQ ID NO: 3423405 - RNA, 20 nt, Human
agagacaaguaauuucagug

SEQ ID NO: 3423406 - RNA, 16 nt, Human
agagacacaagccuuc

SEQ ID NO: 3423407 - RNA, 13 nt, Human
agagacaccugca

SEQ ID NO: 3423408 - RNA, 14 nt, Human
agagacaccugcac

SEQ ID NO: 3423409 - RNA, 18 nt, Human
agagacaccugcaccucc

SEQ ID NO: 3423410 - RNA, 22 nt, Human
agagacaccugcaccucccccc

SEQ ID NO: 3423411 - RNA, 22 nt, Human
agagacacuguugauaaaaacu

SEQ ID NO: 3423412 - RNA, 21 nt, Human
agagacagaaagcagaacagu

SEQ ID NO: 3423413 - RNA, 14 nt, Human
agagacagaagcag

SEQ ID NO: 3423414 - RNA, 15 nt, Human
agagacagaagcagg

SEQ ID NO: 3423415 - RNA, 19 nt, Human
agagacagacuugagaacu

SEQ ID NO: 3423416 - RNA, 23 nt, Human
agagacagauaccuccaacccug

SEQ ID NO: 3423417 - RNA, 14 nt, Human
agagacaggagggc

SEQ ID NO: 3423418 - RNA, 12 nt, Human
agagacaggcag

SEQ ID NO: 3423419 - RNA, 22 nt, Human
agagacaggcaggugaucugcu

SEQ ID NO: 3423420 - RNA, 13 nt, Human
agagacaucagcc

SEQ ID NO: 3423421 - RNA, 23 nt, Human
agagacauuaacucauuagacug

SEQ ID NO: 3423422 - RNA, 19 nt, Human
agagaccacccauaucaug

SEQ ID NO: 3423423 - RNA, 19 nt, Human
agagaccagggcuccagcc

SEQ ID NO: 3423424 - RNA, 21 nt, Human
agagaccaucccugaaggccc

SEQ ID NO: 3423425 - RNA, 21 nt, Human
agagacccaaggaggaaaaac

SEQ ID NO: 3423426 - RNA, 17 nt, Human
acuacaaagguuuaaau

SEQ ID NO: 3423427 - RNA, 20 nt, Human
acuacaaagguuuaaaugaa

SEQ ID NO: 3423428 - RNA, 11 nt, Human
acuacaaauca

SEQ ID NO: 3423429 - RNA, 16 nt, Human
acuacaaccaauggaa

SEQ ID NO: 3423430 - RNA, 16 nt, Human
acuacaauauguacau

SEQ ID NO: 3423431 - RNA, 20 nt, Human
acuacaauauguacauuucu

SEQ ID NO: 3423432 - RNA, 17 nt, Human
acuacaauuuaaagcaa

SEQ ID NO: 3423433 - RNA, 22 nt, Human
acuacaauuuaaagcaaaggag

SEQ ID NO: 3423434 - RNA, 20 nt, Human
acuacacaucccuaaugugu

SEQ ID NO: 3423435 - RNA, 15 nt, Human
acuacacauucaaua

SEQ ID NO: 3423436 - RNA, 18 nt, Human
acuacacauuuuuaaauu

SEQ ID NO: 3423437 - RNA, 15 nt, Human
acuacaccacacaca

SEQ ID NO: 3423438 - RNA, 23 nt, Human
acuacaccauguuugagcucaga

SEQ ID NO: 3423439 - RNA, 14 nt, Human
acuacaccuggcug

SEQ ID NO: 3423440 - RNA, 15 nt, Human
acuacacuccagccu

SEQ ID NO: 3423441 - RNA, 19 nt, Human
acuacacuccagccugagc

SEQ ID NO: 3423442 - RNA, 18 nt, Human
acuacagacauuaaauaa

SEQ ID NO: 3423443 - RNA, 16 nt, Human
acuacagaccugcuuu

SEQ ID NO: 3423444 - RNA, 18 nt, Human
acuacagaccugcuuuuu

SEQ ID NO: 3423445 - RNA, 19 nt, Human
acuacagcuggggugcagg

SEQ ID NO: 3423446 - RNA, 21 nt, Human
acuacagcuggggugcaggga

SEQ ID NO: 3423447 - RNA, 11 nt, Human
acuacaggcac

SEQ ID NO: 3423448 - RNA, 15 nt, Human
acuacaggcacccac

SEQ ID NO: 3423449 - RNA, 18 nt, Human
acuacagggccgccggca

SEQ ID NO: 3423450 - RNA, 23 nt, Human
acuacaggugugagucaccaagc

SEQ ID NO: 3423451 - RNA, 16 nt, Human
acuacagucuaaagcu

SEQ ID NO: 3423452 - RNA, 15 nt, Human
acuacaguuuguuag

SEQ ID NO: 3423453 - RNA, 16 nt, Human
acuacauaaacugacu

SEQ ID NO: 3423454 - RNA, 17 nt, Human
acuacauaaacugacuu

SEQ ID NO: 3423455 - RNA, 17 nt, Human
acuacaucgcccuccac

SEQ ID NO: 3423456 - RNA, 18 nt, Human
acuacaugugguuuauag

SEQ ID NO: 3423457 - RNA, 18 nt, Human
acuacauuagguugugaa

SEQ ID NO: 3423458 - RNA, 19 nt, Human
acuacauuagguugugaau

SEQ ID NO: 3423459 - RNA, 13 nt, Human
acuacauucauuu

SEQ ID NO: 3423460 - RNA, 12 nt, Human
acuacauucugu

SEQ ID NO: 3423461 - RNA, 13 nt, Human
acuacauuuauga

SEQ ID NO: 3423462 - RNA, 15 nt, Human
acuacauuuuaacau

SEQ ID NO: 3423463 - RNA, 13 nt, Human
acuacauuuuuuc

SEQ ID NO: 3423464 - RNA, 21 nt, Human
acuaccaagaggcccugucug

SEQ ID NO: 3423465 - RNA, 15 nt, Human
acuacccauagacau

SEQ ID NO: 3423466 - RNA, 14 nt, Human
acuaccccuugauu

SEQ ID NO: 3423467 - RNA, 15 nt, Human
acuacccuuaauuac

SEQ ID NO: 3423468 - RNA, 23 nt, Human
acuaccgaaugugucuuuagaua

SEQ ID NO: 3423469 - RNA, 14 nt, Human
acuaccuccucagg

SEQ ID NO: 3423470 - RNA, 15 nt, Human
acuaccuccucaggg

SEQ ID NO: 3423471 - RNA, 14 nt, Human
acuaccuccucucc

SEQ ID NO: 3423472 - RNA, 17 nt, Human
acuaccuccucuccuga

SEQ ID NO: 3423473 - RNA, 23 nt, Human
acuaccuguauuuaaaaauagaa

SEQ ID NO: 3423474 - RNA, 12 nt, Human
acuaccugugua

SEQ ID NO: 3423475 - RNA, 15 nt, Human
acuaccuuaucacug

SEQ ID NO: 3423476 - RNA, 19 nt, Human
acuacuaauagaauaaagg

SEQ ID NO: 3423477 - RNA, 18 nt, Human
acuacucaaagcaaaagu

SEQ ID NO: 3423478 - RNA, 12 nt, Human
acuacucagcau

SEQ ID NO: 3423479 - RNA, 17 nt, Human
acuacucagcauggaaa

SEQ ID NO: 3423480 - RNA, 17 nt, Human
acuacucagggaaugaa

SEQ ID NO: 3423481 - RNA, 14 nt, Human
acuacucuuugauu

SEQ ID NO: 3423482 - RNA, 15 nt, Human
acuacucuuugauuu

SEQ ID NO: 3423483 - RNA, 18 nt, Human
acuacugacauguggggc

SEQ ID NO: 3423484 - RNA, 15 nt, Human
acuacugcagcaccu

SEQ ID NO: 3423485 - RNA, 21 nt, Human
acuacugccuuuagaaaauau

SEQ ID NO: 3423486 - RNA, 20 nt, Human
acuacugcuaccacaacuau

SEQ ID NO: 3423487 - RNA, 16 nt, Human
acuacugggugucauu

SEQ ID NO: 3423488 - RNA, 21 nt, Human
acuacuguggaaaaauauuua

SEQ ID NO: 3423489 - RNA, 17 nt, Human
acuacuuagcauccuaa

SEQ ID NO: 3423490 - RNA, 22 nt, Human
acuacuuagcauccuaagaaau

SEQ ID NO: 3423491 - RNA, 23 nt, Human
acuacuucuuuuuucaaaagaaa

SEQ ID NO: 3423492 - RNA, 19 nt, Human
acuacuugauggucagaca

SEQ ID NO: 3423493 - RNA, 21 nt, Human
acuacuugauggucagacaca

SEQ ID NO: 3423494 - RNA, 17 nt, Human
acuacuugggagcaccg

SEQ ID NO: 3423495 - RNA, 13 nt, Human
acuacuuugccuu

SEQ ID NO: 3423496 - RNA, 16 nt, Human
acuacuuugcugcuaa

SEQ ID NO: 3423497 - RNA, 18 nt, Human
acuagaaagugaauaaaa

SEQ ID NO: 3423498 - RNA, 19 nt, Human
acuagaaagugaauaaaaa

SEQ ID NO: 3423499 - RNA, 15 nt, Human
acuagaaaucugcca

SEQ ID NO: 3423500 - RNA, 23 nt, Human
acuagaaccuggagggcuagaac

SEQ ID NO: 3423501 - RNA, 16 nt, Human
acuagaacucuccauc

SEQ ID NO: 3423502 - RNA, 23 nt, Human
acuagaagggccaguccugccug

SEQ ID NO: 3423503 - RNA, 17 nt, Human
acuagaauucuagugcu

SEQ ID NO: 3423504 - RNA, 19 nt, Human
acuagaauucuagugcugc

SEQ ID NO: 3423505 - RNA, 20 nt, Human
acuagaauucuagugcugcu

SEQ ID NO: 3423506 - RNA, 23 nt, Human
acuagaauucuagugcugcugaa

SEQ ID NO: 3423507 - RNA, 17 nt, Human
acuagacaagccagaac

SEQ ID NO: 3423508 - RNA, 20 nt, Human
acuagacaccaaaguucuaa

SEQ ID NO: 3423509 - RNA, 16 nt, Human
acuagaccuccagcug

SEQ ID NO: 3423510 - RNA, 19 nt, Human
acuagacucccaagcugga

SEQ ID NO: 3423511 - RNA, 11 nt, Human
acuagacucuu

SEQ ID NO: 3423512 - RNA, 20 nt, Human
acuagacuugaggaaaccag

SEQ ID NO: 3423513 - RNA, 12 nt, Human
acuagagaaacc

SEQ ID NO: 3423514 - RNA, 19 nt, Human
acuagagcagcccuggagu

SEQ ID NO: 3423515 - RNA, 15 nt, Human
acuagagcuuucuuu

SEQ ID NO: 3423516 - RNA, 21 nt, Human
acuagaggaaaccaguuuggu

SEQ ID NO: 3423517 - RNA, 15 nt, Human
acuagaggcagggag

SEQ ID NO: 3423518 - RNA, 19 nt, Human
acuagagggaccucuccca

SEQ ID NO: 3423519 - RNA, 18 nt, Human
acuagaggugagaaauuu

SEQ ID NO: 3423520 - RNA, 20 nt, Human
acuagagucugaacagcugu

SEQ ID NO: 3423521 - RNA, 13 nt, Human
acuagaugaugga

SEQ ID NO: 3423522 - RNA, 13 nt, Human
acuagauuacauu

SEQ ID NO: 3423523 - RNA, 13 nt, Human
acuagcaaaauaa

SEQ ID NO: 3423524 - RNA, 17 nt, Human
acuagcauaucugccuu

SEQ ID NO: 3423525 - RNA, 16 nt, Human
acuagccaaaccucac

SEQ ID NO: 3423526 - RNA, 18 nt, Human
acuagccaaaccucacca

SEQ ID NO: 3423527 - RNA, 15 nt, Human
acuagcccaaugaaa

SEQ ID NO: 3423528 - RNA, 21 nt, Human
acuagccccuguggagacugg

SEQ ID NO: 3423529 - RNA, 18 nt, Human
acuagcccuccuuuuucc

SEQ ID NO: 3423530 - RNA, 20 nt, Human
agagauggccugagaagaga

SEQ ID NO: 3423531 - RNA, 23 nt, Human
agagauggcuuacaaaaagaaau

SEQ ID NO: 3423532 - RNA, 19 nt, Human
agagaugggaaugaggugg

SEQ ID NO: 3423533 - RNA, 16 nt, Human
agagaugggacuggga

SEQ ID NO: 3423534 - RNA, 15 nt, Human
agagaugggagcucc

SEQ ID NO: 3423535 - RNA, 17 nt, Human
agagaugggagcuccuc

SEQ ID NO: 3423536 - RNA, 24 nt, Human
agagaugggagcuccucuccugga

SEQ ID NO: 3423537 - RNA, 23 nt, Human
agagauguccauuuuuacaaguu

SEQ ID NO: 3423538 - RNA, 14 nt, Human
agagaugugcaccc

SEQ ID NO: 3423539 - RNA, 12 nt, Human
agagaugugugu

SEQ ID NO: 3423540 - RNA, 17 nt, Human
agagauguguguugaua

SEQ ID NO: 3423541 - RNA, 21 nt, Human
agagauguuuuuaaaaguuuc

SEQ ID NO: 3423542 - RNA, 19 nt, Human
agagauuaccuccugagaa

SEQ ID NO: 3423543 - RNA, 13 nt, Human
agagauugcuaau

SEQ ID NO: 3423544 - RNA, 21 nt, Human
agagauuggaaugggcagcuc

SEQ ID NO: 3423545 - RNA, 16 nt, Human
agagauuuaauuaauc

SEQ ID NO: 3423546 - RNA, 18 nt, Human
agagauuuauauaaaugu

SEQ ID NO: 3423547 - RNA, 21 nt, Human
agagauuuauauaaauguaaa

SEQ ID NO: 3423548 - RNA, 22 nt, Human
agagauuuggggcuaaagacug

SEQ ID NO: 3423549 - RNA, 14 nt, Human
agagcaaaauugau

SEQ ID NO: 3423550 - RNA, 14 nt, Human
agagcaaagugacc

SEQ ID NO: 3423551 - RNA, 24 nt, Human
agagcaaccccuggaccccagccu

SEQ ID NO: 3423552 - RNA, 18 nt, Human
agagcaagaccccaucuc

SEQ ID NO: 3423553 - RNA, 14 nt, Human
agagcaagacucug

SEQ ID NO: 3423554 - RNA, 21 nt, Human
agagcaagacucugucuaaaa

SEQ ID NO: 3423555 - RNA, 18 nt, Human
agagcaagcuuuuuuauu

SEQ ID NO: 3423556 - RNA, 14 nt, Human
agagcaagucugca

SEQ ID NO: 3423557 - RNA, 14 nt, Human
agagcaagucugga

SEQ ID NO: 3423558 - RNA, 13 nt, Human
agagcacaaacau

SEQ ID NO: 3423559 - RNA, 15 nt, Human
agagcacagcccucc

SEQ ID NO: 3423560 - RNA, 16 nt, Human
agagcaccccucucug

SEQ ID NO: 3423561 - RNA, 19 nt, Human
agagcaccuaguccaguga

SEQ ID NO: 3423562 - RNA, 14 nt, Human
agagcaccuuccuc

SEQ ID NO: 3423563 - RNA, 21 nt, Human
agagcaccuuccucacuucca

SEQ ID NO: 3423564 - RNA, 20 nt, Human
agagcacgccuguacuagag

SEQ ID NO: 3423565 - RNA, 12 nt, Human
agagcacugcca

SEQ ID NO: 3423566 - RNA, 12 nt, Human
agagcacugcuc

SEQ ID NO: 3423567 - RNA, 20 nt, Human
agagcacuggguugcagggg

SEQ ID NO: 3423568 - RNA, 17 nt, Human
agagcacuguauacccc

SEQ ID NO: 3423569 - RNA, 22 nt, Human
agagcacuuaagagaauauuuu

SEQ ID NO: 3423570 - RNA, 17 nt, Human
agagcagaaauucuguu

SEQ ID NO: 3423571 - RNA, 22 nt, Human
agagcagaaauucuguuuuuaa

SEQ ID NO: 3423572 - RNA, 20 nt, Human
agagcagaacggagccccag

SEQ ID NO: 3423573 - RNA, 17 nt, Human
agagcagacuacagcug

SEQ ID NO: 3423574 - RNA, 12 nt, Human
agagcagagacc

SEQ ID NO: 3423575 - RNA, 18 nt, Human
agagcagagaccaucccu

SEQ ID NO: 3423576 - RNA, 20 nt, Human
agagcagagaccaucccuga

SEQ ID NO: 3423577 - RNA, 12 nt, Human
agagcagcaagg

SEQ ID NO: 3423578 - RNA, 22 nt, Human
agagcagcaccuccucagccug

SEQ ID NO: 3423579 - RNA, 13 nt, Human
agagcagccagga

SEQ ID NO: 3423580 - RNA, 12 nt, Human
agagcagccugu

SEQ ID NO: 3423581 - RNA, 13 nt, Human
agagcagcuucug

SEQ ID NO: 3423582 - RNA, 20 nt, Human
agagcagcuuuaaacucagg

SEQ ID NO: 3423583 - RNA, 18 nt, Human
agagcaggaagcauucag

SEQ ID NO: 3423584 - RNA, 15 nt, Human
agagcaggacuccag

SEQ ID NO: 3423585 - RNA, 17 nt, Human
agagcaggacuccaggc

SEQ ID NO: 3423586 - RNA, 18 nt, Human
acuauauagagauguuuu

SEQ ID NO: 3423587 - RNA, 19 nt, Human
acuauauauauaugccuuu

SEQ ID NO: 3423588 - RNA, 13 nt, Human
acuauauauguga

SEQ ID NO: 3423589 - RNA, 19 nt, Human
acuauaucuguuuuacugc

SEQ ID NO: 3423590 - RNA, 13 nt, Human
acuauaugcaaac

SEQ ID NO: 3423591 - RNA, 13 nt, Human
acuauaugugaau

SEQ ID NO: 3423592 - RNA, 18 nt, Human
acuauauuaucaugcaaa

SEQ ID NO: 3423593 - RNA, 16 nt, Human
acuauauucuggccag

SEQ ID NO: 3423594 - RNA, 22 nt, Human
acuauauuugggccugcuccag

SEQ ID NO: 3423595 - RNA, 23 nt, Human
acuauauuugggccugcuccaga

SEQ ID NO: 3423596 - RNA, 15 nt, Human
acuauauuuugucau

SEQ ID NO: 3423597 - RNA, 16 nt, Human
acuauauuuugucaua

SEQ ID NO: 3423598 - RNA, 18 nt, Human
acuaucauaguuaacaua

SEQ ID NO: 3423599 - RNA, 22 nt, Human
acuaucaugucaaacgugaaaa

SEQ ID NO: 3423600 - RNA, 22 nt, Human
acuauccauaguggacauuguu

SEQ ID NO: 3423601 - RNA, 20 nt, Human
acuaucccaacagucauguu

SEQ ID NO: 3423602 - RNA, 16 nt, Human
acuaucccggcugccc

SEQ ID NO: 3423603 - RNA, 18 nt, Human
acuaucccggcugcccuu

SEQ ID NO: 3423604 - RNA, 17 nt, Human
acuaucuacucuccuca

SEQ ID NO: 3423605 - RNA, 19 nt, Human
acuaucuacucuccucauc

SEQ ID NO: 3423606 - RNA, 17 nt, Human
acuaucucauuuccaag

SEQ ID NO: 3423607 - RNA, 12 nt, Human
acuaucugggug

SEQ ID NO: 3423608 - RNA, 20 nt, Human
acuaucuuacuauuucacaa

SEQ ID NO: 3423609 - RNA, 16 nt, Human
acuaugaaaagcuaga

SEQ ID NO: 3423610 - RNA, 19 nt, Human
acuaugaaaagcuagaauu

SEQ ID NO: 3423611 - RNA, 22 nt, Human
acuaugaacugaaggcagcaug

SEQ ID NO: 3423612 - RNA, 23 nt, Human
acuaugaaugggcaaaacugaau

SEQ ID NO: 3423613 - RNA, 22 nt, Human
acuaugacauaaaaacaacuuu

SEQ ID NO: 3423614 - RNA, 15 nt, Human
acuaugacugcuccc

SEQ ID NO: 3423615 - RNA, 16 nt, Human
acuaugauuuggaaaa

SEQ ID NO: 3423616 - RNA, 16 nt, Human
acuaugcacaauuuaa

SEQ ID NO: 3423617 - RNA, 12 nt, Human
acuaugccugug

SEQ ID NO: 3423618 - RNA, 19 nt, Human
acuaugcguggcuggaacc

SEQ ID NO: 3423619 - RNA, 18 nt, Human
acuaugcguuuuuauaaa

SEQ ID NO: 3423620 - RNA, 20 nt, Human
acuauggaaaaucagcugcu

SEQ ID NO: 3423621 - RNA, 20 nt, Human
acuauggagugcaccaaaga

SEQ ID NO: 3423622 - RNA, 15 nt, Human
acuaugguauuugag

SEQ ID NO: 3423623 - RNA, 21 nt, Human
acuauggugccaauggaaccu

SEQ ID NO: 3423624 - RNA, 11 nt, Human
acuauguaaac

SEQ ID NO: 3423625 - RNA, 14 nt, Human
acuauguaacaugu

SEQ ID NO: 3423626 - RNA, 16 nt, Human
acuauguacaauauuu

SEQ ID NO: 3423627 - RNA, 18 nt, Human
acuauguacaauauuuua

SEQ ID NO: 3423628 - RNA, 12 nt, Human
acuauguaucaa

SEQ ID NO: 3423629 - RNA, 13 nt, Human
acuauguugauaa

SEQ ID NO: 3423630 - RNA, 14 nt, Human
acuauguugcccag

SEQ ID NO: 3423631 - RNA, 22 nt, Human
acuauguuuuaucguccaguga

SEQ ID NO: 3423632 - RNA, 21 nt, Human
acuauuaagaggcagaaaauu

SEQ ID NO: 3423633 - RNA, 17 nt, Human
acuauuauaauuuaaug

SEQ ID NO: 3423634 - RNA, 21 nt, Human
acuauuauguuguuagagaaa

SEQ ID NO: 3423635 - RNA, 22 nt, Human
acuauucaggagaguagaacag

SEQ ID NO: 3423636 - RNA, 14 nt, Human
acuauucaguugug

SEQ ID NO: 3423637 - RNA, 19 nt, Human
acuauucauuaaauguuug

SEQ ID NO: 3423638 - RNA, 21 nt, Human
acuauuccccagcagggucuu

SEQ ID NO: 3423639 - RNA, 16 nt, Human
acuauucgaaugaaaa

SEQ ID NO: 3423640 - RNA, 18 nt, Human
acuauucugagaugacua

SEQ ID NO: 3423641 - RNA, 19 nt, Human
acuauucugagaugacuau

SEQ ID NO: 3423642 - RNA, 15 nt, Human
acuauucugauuaca

SEQ ID NO: 3423643 - RNA, 21 nt, Human
acuauucugauuacacaaaac

SEQ ID NO: 3423644 - RNA, 22 nt, Human
acuauucuugauguaaaaucuu

SEQ ID NO: 3423645 - RNA, 18 nt, Human
acuauugaaguugcagau

SEQ ID NO: 3423646 - RNA, 14 nt, Human
acuauugagucuuc

SEQ ID NO: 3423647 - RNA, 15 nt, Human
acuauugcauuuaua

SEQ ID NO: 3423648 - RNA, 17 nt, Human
acuauugcuugcacaaa

SEQ ID NO: 3423649 - RNA, 19 nt, Human
acuauuggagggugggaga

SEQ ID NO: 3423650 - RNA, 14 nt, Human
acuauuuaacugac

SEQ ID NO: 3423651 - RNA, 16 nt, Human
acuauuuaacugacua

SEQ ID NO: 3423652 - RNA, 17 nt, Human
acuauuuaagaugugaa

SEQ ID NO: 3423653 - RNA, 18 nt, Human
acuauuuaagaugugaaa

SEQ ID NO: 3423654 - RNA, 20 nt, Human
acuauuuaagaugugaaaau

SEQ ID NO: 3423655 - RNA, 21 nt, Human
acuauuuaagaugugaaaauu

SEQ ID NO: 3423656 - RNA, 21 nt, Human
acuauuuaguuuuuguaauuu

SEQ ID NO: 3423657 - RNA, 23 nt, Human
acuauuuaguuuuuguaauuuau

SEQ ID NO: 3423658 - RNA, 18 nt, Human
acuauuugaugagucuua

SEQ ID NO: 3423659 - RNA, 13 nt, Human
acuauuuuaugca

SEQ ID NO: 3423660 - RNA, 19 nt, Human
acuauuuucagaaucugaa

SEQ ID NO: 3423661 - RNA, 12 nt, Human
acuauuuuuacu

SEQ ID NO: 3423662 - RNA, 21 nt, Human
acuauuuuuauuuuuaaauua

SEQ ID NO: 3423663 - RNA, 18 nt, Human
acuauuuuucagaaucuc

SEQ ID NO: 3423664 - RNA, 21 nt, Human
acuauuuuuguuuuuauuaaa

SEQ ID NO: 3423665 - RNA, 18 nt, Human
acucaaaagcugggcagg

SEQ ID NO: 3423666 - RNA, 15 nt, Human
acucaaaauauuugu

SEQ ID NO: 3423667 - RNA, 19 nt, Human
acucaaaauauuuguacau

SEQ ID NO: 3423668 - RNA, 13 nt, Human
acucaaacacaga

SEQ ID NO: 3423669 - RNA, 20 nt, Human
acucaaaccaaaucacugaa

SEQ ID NO: 3423670 - RNA, 17 nt, Human
acucaaacucuuaaaac

SEQ ID NO: 3423671 - RNA, 21 nt, Human
acucaaacugaggaauuucac

SEQ ID NO: 3423672 - RNA, 21 nt, Human
acucaaacugccuuggcuuca

SEQ ID NO: 3423673 - RNA, 22 nt, Human
acucaaacuucuggcucccucu

SEQ ID NO: 3423674 - RNA, 19 nt, Human
agagcgagagaucaaagau

SEQ ID NO: 3423675 - RNA, 18 nt, Human
agagcgccgugaguucuc

SEQ ID NO: 3423676 - RNA, 22 nt, Human
agagcgccgugaguucucaggg

SEQ ID NO: 3423677 - RNA, 15 nt, Human
agagcgccugccccu

SEQ ID NO: 3423678 - RNA, 20 nt, Human
agagcgcgccccuagccggu

SEQ ID NO: 3423679 - RNA, 19 nt, Human
agagcggaggcugugugcc

SEQ ID NO: 3423680 - RNA, 20 nt, Human
agagcguggcugugcucuca

SEQ ID NO: 3423681 - RNA, 23 nt, Human
agagcuaagggugggugcucaga

SEQ ID NO: 3423682 - RNA, 14 nt, Human
agagcuacguauuu

SEQ ID NO: 3423683 - RNA, 16 nt, Human
agagcuacguauuuaa

SEQ ID NO: 3423684 - RNA, 16 nt, Human
agagcuacuugggcca

SEQ ID NO: 3423685 - RNA, 17 nt, Human
agagcuagaacauggag

SEQ ID NO: 3423686 - RNA, 18 nt, Human
agagcuagaacauggaga

SEQ ID NO: 3423687 - RNA, 19 nt, Human
agagcuagaacauggagag

SEQ ID NO: 3423688 - RNA, 19 nt, Human
agagcuagaaccuggagag

SEQ ID NO: 3423689 - RNA, 18 nt, Human
agagcuagaaccuggagg

SEQ ID NO: 3423690 - RNA, 21 nt, Human
agagcuagcgcugccgcaccc

SEQ ID NO: 3423691 - RNA, 18 nt, Human
agagcuaggagcaaagcc

SEQ ID NO: 3423692 - RNA, 19 nt, Human
agagcuaggagcaaagccu

SEQ ID NO: 3423693 - RNA, 20 nt, Human
agagcuaggagcaaagccug

SEQ ID NO: 3423694 - RNA, 13 nt, Human
agagcuauacagu

SEQ ID NO: 3423695 - RNA, 19 nt, Human
agagcuauacaguuuuccu

SEQ ID NO: 3423696 - RNA, 14 nt, Human
agagcuauugccaa

SEQ ID NO: 3423697 - RNA, 21 nt, Human
agagcucaagggacaaggaca

SEQ ID NO: 3423698 - RNA, 10 nt, Human
agagcucagg

SEQ ID NO: 3423699 - RNA, 20 nt, Human
agagcuccccuacggaccag

SEQ ID NO: 3423700 - RNA, 20 nt, Human
agagcucccggcguggugga

SEQ ID NO: 3423701 - RNA, 23 nt, Human
agagcuccuccuugucuuggcag

SEQ ID NO: 3423702 - RNA, 22 nt, Human
agagcucucucuacagagagga

SEQ ID NO: 3423703 - RNA, 12 nt, Human
agagcugaacag

SEQ ID NO: 3423704 - RNA, 21 nt, Human
agagcugaagaguugccccgu

SEQ ID NO: 3423705 - RNA, 20 nt, Human
agagcugaagguuguggccu

SEQ ID NO: 3423706 - RNA, 23 nt, Human
agagcugacacaggaugaaggca

SEQ ID NO: 3423707 - RNA, 11 nt, Human
agagcugaggc

SEQ ID NO: 3423708 - RNA, 17 nt, Human
agagcugauccagagca

SEQ ID NO: 3423709 - RNA, 18 nt, Human
agagcugauccagagcac

SEQ ID NO: 3423710 - RNA, 21 nt, Human
agagcugauccagagcacaga

SEQ ID NO: 3423711 - RNA, 17 nt, Human
agagcugauggagaagg

SEQ ID NO: 3423712 - RNA, 18 nt, Human
agagcugccaccugccug

SEQ ID NO: 3423713 - RNA, 16 nt, Human
agagcugccaucgcug

SEQ ID NO: 3423714 - RNA, 21 nt, Human
agagcugcccuccuuguccac

SEQ ID NO: 3423715 - RNA, 13 nt, Human
agagcugcccucu

SEQ ID NO: 3423716 - RNA, 23 nt, Human
agagcugcucuggaaaaugugac

SEQ ID NO: 3423717 - RNA, 22 nt, Human
agagcuggagaugaggccagac

SEQ ID NO: 3423718 - RNA, 12 nt, Human
agagcuggagcc

SEQ ID NO: 3423719 - RNA, 19 nt, Human
agagcuggagccuggugcc

SEQ ID NO: 3423720 - RNA, 12 nt, Human
agagcugggagg

SEQ ID NO: 3423721 - RNA, 15 nt, Human
agagcuggugcggcu

SEQ ID NO: 3423722 - RNA, 21 nt, Human
agagcuggugcggcuggccau

SEQ ID NO: 3423723 - RNA, 15 nt, Human
agagcuggugucuga

SEQ ID NO: 3423724 - RNA, 22 nt, Human
agagcugguugggaagacaugg

SEQ ID NO: 3423725 - RNA, 13 nt, Human
agagcuguacauu

SEQ ID NO: 3423726 - RNA, 14 nt, Human
agagcuguggagga

SEQ ID NO: 3423727 - RNA, 22 nt, Human
agagcugugggcaaaagagugu

SEQ ID NO: 3423728 - RNA, 19 nt, Human
agagcuguucacagccaga

SEQ ID NO: 3423729 - RNA, 15 nt, Human
agagcuuaacagugu

SEQ ID NO: 3423730 - RNA, 21 nt, Human
agagcuuaaugauaauauugu

SEQ ID NO: 3423731 - RNA, 12 nt, Human
agagcuuagaaa

SEQ ID NO: 3423732 - RNA, 18 nt, Human
agagcuuagccuggagca

SEQ ID NO: 3423733 - RNA, 14 nt, Human
agagcuuagggucu

SEQ ID NO: 3423734 - RNA, 13 nt, Human
agagcuucccuga

SEQ ID NO: 3423735 - RNA, 15 nt, Human
agagcuucuggcacu

SEQ ID NO: 3423736 - RNA, 20 nt, Human
agagcuucuguugcugccuc

SEQ ID NO: 3423737 - RNA, 15 nt, Human
agagcuuuuaaaaau

SEQ ID NO: 3423738 - RNA, 16 nt, Human
agagcuuuuaaaaaug

SEQ ID NO: 3423739 - RNA, 12 nt, Human
agaggaaaaccc

SEQ ID NO: 3423740 - RNA, 18 nt, Human
agaggaaaacccucaagg

SEQ ID NO: 3423741 - RNA, 21 nt, Human
agaggaaaaguaaggugcagu

SEQ ID NO: 3423742 - RNA, 20 nt, Human
agaggaaaaugaauaauaca

SEQ ID NO: 3423743 - RNA, 17 nt, Human
agaggaaaguacauuuu

SEQ ID NO: 3423744 - RNA, 14 nt, Human
acucaccaucugug

SEQ ID NO: 3423745 - RNA, 12 nt, Human
acucacccaagc

SEQ ID NO: 3423746 - RNA, 17 nt, Human
acucacccaugugccaa

SEQ ID NO: 3423747 - RNA, 18 nt, Human
acucacccaugugccaag

SEQ ID NO: 3423748 - RNA, 21 nt, Human
acucacccaugugccaaggug

SEQ ID NO: 3423749 - RNA, 12 nt, Human
acucaccccagc

SEQ ID NO: 3423750 - RNA, 17 nt, Human
acucaccccagccccaa

SEQ ID NO: 3423751 - RNA, 15 nt, Human
acucaccucugccuc

SEQ ID NO: 3423752 - RNA, 19 nt, Human
acucaccugccccucaacu

SEQ ID NO: 3423753 - RNA, 21 nt, Human
acucaccugccccucaacucu

SEQ ID NO: 3423754 - RNA, 23 nt, Human
acucaccuggggcugcuggccug

SEQ ID NO: 3423755 - RNA, 12 nt, Human
acucaccuucua

SEQ ID NO: 3423756 - RNA, 21 nt, Human
acucaccuugaacaccacgcu

SEQ ID NO: 3423757 - RNA, 15 nt, Human
acucacuaggccccc

SEQ ID NO: 3423758 - RNA, 16 nt, Human
acucacuccugagacc

SEQ ID NO: 3423759 - RNA, 21 nt, Human
acucacuccugagaccccugg

SEQ ID NO: 3423760 - RNA, 13 nt, Human
acucacucuaaag

SEQ ID NO: 3423761 - RNA, 13 nt, Human
acucacucugggc

SEQ ID NO: 3423762 - RNA, 14 nt, Human
acucacucugggcu

SEQ ID NO: 3423763 - RNA, 13 nt, Human
acucacugaagcc

SEQ ID NO: 3423764 - RNA, 18 nt, Human
acucacugaagccugcgu

SEQ ID NO: 3423765 - RNA, 14 nt, Human
acucacugucaaug

SEQ ID NO: 3423766 - RNA, 14 nt, Human
acucacuuuuccca

SEQ ID NO: 3423767 - RNA, 18 nt, Human
acucacuuuucccacucc

SEQ ID NO: 3423768 - RNA, 18 nt, Human
acucagaaacuccaugau

SEQ ID NO: 3423769 - RNA, 13 nt, Human
acucagaaagcca

SEQ ID NO: 3423770 - RNA, 14 nt, Human
acucagaagccuga

SEQ ID NO: 3423771 - RNA, 14 nt, Human
acucagaauauugc

SEQ ID NO: 3423772 - RNA, 17 nt, Human
acucagaauuauuuuua

SEQ ID NO: 3423773 - RNA, 18 nt, Human
acucagaauuauuuuuaa

SEQ ID NO: 3423774 - RNA, 15 nt, Human
acucagaccagagaa

SEQ ID NO: 3423775 - RNA, 21 nt, Human
acucagagaaaaaugcucccc

SEQ ID NO: 3423776 - RNA, 17 nt, Human
acucagagacaugcaga

SEQ ID NO: 3423777 - RNA, 20 nt, Human
acucagagacaugcagagau

SEQ ID NO: 3423778 - RNA, 14 nt, Human
acucagagcucucu

SEQ ID NO: 3423779 - RNA, 19 nt, Human
acucagauccagggacaga

SEQ ID NO: 3423780 - RNA, 17 nt, Human
acucagauccuccucau

SEQ ID NO: 3423781 - RNA, 16 nt, Human
acucagaucugucuga

SEQ ID NO: 3423782 - RNA, 22 nt, Human
acucagauggaaccgcaggaag

SEQ ID NO: 3423783 - RNA, 22 nt, Human
acucagaugucucuggcgugug

SEQ ID NO: 3423784 - RNA, 15 nt, Human
acucagcacaaggcc

SEQ ID NO: 3423785 - RNA, 21 nt, Human
acucagcaccacucaagacca

SEQ ID NO: 3423786 - RNA, 13 nt, Human
acucagcagcccu

SEQ ID NO: 3423787 - RNA, 14 nt, Human
acucagcagcccuc

SEQ ID NO: 3423788 - RNA, 18 nt, Human
acucagcagcccuccuca

SEQ ID NO: 3423789 - RNA, 21 nt, Human
acucagcagcccuccucaccc

SEQ ID NO: 3423790 - RNA, 11 nt, Human
acucagcaugg

SEQ ID NO: 3423791 - RNA, 14 nt, Human
acucagccaagcac

SEQ ID NO: 3423792 - RNA, 15 nt, Human
acucagccaagcaca

SEQ ID NO: 3423793 - RNA, 16 nt, Human
acucagccaagcacag

SEQ ID NO: 3423794 - RNA, 18 nt, Human
acucagccaagcacagug

SEQ ID NO: 3423795 - RNA, 18 nt, Human
acucagccacccugaguu

SEQ ID NO: 3423796 - RNA, 14 nt, Human
acucagccccuagg

SEQ ID NO: 3423797 - RNA, 16 nt, Human
acucagccccuaggag

SEQ ID NO: 3423798 - RNA, 21 nt, Human
acucagcccucauuggcucuu

SEQ ID NO: 3423799 - RNA, 15 nt, Human
acucagcccugggcc

SEQ ID NO: 3423800 - RNA, 16 nt, Human
acucagcccugggccc

SEQ ID NO: 3423801 - RNA, 22 nt, Human
acucagcccugggccccaccac

SEQ ID NO: 3423802 - RNA, 12 nt, Human
acucagccugca

SEQ ID NO: 3423803 - RNA, 15 nt, Human
acucagccugcaguu

SEQ ID NO: 3423804 - RNA, 16 nt, Human
acucagccugcaguua

SEQ ID NO: 3423805 - RNA, 17 nt, Human
acucagccugcaguuaa

SEQ ID NO: 3423806 - RNA, 14 nt, Human
acucagcuccccag

SEQ ID NO: 3423807 - RNA, 11 nt, Human
acucagcucug

SEQ ID NO: 3423808 - RNA, 19 nt, Human
acucagcucugacauucug

SEQ ID NO: 3423809 - RNA, 22 nt, Human
acucagcucuuggcuccacugg

SEQ ID NO: 3423810 - RNA, 17 nt, Human
acucagcuguccugcag

SEQ ID NO: 3423811 - RNA, 18 nt, Human
acucagcuguccugcagc

SEQ ID NO: 3423812 - RNA, 14 nt, Human
acucaggacuccag

SEQ ID NO: 3423813 - RNA, 16 nt, Human
acucaggagccuguga

SEQ ID NO: 3423814 - RNA, 13 nt, Human
acucaggaggcug

SEQ ID NO: 3423815 - RNA, 14 nt, Human
acucaggaggcuga

SEQ ID NO: 3423816 - RNA, 17 nt, Human
acucaggaggcugaggc

SEQ ID NO: 3423817 - RNA, 17 nt, Human
acucaggaugcccaggg

SEQ ID NO: 3423818 - RNA, 17 nt, Human
acucaggauuuaaaaac

SEQ ID NO: 3423819 - RNA, 23 nt, Human
acucaggccuccaucuucucaug

SEQ ID NO: 3423820 - RNA, 18 nt, Human
agaugcuccaagauucua

SEQ ID NO: 3423821 - RNA, 19 nt, Human
agaugcuccagcaacacag

SEQ ID NO: 3423822 - RNA, 13 nt, Human
agaugcuccaggg

SEQ ID NO: 3423823 - RNA, 23 nt, Human
agaugcugacuguacuccuccca

SEQ ID NO: 3423824 - RNA, 11 nt, Human
agaugcugaug

SEQ ID NO: 3423825 - RNA, 14 nt, Human
agaugcugauguuc

SEQ ID NO: 3423826 - RNA, 18 nt, Human
agaugcugauguucagug

SEQ ID NO: 3423827 - RNA, 20 nt, Human
agaugcugauguucagugua

SEQ ID NO: 3423828 - RNA, 11 nt, Human
agaugcuggag

SEQ ID NO: 3423829 - RNA, 16 nt, Human
agaugcuggagaagag

SEQ ID NO: 3423830 - RNA, 18 nt, Human
agaugcuggagaagagag

SEQ ID NO: 3423831 - RNA, 22 nt, Human
agaugcuguaacuuaaaauagg

SEQ ID NO: 3423832 - RNA, 16 nt, Human
agaugcugugagucuu

SEQ ID NO: 3423833 - RNA, 20 nt, Human
agaugcugugccccuggccu

SEQ ID NO: 3423834 - RNA, 16 nt, Human
agaugcuguguauaug

SEQ ID NO: 3423835 - RNA, 18 nt, Human
agaugcuguguauauggu

SEQ ID NO: 3423836 - RNA, 18 nt, Human
agaugcuucucacugcca

SEQ ID NO: 3423837 - RNA, 12 nt, Human
agaugcuucugg

SEQ ID NO: 3423838 - RNA, 15 nt, Human
agaugcuucugggag

SEQ ID NO: 3423839 - RNA, 16 nt, Human
agaugcuuuucugucu

SEQ ID NO: 3423840 - RNA, 19 nt, Human
agaugcuuuucugucucug

SEQ ID NO: 3423841 - RNA, 17 nt, Human
agauggaaaaacuugug

SEQ ID NO: 3423842 - RNA, 12 nt, Human
agauggaagcuu

SEQ ID NO: 3423843 - RNA, 23 nt, Human
agauggaaguugcagugagcuga

SEQ ID NO: 3423844 - RNA, 12 nt, Human
agauggacacac

SEQ ID NO: 3423845 - RNA, 13 nt, Human
agauggaguuucu

SEQ ID NO: 3423846 - RNA, 17 nt, Human
agauggauucucagaua

SEQ ID NO: 3423847 - RNA, 18 nt, Human
agauggauucuccacuca

SEQ ID NO: 3423848 - RNA, 22 nt, Human
agauggcacagggcaugaaaug

SEQ ID NO: 3423849 - RNA, 21 nt, Human
agauggcauaaccugucucac

SEQ ID NO: 3423850 - RNA, 17 nt, Human
agauggcauccugugaa

SEQ ID NO: 3423851 - RNA, 20 nt, Human
agauggccagccccuuagac

SEQ ID NO: 3423852 - RNA, 15 nt, Human
agauggcccucuggu

SEQ ID NO: 3423853 - RNA, 19 nt, Human
agauggccugagaagagag

SEQ ID NO: 3423854 - RNA, 17 nt, Human
agauggcucccaggggc

SEQ ID NO: 3423855 - RNA, 22 nt, Human
agauggcugacuuugcucuuuc

SEQ ID NO: 3423856 - RNA, 14 nt, Human
agauggcugugccu

SEQ ID NO: 3423857 - RNA, 19 nt, Human
agauggcugugccucugcc

SEQ ID NO: 3423858 - RNA, 20 nt, Human
agauggcugugccucugccu

SEQ ID NO: 3423859 - RNA, 21 nt, Human
agauggcugugccucugccug

SEQ ID NO: 3423860 - RNA, 22 nt, Human
agauggcugugccucugccugu

SEQ ID NO: 3423861 - RNA, 23 nt, Human
agauggcugugccucugccuguc

SEQ ID NO: 3423862 - RNA, 14 nt, Human
agaugggaaugaag

SEQ ID NO: 3423863 - RNA, 15 nt, Human
agaugggaaugaagc

SEQ ID NO: 3423864 - RNA, 16 nt, Human
agaugggaaugaagcu

SEQ ID NO: 3423865 - RNA, 18 nt, Human
agaugggaaugagguggg

SEQ ID NO: 3423866 - RNA, 19 nt, Human
agaugggacugggagggcc

SEQ ID NO: 3423867 - RNA, 20 nt, Human
agaugggaggaaagagagca

SEQ ID NO: 3423868 - RNA, 22 nt, Human
agaugggcauggggugggccuc

SEQ ID NO: 3423869 - RNA, 16 nt, Human
agaugggcuuguuuuc

SEQ ID NO: 3423870 - RNA, 17 nt, Human
agaugggcuuguuuucu

SEQ ID NO: 3423871 - RNA, 17 nt, Human
agauggggauaaaauga

SEQ ID NO: 3423872 - RNA, 15 nt, Human
agauggggccucugu

SEQ ID NO: 3423873 - RNA, 15 nt, Human
agaugggggaaagca

SEQ ID NO: 3423874 - RNA, 16 nt, Human
agaugggggaaagcaa

SEQ ID NO: 3423875 - RNA, 15 nt, Human
agaugggggcaagaa

SEQ ID NO: 3423876 - RNA, 22 nt, Human
agaugggggcagggcugugcuu

SEQ ID NO: 3423877 - RNA, 19 nt, Human
agauggggucuguaaaauc

SEQ ID NO: 3423878 - RNA, 17 nt, Human
agaugggucuggcugag

SEQ ID NO: 3423879 - RNA, 21 nt, Human
agauggucacgcaccugggug

SEQ ID NO: 3423880 - RNA, 15 nt, Human
agauggucauccaga

SEQ ID NO: 3423881 - RNA, 11 nt, Human
agaugguggau

SEQ ID NO: 3423882 - RNA, 12 nt, Human
agauggugggau

SEQ ID NO: 3423883 - RNA, 22 nt, Human
agaugguguggguguccugccu

SEQ ID NO: 3423884 - RNA, 15 nt, Human
agaugguuaaacauu

SEQ ID NO: 3423885 - RNA, 14 nt, Human
agaugguucuagca

SEQ ID NO: 3423886 - RNA, 17 nt, Human
agaugguuuccacauuu

SEQ ID NO: 3423887 - RNA, 17 nt, Human
agauguaaaagguauua

SEQ ID NO: 3423888 - RNA, 20 nt, Human
agauguaagagcuuuacaaa

SEQ ID NO: 3423889 - RNA, 22 nt, Human
agauguaauuguuugucuuuaa

SEQ ID NO: 3423890 - RNA, 17 nt, Human
agauguaauuuugugua

SEQ ID NO: 3423891 - RNA, 19 nt, Human
agauguagauaaacucaga

SEQ ID NO: 3423892 - RNA, 22 nt, Human
agauguagccccucuccuggaa

SEQ ID NO: 3423893 - RNA, 17 nt, Human
agauguaugaaggcuuu

SEQ ID NO: 3423894 - RNA, 13 nt, Human
agauguaugcaca

SEQ ID NO: 3423895 - RNA, 18 nt, Human
agauguaugcacacacau

SEQ ID NO: 3423896 - RNA, 18 nt, Human
agaugucagccgagccgg

SEQ ID NO: 3423897 - RNA, 13 nt, Human
agaugucaucaga

SEQ ID NO: 3423898 - RNA, 23 nt, Human
agauguccaucagaugacaagaa

SEQ ID NO: 3423899 - RNA, 21 nt, Human
agaugucccuugaugcacaga

SEQ ID NO: 3423900 - RNA, 22 nt, Human
agaugucccuuucuuggccagu

SEQ ID NO: 3423901 - RNA, 18 nt, Human
agaugucuaauaguuauu

SEQ ID NO: 3423902 - RNA, 19 nt, Human
agaugucuucguacaguuc

SEQ ID NO: 3423903 - RNA, 18 nt, Human
agaugucuucugccuguu

SEQ ID NO: 3423904 - RNA, 21 nt, Human
agaugugaaaauaucugcuca

SEQ ID NO: 3423905 - RNA, 13 nt, Human
agaugugaaaauu

SEQ ID NO: 3423906 - RNA, 17 nt, Human
agaugugauaaggauca

SEQ ID NO: 3423907 - RNA, 18 nt, Human
agaugugauauucuaaga

SEQ ID NO: 3423908 - RNA, 19 nt, Human
agaugugauauucuaagac

SEQ ID NO: 3423909 - RNA, 13 nt, Human
agaugugcaccca

SEQ ID NO: 3423910 - RNA, 15 nt, Human
agaugugcagcagau

SEQ ID NO: 3423911 - RNA, 22 nt, Human
agaugugcagcagauuggaagg

SEQ ID NO: 3423912 - RNA, 19 nt, Human
agaugugcagcauuucacu

SEQ ID NO: 3423913 - RNA, 17 nt, Human
agauguggaaaagccaa

SEQ ID NO: 3423914 - RNA, 16 nt, Human
agauguggagccaggc

SEQ ID NO: 3423915 - RNA, 21 nt, Human
agaugugguugcauaagguuu

SEQ ID NO: 3423916 - RNA, 18 nt, Human
agauguguucacaaugga

SEQ ID NO: 3423917 - RNA, 23 nt, Human
agauguuacaaguuuauauauau

SEQ ID NO: 3423918 - RNA, 14 nt, Human
agauguucgguuuu

SEQ ID NO: 3423919 - RNA, 21 nt, Human
agauguucuaagucuuuccau

SEQ ID NO: 3423920 - RNA, 15 nt, Human
agauguucuacuuug

SEQ ID NO: 3423921 - RNA, 12 nt, Human
agauguucucua

SEQ ID NO: 3423922 - RNA, 17 nt, Human
agauguucucuaucauu

SEQ ID NO: 3423923 - RNA, 19 nt, Human
agauguucucuaucauuua

SEQ ID NO: 3423924 - RNA, 21 nt, Human
agauguugaagaauacaguua

SEQ ID NO: 3423925 - RNA, 16 nt, Human
agauguugauuuuuac

SEQ ID NO: 3423926 - RNA, 23 nt, Human
agauguugauuuuuacuguguuu

SEQ ID NO: 3423927 - RNA, 17 nt, Human
agauguugccauguguu

SEQ ID NO: 3423928 - RNA, 12 nt, Human
agauguugcuaa

SEQ ID NO: 3423929 - RNA, 17 nt, Human
agauguuugauagauuu

SEQ ID NO: 3423930 - RNA, 19 nt, Human
agauguuugucagauauga

SEQ ID NO: 3423931 - RNA, 23 nt, Human
agauguuuuagaguuaacaauga

SEQ ID NO: 3423932 - RNA, 22 nt, Human
agauguuuugguagauuaaaua

SEQ ID NO: 3423933 - RNA, 14 nt, Human
agauguuuuuaugu

SEQ ID NO: 3423934 - RNA, 16 nt, Human
agauuaaaaauuauag

SEQ ID NO: 3423935 - RNA, 16 nt, Human
agauuaaacuucauau

SEQ ID NO: 3423936 - RNA, 20 nt, Human
agauuaaccuucucuguccg

SEQ ID NO: 3423937 - RNA, 15 nt, Human
agauuaagagcaaau

SEQ ID NO: 3423938 - RNA, 17 nt, Human
agauuaauacucuauuu

SEQ ID NO: 3423939 - RNA, 17 nt, Human
agauuaauggcacugau

SEQ ID NO: 3423940 - RNA, 22 nt, Human
agauuacccaaaaacugucuuu

SEQ ID NO: 3423941 - RNA, 21 nt, Human
agauuacccccucauuguuua

SEQ ID NO: 3423942 - RNA, 19 nt, Human
agauuagaaaaauuccuaa

SEQ ID NO: 3423943 - RNA, 16 nt, Human
agauuagaauucugua

SEQ ID NO: 3423944 - RNA, 21 nt, Human
agauuagagaguguugaaacg

SEQ ID NO: 3423945 - RNA, 21 nt, Human
agauuagagccuguaaacuuu

SEQ ID NO: 3423946 - RNA, 14 nt, Human
agauuagcucugga

SEQ ID NO: 3423947 - RNA, 21 nt, Human
agaugcugauguucaguguaa

SEQ ID NO: 3423948 - RNA, 22 nt, Human
agaugcugauguucaguguaau

SEQ ID NO: 3423949 - RNA, 19 nt, Human
agaugcuggagaagagagg

SEQ ID NO: 3423950 - RNA, 20 nt, Human
agaugcuggagaagagagga

SEQ ID NO: 3423951 - RNA, 21 nt, Human
agaugcuggaugucugccaau

SEQ ID NO: 3423952 - RNA, 15 nt, Human
agaugcuggcccagg

SEQ ID NO: 3423953 - RNA, 19 nt, Human
agaugcuggcccagggccc

SEQ ID NO: 3423954 - RNA, 23 nt, Human
agaugcuggcccagggcccagag

SEQ ID NO: 3423955 - RNA, 18 nt, Human
agaugcuggcuugggcag

SEQ ID NO: 3423956 - RNA, 15 nt, Human
agaugcugguuuucu

SEQ ID NO: 3423957 - RNA, 20 nt, Human
agaugcuguaacuuaaaaua

SEQ ID NO: 3423958 - RNA, 20 nt, Human
agaugcugugagucuuuggu

SEQ ID NO: 3423959 - RNA, 19 nt, Human
agaugcuguguauauggua

SEQ ID NO: 3423960 - RNA, 16 nt, Human
agaugcuucugggaga

SEQ ID NO: 3423961 - RNA, 22 nt, Human
agaugcuugcggcaaaaggaaa

SEQ ID NO: 3423962 - RNA, 11 nt, Human
agaugcuuuua

SEQ ID NO: 3423963 - RNA, 20 nt, Human
agaugcuuuuaacagagucu

SEQ ID NO: 3423964 - RNA, 16 nt, Human
agauuauuuuauuaug

SEQ ID NO: 3423965 - RNA, 17 nt, Human
agauuauuuuggaaagu

SEQ ID NO: 3423966 - RNA, 19 nt, Human
agauucaaagguucuaggu

SEQ ID NO: 3423967 - RNA, 21 nt, Human
agauucaaagguucuagguuu

SEQ ID NO: 3423968 - RNA, 14 nt, Human
agauucaaggcccc

SEQ ID NO: 3423969 - RNA, 13 nt, Human
agauucacacugu

SEQ ID NO: 3423970 - RNA, 16 nt, Human
agauucaccuguaaaa

SEQ ID NO: 3423971 - RNA, 22 nt, Human
agauucauauuuacuucuuaua

SEQ ID NO: 3423972 - RNA, 20 nt, Human
agauucauuuuuaaucauga

SEQ ID NO: 3423973 - RNA, 18 nt, Human
agauuccagagaguggcu

SEQ ID NO: 3423974 - RNA, 19 nt, Human
agauuccauugguccaaga

SEQ ID NO: 3423975 - RNA, 21 nt, Human
agauuccauugguccaagauu

SEQ ID NO: 3423976 - RNA, 14 nt, Human
agauucccaggagu

SEQ ID NO: 3423977 - RNA, 15 nt, Human
agauucccaggaguu

SEQ ID NO: 3423978 - RNA, 17 nt, Human
agauucccaggaguucu

SEQ ID NO: 3423979 - RNA, 21 nt, Human
agauuccccauugccuccucc

SEQ ID NO: 3423980 - RNA, 22 nt, Human
agauuccccauugccuccuccu

SEQ ID NO: 3423981 - RNA, 24 nt, Human
agauuccccauugccuccuccuuc

SEQ ID NO: 3423982 - RNA, 20 nt, Human
agauuccggauccuaagcau

SEQ ID NO: 3423983 - RNA, 15 nt, Human
agauuccuucccaug

SEQ ID NO: 3423984 - RNA, 17 nt, Human
agauuccuucccaugga

SEQ ID NO: 3423985 - RNA, 13 nt, Human
agauucuaaagau

SEQ ID NO: 3423986 - RNA, 15 nt, Human
agauucuaaagauuc

SEQ ID NO: 3423987 - RNA, 18 nt, Human
agauucuaaagauucuau

SEQ ID NO: 3423988 - RNA, 21 nt, Human
agauucuaaagauucuauagu

SEQ ID NO: 3423989 - RNA, 12 nt, Human
agauucuaaagg

SEQ ID NO: 3423990 - RNA, 10 nt, Human
agauucuaac

SEQ ID NO: 3423991 - RNA, 12 nt, Human
agauucuagauc

SEQ ID NO: 3423992 - RNA, 14 nt, Human
agauucuagaucag

SEQ ID NO: 3423993 - RNA, 20 nt, Human
agauucuaggaccugugucc

SEQ ID NO: 3423994 - RNA, 19 nt, Human
agauucuauaguucuagac

SEQ ID NO: 3423995 - RNA, 15 nt, Human
agauucuccugugcu

SEQ ID NO: 3423996 - RNA, 17 nt, Human
agauucucugugucuaa

SEQ ID NO: 3423997 - RNA, 20 nt, Human
agauucucugugucuaagau

SEQ ID NO: 3423998 - RNA, 22 nt, Human
agauucucugugucuaagauuc

SEQ ID NO: 3423999 - RNA, 21 nt, Human
agauucugauuugccacugau

SEQ ID NO: 3424000 - RNA, 14 nt, Human
agauucugauuuua

SEQ ID NO: 3424001 - RNA, 21 nt, Human
agauucuggacagucagcucu

SEQ ID NO: 3424002 - RNA, 21 nt, Human
agauucuuuuaaauuagaaaa

SEQ ID NO: 3424003 - RNA, 13 nt, Human
agauucuuuuucu

SEQ ID NO: 3424004 - RNA, 19 nt, Human
agauugaaaacuuuucuca

SEQ ID NO: 3424005 - RNA, 20 nt, Human
agauugaaaacuuuucucag

SEQ ID NO: 3424006 - RNA, 16 nt, Human
agauugaaaaggaaga

SEQ ID NO: 3424007 - RNA, 19 nt, Human
agauugaaguaaacugcag

SEQ ID NO: 3424008 - RNA, 22 nt, Human
agauugaauauuuaucuagaga

SEQ ID NO: 3424009 - RNA, 17 nt, Human
agauugacuaacucaaa

SEQ ID NO: 3424010 - RNA, 19 nt, Human
agauugacuaacucaaaua

SEQ ID NO: 3424011 - RNA, 21 nt, Human
agauugacuaacucaaauaca

SEQ ID NO: 3424012 - RNA, 15 nt, Human
agauugagaaggaga

SEQ ID NO: 3424013 - RNA, 16 nt, Human
agauugagaaggagag

SEQ ID NO: 3424014 - RNA, 18 nt, Human
agauugagagaagagaca

SEQ ID NO: 3424015 - RNA, 13 nt, Human
agauugagagaau

SEQ ID NO: 3424016 - RNA, 17 nt, Human
agauugagauguguuca

SEQ ID NO: 3424017 - RNA, 13 nt, Human
agauugaggccug

SEQ ID NO: 3424018 - RNA, 19 nt, Human
agauugaggccugcccuca

SEQ ID NO: 3424019 - RNA, 23 nt, Human
agauugaguauaaaaacuugaaa

SEQ ID NO: 3424020 - RNA, 18 nt, Human
agauugauaucuauaaaa

SEQ ID NO: 3424021 - RNA, 19 nt, Human
agauugauaucuauaaaau

SEQ ID NO: 3424022 - RNA, 22 nt, Human
agauugauaucuauaaaauaga

SEQ ID NO: 3424023 - RNA, 16 nt, Human
agauugauuguauugu

SEQ ID NO: 3424024 - RNA, 16 nt, Human
agauugcaacaggcug

SEQ ID NO: 3424025 - RNA, 20 nt, Human
agauugcaacaggcugggcu

SEQ ID NO: 3424026 - RNA, 16 nt, Human
agauugcaccacugca

SEQ ID NO: 3424027 - RNA, 15 nt, Human
agauugcaugugacu

SEQ ID NO: 3424028 - RNA, 18 nt, Human
agauugcaugugacucug

SEQ ID NO: 3424029 - RNA, 19 nt, Human
agauugcaugugacucuga

SEQ ID NO: 3424030 - RNA, 13 nt, Human
agauugcuaauug

SEQ ID NO: 3424031 - RNA, 16 nt, Human
agauugcuaauugcug

SEQ ID NO: 3424032 - RNA, 18 nt, Human
agauugcuaauugcuguu

SEQ ID NO: 3424033 - RNA, 13 nt, Human
agauugcugaaau

SEQ ID NO: 3424034 - RNA, 14 nt, Human
agauugcugcuucu

SEQ ID NO: 3424035 - RNA, 14 nt, Human
agauugcuucugua

SEQ ID NO: 3424036 - RNA, 21 nt, Human
agauuggaaggagacacagau

SEQ ID NO: 3424037 - RNA, 23 nt, Human
agauuggagaaacccuugaaaag

SEQ ID NO: 3424038 - RNA, 17 nt, Human
agauuggaucaaguauu

SEQ ID NO: 3424039 - RNA, 23 nt, Human
agauuggauuuuauguugacauu

SEQ ID NO: 3424040 - RNA, 15 nt, Human
agauuggcauggcuu

SEQ ID NO: 3424041 - RNA, 14 nt, Human
agauuggcucacac

SEQ ID NO: 3424042 - RNA, 19 nt, Human
agauuggcucacacugaga

SEQ ID NO: 3424043 - RNA, 20 nt, Human
agauugguguuuuuuucuau

SEQ ID NO: 3424044 - RNA, 14 nt, Human
agauuguauugcug

SEQ ID NO: 3424045 - RNA, 15 nt, Human
agauuguauugcugu

SEQ ID NO: 3424046 - RNA, 20 nt, Human
agauugugccacugcucucc

SEQ ID NO: 3424047 - RNA, 15 nt, Human
agauuguguaacaau

SEQ ID NO: 3424048 - RNA, 15 nt, Human
agauuguuaaaauaa

SEQ ID NO: 3424049 - RNA, 16 nt, Human
agauuguuguuugcca

SEQ ID NO: 3424050 - RNA, 12 nt, Human
agauuguuugca

SEQ ID NO: 3424051 - RNA, 19 nt, Human
agauuuaaacucugaauuu

SEQ ID NO: 3424052 - RNA, 20 nt, Human
agauuuaaacucugaauuua

SEQ ID NO: 3424053 - RNA, 22 nt, Human
agauuuaauuaaucaugaaugu

SEQ ID NO: 3424054 - RNA, 14 nt, Human
agauuuaugcauau

SEQ ID NO: 3424055 - RNA, 16 nt, Human
agauuuauuaaagaaa

SEQ ID NO: 3424056 - RNA, 20 nt, Human
agauuuauuuuucaguucca

SEQ ID NO: 3424057 - RNA, 17 nt, Human
agauuucaagaaaaaau

SEQ ID NO: 3424058 - RNA, 19 nt, Human
agauuucaagaaaaaauaa

SEQ ID NO: 3424059 - RNA, 17 nt, Human
agauuucacucuccuug

SEQ ID NO: 3424060 - RNA, 15 nt, Human
agauuucauccagaa

SEQ ID NO: 3424061 - RNA, 22 nt, Human
agauuucauccagaagucaaca

SEQ ID NO: 3424062 - RNA, 13 nt, Human
agauuucaucugc

SEQ ID NO: 3424063 - RNA, 18 nt, Human
agauuucaucugcucucc

SEQ ID NO: 3424064 - RNA, 23 nt, Human
agauuuccagucuccaccaggaa

SEQ ID NO: 3424065 - RNA, 16 nt, Human
agauuuccuucuuuuu

SEQ ID NO: 3424066 - RNA, 16 nt, Human
agauuucuaaauaaaa

SEQ ID NO: 3424067 - RNA, 15 nt, Human
agauuucucuuugaa

SEQ ID NO: 3424068 - RNA, 22 nt, Human
agauuucuuaaauaaugcuuca

SEQ ID NO: 3424069 - RNA, 12 nt, Human
agauuugaccuc

SEQ ID NO: 3424070 - RNA, 15 nt, Human
agauuugcacaaaaa

SEQ ID NO: 3424071 - RNA, 17 nt, Human
agauuugcccauuuaca

SEQ ID NO: 3424072 - RNA, 20 nt, Human
agauuugcccauuuacacuu

SEQ ID NO: 3424073 - RNA, 13 nt, Human
agauuugugaacu

SEQ ID NO: 3424074 - RNA, 19 nt, Human
agauuugugugcaucaggc

SEQ ID NO: 3424075 - RNA, 13 nt, Human
agauuuguguuau

SEQ ID NO: 3424076 - RNA, 13 nt, Human
agauuuguuuugu

SEQ ID NO: 3424077 - RNA, 17 nt, Human
agauuuguuuuuaaacu

SEQ ID NO: 3424078 - RNA, 19 nt, Human
agauuuguuuuuaaacugu

SEQ ID NO: 3424079 - RNA, 23 nt, Human
agauuuguuuuuaaacuguacag

SEQ ID NO: 3424080 - RNA, 17 nt, Human
agauuuuaaaaagucuu

SEQ ID NO: 3424081 - RNA, 20 nt, Human
agauuuuaaaacuucaucug

SEQ ID NO: 3424082 - RNA, 13 nt, Human
agauuuuaaauuc

SEQ ID NO: 3424083 - RNA, 19 nt, Human
agauuuuaaauucacaaua

SEQ ID NO: 3424084 - RNA, 17 nt, Human
agauuuuacaaaagaug

SEQ ID NO: 3424085 - RNA, 18 nt, Human
agauuuuacaaaagaugu

SEQ ID NO: 3424086 - RNA, 20 nt, Human
agauuuuacaugaaguauuu

SEQ ID NO: 3424087 - RNA, 14 nt, Human
agauuuuagguguu

SEQ ID NO: 3424088 - RNA, 13 nt, Human
agauuuuaguuuu

SEQ ID NO: 3424089 - RNA, 14 nt, Human
agauuuuauagugu

SEQ ID NO: 3424090 - RNA, 14 nt, Human
agauuuuauuaugu

SEQ ID NO: 3424091 - RNA, 15 nt, Human
agauuuuauuaugua

SEQ ID NO: 3424092 - RNA, 22 nt, Human
agauuuuauuauguaaauccca

SEQ ID NO: 3424093 - RNA, 12 nt, Human
agauuuucagaa

SEQ ID NO: 3424094 - RNA, 23 nt, Human
agauuuuccacaagauucccaga

SEQ ID NO: 3424095 - RNA, 17 nt, Human
agauuuuccucuuguga

SEQ ID NO: 3424096 - RNA, 16 nt, Human
agauuuuccugaaaac

SEQ ID NO: 3424097 - RNA, 14 nt, Human
agauuuuccugugg

SEQ ID NO: 3424098 - RNA, 16 nt, Human
agauuuucugcuacuu

SEQ ID NO: 3424099 - RNA, 19 nt, Human
agauuuucugcuacuuugc

SEQ ID NO: 3424100 - RNA, 13 nt, Human
agauuuucuuuaa

SEQ ID NO: 3424101 - RNA, 17 nt, Human
agauuuucuuuaaaaga

SEQ ID NO: 3424102 - RNA, 13 nt, Human
agauuuugaaaac

SEQ ID NO: 3424103 - RNA, 21 nt, Human
agauuuugaaaacuacauuuu

SEQ ID NO: 3424104 - RNA, 23 nt, Human
agauuuugaaaacuacauuuuaa

SEQ ID NO: 3424105 - RNA, 12 nt, Human
agauuuugaaug

SEQ ID NO: 3424106 - RNA, 19 nt, Human
agauuaugagacacaggau

SEQ ID NO: 3424107 - RNA, 20 nt, Human
agauuauggagcuuuuuucc

SEQ ID NO: 3424108 - RNA, 14 nt, Human
agauucaaagguuc

SEQ ID NO: 3424109 - RNA, 18 nt, Human
agcagcaaggucuugcuc

SEQ ID NO: 3424110 - RNA, 23 nt, Human
agcagcaaggucuugcucuccua

SEQ ID NO: 3424111 - RNA, 20 nt, Human
agcagcaccuccucagccug

SEQ ID NO: 3424112 - RNA, 14 nt, Human
agcagcaccugccc

SEQ ID NO: 3424113 - RNA, 20 nt, Human
agcagcaccugcccuaccug

SEQ ID NO: 3424114 - RNA, 13 nt, Human
agcagcagcaggu

SEQ ID NO: 3424115 - RNA, 23 nt, Human
agcagcagugaaaacaagugcug

SEQ ID NO: 3424116 - RNA, 14 nt, Human
agcagcaucuucug

SEQ ID NO: 3424117 - RNA, 14 nt, Human
agcagcauuuuuau

SEQ ID NO: 3424118 - RNA, 20 nt, Human
agcagccaagcuccuuggga

SEQ ID NO: 3424119 - RNA, 22 nt, Human
agcagccaagcuccuugggagg

SEQ ID NO: 3424120 - RNA, 15 nt, Human
agcagccacauuccu

SEQ ID NO: 3424121 - RNA, 20 nt, Human
agcagccaccccaugcuggc

SEQ ID NO: 3424122 - RNA, 22 nt, Human
agcagccaccccaugcuggccu

SEQ ID NO: 3424123 - RNA, 10 nt, Human
agcagccacg

SEQ ID NO: 3424124 - RNA, 13 nt, Human
agcagccacgagg

SEQ ID NO: 3424125 - RNA, 21 nt, Human
agcagccagccaaacacacag

SEQ ID NO: 3424126 - RNA, 14 nt, Human
agcagccagcccug

SEQ ID NO: 3424127 - RNA, 22 nt, Human
agcagccagcccugccuggagg

SEQ ID NO: 3424128 - RNA, 15 nt, Human
agcagccagccguga

SEQ ID NO: 3424129 - RNA, 18 nt, Human
agcagcccaagcuucccu

SEQ ID NO: 3424130 - RNA, 14 nt, Human
agcagcccccagcu

SEQ ID NO: 3424131 - RNA, 14 nt, Human
agcagcccuccuca

SEQ ID NO: 3424132 - RNA, 17 nt, Human
agcagcccuccucaccc

SEQ ID NO: 3424133 - RNA, 23 nt, Human
agcagcccuccucaccccgucug

SEQ ID NO: 3424134 - RNA, 17 nt, Human
agcagcccugccccaca

SEQ ID NO: 3424135 - RNA, 16 nt, Human
agcagcccuggaguca

SEQ ID NO: 3424136 - RNA, 16 nt, Human
agcagcccuuggccag

SEQ ID NO: 3424137 - RNA, 20 nt, Human
agcagccucgccccuggcag

SEQ ID NO: 3424138 - RNA, 22 nt, Human
agcagccucgccccuggcagag

SEQ ID NO: 3424139 - RNA, 18 nt, Human
agcagccucuccccaggu

SEQ ID NO: 3424140 - RNA, 14 nt, Human
agcagccucugaag

SEQ ID NO: 3424141 - RNA, 13 nt, Human
agcagccugagca

SEQ ID NO: 3424142 - RNA, 22 nt, Human
agcagccugcuucccaccuccc

SEQ ID NO: 3424143 - RNA, 16 nt, Human
agcagccuggagcccu

SEQ ID NO: 3424144 - RNA, 13 nt, Human
agcagccuggcuc

SEQ ID NO: 3424145 - RNA, 15 nt, Human
agcagccuggcuccc

SEQ ID NO: 3424146 - RNA, 17 nt, Human
agcagccuggcuccccu

SEQ ID NO: 3424147 - RNA, 19 nt, Human
agcagccuggcuccccugg

SEQ ID NO: 3424148 - RNA, 21 nt, Human
agcagccuggcuccccugggg

SEQ ID NO: 3424149 - RNA, 22 nt, Human
agcagccuuucucucuuuauac

SEQ ID NO: 3424150 - RNA, 14 nt, Human
agcagcgagccugc

SEQ ID NO: 3424151 - RNA, 23 nt, Human
agcagcgguuuggggagcagaga

SEQ ID NO: 3424152 - RNA, 13 nt, Human
agcagcguuucua

SEQ ID NO: 3424153 - RNA, 18 nt, Human
agcagcuaaauuuucuga

SEQ ID NO: 3424154 - RNA, 18 nt, Human
agcagcugccaggagcac

SEQ ID NO: 3424155 - RNA, 22 nt, Human
agcagcugguaaucuugcucug

SEQ ID NO: 3424156 - RNA, 18 nt, Human
agcagcuuagacuaaggc

SEQ ID NO: 3424157 - RNA, 12 nt, Human
agcagcuuccag

SEQ ID NO: 3424158 - RNA, 14 nt, Human
agcagcuuccagau

SEQ ID NO: 3424159 - RNA, 17 nt, Human
agcagcuucugccacuu

SEQ ID NO: 3424160 - RNA, 21 nt, Human
agcagcuuuuuuuuccccccu

SEQ ID NO: 3424161 - RNA, 12 nt, Human
agcaggaagcuc

SEQ ID NO: 3424162 - RNA, 17 nt, Human
agcaggaaggccugggu

SEQ ID NO: 3424163 - RNA, 21 nt, Human
agcaggaauauaugugugccu

SEQ ID NO: 3424164 - RNA, 18 nt, Human
agcaggaccucccuuccg

SEQ ID NO: 3424165 - RNA, 14 nt, Human
agcaggacuccagg

SEQ ID NO: 3424166 - RNA, 23 nt, Human
agcaggacugaauuguccccagu

SEQ ID NO: 3424167 - RNA, 12 nt, Human
agcaggagacga

SEQ ID NO: 3424168 - RNA, 16 nt, Human
agcaggagaggagagc

SEQ ID NO: 3424169 - RNA, 17 nt, Human
agcaggagaggagagcc

SEQ ID NO: 3424170 - RNA, 21 nt, Human
agcaggagaggagagccagag

SEQ ID NO: 3424171 - RNA, 23 nt, Human
agcaggagaggagagccagagaa

SEQ ID NO: 3424172 - RNA, 19 nt, Human
agcaggagauugagaagga

SEQ ID NO: 3424173 - RNA, 21 nt, Human
agcaggagauugagaaggaga

SEQ ID NO: 3424174 - RNA, 23 nt, Human
agcaggaggccccuggcccagcg

SEQ ID NO: 3424175 - RNA, 21 nt, Human
agcaggaguggugcagacaga

SEQ ID NO: 3424176 - RNA, 16 nt, Human
agcaggcacauggagg

SEQ ID NO: 3424177 - RNA, 20 nt, Human
agcaggcacuugauuccuug

SEQ ID NO: 3424178 - RNA, 10 nt, Human
agcaggcagc

SEQ ID NO: 3424179 - RNA, 11 nt, Human
agcaggcagcc

SEQ ID NO: 3424180 - RNA, 12 nt, Human
agcaggcagcca

SEQ ID NO: 3424181 - RNA, 14 nt, Human
agcaggcagccagc

SEQ ID NO: 3424182 - RNA, 16 nt, Human
agcaggcagcgccaag

SEQ ID NO: 3424183 - RNA, 17 nt, Human
agcaggccaaggucuga

SEQ ID NO: 3424184 - RNA, 23 nt, Human
agcaggccacacuucaaacuacu

SEQ ID NO: 3424185 - RNA, 23 nt, Human
agcaggccagguccagagagacc

SEQ ID NO: 3424186 - RNA, 14 nt, Human
agcaggcccaccua

SEQ ID NO: 3424187 - RNA, 17 nt, Human
agcaggcccaccuaccu

SEQ ID NO: 3424188 - RNA, 16 nt, Human
agcaggccuguugcuu

SEQ ID NO: 3424189 - RNA, 19 nt, Human
agcaggcgugaccugccag

SEQ ID NO: 3424190 - RNA, 21 nt, Human
agcaggcguucagcucacugu

SEQ ID NO: 3424191 - RNA, 17 nt, Human
agcaggcuacugucagc

SEQ ID NO: 3424192 - RNA, 19 nt, Human
agcaggcuacugucagcuc

SEQ ID NO: 3424193 - RNA, 13 nt, Human
agcaggcucucag

SEQ ID NO: 3424194 - RNA, 15 nt, Human
agcaggcucucaggc

SEQ ID NO: 3424195 - RNA, 17 nt, Human
agcaggcucucaggcca

SEQ ID NO: 3424196 - RNA, 19 nt, Human
agcaggcucucaggccagc

SEQ ID NO: 3424197 - RNA, 20 nt, Human
agcaggcuggcagcucucca

SEQ ID NO: 3424198 - RNA, 22 nt, Human
agcaggcuggcagcucuccagu

SEQ ID NO: 3424199 - RNA, 16 nt, Human
agcagggaaggccuga

SEQ ID NO: 3424200 - RNA, 16 nt, Human
agcagggaauuucuau

SEQ ID NO: 3424201 - RNA, 11 nt, Human
agcagggagga

SEQ ID NO: 3424202 - RNA, 20 nt, Human
agcagggagggcuucugcca

SEQ ID NO: 3424203 - RNA, 20 nt, Human
agcagggauuaaccucugca

SEQ ID NO: 3424204 - RNA, 19 nt, Human
agcagggcauggcugggaa

SEQ ID NO: 3424205 - RNA, 22 nt, Human
agcagggccggggaacuggcca

SEQ ID NO: 3424206 - RNA, 23 nt, Human
agcagggcuacccugagcugagg

SEQ ID NO: 3424207 - RNA, 23 nt, Human
agcagggcucugccccagaggcc

SEQ ID NO: 3424208 - RNA, 16 nt, Human
agcagggcugcuguga

SEQ ID NO: 3424209 - RNA, 18 nt, Human
agcagggucgggaaaggc

SEQ ID NO: 3424210 - RNA, 17 nt, Human
agcagggucugggcagg

SEQ ID NO: 3424211 - RNA, 16 nt, Human
agcagggucuuuucau

SEQ ID NO: 3424212 - RNA, 14 nt, Human
agcagguaccacug

SEQ ID NO: 3424213 - RNA, 17 nt, Human
agcagguagccugcugg

SEQ ID NO: 3424214 - RNA, 18 nt, Human
agcagguagccugcuggu

SEQ ID NO: 3424215 - RNA, 19 nt, Human
agcaggugauuggaccagg

SEQ ID NO: 3424216 - RNA, 20 nt, Human
agcaggugauuggaccaggc

SEQ ID NO: 3424217 - RNA, 13 nt, Human
agcaggugcugac

SEQ ID NO: 3424218 - RNA, 13 nt, Human
agcaggugguccu

SEQ ID NO: 3424219 - RNA, 20 nt, Human
agcaggugguccugagaccu

SEQ ID NO: 3424220 - RNA, 20 nt, Human
agcagguuaaauguuuugua

SEQ ID NO: 3424221 - RNA, 17 nt, Human
agcagguucccaagcuc

SEQ ID NO: 3424222 - RNA, 21 nt, Human
agcaguaaaagaugaaguuuu

SEQ ID NO: 3424223 - RNA, 17 nt, Human
agcaguaaauuugcuag

SEQ ID NO: 3424224 - RNA, 17 nt, Human
agcaguaacugacaacu

SEQ ID NO: 3424225 - RNA, 17 nt, Human
agcaguaccagcgcucu

SEQ ID NO: 3424226 - RNA, 22 nt, Human
agcaguagaaauaauaugcauu

SEQ ID NO: 3424227 - RNA, 18 nt, Human
agcaguagacauuuuaac

SEQ ID NO: 3424228 - RNA, 14 nt, Human
agcaguauauguua

SEQ ID NO: 3424229 - RNA, 20 nt, Human
agcaguauauguuaauuugu

SEQ ID NO: 3424230 - RNA, 15 nt, Human
agcaguauauuagua

SEQ ID NO: 3424231 - RNA, 16 nt, Human
agcaguaucaugaagc

SEQ ID NO: 3424232 - RNA, 11 nt, Human
agcaguauuuu

SEQ ID NO: 3424233 - RNA, 17 nt, Human
agcagucaggaaagaga

SEQ ID NO: 3424234 - RNA, 18 nt, Human
agcagucaggaaagagaa

SEQ ID NO: 3424235 - RNA, 13 nt, Human
agcaguccaugca

SEQ ID NO: 3424236 - RNA, 18 nt, Human
agcaguccccuucccucc

SEQ ID NO: 3424237 - RNA, 22 nt, Human
agcaguccccuucccuccaaga

SEQ ID NO: 3424238 - RNA, 19 nt, Human
agcaguccugccucagccu

SEQ ID NO: 3424239 - RNA, 14 nt, Human
agcagucgugccug

SEQ ID NO: 3424240 - RNA, 16 nt, Human
agcagucgugccugug

SEQ ID NO: 3424241 - RNA, 21 nt, Human
agcagucgugccuguguccau

SEQ ID NO: 3424242 - RNA, 23 nt, Human
agcagucuacccaccucagccuc

SEQ ID NO: 3424243 - RNA, 13 nt, Human
agcagucugccug

SEQ ID NO: 3424244 - RNA, 23 nt, Human
agcagugauauucuuuguuaauu

SEQ ID NO: 3424245 - RNA, 15 nt, Human
agcagugcaggcaca

SEQ ID NO: 3424246 - RNA, 13 nt, Human
agcagugcccagg

SEQ ID NO: 3424247 - RNA, 14 nt, Human
agcagugcccaggu

SEQ ID NO: 3424248 - RNA, 17 nt, Human
agcagugccuuccauaa

SEQ ID NO: 3424249 - RNA, 12 nt, Human
agcagugcuuuu

SEQ ID NO: 3424250 - RNA, 22 nt, Human
agcaguggcaggcagaggccca

SEQ ID NO: 3424251 - RNA, 12 nt, Human
agcaguggccuu

SEQ ID NO: 3424252 - RNA, 12 nt, Human
agcaguggcugg

SEQ ID NO: 3424253 - RNA, 21 nt, Human
agcauugauauuugugcauuu

SEQ ID NO: 3424254 - RNA, 22 nt, Human
agcauugccauucccugccugg

SEQ ID NO: 3424255 - RNA, 13 nt, Human
agcauugccuggc

SEQ ID NO: 3424256 - RNA, 21 nt, Human
agcauugccuggccuuccugu

SEQ ID NO: 3424257 - RNA, 15 nt, Human
agcauugcugguucu

SEQ ID NO: 3424258 - RNA, 15 nt, Human
agcauugcuuucuga

SEQ ID NO: 3424259 - RNA, 16 nt, Human
agcauugcuuucugaa

SEQ ID NO: 3424260 - RNA, 23 nt, Human
agcauugcuuuuauuuugaaaag

SEQ ID NO: 3424261 - RNA, 20 nt, Human
agcauuggggauguuuuucu

SEQ ID NO: 3424262 - RNA, 16 nt, Human
agcauuguaaaauaau

SEQ ID NO: 3424263 - RNA, 22 nt, Human
agcauuguaaaauuauuucaug

SEQ ID NO: 3424264 - RNA, 18 nt, Human
agcauuguaaaugugcuu

SEQ ID NO: 3424265 - RNA, 15 nt, Human
agcauuguagugcuu

SEQ ID NO: 3424266 - RNA, 18 nt, Human
agcauuguagugcuuuga

SEQ ID NO: 3424267 - RNA, 13 nt, Human
agcauugugagua

SEQ ID NO: 3424268 - RNA, 20 nt, Human
agcauuguggcugucagcag

SEQ ID NO: 3424269 - RNA, 21 nt, Human
agcauuguuugcuuauuguuc

SEQ ID NO: 3424270 - RNA, 15 nt, Human
agcauuuacuuugaa

SEQ ID NO: 3424271 - RNA, 16 nt, Human
agcauuuagcuggcca

SEQ ID NO: 3424272 - RNA, 20 nt, Human
agcauuuaguccaaugucuu

SEQ ID NO: 3424273 - RNA, 12 nt, Human
agcauuuaucau

SEQ ID NO: 3424274 - RNA, 15 nt, Human
agcauuuaucauucu

SEQ ID NO: 3424275 - RNA, 13 nt, Human
agcauuucauucu

SEQ ID NO: 3424276 - RNA, 20 nt, Human
agcauuucauucuucucuag

SEQ ID NO: 3424277 - RNA, 21 nt, Human
agcauuuccaacaccacagac

SEQ ID NO: 3424278 - RNA, 23 nt, Human
agcauuuccaacaccacagacac

SEQ ID NO: 3424279 - RNA, 22 nt, Human
agcauuucugaaguggacucuu

SEQ ID NO: 3424280 - RNA, 11 nt, Human
agcauuugaau

SEQ ID NO: 3424281 - RNA, 14 nt, Human
agcauuugaaugca

SEQ ID NO: 3424282 - RNA, 16 nt, Human
agcauuugacuuucug

SEQ ID NO: 3424283 - RNA, 21 nt, Human
agcauuugacuuucugucugu

SEQ ID NO: 3424284 - RNA, 16 nt, Human
agcauuugauaaugau

SEQ ID NO: 3424285 - RNA, 14 nt, Human
agcauuuggugcuu

SEQ ID NO: 3424286 - RNA, 15 nt, Human
agcauuuggugcuug

SEQ ID NO: 3424287 - RNA, 13 nt, Human
agcauuuuaaaca

SEQ ID NO: 3424288 - RNA, 15 nt, Human
agcauuuuaaacaaa

SEQ ID NO: 3424289 - RNA, 17 nt, Human
agcauuuuaaacaaaau

SEQ ID NO: 3424290 - RNA, 20 nt, Human
agcauuuuaaacaaaauaga

SEQ ID NO: 3424291 - RNA, 12 nt, Human
agcauuuuccuc

SEQ ID NO: 3424292 - RNA, 18 nt, Human
agcauuuuccucugcuuu

SEQ ID NO: 3424293 - RNA, 22 nt, Human
agcauuuuccucugcuuugaaa

SEQ ID NO: 3424294 - RNA, 15 nt, Human
agcauuuucugcauc

SEQ ID NO: 3424295 - RNA, 15 nt, Human
agcauuuugcuaaau

SEQ ID NO: 3424296 - RNA, 17 nt, Human
agcauuuuguaaguuga

SEQ ID NO: 3424297 - RNA, 13 nt, Human
agcauuuuguaau

SEQ ID NO: 3424298 - RNA, 23 nt, Human
agcauuuuucaauauauugaacu

SEQ ID NO: 3424299 - RNA, 15 nt, Human
agcauuuuuuaaaaa

SEQ ID NO: 3424300 - RNA, 15 nt, Human
agcauuuuuuaaccu

SEQ ID NO: 3424301 - RNA, 17 nt, Human
agccaaaauguaggcuu

SEQ ID NO: 3424302 - RNA, 23 nt, Human
agccaaaaugugagugguugaau

SEQ ID NO: 3424303 - RNA, 15 nt, Human
agccaaacccugucu

SEQ ID NO: 3424304 - RNA, 16 nt, Human
agccaaacccugucug

SEQ ID NO: 3424305 - RNA, 13 nt, Human
agccaaacccuug

SEQ ID NO: 3424306 - RNA, 19 nt, Human
agccaaacccuugucagug

SEQ ID NO: 3424307 - RNA, 15 nt, Human
agccaaaccucacca

SEQ ID NO: 3424308 - RNA, 21 nt, Human
agccaaaccucaccaacuccu

SEQ ID NO: 3424309 - RNA, 14 nt, Human
agccaaacucugcc

SEQ ID NO: 3424310 - RNA, 17 nt, Human
agccaaagaaaugaaca

SEQ ID NO: 3424311 - RNA, 15 nt, Human
agccaaagauaaucu

SEQ ID NO: 3424312 - RNA, 12 nt, Human
agccaaagccaa

SEQ ID NO: 3424313 - RNA, 18 nt, Human
agccaaagcuaggccugg

SEQ ID NO: 3424314 - RNA, 20 nt, Human
agcagcuaccagguguucua

SEQ ID NO: 3424315 - RNA, 19 nt, Human
agcagcucaaaggcacagu

SEQ ID NO: 3424316 - RNA, 12 nt, Human
agcagcucaggc

SEQ ID NO: 3424317 - RNA, 14 nt, Human
agcagcucaggcac

SEQ ID NO: 3424318 - RNA, 21 nt, Human
agcagcucaggcacacuucuu

SEQ ID NO: 3424319 - RNA, 15 nt, Human
agcagcucuugcuaa

SEQ ID NO: 3424320 - RNA, 16 nt, Human
agcagcucuugcuaau

SEQ ID NO: 3424321 - RNA, 23 nt, Human
agcagcucuugcuaaucaguguc

SEQ ID NO: 3424322 - RNA, 19 nt, Human
agcagcugacuuucaaagu

SEQ ID NO: 3424323 - RNA, 11 nt, Human
agcagcugagc

SEQ ID NO: 3424324 - RNA, 13 nt, Human
agcagcugagcag

SEQ ID NO: 3424325 - RNA, 16 nt, Human
agcagcugagcagggc

SEQ ID NO: 3424326 - RNA, 19 nt, Human
agcagcugagcagggccgg

SEQ ID NO: 3424327 - RNA, 10 nt, Human
agcagcugga

SEQ ID NO: 3424328 - RNA, 14 nt, Human
agcagcuuauuguu

SEQ ID NO: 3424329 - RNA, 18 nt, Human
agcagcuucaccagagca

SEQ ID NO: 3424330 - RNA, 16 nt, Human
agcagcuucugccacu

SEQ ID NO: 3424331 - RNA, 15 nt, Human
agcaggaaaugaaaa

SEQ ID NO: 3424332 - RNA, 21 nt, Human
agcaggaaaugaaaaugucuu

SEQ ID NO: 3424333 - RNA, 23 nt, Human
agcaggaaaugaaaaugucuugu

SEQ ID NO: 3424334 - RNA, 21 nt, Human
agcaggaagcauucagagagc

SEQ ID NO: 3424335 - RNA, 14 nt, Human
agcaggaagcucag

SEQ ID NO: 3424336 - RNA, 15 nt, Human
agcaggaagcucaga

SEQ ID NO: 3424337 - RNA, 20 nt, Human
agcaggaauauaugugugcc

SEQ ID NO: 3424338 - RNA, 17 nt, Human
agcaggaaugggaagga

SEQ ID NO: 3424339 - RNA, 14 nt, Human
agcaggaccucccu

SEQ ID NO: 3424340 - RNA, 16 nt, Human
agcaggaccucccuuc

SEQ ID NO: 3424341 - RNA, 17 nt, Human
agcaggaccucccuucc

SEQ ID NO: 3424342 - RNA, 22 nt, Human
agcaggaccucugaaacccugg

SEQ ID NO: 3424343 - RNA, 22 nt, Human
agcaggacuccaggcccaaggc

SEQ ID NO: 3424344 - RNA, 22 nt, Human
agcaggacugaugucuccuaag

SEQ ID NO: 3424345 - RNA, 22 nt, Human
agcaggagaggagagccagaga

SEQ ID NO: 3424346 - RNA, 15 nt, Human
agcaggagauugaga

SEQ ID NO: 3424347 - RNA, 16 nt, Human
agcaggaggaggugcc

SEQ ID NO: 3424348 - RNA, 10 nt, Human
agcaggaggc

SEQ ID NO: 3424349 - RNA, 20 nt, Human
agcaggaggccccuggccca

SEQ ID NO: 3424350 - RNA, 15 nt, Human
agcaggaggcuggga

SEQ ID NO: 3424351 - RNA, 14 nt, Human
agcaggagggggga

SEQ ID NO: 3424352 - RNA, 16 nt, Human
agcaggaggggggagg

SEQ ID NO: 3424353 - RNA, 21 nt, Human
agcaggaggggggagggaagg

SEQ ID NO: 3424354 - RNA, 18 nt, Human
agcaggaguggugcagac

SEQ ID NO: 3424355 - RNA, 21 nt, Human
agcaggauaguugcuccgccu

SEQ ID NO: 3424356 - RNA, 19 nt, Human
agcaggcacgggugguccc

SEQ ID NO: 3424357 - RNA, 20 nt, Human
agcaggcacggguggucccc

SEQ ID NO: 3424358 - RNA, 16 nt, Human
agcaggccaaggucug

SEQ ID NO: 3424359 - RNA, 13 nt, Human
agcaggccacacu

SEQ ID NO: 3424360 - RNA, 24 nt, Human
agcaggccacacuucaaacuacuu

SEQ ID NO: 3424361 - RNA, 23 nt, Human
agcaggcccaccuaccuucaaag

SEQ ID NO: 3424362 - RNA, 15 nt, Human
agcaggccuguugcu

SEQ ID NO: 3424363 - RNA, 21 nt, Human
agcaggccuugcgcuguugcg

SEQ ID NO: 3424364 - RNA, 16 nt, Human
agcaggcuacacugac

SEQ ID NO: 3424365 - RNA, 14 nt, Human
agcaggcuacuguc

SEQ ID NO: 3424366 - RNA, 22 nt, Human
agcaggcucucaggccagcugc

SEQ ID NO: 3424367 - RNA, 23 nt, Human
agcaggcucucaggccagcugcu

SEQ ID NO: 3424368 - RNA, 13 nt, Human
agcaggcugccag

SEQ ID NO: 3424369 - RNA, 14 nt, Human
agcaggcugccagu

SEQ ID NO: 3424370 - RNA, 17 nt, Human
agcaggcugccagugcc

SEQ ID NO: 3424371 - RNA, 18 nt, Human
agcaggcugccagugccu

SEQ ID NO: 3424372 - RNA, 22 nt, Human
agcaggcugccagugccugggu

SEQ ID NO: 3424373 - RNA, 24 nt, Human
agcaggcuggcagcucuccaguca

SEQ ID NO: 3424374 - RNA, 20 nt, Human
agcagggaaaauauauaucu

SEQ ID NO: 3424375 - RNA, 21 nt, Human
agcagggaaaaugcagcaggg

SEQ ID NO: 3424376 - RNA, 14 nt, Human
agcagggaaacagc

SEQ ID NO: 3424377 - RNA, 14 nt, Human
agcagggaaggccu

SEQ ID NO: 3424378 - RNA, 15 nt, Human
agcagggaaggccug

SEQ ID NO: 3424379 - RNA, 17 nt, Human
agcagggaaggccugac

SEQ ID NO: 3424380 - RNA, 22 nt, Human
agcagggaugcccuggaggugg

SEQ ID NO: 3424381 - RNA, 21 nt, Human
agcagggauuaaccucugcac

SEQ ID NO: 3424382 - RNA, 22 nt, Human
agcagggauuaaccucugcacu

SEQ ID NO: 3424383 - RNA, 14 nt, Human
agcagggccgggga

SEQ ID NO: 3424384 - RNA, 23 nt, Human
agcagggccggggaacuggccaa

SEQ ID NO: 3424385 - RNA, 21 nt, Human
agcaggggcuacaagagggaa

SEQ ID NO: 3424386 - RNA, 22 nt, Human
agcagggguccuuggugugacc

SEQ ID NO: 3424387 - RNA, 21 nt, Human
agcaggguagucugguuucua

SEQ ID NO: 3424388 - RNA, 20 nt, Human
agcagggucuuuucaucugg

SEQ ID NO: 3424389 - RNA, 20 nt, Human
agcagguccccagcuuuggc

SEQ ID NO: 3424390 - RNA, 15 nt, Human
agcaggugcugcuac

SEQ ID NO: 3424391 - RNA, 17 nt, Human
agcaggugcugcuaccc

SEQ ID NO: 3424392 - RNA, 18 nt, Human
agcaggugcugcuacccu

SEQ ID NO: 3424393 - RNA, 19 nt, Human
agcagguggcaucucuaau

SEQ ID NO: 3424394 - RNA, 17 nt, Human
agcaggugggaaauggu

SEQ ID NO: 3424395 - RNA, 21 nt, Human
agcaggugguccugagaccug

SEQ ID NO: 3424396 - RNA, 18 nt, Human
agcagguuaaauguuuug

SEQ ID NO: 3424397 - RNA, 23 nt, Human
agcaucuccugaggaucagaaag

SEQ ID NO: 3424398 - RNA, 14 nt, Human
agcaucucuaccuu

SEQ ID NO: 3424399 - RNA, 15 nt, Human
agcaucucuaccuuc

SEQ ID NO: 3424400 - RNA, 17 nt, Human
agcaucucuaccuucuc

SEQ ID NO: 3424401 - RNA, 22 nt, Human
agcaucucuaccuucuccccag

SEQ ID NO: 3424402 - RNA, 23 nt, Human
agcaucucuaccuucuccccagc

SEQ ID NO: 3424403 - RNA, 17 nt, Human
agcaucucuugaggcca

SEQ ID NO: 3424404 - RNA, 17 nt, Human
agcaucugcauugccca

SEQ ID NO: 3424405 - RNA, 13 nt, Human
agcaucuggcucu

SEQ ID NO: 3424406 - RNA, 16 nt, Human
agcaucuggcucuaau

SEQ ID NO: 3424407 - RNA, 18 nt, Human
agcaucuggcucuaauuc

SEQ ID NO: 3424408 - RNA, 18 nt, Human
agcaucugggccuuggcc

SEQ ID NO: 3424409 - RNA, 22 nt, Human
agcaucugggccuuggccugga

SEQ ID NO: 3424410 - RNA, 23 nt, Human
agcaucugggccuuggccuggag

SEQ ID NO: 3424411 - RNA, 18 nt, Human
agcaucuucacuucuaaa

SEQ ID NO: 3424412 - RNA, 20 nt, Human
agcaucuucacuucuaaaug

SEQ ID NO: 3424413 - RNA, 13 nt, Human
agcaugaaaaagc

SEQ ID NO: 3424414 - RNA, 17 nt, Human
agcaugaaaaugugugu

SEQ ID NO: 3424415 - RNA, 21 nt, Human
agcaugaaaggcuuuuaaauu

SEQ ID NO: 3424416 - RNA, 15 nt, Human
agcaugaaaugugaa

SEQ ID NO: 3424417 - RNA, 17 nt, Human
agcaugaaaugugaauu

SEQ ID NO: 3424418 - RNA, 16 nt, Human
agcaugaacagugcac

SEQ ID NO: 3424419 - RNA, 12 nt, Human
agcaugaagaca

SEQ ID NO: 3424420 - RNA, 22 nt, Human
agcaugaagauaaacacagcug

SEQ ID NO: 3424421 - RNA, 22 nt, Human
agcaugaaugguauggaacucu

SEQ ID NO: 3424422 - RNA, 20 nt, Human
agcaugaauuuuuuucaucu

SEQ ID NO: 3424423 - RNA, 20 nt, Human
agcaugacaagccccaggca

SEQ ID NO: 3424424 - RNA, 21 nt, Human
agcaugacagaaaauauguau

SEQ ID NO: 3424425 - RNA, 23 nt, Human
agcaugacagaaaauauguauua

SEQ ID NO: 3424426 - RNA, 23 nt, Human
agcaugaccugugaccagcacug

SEQ ID NO: 3424427 - RNA, 20 nt, Human
agcaugagagggaugaggca

SEQ ID NO: 3424428 - RNA, 23 nt, Human
agcaugaggcagcacgugcacaa

SEQ ID NO: 3424429 - RNA, 14 nt, Human
agcaugcacaaagu

SEQ ID NO: 3424430 - RNA, 16 nt, Human
agcaugcacaaagugu

SEQ ID NO: 3424431 - RNA, 19 nt, Human
agcaugcacaaaguguauu

SEQ ID NO: 3424432 - RNA, 21 nt, Human
agcaugcacaaaguguauuca

SEQ ID NO: 3424433 - RNA, 15 nt, Human
agcaugcaucuguuu

SEQ ID NO: 3424434 - RNA, 16 nt, Human
agcaugccaacaagaa

SEQ ID NO: 3424435 - RNA, 14 nt, Human
agcauggacauuua

SEQ ID NO: 3424436 - RNA, 20 nt, Human
agcauggacauuuagaagaa

SEQ ID NO: 3424437 - RNA, 14 nt, Human
agcauggagcuggc

SEQ ID NO: 3424438 - RNA, 18 nt, Human
agcauggcacucccucca

SEQ ID NO: 3424439 - RNA, 15 nt, Human
agcauggcuauuuua

SEQ ID NO: 3424440 - RNA, 17 nt, Human
agcauggcuauuuuaua

SEQ ID NO: 3424441 - RNA, 12 nt, Human
agcauggcugcc

SEQ ID NO: 3424442 - RNA, 13 nt, Human
agcauggcuguga

SEQ ID NO: 3424443 - RNA, 17 nt, Human
agcauggucccugccuu

SEQ ID NO: 3424444 - RNA, 16 nt, Human
agcauggugcaugccg

SEQ ID NO: 3424445 - RNA, 13 nt, Human
agcauguaauggu

SEQ ID NO: 3424446 - RNA, 12 nt, Human
agcauguacagu

SEQ ID NO: 3424447 - RNA, 15 nt, Human
agcauguacaguguu

SEQ ID NO: 3424448 - RNA, 20 nt, Human
agcauguacggauuuucagu

SEQ ID NO: 3424449 - RNA, 18 nt, Human
agcauguauaguugcuuu

SEQ ID NO: 3424450 - RNA, 18 nt, Human
agcauguggcauguucau

SEQ ID NO: 3424451 - RNA, 17 nt, Human
agcauguguuaaucuua

SEQ ID NO: 3424452 - RNA, 22 nt, Human
agcauguguuaaucuuaaugua

SEQ ID NO: 3424453 - RNA, 16 nt, Human
agcauguguugaaaaa

SEQ ID NO: 3424454 - RNA, 17 nt, Human
agcauguugcugaggag

SEQ ID NO: 3424455 - RNA, 12 nt, Human
agcauguuuaga

SEQ ID NO: 3424456 - RNA, 13 nt, Human
agcauguuuagac

SEQ ID NO: 3424457 - RNA, 18 nt, Human
agcauguuuagacuuuaa

SEQ ID NO: 3424458 - RNA, 17 nt, Human
agcauguuucauguuuu

SEQ ID NO: 3424459 - RNA, 17 nt, Human
agcauguuugcugaaca

SEQ ID NO: 3424460 - RNA, 20 nt, Human
agcauguuugcugaacaccu

SEQ ID NO: 3424461 - RNA, 16 nt, Human
agcauguuuugcaugu

SEQ ID NO: 3424462 - RNA, 17 nt, Human
agcauuacgugagccag

SEQ ID NO: 3424463 - RNA, 15 nt, Human
agcauuacucuugua

SEQ ID NO: 3424464 - RNA, 21 nt, Human
agcauuacucuuguaagauuu

SEQ ID NO: 3424465 - RNA, 21 nt, Human
agcauuauaaucaccagggcc

SEQ ID NO: 3424466 - RNA, 15 nt, Human
agcauuaugcaauua

SEQ ID NO: 3424467 - RNA, 15 nt, Human
agcauucagagagca

SEQ ID NO: 3424468 - RNA, 20 nt, Human
agcauuccagccccucuggu

SEQ ID NO: 3424469 - RNA, 14 nt, Human
agcauuccagucag

SEQ ID NO: 3424470 - RNA, 19 nt, Human
agcauucccagguaggcca

SEQ ID NO: 3424471 - RNA, 21 nt, Human
agcauuccuucuuugauaaug

SEQ ID NO: 3424472 - RNA, 23 nt, Human
agcauuccuucuuugauaauguu

SEQ ID NO: 3424473 - RNA, 14 nt, Human
agcauucggaggga

SEQ ID NO: 3424474 - RNA, 22 nt, Human
agcauucucacuccuaccuggu

SEQ ID NO: 3424475 - RNA, 17 nt, Human
agcauucuccccagugu

SEQ ID NO: 3424476 - RNA, 14 nt, Human
agcauucuggcagu

SEQ ID NO: 3424477 - RNA, 17 nt, Human
agcauucuggcaguuuu

SEQ ID NO: 3424478 - RNA, 12 nt, Human
agcauucugucu

SEQ ID NO: 3424479 - RNA, 16 nt, Human
acugugccaugugcca

SEQ ID NO: 3424480 - RNA, 13 nt, Human
acugugcccuggu

SEQ ID NO: 3424481 - RNA, 15 nt, Human
acugugcccuggugg

SEQ ID NO: 3424482 - RNA, 23 nt, Human
acugugccuuugaguuuccucag

SEQ ID NO: 3424483 - RNA, 23 nt, Human
acugugccuuugcaaaucagugu

SEQ ID NO: 3424484 - RNA, 22 nt, Human
acugugcgucuugguguaauuu

SEQ ID NO: 3424485 - RNA, 23 nt, Human
acugugcguggggcucccgccuc

SEQ ID NO: 3424486 - RNA, 18 nt, Human
acugugcuggagccacua

SEQ ID NO: 3424487 - RNA, 12 nt, Human
acugugcuuucu

SEQ ID NO: 3424488 - RNA, 14 nt, Human
acugugcuuucuau

SEQ ID NO: 3424489 - RNA, 16 nt, Human
acuguggaaaaauauu

SEQ ID NO: 3424490 - RNA, 17 nt, Human
acuguggaaaaauauuu

SEQ ID NO: 3424491 - RNA, 19 nt, Human
acuguggaaaaauauuuaa

SEQ ID NO: 3424492 - RNA, 17 nt, Human
acuguggagacugcucc

SEQ ID NO: 3424493 - RNA, 16 nt, Human
acuguggaggaaggau

SEQ ID NO: 3424494 - RNA, 21 nt, Human
acuguggauacccuuacccuu

SEQ ID NO: 3424495 - RNA, 15 nt, Human
acuguggccuugguc

SEQ ID NO: 3424496 - RNA, 12 nt, Human
acuguggcugcu

SEQ ID NO: 3424497 - RNA, 14 nt, Human
acugugggcaauuu

SEQ ID NO: 3424498 - RNA, 13 nt, Human
acuguggguagac

SEQ ID NO: 3424499 - RNA, 20 nt, Human
acugugggugugugacucuu

SEQ ID NO: 3424500 - RNA, 23 nt, Human
acuguggguuuguggggggaggc

SEQ ID NO: 3424501 - RNA, 12 nt, Human
acuguggugacu

SEQ ID NO: 3424502 - RNA, 15 nt, Human
acuguguaacugccc

SEQ ID NO: 3424503 - RNA, 23 nt, Human
acuguguacaguaaauggcuuau

SEQ ID NO: 3424504 - RNA, 16 nt, Human
acuguguacauaacug

SEQ ID NO: 3424505 - RNA, 23 nt, Human
acuguguacauaaugcuuaauuu

SEQ ID NO: 3424506 - RNA, 19 nt, Human
acuguguauauuugauuua

SEQ ID NO: 3424507 - RNA, 18 nt, Human
acuguguauguacauaua

SEQ ID NO: 3424508 - RNA, 20 nt, Human
acuguguauguacauauaua

SEQ ID NO: 3424509 - RNA, 15 nt, Human
acuguguauuccaag

SEQ ID NO: 3424510 - RNA, 21 nt, Human
acuguguccaggugguacuuu

SEQ ID NO: 3424511 - RNA, 21 nt, Human
acugugucccucucucuggaa

SEQ ID NO: 3424512 - RNA, 22 nt, Human
acugugucccucucucuggaaa

SEQ ID NO: 3424513 - RNA, 14 nt, Human
acuguguccuggug

SEQ ID NO: 3424514 - RNA, 20 nt, Human
acugugugcucaggagcccu

SEQ ID NO: 3424515 - RNA, 17 nt, Human
acuguguguaauuguuc

SEQ ID NO: 3424516 - RNA, 18 nt, Human
acugugugugcccucugg

SEQ ID NO: 3424517 - RNA, 20 nt, Human
acugugugugcccucugggc

SEQ ID NO: 3424518 - RNA, 21 nt, Human
acugugugugcccucugggcu

SEQ ID NO: 3424519 - RNA, 22 nt, Human
acugugugugcccucugggcuc

SEQ ID NO: 3424520 - RNA, 22 nt, Human
acugugugugugaaugaacacu

SEQ ID NO: 3424521 - RNA, 19 nt, Human
acuguguguugccacagga

SEQ ID NO: 3424522 - RNA, 22 nt, Human
acuguguguugccacaggacac

SEQ ID NO: 3424523 - RNA, 15 nt, Human
acuguguuccuggca

SEQ ID NO: 3424524 - RNA, 12 nt, Human
acuguguuccuu

SEQ ID NO: 3424525 - RNA, 17 nt, Human
acuguguuguauuaaca

SEQ ID NO: 3424526 - RNA, 17 nt, Human
acuguguuuuauaaaau

SEQ ID NO: 3424527 - RNA, 20 nt, Human
acuguuaaauugcuguguau

SEQ ID NO: 3424528 - RNA, 16 nt, Human
acuguuaacuuauuca

SEQ ID NO: 3424529 - RNA, 14 nt, Human
acuguuaagaagca

SEQ ID NO: 3424530 - RNA, 15 nt, Human
acuguuacaguaaug

SEQ ID NO: 3424531 - RNA, 20 nt, Human
acuguuacaguaaugucaua

SEQ ID NO: 3424532 - RNA, 20 nt, Human
acuguuaccuaaaguauuuu

SEQ ID NO: 3424533 - RNA, 16 nt, Human
acuguuacugggcccu

SEQ ID NO: 3424534 - RNA, 15 nt, Human
acuguuagaacacua

SEQ ID NO: 3424535 - RNA, 19 nt, Human
acuguuagaacacuauuuu

SEQ ID NO: 3424536 - RNA, 23 nt, Human
acuguuagaacacuauuuucaga

SEQ ID NO: 3424537 - RNA, 15 nt, Human
acuguuagaauguaa

SEQ ID NO: 3424538 - RNA, 14 nt, Human
acuguuagcacugu

SEQ ID NO: 3424539 - RNA, 15 nt, Human
acuguuagcacuguu

SEQ ID NO: 3424540 - RNA, 17 nt, Human
acuguuagcacuguuga

SEQ ID NO: 3424541 - RNA, 19 nt, Human
agccccgacuccagccagc

SEQ ID NO: 3424542 - RNA, 14 nt, Human
agccccgaggccuu

SEQ ID NO: 3424543 - RNA, 22 nt, Human
agccccgaggccuucucugaag

SEQ ID NO: 3424544 - RNA, 23 nt, Human
agccccgcagaccuccccagccc

SEQ ID NO: 3424545 - RNA, 19 nt, Human
agccccgcccucuuccuga

SEQ ID NO: 3424546 - RNA, 21 nt, Human
agccccggcccugggcucgga

SEQ ID NO: 3424547 - RNA, 24 nt, Human
agccccggggugaguccauucucc

SEQ ID NO: 3424548 - RNA, 18 nt, Human
agccccgugggguuccuc

SEQ ID NO: 3424549 - RNA, 15 nt, Human
agccccuacugcugu

SEQ ID NO: 3424550 - RNA, 23 nt, Human
agccccuacugcugugaacccug

SEQ ID NO: 3424551 - RNA, 12 nt, Human
agccccuagaaa

SEQ ID NO: 3424552 - RNA, 23 nt, Human
agccccuagaaacccaagcuccu

SEQ ID NO: 3424553 - RNA, 16 nt, Human
agccccuagcccagga

SEQ ID NO: 3424554 - RNA, 16 nt, Human
agccccucccaagcug

SEQ ID NO: 3424555 - RNA, 19 nt, Human
agccccucccaagcuggcu

SEQ ID NO: 3424556 - RNA, 13 nt, Human
agccccuccccca

SEQ ID NO: 3424557 - RNA, 20 nt, Human
agccccucccccaucuccca

SEQ ID NO: 3424558 - RNA, 21 nt, Human
agccccucccccaucucccac

SEQ ID NO: 3424559 - RNA, 16 nt, Human
agccccucccuccucu

SEQ ID NO: 3424560 - RNA, 18 nt, Human
agccccucccuccucuga

SEQ ID NO: 3424561 - RNA, 12 nt, Human
agccccuccucu

SEQ ID NO: 3424562 - RNA, 19 nt, Human
agccccuccucugccaccu

SEQ ID NO: 3424563 - RNA, 20 nt, Human
agccccuccucugccaccuc

SEQ ID NO: 3424564 - RNA, 12 nt, Human
agccccucuggu

SEQ ID NO: 3424565 - RNA, 13 nt, Human
agccccucugguc

SEQ ID NO: 3424566 - RNA, 21 nt, Human
agccccucuggucgcuccugc

SEQ ID NO: 3424567 - RNA, 17 nt, Human
agccccucuuggagaag

SEQ ID NO: 3424568 - RNA, 18 nt, Human
agccccucuuggagaagu

SEQ ID NO: 3424569 - RNA, 14 nt, Human
agccccugaaagcc

SEQ ID NO: 3424570 - RNA, 20 nt, Human
agccccugauccugugaagu

SEQ ID NO: 3424571 - RNA, 14 nt, Human
agccccugccauug

SEQ ID NO: 3424572 - RNA, 12 nt, Human
agccccugcccc

SEQ ID NO: 3424573 - RNA, 21 nt, Human
agccccugccccagcccaagu

SEQ ID NO: 3424574 - RNA, 13 nt, Human
agccccugccccu

SEQ ID NO: 3424575 - RNA, 19 nt, Human
agccccugccccucaugcc

SEQ ID NO: 3424576 - RNA, 18 nt, Human
agccccuggaugcagccu

SEQ ID NO: 3424577 - RNA, 22 nt, Human
agccccuggaugcagccucaca

SEQ ID NO: 3424578 - RNA, 14 nt, Human
agccccugggccca

SEQ ID NO: 3424579 - RNA, 22 nt, Human
agccccugggguggccaccagu

SEQ ID NO: 3424580 - RNA, 14 nt, Human
agccccuuagcccc

SEQ ID NO: 3424581 - RNA, 13 nt, Human
agccccuucccca

SEQ ID NO: 3424582 - RNA, 15 nt, Human
agccccuuccccaug

SEQ ID NO: 3424583 - RNA, 16 nt, Human
agccccuucucagaau

SEQ ID NO: 3424584 - RNA, 18 nt, Human
agccccuucucagaaucu

SEQ ID NO: 3424585 - RNA, 15 nt, Human
agccccuucugaccc

SEQ ID NO: 3424586 - RNA, 16 nt, Human
agccccuucugaccca

SEQ ID NO: 3424587 - RNA, 17 nt, Human
agccccuugagaaaccu

SEQ ID NO: 3424588 - RNA, 23 nt, Human
agccccuugcucuccccugcccu

SEQ ID NO: 3424589 - RNA, 14 nt, Human
agccccuuuccaaa

SEQ ID NO: 3424590 - RNA, 16 nt, Human
agccccuuuccaaaau

SEQ ID NO: 3424591 - RNA, 23 nt, Human
agccccuuucccuuguagcuccu

SEQ ID NO: 3424592 - RNA, 15 nt, Human
agcccgaauacaaac

SEQ ID NO: 3424593 - RNA, 15 nt, Human
agcccgcacccccac

SEQ ID NO: 3424594 - RNA, 19 nt, Human
agcccgcacccccacccuu

SEQ ID NO: 3424595 - RNA, 14 nt, Human
agcccgcaucagcu

SEQ ID NO: 3424596 - RNA, 20 nt, Human
agcccgcaugcagcagcuug

SEQ ID NO: 3424597 - RNA, 19 nt, Human
agcccgccaagguagccau

SEQ ID NO: 3424598 - RNA, 21 nt, Human
agcccgccugccaguccuagc

SEQ ID NO: 3424599 - RNA, 23 nt, Human
agcccgcuaggcucgccuucccu

SEQ ID NO: 3424600 - RNA, 20 nt, Human
agcccggaccuuggcagccc

SEQ ID NO: 3424601 - RNA, 20 nt, Human
agcccggccugcucccagca

SEQ ID NO: 3424602 - RNA, 16 nt, Human
agcccggcgccccugc

SEQ ID NO: 3424603 - RNA, 18 nt, Human
agcccggcgccccugcca

SEQ ID NO: 3424604 - RNA, 21 nt, Human
agcccggcgccccugccaccu

SEQ ID NO: 3424605 - RNA, 13 nt, Human
agcccggcugguu

SEQ ID NO: 3424606 - RNA, 13 nt, Human
agcccgggcucug

SEQ ID NO: 3424607 - RNA, 18 nt, Human
agcccgggcucugccucc

SEQ ID NO: 3424608 - RNA, 21 nt, Human
agcccgggcucugccucccau

SEQ ID NO: 3424609 - RNA, 14 nt, Human
agcccgggcugccu

SEQ ID NO: 3424610 - RNA, 17 nt, Human
agcccgggcugccuggg

SEQ ID NO: 3424611 - RNA, 20 nt, Human
agcccgggcugccugggcug

SEQ ID NO: 3424612 - RNA, 15 nt, Human
agcccgguaagagca

SEQ ID NO: 3424613 - RNA, 19 nt, Human
agcccuaaaaauccagacu

SEQ ID NO: 3424614 - RNA, 22 nt, Human
agcccuaaaauuccacugcguu

SEQ ID NO: 3424615 - RNA, 18 nt, Human
agcccuaaccccuuccag

SEQ ID NO: 3424616 - RNA, 21 nt, Human
agcccuacucccugcagaugc

SEQ ID NO: 3424617 - RNA, 22 nt, Human
agcccuagagccugccuggagc

SEQ ID NO: 3424618 - RNA, 17 nt, Human
agcccuaggguggagag

SEQ ID NO: 3424619 - RNA, 20 nt, Human
agcccuaggguggagagcca

SEQ ID NO: 3424620 - RNA, 13 nt, Human
agcccuauggaug

SEQ ID NO: 3424621 - RNA, 14 nt, Human
agcccucaaaguga

SEQ ID NO: 3424622 - RNA, 16 nt, Human
agcccucaauugugaa

SEQ ID NO: 3424623 - RNA, 22 nt, Human
agcccucaccccugguucucau

SEQ ID NO: 3424624 - RNA, 23 nt, Human
agcccucaccccugguucucauc

SEQ ID NO: 3424625 - RNA, 24 nt, Human
agcccucagaacccuuggcuugcc

SEQ ID NO: 3424626 - RNA, 13 nt, Human
agcccucccacuu

SEQ ID NO: 3424627 - RNA, 19 nt, Human
agcccuccccauggagcca

SEQ ID NO: 3424628 - RNA, 21 nt, Human
agcccuccccauggagccagc

SEQ ID NO: 3424629 - RNA, 12 nt, Human
agcccucccugc

SEQ ID NO: 3424630 - RNA, 22 nt, Human
agcccucccugccccucccuuc

SEQ ID NO: 3424631 - RNA, 16 nt, Human
agcccucccuguccuc

SEQ ID NO: 3424632 - RNA, 17 nt, Human
agcccucccuguccucc

SEQ ID NO: 3424633 - RNA, 24 nt, Human
agcccuccgccauucucaagcccu

SEQ ID NO: 3424634 - RNA, 15 nt, Human
agcccuccgccuuca

SEQ ID NO: 3424635 - RNA, 13 nt, Human
agcccuccucacc

SEQ ID NO: 3424636 - RNA, 13 nt, Human
agcccuccuucca

SEQ ID NO: 3424637 - RNA, 14 nt, Human
agcccucgucuccc

SEQ ID NO: 3424638 - RNA, 19 nt, Human
agcccucucacuguguccc

SEQ ID NO: 3424639 - RNA, 13 nt, Human
agcccucucccuc

SEQ ID NO: 3424640 - RNA, 15 nt, Human
agcccucuuccauca

SEQ ID NO: 3424641 - RNA, 17 nt, Human
agcccucuuccaucaug

SEQ ID NO: 3424642 - RNA, 15 nt, Human
agcccugacccugug

SEQ ID NO: 3424643 - RNA, 21 nt, Human
agcccugacccuguggaagca

SEQ ID NO: 3424644 - RNA, 18 nt, Human
agcccugaggaggccuug

SEQ ID NO: 3424645 - RNA, 23 nt, Human
agcccugaguuccuagccaccgc

SEQ ID NO: 3424646 - RNA, 22 nt, Human
agcccugccccacaccuccucu

SEQ ID NO: 3424647 - RNA, 18 nt, Human
agcccugccucuccgccc

SEQ ID NO: 3424648 - RNA, 12 nt, Human
agcccugccugg

SEQ ID NO: 3424649 - RNA, 16 nt, Human
agcccugccuggagga

SEQ ID NO: 3424650 - RNA, 21 nt, Human
agcccugccuggaggaccuga

SEQ ID NO: 3424651 - RNA, 14 nt, Human
agcccugcucccuc

SEQ ID NO: 3424652 - RNA, 13 nt, Human
agcccugcuggcc

SEQ ID NO: 3424653 - RNA, 17 nt, Human
agcccugcuuugggcug

SEQ ID NO: 3424654 - RNA, 19 nt, Human
agcccugcuuugggcugcc

SEQ ID NO: 3424655 - RNA, 20 nt, Human
agcccugcuuugggcugccc

SEQ ID NO: 3424656 - RNA, 20 nt, Human
agcccuggagccaacugcug

SEQ ID NO: 3424657 - RNA, 16 nt, Human
agcccuggaggugcca

SEQ ID NO: 3424658 - RNA, 21 nt, Human
agcccuggcaggaugacccug

SEQ ID NO: 3424659 - RNA, 22 nt, Human
agcccuggcaugucaacagcgu

SEQ ID NO: 3424660 - RNA, 14 nt, Human
agcccuggccagag

SEQ ID NO: 3424661 - RNA, 15 nt, Human
agcccuggccagagg

SEQ ID NO: 3424662 - RNA, 17 nt, Human
agcccuggccagaggcu

SEQ ID NO: 3424663 - RNA, 21 nt, Human
agcccuggcugaaggacugug

SEQ ID NO: 3424664 - RNA, 13 nt, Human
agcccugggaccg

SEQ ID NO: 3424665 - RNA, 21 nt, Human
agcccugggccccaccaccua

SEQ ID NO: 3424666 - RNA, 15 nt, Human
agcccuggggcuggg

SEQ ID NO: 3424667 - RNA, 18 nt, Human
agcccuggggcugggccc

SEQ ID NO: 3424668 - RNA, 16 nt, Human
agcccuggucucagca

SEQ ID NO: 3424669 - RNA, 16 nt, Human
agcccugguggcagug

SEQ ID NO: 3424670 - RNA, 21 nt, Human
agcccugguggcagugggagc

SEQ ID NO: 3424671 - RNA, 20 nt, Human
agcccugucagcaugaauuu

SEQ ID NO: 3424672 - RNA, 16 nt, Human
agcccugucagugcag

SEQ ID NO: 3424673 - RNA, 16 nt, Human
agcccuguccuggugg

SEQ ID NO: 3424674 - RNA, 18 nt, Human
agcccugucgagacacuu

SEQ ID NO: 3424675 - RNA, 21 nt, Human
agcccugucgagacacuugcc

SEQ ID NO: 3424676 - RNA, 11 nt, Human
agcccugucuc

SEQ ID NO: 3424677 - RNA, 18 nt, Human
agcccuguggaugagccc

SEQ ID NO: 3424678 - RNA, 19 nt, Human
agcccuguggaugagcccu

SEQ ID NO: 3424679 - RNA, 14 nt, Human
agcccuguugugcc

SEQ ID NO: 3424680 - RNA, 12 nt, Human
agccucuggcua

SEQ ID NO: 3424681 - RNA, 13 nt, Human
agccucuggcuag

SEQ ID NO: 3424682 - RNA, 13 nt, Human
agccucugggccc

SEQ ID NO: 3424683 - RNA, 23 nt, Human
agccucugggucagugguccaca

SEQ ID NO: 3424684 - RNA, 22 nt, Human
agccucugucacugcaggcacu

SEQ ID NO: 3424685 - RNA, 14 nt, Human
acuuuaauuuaugu

SEQ ID NO: 3424686 - RNA, 20 nt, Human
acuuuacacucggcuuugga

SEQ ID NO: 3424687 - RNA, 15 nt, Human
acuuuacagaaaugg

SEQ ID NO: 3424688 - RNA, 16 nt, Human
acuuuaccacccccac

SEQ ID NO: 3424689 - RNA, 13 nt, Human
acuuuacccaccu

SEQ ID NO: 3424690 - RNA, 18 nt, Human
agccuguuccccucacug

SEQ ID NO: 3424691 - RNA, 22 nt, Human
agccuguugggaucgcauugca

SEQ ID NO: 3424692 - RNA, 15 nt, Human
agccuguuuaagaga

SEQ ID NO: 3424693 - RNA, 18 nt, Human
agccuguuucuuccuguu

SEQ ID NO: 3424694 - RNA, 20 nt, Human
agccuguuuuaaguucugga

SEQ ID NO: 3424695 - RNA, 18 nt, Human
agccuguuuuguuggaag

SEQ ID NO: 3424696 - RNA, 14 nt, Human
agccuuagggaagc

SEQ ID NO: 3424697 - RNA, 15 nt, Human
agccuuagggaagcu

SEQ ID NO: 3424698 - RNA, 14 nt, Human
agccuuaucaagug

SEQ ID NO: 3424699 - RNA, 17 nt, Human
agccuuaucaagugucu

SEQ ID NO: 3424700 - RNA, 14 nt, Human
agccuucaagcucu

SEQ ID NO: 3424701 - RNA, 14 nt, Human
agccuuccacccag

SEQ ID NO: 3424702 - RNA, 15 nt, Human
agccuuccacccagg

SEQ ID NO: 3424703 - RNA, 12 nt, Human
agccuuccaggg

SEQ ID NO: 3424704 - RNA, 14 nt, Human
agccuuccaggggu

SEQ ID NO: 3424705 - RNA, 16 nt, Human
agccuuccaggggugg

SEQ ID NO: 3424706 - RNA, 18 nt, Human
agccuuccagggguggga

SEQ ID NO: 3424707 - RNA, 21 nt, Human
agccuuccccuuauccucccu

SEQ ID NO: 3424708 - RNA, 23 nt, Human
agccuuccccuuauccucccugu

SEQ ID NO: 3424709 - RNA, 19 nt, Human
agccuuccucugcagcuga

SEQ ID NO: 3424710 - RNA, 12 nt, Human
agccuucucugu

SEQ ID NO: 3424711 - RNA, 20 nt, Human
agccuucucuguucauuucc

SEQ ID NO: 3424712 - RNA, 19 nt, Human
agccuucugagcuggccuc

SEQ ID NO: 3424713 - RNA, 15 nt, Human
agccuucugaugucu

SEQ ID NO: 3424714 - RNA, 20 nt, Human
agccuucuuccaucccagga

SEQ ID NO: 3424715 - RNA, 15 nt, Human
agccuucuuugcuug

SEQ ID NO: 3424716 - RNA, 16 nt, Human
agccuucuuuuucugg

SEQ ID NO: 3424717 - RNA, 18 nt, Human
agccuucuuuuucuggac

SEQ ID NO: 3424718 - RNA, 13 nt, Human
agccuugaacuuu

SEQ ID NO: 3424719 - RNA, 22 nt, Human
agccuugaacuuugaccucugc

SEQ ID NO: 3424720 - RNA, 19 nt, Human
agccuugaccauucuccac

SEQ ID NO: 3424721 - RNA, 22 nt, Human
agccuugaccauucuccaccug

SEQ ID NO: 3424722 - RNA, 16 nt, Human
agccuugagcccuggc

SEQ ID NO: 3424723 - RNA, 17 nt, Human
agccuugagcccuggcu

SEQ ID NO: 3424724 - RNA, 15 nt, Human
agccuugccagagau

SEQ ID NO: 3424725 - RNA, 22 nt, Human
agccuugccuaaauuuaaugcu

SEQ ID NO: 3424726 - RNA, 16 nt, Human
agccuuggauguauau

SEQ ID NO: 3424727 - RNA, 16 nt, Human
agccuuggcaucuaga

SEQ ID NO: 3424728 - RNA, 19 nt, Human
agccuuggccucuuuccuc

SEQ ID NO: 3424729 - RNA, 20 nt, Human
agccuuggggcugaugcagu

SEQ ID NO: 3424730 - RNA, 19 nt, Human
agccuugguguccaccugg

SEQ ID NO: 3424731 - RNA, 22 nt, Human
agccuugguguccaccuggccc

SEQ ID NO: 3424732 - RNA, 18 nt, Human
agccuuguaauucuaaau

SEQ ID NO: 3424733 - RNA, 21 nt, Human
agccuugugaugucauacaga

SEQ ID NO: 3424734 - RNA, 21 nt, Human
agccuugugggugugagcagc

SEQ ID NO: 3424735 - RNA, 19 nt, Human
agccuuguguauauuugua

SEQ ID NO: 3424736 - RNA, 17 nt, Human
agccuugugucuacaga

SEQ ID NO: 3424737 - RNA, 23 nt, Human
agccuugugucuacagagaaccu

SEQ ID NO: 3424738 - RNA, 14 nt, Human
agccuuuaaugcau

SEQ ID NO: 3424739 - RNA, 16 nt, Human
agccuuuaccugugaa

SEQ ID NO: 3424740 - RNA, 18 nt, Human
agccuuuaccugugaagu

SEQ ID NO: 3424741 - RNA, 19 nt, Human
agccuuuaccuuuuaugca

SEQ ID NO: 3424742 - RNA, 22 nt, Human
agccuuuacugacccuggggcu

SEQ ID NO: 3424743 - RNA, 16 nt, Human
agccuuuacuguuuga

SEQ ID NO: 3424744 - RNA, 19 nt, Human
agccuuuacuguuugauau

SEQ ID NO: 3424745 - RNA, 18 nt, Human
agccuuuaguaucagugu

SEQ ID NO: 3424746 - RNA, 14 nt, Human
agccuuuccauaag

SEQ ID NO: 3424747 - RNA, 22 nt, Human
agccuuuccauaaggaauguag

SEQ ID NO: 3424748 - RNA, 19 nt, Human
agccuuucuuuucuuucuu

SEQ ID NO: 3424749 - RNA, 16 nt, Human
agccuuugccuccccg

SEQ ID NO: 3424750 - RNA, 18 nt, Human
agccuuuggcucuggaga

SEQ ID NO: 3424751 - RNA, 21 nt, Human
agccuuuggcucuggagacag

SEQ ID NO: 3424752 - RNA, 19 nt, Human
agccuuugguucuggccag

SEQ ID NO: 3424753 - RNA, 23 nt, Human
agccuuuguugaacuguuagaau

SEQ ID NO: 3424754 - RNA, 15 nt, Human
agccuuuuaacugug

SEQ ID NO: 3424755 - RNA, 18 nt, Human
agccuuuucccucuuugg

SEQ ID NO: 3424756 - RNA, 19 nt, Human
agccuuuuuaaaacacaug

SEQ ID NO: 3424757 - RNA, 20 nt, Human
agccuuuuuaaaacacaugu

SEQ ID NO: 3424758 - RNA, 21 nt, Human
agccuuuuuaaaacacauguu

SEQ ID NO: 3424759 - RNA, 19 nt, Human
agccuuuuuuccccagacu

SEQ ID NO: 3424760 - RNA, 12 nt, Human
agcgaaacuccg

SEQ ID NO: 3424761 - RNA, 22 nt, Human
agcgaacccuuuauuugaacaa

SEQ ID NO: 3424762 - RNA, 12 nt, Human
agcgaagggagu

SEQ ID NO: 3424763 - RNA, 20 nt, Human
agcgaaugcuaggucucgga

SEQ ID NO: 3424764 - RNA, 16 nt, Human
agcgaauuuuaaaaga

SEQ ID NO: 3424765 - RNA, 17 nt, Human
agcgacaacagauugga

SEQ ID NO: 3424766 - RNA, 13 nt, Human
agcgacagugaga

SEQ ID NO: 3424767 - RNA, 19 nt, Human
agcgacauagcccaucccu

SEQ ID NO: 3424768 - RNA, 20 nt, Human
agcgaccaccccugccucca

SEQ ID NO: 3424769 - RNA, 17 nt, Human
agcgaccgcccccuccu

SEQ ID NO: 3424770 - RNA, 19 nt, Human
agcgacuccguuggccacu

SEQ ID NO: 3424771 - RNA, 20 nt, Human
agcgacuccguuggccacuc

SEQ ID NO: 3424772 - RNA, 21 nt, Human
agcgacuccguuggccacucc

SEQ ID NO: 3424773 - RNA, 13 nt, Human
agcgagcccuggu

SEQ ID NO: 3424774 - RNA, 19 nt, Human
agcgagcgcccagcuccug

SEQ ID NO: 3424775 - RNA, 17 nt, Human
agcgauauacagaugaa

SEQ ID NO: 3424776 - RNA, 20 nt, Human
agcgauauacagaugaaaau

SEQ ID NO: 3424777 - RNA, 13 nt, Human
agcgaucucuccu

SEQ ID NO: 3424778 - RNA, 18 nt, Human
agcgaugaauuuggagac

SEQ ID NO: 3424779 - RNA, 23 nt, Human
agcgauuauuaucuaaagugugu

SEQ ID NO: 3424780 - RNA, 20 nt, Human
agcgauucccucucccaggc

SEQ ID NO: 3424781 - RNA, 22 nt, Human
agcgauucccucucccaggccc

SEQ ID NO: 3424782 - RNA, 23 nt, Human
agcgauucccucucccaggcccc

SEQ ID NO: 3424783 - RNA, 14 nt, Human
agcgauucuccugc

SEQ ID NO: 3424784 - RNA, 19 nt, Human
agcgauucucuugccucag

SEQ ID NO: 3424785 - RNA, 15 nt, Human
agcgauucuucugcu

SEQ ID NO: 3424786 - RNA, 19 nt, Human
agcgauucuucugcuucag

SEQ ID NO: 3424787 - RNA, 13 nt, Human
agcgcacagcugc

SEQ ID NO: 3424788 - RNA, 18 nt, Human
agcgcaccugcccccugg

SEQ ID NO: 3424789 - RNA, 21 nt, Human
agcgccaagcaaccugggucc

SEQ ID NO: 3424790 - RNA, 15 nt, Human
agcgccaagugcgug

SEQ ID NO: 3424791 - RNA, 13 nt, Human
agcgccagccuca

SEQ ID NO: 3424792 - RNA, 18 nt, Human
agcgccagccugucccau

SEQ ID NO: 3424793 - RNA, 20 nt, Human
agcgcccacuagacccacug

SEQ ID NO: 3424794 - RNA, 14 nt, Human
agcgcccaguuggg

SEQ ID NO: 3424795 - RNA, 14 nt, Human
agcgcccgcugggc

SEQ ID NO: 3424796 - RNA, 15 nt, Human
agcgcccgcugggcu

SEQ ID NO: 3424797 - RNA, 12 nt, Human
agcgcccugcag

SEQ ID NO: 3424798 - RNA, 19 nt, Human
agcgcccugcagacccugc

SEQ ID NO: 3424799 - RNA, 20 nt, Human
agcgcccugcagacccugcc

SEQ ID NO: 3424800 - RNA, 18 nt, Human
agcgcccuggcccccaca

SEQ ID NO: 3424801 - RNA, 15 nt, Human
agcgcccuuccucuc

SEQ ID NO: 3424802 - RNA, 19 nt, Human
agcgccgugaguucucagg

SEQ ID NO: 3424803 - RNA, 20 nt, Human
agcgccgugaguucucaggg

SEQ ID NO: 3424804 - RNA, 21 nt, Human
agcgccgugaguucucagggc

SEQ ID NO: 3424805 - RNA, 21 nt, Human
agcgccuaguggggucucccu

SEQ ID NO: 3424806 - RNA, 23 nt, Human
agcgccuaguggggucucccucu

SEQ ID NO: 3424807 - RNA, 18 nt, Human
agcgccuccauccaaggc

SEQ ID NO: 3424808 - RNA, 19 nt, Human
agcgccucccuccacccca

SEQ ID NO: 3424809 - RNA, 18 nt, Human
agcgccugccccucccag

SEQ ID NO: 3424810 - RNA, 13 nt, Human
agcgccuggccua

SEQ ID NO: 3424811 - RNA, 15 nt, Human
agcgccugugcacac

SEQ ID NO: 3424812 - RNA, 16 nt, Human
agcgccugugcacaca

SEQ ID NO: 3424813 - RNA, 17 nt, Human
agcgccugugcacacac

SEQ ID NO: 3424814 - RNA, 17 nt, Human
agcgccuuucccaacuc

SEQ ID NO: 3424815 - RNA, 20 nt, Human
agcgccuuucccaacucuag

SEQ ID NO: 3424816 - RNA, 22 nt, Human
agcgcgccacucgcuuccccca

SEQ ID NO: 3424817 - RNA, 17 nt, Human
agcgcggacgugcuggg

SEQ ID NO: 3424818 - RNA, 15 nt, Human
agcgcguugccuguc

SEQ ID NO: 3424819 - RNA, 19 nt, Human
agcgcuagaggaagcagcc

SEQ ID NO: 3424820 - RNA, 18 nt, Human
agcgcuaucuucacauag

SEQ ID NO: 3424821 - RNA, 11 nt, Human
agcgcucccuu

SEQ ID NO: 3424822 - RNA, 22 nt, Human
agcgcugacgugucaggaaaac

SEQ ID NO: 3424823 - RNA, 18 nt, Human
agcgcugccgcaccccag

SEQ ID NO: 3424824 - RNA, 20 nt, Human
agcgcugccgcaccccagag

SEQ ID NO: 3424825 - RNA, 21 nt, Human
agcgcugccgcaccccagagu

SEQ ID NO: 3424826 - RNA, 22 nt, Human
agcgcuggccgggaccccgagc

SEQ ID NO: 3424827 - RNA, 13 nt, Human
agcggaaagcagc

SEQ ID NO: 3424828 - RNA, 15 nt, Human
agcggacaguggcag

SEQ ID NO: 3424829 - RNA, 19 nt, Human
agcgaguggagucugccac

SEQ ID NO: 3424830 - RNA, 19 nt, Human
agcgaucucuccacugugc

SEQ ID NO: 3424831 - RNA, 18 nt, Human
agcgauggucucagaaac

SEQ ID NO: 3424832 - RNA, 16 nt, Human
agcgauguaugcagcu

SEQ ID NO: 3424833 - RNA, 19 nt, Human
agcgauucccucucccagg

SEQ ID NO: 3424834 - RNA, 14 nt, Human
agcgcacagcugcu

SEQ ID NO: 3424835 - RNA, 17 nt, Human
agcgcaccugcccccug

SEQ ID NO: 3424836 - RNA, 19 nt, Human
agcgcaccugcccccuggu

SEQ ID NO: 3424837 - RNA, 21 nt, Human
agcgcaccugcccccuggugg

SEQ ID NO: 3424838 - RNA, 14 nt, Human
agcgcacucuucau

SEQ ID NO: 3424839 - RNA, 11 nt, Human
agcgcagcccg

SEQ ID NO: 3424840 - RNA, 19 nt, Human
agcgcagguuuaguuuacu

SEQ ID NO: 3424841 - RNA, 18 nt, Human
agcgccaagcaaccuggg

SEQ ID NO: 3424842 - RNA, 20 nt, Human
agcgccaagugcgugccgug

SEQ ID NO: 3424843 - RNA, 21 nt, Human
agcgccaggcugaccacagca

SEQ ID NO: 3424844 - RNA, 22 nt, Human
agcgcccaaaggacgcacugag

SEQ ID NO: 3424845 - RNA, 11 nt, Human
agcgccccucc

SEQ ID NO: 3424846 - RNA, 15 nt, Human
agcgccccucccuag

SEQ ID NO: 3424847 - RNA, 16 nt, Human
agcgcccgcugggcug

SEQ ID NO: 3424848 - RNA, 14 nt, Human
agcgcccugcagac

SEQ ID NO: 3424849 - RNA, 16 nt, Human
agcgcccugcagaccc

SEQ ID NO: 3424850 - RNA, 17 nt, Human
agcgcccugcagacccu

SEQ ID NO: 3424851 - RNA, 20 nt, Human
agcgcccuggcccccacaug

SEQ ID NO: 3424852 - RNA, 12 nt, Human
agcgcccuuccu

SEQ ID NO: 3424853 - RNA, 13 nt, Human
agcgcccuuccuc

SEQ ID NO: 3424854 - RNA, 16 nt, Human
agcgcccuuccucucc

SEQ ID NO: 3424855 - RNA, 24 nt, Human
agcgccgugaguucucagggcucc

SEQ ID NO: 3424856 - RNA, 18 nt, Human
agcgccuccaacccuagc

SEQ ID NO: 3424857 - RNA, 19 nt, Human
agcgccuccaacccuagca

SEQ ID NO: 3424858 - RNA, 22 nt, Human
agcgccuccaacccuagcaaaa

SEQ ID NO: 3424859 - RNA, 23 nt, Human
agcgccuccaacccuagcaaaag

SEQ ID NO: 3424860 - RNA, 20 nt, Human
agcgccuccauccaaggcca

SEQ ID NO: 3424861 - RNA, 15 nt, Human
agcgccucccuccac

SEQ ID NO: 3424862 - RNA, 20 nt, Human
agcgccucccuccaccccag

SEQ ID NO: 3424863 - RNA, 19 nt, Human
agcgccugccccucccaga

SEQ ID NO: 3424864 - RNA, 12 nt, Human
agcgcgccacuc

SEQ ID NO: 3424865 - RNA, 19 nt, Human
agcgcgccacucgcuuccc

SEQ ID NO: 3424866 - RNA, 15 nt, Human
agcgcggcccucccg

SEQ ID NO: 3424867 - RNA, 20 nt, Human
agcgcuagaggaagcagcca

SEQ ID NO: 3424868 - RNA, 18 nt, Human
agcgcuaucucccugccu

SEQ ID NO: 3424869 - RNA, 22 nt, Human
agcgcucagaacaguaucuuug

SEQ ID NO: 3424870 - RNA, 20 nt, Human
agcgcuccugccgcagagcu

SEQ ID NO: 3424871 - RNA, 14 nt, Human
agcgcucuggugcu

SEQ ID NO: 3424872 - RNA, 23 nt, Human
agcgcuugggcgccgugcugggc

SEQ ID NO: 3424873 - RNA, 16 nt, Human
agcgcuuucuggaaaa

SEQ ID NO: 3424874 - RNA, 14 nt, Human
agcggaaagcagcu

SEQ ID NO: 3424875 - RNA, 17 nt, Human
agcggaaagcagcucaa

SEQ ID NO: 3424876 - RNA, 17 nt, Human
agcggacaguggcagga

SEQ ID NO: 3424877 - RNA, 20 nt, Human
agcggacaguggcaggacag

SEQ ID NO: 3424878 - RNA, 20 nt, Human
agcggagaaaggaagggcug

SEQ ID NO: 3424879 - RNA, 18 nt, Human
agcggagacggaguccca

SEQ ID NO: 3424880 - RNA, 17 nt, Human
agcggagucuguccugu

SEQ ID NO: 3424881 - RNA, 18 nt, Human
agcggaugauucuucaag

SEQ ID NO: 3424882 - RNA, 16 nt, Human
agcggauugcaaagca

SEQ ID NO: 3424883 - RNA, 15 nt, Human
agcggcaucaggcuu

SEQ ID NO: 3424884 - RNA, 14 nt, Human
agcggccccuccca

SEQ ID NO: 3424885 - RNA, 19 nt, Human
agaaaguugcacggcugcu

SEQ ID NO: 3424886 - RNA, 20 nt, Human
agaaaguugcacggcugcug

SEQ ID NO: 3424887 - RNA, 20 nt, Human
agaaaguuuccccaccagug

SEQ ID NO: 3424888 - RNA, 13 nt, Human
agaaauaaaagug

SEQ ID NO: 3424889 - RNA, 14 nt, Human
agaaauaaaccuua

SEQ ID NO: 3424890 - RNA, 18 nt, Human
agaaauaaaguuugcuua

SEQ ID NO: 3424891 - RNA, 15 nt, Human
agaaauaaauagcua

SEQ ID NO: 3424892 - RNA, 21 nt, Human
agaaauaagugguuauuucuc

SEQ ID NO: 3424893 - RNA, 13 nt, Human
agaaauaauaaua

SEQ ID NO: 3424894 - RNA, 16 nt, Human
agaaauaauagaaaug

SEQ ID NO: 3424895 - RNA, 20 nt, Human
agaaauaaugcuacaauuuu

SEQ ID NO: 3424896 - RNA, 18 nt, Human
agaaauaccaaaauuauu

SEQ ID NO: 3424897 - RNA, 16 nt, Human
agaaauacuguacaau

SEQ ID NO: 3424898 - RNA, 18 nt, Human
agaaauagacaguauauu

SEQ ID NO: 3424899 - RNA, 18 nt, Human
agaaauauaauaaaaugu

SEQ ID NO: 3424900 - RNA, 15 nt, Human
agaaauauauauaca

SEQ ID NO: 3424901 - RNA, 18 nt, Human
agaaauauauauacauau

SEQ ID NO: 3424902 - RNA, 19 nt, Human
agaaauauauauacauaug

SEQ ID NO: 3424903 - RNA, 15 nt, Human
agaaauaucugugaa

SEQ ID NO: 3424904 - RNA, 17 nt, Human
agaaauaucugugaaau

SEQ ID NO: 3424905 - RNA, 13 nt, Human
agaaauaucuuca

SEQ ID NO: 3424906 - RNA, 16 nt, Human
agaaauaugauuuuau

SEQ ID NO: 3424907 - RNA, 16 nt, Human
agaaauauggaacuua

SEQ ID NO: 3424908 - RNA, 22 nt, Human
agaaauauggaacuuacauugu

SEQ ID NO: 3424909 - RNA, 15 nt, Human
agaaauaugugagau

SEQ ID NO: 3424910 - RNA, 19 nt, Human
agaaauauuuuaaaaucag

SEQ ID NO: 3424911 - RNA, 14 nt, Human
agaaaucauagcug

SEQ ID NO: 3424912 - RNA, 16 nt, Human
agaaaucauguccaua

SEQ ID NO: 3424913 - RNA, 13 nt, Human
agaaaucauguua

SEQ ID NO: 3424914 - RNA, 18 nt, Human
agaaaucauguuaugaua

SEQ ID NO: 3424915 - RNA, 21 nt, Human
agaaauccauaucuuaaagaa

SEQ ID NO: 3424916 - RNA, 21 nt, Human
agaaaucccccuuucucuaau

SEQ ID NO: 3424917 - RNA, 19 nt, Human
agaaaucccuguuuaauau

SEQ ID NO: 3424918 - RNA, 18 nt, Human
agaaauccugcaaugaaa

SEQ ID NO: 3424919 - RNA, 15 nt, Human
agaaaucuaaaaaac

SEQ ID NO: 3424920 - RNA, 15 nt, Human
agaaaucuaagcugu

SEQ ID NO: 3424921 - RNA, 17 nt, Human
agaaaucuggcuucugg

SEQ ID NO: 3424922 - RNA, 22 nt, Human
agaaaucuggucuuguuagaaa

SEQ ID NO: 3424923 - RNA, 12 nt, Human
agaaaugaaaaa

SEQ ID NO: 3424924 - RNA, 13 nt, Human
agaaaugaaaaaa

SEQ ID NO: 3424925 - RNA, 23 nt, Human
agaaaugaaaaaauauauaucaa

SEQ ID NO: 3424926 - RNA, 13 nt, Human
agaaaugaaauuu

SEQ ID NO: 3424927 - RNA, 14 nt, Human
agaaaugcaaaaau

SEQ ID NO: 3424928 - RNA, 13 nt, Human
agaaaugcacaau

SEQ ID NO: 3424929 - RNA, 23 nt, Human
agaaaugcauaugucacuagaau

SEQ ID NO: 3424930 - RNA, 15 nt, Human
agaaaugcauauugu

SEQ ID NO: 3424931 - RNA, 15 nt, Human
agaaaugcugcccau

SEQ ID NO: 3424932 - RNA, 14 nt, Human
agaaaugcugccug

SEQ ID NO: 3424933 - RNA, 23 nt, Human
agaaaugcugccugccugucugu

SEQ ID NO: 3424934 - RNA, 17 nt, Human
agaaaugcugcuggcca

SEQ ID NO: 3424935 - RNA, 23 nt, Human
agaaaugggaaaugccuaagaag

SEQ ID NO: 3424936 - RNA, 18 nt, Human
agaaaugguuguauuaga

SEQ ID NO: 3424937 - RNA, 19 nt, Human
agaaaugguuguauuagau

SEQ ID NO: 3424938 - RNA, 23 nt, Human
agaaaugguuguauuagauguuc

SEQ ID NO: 3424939 - RNA, 21 nt, Human
agaaauguaaugcgauuuuau

SEQ ID NO: 3424940 - RNA, 22 nt, Human
agaaauguaaugcgauuuuauu

SEQ ID NO: 3424941 - RNA, 15 nt, Human
agaaauguacagcaa

SEQ ID NO: 3424942 - RNA, 16 nt, Human
agaaaugucuuaauuu

SEQ ID NO: 3424943 - RNA, 13 nt, Human
agaaauuaacuua

SEQ ID NO: 3424944 - RNA, 13 nt, Human
agaaauuaaguau

SEQ ID NO: 3424945 - RNA, 18 nt, Human
agaaauuaccuguggaua

SEQ ID NO: 3424946 - RNA, 12 nt, Human
agaaauuagaaa

SEQ ID NO: 3424947 - RNA, 14 nt, Human
agaaauuagccggg

SEQ ID NO: 3424948 - RNA, 22 nt, Human
agaaauuagggcucuaauuucc

SEQ ID NO: 3424949 - RNA, 22 nt, Human
agaaauuaugugccagauuuau

SEQ ID NO: 3424950 - RNA, 23 nt, Human
agaaauucccuggaccagaugcu

SEQ ID NO: 3424951 - RNA, 19 nt, Human
agaaauuccuguagcaucu

SEQ ID NO: 3424952 - RNA, 23 nt, Human
agaaauucguguguuuuuuuaug

SEQ ID NO: 3424953 - RNA, 21 nt, Human
agaaauucuguuaaaaucuau

SEQ ID NO: 3424954 - RNA, 18 nt, Human
agaaauugguaccuugca

SEQ ID NO: 3424955 - RNA, 19 nt, Human
agaaauugguaccuugcac

SEQ ID NO: 3424956 - RNA, 14 nt, Human
agaaauuguauauu

SEQ ID NO: 3424957 - RNA, 21 nt, Human
agaaauuguauauuguaauuu

SEQ ID NO: 3424958 - RNA, 13 nt, Human
agaaauuuaaacu

SEQ ID NO: 3424959 - RNA, 16 nt, Human
agaaauuuaaacuaua

SEQ ID NO: 3424960 - RNA, 17 nt, Human
agaaauuuaauucagaa

SEQ ID NO: 3424961 - RNA, 21 nt, Human
agaaauuuaauucauguuucu

SEQ ID NO: 3424962 - RNA, 13 nt, Human
agaaauuuacuau

SEQ ID NO: 3424963 - RNA, 16 nt, Human
agaaauuuauaaacuu

SEQ ID NO: 3424964 - RNA, 23 nt, Human
agaaauuuauuuccuaguucugu

SEQ ID NO: 3424965 - RNA, 19 nt, Human
agaaauuucagguuguugg

SEQ ID NO: 3424966 - RNA, 17 nt, Human
agaaauuucugugaaac

SEQ ID NO: 3424967 - RNA, 15 nt, Human
agaaauuugauuucu

SEQ ID NO: 3424968 - RNA, 22 nt, Human
agaaauuuuacaauaggugcuu

SEQ ID NO: 3424969 - RNA, 13 nt, Human
agaaauuuucaag

SEQ ID NO: 3424970 - RNA, 17 nt, Human
agaaauuuuucagaugc

SEQ ID NO: 3424971 - RNA, 18 nt, Human
agaaauuuuucagaugcu

SEQ ID NO: 3424972 - RNA, 13 nt, Human
agaacaaagcugu

SEQ ID NO: 3424973 - RNA, 18 nt, Human
agcuacagugcauaguug

SEQ ID NO: 3424974 - RNA, 15 nt, Human
agcuacauaauuuag

SEQ ID NO: 3424975 - RNA, 16 nt, Human
agcuacaucuacuuaa

SEQ ID NO: 3424976 - RNA, 17 nt, Human
agcuacccacuauccuu

SEQ ID NO: 3424977 - RNA, 15 nt, Human
agcuacccuuuuccu

SEQ ID NO: 3424978 - RNA, 16 nt, Human
agcuaccucaaacuuc

SEQ ID NO: 3424979 - RNA, 19 nt, Human
agcuaccuguguggacagg

SEQ ID NO: 3424980 - RNA, 21 nt, Human
agcuacucaagaggcugaggc

SEQ ID NO: 3424981 - RNA, 15 nt, Human
agcuacucagaagcc

SEQ ID NO: 3424982 - RNA, 19 nt, Human
agcuacucagaagccugag

SEQ ID NO: 3424983 - RNA, 21 nt, Human
agcuacucagaagccugaggc

SEQ ID NO: 3424984 - RNA, 18 nt, Human
agcuacucaggaggcuga

SEQ ID NO: 3424985 - RNA, 23 nt, Human
agcuacucgggaggcugaggcac

SEQ ID NO: 3424986 - RNA, 23 nt, Human
agcuacucuccccacgagggcug

SEQ ID NO: 3424987 - RNA, 20 nt, Human
agcuacugauuuccuuugga

SEQ ID NO: 3424988 - RNA, 16 nt, Human
agcuacugccauccug

SEQ ID NO: 3424989 - RNA, 19 nt, Human
agcuacugcggaaaaggaa

SEQ ID NO: 3424990 - RNA, 17 nt, Human
agcuacuuaagagaaau

SEQ ID NO: 3424991 - RNA, 22 nt, Human
agcuacuugggaagcugaggcg

SEQ ID NO: 3424992 - RNA, 17 nt, Human
agcuacuugggaggcug

SEQ ID NO: 3424993 - RNA, 21 nt, Human
agcuacuugggaggcugaggc

SEQ ID NO: 3424994 - RNA, 13 nt, Human
agcuacuugggcc

SEQ ID NO: 3424995 - RNA, 19 nt, Human
agcuacuugggccauagcu

SEQ ID NO: 3424996 - RNA, 11 nt, Human
agcuagaaaug

SEQ ID NO: 3424997 - RNA, 12 nt, Human
agcuagaaauga

SEQ ID NO: 3424998 - RNA, 15 nt, Human
agcuagaaccuggag

SEQ ID NO: 3424999 - RNA, 18 nt, Human
agcuagaaccuggagagc

SEQ ID NO: 3425000 - RNA, 16 nt, Human
agcuagaaccuggagg

SEQ ID NO: 3425001 - RNA, 15 nt, Human
agcuagaaggccaca

SEQ ID NO: 3425002 - RNA, 22 nt, Human
agcuagaagugggccaggacag

SEQ ID NO: 3425003 - RNA, 20 nt, Human
agcuagaauugaguguuuaa

SEQ ID NO: 3425004 - RNA, 13 nt, Human
agcuagaauuuga

SEQ ID NO: 3425005 - RNA, 15 nt, Human
agcuagacacaugaa

SEQ ID NO: 3425006 - RNA, 13 nt, Human
agcuagacuggug

SEQ ID NO: 3425007 - RNA, 20 nt, Human
agcuagcaaaagaaguaaca

SEQ ID NO: 3425008 - RNA, 23 nt, Human
agcuagcaaaagaaguaacaaga

SEQ ID NO: 3425009 - RNA, 14 nt, Human
agcuagcgcugccg

SEQ ID NO: 3425010 - RNA, 16 nt, Human
agcuagcgcugccgca

SEQ ID NO: 3425011 - RNA, 20 nt, Human
agcuagcgcugccgcacccc

SEQ ID NO: 3425012 - RNA, 15 nt, Human
agcuagcuccccucc

SEQ ID NO: 3425013 - RNA, 21 nt, Human
agcuagcuccccuccucuccc

SEQ ID NO: 3425014 - RNA, 15 nt, Human
agcuagcuuuuagga

SEQ ID NO: 3425015 - RNA, 17 nt, Human
agcuaggaaaagaaauc

SEQ ID NO: 3425016 - RNA, 16 nt, Human
agcuaggaacaaaucu

SEQ ID NO: 3425017 - RNA, 17 nt, Human
agcuaggagcaaagccu

SEQ ID NO: 3425018 - RNA, 21 nt, Human
agcuaggagcaaagccuguuc

SEQ ID NO: 3425019 - RNA, 20 nt, Human
agcuaggugacauauacaua

SEQ ID NO: 3425020 - RNA, 19 nt, Human
agcuagucuuuugcuuuug

SEQ ID NO: 3425021 - RNA, 19 nt, Human
agcuaguguaccuccucuc

SEQ ID NO: 3425022 - RNA, 18 nt, Human
agcuaguucguagcuuuc

SEQ ID NO: 3425023 - RNA, 15 nt, Human
agcuaguugaauacu

SEQ ID NO: 3425024 - RNA, 22 nt, Human
agcuaguugaauacuugaacca

SEQ ID NO: 3425025 - RNA, 12 nt, Human
agcuaguuuucu

SEQ ID NO: 3425026 - RNA, 18 nt, Human
agcuauaaaaugaauaca

SEQ ID NO: 3425027 - RNA, 16 nt, Human
agcuauaaauuauauu

SEQ ID NO: 3425028 - RNA, 18 nt, Human
agcuauaauuauuauuca

SEQ ID NO: 3425029 - RNA, 19 nt, Human
agcuauacaguuuuccuaa

SEQ ID NO: 3425030 - RNA, 15 nt, Human
agcuauaccugugcc

SEQ ID NO: 3425031 - RNA, 13 nt, Human
agcuauaggaaau

SEQ ID NO: 3425032 - RNA, 17 nt, Human
agcuauauaagacaaga

SEQ ID NO: 3425033 - RNA, 15 nt, Human
agcuauauccaugua

SEQ ID NO: 3425034 - RNA, 15 nt, Human
agcuauaucuauaua

SEQ ID NO: 3425035 - RNA, 22 nt, Human
agcuauauuuaaguauucaaga

SEQ ID NO: 3425036 - RNA, 14 nt, Human
agcuaucaggaaca

SEQ ID NO: 3425037 - RNA, 18 nt, Human
agcuaucaguaggcuaau

SEQ ID NO: 3425038 - RNA, 20 nt, Human
agcuaucauugcuuccuccu

SEQ ID NO: 3425039 - RNA, 16 nt, Human
agcuauccuggcucuu

SEQ ID NO: 3425040 - RNA, 18 nt, Human
agcuaucuaaaguuuguu

SEQ ID NO: 3425041 - RNA, 15 nt, Human
agcuaucuaggugga

SEQ ID NO: 3425042 - RNA, 18 nt, Human
agcuaucuagguggaguu

SEQ ID NO: 3425043 - RNA, 22 nt, Human
agcuaucuggucaaccuccugg

SEQ ID NO: 3425044 - RNA, 19 nt, Human
agaacccagcccacccccg

SEQ ID NO: 3425045 - RNA, 13 nt, Human
agaacccagggcu

SEQ ID NO: 3425046 - RNA, 18 nt, Human
agaacccagggcucugcc

SEQ ID NO: 3425047 - RNA, 20 nt, Human
agaacccagggcucugcccc

SEQ ID NO: 3425048 - RNA, 21 nt, Human
agaacccagggcucugcccca

SEQ ID NO: 3425049 - RNA, 22 nt, Human
agaaccccuggcuccaggccag

SEQ ID NO: 3425050 - RNA, 18 nt, Human
agaaccgagcaaagauca

SEQ ID NO: 3425051 - RNA, 20 nt, Human
agaaccgagcaaagaucaaa

SEQ ID NO: 3425052 - RNA, 19 nt, Human
agaaccguagaugauuuca

SEQ ID NO: 3425053 - RNA, 16 nt, Human
agaaccuaacuguauc

SEQ ID NO: 3425054 - RNA, 20 nt, Human
agaaccuaacuguaucuuga

SEQ ID NO: 3425055 - RNA, 21 nt, Human
agaaccuaacuguaucuugag

SEQ ID NO: 3425056 - RNA, 19 nt, Human
agaaccuaauucaauucaa

SEQ ID NO: 3425057 - RNA, 16 nt, Human
agaaccuagaagggcu

SEQ ID NO: 3425058 - RNA, 14 nt, Human
agaaccucuucccc

SEQ ID NO: 3425059 - RNA, 12 nt, Human
agaaccuggagg

SEQ ID NO: 3425060 - RNA, 17 nt, Human
agaaccuggagggcugg

SEQ ID NO: 3425061 - RNA, 17 nt, Human
agaaccuggaguuccug

SEQ ID NO: 3425062 - RNA, 12 nt, Human
agaaccuggccu

SEQ ID NO: 3425063 - RNA, 21 nt, Human
agaaccuggguugcagacagg

SEQ ID NO: 3425064 - RNA, 17 nt, Human
agaaccuguagagcuag

SEQ ID NO: 3425065 - RNA, 13 nt, Human
agaaccuguccuu

SEQ ID NO: 3425066 - RNA, 14 nt, Human
agaaccuguccuug

SEQ ID NO: 3425067 - RNA, 12 nt, Human
agaaccuucucu

SEQ ID NO: 3425068 - RNA, 17 nt, Human
agaaccuugugccuggc

SEQ ID NO: 3425069 - RNA, 22 nt, Human
agaacgcagcccuagagccugc

SEQ ID NO: 3425070 - RNA, 21 nt, Human
agaacggagccccaggccucu

SEQ ID NO: 3425071 - RNA, 17 nt, Human
agaacggggcucuucuc

SEQ ID NO: 3425072 - RNA, 20 nt, Human
agaacggggcucuucucauu

SEQ ID NO: 3425073 - RNA, 22 nt, Human
agaacguauugguccagcuugc

SEQ ID NO: 3425074 - RNA, 18 nt, Human
agaacguggcucugcugg

SEQ ID NO: 3425075 - RNA, 19 nt, Human
agaacguggcucugcuggc

SEQ ID NO: 3425076 - RNA, 13 nt, Human
agaacguggucag

SEQ ID NO: 3425077 - RNA, 12 nt, Human
agaacuaaacuc

SEQ ID NO: 3425078 - RNA, 20 nt, Human
agaacuaaagguggccacaa

SEQ ID NO: 3425079 - RNA, 12 nt, Human
agaacuaaaugu

SEQ ID NO: 3425080 - RNA, 15 nt, Human
agaacuaaauguucu

SEQ ID NO: 3425081 - RNA, 20 nt, Human
agaacuaccuggauuuguau

SEQ ID NO: 3425082 - RNA, 17 nt, Human
agaacuagaauuugauu

SEQ ID NO: 3425083 - RNA, 20 nt, Human
agaacuagugguggcucuga

SEQ ID NO: 3425084 - RNA, 19 nt, Human
agaacuauaugugaauccu

SEQ ID NO: 3425085 - RNA, 13 nt, Human
agaacuaucuuca

SEQ ID NO: 3425086 - RNA, 23 nt, Human
agaacuauugugcucagagacac

SEQ ID NO: 3425087 - RNA, 20 nt, Human
agaacucaaacuucuggcuc

SEQ ID NO: 3425088 - RNA, 19 nt, Human
agaacucaaauggggccag

SEQ ID NO: 3425089 - RNA, 20 nt, Human
agaacucaaauggggccaga

SEQ ID NO: 3425090 - RNA, 19 nt, Human
agaacucacucugggcugu

SEQ ID NO: 3425091 - RNA, 20 nt, Human
agaacucacucugggcugua

SEQ ID NO: 3425092 - RNA, 15 nt, Human
agaacucaucacugu

SEQ ID NO: 3425093 - RNA, 15 nt, Human
agaacucaugugauu

SEQ ID NO: 3425094 - RNA, 18 nt, Human
agaacucaugugauuuac

SEQ ID NO: 3425095 - RNA, 16 nt, Human
agaacucccuuucaac

SEQ ID NO: 3425096 - RNA, 14 nt, Human
agaacuccuagggu

SEQ ID NO: 3425097 - RNA, 11 nt, Human
agaacuccuga

SEQ ID NO: 3425098 - RNA, 20 nt, Human
agaacucgcgcucaguaaac

SEQ ID NO: 3425099 - RNA, 18 nt, Human
agaacucgguguccccac

SEQ ID NO: 3425100 - RNA, 19 nt, Human
agaacucgguguccccacc

SEQ ID NO: 3425101 - RNA, 13 nt, Human
agaacucucugga

SEQ ID NO: 3425102 - RNA, 16 nt, Human
agaacucucuggaagc

SEQ ID NO: 3425103 - RNA, 21 nt, Human
agaacucucuggaagccccug

SEQ ID NO: 3425104 - RNA, 14 nt, Human
agaacucugggcug

SEQ ID NO: 3425105 - RNA, 13 nt, Human
agaacugaaaaca

SEQ ID NO: 3425106 - RNA, 19 nt, Human
agaacugaaaacauaaaaa

SEQ ID NO: 3425107 - RNA, 21 nt, Human
agaacugaaaacauaaaaagu

SEQ ID NO: 3425108 - RNA, 13 nt, Human
agaacugaaaaga

SEQ ID NO: 3425109 - RNA, 17 nt, Human
agaacugaaaagagagc

SEQ ID NO: 3425110 - RNA, 16 nt, Human
agaacugaaaggcuuu

SEQ ID NO: 3425111 - RNA, 21 nt, Human
agaacugaauuuugucuuuau

SEQ ID NO: 3425112 - RNA, 12 nt, Human
agaacugagcuc

SEQ ID NO: 3425113 - RNA, 17 nt, Human
agaacugaugacacuga

SEQ ID NO: 3425114 - RNA, 17 nt, Human
agaacugcacaugaaga

SEQ ID NO: 3425115 - RNA, 19 nt, Human
agaacugcacaugaagaaa

SEQ ID NO: 3425116 - RNA, 20 nt, Human
agaacugcacaugaagaaau

SEQ ID NO: 3425117 - RNA, 12 nt, Human
agaacugcaggc

SEQ ID NO: 3425118 - RNA, 11 nt, Human
agaagcugcug

SEQ ID NO: 3425119 - RNA, 13 nt, Human
agaagcugcugac

SEQ ID NO: 3425120 - RNA, 23 nt, Human
agaagcuguuguacauuuaugau

SEQ ID NO: 3425121 - RNA, 12 nt, Human
agaagcuucuaa

SEQ ID NO: 3425122 - RNA, 22 nt, Human
agaagcuucuaauaaauuauac

SEQ ID NO: 3425123 - RNA, 22 nt, Human
agaagcuuuugaauaaaaacuu

SEQ ID NO: 3425124 - RNA, 17 nt, Human
agaaggaaaaaugugua

SEQ ID NO: 3425125 - RNA, 16 nt, Human
agaaggaaaaggcagg

SEQ ID NO: 3425126 - RNA, 15 nt, Human
agaaggaaagauggu

SEQ ID NO: 3425127 - RNA, 19 nt, Human
agaaggaaagaugguuaaa

SEQ ID NO: 3425128 - RNA, 22 nt, Human
agaaggaaggagacucaccucu

SEQ ID NO: 3425129 - RNA, 11 nt, Human
agaaggaaugu

SEQ ID NO: 3425130 - RNA, 14 nt, Human
agaaggaaugucuu

SEQ ID NO: 3425131 - RNA, 17 nt, Human
agaaggagacagagcug

SEQ ID NO: 3425132 - RNA, 22 nt, Human
agaaggaggagagggaaaaugu

SEQ ID NO: 3425133 - RNA, 23 nt, Human
agaaggaggagagggaaaauguu

SEQ ID NO: 3425134 - RNA, 16 nt, Human
agaaggaucuucaucu

SEQ ID NO: 3425135 - RNA, 21 nt, Human
agaaggaugaaugagguccca

SEQ ID NO: 3425136 - RNA, 16 nt, Human
agaaggauguacauuu

SEQ ID NO: 3425137 - RNA, 19 nt, Human
agaaggcaaaaauaguuug

SEQ ID NO: 3425138 - RNA, 14 nt, Human
agaaggccacaugu

SEQ ID NO: 3425139 - RNA, 12 nt, Human
agaaggcucuuc

SEQ ID NO: 3425140 - RNA, 12 nt, Human
agaagggaaaca

SEQ ID NO: 3425141 - RNA, 14 nt, Human
agaagggaaacagu

SEQ ID NO: 3425142 - RNA, 14 nt, Human
agaagggagaagaa

SEQ ID NO: 3425143 - RNA, 15 nt, Human
agaagggagaagaaa

SEQ ID NO: 3425144 - RNA, 16 nt, Human
agaagggagaagaaag

SEQ ID NO: 3425145 - RNA, 13 nt, Human
agaagggagaagg

SEQ ID NO: 3425146 - RNA, 14 nt, Human
agaagggagaagga

SEQ ID NO: 3425147 - RNA, 15 nt, Human
agaagggagggcaga

SEQ ID NO: 3425148 - RNA, 20 nt, Human
agaagggccaguccugccug

SEQ ID NO: 3425149 - RNA, 13 nt, Human
agaagggcuagaa

SEQ ID NO: 3425150 - RNA, 21 nt, Human
agaagggcuagaaccuggagg

SEQ ID NO: 3425151 - RNA, 15 nt, Human
agaagggcugcauga

SEQ ID NO: 3425152 - RNA, 16 nt, Human
agaagggcugcaugau

SEQ ID NO: 3425153 - RNA, 21 nt, Human
agaagggcugcuucccugaag

SEQ ID NO: 3425154 - RNA, 16 nt, Human
agaaggggaagcacuc

SEQ ID NO: 3425155 - RNA, 19 nt, Human
agaaggggacugccaccuc

SEQ ID NO: 3425156 - RNA, 20 nt, Human
agaaggggacugccaccucc

SEQ ID NO: 3425157 - RNA, 19 nt, Human
agaagggggucaaagcaag

SEQ ID NO: 3425158 - RNA, 21 nt, Human
agaagggggucaaagcaagga

SEQ ID NO: 3425159 - RNA, 20 nt, Human
agaaggggguggugucucca

SEQ ID NO: 3425160 - RNA, 16 nt, Human
agaaggguuauauuuu

SEQ ID NO: 3425161 - RNA, 19 nt, Human
agaaggguuauauuuuacu

SEQ ID NO: 3425162 - RNA, 23 nt, Human
agaagguauuaagauuauaauug

SEQ ID NO: 3425163 - RNA, 14 nt, Human
agaaggugggagga

SEQ ID NO: 3425164 - RNA, 20 nt, Human
agaagguggggguuggcugg

SEQ ID NO: 3425165 - RNA, 23 nt, Human
agaagguggggguuggcugggua

SEQ ID NO: 3425166 - RNA, 17 nt, Human
agaagguuuguguuuuu

SEQ ID NO: 3425167 - RNA, 19 nt, Human
agaagguuuguguuuuucu

SEQ ID NO: 3425168 - RNA, 20 nt, Human
agaagguuuguguuuuucug

SEQ ID NO: 3425169 - RNA, 22 nt, Human
agaaguaacuggugauauaucu

SEQ ID NO: 3425170 - RNA, 14 nt, Human
agaaguaacuuacu

SEQ ID NO: 3425171 - RNA, 16 nt, Human
agaaguaccagacuag

SEQ ID NO: 3425172 - RNA, 17 nt, Human
agaaguagaaaucauag

SEQ ID NO: 3425173 - RNA, 19 nt, Human
agaaguagauuaagagcca

SEQ ID NO: 3425174 - RNA, 16 nt, Human
agaaguagccacagua

SEQ ID NO: 3425175 - RNA, 18 nt, Human
agaaguaggggaagaaua

SEQ ID NO: 3425176 - RNA, 23 nt, Human
agaaguagugucuggaucaguaa

SEQ ID NO: 3425177 - RNA, 16 nt, Human
agaaguauaaagaauu

SEQ ID NO: 3425178 - RNA, 13 nt, Human
agaaguauacaua

SEQ ID NO: 3425179 - RNA, 14 nt, Human
agaaguauuuuuag

SEQ ID NO: 3425180 - RNA, 15 nt, Human
agaagucaacauccu

SEQ ID NO: 3425181 - RNA, 14 nt, Human
agaagucacagggc

SEQ ID NO: 3425182 - RNA, 19 nt, Human
agaagucacagggcaguac

SEQ ID NO: 3425183 - RNA, 21 nt, Human
agaagucacagggcaguaccu

SEQ ID NO: 3425184 - RNA, 20 nt, Human
agaagucacauuccugaaca

SEQ ID NO: 3425185 - RNA, 13 nt, Human
agaagucaugaag

SEQ ID NO: 3425186 - RNA, 22 nt, Human
agaaguccuguaugucugucau

SEQ ID NO: 3425187 - RNA, 15 nt, Human
agaaguccuuauguu

SEQ ID NO: 3425188 - RNA, 17 nt, Human
agaaguccuuauguuaa

SEQ ID NO: 3425189 - RNA, 14 nt, Human
agaagucucagcua

SEQ ID NO: 3425190 - RNA, 15 nt, Human
agaagucucuuccag

SEQ ID NO: 3425191 - RNA, 13 nt, Human
agaagucuucaug

SEQ ID NO: 3425192 - RNA, 18 nt, Human
agaagucuucaugaaaug

SEQ ID NO: 3425193 - RNA, 16 nt, Human
agaagugaaugcuggg

SEQ ID NO: 3425194 - RNA, 17 nt, Human
agaagugaaugcuggga

SEQ ID NO: 3425195 - RNA, 21 nt, Human
agaagugaaugcugggacuca

SEQ ID NO: 3425196 - RNA, 17 nt, Human
agaagugacagggaagc

SEQ ID NO: 3425197 - RNA, 23 nt, Human
agaagugacagggaagcuacagg

SEQ ID NO: 3425198 - RNA, 16 nt, Human
agaagugacauugcau

SEQ ID NO: 3425199 - RNA, 23 nt, Human
agaagugacgguuccuacacagg

SEQ ID NO: 3425200 - RNA, 18 nt, Human
agaagugagaauaggcag

SEQ ID NO: 3425201 - RNA, 14 nt, Human
agaagugagcaaaa

SEQ ID NO: 3425202 - RNA, 23 nt, Human
agaagugagcuuugcugcuacag

SEQ ID NO: 3425203 - RNA, 18 nt, Human
agcuaucuucauguaaau

SEQ ID NO: 3425204 - RNA, 20 nt, Human
agcuaucuucauguaaauug

SEQ ID NO: 3425205 - RNA, 17 nt, Human
agcuaugcaaaaagcua

SEQ ID NO: 3425206 - RNA, 15 nt, Human
agcuaugcuguaucu

SEQ ID NO: 3425207 - RNA, 20 nt, Human
agcuauggacagcauugcca

SEQ ID NO: 3425208 - RNA, 19 nt, Human
agcuaugggagccccaggg

SEQ ID NO: 3425209 - RNA, 20 nt, Human
agcuauggugagaugcagcu

SEQ ID NO: 3425210 - RNA, 17 nt, Human
agcuaugucaagaggcu

SEQ ID NO: 3425211 - RNA, 20 nt, Human
agcuaugucccaggaaucag

SEQ ID NO: 3425212 - RNA, 22 nt, Human
agcuauguuauauugaaaaaau

SEQ ID NO: 3425213 - RNA, 13 nt, Human
agcuauuaaaacu

SEQ ID NO: 3425214 - RNA, 14 nt, Human
agcuauuaaaacuc

SEQ ID NO: 3425215 - RNA, 19 nt, Human
agcuauucaguaauaacuc

SEQ ID NO: 3425216 - RNA, 21 nt, Human
agcuauucaguugguaagcuu

SEQ ID NO: 3425217 - RNA, 21 nt, Human
agcuauuccuuucccuuccuc

SEQ ID NO: 3425218 - RNA, 22 nt, Human
agcuauuccuuucccuuccucu

SEQ ID NO: 3425219 - RNA, 23 nt, Human
agcuauugauauaaauaaaacau

SEQ ID NO: 3425220 - RNA, 14 nt, Human
agcuauuucaucua

SEQ ID NO: 3425221 - RNA, 17 nt, Human
agcuauuugauguaaua

SEQ ID NO: 3425222 - RNA, 10 nt, Human
agcuauuuuu

SEQ ID NO: 3425223 - RNA, 16 nt, Human
agcuauuuuuacuaga

SEQ ID NO: 3425224 - RNA, 22 nt, Human
agcuauuuuuauuuguuugugc

SEQ ID NO: 3425225 - RNA, 13 nt, Human
agcuauuuuucua

SEQ ID NO: 3425226 - RNA, 14 nt, Human
agcuauuuuucuaa

SEQ ID NO: 3425227 - RNA, 20 nt, Human
agcuauuuuucuaacuacaa

SEQ ID NO: 3425228 - RNA, 20 nt, Human
agcucaaagguuuggaagga

SEQ ID NO: 3425229 - RNA, 16 nt, Human
agcucaaaugaaaugu

SEQ ID NO: 3425230 - RNA, 14 nt, Human
agcucaacucucuu

SEQ ID NO: 3425231 - RNA, 19 nt, Human
agcucaaggaaaggccuga

SEQ ID NO: 3425232 - RNA, 14 nt, Human
agcucaaugagcau

SEQ ID NO: 3425233 - RNA, 15 nt, Human
agcucaaugagcaug

SEQ ID NO: 3425234 - RNA, 23 nt, Human
agcucaaugagcauguuuagacu

SEQ ID NO: 3425235 - RNA, 13 nt, Human
agcucaaugcagu

SEQ ID NO: 3425236 - RNA, 14 nt, Human
agcucacaaggcag

SEQ ID NO: 3425237 - RNA, 18 nt, Human
agcucacaaggcagcaag

SEQ ID NO: 3425238 - RNA, 16 nt, Human
agcucacacaugagau

SEQ ID NO: 3425239 - RNA, 20 nt, Human
agcucacaguuccucgcccu

SEQ ID NO: 3425240 - RNA, 21 nt, Human
agcucacaguuccucgcccug

SEQ ID NO: 3425241 - RNA, 14 nt, Human
agcucaccagcccc

SEQ ID NO: 3425242 - RNA, 16 nt, Human
agcucaccagccccag

SEQ ID NO: 3425243 - RNA, 23 nt, Human
agcucaccagccccagugcccac

SEQ ID NO: 3425244 - RNA, 14 nt, Human
agcucaccccccac

SEQ ID NO: 3425245 - RNA, 17 nt, Human
agcucaccccccacacu

SEQ ID NO: 3425246 - RNA, 12 nt, Human
agcucaccucuc

SEQ ID NO: 3425247 - RNA, 18 nt, Human
agcucaccucucccuugg

SEQ ID NO: 3425248 - RNA, 17 nt, Human
agcucaccuguugcuua

SEQ ID NO: 3425249 - RNA, 21 nt, Human
agcucaccuguugcuuacaau

SEQ ID NO: 3425250 - RNA, 15 nt, Human
agcucacgcuucaca

SEQ ID NO: 3425251 - RNA, 16 nt, Human
agcucacgucacacuu

SEQ ID NO: 3425252 - RNA, 20 nt, Human
agcucacguccugagaaagc

SEQ ID NO: 3425253 - RNA, 13 nt, Human
agcucacuucugg

SEQ ID NO: 3425254 - RNA, 15 nt, Human
agcucagaacccagg

SEQ ID NO: 3425255 - RNA, 22 nt, Human
agcucagaauccaagugaacac

SEQ ID NO: 3425256 - RNA, 16 nt, Human
agcucagagagggcag

SEQ ID NO: 3425257 - RNA, 14 nt, Human
agcucagagagggu

SEQ ID NO: 3425258 - RNA, 17 nt, Human
agcucagcacugccugc

SEQ ID NO: 3425259 - RNA, 14 nt, Human
agcucagcccaccc

SEQ ID NO: 3425260 - RNA, 15 nt, Human
agcucagcccacccc

SEQ ID NO: 3425261 - RNA, 19 nt, Human
agcucagcccaccccccuc

SEQ ID NO: 3425262 - RNA, 22 nt, Human
agcucagcccaccccccucauu

SEQ ID NO: 3425263 - RNA, 12 nt, Human
agcuuccagcag

SEQ ID NO: 3425264 - RNA, 14 nt, Human
agcuuccaggaaaa

SEQ ID NO: 3425265 - RNA, 20 nt, Human
agcuucccccccaccacagg

SEQ ID NO: 3425266 - RNA, 16 nt, Human
agcuuccgagaauagc

SEQ ID NO: 3425267 - RNA, 20 nt, Human
agcuuccuguccccaucugu

SEQ ID NO: 3425268 - RNA, 22 nt, Human
agcuuccuuaaguauaucaugu

SEQ ID NO: 3425269 - RNA, 12 nt, Human
agcuuccuucag

SEQ ID NO: 3425270 - RNA, 13 nt, Human
agcuuccuucaga

SEQ ID NO: 3425271 - RNA, 15 nt, Human
agcuuccuucagaga

SEQ ID NO: 3425272 - RNA, 18 nt, Human
agcuuccuucagagagca

SEQ ID NO: 3425273 - RNA, 19 nt, Human
agcuuccuucagagagcag

SEQ ID NO: 3425274 - RNA, 14 nt, Human
agcuuccuuggcuu

SEQ ID NO: 3425275 - RNA, 23 nt, Human
agcuuccuuuguuuuuuuuuccu

SEQ ID NO: 3425276 - RNA, 17 nt, Human
agcuucuaucccaggag

SEQ ID NO: 3425277 - RNA, 17 nt, Human
agcuucuauuagccagu

SEQ ID NO: 3425278 - RNA, 19 nt, Human
agcuucucauccugcaggc

SEQ ID NO: 3425279 - RNA, 21 nt, Human
agcuucuccugugugauugac

SEQ ID NO: 3425280 - RNA, 13 nt, Human
agcuucucuguga

SEQ ID NO: 3425281 - RNA, 14 nt, Human
agcuucucugugaa

SEQ ID NO: 3425282 - RNA, 14 nt, Human
agcuucucuuuaac

SEQ ID NO: 3425283 - RNA, 18 nt, Human
agcuucucuuuaacucag

SEQ ID NO: 3425284 - RNA, 18 nt, Human
agcuucugaccucagcau

SEQ ID NO: 3425285 - RNA, 17 nt, Human
agcuucugccacauaaa

SEQ ID NO: 3425286 - RNA, 13 nt, Human
agcuucugccacu

SEQ ID NO: 3425287 - RNA, 19 nt, Human
agcuucugcccccugcaga

SEQ ID NO: 3425288 - RNA, 16 nt, Human
agcuucugcugggcug

SEQ ID NO: 3425289 - RNA, 18 nt, Human
agcuucugcugggcuggg

SEQ ID NO: 3425290 - RNA, 17 nt, Human
agcuucugcuuuucugc

SEQ ID NO: 3425291 - RNA, 19 nt, Human
agcuucugcuuuucugccc

SEQ ID NO: 3425292 - RNA, 20 nt, Human
agcuucugcuuuucugcccu

SEQ ID NO: 3425293 - RNA, 21 nt, Human
agcuucugggguccccagggc

SEQ ID NO: 3425294 - RNA, 14 nt, Human
agcuucugguacuc

SEQ ID NO: 3425295 - RNA, 16 nt, Human
agcuucugguacucuc

SEQ ID NO: 3425296 - RNA, 21 nt, Human
agcuucugguacucuccuaga

SEQ ID NO: 3425297 - RNA, 14 nt, Human
agcuucugucucca

SEQ ID NO: 3425298 - RNA, 19 nt, Human
agcuucuguugcugccuca

SEQ ID NO: 3425299 - RNA, 20 nt, Human
agcuucuuaauauaacugcc

SEQ ID NO: 3425300 - RNA, 23 nt, Human
agcuucuuaauauaacugccuua

SEQ ID NO: 3425301 - RNA, 13 nt, Human
agcuucuuaauua

SEQ ID NO: 3425302 - RNA, 19 nt, Human
agcuucuuaauuaauuuga

SEQ ID NO: 3425303 - RNA, 18 nt, Human
agcuucuuguuuccuugu

SEQ ID NO: 3425304 - RNA, 22 nt, Human
agcuugaaaguuuucagaaccu

SEQ ID NO: 3425305 - RNA, 19 nt, Human
agcuugaaggaucuguuuu

SEQ ID NO: 3425306 - RNA, 19 nt, Human
agcuugaccgugaggccag

SEQ ID NO: 3425307 - RNA, 20 nt, Human
agcuugaccugaggcugugg

SEQ ID NO: 3425308 - RNA, 13 nt, Human
agcuugacuccca

SEQ ID NO: 3425309 - RNA, 21 nt, Human
agcuugagccgggccccuggg

SEQ ID NO: 3425310 - RNA, 23 nt, Human
agcuugagccgggccccugggcu

SEQ ID NO: 3425311 - RNA, 24 nt, Human
agcuugagccgggccccugggcuu

SEQ ID NO: 3425312 - RNA, 14 nt, Human
agcuugaggguugg

SEQ ID NO: 3425313 - RNA, 22 nt, Human
agcuugauguuggaucucaaga

SEQ ID NO: 3425314 - RNA, 14 nt, Human
agcuugcacauuug

SEQ ID NO: 3425315 - RNA, 16 nt, Human
agcuugccagaugcug

SEQ ID NO: 3425316 - RNA, 18 nt, Human
agcuugccccggccccgg

SEQ ID NO: 3425317 - RNA, 20 nt, Human
agcuugcccuggugccucac

SEQ ID NO: 3425318 - RNA, 22 nt, Human
agcuugcgcauucucauggaga

SEQ ID NO: 3425319 - RNA, 19 nt, Human
agcuugcucuucaguggga

SEQ ID NO: 3425320 - RNA, 16 nt, Human
agcuugcugcccuagg

SEQ ID NO: 3425321 - RNA, 23 nt, Human
agcuuggaaacuggaugagguca

SEQ ID NO: 3425322 - RNA, 14 nt, Human
agcuuggcagccga

SEQ ID NO: 3425323 - RNA, 17 nt, Human
agcuuggcagccgagcu

SEQ ID NO: 3425324 - RNA, 12 nt, Human
agcuugggaaug

SEQ ID NO: 3425325 - RNA, 14 nt, Human
agcuugggaaugga

SEQ ID NO: 3425326 - RNA, 15 nt, Human
agcuugggagagccc

SEQ ID NO: 3425327 - RNA, 19 nt, Human
agcuugggagagccccugg

SEQ ID NO: 3425328 - RNA, 18 nt, Human
agcuugggaggcuucccc

SEQ ID NO: 3425329 - RNA, 17 nt, Human
agcuugggcagaucucc

SEQ ID NO: 3425330 - RNA, 21 nt, Human
agcuugggcagaucucccaca

SEQ ID NO: 3425331 - RNA, 16 nt, Human
agcuugggcccagcug

SEQ ID NO: 3425332 - RNA, 19 nt, Human
agcuugggcccagcugggc

SEQ ID NO: 3425333 - RNA, 20 nt, Human
agcuugggcccagcugggcu

SEQ ID NO: 3425334 - RNA, 23 nt, Human
agcuuggggacaggggcaggagg

SEQ ID NO: 3425335 - RNA, 17 nt, Human
agcuuggggcaacauug

SEQ ID NO: 3425336 - RNA, 23 nt, Human
agcuuggggccaccaaagcugcc

SEQ ID NO: 3425337 - RNA, 15 nt, Human
agcuuggggccaggg

SEQ ID NO: 3425338 - RNA, 16 nt, Human
agcuuggggccaggga

SEQ ID NO: 3425339 - RNA, 18 nt, Human
agcuuguaaauagcucag

SEQ ID NO: 3425340 - RNA, 19 nt, Human
agcuuguaaauagcucagg

SEQ ID NO: 3425341 - RNA, 16 nt, Human
agcuuguagccagccg

SEQ ID NO: 3425342 - RNA, 18 nt, Human
agcuuguauaguguaaaa

SEQ ID NO: 3425343 - RNA, 21 nt, Human
agcuuguauaguguaaaauaa

SEQ ID NO: 3425344 - RNA, 12 nt, Human
agcuuguauuuu

SEQ ID NO: 3425345 - RNA, 23 nt, Human
agcuuguccaacccgaggcccgc

SEQ ID NO: 3425346 - RNA, 17 nt, Human
agcuuguggagccccac

SEQ ID NO: 3425347 - RNA, 20 nt, Human
agcuuguguauccauuauca

SEQ ID NO: 3425348 - RNA, 16 nt, Human
agcuuguuauuuauaa

SEQ ID NO: 3425349 - RNA, 16 nt, Human
agcuuguuuacaugcu

SEQ ID NO: 3425350 - RNA, 23 nt, Human
agcuuguuuuggacuuuguuaca

SEQ ID NO: 3425351 - RNA, 22 nt, Human
agcuuguuuuguuucauccugu

SEQ ID NO: 3425352 - RNA, 15 nt, Human
agcuuuaaaagaaaa

SEQ ID NO: 3425353 - RNA, 21 nt, Human
agcuuuaaugauaugcuugua

SEQ ID NO: 3425354 - RNA, 21 nt, Human
agcuuuacaugcaauuuauua

SEQ ID NO: 3425355 - RNA, 13 nt, Human
agcuuuagacccu

SEQ ID NO: 3425356 - RNA, 12 nt, Human
agcuuuaugauu

SEQ ID NO: 3425357 - RNA, 18 nt, Human
agcuuuaugauuuucaua

SEQ ID NO: 3425358 - RNA, 16 nt, Human
agcuuuauguaauaau

SEQ ID NO: 3425359 - RNA, 22 nt, Human
agcuuuauguaauaaugugaau

SEQ ID NO: 3425360 - RNA, 13 nt, Human
agcuuuauuucua

SEQ ID NO: 3425361 - RNA, 14 nt, Human
agcuuuauuucuag

SEQ ID NO: 3425362 - RNA, 19 nt, Human
agcuuuauuuuuuaaguau

SEQ ID NO: 3425363 - RNA, 16 nt, Human
agcuuucagaauaugu

SEQ ID NO: 3425364 - RNA, 15 nt, Human
agcuuuccccagccc

SEQ ID NO: 3425365 - RNA, 22 nt, Human
agcuuuccccaugucucgacuc

SEQ ID NO: 3425366 - RNA, 12 nt, Human
agcuuucccugc

SEQ ID NO: 3425367 - RNA, 23 nt, Human
agcuuuccugccccaggccugaa

SEQ ID NO: 3425368 - RNA, 23 nt, Human
agcuuucuagaaguuucccuucc

SEQ ID NO: 3425369 - RNA, 21 nt, Human
agcuuucucugcuucagcuug

SEQ ID NO: 3425370 - RNA, 15 nt, Human
agcuuucugaacagc

SEQ ID NO: 3425371 - RNA, 16 nt, Human
agcuuucugaacagcu

SEQ ID NO: 3425372 - RNA, 19 nt, Human
agcuuucugaacagcuggu

SEQ ID NO: 3425373 - RNA, 22 nt, Human
agcuuucugaacagcuggugua

SEQ ID NO: 3425374 - RNA, 23 nt, Human
agcuuucugagcaagaggauuuu

SEQ ID NO: 3425375 - RNA, 13 nt, Human
agcuuucugccac

SEQ ID NO: 3425376 - RNA, 14 nt, Human
agcuuucuuucaca

SEQ ID NO: 3425377 - RNA, 17 nt, Human
agcuuugacacuggaau

SEQ ID NO: 3425378 - RNA, 20 nt, Human
agcuuugacucaggagccug

SEQ ID NO: 3425379 - RNA, 21 nt, Human
agcuuugcuaccaaagcaccu

SEQ ID NO: 3425380 - RNA, 18 nt, Human
agcuuugcucuuugguag

SEQ ID NO: 3425381 - RNA, 23 nt, Human
agcuuugcucuuugguagaaaag

SEQ ID NO: 3425382 - RNA, 12 nt, Human
agcuuugcugcu

SEQ ID NO: 3425383 - RNA, 22 nt, Human
agcuuuggaaguuuagcucuga

SEQ ID NO: 3425384 - RNA, 23 nt, Human
agcuuuggaaguuuagcucugag

SEQ ID NO: 3425385 - RNA, 21 nt, Human
agcuuuggacacacacagcuu

SEQ ID NO: 3425386 - RNA, 23 nt, Human
agcuuuggacacacacagcuucu

SEQ ID NO: 3425387 - RNA, 21 nt, Human
agcuuuggacgcacacagcuu

SEQ ID NO: 3425388 - RNA, 21 nt, Human
agcuuuggcuaugagggccuu

SEQ ID NO: 3425389 - RNA, 23 nt, Human
agcuuuggggugucuuuuuuugg

SEQ ID NO: 3425390 - RNA, 17 nt, Human
agcuuuggugcaauggc

SEQ ID NO: 3425391 - RNA, 21 nt, Human
agcuuuguccccugcuucaga

SEQ ID NO: 3425392 - RNA, 15 nt, Human
agcuuugucguauuu

SEQ ID NO: 3425393 - RNA, 21 nt, Human
agcuuuguguuugguuuacau

SEQ ID NO: 3425394 - RNA, 23 nt, Human
agcuuuguguuugguuuacauuu

SEQ ID NO: 3425395 - RNA, 21 nt, Human
agcuuuuaugugaaacauguu

SEQ ID NO: 3425396 - RNA, 12 nt, Human
agcuuuucaaac

SEQ ID NO: 3425397 - RNA, 16 nt, Human
agcuuuucaaacaaga

SEQ ID NO: 3425398 - RNA, 18 nt, Human
agcuuuucccaaaagccc

SEQ ID NO: 3425399 - RNA, 17 nt, Human
agcuuuucuauuuuaau

SEQ ID NO: 3425400 - RNA, 12 nt, Human
agcuuuugaugu

SEQ ID NO: 3425401 - RNA, 13 nt, Human
agcuuuugcuuuu

SEQ ID NO: 3425402 - RNA, 17 nt, Human
agcuuuuuaaaacauua

SEQ ID NO: 3425403 - RNA, 17 nt, Human
agcuuuuuaauuaagca

SEQ ID NO: 3425404 - RNA, 17 nt, Human
agcuuuuuaauuguugu

SEQ ID NO: 3425405 - RNA, 23 nt, Human
agacauuucuuuucuuuuuacau

SEQ ID NO: 3425406 - RNA, 12 nt, Human
agacuaaaugaa

SEQ ID NO: 3425407 - RNA, 17 nt, Human
agacuaagaaauauucc

SEQ ID NO: 3425408 - RNA, 19 nt, Human
agacuaagaaauauuccaa

SEQ ID NO: 3425409 - RNA, 16 nt, Human
agacuaagccagcacc

SEQ ID NO: 3425410 - RNA, 19 nt, Human
agacuaauuccugcccugc

SEQ ID NO: 3425411 - RNA, 20 nt, Human
aggaccuguauuuaagcaaa

SEQ ID NO: 3425412 - RNA, 21 nt, Human
aggaccuguauuuaagcaaau

SEQ ID NO: 3425413 - RNA, 14 nt, Human
aggacgcacugagc

SEQ ID NO: 3425414 - RNA, 16 nt, Human
aggacgccacucauuu

SEQ ID NO: 3425415 - RNA, 17 nt, Human
aggacgccacucauuuc

SEQ ID NO: 3425416 - RNA, 18 nt, Human
aggacgccacucauuuca

SEQ ID NO: 3425417 - RNA, 19 nt, Human
aggacgccacucauuucau

SEQ ID NO: 3425418 - RNA, 20 nt, Human
aggacgcucucuggccuucg

SEQ ID NO: 3425419 - RNA, 14 nt, Human
aggacgcuucugaa

SEQ ID NO: 3425420 - RNA, 19 nt, Human
aggacggggccggccaggu

SEQ ID NO: 3425421 - RNA, 20 nt, Human
aggacggggccggccaggug

SEQ ID NO: 3425422 - RNA, 22 nt, Human
aggacggggccggccagguggg

SEQ ID NO: 3425423 - RNA, 14 nt, Human
aggacuaaccaugu

SEQ ID NO: 3425424 - RNA, 16 nt, Human
aggacuaggguccugg

SEQ ID NO: 3425425 - RNA, 18 nt, Human
aggacuaggguccugggg

SEQ ID NO: 3425426 - RNA, 20 nt, Human
aggacuauauuugggccugc

SEQ ID NO: 3425427 - RNA, 17 nt, Human
aggacucagcuccccag

SEQ ID NO: 3425428 - RNA, 20 nt, Human
aggacucagcuccccagagu

SEQ ID NO: 3425429 - RNA, 11 nt, Human
aggacuccagc

SEQ ID NO: 3425430 - RNA, 19 nt, Human
aggacuccaggcagcagac

SEQ ID NO: 3425431 - RNA, 17 nt, Human
aggacuccccaggccag

SEQ ID NO: 3425432 - RNA, 12 nt, Human
aggacucccucc

SEQ ID NO: 3425433 - RNA, 13 nt, Human
aggacucccuccu

SEQ ID NO: 3425434 - RNA, 15 nt, Human
aggacucccuccuca

SEQ ID NO: 3425435 - RNA, 18 nt, Human
aggacucccuccucaccu

SEQ ID NO: 3425436 - RNA, 23 nt, Human
aggacucccuccucaccucugga

SEQ ID NO: 3425437 - RNA, 15 nt, Human
aggacuccuccccac

SEQ ID NO: 3425438 - RNA, 22 nt, Human
aggacuccuccccacccuccug

SEQ ID NO: 3425439 - RNA, 23 nt, Human
aggacuccuccccacccuccugg

SEQ ID NO: 3425440 - RNA, 21 nt, Human
aggacuccuccuuuuuccaug

SEQ ID NO: 3425441 - RNA, 17 nt, Human
aggacuccugaaaaaaa

SEQ ID NO: 3425442 - RNA, 15 nt, Human
aggacucgcuuguaa

SEQ ID NO: 3425443 - RNA, 13 nt, Human
aggacucugaggc

SEQ ID NO: 3425444 - RNA, 17 nt, Human
aggacucugaggcucuu

SEQ ID NO: 3425445 - RNA, 15 nt, Human
aggacucugcccaga

SEQ ID NO: 3425446 - RNA, 22 nt, Human
aggacugacugaggcaguuuga

SEQ ID NO: 3425447 - RNA, 21 nt, Human
aggacugcacagcguccuguc

SEQ ID NO: 3425448 - RNA, 16 nt, Human
aggacugcaccauugc

SEQ ID NO: 3425449 - RNA, 21 nt, Human
aggacugcaccauugcugcuc

SEQ ID NO: 3425450 - RNA, 18 nt, Human
aggacugggagcccccag

SEQ ID NO: 3425451 - RNA, 11 nt, Human
aggacugggcc

SEQ ID NO: 3425452 - RNA, 16 nt, Human
aggacuguauuuguga

SEQ ID NO: 3425453 - RNA, 14 nt, Human
aggacuguccccuu

SEQ ID NO: 3425454 - RNA, 21 nt, Human
aggacuguccccuugaaggag

SEQ ID NO: 3425455 - RNA, 14 nt, Human
aggacugugaugcc

SEQ ID NO: 3425456 - RNA, 20 nt, Human
aggacugugaugcccugccc

SEQ ID NO: 3425457 - RNA, 21 nt, Human
aggacugugaugcccugcccu

SEQ ID NO: 3425458 - RNA, 22 nt, Human
aggacuguuuuuuccugagcuu

SEQ ID NO: 3425459 - RNA, 18 nt, Human
aggacuuaacggcuccag

SEQ ID NO: 3425460 - RNA, 20 nt, Human
aggacuuaacggcuccagga

SEQ ID NO: 3425461 - RNA, 20 nt, Human
aggacuuccccggagggcug

SEQ ID NO: 3425462 - RNA, 22 nt, Human
aggacuuccuguccagcuccaa

SEQ ID NO: 3425463 - RNA, 23 nt, Human
aggacuucuuuaauuuuggaauu

SEQ ID NO: 3425464 - RNA, 13 nt, Human
aggacuugaaaga

SEQ ID NO: 3425465 - RNA, 13 nt, Human
aggacuugcccuc

SEQ ID NO: 3425466 - RNA, 23 nt, Human
aggacuugcccucgugguggaaa

SEQ ID NO: 3425467 - RNA, 14 nt, Human
aggacuuguuagau

SEQ ID NO: 3425468 - RNA, 18 nt, Human
aggacuuugaggcaagug

SEQ ID NO: 3425469 - RNA, 23 nt, Human
aggacuuugaggcaagugugggc

SEQ ID NO: 3425470 - RNA, 17 nt, Human
aggagaaacacuugaac

SEQ ID NO: 3425471 - RNA, 20 nt, Human
aggagaaacacuugaaccug

SEQ ID NO: 3425472 - RNA, 14 nt, Human
aggagaaacagaga

SEQ ID NO: 3425473 - RNA, 16 nt, Human
aggagaaacagagaca

SEQ ID NO: 3425474 - RNA, 17 nt, Human
aggagaaacuggaacuc

SEQ ID NO: 3425475 - RNA, 19 nt, Human
aggagaaccaaaucuggaa

SEQ ID NO: 3425476 - RNA, 15 nt, Human
aggagaaccacuaca

SEQ ID NO: 3425477 - RNA, 21 nt, Human
aggagaacucauguuauuuuu

SEQ ID NO: 3425478 - RNA, 20 nt, Human
aggagaagaaggaaaugaau

SEQ ID NO: 3425479 - RNA, 13 nt, Human
aggagaagccagg

SEQ ID NO: 3425480 - RNA, 19 nt, Human
aggagaagcucagcugcau

SEQ ID NO: 3425481 - RNA, 13 nt, Human
aggagaagcugca

SEQ ID NO: 3425482 - RNA, 17 nt, Human
aggagaagcugcaucca

SEQ ID NO: 3425483 - RNA, 12 nt, Human
aggagaaggaag

SEQ ID NO: 3425484 - RNA, 16 nt, Human
aggagaauccaagcga

SEQ ID NO: 3425485 - RNA, 20 nt, Human
aggagaaucgcuugaaccca

SEQ ID NO: 3425486 - RNA, 20 nt, Human
aggagaauggugugaacccg

SEQ ID NO: 3425487 - RNA, 13 nt, Human
aggagacacaggg

SEQ ID NO: 3425488 - RNA, 18 nt, Human
aggagacaguucaagaaa

SEQ ID NO: 3425489 - RNA, 14 nt, Human
aggagaccaaggcg

SEQ ID NO: 3425490 - RNA, 13 nt, Human
aggagacucaccu

SEQ ID NO: 3425491 - RNA, 19 nt, Human
aggagacucaccucugccu

SEQ ID NO: 3425492 - RNA, 21 nt, Human
aggagacucaccucugccuca

SEQ ID NO: 3425493 - RNA, 20 nt, Human
aggagacuguuuggaaauug

SEQ ID NO: 3425494 - RNA, 14 nt, Human
aggagacuuguagu

SEQ ID NO: 3425495 - RNA, 14 nt, Human
aggagagaaaauau

SEQ ID NO: 3425496 - RNA, 12 nt, Human
aggagagaagaa

SEQ ID NO: 3425497 - RNA, 14 nt, Human
aggagagaagaaug

SEQ ID NO: 3425498 - RNA, 21 nt, Human
aggagagaaggggaggagggc

SEQ ID NO: 3425499 - RNA, 11 nt, Human
aggagagaccg

SEQ ID NO: 3425500 - RNA, 23 nt, Human
aggagagacucccaugaagccuu

SEQ ID NO: 3425501 - RNA, 11 nt, Human
aggagagagaa

SEQ ID NO: 3425502 - RNA, 14 nt, Human
aggagagagaaagc

SEQ ID NO: 3425503 - RNA, 18 nt, Human
aggagagagaaagccagg

SEQ ID NO: 3425504 - RNA, 13 nt, Human
aggagagaggcag

SEQ ID NO: 3425505 - RNA, 14 nt, Human
aggagagaggcaga

SEQ ID NO: 3425506 - RNA, 14 nt, Human
aggagagaguugaa

SEQ ID NO: 3425507 - RNA, 19 nt, Human
aggagagauagccuguggc

SEQ ID NO: 3425508 - RNA, 11 nt, Human
aggagagcagc

SEQ ID NO: 3425509 - RNA, 14 nt, Human
aggagagccugcug

SEQ ID NO: 3425510 - RNA, 15 nt, Human
aggagagccugcugc

SEQ ID NO: 3425511 - RNA, 22 nt, Human
aggagaggaaacuacugccuuu

SEQ ID NO: 3425512 - RNA, 12 nt, Human
aggagaggaaag

SEQ ID NO: 3425513 - RNA, 14 nt, Human
aggagaggagagag

SEQ ID NO: 3425514 - RNA, 13 nt, Human
aggagaggagagc

SEQ ID NO: 3425515 - RNA, 13 nt, Human
aggagaggaugag

SEQ ID NO: 3425516 - RNA, 18 nt, Human
aggagaggaugagagccc

SEQ ID NO: 3425517 - RNA, 23 nt, Human
aggagaggaugagagcccagagg

SEQ ID NO: 3425518 - RNA, 18 nt, Human
aggagagggaaaauguuu

SEQ ID NO: 3425519 - RNA, 20 nt, Human
aggagaggugauaaugaaug

SEQ ID NO: 3425520 - RNA, 17 nt, Human
aggagagucccagagca

SEQ ID NO: 3425521 - RNA, 21 nt, Human
aggagagucccagagcaggag

SEQ ID NO: 3425522 - RNA, 12 nt, Human
aggagauaaauc

SEQ ID NO: 3425523 - RNA, 20 nt, Human
aggagauaauuacugccuug

SEQ ID NO: 3425524 - RNA, 19 nt, Human
aggagauaucugagggagg

SEQ ID NO: 3425525 - RNA, 20 nt, Human
aggagauaucugagggagga

SEQ ID NO: 3425526 - RNA, 22 nt, Human
aggagauccagggcaaggccau

SEQ ID NO: 3425527 - RNA, 15 nt, Human
aggagaugcugugcc

SEQ ID NO: 3425528 - RNA, 20 nt, Human
aggagauucugccuuugcca

SEQ ID NO: 3425529 - RNA, 22 nt, Human
aggagauucugccuuugccagg

SEQ ID NO: 3425530 - RNA, 21 nt, Human
aggagauugagaaggagagaa

SEQ ID NO: 3425531 - RNA, 17 nt, Human
aggagauuggaaggaac

SEQ ID NO: 3425532 - RNA, 14 nt, Human
aggagauuuuccuu

SEQ ID NO: 3425533 - RNA, 15 nt, Human
aggagauuuuccuuc

SEQ ID NO: 3425534 - RNA, 18 nt, Human
aggagauuuuccuuccua

SEQ ID NO: 3425535 - RNA, 15 nt, Human
aggagcaaaggcuga

SEQ ID NO: 3425536 - RNA, 19 nt, Human
aggagcaaauguuucugca

SEQ ID NO: 3425537 - RNA, 16 nt, Human
aggagcacaagccaca

SEQ ID NO: 3425538 - RNA, 15 nt, Human
aggagcacacccagc

SEQ ID NO: 3425539 - RNA, 15 nt, Human
aggagcacaggcagc

SEQ ID NO: 3425540 - RNA, 22 nt, Human
aggagcacaggcagcuggauga

SEQ ID NO: 3425541 - RNA, 15 nt, Human
aggagcacagguccc

SEQ ID NO: 3425542 - RNA, 20 nt, Human
aggagcagcuucaguuguuu

SEQ ID NO: 3425543 - RNA, 16 nt, Human
aggagcaggcacgggu

SEQ ID NO: 3425544 - RNA, 19 nt, Human
aggagcaguaucaugaagc

SEQ ID NO: 3425545 - RNA, 16 nt, Human
aggagcagugcaggca

SEQ ID NO: 3425546 - RNA, 20 nt, Human
aggagcauccaccuccuucu

SEQ ID NO: 3425547 - RNA, 15 nt, Human
aggagccagacagac

SEQ ID NO: 3425548 - RNA, 16 nt, Human
aggagccagacagacc

SEQ ID NO: 3425549 - RNA, 19 nt, Human
aggagccaggcaacuucag

SEQ ID NO: 3425550 - RNA, 10 nt, Human
aggagcccag

SEQ ID NO: 3425551 - RNA, 16 nt, Human
aggccauucugccgcc

SEQ ID NO: 3425552 - RNA, 14 nt, Human
aggccauucuuucc

SEQ ID NO: 3425553 - RNA, 19 nt, Human
aggccauucuuucccaaca

SEQ ID NO: 3425554 - RNA, 15 nt, Human
aggcccaaagccucg

SEQ ID NO: 3425555 - RNA, 19 nt, Human
aggcccaaccaccagauga

SEQ ID NO: 3425556 - RNA, 14 nt, Human
aggcccaaccuccu

SEQ ID NO: 3425557 - RNA, 11 nt, Human
aggcccacaca

SEQ ID NO: 3425558 - RNA, 12 nt, Human
aggcccacacac

SEQ ID NO: 3425559 - RNA, 14 nt, Human
aggcccacccugcu

SEQ ID NO: 3425560 - RNA, 22 nt, Human
aggcccacccugcuuggcccag

SEQ ID NO: 3425561 - RNA, 13 nt, Human
aggcccacucagg

SEQ ID NO: 3425562 - RNA, 15 nt, Human
aggcccagagggccu

SEQ ID NO: 3425563 - RNA, 10 nt, Human
aggcccagca

SEQ ID NO: 3425564 - RNA, 23 nt, Human
aggcccagcgcggacauccccug

SEQ ID NO: 3425565 - RNA, 17 nt, Human
aggcccaggcugccguc

SEQ ID NO: 3425566 - RNA, 15 nt, Human
aggcccaggcuggga

SEQ ID NO: 3425567 - RNA, 17 nt, Human
aggcccaguucacccug

SEQ ID NO: 3425568 - RNA, 16 nt, Human
aggcccaugggaggcu

SEQ ID NO: 3425569 - RNA, 18 nt, Human
aggcccaugguugagaaa

SEQ ID NO: 3425570 - RNA, 21 nt, Human
aggccccaaaaccacagcccu

SEQ ID NO: 3425571 - RNA, 15 nt, Human
aggccccaacccugu

SEQ ID NO: 3425572 - RNA, 16 nt, Human
aggccccaauacccca

SEQ ID NO: 3425573 - RNA, 19 nt, Human
aggccccaauaccccaugg

SEQ ID NO: 3425574 - RNA, 14 nt, Human
aggccccacugaug

SEQ ID NO: 3425575 - RNA, 22 nt, Human
aggccccagagacucagaggga

SEQ ID NO: 3425576 - RNA, 13 nt, Human
aggccccagccuc

SEQ ID NO: 3425577 - RNA, 13 nt, Human
aggccccaggaag

SEQ ID NO: 3425578 - RNA, 20 nt, Human
aggccccaugaccuccagcu

SEQ ID NO: 3425579 - RNA, 13 nt, Human
aggcccccaagcc

SEQ ID NO: 3425580 - RNA, 13 nt, Human
aggcccccaccac

SEQ ID NO: 3425581 - RNA, 14 nt, Human
aggcccccaccaca

SEQ ID NO: 3425582 - RNA, 18 nt, Human
aggcccccaccacacauc

SEQ ID NO: 3425583 - RNA, 21 nt, Human
aggcccccaccacacauccca

SEQ ID NO: 3425584 - RNA, 23 nt, Human
aggcccccaccacacaucccagc

SEQ ID NO: 3425585 - RNA, 20 nt, Human
aggcccccacuugccucuuc

SEQ ID NO: 3425586 - RNA, 17 nt, Human
aggcccccagcccaggg

SEQ ID NO: 3425587 - RNA, 19 nt, Human
aggcccccagcccagggcu

SEQ ID NO: 3425588 - RNA, 15 nt, Human
aggcccccugccugc

SEQ ID NO: 3425589 - RNA, 17 nt, Human
aggccccgaggacccag

SEQ ID NO: 3425590 - RNA, 20 nt, Human
aggccccgaggacccagacc

SEQ ID NO: 3425591 - RNA, 14 nt, Human
aggccccgcccagg

SEQ ID NO: 3425592 - RNA, 20 nt, Human
aggccccgcuuguccagcgc

SEQ ID NO: 3425593 - RNA, 15 nt, Human
aggccccugccaccc

SEQ ID NO: 3425594 - RNA, 17 nt, Human
aggccccugccacccug

SEQ ID NO: 3425595 - RNA, 21 nt, Human
aggccccugccacccugggga

SEQ ID NO: 3425596 - RNA, 13 nt, Human
aggccccuggagg

SEQ ID NO: 3425597 - RNA, 19 nt, Human
aggccccuggaggcugccu

SEQ ID NO: 3425598 - RNA, 20 nt, Human
aggccccuggaggcugccuc

SEQ ID NO: 3425599 - RNA, 21 nt, Human
aggccccuggaggcugccucc

SEQ ID NO: 3425600 - RNA, 22 nt, Human
aggccccuggaggcugccuccc

SEQ ID NO: 3425601 - RNA, 21 nt, Human
aggccccugucucagggugag

SEQ ID NO: 3425602 - RNA, 20 nt, Human
aggccccuucucucccugcc

SEQ ID NO: 3425603 - RNA, 13 nt, Human
aggcccggcucca

SEQ ID NO: 3425604 - RNA, 17 nt, Human
aggcccggcuccaggcu

SEQ ID NO: 3425605 - RNA, 20 nt, Human
aggcccggcuccaggcuccu

SEQ ID NO: 3425606 - RNA, 14 nt, Human
aggcccgucugucc

SEQ ID NO: 3425607 - RNA, 16 nt, Human
aggcccuccacaccug

SEQ ID NO: 3425608 - RNA, 22 nt, Human
aggcccucccuguuccccagag

SEQ ID NO: 3425609 - RNA, 22 nt, Human
aggcccuccucccucccagcuc

SEQ ID NO: 3425610 - RNA, 17 nt, Human
aggcccucgggcccagc

SEQ ID NO: 3425611 - RNA, 18 nt, Human
aggcccucgggcccagcc

SEQ ID NO: 3425612 - RNA, 19 nt, Human
aggcccucgggcccagccc

SEQ ID NO: 3425613 - RNA, 17 nt, Human
aggcccucugcccacuc

SEQ ID NO: 3425614 - RNA, 19 nt, Human
aggcccucugcccacuccc

SEQ ID NO: 3425615 - RNA, 20 nt, Human
aggcccucugcccacucccu

SEQ ID NO: 3425616 - RNA, 21 nt, Human
aggcccucugcccacucccug

SEQ ID NO: 3425617 - RNA, 18 nt, Human
agagcaggcacauggagg

SEQ ID NO: 3425618 - RNA, 21 nt, Human
agagcaggccaggcgcggugg

SEQ ID NO: 3425619 - RNA, 17 nt, Human
agagcaggcuggcagcu

SEQ ID NO: 3425620 - RNA, 24 nt, Human
agagcagggauuaaccucugcacu

SEQ ID NO: 3425621 - RNA, 17 nt, Human
agagcaggugagauggg

SEQ ID NO: 3425622 - RNA, 18 nt, Human
agagcaggugcuggcucu

SEQ ID NO: 3425623 - RNA, 19 nt, Human
agagcagugguaagaauag

SEQ ID NO: 3425624 - RNA, 23 nt, Human
agagcauaauuuaaaaauauauu

SEQ ID NO: 3425625 - RNA, 16 nt, Human
agagcaucaugccucu

SEQ ID NO: 3425626 - RNA, 20 nt, Human
agagcaucaugccucugagg

SEQ ID NO: 3425627 - RNA, 22 nt, Human
agagcaucaugccucugaggcc

SEQ ID NO: 3425628 - RNA, 23 nt, Human
agagcauccugcuucuaccaugu

SEQ ID NO: 3425629 - RNA, 23 nt, Human
agagcauuauaaucaccagggcc

SEQ ID NO: 3425630 - RNA, 21 nt, Human
agagcauuccagucaggcucu

SEQ ID NO: 3425631 - RNA, 19 nt, Human
agagcauugaauuggagag

SEQ ID NO: 3425632 - RNA, 11 nt, Human
agagccacaca

SEQ ID NO: 3425633 - RNA, 16 nt, Human
agagccacccuguguu

SEQ ID NO: 3425634 - RNA, 10 nt, Human
agagccagag

SEQ ID NO: 3425635 - RNA, 13 nt, Human
agagccagagaag

SEQ ID NO: 3425636 - RNA, 13 nt, Human
agagccaggagaa

SEQ ID NO: 3425637 - RNA, 18 nt, Human
agagccaggagaagcuca

SEQ ID NO: 3425638 - RNA, 23 nt, Human
agagccaggggggugaggagcug

SEQ ID NO: 3425639 - RNA, 20 nt, Human
agagccauacauaaaagaaa

SEQ ID NO: 3425640 - RNA, 19 nt, Human
agagccauauaaguuugaa

SEQ ID NO: 3425641 - RNA, 19 nt, Human
agagccauggacucuacac

SEQ ID NO: 3425642 - RNA, 17 nt, Human
agagcccacgcccccac

SEQ ID NO: 3425643 - RNA, 14 nt, Human
agagcccagccauu

SEQ ID NO: 3425644 - RNA, 15 nt, Human
agagcccagcuccaa

SEQ ID NO: 3425645 - RNA, 13 nt, Human
agagcccaggagc

SEQ ID NO: 3425646 - RNA, 19 nt, Human
agagcccaggagcuccccu

SEQ ID NO: 3425647 - RNA, 14 nt, Human
agagccccacacgg

SEQ ID NO: 3425648 - RNA, 17 nt, Human
agagccccacacggagg

SEQ ID NO: 3425649 - RNA, 21 nt, Human
agagccccacucucagaggcc

SEQ ID NO: 3425650 - RNA, 22 nt, Human
agagccccacucucagaggccc

SEQ ID NO: 3425651 - RNA, 13 nt, Human
agagccccagcug

SEQ ID NO: 3425652 - RNA, 16 nt, Human
agagccccagcugaca

SEQ ID NO: 3425653 - RNA, 15 nt, Human
agagccccuccucca

SEQ ID NO: 3425654 - RNA, 15 nt, Human
agagccccuggggcc

SEQ ID NO: 3425655 - RNA, 19 nt, Human
agagccccuggggccuaga

SEQ ID NO: 3425656 - RNA, 18 nt, Human
agagcccugaggccuaga

SEQ ID NO: 3425657 - RNA, 22 nt, Human
agagcccugaggccuagacucu

SEQ ID NO: 3425658 - RNA, 14 nt, Human
agagcccugcuccc

SEQ ID NO: 3425659 - RNA, 14 nt, Human
agagcccuugccuc

SEQ ID NO: 3425660 - RNA, 13 nt, Human
agagccgggaagc

SEQ ID NO: 3425661 - RNA, 22 nt, Human
agagccggggugggguggcugc

SEQ ID NO: 3425662 - RNA, 23 nt, Human
agagccggggugggguggcugca

SEQ ID NO: 3425663 - RNA, 14 nt, Human
agagccguaaaaac

SEQ ID NO: 3425664 - RNA, 16 nt, Human
agagccguggucccug

SEQ ID NO: 3425665 - RNA, 22 nt, Human
agagccucccucaauucccccu

SEQ ID NO: 3425666 - RNA, 13 nt, Human
agagccugaggga

SEQ ID NO: 3425667 - RNA, 14 nt, Human
agagccugagggau

SEQ ID NO: 3425668 - RNA, 13 nt, Human
agagccugaucuc

SEQ ID NO: 3425669 - RNA, 14 nt, Human
agagccugaucucu

SEQ ID NO: 3425670 - RNA, 14 nt, Human
agagccugcaggau

SEQ ID NO: 3425671 - RNA, 19 nt, Human
agagccugcaggugcugcu

SEQ ID NO: 3425672 - RNA, 12 nt, Human
agagccugcccc

SEQ ID NO: 3425673 - RNA, 16 nt, Human
agagccugccccagcg

SEQ ID NO: 3425674 - RNA, 17 nt, Human
agagccugccccagcgc

SEQ ID NO: 3425675 - RNA, 13 nt, Human
agagccugcuccc

SEQ ID NO: 3425676 - RNA, 16 nt, Human
agagccugcuccccca

SEQ ID NO: 3425677 - RNA, 18 nt, Human
agagccugcucccccacc

SEQ ID NO: 3425678 - RNA, 19 nt, Human
agagccugcucccccaccc

SEQ ID NO: 3425679 - RNA, 15 nt, Human
agagccugcugcaug

SEQ ID NO: 3425680 - RNA, 19 nt, Human
agagccugcuggcacccac

SEQ ID NO: 3425681 - RNA, 24 nt, Human
agagccugcuggcacccaccgugg

SEQ ID NO: 3425682 - RNA, 12 nt, Human
agagccuggggc

SEQ ID NO: 3425683 - RNA, 23 nt, Human
agagccuggggcucuaacgccug

SEQ ID NO: 3425684 - RNA, 16 nt, Human
agagccuuaaaacauc

SEQ ID NO: 3425685 - RNA, 14 nt, Human
agagccuucagccu

SEQ ID NO: 3425686 - RNA, 13 nt, Human
agagccuuccacc

SEQ ID NO: 3425687 - RNA, 22 nt, Human
agagccuuccacccaggggcag

SEQ ID NO: 3425688 - RNA, 13 nt, Human
agagccuuccagg

SEQ ID NO: 3425689 - RNA, 15 nt, Human
agagccuuccagggg

SEQ ID NO: 3425690 - RNA, 22 nt, Human
agagccuuccaggggugggaca

SEQ ID NO: 3425691 - RNA, 11 nt, Human
agagccuugcg

SEQ ID NO: 3425692 - RNA, 17 nt, Human
agagccuugguguccac

SEQ ID NO: 3425693 - RNA, 19 nt, Human
agagccuugguguccaccu

SEQ ID NO: 3425694 - RNA, 20 nt, Human
agagccuugguguccaccug

SEQ ID NO: 3425695 - RNA, 15 nt, Human
agagccuuuugugca

SEQ ID NO: 3425696 - RNA, 23 nt, Human
agaggauuuuagcuaggauuuga

SEQ ID NO: 3425697 - RNA, 20 nt, Human
agaggauuuuuuucugagcg

SEQ ID NO: 3425698 - RNA, 16 nt, Human
agaggcaagcugaaau

SEQ ID NO: 3425699 - RNA, 22 nt, Human
agaggcaagcugaaauuuuaga

SEQ ID NO: 3425700 - RNA, 18 nt, Human
agaggcaauggcuccuuc

SEQ ID NO: 3425701 - RNA, 17 nt, Human
agaggcaccaggaagcc

SEQ ID NO: 3425702 - RNA, 18 nt, Human
agaggcagaaaauugcac

SEQ ID NO: 3425703 - RNA, 13 nt, Human
agaggcagagaaa

SEQ ID NO: 3425704 - RNA, 18 nt, Human
agaggcagagaaagaaga

SEQ ID NO: 3425705 - RNA, 14 nt, Human
agaggcagcccagg

SEQ ID NO: 3425706 - RNA, 21 nt, Human
agaggcagccccauucugccu

SEQ ID NO: 3425707 - RNA, 22 nt, Human
agaggcagccccauucugccug

SEQ ID NO: 3425708 - RNA, 17 nt, Human
agaggcagggaggggac

SEQ ID NO: 3425709 - RNA, 22 nt, Human
agaggcaggggcuugcuuugca

SEQ ID NO: 3425710 - RNA, 16 nt, Human
agaggccaaacaggcc

SEQ ID NO: 3425711 - RNA, 18 nt, Human
agaggccaaaggcuggug

SEQ ID NO: 3425712 - RNA, 14 nt, Human
agaggccagccugg

SEQ ID NO: 3425713 - RNA, 14 nt, Human
agaggccauggagg

SEQ ID NO: 3425714 - RNA, 16 nt, Human
agaggccauggcagaa

SEQ ID NO: 3425715 - RNA, 22 nt, Human
agaggccauguuccaauaaaca

SEQ ID NO: 3425716 - RNA, 20 nt, Human
agaggcccagauauuagaaa

SEQ ID NO: 3425717 - RNA, 17 nt, Human
agaggcccaggcugccg

SEQ ID NO: 3425718 - RNA, 20 nt, Human
agaggccccaauaccccaug

SEQ ID NO: 3425719 - RNA, 13 nt, Human
agaggccccagcc

SEQ ID NO: 3425720 - RNA, 13 nt, Human
agaggcccuggau

SEQ ID NO: 3425721 - RNA, 17 nt, Human
agaggcccuuugcuguc

SEQ ID NO: 3425722 - RNA, 17 nt, Human
agaggccguggcugcug

SEQ ID NO: 3425723 - RNA, 19 nt, Human
agaggccugaaauccuggu

SEQ ID NO: 3425724 - RNA, 13 nt, Human
agaggccugagga

SEQ ID NO: 3425725 - RNA, 22 nt, Human
agaggccugaggaugagcugga

SEQ ID NO: 3425726 - RNA, 20 nt, Human
agaggccugccuccagggcu

SEQ ID NO: 3425727 - RNA, 19 nt, Human
agaggccugggcugggaaa

SEQ ID NO: 3425728 - RNA, 20 nt, Human
agaggccuguuuggccucuc

SEQ ID NO: 3425729 - RNA, 21 nt, Human
agaggccuuuaguuauaaagg

SEQ ID NO: 3425730 - RNA, 21 nt, Human
agaggcgcaugaauuugugaa

SEQ ID NO: 3425731 - RNA, 14 nt, Human
agaggcgggccagc

SEQ ID NO: 3425732 - RNA, 16 nt, Human
agaggcgggccagcca

SEQ ID NO: 3425733 - RNA, 17 nt, Human
agaggcgggccagccag

SEQ ID NO: 3425734 - RNA, 18 nt, Human
agaggcgggccagccagg

SEQ ID NO: 3425735 - RNA, 15 nt, Human
agaggcuaaaauguu

SEQ ID NO: 3425736 - RNA, 17 nt, Human
agaggcuagcuucugcu

SEQ ID NO: 3425737 - RNA, 19 nt, Human
agaggcuagcuucugcuuu

SEQ ID NO: 3425738 - RNA, 17 nt, Human
agaggcuaugugagcac

SEQ ID NO: 3425739 - RNA, 13 nt, Human
agaggcugaggca

SEQ ID NO: 3425740 - RNA, 21 nt, Human
agaggcugaggcuggcacagg

SEQ ID NO: 3425741 - RNA, 13 nt, Human
agaggcugcagaa

SEQ ID NO: 3425742 - RNA, 12 nt, Human
agaggcugcccc

SEQ ID NO: 3425743 - RNA, 19 nt, Human
agaggcugccccucucacc

SEQ ID NO: 3425744 - RNA, 19 nt, Human
agaggcuggccucuacauc

SEQ ID NO: 3425745 - RNA, 14 nt, Human
agaggcuggguuca

SEQ ID NO: 3425746 - RNA, 14 nt, Human
agaggcuggugcug

SEQ ID NO: 3425747 - RNA, 22 nt, Human
agaggcuguucccaccaggcug

SEQ ID NO: 3425748 - RNA, 12 nt, Human
agaggcuucucc

SEQ ID NO: 3425749 - RNA, 19 nt, Human
agaggcuucuccgccagcc

SEQ ID NO: 3425750 - RNA, 20 nt, Human
agaggcuucuccgccagccu

SEQ ID NO: 3425751 - RNA, 14 nt, Human
agaggcuuguuuac

SEQ ID NO: 3425752 - RNA, 14 nt, Human
agagggaagaaaag

SEQ ID NO: 3425753 - RNA, 15 nt, Human
agagggaaugugaaa

SEQ ID NO: 3425754 - RNA, 21 nt, Human
agagggacagcccacugagaa

SEQ ID NO: 3425755 - RNA, 20 nt, Human
agagggacggccaagaaugu

SEQ ID NO: 3425756 - RNA, 14 nt, Human
agagggagaagaag

SEQ ID NO: 3425757 - RNA, 16 nt, Human
agagggagaagcauga

SEQ ID NO: 3425758 - RNA, 19 nt, Human
agagggagaagcaugaaaa

SEQ ID NO: 3425759 - RNA, 16 nt, Human
agagggaggcaagccc

SEQ ID NO: 3425760 - RNA, 18 nt, Human
agagggaggcaagcccug

SEQ ID NO: 3425761 - RNA, 13 nt, Human
agagggaggggcc

SEQ ID NO: 3425762 - RNA, 20 nt, Human
agagggaggggccuaggccu

SEQ ID NO: 3425763 - RNA, 15 nt, Human
agagggagugacaga

SEQ ID NO: 3425764 - RNA, 23 nt, Human
agagggaugaggugcugggaggg

SEQ ID NO: 3425765 - RNA, 14 nt, Human
agagggcagaggcu

SEQ ID NO: 3425766 - RNA, 23 nt, Human
agagggcaugcgcacaaggcuga

SEQ ID NO: 3425767 - RNA, 14 nt, Human
agagggcccaggca

SEQ ID NO: 3425768 - RNA, 16 nt, Human
agagggcccaggcagg

SEQ ID NO: 3425769 - RNA, 17 nt, Human
agagggccgggcagagg

SEQ ID NO: 3425770 - RNA, 18 nt, Human
agagggccgggcagaggg

SEQ ID NO: 3425771 - RNA, 19 nt, Human
agagggccugugggagccu

SEQ ID NO: 3425772 - RNA, 12 nt, Human
agagggcuggag

SEQ ID NO: 3425773 - RNA, 17 nt, Human
agagggcuggaggccca

SEQ ID NO: 3425774 - RNA, 18 nt, Human
agagggcuggaggcccag

SEQ ID NO: 3425775 - RNA, 19 nt, Human
agagggcuggaggcccagg

SEQ ID NO: 3425776 - RNA, 12 nt, Human
agagggcuuccu

SEQ ID NO: 3425777 - RNA, 21 nt, Human
aggcccucuggaguggccacu

SEQ ID NO: 3425778 - RNA, 22 nt, Human
aggcccugcacuguccugcucc

SEQ ID NO: 3425779 - RNA, 12 nt, Human
aggcccugccca

SEQ ID NO: 3425780 - RNA, 19 nt, Human
aggcccugcuccugcagca

SEQ ID NO: 3425781 - RNA, 16 nt, Human
aggcccugcugaguca

SEQ ID NO: 3425782 - RNA, 14 nt, Human
aggcccugcugccc

SEQ ID NO: 3425783 - RNA, 15 nt, Human
aggcccugcugccca

SEQ ID NO: 3425784 - RNA, 23 nt, Human
aggcccuggaucagcguggccuu

SEQ ID NO: 3425785 - RNA, 22 nt, Human
aggcccuggugcgaauggacuu

SEQ ID NO: 3425786 - RNA, 14 nt, Human
aggcccugucugua

SEQ ID NO: 3425787 - RNA, 13 nt, Human
aggcccugugccc

SEQ ID NO: 3425788 - RNA, 16 nt, Human
aggcccuuauuuucaa

SEQ ID NO: 3425789 - RNA, 20 nt, Human
aggcccuuauuuucaagaaa

SEQ ID NO: 3425790 - RNA, 18 nt, Human
aggcccuuccucuccacu

SEQ ID NO: 3425791 - RNA, 19 nt, Human
aggcccuucucuccagccc

SEQ ID NO: 3425792 - RNA, 20 nt, Human
aggcccuucucuccagcccc

SEQ ID NO: 3425793 - RNA, 23 nt, Human
aggcccuucucuccagccccugg

SEQ ID NO: 3425794 - RNA, 21 nt, Human
aggcccuuugaagccucagcu

SEQ ID NO: 3425795 - RNA, 18 nt, Human
aggccgaagaaggguccu

SEQ ID NO: 3425796 - RNA, 22 nt, Human
aggccgaagaaggguccuuccc

SEQ ID NO: 3425797 - RNA, 15 nt, Human
aggccgaagcucugg

SEQ ID NO: 3425798 - RNA, 19 nt, Human
aggccgaagcucuggcuga

SEQ ID NO: 3425799 - RNA, 24 nt, Human
aggccgaagcucuggcugaacccu

SEQ ID NO: 3425800 - RNA, 21 nt, Human
aggccgcagcucuugcccuuc

SEQ ID NO: 3425801 - RNA, 18 nt, Human
aggccgcgcguccagcug

SEQ ID NO: 3425802 - RNA, 19 nt, Human
aggccgcgcguccagcugc

SEQ ID NO: 3425803 - RNA, 14 nt, Human
aggccgcuagaggc

SEQ ID NO: 3425804 - RNA, 20 nt, Human
aggccgcuagaggccugagg

SEQ ID NO: 3425805 - RNA, 21 nt, Human
aggccggcagccccagccugc

SEQ ID NO: 3425806 - RNA, 22 nt, Human
aggccggcagccccagccugcu

SEQ ID NO: 3425807 - RNA, 15 nt, Human
aggccggccagccuc

SEQ ID NO: 3425808 - RNA, 16 nt, Human
aggccggccagccuca

SEQ ID NO: 3425809 - RNA, 21 nt, Human
aggccggcuugccacaccccc

SEQ ID NO: 3425810 - RNA, 14 nt, Human
aggccgggaaaaag

SEQ ID NO: 3425811 - RNA, 21 nt, Human
aggccgggccgaauccccucc

SEQ ID NO: 3425812 - RNA, 15 nt, Human
aggccggggccgggu

SEQ ID NO: 3425813 - RNA, 19 nt, Human
aggccggggccggguacug

SEQ ID NO: 3425814 - RNA, 17 nt, Human
aggccguccucccgggc

SEQ ID NO: 3425815 - RNA, 22 nt, Human
aggccguccucccgggcccucc

SEQ ID NO: 3425816 - RNA, 21 nt, Human
aggccgugacgucuggguggc

SEQ ID NO: 3425817 - RNA, 18 nt, Human
aggccguugcugacuuag

SEQ ID NO: 3425818 - RNA, 22 nt, Human
aggccuacaugcuuugugaaca

SEQ ID NO: 3425819 - RNA, 23 nt, Human
aggccuacaugcuuugugaacaa

SEQ ID NO: 3425820 - RNA, 15 nt, Human
aggccuagaggccug

SEQ ID NO: 3425821 - RNA, 15 nt, Human
aggccuaggauucua

SEQ ID NO: 3425822 - RNA, 17 nt, Human
aggccuagucagccaca

SEQ ID NO: 3425823 - RNA, 19 nt, Human
aggccucaacuccucccau

SEQ ID NO: 3425824 - RNA, 20 nt, Human
aggccucaacuccucccaua

SEQ ID NO: 3425825 - RNA, 17 nt, Human
aggccucaccucuaccc

SEQ ID NO: 3425826 - RNA, 16 nt, Human
aggccucagccagaga

SEQ ID NO: 3425827 - RNA, 13 nt, Human
aggccucagugga

SEQ ID NO: 3425828 - RNA, 15 nt, Human
aggccucaguggacu

SEQ ID NO: 3425829 - RNA, 15 nt, Human
aggccuccagcucag

SEQ ID NO: 3425830 - RNA, 18 nt, Human
aggccuccaucuucucau

SEQ ID NO: 3425831 - RNA, 16 nt, Human
aggccucccacaguga

SEQ ID NO: 3425832 - RNA, 18 nt, Human
aggccucccacagugacu

SEQ ID NO: 3425833 - RNA, 15 nt, Human
aggccucccugccag

SEQ ID NO: 3425834 - RNA, 17 nt, Human
aggccucccugccagua

SEQ ID NO: 3425835 - RNA, 12 nt, Human
aggccucugggc

SEQ ID NO: 3425836 - RNA, 18 nt, Human
aggccucugggccuccuc

SEQ ID NO: 3425837 - RNA, 15 nt, Human
aggccucuguguccu

SEQ ID NO: 3425838 - RNA, 23 nt, Human
aggccucuguguccuucccugca

SEQ ID NO: 3425839 - RNA, 18 nt, Human
aggccucuuggaccucug

SEQ ID NO: 3425840 - RNA, 14 nt, Human
agaguaauggguuu

SEQ ID NO: 3425841 - RNA, 17 nt, Human
agaguaauggguuucau

SEQ ID NO: 3425842 - RNA, 17 nt, Human
agaguacuuugguuucu

SEQ ID NO: 3425843 - RNA, 14 nt, Human
agaguagaaauaaa

SEQ ID NO: 3425844 - RNA, 15 nt, Human
agaguagaauugcau

SEQ ID NO: 3425845 - RNA, 17 nt, Human
agaguagaauugcauug

SEQ ID NO: 3425846 - RNA, 13 nt, Human
agaguagacauuu

SEQ ID NO: 3425847 - RNA, 12 nt, Human
agaguagcaagu

SEQ ID NO: 3425848 - RNA, 23 nt, Human
agaguagcaaguucuagagaaga

SEQ ID NO: 3425849 - RNA, 19 nt, Human
agaguagccgagagccugc

SEQ ID NO: 3425850 - RNA, 18 nt, Human
agaguauauuauguauuu

SEQ ID NO: 3425851 - RNA, 22 nt, Human
agaguaugugccaggaaacucu

SEQ ID NO: 3425852 - RNA, 16 nt, Human
agaguauugagauacu

SEQ ID NO: 3425853 - RNA, 15 nt, Human
agaguauuuuugaca

SEQ ID NO: 3425854 - RNA, 14 nt, Human
agagucacaagccu

SEQ ID NO: 3425855 - RNA, 15 nt, Human
agagucacuggaaca

SEQ ID NO: 3425856 - RNA, 16 nt, Human
agagucagcagaacug

SEQ ID NO: 3425857 - RNA, 15 nt, Human
agagucagcucucug

SEQ ID NO: 3425858 - RNA, 18 nt, Human
agagucagcucucugccc

SEQ ID NO: 3425859 - RNA, 13 nt, Human
agagucauauuuu

SEQ ID NO: 3425860 - RNA, 21 nt, Human
agagucaucuccaucagcugu

SEQ ID NO: 3425861 - RNA, 21 nt, Human
agaguccaagguuuaaagagu

SEQ ID NO: 3425862 - RNA, 15 nt, Human
agaguccaggcccca

SEQ ID NO: 3425863 - RNA, 23 nt, Human
agaguccaucagccuccauccua

SEQ ID NO: 3425864 - RNA, 15 nt, Human
agagucccacugccu

SEQ ID NO: 3425865 - RNA, 19 nt, Human
agagucccacugccucagg

SEQ ID NO: 3425866 - RNA, 21 nt, Human
agagucccacugccucagguu

SEQ ID NO: 3425867 - RNA, 15 nt, Human
agaguccccccacuc

SEQ ID NO: 3425868 - RNA, 12 nt, Human
agaguccuauuu

SEQ ID NO: 3425869 - RNA, 12 nt, Human
agaguccucuga

SEQ ID NO: 3425870 - RNA, 14 nt, Human
agaguccugcacag

SEQ ID NO: 3425871 - RNA, 17 nt, Human
agagucuaaagauggag

SEQ ID NO: 3425872 - RNA, 13 nt, Human
agagucuagauuc

SEQ ID NO: 3425873 - RNA, 23 nt, Human
agagucuagauucaaagguucua

SEQ ID NO: 3425874 - RNA, 17 nt, Human
agagucuauugucuccu

SEQ ID NO: 3425875 - RNA, 18 nt, Human
agagucucacuccccucc

SEQ ID NO: 3425876 - RNA, 12 nt, Human
agagucugaaca

SEQ ID NO: 3425877 - RNA, 17 nt, Human
agagucugaacagcugu

SEQ ID NO: 3425878 - RNA, 22 nt, Human
agagucugagggcuuguaguuc

SEQ ID NO: 3425879 - RNA, 23 nt, Human
agagucugagggcuuguaguucu

SEQ ID NO: 3425880 - RNA, 23 nt, Human
agagucuggauaacuuccacagg

SEQ ID NO: 3425881 - RNA, 23 nt, Human
agagucuggugaagcucacuucu

SEQ ID NO: 3425882 - RNA, 21 nt, Human
agagucuuccacuucaaugca

SEQ ID NO: 3425883 - RNA, 18 nt, Human
agagucuugcagugauua

SEQ ID NO: 3425884 - RNA, 15 nt, Human
agagugagacccugu

SEQ ID NO: 3425885 - RNA, 18 nt, Human
agagugagacucagucuu

SEQ ID NO: 3425886 - RNA, 15 nt, Human
agagugagacucugu

SEQ ID NO: 3425887 - RNA, 22 nt, Human
agagugagagacauuaacucau

SEQ ID NO: 3425888 - RNA, 16 nt, Human
agagugagcuacagag

SEQ ID NO: 3425889 - RNA, 14 nt, Human
agagugcaaaacau

SEQ ID NO: 3425890 - RNA, 17 nt, Human
agagugcgccgagucug

SEQ ID NO: 3425891 - RNA, 21 nt, Human
agagugcuguccgguggagau

SEQ ID NO: 3425892 - RNA, 22 nt, Human
agaguggaaugcuuccuagaag

SEQ ID NO: 3425893 - RNA, 13 nt, Human
agaguggaggugg

SEQ ID NO: 3425894 - RNA, 21 nt, Human
agaguggccccaccuggcccu

SEQ ID NO: 3425895 - RNA, 11 nt, Human
agaguggccug

SEQ ID NO: 3425896 - RNA, 14 nt, Human
agaguggccuggcc

SEQ ID NO: 3425897 - RNA, 16 nt, Human
agaguggccuggccag

SEQ ID NO: 3425898 - RNA, 13 nt, Human
agaguggcuccuc

SEQ ID NO: 3425899 - RNA, 15 nt, Human
agaguggcuccuccc

SEQ ID NO: 3425900 - RNA, 14 nt, Human
agaguggcuggggc

SEQ ID NO: 3425901 - RNA, 19 nt, Human
agaguggggauaugauuua

SEQ ID NO: 3425902 - RNA, 14 nt, Human
agaguggggguggg

SEQ ID NO: 3425903 - RNA, 15 nt, Human
agagugguauuugca

SEQ ID NO: 3425904 - RNA, 18 nt, Human
agaguggucuuucuggag

SEQ ID NO: 3425905 - RNA, 11 nt, Human
agaguguaaaa

SEQ ID NO: 3425906 - RNA, 12 nt, Human
agaguguagaag

SEQ ID NO: 3425907 - RNA, 13 nt, Human
agaguguagaagc

SEQ ID NO: 3425908 - RNA, 18 nt, Human
agaguguagacuguggcu

SEQ ID NO: 3425909 - RNA, 15 nt, Human
agagugucaaccaga

SEQ ID NO: 3425910 - RNA, 20 nt, Human
agagugucaaccagacagag

SEQ ID NO: 3425911 - RNA, 22 nt, Human
agagugucuucacggcaggaca

SEQ ID NO: 3425912 - RNA, 19 nt, Human
agagugugaaauagacauu

SEQ ID NO: 3425913 - RNA, 11 nt, Human
agagugugacc

SEQ ID NO: 3425914 - RNA, 21 nt, Human
agagugugaccaaaaguuaca

SEQ ID NO: 3425915 - RNA, 14 nt, Human
agagugugccugaa

SEQ ID NO: 3425916 - RNA, 17 nt, Human
agaguguggcaaaauaa

SEQ ID NO: 3425917 - RNA, 17 nt, Human
agaguguggccuucgga

SEQ ID NO: 3425918 - RNA, 13 nt, Human
agaguguugaaac

SEQ ID NO: 3425919 - RNA, 23 nt, Human
agaguuaaauagaguauaugcac

SEQ ID NO: 3425920 - RNA, 16 nt, Human
agaguuaacaaugaua

SEQ ID NO: 3425921 - RNA, 12 nt, Human
agaguuaagaag

SEQ ID NO: 3425922 - RNA, 13 nt, Human
agaguuaagaagc

SEQ ID NO: 3425923 - RNA, 17 nt, Human
agaguuaagaagcuguu

SEQ ID NO: 3425924 - RNA, 20 nt, Human
agaguuaagaagcuguugua

SEQ ID NO: 3425925 - RNA, 21 nt, Human
agaguuaagaagcuguuguac

SEQ ID NO: 3425926 - RNA, 13 nt, Human
agaguuaagaaug

SEQ ID NO: 3425927 - RNA, 14 nt, Human
agaguuaaucaacu

SEQ ID NO: 3425928 - RNA, 19 nt, Human
agaguuaaucaacugaaag

SEQ ID NO: 3425929 - RNA, 13 nt, Human
agaguuagacugu

SEQ ID NO: 3425930 - RNA, 21 nt, Human
agaguuagguuuaacauaaag

SEQ ID NO: 3425931 - RNA, 19 nt, Human
agaguuaguuucuuuggga

SEQ ID NO: 3425932 - RNA, 20 nt, Human
agaguucaauggcugcugaa

SEQ ID NO: 3425933 - RNA, 18 nt, Human
agaguucagggaagauaa

SEQ ID NO: 3425934 - RNA, 13 nt, Human
agaguuccagagg

SEQ ID NO: 3425935 - RNA, 19 nt, Human
agaguucuauacuguaaag

SEQ ID NO: 3425936 - RNA, 14 nt, Human
agaguugaagacag

SEQ ID NO: 3425937 - RNA, 19 nt, Human
aggcuaaaauguuuucagc

SEQ ID NO: 3425938 - RNA, 19 nt, Human
aggcuaaggcguggagcug

SEQ ID NO: 3425939 - RNA, 20 nt, Human
aggcuaaggcguggagcugc

SEQ ID NO: 3425940 - RNA, 14 nt, Human
aggcuaaugucaaa

SEQ ID NO: 3425941 - RNA, 23 nt, Human
aggcuaauguuggcagaugcagc

SEQ ID NO: 3425942 - RNA, 12 nt, Human
aggcuacagaga

SEQ ID NO: 3425943 - RNA, 16 nt, Human
aggcuacagagaagcc

SEQ ID NO: 3425944 - RNA, 18 nt, Human
aggcuacagagaagccuu

SEQ ID NO: 3425945 - RNA, 14 nt, Human
aggcuacagggcca

SEQ ID NO: 3425946 - RNA, 16 nt, Human
aggcuaccuuauugua

SEQ ID NO: 3425947 - RNA, 13 nt, Human
aggcuacucaccu

SEQ ID NO: 3425948 - RNA, 21 nt, Human
aggcuagaaccaccugccuau

SEQ ID NO: 3425949 - RNA, 20 nt, Human
aggcuagagugcaguggcau

SEQ ID NO: 3425950 - RNA, 17 nt, Human
aggcuagauguauguac

SEQ ID NO: 3425951 - RNA, 15 nt, Human
aggcuagcuucugcu

SEQ ID NO: 3425952 - RNA, 15 nt, Human
aggcuagggugggga

SEQ ID NO: 3425953 - RNA, 16 nt, Human
aggcuaggguggggag

SEQ ID NO: 3425954 - RNA, 19 nt, Human
aggcuaggguggggagaga

SEQ ID NO: 3425955 - RNA, 23 nt, Human
aggcuagguggguugaaagccaa

SEQ ID NO: 3425956 - RNA, 18 nt, Human
aggcuaguccggacccac

SEQ ID NO: 3425957 - RNA, 22 nt, Human
aggcuauggacagggcaugcca

SEQ ID NO: 3425958 - RNA, 17 nt, Human
aggcuauguauaaaaua

SEQ ID NO: 3425959 - RNA, 17 nt, Human
aggcuaugugauuacaa

SEQ ID NO: 3425960 - RNA, 16 nt, Human
aggcuauuauuuucac

SEQ ID NO: 3425961 - RNA, 15 nt, Human
aggcuauuccugaga

SEQ ID NO: 3425962 - RNA, 20 nt, Human
aggcuauuccugagagcugc

SEQ ID NO: 3425963 - RNA, 16 nt, Human
aggcuauuuguaaauc

SEQ ID NO: 3425964 - RNA, 15 nt, Human
aggcucaaacaauga

SEQ ID NO: 3425965 - RNA, 16 nt, Human
aggcucacccccuucu

SEQ ID NO: 3425966 - RNA, 21 nt, Human
aggcucacccccuucuccauc

SEQ ID NO: 3425967 - RNA, 12 nt, Human
aggcucacugcc

SEQ ID NO: 3425968 - RNA, 24 nt, Human
aggcucacugccaggccagccucc

SEQ ID NO: 3425969 - RNA, 13 nt, Human
aggcucagagaug

SEQ ID NO: 3425970 - RNA, 18 nt, Human
aggcucagaggguguccu

SEQ ID NO: 3425971 - RNA, 19 nt, Human
aggcucagaggguguccug

SEQ ID NO: 3425972 - RNA, 15 nt, Human
aggcucauuuacugu

SEQ ID NO: 3425973 - RNA, 11 nt, Human
aggcuccacuu

SEQ ID NO: 3425974 - RNA, 22 nt, Human
aggcuccacuuggucugugaga

SEQ ID NO: 3425975 - RNA, 16 nt, Human
aggcuccagagggcac

SEQ ID NO: 3425976 - RNA, 19 nt, Human
aggcuccaggagcagccac

SEQ ID NO: 3425977 - RNA, 13 nt, Human
aggcuccaggcag

SEQ ID NO: 3425978 - RNA, 14 nt, Human
aggcuccaggcagc

SEQ ID NO: 3425979 - RNA, 14 nt, Human
aggcuccauuagga

SEQ ID NO: 3425980 - RNA, 15 nt, Human
aggcuccccugagga

SEQ ID NO: 3425981 - RNA, 13 nt, Human
aggcuccugccac

SEQ ID NO: 3425982 - RNA, 13 nt, Human
aggcuccugcccc

SEQ ID NO: 3425983 - RNA, 12 nt, Human
aggcuccugucc

SEQ ID NO: 3425984 - RNA, 19 nt, Human
aggcuccugugcuacuuug

SEQ ID NO: 3425985 - RNA, 23 nt, Human
aggcuccuuaggguuuucucucu

SEQ ID NO: 3425986 - RNA, 14 nt, Human
aggggcaucugccc

SEQ ID NO: 3425987 - RNA, 21 nt, Human
aggggcauguauuggccugga

SEQ ID NO: 3425988 - RNA, 23 nt, Human
aggggccaaauauauucucuuug

SEQ ID NO: 3425989 - RNA, 17 nt, Human
aggggccagaagaugaa

SEQ ID NO: 3425990 - RNA, 22 nt, Human
aggggccagaggaacuguccag

SEQ ID NO: 3425991 - RNA, 24 nt, Human
aggcugccugagucgugaccugcu

SEQ ID NO: 3425992 - RNA, 17 nt, Human
aggcugcggccccuccc

SEQ ID NO: 3425993 - RNA, 17 nt, Human
aggcugcucagggcugg

SEQ ID NO: 3425994 - RNA, 17 nt, Human
aggcugcucggggugca

SEQ ID NO: 3425995 - RNA, 21 nt, Human
aggcugcucggggugcacagg

SEQ ID NO: 3425996 - RNA, 13 nt, Human
aggcugcuggagg

SEQ ID NO: 3425997 - RNA, 15 nt, Human
aggcugcuggaggaa

SEQ ID NO: 3425998 - RNA, 12 nt, Human
aggcugcuggcg

SEQ ID NO: 3425999 - RNA, 19 nt, Human
aggcugcuggcgccucugc

SEQ ID NO: 3426000 - RNA, 22 nt, Human
aggcugcuggggccucagacga

SEQ ID NO: 3426001 - RNA, 22 nt, Human
aggcugcuuagaauccaaacuu

SEQ ID NO: 3426002 - RNA, 18 nt, Human
aggcugcuuuccaaagcc

SEQ ID NO: 3426003 - RNA, 18 nt, Human
aggcuggaagauagcugu

SEQ ID NO: 3426004 - RNA, 17 nt, Human
aggcuggaaggaggaag

SEQ ID NO: 3426005 - RNA, 21 nt, Human
aggcuggacuccagaucugca

SEQ ID NO: 3426006 - RNA, 20 nt, Human
aggcuggagaagcucaccca

SEQ ID NO: 3426007 - RNA, 17 nt, Human
aggcuggagcuggcguc

SEQ ID NO: 3426008 - RNA, 15 nt, Human
aggcuggaggaaggg

SEQ ID NO: 3426009 - RNA, 14 nt, Human
aggcuggaggcagg

SEQ ID NO: 3426010 - RNA, 16 nt, Human
aggcuggaggcagggc

SEQ ID NO: 3426011 - RNA, 23 nt, Human
aggcuggaguugucacugcuuuu

SEQ ID NO: 3426012 - RNA, 23 nt, Human
aggcuggaucuuggagaauguga

SEQ ID NO: 3426013 - RNA, 15 nt, Human
aggcuggcagcucuc

SEQ ID NO: 3426014 - RNA, 17 nt, Human
aggcuggcagcucucca

SEQ ID NO: 3426015 - RNA, 19 nt, Human
aggcuggcagcucuccagu

SEQ ID NO: 3426016 - RNA, 15 nt, Human
aggcuggccagcccc

SEQ ID NO: 3426017 - RNA, 18 nt, Human
aggcuggccagccgcucu

SEQ ID NO: 3426018 - RNA, 15 nt, Human
aggcuggccagucca

SEQ ID NO: 3426019 - RNA, 18 nt, Human
aggcuggccaguccaggc

SEQ ID NO: 3426020 - RNA, 19 nt, Human
aggcuggccaguccaggcu

SEQ ID NO: 3426021 - RNA, 12 nt, Human
aggcuggcccug

SEQ ID NO: 3426022 - RNA, 16 nt, Human
aggcuggcccugcccu

SEQ ID NO: 3426023 - RNA, 18 nt, Human
aggcuggcccugcccugg

SEQ ID NO: 3426024 - RNA, 14 nt, Human
aggcuggccucaga

SEQ ID NO: 3426025 - RNA, 15 nt, Human
aggcuggccucagac

SEQ ID NO: 3426026 - RNA, 18 nt, Human
aggcuggcgagagucugg

SEQ ID NO: 3426027 - RNA, 19 nt, Human
aggcuggcgcagccaaggc

SEQ ID NO: 3426028 - RNA, 22 nt, Human
aggcuggcgcagccaaggccga

SEQ ID NO: 3426029 - RNA, 17 nt, Human
aggcuggcgugcagugg

SEQ ID NO: 3426030 - RNA, 13 nt, Human
aggcuggcuggcc

SEQ ID NO: 3426031 - RNA, 14 nt, Human
aggcuggcuugucc

SEQ ID NO: 3426032 - RNA, 19 nt, Human
aggcuggcuuucagaguag

SEQ ID NO: 3426033 - RNA, 18 nt, Human
aggcugggacgcucugcu

SEQ ID NO: 3426034 - RNA, 13 nt, Human
aggcugggccaag

SEQ ID NO: 3426035 - RNA, 22 nt, Human
aggcugggccauguccaaagag

SEQ ID NO: 3426036 - RNA, 14 nt, Human
aggcugggcccaga

SEQ ID NO: 3426037 - RNA, 18 nt, Human
aggcugggcucccuuccc

SEQ ID NO: 3426038 - RNA, 18 nt, Human
aggcugggcugggcacug

SEQ ID NO: 3426039 - RNA, 19 nt, Human
aggcugggcugggcacugc

SEQ ID NO: 3426040 - RNA, 22 nt, Human
aggcugggcuucaguggcagcu

SEQ ID NO: 3426041 - RNA, 16 nt, Human
aggcuggggaaguccu

SEQ ID NO: 3426042 - RNA, 18 nt, Human
aggcuggggaaguccucu

SEQ ID NO: 3426043 - RNA, 16 nt, Human
aggcuggggcugaccu

SEQ ID NO: 3426044 - RNA, 15 nt, Human
aggcugggugacaga

SEQ ID NO: 3426045 - RNA, 17 nt, Human
aggcugggugcccacag

SEQ ID NO: 3426046 - RNA, 17 nt, Human
aggcuggguucugaucc

SEQ ID NO: 3426047 - RNA, 21 nt, Human
aggcugguacaacggaggccu

SEQ ID NO: 3426048 - RNA, 17 nt, Human
aggcuggucuaaaacuc

SEQ ID NO: 3426049 - RNA, 11 nt, Human
aggcuggucuu

SEQ ID NO: 3426050 - RNA, 15 nt, Human
aggcuggucuugaag

SEQ ID NO: 3426051 - RNA, 22 nt, Human
aggcuggugcuguggccagggu

SEQ ID NO: 3426052 - RNA, 15 nt, Human
aggcugguggcccag

SEQ ID NO: 3426053 - RNA, 12 nt, Human
aggcugguggga

SEQ ID NO: 3426054 - RNA, 18 nt, Human
aggcuggugggaggggcg

SEQ ID NO: 3426055 - RNA, 22 nt, Human
aggcugguucggauuuggggug

SEQ ID NO: 3426056 - RNA, 12 nt, Human
aggcuguaacua

SEQ ID NO: 3426057 - RNA, 13 nt, Human
aggcuguauccca

SEQ ID NO: 3426058 - RNA, 20 nt, Human
aggcuguaucccaugagccu

SEQ ID NO: 3426059 - RNA, 20 nt, Human
aggcugucaauuacaggaag

SEQ ID NO: 3426060 - RNA, 21 nt, Human
aggcuguccuuacccaucugc

SEQ ID NO: 3426061 - RNA, 15 nt, Human
aggcugucuggccag

SEQ ID NO: 3426062 - RNA, 17 nt, Human
aggcugucuggccaggc

SEQ ID NO: 3426063 - RNA, 20 nt, Human
aggcugucuucucaggcucu

SEQ ID NO: 3426064 - RNA, 23 nt, Human
aggcugucuucucaggcucugcc

SEQ ID NO: 3426065 - RNA, 24 nt, Human
aggcugugcucccugguucugaug

SEQ ID NO: 3426066 - RNA, 20 nt, Human
aggcugugcugcccugaaga

SEQ ID NO: 3426067 - RNA, 18 nt, Human
aggcuguggaccauggag

SEQ ID NO: 3426068 - RNA, 14 nt, Human
aggcuguggcuggu

SEQ ID NO: 3426069 - RNA, 18 nt, Human
aggcugugggccucaagg

SEQ ID NO: 3426070 - RNA, 16 nt, Human
aggcuguggucacagc

SEQ ID NO: 3426071 - RNA, 17 nt, Human
aggcuguguaagauuug

SEQ ID NO: 3426072 - RNA, 19 nt, Human
aggcuguguaagauuuguu

SEQ ID NO: 3426073 - RNA, 21 nt, Human
aggcuguguuuggcuuucagg

SEQ ID NO: 3426074 - RNA, 18 nt, Human
aggcuguucugcacugaa

SEQ ID NO: 3426075 - RNA, 20 nt, Human
aggcuguucugcacugaaaa

SEQ ID NO: 3426076 - RNA, 19 nt, Human
aggcuguugaauggaauuu

SEQ ID NO: 3426077 - RNA, 12 nt, Human
aggcuguuugcu

SEQ ID NO: 3426078 - RNA, 14 nt, Human
aggcuguuugcuuc

SEQ ID NO: 3426079 - RNA, 17 nt, Human
aggcuguuuuugggugc

SEQ ID NO: 3426080 - RNA, 21 nt, Human
aggcuuaauaaaaaugacaga

SEQ ID NO: 3426081 - RNA, 17 nt, Human
aggcuuaccaaaguauu

SEQ ID NO: 3426082 - RNA, 12 nt, Human
aggcuuagaccc

SEQ ID NO: 3426083 - RNA, 22 nt, Human
aggcuuagacccucaugcugcc

SEQ ID NO: 3426084 - RNA, 23 nt, Human
aggcuuagacccucaugcugcca

SEQ ID NO: 3426085 - RNA, 21 nt, Human
aggcuuagucacugagacagc

SEQ ID NO: 3426086 - RNA, 22 nt, Human
aggcuuagucacugagacagcc

SEQ ID NO: 3426087 - RNA, 14 nt, Human
aggcuuauaaaaca

SEQ ID NO: 3426088 - RNA, 16 nt, Human
aggcuuauaaaacaga

SEQ ID NO: 3426089 - RNA, 16 nt, Human
aggcuuauauucaacc

SEQ ID NO: 3426090 - RNA, 18 nt, Human
aggcuuauauucaaccau

SEQ ID NO: 3426091 - RNA, 22 nt, Human
aggcuuauauuuguguaauuuu

SEQ ID NO: 3426092 - RNA, 19 nt, Human
aggcuucaaaauguuaucu

SEQ ID NO: 3426093 - RNA, 13 nt, Human
aggcuuccagaga

SEQ ID NO: 3426094 - RNA, 10 nt, Human
aggcuuccug

SEQ ID NO: 3426095 - RNA, 22 nt, Human
aggcuuccugcaauuuucuaag

SEQ ID NO: 3426096 - RNA, 21 nt, Human
aggcuuccuucauuuccuccg

SEQ ID NO: 3426097 - RNA, 22 nt, Human
aggcuucuccaauucugcccaa

SEQ ID NO: 3426098 - RNA, 19 nt, Human
aggcuucuccgccagccuc

SEQ ID NO: 3426099 - RNA, 21 nt, Human
aggcuucuccgccagccuccu

SEQ ID NO: 3426100 - RNA, 16 nt, Human
aggcuucucuguucua

SEQ ID NO: 3426101 - RNA, 21 nt, Human
aggcuucugcuggggccuggg

SEQ ID NO: 3426102 - RNA, 20 nt, Human
aggcuucuguuccucucuuu

SEQ ID NO: 3426103 - RNA, 16 nt, Human
aggcuucuucagauca

SEQ ID NO: 3426104 - RNA, 13 nt, Human
aggcuugaagcug

SEQ ID NO: 3426105 - RNA, 15 nt, Human
aggcuugccugcagg

SEQ ID NO: 3426106 - RNA, 16 nt, Human
aggcuugccugcaggc

SEQ ID NO: 3426107 - RNA, 17 nt, Human
aggcuugccugcaggca

SEQ ID NO: 3426108 - RNA, 20 nt, Human
aggcuugcugagaggggcug

SEQ ID NO: 3426109 - RNA, 15 nt, Human
aggcuugcugcagau

SEQ ID NO: 3426110 - RNA, 21 nt, Human
aggcuugggauuugcugugua

SEQ ID NO: 3426111 - RNA, 17 nt, Human
aggcuuggggcuggaga

SEQ ID NO: 3426112 - RNA, 14 nt, Human
aggcuugguuccuu

SEQ ID NO: 3426113 - RNA, 20 nt, Human
aggcuugucagagcugggag

SEQ ID NO: 3426114 - RNA, 16 nt, Human
aggcuuguugugcuuu

SEQ ID NO: 3426115 - RNA, 22 nt, Human
aggcuuguuuaccuuucucucu

SEQ ID NO: 3426116 - RNA, 19 nt, Human
aggcuuuacuuagcuuauc

SEQ ID NO: 3426117 - RNA, 21 nt, Human
aggcuuuacuuagcuuaucaa

SEQ ID NO: 3426118 - RNA, 18 nt, Human
aggcuuuaguguauuuau

SEQ ID NO: 3426119 - RNA, 19 nt, Human
aggcuuucacuauuuccuu

SEQ ID NO: 3426120 - RNA, 23 nt, Human
aggcuuucccacuucccacccug

SEQ ID NO: 3426121 - RNA, 13 nt, Human
aggcuuucucuac

SEQ ID NO: 3426122 - RNA, 19 nt, Human
aggcuuugauuaguuuucu

SEQ ID NO: 3426123 - RNA, 13 nt, Human
aggcuuuguguug

SEQ ID NO: 3426124 - RNA, 17 nt, Human
aggcuuuguguuguaau

SEQ ID NO: 3426125 - RNA, 22 nt, Human
aggcuuuuguuuccuuuuucag

SEQ ID NO: 3426126 - RNA, 21 nt, Human
aggcuuuuuuaucaugugaaa

SEQ ID NO: 3426127 - RNA, 16 nt, Human
agggaaaacauuccau

SEQ ID NO: 3426128 - RNA, 22 nt, Human
agggaaaagauaaagaccagaa

SEQ ID NO: 3426129 - RNA, 15 nt, Human
aggguccccaccugg

SEQ ID NO: 3426130 - RNA, 23 nt, Human
agggucccccacucuaaagcaaa

SEQ ID NO: 3426131 - RNA, 15 nt, Human
agggucccucugugu

SEQ ID NO: 3426132 - RNA, 12 nt, Human
agggucccuggu

SEQ ID NO: 3426133 - RNA, 17 nt, Human
agggucccugguggcag

SEQ ID NO: 3426134 - RNA, 18 nt, Human
aggguccucuacuucagg

SEQ ID NO: 3426135 - RNA, 19 nt, Human
aggguccugcagccugcag

SEQ ID NO: 3426136 - RNA, 20 nt, Human
aggguccuggcuccugaggg

SEQ ID NO: 3426137 - RNA, 12 nt, Human
aggguccugggg

SEQ ID NO: 3426138 - RNA, 16 nt, Human
agggucuagggagaga

SEQ ID NO: 3426139 - RNA, 21 nt, Human
agggucucacucugucgccca

SEQ ID NO: 3426140 - RNA, 12 nt, Human
agggucucuacc

SEQ ID NO: 3426141 - RNA, 21 nt, Human
agggucucuagugcugugaaa

SEQ ID NO: 3426142 - RNA, 16 nt, Human
agggucucucccucag

SEQ ID NO: 3426143 - RNA, 17 nt, Human
agggucugcucuuucuc

SEQ ID NO: 3426144 - RNA, 22 nt, Human
agggucugcucuuucucugcca

SEQ ID NO: 3426145 - RNA, 15 nt, Human
agggucuggagaagc

SEQ ID NO: 3426146 - RNA, 19 nt, Human
agggucuguuuggacugca

SEQ ID NO: 3426147 - RNA, 15 nt, Human
agggucuucccuacc

SEQ ID NO: 3426148 - RNA, 17 nt, Human
agggucuucccuaccuc

SEQ ID NO: 3426149 - RNA, 14 nt, Human
agggucuugggaaa

SEQ ID NO: 3426150 - RNA, 15 nt, Human
agauuagaagcugaa

SEQ ID NO: 3426151 - RNA, 15 nt, Human
agauuagaauucugu

SEQ ID NO: 3426152 - RNA, 22 nt, Human
agauuagaauucuguauagauu

SEQ ID NO: 3426153 - RNA, 14 nt, Human
agauuagagggagg

SEQ ID NO: 3426154 - RNA, 18 nt, Human
agauuagagggagguguu

SEQ ID NO: 3426155 - RNA, 16 nt, Human
agauuagaucuuuuaa

SEQ ID NO: 3426156 - RNA, 15 nt, Human
agauuagcucuggac

SEQ ID NO: 3426157 - RNA, 18 nt, Human
agauuauaauaaauauau

SEQ ID NO: 3426158 - RNA, 17 nt, Human
agauuauacagaauugu

SEQ ID NO: 3426159 - RNA, 14 nt, Human
agauuauagauucu

SEQ ID NO: 3426160 - RNA, 17 nt, Human
agauuauagauucuaaa

SEQ ID NO: 3426161 - RNA, 18 nt, Human
agauuauagauucuaaag

SEQ ID NO: 3426162 - RNA, 19 nt, Human
agauuauagauucuaaaga

SEQ ID NO: 3426163 - RNA, 20 nt, Human
agauuauagauucuaaagau

SEQ ID NO: 3426164 - RNA, 15 nt, Human
agauuauaucaaagu

SEQ ID NO: 3426165 - RNA, 16 nt, Human
agauuauauugagaca

SEQ ID NO: 3426166 - RNA, 21 nt, Human
agauuauauugagacaaaaau

SEQ ID NO: 3426167 - RNA, 12 nt, Human
agauuauuuaca

SEQ ID NO: 3426168 - RNA, 14 nt, Human
agauuauuuacaag

SEQ ID NO: 3426169 - RNA, 19 nt, Human
agauuauuuacaagaagaa

SEQ ID NO: 3426170 - RNA, 20 nt, Human
agauuauuuuggaaaguuuu

SEQ ID NO: 3426171 - RNA, 16 nt, Human
agauuauuuuuuauga

SEQ ID NO: 3426172 - RNA, 16 nt, Human
agauucaaagguucua

SEQ ID NO: 3426173 - RNA, 23 nt, Human
agauucaauauugaauuuuuccu

SEQ ID NO: 3426174 - RNA, 21 nt, Human
agauucaaugccccugaauuu

SEQ ID NO: 3426175 - RNA, 15 nt, Human
agauucaccuguaaa

SEQ ID NO: 3426176 - RNA, 17 nt, Human
agauucaccuguaaaac

SEQ ID NO: 3426177 - RNA, 22 nt, Human
agauucacuuaacaaacaaauu

SEQ ID NO: 3426178 - RNA, 16 nt, Human
agauucagguaauaca

SEQ ID NO: 3426179 - RNA, 20 nt, Human
agauucagguaauacaaacu

SEQ ID NO: 3426180 - RNA, 19 nt, Human
agauucagguauguugccu

SEQ ID NO: 3426181 - RNA, 15 nt, Human
agauucagucuugcc

SEQ ID NO: 3426182 - RNA, 15 nt, Human
agauucauccauuua

SEQ ID NO: 3426183 - RNA, 20 nt, Human
agauuccauugguccaagau

SEQ ID NO: 3426184 - RNA, 23 nt, Human
agauuccauugguccaagauucc

SEQ ID NO: 3426185 - RNA, 13 nt, Human
agauucccagaga

SEQ ID NO: 3426186 - RNA, 16 nt, Human
agauucccagagcaaa

SEQ ID NO: 3426187 - RNA, 12 nt, Human
agauucccagga

SEQ ID NO: 3426188 - RNA, 13 nt, Human
agauucccaggag

SEQ ID NO: 3426189 - RNA, 22 nt, Human
agauucccaggaguucugcuca

SEQ ID NO: 3426190 - RNA, 23 nt, Human
agauuccccauugccuccuccuu

SEQ ID NO: 3426191 - RNA, 16 nt, Human
agauuccggauccuaa

SEQ ID NO: 3426192 - RNA, 18 nt, Human
agauuccggauccuaagc

SEQ ID NO: 3426193 - RNA, 16 nt, Human
agauucgcuuuccaug

SEQ ID NO: 3426194 - RNA, 16 nt, Human
agauucuaaagauucu

SEQ ID NO: 3426195 - RNA, 17 nt, Human
agauucuaaagauucua

SEQ ID NO: 3426196 - RNA, 21 nt, Human
agauucuauguuaauauuuua

SEQ ID NO: 3426197 - RNA, 13 nt, Human
agauucucaaagg

SEQ ID NO: 3426198 - RNA, 17 nt, Human
agauucucccuugcucu

SEQ ID NO: 3426199 - RNA, 23 nt, Human
agauucucuggcuguaaggcucu

SEQ ID NO: 3426200 - RNA, 16 nt, Human
agauucucugugucua

SEQ ID NO: 3426201 - RNA, 23 nt, Human
agauucucugugucuaagauucu

SEQ ID NO: 3426202 - RNA, 17 nt, Human
agauucugaaacauugc

SEQ ID NO: 3426203 - RNA, 20 nt, Human
agauucugaccuuaaaugca

SEQ ID NO: 3426204 - RNA, 19 nt, Human
agauucugccuuugccagg

SEQ ID NO: 3426205 - RNA, 19 nt, Human
agauucugugaucuuuuaa

SEQ ID NO: 3426206 - RNA, 21 nt, Human
agauucugugaucuuuuaaag

SEQ ID NO: 3426207 - RNA, 19 nt, Human
agauucuucccauucucca

SEQ ID NO: 3426208 - RNA, 22 nt, Human
agauucuucccauucuccauuu

SEQ ID NO: 3426209 - RNA, 16 nt, Human
agauucuucuguguuu

SEQ ID NO: 3426210 - RNA, 20 nt, Human
agauucuuucaguucuuugg

SEQ ID NO: 3426211 - RNA, 14 nt, Human
agauucuuuccuga

SEQ ID NO: 3426212 - RNA, 16 nt, Human
agauucuuuccugagg

SEQ ID NO: 3426213 - RNA, 19 nt, Human
agauucuuuccugaggcug

SEQ ID NO: 3426214 - RNA, 22 nt, Human
agauucuuuuaaauuagaaaau

SEQ ID NO: 3426215 - RNA, 15 nt, Human
agauugaaaaggaag

SEQ ID NO: 3426216 - RNA, 18 nt, Human
agauugaaaaucuugugu

SEQ ID NO: 3426217 - RNA, 15 nt, Human
agauugacgacaagu

SEQ ID NO: 3426218 - RNA, 13 nt, Human
agauugagaaaug

SEQ ID NO: 3426219 - RNA, 16 nt, Human
agauugagaaaugugu

SEQ ID NO: 3426220 - RNA, 18 nt, Human
agauugagaaggagagaa

SEQ ID NO: 3426221 - RNA, 19 nt, Human
agauugagagaagagacaa

SEQ ID NO: 3426222 - RNA, 15 nt, Human
agauugagagaauuu

SEQ ID NO: 3426223 - RNA, 22 nt, Human
agauugaggccugcccucaggg

SEQ ID NO: 3426224 - RNA, 22 nt, Human
agauugaguaagauuuacccag

SEQ ID NO: 3426225 - RNA, 22 nt, Human
agauugaguauaaaaacuugaa

SEQ ID NO: 3426226 - RNA, 20 nt, Human
agauugauaucuauaaaaua

SEQ ID NO: 3426227 - RNA, 14 nt, Human
agauugauuguauu

SEQ ID NO: 3426228 - RNA, 21 nt, Human
agauugcaacaggcugggcuu

SEQ ID NO: 3426229 - RNA, 23 nt, Human
agauugcaacaggcugggcuuca

SEQ ID NO: 3426230 - RNA, 16 nt, Human
agauugcagaaaauuc

SEQ ID NO: 3426231 - RNA, 18 nt, Human
agauugcagaaaauucug

SEQ ID NO: 3426232 - RNA, 19 nt, Human
agauugcagaaaauucugu

SEQ ID NO: 3426233 - RNA, 23 nt, Human
agauugcagaaaauucugugccu

SEQ ID NO: 3426234 - RNA, 23 nt, Human
agauugcaugugacucugaagcu

SEQ ID NO: 3426235 - RNA, 21 nt, Human
agauugcgccauugcacucca

SEQ ID NO: 3426236 - RNA, 22 nt, Human
agauugcuguguguugccuggg

SEQ ID NO: 3426237 - RNA, 15 nt, Human
agauugcuuaaaaua

SEQ ID NO: 3426238 - RNA, 23 nt, Human
agauugcuuugauuaauccagaa

SEQ ID NO: 3426239 - RNA, 16 nt, Human
agauuggaaggagaca

SEQ ID NO: 3426240 - RNA, 22 nt, Human
agauuggaaggagacacagaug

SEQ ID NO: 3426241 - RNA, 21 nt, Human
agauuggugggauuuuuuguu

SEQ ID NO: 3426242 - RNA, 15 nt, Human
agauugguuuuccug

SEQ ID NO: 3426243 - RNA, 22 nt, Human
agauuguaaaccgcuuuggccu

SEQ ID NO: 3426244 - RNA, 18 nt, Human
agauugugaauaaugauu

SEQ ID NO: 3426245 - RNA, 18 nt, Human
agauugugggggaaaaau

SEQ ID NO: 3426246 - RNA, 23 nt, Human
agauuguuguuugccauacuuug

SEQ ID NO: 3426247 - RNA, 19 nt, Human
agauuguuuaucuagaugu

SEQ ID NO: 3426248 - RNA, 22 nt, Human
agauuguuuaucuagauguaaa

SEQ ID NO: 3426249 - RNA, 18 nt, Human
agauuguuucuauacaaa

SEQ ID NO: 3426250 - RNA, 19 nt, Human
agauuuaagcacaaacuuu

SEQ ID NO: 3426251 - RNA, 16 nt, Human
agauuuaauauuacag

SEQ ID NO: 3426252 - RNA, 20 nt, Human
agauuuaaucugccaagggc

SEQ ID NO: 3426253 - RNA, 13 nt, Human
agauuuaauuaau

SEQ ID NO: 3426254 - RNA, 16 nt, Human
agauuuaauuugccaa

SEQ ID NO: 3426255 - RNA, 17 nt, Human
agauuuaauuugccaaa

SEQ ID NO: 3426256 - RNA, 16 nt, Human
agauuuacacugggag

SEQ ID NO: 3426257 - RNA, 16 nt, Human
agauuuaccacuugug

SEQ ID NO: 3426258 - RNA, 19 nt, Human
agauuuaguguaauaagac

SEQ ID NO: 3426259 - RNA, 16 nt, Human
agauuuaucaaaucag

SEQ ID NO: 3426260 - RNA, 14 nt, Human
agauuuauuaaaga

SEQ ID NO: 3426261 - RNA, 15 nt, Human
agauuuauuaaagaa

SEQ ID NO: 3426262 - RNA, 19 nt, Human
agauuuauuaaagaaaaaa

SEQ ID NO: 3426263 - RNA, 15 nt, Human
agauuuauuccuuug

SEQ ID NO: 3426264 - RNA, 15 nt, Human
agauuuauuuuguua

SEQ ID NO: 3426265 - RNA, 21 nt, Human
agauuuauuuuucaguuccaa

SEQ ID NO: 3426266 - RNA, 19 nt, Human
agauuuauuuuuuggacuu

SEQ ID NO: 3426267 - RNA, 17 nt, Human
agauuucagucuuuucc

SEQ ID NO: 3426268 - RNA, 19 nt, Human
agauuucauaguucagaau

SEQ ID NO: 3426269 - RNA, 19 nt, Human
agauuucaucugcucuccu

SEQ ID NO: 3426270 - RNA, 20 nt, Human
agauuucaucugcucuccuu

SEQ ID NO: 3426271 - RNA, 15 nt, Human
agauuuccagucucc

SEQ ID NO: 3426272 - RNA, 22 nt, Human
agguuuuguuugcuaucuuaau

SEQ ID NO: 3426273 - RNA, 14 nt, Human
agguuuuuaagccu

SEQ ID NO: 3426274 - RNA, 13 nt, Human
agguuuuucaauu

SEQ ID NO: 3426275 - RNA, 15 nt, Human
agguuuuucaauuaa

SEQ ID NO: 3426276 - RNA, 23 nt, Human
agguuuuucaauuaaacggauua

SEQ ID NO: 3426277 - RNA, 15 nt, Human
agguuuuuguaaaga

SEQ ID NO: 3426278 - RNA, 22 nt, Human
agguuuuuguaaagauuucugu

SEQ ID NO: 3426279 - RNA, 19 nt, Human
agguuuuuguagugauuuu

SEQ ID NO: 3426280 - RNA, 14 nt, Human
agguuuuuuuaaug

SEQ ID NO: 3426281 - RNA, 18 nt, Human
agguuuuuuuccuucuga

SEQ ID NO: 3426282 - RNA, 19 nt, Human
agguuuuuuuccuucugaa

SEQ ID NO: 3426283 - RNA, 22 nt, Human
agguuuuuuugucaacauugug

SEQ ID NO: 3426284 - RNA, 17 nt, Human
agguuuuuuuucaguug

SEQ ID NO: 3426285 - RNA, 16 nt, Human
agguuuuuuuuucuca

SEQ ID NO: 3426286 - RNA, 20 nt, Human
aguaaaaaaugguguuuuau

SEQ ID NO: 3426287 - RNA, 15 nt, Human
aguaaaaauaaaauu

SEQ ID NO: 3426288 - RNA, 12 nt, Human
aguaaaaauaca

SEQ ID NO: 3426289 - RNA, 13 nt, Human
aguaaaaauacaa

SEQ ID NO: 3426290 - RNA, 15 nt, Human
aguaaaaauuaaaaa

SEQ ID NO: 3426291 - RNA, 14 nt, Human
aguaaaacacagag

SEQ ID NO: 3426292 - RNA, 15 nt, Human
aguaaaaccacagca

SEQ ID NO: 3426293 - RNA, 11 nt, Human
aguaaaagaaa

SEQ ID NO: 3426294 - RNA, 13 nt, Human
aguaaaagaaacc

SEQ ID NO: 3426295 - RNA, 20 nt, Human
aguaaaagaaaccacuucug

SEQ ID NO: 3426296 - RNA, 20 nt, Human
aguaaaauaaauauugucuu

SEQ ID NO: 3426297 - RNA, 18 nt, Human
aguaaaauuauacugugu

SEQ ID NO: 3426298 - RNA, 18 nt, Human
aguaaaauucaguuuuuu

SEQ ID NO: 3426299 - RNA, 16 nt, Human
aguaaaauugccauau

SEQ ID NO: 3426300 - RNA, 19 nt, Human
aguaaaauugccauauugc

SEQ ID NO: 3426301 - RNA, 21 nt, Human
aguaaaauugccauauugcac

SEQ ID NO: 3426302 - RNA, 15 nt, Human
aguaaaauuuauuuc

SEQ ID NO: 3426303 - RNA, 16 nt, Human
aguaaaauuuauuuca

SEQ ID NO: 3426304 - RNA, 17 nt, Human
aguaaaauuuauuucau

SEQ ID NO: 3426305 - RNA, 23 nt, Human
aguaaaccacugaaaaaauauau

SEQ ID NO: 3426306 - RNA, 14 nt, Human
aguaaacgggaaca

SEQ ID NO: 3426307 - RNA, 19 nt, Human
aguaaacgggaacaugccc

SEQ ID NO: 3426308 - RNA, 16 nt, Human
aguaaacuaaugaguu

SEQ ID NO: 3426309 - RNA, 19 nt, Human
aguaaacuaaugaguuucu

SEQ ID NO: 3426310 - RNA, 16 nt, Human
aguaaacuauuuaucu

SEQ ID NO: 3426311 - RNA, 15 nt, Human
aguaaagaaaugaca

SEQ ID NO: 3426312 - RNA, 20 nt, Human
aguaaagaaauuuaaaagac

SEQ ID NO: 3426313 - RNA, 14 nt, Human
aguaaagagaaacu

SEQ ID NO: 3426314 - RNA, 13 nt, Human
aguaaagccauua

SEQ ID NO: 3426315 - RNA, 16 nt, Human
aguaaagucaaggaga

SEQ ID NO: 3426316 - RNA, 22 nt, Human
aguaaaguguaacauaugcaaa

SEQ ID NO: 3426317 - RNA, 14 nt, Human
aguaaauaaauugu

SEQ ID NO: 3426318 - RNA, 16 nt, Human
aguaaauaaauuguuu

SEQ ID NO: 3426319 - RNA, 21 nt, Human
aguaaauauugaggcuuugug

SEQ ID NO: 3426320 - RNA, 19 nt, Human
aguaaaucacgcuuuuuga

SEQ ID NO: 3426321 - RNA, 14 nt, Human
aguaaaucucuucu

SEQ ID NO: 3426322 - RNA, 15 nt, Human
aguaaaucuuuuaca

SEQ ID NO: 3426323 - RNA, 20 nt, Human
aguaaaugggggugcauuug

SEQ ID NO: 3426324 - RNA, 12 nt, Human
aguaaauguagu

SEQ ID NO: 3426325 - RNA, 15 nt, Human
aguaaauguaguuca

SEQ ID NO: 3426326 - RNA, 15 nt, Human
aguaaaugucuuugu

SEQ ID NO: 3426327 - RNA, 17 nt, Human
aguaaaugucuuuguaa

SEQ ID NO: 3426328 - RNA, 15 nt, Human
aguaaauuauagcuc

SEQ ID NO: 3426329 - RNA, 13 nt, Human
aguaacacuaaua

SEQ ID NO: 3426330 - RNA, 16 nt, Human
aguaacacuaauauau

SEQ ID NO: 3426331 - RNA, 23 nt, Human
aguaacacuaauauauuuaaaaa

SEQ ID NO: 3426332 - RNA, 23 nt, Human
aguaacaggaaaccacuuaucac

SEQ ID NO: 3426333 - RNA, 22 nt, Human
aguaacaucaaagauuagguga

SEQ ID NO: 3426334 - RNA, 18 nt, Human
aguaaccacagaaaagca

SEQ ID NO: 3426335 - RNA, 23 nt, Human
aguaaccaucacugguugcacuu

SEQ ID NO: 3426336 - RNA, 21 nt, Human
aguaacccccuuaaauuuaau

SEQ ID NO: 3426337 - RNA, 18 nt, Human
aguaacgcgucuuccuga

SEQ ID NO: 3426338 - RNA, 19 nt, Human
aguaacgcgucuuccugag

SEQ ID NO: 3426339 - RNA, 22 nt, Human
aguaacgggucguaaugacuua

SEQ ID NO: 3426340 - RNA, 19 nt, Human
aguaacuacaguuagggcu

SEQ ID NO: 3426341 - RNA, 22 nt, Human
aguaacucauaaucuauaaaca

SEQ ID NO: 3426342 - RNA, 14 nt, Human
aguaacucaucugu

SEQ ID NO: 3426343 - RNA, 17 nt, Human
aguaacucauugcucug

SEQ ID NO: 3426344 - RNA, 22 nt, Human
aguaacucauuuguuaaaauua

SEQ ID NO: 3426345 - RNA, 14 nt, Human
aguaacugacaacu

SEQ ID NO: 3426346 - RNA, 23 nt, Human
aguaacugucaggcugaaaacaa

SEQ ID NO: 3426347 - RNA, 13 nt, Human
aggggcaggcaca

SEQ ID NO: 3426348 - RNA, 19 nt, Human
aggggcaggcccugcacug

SEQ ID NO: 3426349 - RNA, 12 nt, Human
aggggcaggcug

SEQ ID NO: 3426350 - RNA, 18 nt, Human
aggggcagucuggagggg

SEQ ID NO: 3426351 - RNA, 20 nt, Human
aggggcagucuggaggggca

SEQ ID NO: 3426352 - RNA, 17 nt, Human
aggggcaucugccccuc

SEQ ID NO: 3426353 - RNA, 19 nt, Human
aggggcaucugccccuccc

SEQ ID NO: 3426354 - RNA, 22 nt, Human
aggggcaucugccccuccccca

SEQ ID NO: 3426355 - RNA, 20 nt, Human
aggggcauguauuggccugg

SEQ ID NO: 3426356 - RNA, 22 nt, Human
aggggccaaauauauucucuuu

SEQ ID NO: 3426357 - RNA, 22 nt, Human
aggggcccaaauucuuucagug

SEQ ID NO: 3426358 - RNA, 22 nt, Human
aggggcccaaggcggccccucc

SEQ ID NO: 3426359 - RNA, 21 nt, Human
aggggcccacagggaacccug

SEQ ID NO: 3426360 - RNA, 22 nt, Human
aggggccccccugcccuguggg

SEQ ID NO: 3426361 - RNA, 19 nt, Human
aggggccccucucagcccu

SEQ ID NO: 3426362 - RNA, 20 nt, Human
aggggccccugcuucuccag

SEQ ID NO: 3426363 - RNA, 21 nt, Human
aggggccccugcuucuccagc

SEQ ID NO: 3426364 - RNA, 19 nt, Human
aggggcccgcuugccucgg

SEQ ID NO: 3426365 - RNA, 20 nt, Human
aggggcccgcuugccucggc

SEQ ID NO: 3426366 - RNA, 14 nt, Human
aggggcccguggga

SEQ ID NO: 3426367 - RNA, 20 nt, Human
aggggcccguugucucccug

SEQ ID NO: 3426368 - RNA, 12 nt, Human
aggggcccugca

SEQ ID NO: 3426369 - RNA, 12 nt, Human
aggggcccuggu

SEQ ID NO: 3426370 - RNA, 17 nt, Human
aggggccgaugcccaga

SEQ ID NO: 3426371 - RNA, 14 nt, Human
aggggccggcccug

SEQ ID NO: 3426372 - RNA, 19 nt, Human
aggggccuaggccucagcc

SEQ ID NO: 3426373 - RNA, 21 nt, Human
aggggccucuuaugggcuggg

SEQ ID NO: 3426374 - RNA, 20 nt, Human
aggggccugccaccuggacc

SEQ ID NO: 3426375 - RNA, 14 nt, Human
aggggccuggagau

SEQ ID NO: 3426376 - RNA, 18 nt, Human
aggggccuggagauccuc

SEQ ID NO: 3426377 - RNA, 12 nt, Human
aggggccuggca

SEQ ID NO: 3426378 - RNA, 17 nt, Human
aggggccuuagggcacu

SEQ ID NO: 3426379 - RNA, 19 nt, Human
aggggccuuagggcacugg

SEQ ID NO: 3426380 - RNA, 20 nt, Human
aggggccuuagggcacuggg

SEQ ID NO: 3426381 - RNA, 20 nt, Human
aggggcgcucgcuuccgcau

SEQ ID NO: 3426382 - RNA, 13 nt, Human
aggggcgcuggcc

SEQ ID NO: 3426383 - RNA, 14 nt, Human
aggggcgcuggccc

SEQ ID NO: 3426384 - RNA, 17 nt, Human
aggggcgcuggcccagc

SEQ ID NO: 3426385 - RNA, 18 nt, Human
aggggcgcuggcccagcc

SEQ ID NO: 3426386 - RNA, 19 nt, Human
aggggcgcuggcccagccg

SEQ ID NO: 3426387 - RNA, 21 nt, Human
aggggcgcuggcccagccggc

SEQ ID NO: 3426388 - RNA, 14 nt, Human
aggggcggcaggag

SEQ ID NO: 3426389 - RNA, 18 nt, Human
aggggcgggacccaggca

SEQ ID NO: 3426390 - RNA, 18 nt, Human
aggggcggugcccacacc

SEQ ID NO: 3426391 - RNA, 16 nt, Human
aggggcgucuguuccc

SEQ ID NO: 3426392 - RNA, 21 nt, Human
aggggcgucuguucccccuuc

SEQ ID NO: 3426393 - RNA, 22 nt, Human
aggggcguggagggcguggagg

SEQ ID NO: 3426394 - RNA, 15 nt, Human
aggggcuacaagagg

SEQ ID NO: 3426395 - RNA, 13 nt, Human
aggggcucccucc

SEQ ID NO: 3426396 - RNA, 13 nt, Human
aggggcuccugga

SEQ ID NO: 3426397 - RNA, 14 nt, Human
aggggcuccuggaa

SEQ ID NO: 3426398 - RNA, 11 nt, Human
aggggcucugc

SEQ ID NO: 3426399 - RNA, 20 nt, Human
aggggcugaaagaacaugga

SEQ ID NO: 3426400 - RNA, 17 nt, Human
aggggcugcccgcuccc

SEQ ID NO: 3426401 - RNA, 19 nt, Human
aggggcugcccgcucccag

SEQ ID NO: 3426402 - RNA, 22 nt, Human
aggggcugcugaccuccacagc

SEQ ID NO: 3426403 - RNA, 14 nt, Human
aggggcuggggacu

SEQ ID NO: 3426404 - RNA, 21 nt, Human
aggggcuggggacuugugucu

SEQ ID NO: 3426405 - RNA, 21 nt, Human
aggggcuuauaauaaaggacu

SEQ ID NO: 3426406 - RNA, 15 nt, Human
aggggcuucaggucc

SEQ ID NO: 3426407 - RNA, 20 nt, Human
aggggcuuucuggagaggag

SEQ ID NO: 3426408 - RNA, 18 nt, Human
agggggaagaagcagaga

SEQ ID NO: 3426409 - RNA, 19 nt, Human
agggggaagaagcagagag

SEQ ID NO: 3426410 - RNA, 22 nt, Human
agggggaaggugggguccugga

SEQ ID NO: 3426411 - RNA, 16 nt, Human
agggggaauggcagca

SEQ ID NO: 3426412 - RNA, 22 nt, Human
agggggacugcugcugccuggc

SEQ ID NO: 3426413 - RNA, 16 nt, Human
agggggagagggcugc

SEQ ID NO: 3426414 - RNA, 23 nt, Human
agggggagccgguaacuguccug

SEQ ID NO: 3426415 - RNA, 23 nt, Human
agggggaugccacuccucccucc

SEQ ID NO: 3426416 - RNA, 12 nt, Human
aguaauuucagu

SEQ ID NO: 3426417 - RNA, 19 nt, Human
aguaauuucaguguaaagu

SEQ ID NO: 3426418 - RNA, 14 nt, Human
aguaauuucuucuc

SEQ ID NO: 3426419 - RNA, 15 nt, Human
aguaauuuguagauu

SEQ ID NO: 3426420 - RNA, 22 nt, Human
aguacaaaugccuuaaaaugga

SEQ ID NO: 3426421 - RNA, 16 nt, Human
aguacacaauaagcaa

SEQ ID NO: 3426422 - RNA, 17 nt, Human
aguacacaauaagcaaa

SEQ ID NO: 3426423 - RNA, 16 nt, Human
aguacaccccaccucu

SEQ ID NO: 3426424 - RNA, 14 nt, Human
aguacacucugcug

SEQ ID NO: 3426425 - RNA, 16 nt, Human
aguacagagaagccau

SEQ ID NO: 3426426 - RNA, 17 nt, Human
aguacaggcagcacaga

SEQ ID NO: 3426427 - RNA, 19 nt, Human
aguacaggcagcacagaga

SEQ ID NO: 3426428 - RNA, 23 nt, Human
aguacagguaaggugagggaaua

SEQ ID NO: 3426429 - RNA, 13 nt, Human
aguacaguggugc

SEQ ID NO: 3426430 - RNA, 22 nt, Human
aguacauaaaggugguaugugu

SEQ ID NO: 3426431 - RNA, 17 nt, Human
aguacauauuuauuuuc

SEQ ID NO: 3426432 - RNA, 22 nt, Human
aguacauauuuauuuucuuuug

SEQ ID NO: 3426433 - RNA, 13 nt, Human
aguacauucucag

SEQ ID NO: 3426434 - RNA, 17 nt, Human
aguacauucucaguuuu

SEQ ID NO: 3426435 - RNA, 20 nt, Human
aguacauucucaguuuuucu

SEQ ID NO: 3426436 - RNA, 19 nt, Human
aguacauuuaaauuuuuug

SEQ ID NO: 3426437 - RNA, 13 nt, Human
aguacauuuaaua

SEQ ID NO: 3426438 - RNA, 21 nt, Human
aguacauuuaauacagcagug

SEQ ID NO: 3426439 - RNA, 16 nt, Human
aguacauuuggagaca

SEQ ID NO: 3426440 - RNA, 19 nt, Human
aguacauuuggagacacaa

SEQ ID NO: 3426441 - RNA, 20 nt, Human
aguacauuuuuugaaaugcu

SEQ ID NO: 3426442 - RNA, 22 nt, Human
aguacauuuuuugaaaugcuga

SEQ ID NO: 3426443 - RNA, 15 nt, Human
aguaccaaucauuuu

SEQ ID NO: 3426444 - RNA, 15 nt, Human
aguaccacucaggcc

SEQ ID NO: 3426445 - RNA, 14 nt, Human
aguaccagacuaga

SEQ ID NO: 3426446 - RNA, 23 nt, Human
aguaccaguaggggcuuauaaua

SEQ ID NO: 3426447 - RNA, 19 nt, Human
aguaccauaguaccauuua

SEQ ID NO: 3426448 - RNA, 21 nt, Human
aguaccauaguaccauuuaua

SEQ ID NO: 3426449 - RNA, 12 nt, Human
aguaccauuuaa

SEQ ID NO: 3426450 - RNA, 18 nt, Human
aguacccaucuaguacuu

SEQ ID NO: 3426451 - RNA, 18 nt, Human
aguacccucucagcucca

SEQ ID NO: 3426452 - RNA, 21 nt, Human
aguaccuagcuggcucuguga

SEQ ID NO: 3426453 - RNA, 17 nt, Human
aguaccugaaaaaaugc

SEQ ID NO: 3426454 - RNA, 19 nt, Human
aguaccugagggucuguag

SEQ ID NO: 3426455 - RNA, 22 nt, Human
aguaccugagggucuguagguu

SEQ ID NO: 3426456 - RNA, 12 nt, Human
aguaccuggagg

SEQ ID NO: 3426457 - RNA, 14 nt, Human
aguaccuggaggag

SEQ ID NO: 3426458 - RNA, 15 nt, Human
aguaccuggaggagg

SEQ ID NO: 3426459 - RNA, 13 nt, Human
aguaccugggcaa

SEQ ID NO: 3426460 - RNA, 20 nt, Human
aguaccuuaucaaaguagca

SEQ ID NO: 3426461 - RNA, 20 nt, Human
aguaccuucagauccuaccc

SEQ ID NO: 3426462 - RNA, 14 nt, Human
aguaccuugcuucu

SEQ ID NO: 3426463 - RNA, 18 nt, Human
aguacgugcuaacaggcu

SEQ ID NO: 3426464 - RNA, 15 nt, Human
aguacguuauuguug

SEQ ID NO: 3426465 - RNA, 17 nt, Human
aguacguugugcauuug

SEQ ID NO: 3426466 - RNA, 18 nt, Human
aguacguugugcauuugg

SEQ ID NO: 3426467 - RNA, 14 nt, Human
aguacuaagaguau

SEQ ID NO: 3426468 - RNA, 19 nt, Human
aguacuacaguccucccau

SEQ ID NO: 3426469 - RNA, 19 nt, Human
aguacuagagauauuuugu

SEQ ID NO: 3426470 - RNA, 15 nt, Human
aguacuccacacugc

SEQ ID NO: 3426471 - RNA, 16 nt, Human
aguacuccacacugca

SEQ ID NO: 3426472 - RNA, 19 nt, Human
aguacuccacacugcacaa

SEQ ID NO: 3426473 - RNA, 18 nt, Human
aguacuccugcaaaauuu

SEQ ID NO: 3426474 - RNA, 19 nt, Human
aguacugagcagugauauu

SEQ ID NO: 3426475 - RNA, 20 nt, Human
aguacuggcugauggaguaa

SEQ ID NO: 3426476 - RNA, 21 nt, Human
aguacugguaagauuguuauu

SEQ ID NO: 3426477 - RNA, 22 nt, Human
aguacugugggcaauuuagaaa

SEQ ID NO: 3426478 - RNA, 21 nt, Human
aguacuguuuaccauuuuuca

SEQ ID NO: 3426479 - RNA, 17 nt, Human
aguacuucagcaagaga

SEQ ID NO: 3426480 - RNA, 21 nt, Human
aguacuucagcaagagagaac

SEQ ID NO: 3426481 - RNA, 17 nt, Human
aguacuucuccacccug

SEQ ID NO: 3426482 - RNA, 21 nt, Human
aguacuucuccacccugcucu

SEQ ID NO: 3426483 - RNA, 22 nt, Human
aguacuucuccacccugcucuc

SEQ ID NO: 3426484 - RNA, 18 nt, Human
aguacuucuucuguaaua

SEQ ID NO: 3426485 - RNA, 22 nt, Human
aguacuugaguguaauguuugu

SEQ ID NO: 3426486 - RNA, 14 nt, Human
aguacuugucauau

SEQ ID NO: 3426487 - RNA, 15 nt, Human
aguacuugucauaug

SEQ ID NO: 3426488 - RNA, 18 nt, Human
aguacuugugaaacacag

SEQ ID NO: 3426489 - RNA, 18 nt, Human
aguacuuuauagaagaau

SEQ ID NO: 3426490 - RNA, 19 nt, Human
aguacuuuauagaagaaug

SEQ ID NO: 3426491 - RNA, 17 nt, Human
aguacuuuggaggcccc

SEQ ID NO: 3426492 - RNA, 19 nt, Human
aguacuuuggaggccccua

SEQ ID NO: 3426493 - RNA, 22 nt, Human
aguacuuuggaggccccuaugu

SEQ ID NO: 3426494 - RNA, 19 nt, Human
aguacuuuuggcauuuuac

SEQ ID NO: 3426495 - RNA, 15 nt, Human
aguacuuuuuuaaau

SEQ ID NO: 3426496 - RNA, 12 nt, Human
aguagaaaaugu

SEQ ID NO: 3426497 - RNA, 19 nt, Human
aguagaaauaaaagugaau

SEQ ID NO: 3426498 - RNA, 12 nt, Human
aguagaaaucau

SEQ ID NO: 3426499 - RNA, 13 nt, Human
aguagaacagaua

SEQ ID NO: 3426500 - RNA, 19 nt, Human
agcagcuaucucucaguga

SEQ ID NO: 3426501 - RNA, 15 nt, Human
agcagcucaaaggca

SEQ ID NO: 3426502 - RNA, 20 nt, Human
agcagcucaaaggcacagug

SEQ ID NO: 3426503 - RNA, 22 nt, Human
agcagcuccuuccuagccuugc

SEQ ID NO: 3426504 - RNA, 22 nt, Human
agcagcugaaauaugcuggcug

SEQ ID NO: 3426505 - RNA, 23 nt, Human
agcagcugaaauaugcuggcugg

SEQ ID NO: 3426506 - RNA, 18 nt, Human
agcagcugaacagccaaa

SEQ ID NO: 3426507 - RNA, 21 nt, Human
agcagcugccaggagcacggc

SEQ ID NO: 3426508 - RNA, 13 nt, Human
agcagcuggacua

SEQ ID NO: 3426509 - RNA, 22 nt, Human
agcagcuuauaaugggcucucc

SEQ ID NO: 3426510 - RNA, 15 nt, Human
agcagcuuauuguuu

SEQ ID NO: 3426511 - RNA, 15 nt, Human
agcagcuucaccaga

SEQ ID NO: 3426512 - RNA, 16 nt, Human
agcagcuucaccagag

SEQ ID NO: 3426513 - RNA, 16 nt, Human
agcagcuuccagauug

SEQ ID NO: 3426514 - RNA, 22 nt, Human
agcagcuucugccacuucccag

SEQ ID NO: 3426515 - RNA, 17 nt, Human
agcagcuugcugcaccc

SEQ ID NO: 3426516 - RNA, 16 nt, Human
agcagcuuuaaacaaa

SEQ ID NO: 3426517 - RNA, 19 nt, Human
agcagcuuuaaacucaggg

SEQ ID NO: 3426518 - RNA, 20 nt, Human
agcagcuuuaaacucaggga

SEQ ID NO: 3426519 - RNA, 22 nt, Human
agcagcuuuaaacucagggaca

SEQ ID NO: 3426520 - RNA, 20 nt, Human
agcaggaagcugugagagca

SEQ ID NO: 3426521 - RNA, 13 nt, Human
agcaggacaugga

SEQ ID NO: 3426522 - RNA, 15 nt, Human
agcaggacuccaggc

SEQ ID NO: 3426523 - RNA, 15 nt, Human
agcaggagagaaauu

SEQ ID NO: 3426524 - RNA, 19 nt, Human
agcaggagaggagagccag

SEQ ID NO: 3426525 - RNA, 20 nt, Human
agcaggagaggagagccaga

SEQ ID NO: 3426526 - RNA, 18 nt, Human
agcaggagauugagaagg

SEQ ID NO: 3426527 - RNA, 20 nt, Human
agcaggagauugagaaggag

SEQ ID NO: 3426528 - RNA, 14 nt, Human
agcaggagggacag

SEQ ID NO: 3426529 - RNA, 19 nt, Human
agcaggagggacagucuca

SEQ ID NO: 3426530 - RNA, 13 nt, Human
agcaggaguggug

SEQ ID NO: 3426531 - RNA, 22 nt, Human
agcaggauaguugcuccgccuc

SEQ ID NO: 3426532 - RNA, 14 nt, Human
agcaggcacaugga

SEQ ID NO: 3426533 - RNA, 19 nt, Human
agcaggcacauggaggagc

SEQ ID NO: 3426534 - RNA, 15 nt, Human
agcaggcagccagca

SEQ ID NO: 3426535 - RNA, 17 nt, Human
agcaggcagccagcauc

SEQ ID NO: 3426536 - RNA, 19 nt, Human
agcaggcagccagcaucug

SEQ ID NO: 3426537 - RNA, 13 nt, Human
agcaggcagccuu

SEQ ID NO: 3426538 - RNA, 14 nt, Human
agcaggcagcgcca

SEQ ID NO: 3426539 - RNA, 18 nt, Human
agcaggccagguccagag

SEQ ID NO: 3426540 - RNA, 23 nt, Human
agcaggcccaugggaggcuggag

SEQ ID NO: 3426541 - RNA, 18 nt, Human
agcaggccuguugcuuuu

SEQ ID NO: 3426542 - RNA, 13 nt, Human
agcaggccuugcg

SEQ ID NO: 3426543 - RNA, 21 nt, Human
agcaggcgcugugcuaucaug

SEQ ID NO: 3426544 - RNA, 22 nt, Human
agcaggcuacacugacacuggu

SEQ ID NO: 3426545 - RNA, 20 nt, Human
agcaggcuacugucagcucc

SEQ ID NO: 3426546 - RNA, 14 nt, Human
agcaggcucucagg

SEQ ID NO: 3426547 - RNA, 16 nt, Human
agcaggcucucaggcc

SEQ ID NO: 3426548 - RNA, 18 nt, Human
agcaggcucucaggccag

SEQ ID NO: 3426549 - RNA, 13 nt, Human
agcaggcuggcag

SEQ ID NO: 3426550 - RNA, 14 nt, Human
agcaggcuggcagc

SEQ ID NO: 3426551 - RNA, 15 nt, Human
agcaggcugugaguu

SEQ ID NO: 3426552 - RNA, 13 nt, Human
agcagggaaacag

SEQ ID NO: 3426553 - RNA, 16 nt, Human
agcagggacuguaaac

SEQ ID NO: 3426554 - RNA, 17 nt, Human
agcagggaugcccugga

SEQ ID NO: 3426555 - RNA, 24 nt, Human
agcagggaugcccuggagguggcu

SEQ ID NO: 3426556 - RNA, 13 nt, Human
agcagggcucagc

SEQ ID NO: 3426557 - RNA, 22 nt, Human
agcagggcucagcggggacagc

SEQ ID NO: 3426558 - RNA, 16 nt, Human
agcagggcucugcccc

SEQ ID NO: 3426559 - RNA, 16 nt, Human
agcaggggcguggagg

SEQ ID NO: 3426560 - RNA, 18 nt, Human
aguagcuugcucccugug

SEQ ID NO: 3426561 - RNA, 17 nt, Human
aguaggaagacuuugga

SEQ ID NO: 3426562 - RNA, 19 nt, Human
aguaggaagacuuuggaaa

SEQ ID NO: 3426563 - RNA, 23 nt, Human
aguaggacuccuuauuuggcgug

SEQ ID NO: 3426564 - RNA, 18 nt, Human
aguagggcuuaguguuuu

SEQ ID NO: 3426565 - RNA, 19 nt, Human
aguagggguaccacugaau

SEQ ID NO: 3426566 - RNA, 13 nt, Human
aguaggugcuuga

SEQ ID NO: 3426567 - RNA, 20 nt, Human
aguagguuggaagcuagcuc

SEQ ID NO: 3426568 - RNA, 23 nt, Human
aguagguuggaagcuagcucccc

SEQ ID NO: 3426569 - RNA, 13 nt, Human
aguaguaaaaauu

SEQ ID NO: 3426570 - RNA, 20 nt, Human
aguaguaaaagaagaaauag

SEQ ID NO: 3426571 - RNA, 17 nt, Human
aguaguaccaaaugcuu

SEQ ID NO: 3426572 - RNA, 19 nt, Human
aguaguaccaaaugcuuua

SEQ ID NO: 3426573 - RNA, 18 nt, Human
aguaguacuucuucugua

SEQ ID NO: 3426574 - RNA, 22 nt, Human
aguaguacuucuucuguaauau

SEQ ID NO: 3426575 - RNA, 12 nt, Human
aguagucauuuc

SEQ ID NO: 3426576 - RNA, 14 nt, Human
aguagucauuucau

SEQ ID NO: 3426577 - RNA, 13 nt, Human
aguaguccuguga

SEQ ID NO: 3426578 - RNA, 19 nt, Human
aguagugaagacuccagaa

SEQ ID NO: 3426579 - RNA, 20 nt, Human
aguagugagaagaauauugu

SEQ ID NO: 3426580 - RNA, 13 nt, Human
aguaguuauauaa

SEQ ID NO: 3426581 - RNA, 12 nt, Human
aguaguuaucau

SEQ ID NO: 3426582 - RNA, 14 nt, Human
aguaguuaucaugu

SEQ ID NO: 3426583 - RNA, 23 nt, Human
aguaguuaucauguuaguaauac

SEQ ID NO: 3426584 - RNA, 17 nt, Human
aguaguucuguauuuga

SEQ ID NO: 3426585 - RNA, 14 nt, Human
aguaguuugcauuu

SEQ ID NO: 3426586 - RNA, 18 nt, Human
aguaguuugcauuucaga

SEQ ID NO: 3426587 - RNA, 12 nt, Human
aguaguuuguau

SEQ ID NO: 3426588 - RNA, 13 nt, Human
aguauaaaauagu

SEQ ID NO: 3426589 - RNA, 13 nt, Human
aguauaaacaaag

SEQ ID NO: 3426590 - RNA, 14 nt, Human
aguauaaagaauag

SEQ ID NO: 3426591 - RNA, 14 nt, Human
aguauaaauuugug

SEQ ID NO: 3426592 - RNA, 17 nt, Human
aguauaaccauaugaua

SEQ ID NO: 3426593 - RNA, 19 nt, Human
aguauaaccauaugauacu

SEQ ID NO: 3426594 - RNA, 21 nt, Human
aguauaaccauaugauacuau

SEQ ID NO: 3426595 - RNA, 13 nt, Human
aguauaagaaaug

SEQ ID NO: 3426596 - RNA, 19 nt, Human
aguauaagacuacugaauc

SEQ ID NO: 3426597 - RNA, 13 nt, Human
aguauaauuaaca

SEQ ID NO: 3426598 - RNA, 12 nt, Human
aguauacaagau

SEQ ID NO: 3426599 - RNA, 15 nt, Human
aguauacaauauaua

SEQ ID NO: 3426600 - RNA, 21 nt, Human
aguauacaauauauaaaaaua

SEQ ID NO: 3426601 - RNA, 21 nt, Human
aguauacaguucaauaaacuu

SEQ ID NO: 3426602 - RNA, 15 nt, Human
aguauagaaaaucuu

SEQ ID NO: 3426603 - RNA, 13 nt, Human
aguauaucuggac

SEQ ID NO: 3426604 - RNA, 15 nt, Human
aguauaucuggacaa

SEQ ID NO: 3426605 - RNA, 12 nt, Human
aguauaugugag

SEQ ID NO: 3426606 - RNA, 14 nt, Human
aguauauuauguau

SEQ ID NO: 3426607 - RNA, 18 nt, Human
aguauauuguugaagaga

SEQ ID NO: 3426608 - RNA, 18 nt, Human
aguauauuuauagucaca

SEQ ID NO: 3426609 - RNA, 18 nt, Human
aguauauuuauauaauua

SEQ ID NO: 3426610 - RNA, 13 nt, Human
aguauauuuuauu

SEQ ID NO: 3426611 - RNA, 19 nt, Human
aguauauuuuauuucaaug

SEQ ID NO: 3426612 - RNA, 16 nt, Human
aguaucaaguauagaa

SEQ ID NO: 3426613 - RNA, 17 nt, Human
aguaucaaguauagaaa

SEQ ID NO: 3426614 - RNA, 19 nt, Human
aguaucaauccuuguucag

SEQ ID NO: 3426615 - RNA, 14 nt, Human
aguaucagaauuga

SEQ ID NO: 3426616 - RNA, 18 nt, Human
aguaucagagauguccau

SEQ ID NO: 3426617 - RNA, 17 nt, Human
aguaucaguguuuuaaa

SEQ ID NO: 3426618 - RNA, 20 nt, Human
aguaucaguguuuuaaauuc

SEQ ID NO: 3426619 - RNA, 20 nt, Human
aguaucaucagauagcaucu

SEQ ID NO: 3426620 - RNA, 11 nt, Human
aguaucaugca

SEQ ID NO: 3426621 - RNA, 12 nt, Human
aguaucaugcau

SEQ ID NO: 3426622 - RNA, 14 nt, Human
aguaucaugcauuc

SEQ ID NO: 3426623 - RNA, 19 nt, Human
aguaucauggaaauauuau

SEQ ID NO: 3426624 - RNA, 11 nt, Human
aguauccaggc

SEQ ID NO: 3426625 - RNA, 23 nt, Human
aguauccaggcuuuguacagagu

SEQ ID NO: 3426626 - RNA, 13 nt, Human
aguauccuccagg

SEQ ID NO: 3426627 - RNA, 21 nt, Human
aguauccuccagguuuuucaa

SEQ ID NO: 3426628 - RNA, 20 nt, Human
aguauccugagagcccagaa

SEQ ID NO: 3426629 - RNA, 15 nt, Human
aguaucggcacugua

SEQ ID NO: 3426630 - RNA, 19 nt, Human
aguaucuccucgcaagcug

SEQ ID NO: 3426631 - RNA, 22 nt, Human
aguaucucggaccuuucagcug

SEQ ID NO: 3426632 - RNA, 14 nt, Human
aguaucuucaugua

SEQ ID NO: 3426633 - RNA, 12 nt, Human
aguaugaaaaua

SEQ ID NO: 3426634 - RNA, 19 nt, Human
aguaugaaaauggaaauuu

SEQ ID NO: 3426635 - RNA, 22 nt, Human
aguaugaauuauucaauuuauu

SEQ ID NO: 3426636 - RNA, 20 nt, Human
aguaugacgcugauacauaa

SEQ ID NO: 3426637 - RNA, 23 nt, Human
aguaugaggcauuuguuugaacu

SEQ ID NO: 3426638 - RNA, 21 nt, Human
aguaugcauuauuaaauugua

SEQ ID NO: 3426639 - RNA, 16 nt, Human
aguaugcuugcucuaa

SEQ ID NO: 3426640 - RNA, 20 nt, Human
aguaugcuuggacugaaggg

SEQ ID NO: 3426641 - RNA, 15 nt, Human
aguauggccuguguc

SEQ ID NO: 3426642 - RNA, 18 nt, Human
aguauggggguuguaaau

SEQ ID NO: 3426643 - RNA, 19 nt, Human
aguauggggguuguaaauu

SEQ ID NO: 3426644 - RNA, 18 nt, Human
aguauggguuagggaaaa

SEQ ID NO: 3426645 - RNA, 13 nt, Human
aguaugguacauu

SEQ ID NO: 3426646 - RNA, 23 nt, Human
aguaugguacauuuuucaacuuu

SEQ ID NO: 3426647 - RNA, 15 nt, Human
aguaugguggcuggg

SEQ ID NO: 3426648 - RNA, 13 nt, Human
aguauguaugugu

SEQ ID NO: 3426649 - RNA, 14 nt, Human
aguauguucaaagu

SEQ ID NO: 3426650 - RNA, 18 nt, Human
aguauguucuaaccuuua

SEQ ID NO: 3426651 - RNA, 22 nt, Human
aguauguucuaaccuuuacaug

SEQ ID NO: 3426652 - RNA, 17 nt, Human
aguauguuuuacacugu

SEQ ID NO: 3426653 - RNA, 16 nt, Human
aguauguuuuagcaug

SEQ ID NO: 3426654 - RNA, 15 nt, Human
aguauuaaaacauug

SEQ ID NO: 3426655 - RNA, 22 nt, Human
aguauuaaaacauuggauuauc

SEQ ID NO: 3426656 - RNA, 23 nt, Human
aguauuaaaacauuggauuaucc

SEQ ID NO: 3426657 - RNA, 15 nt, Human
aguauuaaagggggg

SEQ ID NO: 3426658 - RNA, 18 nt, Human
aguauuagaauaccacag

SEQ ID NO: 3426659 - RNA, 13 nt, Human
aguauuauaaauu

SEQ ID NO: 3426660 - RNA, 13 nt, Human
agguauggcucug

SEQ ID NO: 3426661 - RNA, 19 nt, Human
agguauuaaaacuaaauuu

SEQ ID NO: 3426662 - RNA, 13 nt, Human
agguauuaagauu

SEQ ID NO: 3426663 - RNA, 14 nt, Human
agguauuacacucu

SEQ ID NO: 3426664 - RNA, 13 nt, Human
agguauuauacau

SEQ ID NO: 3426665 - RNA, 17 nt, Human
agguauucgugcagcau

SEQ ID NO: 3426666 - RNA, 18 nt, Human
agguauucguuaucuaau

SEQ ID NO: 3426667 - RNA, 14 nt, Human
agguauuuaucuuu

SEQ ID NO: 3426668 - RNA, 14 nt, Human
agguauuucaaaac

SEQ ID NO: 3426669 - RNA, 14 nt, Human
agguauuuugaaua

SEQ ID NO: 3426670 - RNA, 17 nt, Human
aggucaacagagaaggc

SEQ ID NO: 3426671 - RNA, 19 nt, Human
aggucaacagagaaggcag

SEQ ID NO: 3426672 - RNA, 21 nt, Human
aggucaaggccugucccuggc

SEQ ID NO: 3426673 - RNA, 20 nt, Human
aggucaagggcuuacuauuu

SEQ ID NO: 3426674 - RNA, 17 nt, Human
aggucaaguaagaagac

SEQ ID NO: 3426675 - RNA, 23 nt, Human
aggucaauacaguacaggcagca

SEQ ID NO: 3426676 - RNA, 22 nt, Human
aggucacacgaccggggccagc

SEQ ID NO: 3426677 - RNA, 23 nt, Human
aggucacacgaccggggccagca

SEQ ID NO: 3426678 - RNA, 23 nt, Human
aggucacacgaggggccccgugu

SEQ ID NO: 3426679 - RNA, 21 nt, Human
aggucacucuuccugcaagga

SEQ ID NO: 3426680 - RNA, 17 nt, Human
aggucacuggcucucca

SEQ ID NO: 3426681 - RNA, 18 nt, Human
aggucacuggcucuccaa

SEQ ID NO: 3426682 - RNA, 19 nt, Human
aggucacuggcucuccaag

SEQ ID NO: 3426683 - RNA, 20 nt, Human
aggucacuggcucuccaagu

SEQ ID NO: 3426684 - RNA, 13 nt, Human
aggucagagccug

SEQ ID NO: 3426685 - RNA, 14 nt, Human
aggucagagccugc

SEQ ID NO: 3426686 - RNA, 15 nt, Human
aggucagagccugca

SEQ ID NO: 3426687 - RNA, 17 nt, Human
aggucagagccugcagu

SEQ ID NO: 3426688 - RNA, 18 nt, Human
aggucagagccugcaguu

SEQ ID NO: 3426689 - RNA, 21 nt, Human
aggucagcacaucucaacagg

SEQ ID NO: 3426690 - RNA, 15 nt, Human
aggucagcaugucua

SEQ ID NO: 3426691 - RNA, 15 nt, Human
aggucagcucagagc

SEQ ID NO: 3426692 - RNA, 16 nt, Human
aggucagcuugcugcc

SEQ ID NO: 3426693 - RNA, 21 nt, Human
aggucaggaguuagaggccag

SEQ ID NO: 3426694 - RNA, 15 nt, Human
aggucaggaguuccu

SEQ ID NO: 3426695 - RNA, 15 nt, Human
aggucaggaguucga

SEQ ID NO: 3426696 - RNA, 14 nt, Human
aggucaggcccugg

SEQ ID NO: 3426697 - RNA, 15 nt, Human
aggucaggcccugga

SEQ ID NO: 3426698 - RNA, 16 nt, Human
aggucagggagugcug

SEQ ID NO: 3426699 - RNA, 17 nt, Human
aggucaggggugacaca

SEQ ID NO: 3426700 - RNA, 22 nt, Human
aggucaggggugacacagacuc

SEQ ID NO: 3426701 - RNA, 23 nt, Human
aggucaucuccuuucauccccac

SEQ ID NO: 3426702 - RNA, 15 nt, Human
aggucauggccacac

SEQ ID NO: 3426703 - RNA, 16 nt, Human
aggucauggccacacu

SEQ ID NO: 3426704 - RNA, 18 nt, Human
aggucauggccacacugu

SEQ ID NO: 3426705 - RNA, 17 nt, Human
agccauguuuaagauuu

SEQ ID NO: 3426706 - RNA, 14 nt, Human
aguaagaggcugga

SEQ ID NO: 3426707 - RNA, 14 nt, Human
aguaagagguguua

SEQ ID NO: 3426708 - RNA, 12 nt, Human
aguaagauugau

SEQ ID NO: 3426709 - RNA, 22 nt, Human
aguaagauugauaucuauaaaa

SEQ ID NO: 3426710 - RNA, 12 nt, Human
aguaagccucau

SEQ ID NO: 3426711 - RNA, 21 nt, Human
aguaagccucaucaucagagc

SEQ ID NO: 3426712 - RNA, 22 nt, Human
aguaagcggcucaagcccagga

SEQ ID NO: 3426713 - RNA, 18 nt, Human
aguaagcugcucuauugu

SEQ ID NO: 3426714 - RNA, 12 nt, Human
aguaaggcugug

SEQ ID NO: 3426715 - RNA, 14 nt, Human
aguaaguaauuaug

SEQ ID NO: 3426716 - RNA, 20 nt, Human
aguaaguaauuaugcacuaa

SEQ ID NO: 3426717 - RNA, 17 nt, Human
aguaaguaccacucagg

SEQ ID NO: 3426718 - RNA, 23 nt, Human
aguaaguaucuucguucuuguua

SEQ ID NO: 3426719 - RNA, 15 nt, Human
aguaagucucaaggu

SEQ ID NO: 3426720 - RNA, 23 nt, Human
aguaagucuugccuauauuuucc

SEQ ID NO: 3426721 - RNA, 13 nt, Human
aguaagugccuuc

SEQ ID NO: 3426722 - RNA, 16 nt, Human
aguaagugccuuccau

SEQ ID NO: 3426723 - RNA, 23 nt, Human
aguaagugggguugcaaccacug

SEQ ID NO: 3426724 - RNA, 15 nt, Human
aguaaguuaauguau

SEQ ID NO: 3426725 - RNA, 17 nt, Human
aguaaguucagcacuug

SEQ ID NO: 3426726 - RNA, 16 nt, Human
aguaauaaaacaucuu

SEQ ID NO: 3426727 - RNA, 23 nt, Human
aguaauaaaauucaacaaacauu

SEQ ID NO: 3426728 - RNA, 19 nt, Human
aguaauaaaugaaugucac

SEQ ID NO: 3426729 - RNA, 13 nt, Human
aguaauacaaacu

SEQ ID NO: 3426730 - RNA, 13 nt, Human
aguaauagagcaa

SEQ ID NO: 3426731 - RNA, 19 nt, Human
aguaauaggagcuuccagc

SEQ ID NO: 3426732 - RNA, 20 nt, Human
aguaauauaauggaagagaa

SEQ ID NO: 3426733 - RNA, 17 nt, Human
aguaauauauuuaaagg

SEQ ID NO: 3426734 - RNA, 14 nt, Human
aguaauaugcacac

SEQ ID NO: 3426735 - RNA, 18 nt, Human
aguaauaugcacacauuu

SEQ ID NO: 3426736 - RNA, 20 nt, Human
aguaauaugcacacauuuuu

SEQ ID NO: 3426737 - RNA, 14 nt, Human
aguaaucaauaaag

SEQ ID NO: 3426738 - RNA, 18 nt, Human
aguaaucaauaaagaaaa

SEQ ID NO: 3426739 - RNA, 22 nt, Human
aguaaucaaucuacucaaagca

SEQ ID NO: 3426740 - RNA, 17 nt, Human
aguaaucaucuaaguca

SEQ ID NO: 3426741 - RNA, 15 nt, Human
aguaauccaagcaaa

SEQ ID NO: 3426742 - RNA, 22 nt, Human
aguaaucccgccaccuaucucg

SEQ ID NO: 3426743 - RNA, 12 nt, Human
aguaauccugua

SEQ ID NO: 3426744 - RNA, 13 nt, Human
aguaaucuguaca

SEQ ID NO: 3426745 - RNA, 13 nt, Human
aguaaucuguaua

SEQ ID NO: 3426746 - RNA, 14 nt, Human
aguaaucuguauaa

SEQ ID NO: 3426747 - RNA, 15 nt, Human
aguaaucuguauaau

SEQ ID NO: 3426748 - RNA, 23 nt, Human
aguaaucuguauaauacuuugua

SEQ ID NO: 3426749 - RNA, 13 nt, Human
aguaaucugugua

SEQ ID NO: 3426750 - RNA, 15 nt, Human
aguaaugaaauggag

SEQ ID NO: 3426751 - RNA, 22 nt, Human
aguaaugaauuuuuaugauauu

SEQ ID NO: 3426752 - RNA, 14 nt, Human
aguaaugaguuuaa

SEQ ID NO: 3426753 - RNA, 17 nt, Human
aguaaugauaacuggaa

SEQ ID NO: 3426754 - RNA, 19 nt, Human
aguaaugcuacgugugauu

SEQ ID NO: 3426755 - RNA, 15 nt, Human
aguaaugguguagaa

SEQ ID NO: 3426756 - RNA, 18 nt, Human
aguaauguggaagaaaau

SEQ ID NO: 3426757 - RNA, 13 nt, Human
aguaauuaucggg

SEQ ID NO: 3426758 - RNA, 15 nt, Human
aguaauucaagaaaa

SEQ ID NO: 3426759 - RNA, 19 nt, Human
aguaauucaagaaaacaac

SEQ ID NO: 3426760 - RNA, 20 nt, Human
aguaauugacaugugccagg

SEQ ID NO: 3426761 - RNA, 17 nt, Human
aguaauugcauuugcuu

SEQ ID NO: 3426762 - RNA, 12 nt, Human
aguaauuggaaa

SEQ ID NO: 3426763 - RNA, 22 nt, Human
aguaauugguccgaucuuugac

SEQ ID NO: 3426764 - RNA, 12 nt, Human
aguaauugugaa

SEQ ID NO: 3426765 - RNA, 23 nt, Human
aguaauuuagaaaucauuuugca

SEQ ID NO: 3426766 - RNA, 13 nt, Human
aguaauuucagug

SEQ ID NO: 3426767 - RNA, 14 nt, Human
aguaauuucagugu

SEQ ID NO: 3426768 - RNA, 14 nt, Human
aguaauuucuuuuu

SEQ ID NO: 3426769 - RNA, 21 nt, Human
aguaauuucuuuuuuuccuuu

SEQ ID NO: 3426770 - RNA, 21 nt, Human
aguaauuuguuuaaaaaguaa

SEQ ID NO: 3426771 - RNA, 13 nt, Human
aguacaaaugccu

SEQ ID NO: 3426772 - RNA, 21 nt, Human
aguacaaaugccuuaaaaugg

SEQ ID NO: 3426773 - RNA, 14 nt, Human
aguacaaauuauaa

SEQ ID NO: 3426774 - RNA, 17 nt, Human
aguacaaauuauaaaaa

SEQ ID NO: 3426775 - RNA, 19 nt, Human
aguacaaugugacuuugaa

SEQ ID NO: 3426776 - RNA, 17 nt, Human
aguacaauguguuuuuc

SEQ ID NO: 3426777 - RNA, 18 nt, Human
aguacaauguguuuuucu

SEQ ID NO: 3426778 - RNA, 20 nt, Human
aguacaauguguuuuucucc

SEQ ID NO: 3426779 - RNA, 18 nt, Human
aguacacaauaagcaaaa

SEQ ID NO: 3426780 - RNA, 20 nt, Human
aguacacagcaccagaaugu

SEQ ID NO: 3426781 - RNA, 19 nt, Human
aguacaccacaagggucac

SEQ ID NO: 3426782 - RNA, 17 nt, Human
aguacacucugcuguuu

SEQ ID NO: 3426783 - RNA, 20 nt, Human
aguacacuguuucaaacuuu

SEQ ID NO: 3426784 - RNA, 23 nt, Human
aguacacuguuucaaacuuuacu

SEQ ID NO: 3426785 - RNA, 19 nt, Human
aguacacuuuuaugagcuu

SEQ ID NO: 3426786 - RNA, 16 nt, Human
aguacagaauuugaau

SEQ ID NO: 3426787 - RNA, 12 nt, Human
aguacagagaag

SEQ ID NO: 3426788 - RNA, 13 nt, Human
aguacagagaagc

SEQ ID NO: 3426789 - RNA, 14 nt, Human
aguacagagaagcc

SEQ ID NO: 3426790 - RNA, 20 nt, Human
aguacagagaagccaucacc

SEQ ID NO: 3426791 - RNA, 21 nt, Human
aguacagugguucuacaaucu

SEQ ID NO: 3426792 - RNA, 17 nt, Human
aguacauauuaggaaaa

SEQ ID NO: 3426793 - RNA, 15 nt, Human
aguacauuuaaauuu

SEQ ID NO: 3426794 - RNA, 12 nt, Human
aguacauuuaau

SEQ ID NO: 3426795 - RNA, 13 nt, Human
aguacauuuuuug

SEQ ID NO: 3426796 - RNA, 16 nt, Human
aguaccagccccaccc

SEQ ID NO: 3426797 - RNA, 14 nt, Human
aguaccagcgcucu

SEQ ID NO: 3426798 - RNA, 15 nt, Human
aguaccaucugaaua

SEQ ID NO: 3426799 - RNA, 23 nt, Human
aguaccauuuaauggggaggaca

SEQ ID NO: 3426800 - RNA, 15 nt, Human
aguacccaaaagcuc

SEQ ID NO: 3426801 - RNA, 21 nt, Human
aguacccaaaagcucagccag

SEQ ID NO: 3426802 - RNA, 13 nt, Human
aguacccaccuga

SEQ ID NO: 3426803 - RNA, 15 nt, Human
aguacccaccugagc

SEQ ID NO: 3426804 - RNA, 16 nt, Human
aguacccaccugagcu

SEQ ID NO: 3426805 - RNA, 12 nt, Human
aguacccugguu

SEQ ID NO: 3426806 - RNA, 18 nt, Human
aguacccugguugugugu

SEQ ID NO: 3426807 - RNA, 19 nt, Human
aguacccugguuguguguc

SEQ ID NO: 3426808 - RNA, 12 nt, Human
aguaccuccugu

SEQ ID NO: 3426809 - RNA, 14 nt, Human
aguaccugaaaagu

SEQ ID NO: 3426810 - RNA, 18 nt, Human
aguaccugggcaagcugg

SEQ ID NO: 3426811 - RNA, 19 nt, Human
aguaccugggcaagcuggc

SEQ ID NO: 3426812 - RNA, 13 nt, Human
aguaccuuugcuc

SEQ ID NO: 3426813 - RNA, 16 nt, Human
aguaccuuugcucuug

SEQ ID NO: 3426814 - RNA, 21 nt, Human
aguaccuuugcucuugcagag

SEQ ID NO: 3426815 - RNA, 15 nt, Human
aguaccuuugucaca

SEQ ID NO: 3426816 - RNA, 14 nt, Human
aguacguugugcau

SEQ ID NO: 3426817 - RNA, 22 nt, Human
aguacuacaguccucccaucuc

SEQ ID NO: 3426818 - RNA, 21 nt, Human
aguacuagagauauuuuguaa

SEQ ID NO: 3426819 - RNA, 14 nt, Human
aguacuauaauuua

SEQ ID NO: 3426820 - RNA, 14 nt, Human
aguacuauaucugu

SEQ ID NO: 3426821 - RNA, 22 nt, Human
aguacuauaucuguuuuacugc

SEQ ID NO: 3426822 - RNA, 12 nt, Human
aguacuauguau

SEQ ID NO: 3426823 - RNA, 14 nt, Human
aguacuauguauca

SEQ ID NO: 3426824 - RNA, 14 nt, Human
aguacuccacacug

SEQ ID NO: 3426825 - RNA, 18 nt, Human
aguacuccacacugcaca

SEQ ID NO: 3426826 - RNA, 19 nt, Human
aguacuccugcaaaauuuu

SEQ ID NO: 3426827 - RNA, 19 nt, Human
aguacuccuuaagaacaca

SEQ ID NO: 3426828 - RNA, 23 nt, Human
aguacugguaagauuguuauuaa

SEQ ID NO: 3426829 - RNA, 23 nt, Human
aguacuguaauaauaccucaaug

SEQ ID NO: 3426830 - RNA, 21 nt, Human
aguacugugggcaauuuagaa

SEQ ID NO: 3426831 - RNA, 23 nt, Human
aguacugugggcaauuuagaaaa

SEQ ID NO: 3426832 - RNA, 16 nt, Human
aguacuguguacagaa

SEQ ID NO: 3426833 - RNA, 17 nt, Human
aguacuguuuaccauuu

SEQ ID NO: 3426834 - RNA, 18 nt, Human
aguacuucagcaagagag

SEQ ID NO: 3426835 - RNA, 22 nt, Human
aguacuucagcaagagagaacc

SEQ ID NO: 3426836 - RNA, 19 nt, Human
aguacuugaaaucuaggau

SEQ ID NO: 3426837 - RNA, 17 nt, Human
aguacuuguaguuccac

SEQ ID NO: 3426838 - RNA, 17 nt, Human
aguacuugucauaugua

SEQ ID NO: 3426839 - RNA, 20 nt, Human
aguacuugugaaacacagcu

SEQ ID NO: 3426840 - RNA, 22 nt, Human
aguacuugugaaacacagcugu

SEQ ID NO: 3426841 - RNA, 23 nt, Human
aguacuugugaaacacagcuguu

SEQ ID NO: 3426842 - RNA, 16 nt, Human
aguacuuuauagaaga

SEQ ID NO: 3426843 - RNA, 16 nt, Human
aguacuuugugcauuc

SEQ ID NO: 3426844 - RNA, 20 nt, Human
aguagaaagacagagcuggg

SEQ ID NO: 3426845 - RNA, 18 nt, Human
aguagaaaggccuuuaaa

SEQ ID NO: 3426846 - RNA, 15 nt, Human
aguagaacuuuguau

SEQ ID NO: 3426847 - RNA, 20 nt, Human
aguagaagauuugaugcugg

SEQ ID NO: 3426848 - RNA, 17 nt, Human
aguagaagucuuagaug

SEQ ID NO: 3426849 - RNA, 20 nt, Human
aguagaagucuuagauguau

SEQ ID NO: 3426850 - RNA, 13 nt, Human
aguauuauaugua

SEQ ID NO: 3426851 - RNA, 17 nt, Human
aguauuaucaaagggau

SEQ ID NO: 3426852 - RNA, 23 nt, Human
aguauucaagaaagccagucuua

SEQ ID NO: 3426853 - RNA, 14 nt, Human
aguauucauucugc

SEQ ID NO: 3426854 - RNA, 23 nt, Human
aguauuccaccuuaaauuaaaca

SEQ ID NO: 3426855 - RNA, 20 nt, Human
aguauuccauugugugagug

SEQ ID NO: 3426856 - RNA, 16 nt, Human
aguauucuaauaagcu

SEQ ID NO: 3426857 - RNA, 21 nt, Human
aguauucuaauaagcuaguug

SEQ ID NO: 3426858 - RNA, 23 nt, Human
aguauucuaauaagcuaguugaa

SEQ ID NO: 3426859 - RNA, 15 nt, Human
aguauucucauucuu

SEQ ID NO: 3426860 - RNA, 16 nt, Human
aguauucucauucuuc

SEQ ID NO: 3426861 - RNA, 13 nt, Human
agucuguugugug

SEQ ID NO: 3426862 - RNA, 16 nt, Human
agucuguuguguguca

SEQ ID NO: 3426863 - RNA, 12 nt, Human
agucuguuuuau

SEQ ID NO: 3426864 - RNA, 13 nt, Human
agucuguuuuaug

SEQ ID NO: 3426865 - RNA, 14 nt, Human
agucuguuuuauga

SEQ ID NO: 3426866 - RNA, 13 nt, Human
agucuuaagaacu

SEQ ID NO: 3426867 - RNA, 16 nt, Human
agucuuacgaauacuu

SEQ ID NO: 3426868 - RNA, 23 nt, Human
agucuuaucugagcugagccagg

SEQ ID NO: 3426869 - RNA, 18 nt, Human
agucuuaugcuuccagaa

SEQ ID NO: 3426870 - RNA, 23 nt, Human
agucuucaagcagauuggagaaa

SEQ ID NO: 3426871 - RNA, 17 nt, Human
agucuucacucucugaa

SEQ ID NO: 3426872 - RNA, 15 nt, Human
agucuuccaauuaau

SEQ ID NO: 3426873 - RNA, 22 nt, Human
agucuuccaauuaaugcuuuuu

SEQ ID NO: 3426874 - RNA, 21 nt, Human
agucuuccacaaagaaaauuc

SEQ ID NO: 3426875 - RNA, 16 nt, Human
agucuuccaccuggaa

SEQ ID NO: 3426876 - RNA, 17 nt, Human
agucuuccaccuggaag

SEQ ID NO: 3426877 - RNA, 22 nt, Human
agucuucccuagggcugggugu

SEQ ID NO: 3426878 - RNA, 13 nt, Human
agucuucccugau

SEQ ID NO: 3426879 - RNA, 20 nt, Human
agucuucucauagcauuaac

SEQ ID NO: 3426880 - RNA, 17 nt, Human
agucuucugacaaacug

SEQ ID NO: 3426881 - RNA, 16 nt, Human
agucuugcagugauua

SEQ ID NO: 3426882 - RNA, 18 nt, Human
agucuugccuauauuuuc

SEQ ID NO: 3426883 - RNA, 15 nt, Human
agucuuggcucacug

SEQ ID NO: 3426884 - RNA, 23 nt, Human
agucuugguuucucucuacagug

SEQ ID NO: 3426885 - RNA, 16 nt, Human
agucuuguauuaaguu

SEQ ID NO: 3426886 - RNA, 18 nt, Human
agucuuguauuaaguugu

SEQ ID NO: 3426887 - RNA, 16 nt, Human
agucuugucucagauu

SEQ ID NO: 3426888 - RNA, 20 nt, Human
agucuugugacuagugcuga

SEQ ID NO: 3426889 - RNA, 21 nt, Human
agucuugugacuagugcugaa

SEQ ID NO: 3426890 - RNA, 23 nt, Human
agucuugugacuagugcugaagc

SEQ ID NO: 3426891 - RNA, 20 nt, Human
agucuuuaaaggcccagccc

SEQ ID NO: 3426892 - RNA, 21 nt, Human
agucuuuaaaggcccagcccc

SEQ ID NO: 3426893 - RNA, 21 nt, Human
agucuuuaggucuuuguaaga

SEQ ID NO: 3426894 - RNA, 17 nt, Human
agucuuucauggcugcu

SEQ ID NO: 3426895 - RNA, 15 nt, Human
agucuuucucuuucc

SEQ ID NO: 3426896 - RNA, 20 nt, Human
agucuuucucuuucccuggu

SEQ ID NO: 3426897 - RNA, 23 nt, Human
agucuuucucuuucccugguccc

SEQ ID NO: 3426898 - RNA, 14 nt, Human
agucuuuguacaga

SEQ ID NO: 3426899 - RNA, 13 nt, Human
agucuuuuaaaaa

SEQ ID NO: 3426900 - RNA, 13 nt, Human
agucuuuugcuuu

SEQ ID NO: 3426901 - RNA, 22 nt, Human
agucuuuugcuuuugcccauuu

SEQ ID NO: 3426902 - RNA, 11 nt, Human
agucuuuuguc

SEQ ID NO: 3426903 - RNA, 22 nt, Human
agucuuuuguucgcauggucac

SEQ ID NO: 3426904 - RNA, 19 nt, Human
agucuuuuucuguuguaac

SEQ ID NO: 3426905 - RNA, 21 nt, Human
agucuuuuucuguuguaacuu

SEQ ID NO: 3426906 - RNA, 20 nt, Human
agugaaaaaggaggaagaga

SEQ ID NO: 3426907 - RNA, 14 nt, Human
agugaaaaaugaga

SEQ ID NO: 3426908 - RNA, 20 nt, Human
agugaaaacaagugcuggca

SEQ ID NO: 3426909 - RNA, 12 nt, Human
agugaaaacuag

SEQ ID NO: 3426910 - RNA, 14 nt, Human
agugaaaauaggua

SEQ ID NO: 3426911 - RNA, 22 nt, Human
agugaaaaucuuggagacccug

SEQ ID NO: 3426912 - RNA, 21 nt, Human
agugaaacugcuuguuuccua

SEQ ID NO: 3426913 - RNA, 24 nt, Human
agugaaacugcuuguuuccuagca

SEQ ID NO: 3426914 - RNA, 15 nt, Human
agugaaacuuuucua

SEQ ID NO: 3426915 - RNA, 15 nt, Human
agugaaagaaaauaa

SEQ ID NO: 3426916 - RNA, 17 nt, Human
agugaaagaaaauaaca

SEQ ID NO: 3426917 - RNA, 17 nt, Human
agugaaagacaagcugc

SEQ ID NO: 3426918 - RNA, 15 nt, Human
agugaaauaaugugu

SEQ ID NO: 3426919 - RNA, 14 nt, Human
agugaaauuucuag

SEQ ID NO: 3426920 - RNA, 17 nt, Human
agugaaauuucuagccu

SEQ ID NO: 3426921 - RNA, 16 nt, Human
agugaacaaauuuaca

SEQ ID NO: 3426922 - RNA, 17 nt, Human
agugaacacuagccaga

SEQ ID NO: 3426923 - RNA, 13 nt, Human
agugaaccaucau

SEQ ID NO: 3426924 - RNA, 13 nt, Human
agugaagacagaa

SEQ ID NO: 3426925 - RNA, 15 nt, Human
agugaagacuccaga

SEQ ID NO: 3426926 - RNA, 16 nt, Human
agugaagacuggaagc

SEQ ID NO: 3426927 - RNA, 19 nt, Human
agugaagagggagaaggga

SEQ ID NO: 3426928 - RNA, 16 nt, Human
agugaagaggggcagc

SEQ ID NO: 3426929 - RNA, 21 nt, Human
agugaagaggggcagcccuug

SEQ ID NO: 3426930 - RNA, 23 nt, Human
agugaagggaagagacagcccag

SEQ ID NO: 3426931 - RNA, 23 nt, Human
agugaagguuuacaauuuacaaa

SEQ ID NO: 3426932 - RNA, 13 nt, Human
agugaauaaacuu

SEQ ID NO: 3426933 - RNA, 14 nt, Human
agugaauaaacuuc

SEQ ID NO: 3426934 - RNA, 16 nt, Human
agugaauaaacuucag

SEQ ID NO: 3426935 - RNA, 17 nt, Human
agugaauaaacuucagc

SEQ ID NO: 3426936 - RNA, 17 nt, Human
agugaauaaaugucuug

SEQ ID NO: 3426937 - RNA, 17 nt, Human
agugaauaaccugagga

SEQ ID NO: 3426938 - RNA, 14 nt, Human
agugaaugaaagau

SEQ ID NO: 3426939 - RNA, 17 nt, Human
agugaaugccagugugc

SEQ ID NO: 3426940 - RNA, 14 nt, Human
agugaaugcuggga

SEQ ID NO: 3426941 - RNA, 17 nt, Human
agugaauguaggcuggc

SEQ ID NO: 3426942 - RNA, 19 nt, Human
agugaauuaguuuuaaaau

SEQ ID NO: 3426943 - RNA, 15 nt, Human
agugaauucccucac

SEQ ID NO: 3426944 - RNA, 16 nt, Human
agugaauucccucacu

SEQ ID NO: 3426945 - RNA, 17 nt, Human
agugaauucccucacuc

SEQ ID NO: 3426946 - RNA, 23 nt, Human
agugaauucccucacucgucucc

SEQ ID NO: 3426947 - RNA, 15 nt, Human
agugaauuugaauga

SEQ ID NO: 3426948 - RNA, 19 nt, Human
agugaauuugaaugaaaaa

SEQ ID NO: 3426949 - RNA, 14 nt, Human
agugaauuugccug

SEQ ID NO: 3426950 - RNA, 16 nt, Human
agugaauuuuucucua

SEQ ID NO: 3426951 - RNA, 24 nt, Human
agugacaaauaaauuaggaccaag

SEQ ID NO: 3426952 - RNA, 15 nt, Human
agugacaaggcccca

SEQ ID NO: 3426953 - RNA, 21 nt, Human
agugacaaggccccagagacu

SEQ ID NO: 3426954 - RNA, 18 nt, Human
agugacacagcagcuuca

SEQ ID NO: 3426955 - RNA, 23 nt, Human
agugacacagcagcuucaccaga

SEQ ID NO: 3426956 - RNA, 15 nt, Human
agugacacuucagag

SEQ ID NO: 3426957 - RNA, 16 nt, Human
agugacagacaggcuc

SEQ ID NO: 3426958 - RNA, 21 nt, Human
agugacagaccacaucuuuau

SEQ ID NO: 3426959 - RNA, 16 nt, Human
agugacagaggcagcc

SEQ ID NO: 3426960 - RNA, 11 nt, Human
agugacagcua

SEQ ID NO: 3426961 - RNA, 22 nt, Human
agugacaucucuuugaugucau

SEQ ID NO: 3426962 - RNA, 18 nt, Human
agugaccauacuaauuau

SEQ ID NO: 3426963 - RNA, 14 nt, Human
agugaccccugccu

SEQ ID NO: 3426964 - RNA, 14 nt, Human
agugacccugcucu

SEQ ID NO: 3426965 - RNA, 17 nt, Human
agugaccugaggaagcg

SEQ ID NO: 3426966 - RNA, 14 nt, Human
agugaccuguuuau

SEQ ID NO: 3426967 - RNA, 16 nt, Human
agugacuaguacaaau

SEQ ID NO: 3426968 - RNA, 17 nt, Human
agugacuaguacaaauu

SEQ ID NO: 3426969 - RNA, 22 nt, Human
agugacuaugaacuucucucag

SEQ ID NO: 3426970 - RNA, 18 nt, Human
agugacuccaagaacaau

SEQ ID NO: 3426971 - RNA, 18 nt, Human
agugacucuauauagcug

SEQ ID NO: 3426972 - RNA, 19 nt, Human
agugacugaacgauccuuc

SEQ ID NO: 3426973 - RNA, 20 nt, Human
agugacuguaucuguguaga

SEQ ID NO: 3426974 - RNA, 20 nt, Human
agugacuguggccauggucc

SEQ ID NO: 3426975 - RNA, 20 nt, Human
agugacuguucaagagcaca

SEQ ID NO: 3426976 - RNA, 14 nt, Human
agugagaaaaagcu

SEQ ID NO: 3426977 - RNA, 19 nt, Human
agugagaaaaagcuccugu

SEQ ID NO: 3426978 - RNA, 20 nt, Human
agugagaagcuuugcccucc

SEQ ID NO: 3426979 - RNA, 16 nt, Human
agugagacaaaauuuu

SEQ ID NO: 3426980 - RNA, 14 nt, Human
agugagacagcucu

SEQ ID NO: 3426981 - RNA, 20 nt, Human
agugagaccuuccuuuuacu

SEQ ID NO: 3426982 - RNA, 13 nt, Human
agugagacucugu

SEQ ID NO: 3426983 - RNA, 17 nt, Human
agugagacucugucuca

SEQ ID NO: 3426984 - RNA, 22 nt, Human
agugagacucugucucaaaaaa

SEQ ID NO: 3426985 - RNA, 13 nt, Human
agugagagacauu

SEQ ID NO: 3426986 - RNA, 21 nt, Human
agugagagacauuaacucauu

SEQ ID NO: 3426987 - RNA, 13 nt, Human
agugagagagaca

SEQ ID NO: 3426988 - RNA, 18 nt, Human
agugagagagacaagaag

SEQ ID NO: 3426989 - RNA, 21 nt, Human
agugagagaguggcuggggca

SEQ ID NO: 3426990 - RNA, 14 nt, Human
agugagagcagaug

SEQ ID NO: 3426991 - RNA, 23 nt, Human
agugagagcgugcuccagccugg

SEQ ID NO: 3426992 - RNA, 14 nt, Human
agugagagcugggu

SEQ ID NO: 3426993 - RNA, 19 nt, Human
agugagauagcauugugaa

SEQ ID NO: 3426994 - RNA, 16 nt, Human
agucacugccugcaga

SEQ ID NO: 3426995 - RNA, 12 nt, Human
agucacugcucu

SEQ ID NO: 3426996 - RNA, 21 nt, Human
agucacuggagguugaagcca

SEQ ID NO: 3426997 - RNA, 22 nt, Human
agucacuggagguugaagccaa

SEQ ID NO: 3426998 - RNA, 23 nt, Human
agucacugugagcucccaggugc

SEQ ID NO: 3426999 - RNA, 16 nt, Human
agucacuuauuucaua

SEQ ID NO: 3427000 - RNA, 12 nt, Human
agucagaacagc

SEQ ID NO: 3427001 - RNA, 22 nt, Human
agucagaacagcagacucagcu

SEQ ID NO: 3427002 - RNA, 23 nt, Human
agucagacuggauaguccgucuc

SEQ ID NO: 3427003 - RNA, 19 nt, Human
agucagagacagauaccuc

SEQ ID NO: 3427004 - RNA, 14 nt, Human
agucagaggauggc

SEQ ID NO: 3427005 - RNA, 19 nt, Human
agucagaggauggccagug

SEQ ID NO: 3427006 - RNA, 20 nt, Human
agucagaucugccuaaggac

SEQ ID NO: 3427007 - RNA, 21 nt, Human
agucagaucugccuaaggacu

SEQ ID NO: 3427008 - RNA, 22 nt, Human
agucagaucugccuaaggacuu

SEQ ID NO: 3427009 - RNA, 23 nt, Human
agucagaucugccuaaggacuuc

SEQ ID NO: 3427010 - RNA, 22 nt, Human
agucagauggaaaauucauuuu

SEQ ID NO: 3427011 - RNA, 11 nt, Human
agucagccucu

SEQ ID NO: 3427012 - RNA, 20 nt, Human
agucagcucuucaucugccc

SEQ ID NO: 3427013 - RNA, 19 nt, Human
agucagcuuugccuuccac

SEQ ID NO: 3427014 - RNA, 12 nt, Human
agucaggaaagg

SEQ ID NO: 3427015 - RNA, 17 nt, Human
agucaggcccaggcacu

SEQ ID NO: 3427016 - RNA, 17 nt, Human
agucaggcucucugggc

SEQ ID NO: 3427017 - RNA, 19 nt, Human
agucagggaccccugcccu

SEQ ID NO: 3427018 - RNA, 16 nt, Human
agucagggcccagagg

SEQ ID NO: 3427019 - RNA, 20 nt, Human
agucagggcccagaggcuga

SEQ ID NO: 3427020 - RNA, 18 nt, Human
agugaggcauugcacagg

SEQ ID NO: 3427021 - RNA, 18 nt, Human
agugaggccacugaagag

SEQ ID NO: 3427022 - RNA, 13 nt, Human
agugaggcucugc

SEQ ID NO: 3427023 - RNA, 21 nt, Human
agugaggcucugcccuugguu

SEQ ID NO: 3427024 - RNA, 19 nt, Human
agugagggagggcugucau

SEQ ID NO: 3427025 - RNA, 24 nt, Human
agugagggguaaaagcugaucugg

SEQ ID NO: 3427026 - RNA, 15 nt, Human
agugagggucagaga

SEQ ID NO: 3427027 - RNA, 21 nt, Human
agugaggguuucugagcugcu

SEQ ID NO: 3427028 - RNA, 22 nt, Human
agugaggugugucacaaugaga

SEQ ID NO: 3427029 - RNA, 20 nt, Human
agugaguaauuuuggauuuu

SEQ ID NO: 3427030 - RNA, 17 nt, Human
agugagucucucugggc

SEQ ID NO: 3427031 - RNA, 13 nt, Human
agugagugagccu

SEQ ID NO: 3427032 - RNA, 19 nt, Human
agugagugugcugcuguaa

SEQ ID NO: 3427033 - RNA, 19 nt, Human
agugaguuggguguauugu

SEQ ID NO: 3427034 - RNA, 21 nt, Human
agugaguuggguguauugugc

SEQ ID NO: 3427035 - RNA, 19 nt, Human
agugaguuuuuuagugcgu

SEQ ID NO: 3427036 - RNA, 21 nt, Human
agugauaacuccuaagaggag

SEQ ID NO: 3427037 - RNA, 15 nt, Human
agugauagucuuuug

SEQ ID NO: 3427038 - RNA, 14 nt, Human
agugauauaaauca

SEQ ID NO: 3427039 - RNA, 15 nt, Human
agugauauggagcaa

SEQ ID NO: 3427040 - RNA, 14 nt, Human
agugauauggcaga

SEQ ID NO: 3427041 - RNA, 18 nt, Human
agugauauucuuuguuaa

SEQ ID NO: 3427042 - RNA, 14 nt, Human
agugauauuucucu

SEQ ID NO: 3427043 - RNA, 17 nt, Human
agugaucaauaaaaugu

SEQ ID NO: 3427044 - RNA, 16 nt, Human
agugaucacagcagcu

SEQ ID NO: 3427045 - RNA, 13 nt, Human
agugauccuccca

SEQ ID NO: 3427046 - RNA, 18 nt, Human
agugauccucccaccuca

SEQ ID NO: 3427047 - RNA, 19 nt, Human
agugauccucccaccucag

SEQ ID NO: 3427048 - RNA, 22 nt, Human
agugauccucccaccucagccu

SEQ ID NO: 3427049 - RNA, 16 nt, Human
agugauccuuacaagu

SEQ ID NO: 3427050 - RNA, 13 nt, Human
agugaucuccaua

SEQ ID NO: 3427051 - RNA, 14 nt, Human
agugaucuccauau

SEQ ID NO: 3427052 - RNA, 17 nt, Human
agugaugcuaaaaccug

SEQ ID NO: 3427053 - RNA, 18 nt, Human
agugauggagcagagcaa

SEQ ID NO: 3427054 - RNA, 18 nt, Human
agugauguaauuaugguu

SEQ ID NO: 3427055 - RNA, 16 nt, Human
agugauguaccaugaa

SEQ ID NO: 3427056 - RNA, 19 nt, Human
agugaugucacuagggcag

SEQ ID NO: 3427057 - RNA, 18 nt, Human
agugauuaaggucucucu

SEQ ID NO: 3427058 - RNA, 19 nt, Human
agugauuaaggucucucuu

SEQ ID NO: 3427059 - RNA, 14 nt, Human
agugauuacuguca

SEQ ID NO: 3427060 - RNA, 21 nt, Human
agugauucucaugccucagcc

SEQ ID NO: 3427061 - RNA, 18 nt, Human
agugauucuccugccuca

SEQ ID NO: 3427062 - RNA, 19 nt, Human
agugauucuccugccucag

SEQ ID NO: 3427063 - RNA, 20 nt, Human
agugauucuccugccucagc

SEQ ID NO: 3427064 - RNA, 13 nt, Human
agugauugcagcu

SEQ ID NO: 3427065 - RNA, 18 nt, Human
agugcaaauugucacagg

SEQ ID NO: 3427066 - RNA, 21 nt, Human
agugcaaauugucacaggaca

SEQ ID NO: 3427067 - RNA, 17 nt, Human
agugcaacacugaagcu

SEQ ID NO: 3427068 - RNA, 18 nt, Human
agugcaaccacacaccuc

SEQ ID NO: 3427069 - RNA, 14 nt, Human
agugcaaccucugc

SEQ ID NO: 3427070 - RNA, 15 nt, Human
agugcaaccucugcu

SEQ ID NO: 3427071 - RNA, 21 nt, Human
agugcaauaaaucugacccag

SEQ ID NO: 3427072 - RNA, 14 nt, Human
agugcacaaaauga

SEQ ID NO: 3427073 - RNA, 17 nt, Human
agugcacaaaaugaaug

SEQ ID NO: 3427074 - RNA, 16 nt, Human
agugcacacagaaaua

SEQ ID NO: 3427075 - RNA, 20 nt, Human
agugcacacagaaauauaua

SEQ ID NO: 3427076 - RNA, 14 nt, Human
agugcacagcuguc

SEQ ID NO: 3427077 - RNA, 15 nt, Human
agugcacagcugucc

SEQ ID NO: 3427078 - RNA, 12 nt, Human
agugcacaugaa

SEQ ID NO: 3427079 - RNA, 16 nt, Human
agugcaccaaagagaa

SEQ ID NO: 3427080 - RNA, 18 nt, Human
agugcaccaaagagaaug

SEQ ID NO: 3427081 - RNA, 13 nt, Human
agugcacccacuc

SEQ ID NO: 3427082 - RNA, 17 nt, Human
agugcacccacucugcu

SEQ ID NO: 3427083 - RNA, 16 nt, Human
agugcacuugcuggaa

SEQ ID NO: 3427084 - RNA, 18 nt, Human
agugcacuugcuggaaga

SEQ ID NO: 3427085 - RNA, 23 nt, Human
agugcagaauguaagugggccca

SEQ ID NO: 3427086 - RNA, 21 nt, Human
agugcagccaaguagccucuc

SEQ ID NO: 3427087 - RNA, 24 nt, Human
agugcagcccguguggccccuuca

SEQ ID NO: 3427088 - RNA, 17 nt, Human
agugcagccguuugaga

SEQ ID NO: 3427089 - RNA, 18 nt, Human
agugcagccguuugagaa

SEQ ID NO: 3427090 - RNA, 20 nt, Human
agugcagcugauuuuaacaa

SEQ ID NO: 3427091 - RNA, 12 nt, Human
agugcaggccca

SEQ ID NO: 3427092 - RNA, 14 nt, Human
agugcaggcuggcc

SEQ ID NO: 3427093 - RNA, 14 nt, Human
agugcaguauagaa

SEQ ID NO: 3427094 - RNA, 23 nt, Human
agugcaguggcgcgaucucagcu

SEQ ID NO: 3427095 - RNA, 23 nt, Human
agugcaguggugcgaucauggcu

SEQ ID NO: 3427096 - RNA, 21 nt, Human
agugcauaguuguagacaaag

SEQ ID NO: 3427097 - RNA, 14 nt, Human
agugcauauuccuu

SEQ ID NO: 3427098 - RNA, 16 nt, Human
agugcauauuccuuuc

SEQ ID NO: 3427099 - RNA, 18 nt, Human
agugcauauuccuuucua

SEQ ID NO: 3427100 - RNA, 19 nt, Human
agugcauauuccuuucuau

SEQ ID NO: 3427101 - RNA, 16 nt, Human
agugcauauuuaucca

SEQ ID NO: 3427102 - RNA, 14 nt, Human
agugcaucuacuug

SEQ ID NO: 3427103 - RNA, 22 nt, Human
agugcaugcucucugcagccag

SEQ ID NO: 3427104 - RNA, 16 nt, Human
agugcaugguggccag

SEQ ID NO: 3427105 - RNA, 19 nt, Human
agugcaugguggccagagg

SEQ ID NO: 3427106 - RNA, 15 nt, Human
agugcauuguuucug

SEQ ID NO: 3427107 - RNA, 17 nt, Human
agugcauuguuucugug

SEQ ID NO: 3427108 - RNA, 16 nt, Human
agugcauuucugaaua

SEQ ID NO: 3427109 - RNA, 21 nt, Human
agugcauuugugcuagaaauu

SEQ ID NO: 3427110 - RNA, 16 nt, Human
agugccaaaaacaaca

SEQ ID NO: 3427111 - RNA, 12 nt, Human
agugccaaagaa

SEQ ID NO: 3427112 - RNA, 14 nt, Human
agugccaaaugcuc

SEQ ID NO: 3427113 - RNA, 16 nt, Human
agugccaacaauccua

SEQ ID NO: 3427114 - RNA, 16 nt, Human
agugccaacuguggcu

SEQ ID NO: 3427115 - RNA, 19 nt, Human
agugccaagcacagugccu

SEQ ID NO: 3427116 - RNA, 22 nt, Human
agugccaaggaccuccucuucc

SEQ ID NO: 3427117 - RNA, 17 nt, Human
agugccacuguuguuuu

SEQ ID NO: 3427118 - RNA, 18 nt, Human
agugccagaggugggcag

SEQ ID NO: 3427119 - RNA, 21 nt, Human
agugccagaggugggcaggug

SEQ ID NO: 3427120 - RNA, 23 nt, Human
agugccaggacuccccaggccag

SEQ ID NO: 3427121 - RNA, 20 nt, Human
agugccagucuugugucugc

SEQ ID NO: 3427122 - RNA, 16 nt, Human
agugccauuaacaaau

SEQ ID NO: 3427123 - RNA, 14 nt, Human
agugccauugucuu

SEQ ID NO: 3427124 - RNA, 18 nt, Human
agugccauugucuuuaua

SEQ ID NO: 3427125 - RNA, 19 nt, Human
agugcccaccaacauccca

SEQ ID NO: 3427126 - RNA, 13 nt, Human
agugcccaggugg

SEQ ID NO: 3427127 - RNA, 13 nt, Human
agugcccauuccu

SEQ ID NO: 3427128 - RNA, 13 nt, Human
agugccccaccug

SEQ ID NO: 3427129 - RNA, 17 nt, Human
agugccccaccugccac

SEQ ID NO: 3427130 - RNA, 19 nt, Human
agugccccauucuuuugua

SEQ ID NO: 3427131 - RNA, 20 nt, Human
agugccccgucuacagcucc

SEQ ID NO: 3427132 - RNA, 12 nt, Human
agugccccugcu

SEQ ID NO: 3427133 - RNA, 14 nt, Human
agugccccugcugc

SEQ ID NO: 3427134 - RNA, 14 nt, Human
agugcccuccagcc

SEQ ID NO: 3427135 - RNA, 15 nt, Human
agugcccuccagccc

SEQ ID NO: 3427136 - RNA, 16 nt, Human
agugcccuccaggaua

SEQ ID NO: 3427137 - RNA, 19 nt, Human
agugcccucucccacccuc

SEQ ID NO: 3427138 - RNA, 20 nt, Human
agucuugugcuuuuccuauu

SEQ ID NO: 3427139 - RNA, 19 nt, Human
agucuuuaaaggcccagcc

SEQ ID NO: 3427140 - RNA, 13 nt, Human
agucuuuaauaaa

SEQ ID NO: 3427141 - RNA, 14 nt, Human
agucuuuaauaaau

SEQ ID NO: 3427142 - RNA, 18 nt, Human
agucuuuagcuauuacug

SEQ ID NO: 3427143 - RNA, 15 nt, Human
agucuuuaggucuuu

SEQ ID NO: 3427144 - RNA, 16 nt, Human
agucuuucaagaauga

SEQ ID NO: 3427145 - RNA, 18 nt, Human
agucuuucacauuuaaau

SEQ ID NO: 3427146 - RNA, 20 nt, Human
agucuuucuuagugccugug

SEQ ID NO: 3427147 - RNA, 16 nt, Human
agucuuucuucuucaa

SEQ ID NO: 3427148 - RNA, 17 nt, Human
agucuuugaagcugaaa

SEQ ID NO: 3427149 - RNA, 12 nt, Human
agucuuuggggu

SEQ ID NO: 3427150 - RNA, 15 nt, Human
agucuuugguucuaa

SEQ ID NO: 3427151 - RNA, 22 nt, Human
agucuuuguaaguaaacugccc

SEQ ID NO: 3427152 - RNA, 19 nt, Human
agucuuuuaaaaaguauug

SEQ ID NO: 3427153 - RNA, 20 nt, Human
agucuuuuaaaaaguauugc

SEQ ID NO: 3427154 - RNA, 13 nt, Human
agucuuuuccaug

SEQ ID NO: 3427155 - RNA, 15 nt, Human
agucuuuuccaugaa

SEQ ID NO: 3427156 - RNA, 18 nt, Human
agucuuuugcuuuuggca

SEQ ID NO: 3427157 - RNA, 19 nt, Human
agucuuuugcuuuuggcaa

SEQ ID NO: 3427158 - RNA, 17 nt, Human
agucuuuuguucgcaug

SEQ ID NO: 3427159 - RNA, 13 nt, Human
agucuuuuucugu

SEQ ID NO: 3427160 - RNA, 14 nt, Human
agucuuuuucuguu

SEQ ID NO: 3427161 - RNA, 18 nt, Human
agucuuuuucuguuguaa

SEQ ID NO: 3427162 - RNA, 20 nt, Human
agucuuuuucuguuguaacu

SEQ ID NO: 3427163 - RNA, 17 nt, Human
agucuuuuuuuuuuaag

SEQ ID NO: 3427164 - RNA, 11 nt, Human
agugaaaaagg

SEQ ID NO: 3427165 - RNA, 17 nt, Human
agugaaaaaggaggaag

SEQ ID NO: 3427166 - RNA, 23 nt, Human
agugaaaaaggaggaagagaaaa

SEQ ID NO: 3427167 - RNA, 19 nt, Human
agugaaaacaagugcuggc

SEQ ID NO: 3427168 - RNA, 15 nt, Human
agugaaaacuuugua

SEQ ID NO: 3427169 - RNA, 14 nt, Human
agugaaaauauagc

SEQ ID NO: 3427170 - RNA, 20 nt, Human
agugaaaccuuuagggcagc

SEQ ID NO: 3427171 - RNA, 22 nt, Human
agugaaaccuuuagggcagcuu

SEQ ID NO: 3427172 - RNA, 20 nt, Human
agugaaacucguuaauuugu

SEQ ID NO: 3427173 - RNA, 21 nt, Human
agugaaagugaggaaauaaag

SEQ ID NO: 3427174 - RNA, 12 nt, Human
agugaaauaaca

SEQ ID NO: 3427175 - RNA, 14 nt, Human
agugaaauaacaaa

SEQ ID NO: 3427176 - RNA, 20 nt, Human
agugaaauaacaaaauggac

SEQ ID NO: 3427177 - RNA, 19 nt, Human
agugaaauaauguguaguu

SEQ ID NO: 3427178 - RNA, 15 nt, Human
agugaaauggauacu

SEQ ID NO: 3427179 - RNA, 21 nt, Human
agugaacaaauuuacagagac

SEQ ID NO: 3427180 - RNA, 22 nt, Human
agugaacaaauuuacagagaca

SEQ ID NO: 3427181 - RNA, 18 nt, Human
agugaacacauuguguca

SEQ ID NO: 3427182 - RNA, 21 nt, Human
agugaaccaucauuauaaacg

SEQ ID NO: 3427183 - RNA, 22 nt, Human
agugaaccucaccccgaggccc

SEQ ID NO: 3427184 - RNA, 20 nt, Human
agugaacuacgcuugcucau

SEQ ID NO: 3427185 - RNA, 18 nt, Human
agugaacuuaguccuguu

SEQ ID NO: 3427186 - RNA, 16 nt, Human
agugaacuugggccac

SEQ ID NO: 3427187 - RNA, 16 nt, Human
agugaagaaaagugaa

SEQ ID NO: 3427188 - RNA, 22 nt, Human
agugaagaaaagugaaugcuca

SEQ ID NO: 3427189 - RNA, 12 nt, Human
agugaagaauac

SEQ ID NO: 3427190 - RNA, 16 nt, Human
agugaagacaaugacu

SEQ ID NO: 3427191 - RNA, 14 nt, Human
agugaagacagaag

SEQ ID NO: 3427192 - RNA, 15 nt, Human
agugaagacagaagu

SEQ ID NO: 3427193 - RNA, 16 nt, Human
agugaagacuccagaa

SEQ ID NO: 3427194 - RNA, 13 nt, Human
agugaagaggggc

SEQ ID NO: 3427195 - RNA, 17 nt, Human
agugaagaggggcagcc

SEQ ID NO: 3427196 - RNA, 19 nt, Human
agugaagaggggcagcccu

SEQ ID NO: 3427197 - RNA, 17 nt, Human
agugaaggccacagcaa

SEQ ID NO: 3427198 - RNA, 15 nt, Human
agugaaggcuucucu

SEQ ID NO: 3427199 - RNA, 21 nt, Human
agugaaggcuucucucugugg

SEQ ID NO: 3427200 - RNA, 18 nt, Human
agugaagguuuacaauuu

SEQ ID NO: 3427201 - RNA, 14 nt, Human
agugaaguugcugc

SEQ ID NO: 3427202 - RNA, 15 nt, Human
agugaaguugcugcu

SEQ ID NO: 3427203 - RNA, 19 nt, Human
agugaaguugcuucuucua

SEQ ID NO: 3427204 - RNA, 15 nt, Human
agugaauaaaaauua

SEQ ID NO: 3427205 - RNA, 13 nt, Human
agugaauaaaugu

SEQ ID NO: 3427206 - RNA, 16 nt, Human
agugaauacugcuaca

SEQ ID NO: 3427207 - RNA, 20 nt, Human
agugaauacugcuacagcaa

SEQ ID NO: 3427208 - RNA, 15 nt, Human
agugaauaugccugu

SEQ ID NO: 3427209 - RNA, 20 nt, Human
agugaaucacguaaagcuag

SEQ ID NO: 3427210 - RNA, 13 nt, Human
agugaaugaaaca

SEQ ID NO: 3427211 - RNA, 15 nt, Human
agugaaugaaagauu

SEQ ID NO: 3427212 - RNA, 18 nt, Human
agugaaugcucaaguuuu

SEQ ID NO: 3427213 - RNA, 15 nt, Human
agugaaugcugggac

SEQ ID NO: 3427214 - RNA, 19 nt, Human
agugaaugcugggacucag

SEQ ID NO: 3427215 - RNA, 16 nt, Human
agugaauguaggcugg

SEQ ID NO: 3427216 - RNA, 14 nt, Human
agugaauuugaaug

SEQ ID NO: 3427217 - RNA, 17 nt, Human
agugaauuuuucucuaa

SEQ ID NO: 3427218 - RNA, 16 nt, Human
agugaauuuuugcaau

SEQ ID NO: 3427219 - RNA, 20 nt, Human
agugacaaggccccagagac

SEQ ID NO: 3427220 - RNA, 18 nt, Human
agugacacuucagagagc

SEQ ID NO: 3427221 - RNA, 20 nt, Human
agugacacuucagagagcug

SEQ ID NO: 3427222 - RNA, 21 nt, Human
agccuggaccucugacagcag

SEQ ID NO: 3427223 - RNA, 19 nt, Human
agccuggagacccacccca

SEQ ID NO: 3427224 - RNA, 11 nt, Human
agccuggaggc

SEQ ID NO: 3427225 - RNA, 10 nt, Human
agccuggaug

SEQ ID NO: 3427226 - RNA, 13 nt, Human
agccuggaugcca

SEQ ID NO: 3427227 - RNA, 13 nt, Human
agccuggcacagg

SEQ ID NO: 3427228 - RNA, 19 nt, Human
agccuggcacaggacugau

SEQ ID NO: 3427229 - RNA, 20 nt, Human
agccuggccacgcagccagg

SEQ ID NO: 3427230 - RNA, 12 nt, Human
agccuggccaga

SEQ ID NO: 3427231 - RNA, 12 nt, Human
agccuggcccag

SEQ ID NO: 3427232 - RNA, 13 nt, Human
agccuggcccagc

SEQ ID NO: 3427233 - RNA, 17 nt, Human
agccuggcccagcuccc

SEQ ID NO: 3427234 - RNA, 18 nt, Human
agccuggcccagcucccc

SEQ ID NO: 3427235 - RNA, 16 nt, Human
agccuggcccauagaa

SEQ ID NO: 3427236 - RNA, 16 nt, Human
agccuggccccauggu

SEQ ID NO: 3427237 - RNA, 13 nt, Human
agccuggccuccu

SEQ ID NO: 3427238 - RNA, 15 nt, Human
agccuggccuccugc

SEQ ID NO: 3427239 - RNA, 16 nt, Human
agccuggccuccugcc

SEQ ID NO: 3427240 - RNA, 17 nt, Human
agccuggccuccugccu

SEQ ID NO: 3427241 - RNA, 18 nt, Human
agccuggccuccugccuc

SEQ ID NO: 3427242 - RNA, 20 nt, Human
agccuggcuccaaacccucg

SEQ ID NO: 3427243 - RNA, 22 nt, Human
agccuggcuccaaacccucgag

SEQ ID NO: 3427244 - RNA, 12 nt, Human
agccuggcuccc

SEQ ID NO: 3427245 - RNA, 20 nt, Human
agccuggcucccacaggcag

SEQ ID NO: 3427246 - RNA, 21 nt, Human
agccuggcucccacaggcagc

SEQ ID NO: 3427247 - RNA, 17 nt, Human
agccuggcucccaggac

SEQ ID NO: 3427248 - RNA, 11 nt, Human
agccuggcucu

SEQ ID NO: 3427249 - RNA, 15 nt, Human
agccuggcuucugga

SEQ ID NO: 3427250 - RNA, 21 nt, Human
agccuggcuucuggagcccuu

SEQ ID NO: 3427251 - RNA, 17 nt, Human
agccugggaaagccccu

SEQ ID NO: 3427252 - RNA, 14 nt, Human
agccugggaggcac

SEQ ID NO: 3427253 - RNA, 20 nt, Human
agccugggauaggggcagag

SEQ ID NO: 3427254 - RNA, 19 nt, Human
agccugggauuucuaugca

SEQ ID NO: 3427255 - RNA, 20 nt, Human
agccugggcagcauagcaag

SEQ ID NO: 3427256 - RNA, 18 nt, Human
agccugggcccaucuccc

SEQ ID NO: 3427257 - RNA, 12 nt, Human
agccugggcccc

SEQ ID NO: 3427258 - RNA, 22 nt, Human
agccugggccuauggagagccc

SEQ ID NO: 3427259 - RNA, 23 nt, Human
agccugggccuauggagagcccu

SEQ ID NO: 3427260 - RNA, 15 nt, Human
agccugggcgacaga

SEQ ID NO: 3427261 - RNA, 17 nt, Human
agccuggggccuggcag

SEQ ID NO: 3427262 - RNA, 16 nt, Human
agccuggggcucuaac

SEQ ID NO: 3427263 - RNA, 18 nt, Human
agccugggggccuggcug

SEQ ID NO: 3427264 - RNA, 19 nt, Human
agccugggggccuggcugg

SEQ ID NO: 3427265 - RNA, 23 nt, Human
agccugggggccuggcuggcuga

SEQ ID NO: 3427266 - RNA, 19 nt, Human
agccugggguggggucaug

SEQ ID NO: 3427267 - RNA, 20 nt, Human
agccugggguggggucaugc

SEQ ID NO: 3427268 - RNA, 14 nt, Human
agccugggugacaa

SEQ ID NO: 3427269 - RNA, 22 nt, Human
agccugggugacagagcaagug

SEQ ID NO: 3427270 - RNA, 20 nt, Human
agccugguaggaaagggcaa

SEQ ID NO: 3427271 - RNA, 11 nt, Human
agccuggugcc

SEQ ID NO: 3427272 - RNA, 16 nt, Human
agccuggugcugcugc

SEQ ID NO: 3427273 - RNA, 11 nt, Human
agccugguggg

SEQ ID NO: 3427274 - RNA, 19 nt, Human
agccuguaacacuccucug

SEQ ID NO: 3427275 - RNA, 18 nt, Human
agccuguaagccugcaag

SEQ ID NO: 3427276 - RNA, 21 nt, Human
agccugucagauccaggagcu

SEQ ID NO: 3427277 - RNA, 11 nt, Human
agccuguccug

SEQ ID NO: 3427278 - RNA, 12 nt, Human
agccuguccugu

SEQ ID NO: 3427279 - RNA, 16 nt, Human
agccugucucuuccau

SEQ ID NO: 3427280 - RNA, 15 nt, Human
agccugugaacccag

SEQ ID NO: 3427281 - RNA, 18 nt, Human
agccugugaacccaggac

SEQ ID NO: 3427282 - RNA, 19 nt, Human
agccugugaacccaggaca

SEQ ID NO: 3427283 - RNA, 21 nt, Human
agccugugcauguaugucuug

SEQ ID NO: 3427284 - RNA, 23 nt, Human
agugagcggugcuguccucaggu

SEQ ID NO: 3427285 - RNA, 16 nt, Human
agugagcuacagagcc

SEQ ID NO: 3427286 - RNA, 17 nt, Human
agugagcucuaugggca

SEQ ID NO: 3427287 - RNA, 13 nt, Human
agugagcugggca

SEQ ID NO: 3427288 - RNA, 21 nt, Human
agugagcugggcaugguacca

SEQ ID NO: 3427289 - RNA, 17 nt, Human
agugagcuguaggugug

SEQ ID NO: 3427290 - RNA, 14 nt, Human
agugagcuuugcug

SEQ ID NO: 3427291 - RNA, 20 nt, Human
agugagcuuugcugcuacag

SEQ ID NO: 3427292 - RNA, 17 nt, Human
agugaggaaaucaaagu

SEQ ID NO: 3427293 - RNA, 22 nt, Human
agugaggaaggcaggaagagag

SEQ ID NO: 3427294 - RNA, 20 nt, Human
agugaggaauaguugagccc

SEQ ID NO: 3427295 - RNA, 22 nt, Human
agugaggcauugcacagggaga

SEQ ID NO: 3427296 - RNA, 12 nt, Human
agugaggccacu

SEQ ID NO: 3427297 - RNA, 13 nt, Human
agugaggcccagg

SEQ ID NO: 3427298 - RNA, 17 nt, Human
agugaggcucugcccuu

SEQ ID NO: 3427299 - RNA, 20 nt, Human
agugaggcucugcccuuggu

SEQ ID NO: 3427300 - RNA, 13 nt, Human
agugagggucaga

SEQ ID NO: 3427301 - RNA, 16 nt, Human
agugagggucagagag

SEQ ID NO: 3427302 - RNA, 17 nt, Human
agugaggguuucugagc

SEQ ID NO: 3427303 - RNA, 20 nt, Human
agugaggguuucugagcugc

SEQ ID NO: 3427304 - RNA, 16 nt, Human
agugagguccuggggg

SEQ ID NO: 3427305 - RNA, 17 nt, Human
agugagguccugggggc

SEQ ID NO: 3427306 - RNA, 14 nt, Human
agugaggugcccag

SEQ ID NO: 3427307 - RNA, 15 nt, Human
agugaggugcccagc

SEQ ID NO: 3427308 - RNA, 16 nt, Human
agugaggugugucaca

SEQ ID NO: 3427309 - RNA, 15 nt, Human
agugagucgaggaca

SEQ ID NO: 3427310 - RNA, 24 nt, Human
agugagucucucugggccuuagga

SEQ ID NO: 3427311 - RNA, 14 nt, Human
agugagugagccug

SEQ ID NO: 3427312 - RNA, 14 nt, Human
agugaguggcccuu

SEQ ID NO: 3427313 - RNA, 17 nt, Human
agugagugugcugcugu

SEQ ID NO: 3427314 - RNA, 16 nt, Human
agugaguguggcuccc

SEQ ID NO: 3427315 - RNA, 22 nt, Human
agugaguuacagcgagaggcag

SEQ ID NO: 3427316 - RNA, 20 nt, Human
agugaguuggguguauugug

SEQ ID NO: 3427317 - RNA, 18 nt, Human
agugauaacuccuaagag

SEQ ID NO: 3427318 - RNA, 20 nt, Human
agugauagagcuaacccuua

SEQ ID NO: 3427319 - RNA, 17 nt, Human
agugauagucuuuugcu

SEQ ID NO: 3427320 - RNA, 20 nt, Human
agugauagucuuuugcuuuu

SEQ ID NO: 3427321 - RNA, 17 nt, Human
agugauauggagcaaga

SEQ ID NO: 3427322 - RNA, 17 nt, Human
agugauauggcagaaga

SEQ ID NO: 3427323 - RNA, 22 nt, Human
agugauauggcagaagacacca

SEQ ID NO: 3427324 - RNA, 15 nt, Human
agugauauuacauuu

SEQ ID NO: 3427325 - RNA, 17 nt, Human
agugauauucuuuguua

SEQ ID NO: 3427326 - RNA, 20 nt, Human
agugauauucuuuguuaauu

SEQ ID NO: 3427327 - RNA, 22 nt, Human
agugauauuucucuaguaguua

SEQ ID NO: 3427328 - RNA, 16 nt, Human
agugaucaauaaaaug

SEQ ID NO: 3427329 - RNA, 14 nt, Human
agugaucacagcag

SEQ ID NO: 3427330 - RNA, 14 nt, Human
agugauccucccac

SEQ ID NO: 3427331 - RNA, 23 nt, Human
agugauccucccaccucagccuc

SEQ ID NO: 3427332 - RNA, 20 nt, Human
agugaucugaacagaaauac

SEQ ID NO: 3427333 - RNA, 20 nt, Human
agugaucuuuuguucccauc

SEQ ID NO: 3427334 - RNA, 21 nt, Human
agugaugcugugcuaugaauu

SEQ ID NO: 3427335 - RNA, 14 nt, Human
agugauggagcaga

SEQ ID NO: 3427336 - RNA, 13 nt, Human
agugauggucaga

SEQ ID NO: 3427337 - RNA, 14 nt, Human
agugauguuuuuau

SEQ ID NO: 3427338 - RNA, 13 nt, Human
agugauuaccagg

SEQ ID NO: 3427339 - RNA, 15 nt, Human
agugauuaccaggga

SEQ ID NO: 3427340 - RNA, 18 nt, Human
agugauuaccagggacug

SEQ ID NO: 3427341 - RNA, 18 nt, Human
agugauucucaugccuca

SEQ ID NO: 3427342 - RNA, 20 nt, Human
agugauugcagcuuuauguu

SEQ ID NO: 3427343 - RNA, 17 nt, Human
agugauugggacagagg

SEQ ID NO: 3427344 - RNA, 15 nt, Human
agugauuguuggcac

SEQ ID NO: 3427345 - RNA, 15 nt, Human
agugauuucuagaaa

SEQ ID NO: 3427346 - RNA, 16 nt, Human
agugauuuuuauccaa

SEQ ID NO: 3427347 - RNA, 12 nt, Human
agugcaaaaggc

SEQ ID NO: 3427348 - RNA, 21 nt, Human
agugcaaagauuugcuuuaau

SEQ ID NO: 3427349 - RNA, 16 nt, Human
agugcaacacuggucu

SEQ ID NO: 3427350 - RNA, 20 nt, Human
agugcaacagcacuggcucu

SEQ ID NO: 3427351 - RNA, 13 nt, Human
agugcaaccucug

SEQ ID NO: 3427352 - RNA, 16 nt, Human
agugcaaccucugcuu

SEQ ID NO: 3427353 - RNA, 15 nt, Human
agugcaagccccugc

SEQ ID NO: 3427354 - RNA, 17 nt, Human
agugcaagccccugcuc

SEQ ID NO: 3427355 - RNA, 20 nt, Human
agugcaauaaaucugaccca

SEQ ID NO: 3427356 - RNA, 14 nt, Human
agugcaauauauuu

SEQ ID NO: 3427357 - RNA, 16 nt, Human
agugcaauauauuuug

SEQ ID NO: 3427358 - RNA, 21 nt, Human
agugcaauauauuuuguaugc

SEQ ID NO: 3427359 - RNA, 13 nt, Human
agugcacaaaaug

SEQ ID NO: 3427360 - RNA, 15 nt, Human
agugcacaaaaugaa

SEQ ID NO: 3427361 - RNA, 17 nt, Human
agugcacacagaaauau

SEQ ID NO: 3427362 - RNA, 19 nt, Human
agugcacacagaaauauau

SEQ ID NO: 3427363 - RNA, 12 nt, Human
agugcacagcug

SEQ ID NO: 3427364 - RNA, 20 nt, Human
agugcaccaaagagaaugcc

SEQ ID NO: 3427365 - RNA, 12 nt, Human
agugcacugauu

SEQ ID NO: 3427366 - RNA, 14 nt, Human
agugcacuuucuaa

SEQ ID NO: 3427367 - RNA, 12 nt, Human
agugcagaacug

SEQ ID NO: 3427368 - RNA, 19 nt, Human
agugcagaaugcuccucca

SEQ ID NO: 3427369 - RNA, 14 nt, Human
agugcagaauguaa

SEQ ID NO: 3427370 - RNA, 22 nt, Human
agugcagaauguaagugggccc

SEQ ID NO: 3427371 - RNA, 21 nt, Human
agugcagaccccuuggccagc

SEQ ID NO: 3427372 - RNA, 17 nt, Human
agugcagagccuucuca

SEQ ID NO: 3427373 - RNA, 18 nt, Human
agugcagagccuucucag

SEQ ID NO: 3427374 - RNA, 19 nt, Human
agugcagagccuucucaga

SEQ ID NO: 3427375 - RNA, 16 nt, Human
agugcagcagggcagu

SEQ ID NO: 3427376 - RNA, 23 nt, Human
agugcagcccguguggccccuuc

SEQ ID NO: 3427377 - RNA, 17 nt, Human
agugcagcugaaauuga

SEQ ID NO: 3427378 - RNA, 14 nt, Human
agugcagcugauuu

SEQ ID NO: 3427379 - RNA, 19 nt, Human
agugcaggcccacccugcu

SEQ ID NO: 3427380 - RNA, 15 nt, Human
agugcaguauagaau

SEQ ID NO: 3427381 - RNA, 23 nt, Human
agugcaguccugaucagagccgu

SEQ ID NO: 3427382 - RNA, 23 nt, Human
agugcaguggcaucaucucagcu

SEQ ID NO: 3427383 - RNA, 15 nt, Human
agcgacagugagacu

SEQ ID NO: 3427384 - RNA, 17 nt, Human
agcgacagugagacucu

SEQ ID NO: 3427385 - RNA, 20 nt, Human
agcgacaucucugacuuucu

SEQ ID NO: 3427386 - RNA, 14 nt, Human
agcgaccgcccccu

SEQ ID NO: 3427387 - RNA, 16 nt, Human
agcgacuccguuggcc

SEQ ID NO: 3427388 - RNA, 17 nt, Human
agcgacuccguuggcca

SEQ ID NO: 3427389 - RNA, 23 nt, Human
agcgaggcacccuuacuggcuua

SEQ ID NO: 3427390 - RNA, 14 nt, Human
agcgagggcagcug

SEQ ID NO: 3427391 - RNA, 17 nt, Human
agcgagggcagcugcua

SEQ ID NO: 3427392 - RNA, 18 nt, Human
agcgaggucaacagagaa

SEQ ID NO: 3427393 - RNA, 21 nt, Human
agcgaguggagucugccaccc

SEQ ID NO: 3427394 - RNA, 14 nt, Human
agcgaguuguggaa

SEQ ID NO: 3427395 - RNA, 15 nt, Human
agcgauauacagaug

SEQ ID NO: 3427396 - RNA, 16 nt, Human
agcgaucucuccacug

SEQ ID NO: 3427397 - RNA, 17 nt, Human
agcgaucucuccuggcc

SEQ ID NO: 3427398 - RNA, 18 nt, Human
agcgaucucuccuggccu

SEQ ID NO: 3427399 - RNA, 19 nt, Human
agcgaucucuccuggccua

SEQ ID NO: 3427400 - RNA, 19 nt, Human
agcgaugaauuuggagacu

SEQ ID NO: 3427401 - RNA, 19 nt, Human
agcgauuauuaucuaaagu

SEQ ID NO: 3427402 - RNA, 21 nt, Human
agcgauucccucucccaggcc

SEQ ID NO: 3427403 - RNA, 22 nt, Human
agcgauucuucugcuucagccu

SEQ ID NO: 3427404 - RNA, 19 nt, Human
agcgcagcagcccuccccg

SEQ ID NO: 3427405 - RNA, 21 nt, Human
agcgcagccgccuucacagca

SEQ ID NO: 3427406 - RNA, 14 nt, Human
agcgcaguuuuuuu

SEQ ID NO: 3427407 - RNA, 16 nt, Human
agcgccaagcaaccug

SEQ ID NO: 3427408 - RNA, 12 nt, Human
agcgccaggcug

SEQ ID NO: 3427409 - RNA, 16 nt, Human
agcgccccucccuagu

SEQ ID NO: 3427410 - RNA, 19 nt, Human
agcgcccgcugggcugagc

SEQ ID NO: 3427411 - RNA, 13 nt, Human
agcgcccugcaga

SEQ ID NO: 3427412 - RNA, 18 nt, Human
agcgcccugcagacccug

SEQ ID NO: 3427413 - RNA, 21 nt, Human
agcgcccugcagacccugccc

SEQ ID NO: 3427414 - RNA, 23 nt, Human
agcgcccugcagacccugcccuu

SEQ ID NO: 3427415 - RNA, 13 nt, Human
agcgcccuggccc

SEQ ID NO: 3427416 - RNA, 14 nt, Human
agcgcccuggcccc

SEQ ID NO: 3427417 - RNA, 14 nt, Human
agcgcccuuccucu

SEQ ID NO: 3427418 - RNA, 17 nt, Human
agcgccgugaguucuca

SEQ ID NO: 3427419 - RNA, 22 nt, Human
agcgccgugaguucucagggcu

SEQ ID NO: 3427420 - RNA, 23 nt, Human
agcgccuccauccaaggccaggu

SEQ ID NO: 3427421 - RNA, 12 nt, Human
agcgccucccuc

SEQ ID NO: 3427422 - RNA, 13 nt, Human
agcgccucccucc

SEQ ID NO: 3427423 - RNA, 22 nt, Human
agcgccucccuccaccccagga

SEQ ID NO: 3427424 - RNA, 23 nt, Human
agcgccucccuccaccccaggac

SEQ ID NO: 3427425 - RNA, 15 nt, Human
agcgccugccccucc

SEQ ID NO: 3427426 - RNA, 11 nt, Human
agcgccuggcc

SEQ ID NO: 3427427 - RNA, 20 nt, Human
agcgcgccacucgcuucccc

SEQ ID NO: 3427428 - RNA, 15 nt, Human
agcgcgccccuagcc

SEQ ID NO: 3427429 - RNA, 14 nt, Human
aguuuaauugacuu

SEQ ID NO: 3427430 - RNA, 17 nt, Human
aguuuacaaguguauau

SEQ ID NO: 3427431 - RNA, 21 nt, Human
aguuuacaaguguauaucaga

SEQ ID NO: 3427432 - RNA, 13 nt, Human
aguuuacaguaaa

SEQ ID NO: 3427433 - RNA, 14 nt, Human
aguuuacaguaaau

SEQ ID NO: 3427434 - RNA, 16 nt, Human
aguuuacaguaaauaa

SEQ ID NO: 3427435 - RNA, 15 nt, Human
aguuuacauuguaaa

SEQ ID NO: 3427436 - RNA, 17 nt, Human
aguuuacauuguaaaua

SEQ ID NO: 3427437 - RNA, 13 nt, Human
aguuuacauuuuu

SEQ ID NO: 3427438 - RNA, 13 nt, Human
aguuuaccauuug

SEQ ID NO: 3427439 - RNA, 16 nt, Human
aguuuaccauuuguaa

SEQ ID NO: 3427440 - RNA, 21 nt, Human
aguuuacccaugaagauuggu

SEQ ID NO: 3427441 - RNA, 20 nt, Human
aguuuaccucuuuaaaaaca

SEQ ID NO: 3427442 - RNA, 14 nt, Human
aguuuaccuuguau

SEQ ID NO: 3427443 - RNA, 20 nt, Human
aguuuaccuuguauacugua

SEQ ID NO: 3427444 - RNA, 15 nt, Human
aguuuacuauuuuac

SEQ ID NO: 3427445 - RNA, 15 nt, Human
aguuuacugagaaug

SEQ ID NO: 3427446 - RNA, 22 nt, Human
aguuuagaggaaaaaaaugacu

SEQ ID NO: 3427447 - RNA, 21 nt, Human
aguuuagggaacaauuuggca

SEQ ID NO: 3427448 - RNA, 24 nt, Human
aguuuagggaacaauuuggcaauu

SEQ ID NO: 3427449 - RNA, 13 nt, Human
aguuuaggguggg

SEQ ID NO: 3427450 - RNA, 14 nt, Human
aguuuagggugggg

SEQ ID NO: 3427451 - RNA, 22 nt, Human
aguuuagugugguuuucuguuu

SEQ ID NO: 3427452 - RNA, 21 nt, Human
aguuuauaaaagacugucuua

SEQ ID NO: 3427453 - RNA, 15 nt, Human
aguuuauacaguaca

SEQ ID NO: 3427454 - RNA, 16 nt, Human
aguuuauacucaccuu

SEQ ID NO: 3427455 - RNA, 19 nt, Human
aguuuaucaguaaauaacu

SEQ ID NO: 3427456 - RNA, 16 nt, Human
aguuuaucauucaagu

SEQ ID NO: 3427457 - RNA, 19 nt, Human
aguuuaugcagugcugcuu

SEQ ID NO: 3427458 - RNA, 12 nt, Human
aguuuauguuuu

SEQ ID NO: 3427459 - RNA, 14 nt, Human
aguuuauguuuugg

SEQ ID NO: 3427460 - RNA, 16 nt, Human
aguuuauuccagagcu

SEQ ID NO: 3427461 - RNA, 15 nt, Human
aguuuauucucauuu

SEQ ID NO: 3427462 - RNA, 23 nt, Human
aguuuauuuguugagagugugac

SEQ ID NO: 3427463 - RNA, 20 nt, Human
aguuuauuuuuaaagauaga

SEQ ID NO: 3427464 - RNA, 15 nt, Human
aguuucaaaaaucug

SEQ ID NO: 3427465 - RNA, 14 nt, Human
aguuucaacaugaa

SEQ ID NO: 3427466 - RNA, 15 nt, Human
aguuucaaccaugaa

SEQ ID NO: 3427467 - RNA, 18 nt, Human
aguuucaaguuuuaaagu

SEQ ID NO: 3427468 - RNA, 15 nt, Human
aguuucaauaaaguu

SEQ ID NO: 3427469 - RNA, 18 nt, Human
aguuucaauaaaguuuga

SEQ ID NO: 3427470 - RNA, 23 nt, Human
aguuucaauaaaguuugaucuuc

SEQ ID NO: 3427471 - RNA, 12 nt, Human
aguuucaaugug

SEQ ID NO: 3427472 - RNA, 16 nt, Human
aguuucaauucagugc

SEQ ID NO: 3427473 - RNA, 15 nt, Human
aguuucagauauaua

SEQ ID NO: 3427474 - RNA, 17 nt, Human
aguuucagauauauauc

SEQ ID NO: 3427475 - RNA, 14 nt, Human
aguuucaggugaca

SEQ ID NO: 3427476 - RNA, 20 nt, Human
aguuucaggugacaugugaa

SEQ ID NO: 3427477 - RNA, 21 nt, Human
aguuucaggugacaugugaaa

SEQ ID NO: 3427478 - RNA, 18 nt, Human
aguuucagguguuuaguu

SEQ ID NO: 3427479 - RNA, 18 nt, Human
aguuucaguuuguuggaa

SEQ ID NO: 3427480 - RNA, 16 nt, Human
aguuucauaauugugu

SEQ ID NO: 3427481 - RNA, 15 nt, Human
aguuucauguacaag

SEQ ID NO: 3427482 - RNA, 20 nt, Human
aguuucauucuccugccugu

SEQ ID NO: 3427483 - RNA, 13 nt, Human
aguuucauuuaug

SEQ ID NO: 3427484 - RNA, 15 nt, Human
aguuuccaagcaaau

SEQ ID NO: 3427485 - RNA, 18 nt, Human
aguuuccaagcaaauguu

SEQ ID NO: 3427486 - RNA, 22 nt, Human
aguuuccaagcaaauguuacau

SEQ ID NO: 3427487 - RNA, 18 nt, Human
aguuuccaauuauuugac

SEQ ID NO: 3427488 - RNA, 20 nt, Human
aguuuccauagcaacaggaa

SEQ ID NO: 3427489 - RNA, 22 nt, Human
aguuuccccaccagugaaugaa

SEQ ID NO: 3427490 - RNA, 16 nt, Human
aguuuccuaaucagaa

SEQ ID NO: 3427491 - RNA, 18 nt, Human
aguuuccuuggcuggugc

SEQ ID NO: 3427492 - RNA, 19 nt, Human
aguuuccuuggcuggugca

SEQ ID NO: 3427493 - RNA, 23 nt, Human
aguuuccuuuucugucucucucu

SEQ ID NO: 3427494 - RNA, 12 nt, Human
aguuuccuuuuu

SEQ ID NO: 3427495 - RNA, 18 nt, Human
aguuuccuuuuuaauaug

SEQ ID NO: 3427496 - RNA, 18 nt, Human
aguuucuaagauucuaaa

SEQ ID NO: 3427497 - RNA, 11 nt, Human
aguuucuaagg

SEQ ID NO: 3427498 - RNA, 23 nt, Human
aguuucuaagguccgguguucua

SEQ ID NO: 3427499 - RNA, 15 nt, Human
aguuucucagauccu

SEQ ID NO: 3427500 - RNA, 21 nt, Human
aguuucucagcucccauuucu

SEQ ID NO: 3427501 - RNA, 14 nt, Human
aguuucugaguuuu

SEQ ID NO: 3427502 - RNA, 20 nt, Human
aguuucugaguuuuaccaaa

SEQ ID NO: 3427503 - RNA, 15 nt, Human
aguuucugccgcagc

SEQ ID NO: 3427504 - RNA, 17 nt, Human
aguuucugccgcagccc

SEQ ID NO: 3427505 - RNA, 17 nt, Human
aguuucuguccugcugg

SEQ ID NO: 3427506 - RNA, 23 nt, Human
aguuucugucguuaaaaacagau

SEQ ID NO: 3427507 - RNA, 16 nt, Human
aguuucuguucugugg

SEQ ID NO: 3427508 - RNA, 19 nt, Human
aguuucuguucuguggaaa

SEQ ID NO: 3427509 - RNA, 15 nt, Human
aguuucuuagacuuu

SEQ ID NO: 3427510 - RNA, 15 nt, Human
aguuucuuagcuuuu

SEQ ID NO: 3427511 - RNA, 13 nt, Human
aguuucuugcuug

SEQ ID NO: 3427512 - RNA, 16 nt, Human
aguuucuugguaaagu

SEQ ID NO: 3427513 - RNA, 12 nt, Human
aguuugaaauaa

SEQ ID NO: 3427514 - RNA, 13 nt, Human
aguuugaaauaag

SEQ ID NO: 3427515 - RNA, 22 nt, Human
aguuugaaauucugaauuugca

SEQ ID NO: 3427516 - RNA, 22 nt, Human
aguuugaaucuauuuaucuuca

SEQ ID NO: 3427517 - RNA, 18 nt, Human
aguuugagaucagccugg

SEQ ID NO: 3427518 - RNA, 19 nt, Human
aguuugagaucagccuggg

SEQ ID NO: 3427519 - RNA, 20 nt, Human
aguuugagaucagccugggc

SEQ ID NO: 3427520 - RNA, 16 nt, Human
aguuugagcugccuuc

SEQ ID NO: 3427521 - RNA, 23 nt, Human
aguuugagcugccuucccuagcu

SEQ ID NO: 3427522 - RNA, 19 nt, Human
aguuugaggaaauuugcag

SEQ ID NO: 3427523 - RNA, 18 nt, Human
aguuugaggauuaguuua

SEQ ID NO: 3427524 - RNA, 19 nt, Human
aguuugauaaauaguguua

SEQ ID NO: 3427525 - RNA, 16 nt, Human
aguuugaucuuccucu

SEQ ID NO: 3427526 - RNA, 18 nt, Human
aguuugaugaggcccucc

SEQ ID NO: 3427527 - RNA, 20 nt, Human
aguuugaugucauuaaugug

SEQ ID NO: 3427528 - RNA, 18 nt, Human
aguuugauuaaauucuug

SEQ ID NO: 3427529 - RNA, 20 nt, Human
aguuugauuaaauucuugca

SEQ ID NO: 3427530 - RNA, 14 nt, Human
aguuugauuauuca

SEQ ID NO: 3427531 - RNA, 10 nt, Human
aguuugcacu

SEQ ID NO: 3427532 - RNA, 23 nt, Human
aguuugcacucaaaucuuaagaa

SEQ ID NO: 3427533 - RNA, 20 nt, Human
aguuugcacuguaugcugga

SEQ ID NO: 3427534 - RNA, 13 nt, Human
aguuugcagaaaa

SEQ ID NO: 3427535 - RNA, 21 nt, Human
aguuugcagaaaagcaccugc

SEQ ID NO: 3427536 - RNA, 16 nt, Human
aguuugcauuucagaa

SEQ ID NO: 3427537 - RNA, 23 nt, Human
aguuugcauuucagaaagccuuu

SEQ ID NO: 3427538 - RNA, 13 nt, Human
aguuugccagaag

SEQ ID NO: 3427539 - RNA, 23 nt, Human
aguuugcuagcagaaaucuagaa

SEQ ID NO: 3427540 - RNA, 14 nt, Human
aguuugcuauuaga

SEQ ID NO: 3427541 - RNA, 14 nt, Human
aguuugcuuagaaa

SEQ ID NO: 3427542 - RNA, 14 nt, Human
aguuuggauaugua

SEQ ID NO: 3427543 - RNA, 23 nt, Human
agcuacagagccgagcaauauuu

SEQ ID NO: 3427544 - RNA, 14 nt, Human
agcuacaggaagca

SEQ ID NO: 3427545 - RNA, 12 nt, Human
agcuacagguua

SEQ ID NO: 3427546 - RNA, 13 nt, Human
agcuaccaugaca

SEQ ID NO: 3427547 - RNA, 17 nt, Human
agcuacccaaaagagaa

SEQ ID NO: 3427548 - RNA, 17 nt, Human
agcuacccgcagaguuc

SEQ ID NO: 3427549 - RNA, 20 nt, Human
agcuacccuuuuucuccagc

SEQ ID NO: 3427550 - RNA, 14 nt, Human
agcuaccucaacca

SEQ ID NO: 3427551 - RNA, 20 nt, Human
agcuaccuguguggacagga

SEQ ID NO: 3427552 - RNA, 16 nt, Human
agcuacguauuuaaua

SEQ ID NO: 3427553 - RNA, 15 nt, Human
agcuacguuuacuca

SEQ ID NO: 3427554 - RNA, 14 nt, Human
agcuacuaaaauca

SEQ ID NO: 3427555 - RNA, 16 nt, Human
agcuacuaaaaucagu

SEQ ID NO: 3427556 - RNA, 19 nt, Human
agcuacuaauuuuaaaaug

SEQ ID NO: 3427557 - RNA, 15 nt, Human
agcuacuagcaaaau

SEQ ID NO: 3427558 - RNA, 14 nt, Human
agcuacucagaagc

SEQ ID NO: 3427559 - RNA, 20 nt, Human
agcuacucagaagccugagg

SEQ ID NO: 3427560 - RNA, 15 nt, Human
agcuacucaggaggc

SEQ ID NO: 3427561 - RNA, 18 nt, Human
agcuacuccggaggcuga

SEQ ID NO: 3427562 - RNA, 19 nt, Human
agcuacuccggaggcugag

SEQ ID NO: 3427563 - RNA, 19 nt, Human
agcuacucgggaagcugag

SEQ ID NO: 3427564 - RNA, 22 nt, Human
agcuacucuccccacgagggcu

SEQ ID NO: 3427565 - RNA, 13 nt, Human
agcuacugccauc

SEQ ID NO: 3427566 - RNA, 14 nt, Human
agcuacugccaucc

SEQ ID NO: 3427567 - RNA, 22 nt, Human
agcuacugccauccuggcccag

SEQ ID NO: 3427568 - RNA, 23 nt, Human
agcuacugccgucagugcugugc

SEQ ID NO: 3427569 - RNA, 15 nt, Human
agcuacugugugugu

SEQ ID NO: 3427570 - RNA, 19 nt, Human
agcuacugugugugugaau

SEQ ID NO: 3427571 - RNA, 18 nt, Human
agcuacuuaagagaaaug

SEQ ID NO: 3427572 - RNA, 18 nt, Human
agcuacuugggaggcuga

SEQ ID NO: 3427573 - RNA, 16 nt, Human
agcuacuugguuugug

SEQ ID NO: 3427574 - RNA, 11 nt, Human
auaauaaaaau

SEQ ID NO: 3427575 - RNA, 19 nt, Human
auaauaaaaauauauuuuc

SEQ ID NO: 3427576 - RNA, 14 nt, Human
auaauaaaaggaaa

SEQ ID NO: 3427577 - RNA, 15 nt, Human
auaauaaaaggaaaa

SEQ ID NO: 3427578 - RNA, 20 nt, Human
auaauaaaaggaaaagcaaa

SEQ ID NO: 3427579 - RNA, 12 nt, Human
auaauaaaauag

SEQ ID NO: 3427580 - RNA, 16 nt, Human
auaauaaagcuacuga

SEQ ID NO: 3427581 - RNA, 13 nt, Human
auaauaaaggacu

SEQ ID NO: 3427582 - RNA, 13 nt, Human
auaauaaauaguu

SEQ ID NO: 3427583 - RNA, 13 nt, Human
auaauaaauauau

SEQ ID NO: 3427584 - RNA, 13 nt, Human
auaauaagcuaaa

SEQ ID NO: 3427585 - RNA, 18 nt, Human
auaauaaggaaaaguuua

SEQ ID NO: 3427586 - RNA, 12 nt, Human
auaauaauacaa

SEQ ID NO: 3427587 - RNA, 14 nt, Human
auaauaaucucagu

SEQ ID NO: 3427588 - RNA, 22 nt, Human
auaauaauuuuuauauuuaauu

SEQ ID NO: 3427589 - RNA, 13 nt, Human
auaauacaaaagg

SEQ ID NO: 3427590 - RNA, 12 nt, Human
auaauacaccac

SEQ ID NO: 3427591 - RNA, 20 nt, Human
auaauacaccacuacauucu

SEQ ID NO: 3427592 - RNA, 21 nt, Human
auaauacaccacuacauucug

SEQ ID NO: 3427593 - RNA, 23 nt, Human
auaauacaccacuacauucuguu

SEQ ID NO: 3427594 - RNA, 19 nt, Human
auaauacacuugcccugcu

SEQ ID NO: 3427595 - RNA, 12 nt, Human
auaauaccucaa

SEQ ID NO: 3427596 - RNA, 15 nt, Human
auaauaccuuagaag

SEQ ID NO: 3427597 - RNA, 12 nt, Human
agcucuuccugg

SEQ ID NO: 3427598 - RNA, 21 nt, Human
agcucuuccuuacucccaggc

SEQ ID NO: 3427599 - RNA, 16 nt, Human
agcucuucuccccagg

SEQ ID NO: 3427600 - RNA, 17 nt, Human
agcucuucuccccaggu

SEQ ID NO: 3427601 - RNA, 20 nt, Human
agcucuucuccccaggugug

SEQ ID NO: 3427602 - RNA, 20 nt, Human
agcucuucugccggcccugg

SEQ ID NO: 3427603 - RNA, 13 nt, Human
agcucuugcuaau

SEQ ID NO: 3427604 - RNA, 20 nt, Human
agcucuugcuaaucaguguc

SEQ ID NO: 3427605 - RNA, 16 nt, Human
agcucuuggcuccacu

SEQ ID NO: 3427606 - RNA, 17 nt, Human
agcucuugugaggaaag

SEQ ID NO: 3427607 - RNA, 21 nt, Human
agcucuugugaggaaagucau

SEQ ID NO: 3427608 - RNA, 18 nt, Human
agcucuuguugagccgug

SEQ ID NO: 3427609 - RNA, 14 nt, Human
agcucuuugucagg

SEQ ID NO: 3427610 - RNA, 16 nt, Human
agcucuuugucaggga

SEQ ID NO: 3427611 - RNA, 15 nt, Human
agcucuuuuccuaga

SEQ ID NO: 3427612 - RNA, 17 nt, Human
agcucuuuuugugaagu

SEQ ID NO: 3427613 - RNA, 21 nt, Human
agcucuuuuuuguuuguuucu

SEQ ID NO: 3427614 - RNA, 19 nt, Human
agcugaaaaaucacauccu

SEQ ID NO: 3427615 - RNA, 23 nt, Human
agcugaaaaaucacauccuggcc

SEQ ID NO: 3427616 - RNA, 13 nt, Human
agcugaaaugcug

SEQ ID NO: 3427617 - RNA, 16 nt, Human
agcugaaaugcugcau

SEQ ID NO: 3427618 - RNA, 19 nt, Human
agcugaaauugaaaaguua

SEQ ID NO: 3427619 - RNA, 13 nt, Human
agcugaaauuuua

SEQ ID NO: 3427620 - RNA, 20 nt, Human
agcugaaauuuuagaaauau

SEQ ID NO: 3427621 - RNA, 17 nt, Human
agcugaacacauuucuu

SEQ ID NO: 3427622 - RNA, 19 nt, Human
agcugaacacauuucuuuu

SEQ ID NO: 3427623 - RNA, 19 nt, Human
agcugaacccauuuugagu

SEQ ID NO: 3427624 - RNA, 13 nt, Human
agcugaagagcug

SEQ ID NO: 3427625 - RNA, 19 nt, Human
agcugaagaguugccccgu

SEQ ID NO: 3427626 - RNA, 15 nt, Human
agcugaauacauucu

SEQ ID NO: 3427627 - RNA, 17 nt, Human
agcugaaugccuccugu

SEQ ID NO: 3427628 - RNA, 22 nt, Human
agcugaaugccuccugugggga

SEQ ID NO: 3427629 - RNA, 16 nt, Human
agcugaauguuuuucu

SEQ ID NO: 3427630 - RNA, 17 nt, Human
agcugaauguuuuucua

SEQ ID NO: 3427631 - RNA, 18 nt, Human
agcugaauguuuuucuaa

SEQ ID NO: 3427632 - RNA, 16 nt, Human
agcugacaaaauuuug

SEQ ID NO: 3427633 - RNA, 19 nt, Human
agcugacacaaaccugccu

SEQ ID NO: 3427634 - RNA, 22 nt, Human
agcugacacaaaccugccuggg

SEQ ID NO: 3427635 - RNA, 13 nt, Human
agcugacaguccu

SEQ ID NO: 3427636 - RNA, 14 nt, Human
agcugacaguccuc

SEQ ID NO: 3427637 - RNA, 16 nt, Human
agcugacaucuugaau

SEQ ID NO: 3427638 - RNA, 16 nt, Human
agcugacauugccaaa

SEQ ID NO: 3427639 - RNA, 16 nt, Human
agcugaccagccguga

SEQ ID NO: 3427640 - RNA, 16 nt, Human
agcugacccagccccu

SEQ ID NO: 3427641 - RNA, 12 nt, Human
agcugaccucug

SEQ ID NO: 3427642 - RNA, 15 nt, Human
agcugaccucuguug

SEQ ID NO: 3427643 - RNA, 17 nt, Human
agcugacgaggcugggc

SEQ ID NO: 3427644 - RNA, 18 nt, Human
agcugacgaggcugggcc

SEQ ID NO: 3427645 - RNA, 20 nt, Human
agcugacgaggcugggccaa

SEQ ID NO: 3427646 - RNA, 23 nt, Human
agcugacuaaacuuuuuuucugu

SEQ ID NO: 3427647 - RNA, 20 nt, Human
agcugacuugcacagggauu

SEQ ID NO: 3427648 - RNA, 14 nt, Human
agcugacuuggcug

SEQ ID NO: 3427649 - RNA, 21 nt, Human
agcugacuuuucuguccgagc

SEQ ID NO: 3427650 - RNA, 17 nt, Human
agcugagaacuccugac

SEQ ID NO: 3427651 - RNA, 11 nt, Human
agcugagaaga

SEQ ID NO: 3427652 - RNA, 21 nt, Human
agcugagaagacucaaguccc

SEQ ID NO: 3427653 - RNA, 16 nt, Human
agcugagaauagaagg

SEQ ID NO: 3427654 - RNA, 17 nt, Human
agcugagaauagaagga

SEQ ID NO: 3427655 - RNA, 22 nt, Human
agcugagaucgugccacugcac

SEQ ID NO: 3427656 - RNA, 20 nt, Human
agcugagcaaaucaccacaa

SEQ ID NO: 3427657 - RNA, 14 nt, Human
agcugagcaggugu

SEQ ID NO: 3427658 - RNA, 12 nt, Human
agcugagccagg

SEQ ID NO: 3427659 - RNA, 21 nt, Human
agcugagccugcagggaagcc

SEQ ID NO: 3427660 - RNA, 23 nt, Human
agcugagccugcagggaagcccc

SEQ ID NO: 3427661 - RNA, 15 nt, Human
agcugagcgccagga

SEQ ID NO: 3427662 - RNA, 19 nt, Human
agcugagcucacaaggcag

SEQ ID NO: 3427663 - RNA, 13 nt, Human
agcugaggccaca

SEQ ID NO: 3427664 - RNA, 13 nt, Human
agcugaggggggc

SEQ ID NO: 3427665 - RNA, 23 nt, Human
agcugaggggggccgugcccagg

SEQ ID NO: 3427666 - RNA, 15 nt, Human
agcugaggugcccag

SEQ ID NO: 3427667 - RNA, 16 nt, Human
agcugaggugcccagg

SEQ ID NO: 3427668 - RNA, 17 nt, Human
agcugaggugcccagga

SEQ ID NO: 3427669 - RNA, 15 nt, Human
agcugagugaaaaau

SEQ ID NO: 3427670 - RNA, 16 nt, Human
agcugauacuucauuu

SEQ ID NO: 3427671 - RNA, 21 nt, Human
agcugauacuucauuuaaaaa

SEQ ID NO: 3427672 - RNA, 19 nt, Human
agcugauauaaauucugug

SEQ ID NO: 3427673 - RNA, 20 nt, Human
agcugaucauaagugaauuu

SEQ ID NO: 3427674 - RNA, 13 nt, Human
agcugauccagag

SEQ ID NO: 3427675 - RNA, 15 nt, Human
agcugauccagagca

SEQ ID NO: 3427676 - RNA, 22 nt, Human
agcugaugaaacucacaaauga

SEQ ID NO: 3427677 - RNA, 22 nt, Human
agcugaugaacuuauucuguag

SEQ ID NO: 3427678 - RNA, 15 nt, Human
agcugaugacucaag

SEQ ID NO: 3427679 - RNA, 20 nt, Human
agcugauguguugccacuuu

SEQ ID NO: 3427680 - RNA, 21 nt, Human
agcugauuacugucaauaaac

SEQ ID NO: 3427681 - RNA, 15 nt, Human
agcugauuuuaacaa

SEQ ID NO: 3427682 - RNA, 16 nt, Human
agcugauuuuaacaau

SEQ ID NO: 3427683 - RNA, 16 nt, Human
agcugcaaaaauaauc

SEQ ID NO: 3427684 - RNA, 14 nt, Human
agcugcaaaggaca

SEQ ID NO: 3427685 - RNA, 11 nt, Human
agcugcaaagu

SEQ ID NO: 3427686 - RNA, 12 nt, Human
agcugcaaagug

SEQ ID NO: 3427687 - RNA, 16 nt, Human
agcugcaaaucugaug

SEQ ID NO: 3427688 - RNA, 15 nt, Human
agcugcacagggcag

SEQ ID NO: 3427689 - RNA, 20 nt, Human
agcugcacagggcagcuggg

SEQ ID NO: 3427690 - RNA, 22 nt, Human
agcugcacagggcagcugggcc

SEQ ID NO: 3427691 - RNA, 24 nt, Human
agcugcacagggcagcugggccca

SEQ ID NO: 3427692 - RNA, 14 nt, Human
agcugcaccagagc

SEQ ID NO: 3427693 - RNA, 15 nt, Human
agcugcaccagagca

SEQ ID NO: 3427694 - RNA, 22 nt, Human
agcugcacccucaggcaggugg

SEQ ID NO: 3427695 - RNA, 18 nt, Human
agcugcaccugccagccu

SEQ ID NO: 3427696 - RNA, 17 nt, Human
agcugcacugaugcugc

SEQ ID NO: 3427697 - RNA, 19 nt, Human
agcugcacugaugcugccc

SEQ ID NO: 3427698 - RNA, 22 nt, Human
agcugcacugaugcugccccuc

SEQ ID NO: 3427699 - RNA, 18 nt, Human
agcugcagagacagagag

SEQ ID NO: 3427700 - RNA, 16 nt, Human
agcugcagagccaccc

SEQ ID NO: 3427701 - RNA, 19 nt, Human
agcugcagauaaguggccu

SEQ ID NO: 3427702 - RNA, 14 nt, Human
agcugcagcuuccu

SEQ ID NO: 3427703 - RNA, 17 nt, Human
agcugcagcuuccuguc

SEQ ID NO: 3427704 - RNA, 22 nt, Human
agcugcauccuccaagaaucua

SEQ ID NO: 3427705 - RNA, 23 nt, Human
agcugcauguggcuuuuuuaaaa

SEQ ID NO: 3427706 - RNA, 16 nt, Human
agcugccaagccccau

SEQ ID NO: 3427707 - RNA, 14 nt, Human
agcugccagagaag

SEQ ID NO: 3427708 - RNA, 14 nt, Human
agcugccagccgag

SEQ ID NO: 3427709 - RNA, 14 nt, Human
agcugcccagaguu

SEQ ID NO: 3427710 - RNA, 22 nt, Human
agcugcccauuucgugagcccc

SEQ ID NO: 3427711 - RNA, 14 nt, Human
agcugccccagcca

SEQ ID NO: 3427712 - RNA, 15 nt, Human
agcugccccagccag

SEQ ID NO: 3427713 - RNA, 20 nt, Human
agcugcccccagagccacag

SEQ ID NO: 3427714 - RNA, 21 nt, Human
agcugcccccagagccacagu

SEQ ID NO: 3427715 - RNA, 18 nt, Human
agcugcccccgcucaugg

SEQ ID NO: 3427716 - RNA, 16 nt, Human
agcugccccggccccu

SEQ ID NO: 3427717 - RNA, 19 nt, Human
agcugccccggccccuccc

SEQ ID NO: 3427718 - RNA, 15 nt, Human
agcugccccucucug

SEQ ID NO: 3427719 - RNA, 15 nt, Human
auaauucucauuaaa

SEQ ID NO: 3427720 - RNA, 22 nt, Human
auaauucucauuaaaagaauau

SEQ ID NO: 3427721 - RNA, 19 nt, Human
auaauucugaaguuauauu

SEQ ID NO: 3427722 - RNA, 20 nt, Human
auaauucugaguuuuguguu

SEQ ID NO: 3427723 - RNA, 22 nt, Human
auaauucuguacauagccuaua

SEQ ID NO: 3427724 - RNA, 13 nt, Human
auaauucuuauuu

SEQ ID NO: 3427725 - RNA, 16 nt, Human
auaauucuuugauuau

SEQ ID NO: 3427726 - RNA, 19 nt, Human
auaauucuuuuuuauuaau

SEQ ID NO: 3427727 - RNA, 22 nt, Human
auaauugacaggcgaaagaaaa

SEQ ID NO: 3427728 - RNA, 15 nt, Human
auaauugaucaaauu

SEQ ID NO: 3427729 - RNA, 13 nt, Human
auaauugcaucua

SEQ ID NO: 3427730 - RNA, 19 nt, Human
auaauugcaucuagguaau

SEQ ID NO: 3427731 - RNA, 17 nt, Human
auaauugccaaaaagug

SEQ ID NO: 3427732 - RNA, 18 nt, Human
auaauuggauuuccuaau

SEQ ID NO: 3427733 - RNA, 19 nt, Human
auaauugggucauagaaau

SEQ ID NO: 3427734 - RNA, 23 nt, Human
auaauuguaucagaggccuauaa

SEQ ID NO: 3427735 - RNA, 21 nt, Human
auaauugugauuagacagaac

SEQ ID NO: 3427736 - RNA, 18 nt, Human
auaauugugugauauuuc

SEQ ID NO: 3427737 - RNA, 22 nt, Human
auaauugugugauauuucagaa

SEQ ID NO: 3427738 - RNA, 23 nt, Human
auaauugugugauauuucagaaa

SEQ ID NO: 3427739 - RNA, 19 nt, Human
auaauuguugaaauuuugc

SEQ ID NO: 3427740 - RNA, 20 nt, Human
auaauuguugaaauuuugca

SEQ ID NO: 3427741 - RNA, 21 nt, Human
auaauuguugaaauuuugcaa

SEQ ID NO: 3427742 - RNA, 14 nt, Human
auaauuguugcaua

SEQ ID NO: 3427743 - RNA, 18 nt, Human
auaauuguuguucuguua

SEQ ID NO: 3427744 - RNA, 21 nt, Human
auaauuguuuuaucugaauuu

SEQ ID NO: 3427745 - RNA, 19 nt, Human
auaauuguuuuuuaucuuu

SEQ ID NO: 3427746 - RNA, 21 nt, Human
auaauuguuuuuuaucuuuuc

SEQ ID NO: 3427747 - RNA, 17 nt, Human
auaauuuaaaaauauau

SEQ ID NO: 3427748 - RNA, 21 nt, Human
auaauuuacugugacuuuauu

SEQ ID NO: 3427749 - RNA, 15 nt, Human
auaauuuaguuguuu

SEQ ID NO: 3427750 - RNA, 18 nt, Human
auaauuuaguuguuucua

SEQ ID NO: 3427751 - RNA, 20 nt, Human
auaauuuaguuguuucuaga

SEQ ID NO: 3427752 - RNA, 19 nt, Human
auaauuuauacaggucaua

SEQ ID NO: 3427753 - RNA, 21 nt, Human
auaauuuauacaggucauauu

SEQ ID NO: 3427754 - RNA, 20 nt, Human
auaauuuauuuccacuaaaa

SEQ ID NO: 3427755 - RNA, 13 nt, Human
auaauuucagggu

SEQ ID NO: 3427756 - RNA, 22 nt, Human
auaauuuccauuuacuuaagac

SEQ ID NO: 3427757 - RNA, 16 nt, Human
agcugcgguccaccca

SEQ ID NO: 3427758 - RNA, 17 nt, Human
agcugcgguccacccag

SEQ ID NO: 3427759 - RNA, 19 nt, Human
agcugcgguccacccagga

SEQ ID NO: 3427760 - RNA, 21 nt, Human
agcugcgguccacccaggagc

SEQ ID NO: 3427761 - RNA, 11 nt, Human
agcugcuacaa

SEQ ID NO: 3427762 - RNA, 13 nt, Human
agcugcuacaaag

SEQ ID NO: 3427763 - RNA, 16 nt, Human
agcugcuacaaagaag

SEQ ID NO: 3427764 - RNA, 15 nt, Human
agcugcuauagccug

SEQ ID NO: 3427765 - RNA, 21 nt, Human
agcugcuauagccuggggugg

SEQ ID NO: 3427766 - RNA, 18 nt, Human
agcugcuauccccaucuc

SEQ ID NO: 3427767 - RNA, 22 nt, Human
agcugcuauccccaucucccug

SEQ ID NO: 3427768 - RNA, 21 nt, Human
agcugcuauuuauuuuccuaa

SEQ ID NO: 3427769 - RNA, 23 nt, Human
agcugcucacuaccuccucaggg

SEQ ID NO: 3427770 - RNA, 21 nt, Human
agcugcucagggaaaagcagc

SEQ ID NO: 3427771 - RNA, 14 nt, Human
agcugcuccccacg

SEQ ID NO: 3427772 - RNA, 17 nt, Human
agcugcuccccacguca

SEQ ID NO: 3427773 - RNA, 13 nt, Human
agcugcuccccag

SEQ ID NO: 3427774 - RNA, 13 nt, Human
agcugcuccccuc

SEQ ID NO: 3427775 - RNA, 19 nt, Human
agcugcuccgaggacccag

SEQ ID NO: 3427776 - RNA, 22 nt, Human
agcugcuccuagagggaggggc

SEQ ID NO: 3427777 - RNA, 21 nt, Human
agcugcucugaaaucuccuuu

SEQ ID NO: 3427778 - RNA, 23 nt, Human
agcugcucugaauuaguccuugc

SEQ ID NO: 3427779 - RNA, 18 nt, Human
agcugcucugagccacag

SEQ ID NO: 3427780 - RNA, 14 nt, Human
agcugcucuggaaa

SEQ ID NO: 3427781 - RNA, 16 nt, Human
agcugcucugucuucu

SEQ ID NO: 3427782 - RNA, 14 nt, Human
agcugcugaaacaa

SEQ ID NO: 3427783 - RNA, 16 nt, Human
agcugcugaaacaaca

SEQ ID NO: 3427784 - RNA, 12 nt, Human
agcugcugacag

SEQ ID NO: 3427785 - RNA, 21 nt, Human
agcugcugagccgcagagaag

SEQ ID NO: 3427786 - RNA, 12 nt, Human
agcugcugucuu

SEQ ID NO: 3427787 - RNA, 15 nt, Human
agcugcuuccagugu

SEQ ID NO: 3427788 - RNA, 23 nt, Human
agcugcuuggaccucgugcuuua

SEQ ID NO: 3427789 - RNA, 19 nt, Human
agcugcuuucuguugucau

SEQ ID NO: 3427790 - RNA, 21 nt, Human
agcugcuuuguuaccuuaaaa

SEQ ID NO: 3427791 - RNA, 22 nt, Human
agcugcuuuguuaccuuaaaac

SEQ ID NO: 3427792 - RNA, 23 nt, Human
agcugcuuuuuuugaaacuuuga

SEQ ID NO: 3427793 - RNA, 13 nt, Human
agcuggaaaagua

SEQ ID NO: 3427794 - RNA, 21 nt, Human
agcuggaauuuuuuauucuug

SEQ ID NO: 3427795 - RNA, 23 nt, Human
agcuggaauuuuuuauucuugug

SEQ ID NO: 3427796 - RNA, 22 nt, Human
agcuggacagaggggacucugg

SEQ ID NO: 3427797 - RNA, 19 nt, Human
agcuggacucugcauccca

SEQ ID NO: 3427798 - RNA, 16 nt, Human
agcuggagaggagccc

SEQ ID NO: 3427799 - RNA, 18 nt, Human
agcuggagaggagcccug

SEQ ID NO: 3427800 - RNA, 19 nt, Human
agcuggagccuggugcccu

SEQ ID NO: 3427801 - RNA, 13 nt, Human
agcuggaggacua

SEQ ID NO: 3427802 - RNA, 23 nt, Human
agcuggauuggguuaugaauauu

SEQ ID NO: 3427803 - RNA, 18 nt, Human
agcuggccccgccgccug

SEQ ID NO: 3427804 - RNA, 15 nt, Human
agcuggcccgugaca

SEQ ID NO: 3427805 - RNA, 23 nt, Human
agcuggccgaggguccuggcucc

SEQ ID NO: 3427806 - RNA, 16 nt, Human
agcuggccgugggccu

SEQ ID NO: 3427807 - RNA, 17 nt, Human
agcuggccgugggccug

SEQ ID NO: 3427808 - RNA, 14 nt, Human
agcuggccucuacc

SEQ ID NO: 3427809 - RNA, 16 nt, Human
agcuggccucucuagc

SEQ ID NO: 3427810 - RNA, 15 nt, Human
agcuggcgucugucu

SEQ ID NO: 3427811 - RNA, 18 nt, Human
agcuggcgucugucuuca

SEQ ID NO: 3427812 - RNA, 14 nt, Human
agcuggcucaccuu

SEQ ID NO: 3427813 - RNA, 15 nt, Human
agcuggcuccagccu

SEQ ID NO: 3427814 - RNA, 18 nt, Human
agcuggcucugugagggu

SEQ ID NO: 3427815 - RNA, 21 nt, Human
agcuggcugggguggccugug

SEQ ID NO: 3427816 - RNA, 23 nt, Human
agcuggcugggguggccugugug

SEQ ID NO: 3427817 - RNA, 15 nt, Human
agcugggaaagcaua

SEQ ID NO: 3427818 - RNA, 15 nt, Human
agcugggacuacagg

SEQ ID NO: 3427819 - RNA, 13 nt, Human
agcugggaggcaa

SEQ ID NO: 3427820 - RNA, 22 nt, Human
agcugggaucacauguggacuu

SEQ ID NO: 3427821 - RNA, 17 nt, Human
agcugggauguuucugu

SEQ ID NO: 3427822 - RNA, 18 nt, Human
agcugggcagaaggccaa

SEQ ID NO: 3427823 - RNA, 13 nt, Human
agcugggccccag

SEQ ID NO: 3427824 - RNA, 14 nt, Human
agcugggccccagc

SEQ ID NO: 3427825 - RNA, 16 nt, Human
agcugggcccgacaug

SEQ ID NO: 3427826 - RNA, 22 nt, Human
agcugggcccgacauggcuccg

SEQ ID NO: 3427827 - RNA, 15 nt, Human
agcuggggaugucuc

SEQ ID NO: 3427828 - RNA, 20 nt, Human
agcuggggccaggcuggguc

SEQ ID NO: 3427829 - RNA, 16 nt, Human
agcuggggcgugggga

SEQ ID NO: 3427830 - RNA, 20 nt, Human
agcugggggugggccaggcu

SEQ ID NO: 3427831 - RNA, 21 nt, Human
agcugggggugggccaggcug

SEQ ID NO: 3427832 - RNA, 18 nt, Human
agcuggggugcagggaug

SEQ ID NO: 3427833 - RNA, 20 nt, Human
agcuggguaaucgauggggg

SEQ ID NO: 3427834 - RNA, 15 nt, Human
agcugggucaggcag

SEQ ID NO: 3427835 - RNA, 19 nt, Human
agcuggguggcacugccau

SEQ ID NO: 3427836 - RNA, 20 nt, Human
agcuggguggcacugccaug

SEQ ID NO: 3427837 - RNA, 17 nt, Human
agcugggugucaagagg

SEQ ID NO: 3427838 - RNA, 20 nt, Human
agcuggguuggaaaacagua

SEQ ID NO: 3427839 - RNA, 20 nt, Human
agcugguaaucuugcucugc

SEQ ID NO: 3427840 - RNA, 15 nt, Human
agcugguaguuagua

SEQ ID NO: 3427841 - RNA, 22 nt, Human
agcugguaguuaguagcauguu

SEQ ID NO: 3427842 - RNA, 19 nt, Human
agcuggucccacucagucc

SEQ ID NO: 3427843 - RNA, 10 nt, Human
agcuggugca

SEQ ID NO: 3427844 - RNA, 17 nt, Human
agcuggugcauuacaga

SEQ ID NO: 3427845 - RNA, 19 nt, Human
agcuggugcggcuggccau

SEQ ID NO: 3427846 - RNA, 20 nt, Human
agcuggugggugaaagaaau

SEQ ID NO: 3427847 - RNA, 21 nt, Human
agcuggugguaucugaguuga

SEQ ID NO: 3427848 - RNA, 12 nt, Human
agcuggugguuu

SEQ ID NO: 3427849 - RNA, 16 nt, Human
agcuggugguuucacg

SEQ ID NO: 3427850 - RNA, 13 nt, Human
agcugguguagcu

SEQ ID NO: 3427851 - RNA, 18 nt, Human
agcugguguagcuacaga

SEQ ID NO: 3427852 - RNA, 17 nt, Human
agcugguuagaaaugca

SEQ ID NO: 3427853 - RNA, 20 nt, Human
agcugguuuaauguuuuggc

SEQ ID NO: 3427854 - RNA, 21 nt, Human
agcugguuuccucauuccuga

SEQ ID NO: 3427855 - RNA, 18 nt, Human
agcuguaaaacgcuguca

SEQ ID NO: 3427856 - RNA, 14 nt, Human
agcuguaaaccaga

SEQ ID NO: 3427857 - RNA, 17 nt, Human
agcuguaaaccagagag

SEQ ID NO: 3427858 - RNA, 17 nt, Human
agcuguaagaagagacu

SEQ ID NO: 3427859 - RNA, 22 nt, Human
agcuguaagaagagacugggaa

SEQ ID NO: 3427860 - RNA, 23 nt, Human
agcuguaagaagagacugggaag

SEQ ID NO: 3427861 - RNA, 17 nt, Human
agcuguacaaauauaag

SEQ ID NO: 3427862 - RNA, 20 nt, Human
auacagucccuaaagaaaaa

SEQ ID NO: 3427863 - RNA, 17 nt, Human
auacagugcagagccuu

SEQ ID NO: 3427864 - RNA, 23 nt, Human
auacagugcagagccuucucaga

SEQ ID NO: 3427865 - RNA, 23 nt, Human
auacaguguuauuuucuuugaaa

SEQ ID NO: 3427866 - RNA, 22 nt, Human
auacaguuaggcaccagaagaa

SEQ ID NO: 3427867 - RNA, 15 nt, Human
auacaguucaauaaa

SEQ ID NO: 3427868 - RNA, 21 nt, Human
auacaguucggugagcuacaa

SEQ ID NO: 3427869 - RNA, 15 nt, Human
auacaguuuuaaaga

SEQ ID NO: 3427870 - RNA, 23 nt, Human
auacaguuuuaaagaaucauuau

SEQ ID NO: 3427871 - RNA, 19 nt, Human
auacaguuuuaugcucuuu

SEQ ID NO: 3427872 - RNA, 20 nt, Human
auacaguuuuaugcucuuuu

SEQ ID NO: 3427873 - RNA, 16 nt, Human
auacaguuuucagaaa

SEQ ID NO: 3427874 - RNA, 17 nt, Human
auacaguuuucagaaaa

SEQ ID NO: 3427875 - RNA, 15 nt, Human
auacaguuuuccuaa

SEQ ID NO: 3427876 - RNA, 12 nt, Human
auacauaauggg

SEQ ID NO: 3427877 - RNA, 17 nt, Human
auacauacagaauuacu

SEQ ID NO: 3427878 - RNA, 15 nt, Human
auacauacuaugaaa

SEQ ID NO: 3427879 - RNA, 16 nt, Human
auacauaucgcugacu

SEQ ID NO: 3427880 - RNA, 14 nt, Human
auacauaucuuuau

SEQ ID NO: 3427881 - RNA, 16 nt, Human
auacauaucuuuauua

SEQ ID NO: 3427882 - RNA, 15 nt, Human
auacauauggauguu

SEQ ID NO: 3427883 - RNA, 18 nt, Human
auacauauggauguuacu

SEQ ID NO: 3427884 - RNA, 18 nt, Human
auacaucacguuaaagua

SEQ ID NO: 3427885 - RNA, 12 nt, Human
auacaucacugc

SEQ ID NO: 3427886 - RNA, 13 nt, Human
auacaucacugcu

SEQ ID NO: 3427887 - RNA, 18 nt, Human
auacaucacugcuugaug

SEQ ID NO: 3427888 - RNA, 22 nt, Human
auacaucacugcuugaugaagc

SEQ ID NO: 3427889 - RNA, 15 nt, Human
auacauccuggguaa

SEQ ID NO: 3427890 - RNA, 16 nt, Human
auacauccuggguaau

SEQ ID NO: 3427891 - RNA, 18 nt, Human
auacauccuggguaauga

SEQ ID NO: 3427892 - RNA, 15 nt, Human
auacaugacacugaa

SEQ ID NO: 3427893 - RNA, 16 nt, Human
auacaugacacugaaa

SEQ ID NO: 3427894 - RNA, 19 nt, Human
auacaugaugauuucagaa

SEQ ID NO: 3427895 - RNA, 15 nt, Human
auacaugcauauaau

SEQ ID NO: 3427896 - RNA, 15 nt, Human
auacaugcugcuaau

SEQ ID NO: 3427897 - RNA, 22 nt, Human
auacauguaauucuaccaaggu

SEQ ID NO: 3427898 - RNA, 20 nt, Human
auacauguguguauauaugu

SEQ ID NO: 3427899 - RNA, 23 nt, Human
auacauguguguauauaugugua

SEQ ID NO: 3427900 - RNA, 14 nt, Human
auacauuaaagcag

SEQ ID NO: 3427901 - RNA, 21 nt, Human
auacauuaguaaaugucuuug

SEQ ID NO: 3427902 - RNA, 22 nt, Human
auacauuauauuucuauuuuau

SEQ ID NO: 3427903 - RNA, 21 nt, Human
auacauucaaauuugucuggu

SEQ ID NO: 3427904 - RNA, 13 nt, Human
auacauucuagau

SEQ ID NO: 3427905 - RNA, 16 nt, Human
auacauucuuuuugcu

SEQ ID NO: 3427906 - RNA, 21 nt, Human
auacauucuuuuugcucuaaa

SEQ ID NO: 3427907 - RNA, 19 nt, Human
auacauugaauuagaaaca

SEQ ID NO: 3427908 - RNA, 14 nt, Human
auacauuguacgaa

SEQ ID NO: 3427909 - RNA, 21 nt, Human
auacauuguacgaagaguauu

SEQ ID NO: 3427910 - RNA, 15 nt, Human
auacauuuaaaacuu

SEQ ID NO: 3427911 - RNA, 20 nt, Human
auacauuuauaauguuugcu

SEQ ID NO: 3427912 - RNA, 23 nt, Human
auacauuuauaauguuugcuauu

SEQ ID NO: 3427913 - RNA, 20 nt, Human
auacauuucuccuuugauaa

SEQ ID NO: 3427914 - RNA, 12 nt, Human
auacauuuguau

SEQ ID NO: 3427915 - RNA, 16 nt, Human
auacauuuucuaagaa

SEQ ID NO: 3427916 - RNA, 20 nt, Human
aguuuucccuugaggaaaca

SEQ ID NO: 3427917 - RNA, 10 nt, Human
aguuuuccua

SEQ ID NO: 3427918 - RNA, 16 nt, Human
aguuuuccuaugcuuu

SEQ ID NO: 3427919 - RNA, 22 nt, Human
aguuuuccuucucaucugugau

SEQ ID NO: 3427920 - RNA, 21 nt, Human
aguuuucucuuuguggggcuu

SEQ ID NO: 3427921 - RNA, 13 nt, Human
aguuuucugagaa

SEQ ID NO: 3427922 - RNA, 19 nt, Human
aguuuucugagaaagacua

SEQ ID NO: 3427923 - RNA, 23 nt, Human
aguuuucugagaaagacuauuca

SEQ ID NO: 3427924 - RNA, 13 nt, Human
aguuuucuggcug

SEQ ID NO: 3427925 - RNA, 13 nt, Human
aguuuucuuguug

SEQ ID NO: 3427926 - RNA, 21 nt, Human
aguuuucuuguugcuuuguug

SEQ ID NO: 3427927 - RNA, 16 nt, Human
aguuuucuuuuaauuu

SEQ ID NO: 3427928 - RNA, 14 nt, Human
aguuuugaaaagcu

SEQ ID NO: 3427929 - RNA, 18 nt, Human
aguuuugaagauucuaug

SEQ ID NO: 3427930 - RNA, 14 nt, Human
aguuuugacaagcu

SEQ ID NO: 3427931 - RNA, 18 nt, Human
aguuuugacaucagccag

SEQ ID NO: 3427932 - RNA, 18 nt, Human
aguuuugauauuucuagc

SEQ ID NO: 3427933 - RNA, 20 nt, Human
aguuuugaugacuggcauuu

SEQ ID NO: 3427934 - RNA, 21 nt, Human
aguuuugaugacuggcauuuu

SEQ ID NO: 3427935 - RNA, 17 nt, Human
aguuuuggaugcagugc

SEQ ID NO: 3427936 - RNA, 20 nt, Human
aguuuugggaaguuaaaggg

SEQ ID NO: 3427937 - RNA, 22 nt, Human
aguuuugguugcuuuaauauca

SEQ ID NO: 3427938 - RNA, 16 nt, Human
aguuuuguaaaagaaa

SEQ ID NO: 3427939 - RNA, 22 nt, Human
aguuuuguaaaagaaaucaugu

SEQ ID NO: 3427940 - RNA, 12 nt, Human
aguuuuguaaau

SEQ ID NO: 3427941 - RNA, 15 nt, Human
aguuuugugaaauuu

SEQ ID NO: 3427942 - RNA, 21 nt, Human
aguuuugugaaauuuuucaua

SEQ ID NO: 3427943 - RNA, 14 nt, Human
aguuuuguugcccc

SEQ ID NO: 3427944 - RNA, 13 nt, Human
aguuuuguuguac

SEQ ID NO: 3427945 - RNA, 16 nt, Human
aguuuuguuuggacca

SEQ ID NO: 3427946 - RNA, 15 nt, Human
aguuuuuaaacauca

SEQ ID NO: 3427947 - RNA, 18 nt, Human
aguuuuuaguaaucugua

SEQ ID NO: 3427948 - RNA, 23 nt, Human
aguuuuuauggcuuuugugcauu

SEQ ID NO: 3427949 - RNA, 15 nt, Human
aguuuuuauugcuug

SEQ ID NO: 3427950 - RNA, 9 nt, Human
aguuuuuca

SEQ ID NO: 3427951 - RNA, 17 nt, Human
aguuuuucagaaagcau

SEQ ID NO: 3427952 - RNA, 23 nt, Human
aguuuuucaggagcgcaagauag

SEQ ID NO: 3427953 - RNA, 20 nt, Human
aguuuuucauaagauauuuu

SEQ ID NO: 3427954 - RNA, 20 nt, Human
aguuuuucauuaaauaaauu

SEQ ID NO: 3427955 - RNA, 22 nt, Human
aguuuuucccagcuacaccuuu

SEQ ID NO: 3427956 - RNA, 13 nt, Human
aguuuuuccugga

SEQ ID NO: 3427957 - RNA, 16 nt, Human
aguuuuucuguauuuu

SEQ ID NO: 3427958 - RNA, 17 nt, Human
aguuuuugguugggaau

SEQ ID NO: 3427959 - RNA, 16 nt, Human
aguuuuuguaauuuau

SEQ ID NO: 3427960 - RNA, 12 nt, Human
aguuuuuguacu

SEQ ID NO: 3427961 - RNA, 19 nt, Human
aguuuuuguacuguaaaga

SEQ ID NO: 3427962 - RNA, 12 nt, Human
aguuuuuguucu

SEQ ID NO: 3427963 - RNA, 16 nt, Human
aguuuuuguuuggaga

SEQ ID NO: 3427964 - RNA, 21 nt, Human
aguuuuuuacuuuuguuuauu

SEQ ID NO: 3427965 - RNA, 17 nt, Human
aguuuuuucucuugggc

SEQ ID NO: 3427966 - RNA, 18 nt, Human
aguuuuuucucuugggcu

SEQ ID NO: 3427967 - RNA, 15 nt, Human
aguuuuuuguaccaa

SEQ ID NO: 3427968 - RNA, 12 nt, Human
aguuuuuuugcu

SEQ ID NO: 3427969 - RNA, 19 nt, Human
aguuuuuuuuuucuugucu

SEQ ID NO: 3427970 - RNA, 13 nt, Human
auaaaaaaaagaa

SEQ ID NO: 3427971 - RNA, 15 nt, Human
auaaaaaaaaugaaa

SEQ ID NO: 3427972 - RNA, 19 nt, Human
auaaaaaaacaaucauuug

SEQ ID NO: 3427973 - RNA, 15 nt, Human
auaaaaaaacagcuu

SEQ ID NO: 3427974 - RNA, 11 nt, Human
auaaaaaauaa

SEQ ID NO: 3427975 - RNA, 13 nt, Human
auaaaaaauaugu

SEQ ID NO: 3427976 - RNA, 13 nt, Human
auaaaaaaucaug

SEQ ID NO: 3427977 - RNA, 14 nt, Human
auaaaaaaugacaa

SEQ ID NO: 3427978 - RNA, 12 nt, Human
auaaaaaauggu

SEQ ID NO: 3427979 - RNA, 17 nt, Human
auaaaaaccaagaagau

SEQ ID NO: 3427980 - RNA, 16 nt, Human
auaaaaacuaaauugu

SEQ ID NO: 3427981 - RNA, 21 nt, Human
auaaaaacucaggcaaagaaa

SEQ ID NO: 3427982 - RNA, 20 nt, Human
auaaaaacuugaaaauauau

SEQ ID NO: 3427983 - RNA, 14 nt, Human
auaaaaagaaaggc

SEQ ID NO: 3427984 - RNA, 22 nt, Human
auaaaaagaucacuuucucagu

SEQ ID NO: 3427985 - RNA, 12 nt, Human
auaaaaagcuga

SEQ ID NO: 3427986 - RNA, 14 nt, Human
auaaaaaggacauc

SEQ ID NO: 3427987 - RNA, 19 nt, Human
auaaaaaggacaucagcaa

SEQ ID NO: 3427988 - RNA, 11 nt, Human
auaaaaaggca

SEQ ID NO: 3427989 - RNA, 10 nt, Human
auaaaaaguu

SEQ ID NO: 3427990 - RNA, 23 nt, Human
auaaaaauauauauagugcuaua

SEQ ID NO: 3427991 - RNA, 23 nt, Human
auaaaaauauuguguugugaaug

SEQ ID NO: 3427992 - RNA, 13 nt, Human
auaaaaaugacag

SEQ ID NO: 3427993 - RNA, 16 nt, Human
auaaaaaugaucuaaa

SEQ ID NO: 3427994 - RNA, 17 nt, Human
auaaaaaugaucuaaac

SEQ ID NO: 3427995 - RNA, 14 nt, Human
auaaaaauucugaa

SEQ ID NO: 3427996 - RNA, 13 nt, Human
auaaaacaaaggg

SEQ ID NO: 3427997 - RNA, 16 nt, Human
auaaaacaggucaaua

SEQ ID NO: 3427998 - RNA, 16 nt, Human
auaaaacaucuuucca

SEQ ID NO: 3427999 - RNA, 23 nt, Human
auaaaacauuuuaaauggacaga

SEQ ID NO: 3428000 - RNA, 18 nt, Human
auaaaaccccaucucuac

SEQ ID NO: 3428001 - RNA, 11 nt, Human
auaaaaccuuu

SEQ ID NO: 3428002 - RNA, 21 nt, Human
auaaaaccuuucaaauuucac

SEQ ID NO: 3428003 - RNA, 17 nt, Human
auaaaacugaugugaaa

SEQ ID NO: 3428004 - RNA, 15 nt, Human
auaaaagaaaaaaua

SEQ ID NO: 3428005 - RNA, 12 nt, Human
auaaaagaaaau

SEQ ID NO: 3428006 - RNA, 22 nt, Human
auaaaagaaaugcacaaugucu

SEQ ID NO: 3428007 - RNA, 16 nt, Human
auaaaagacagugaaa

SEQ ID NO: 3428008 - RNA, 15 nt, Human
auaauguaagcucua

SEQ ID NO: 3428009 - RNA, 18 nt, Human
auaauguauucauauuug

SEQ ID NO: 3428010 - RNA, 15 nt, Human
auaaugucucuguga

SEQ ID NO: 3428011 - RNA, 19 nt, Human
auaaugucucugugagacu

SEQ ID NO: 3428012 - RNA, 16 nt, Human
auaaugucuuguuaau

SEQ ID NO: 3428013 - RNA, 19 nt, Human
auaaugugaaacuggauua

SEQ ID NO: 3428014 - RNA, 12 nt, Human
auaaugugaaau

SEQ ID NO: 3428015 - RNA, 15 nt, Human
auaaugugaaaugua

SEQ ID NO: 3428016 - RNA, 21 nt, Human
auaaugugggaagaaacaaac

SEQ ID NO: 3428017 - RNA, 20 nt, Human
auaauguguaguucauguaa

SEQ ID NO: 3428018 - RNA, 18 nt, Human
auaauguuaaccaaggaa

SEQ ID NO: 3428019 - RNA, 14 nt, Human
auaauguucugcua

SEQ ID NO: 3428020 - RNA, 12 nt, Human
auaauguuguca

SEQ ID NO: 3428021 - RNA, 19 nt, Human
auaauguuuaauauugaga

SEQ ID NO: 3428022 - RNA, 16 nt, Human
auaauguuuauuaaau

SEQ ID NO: 3428023 - RNA, 15 nt, Human
auaauuaaagugucc

SEQ ID NO: 3428024 - RNA, 20 nt, Human
auaauuaaaguguccauuga

SEQ ID NO: 3428025 - RNA, 12 nt, Human
auaauuaacacu

SEQ ID NO: 3428026 - RNA, 17 nt, Human
auaauuaacauguuaaa

SEQ ID NO: 3428027 - RNA, 20 nt, Human
auaauuaacauguuaaacca

SEQ ID NO: 3428028 - RNA, 21 nt, Human
auaauuaacauguuaaaccau

SEQ ID NO: 3428029 - RNA, 22 nt, Human
auaauuaacauguuaaaccaug

SEQ ID NO: 3428030 - RNA, 20 nt, Human
auaauuaaccaagguagaau

SEQ ID NO: 3428031 - RNA, 14 nt, Human
auaauuacuauguc

SEQ ID NO: 3428032 - RNA, 19 nt, Human
auaauuagauccauuaauu

SEQ ID NO: 3428033 - RNA, 23 nt, Human
auaauuauaugcuauuucuauau

SEQ ID NO: 3428034 - RNA, 17 nt, Human
auaauuauccagaguuu

SEQ ID NO: 3428035 - RNA, 16 nt, Human
auaauuaucggaagca

SEQ ID NO: 3428036 - RNA, 19 nt, Human
auaauuaucggaagcagug

SEQ ID NO: 3428037 - RNA, 16 nt, Human
auaauuaugacaguua

SEQ ID NO: 3428038 - RNA, 16 nt, Human
auaauuauuuauuuaa

SEQ ID NO: 3428039 - RNA, 17 nt, Human
auaauuauuuauuuaau

SEQ ID NO: 3428040 - RNA, 13 nt, Human
auaauucacucaa

SEQ ID NO: 3428041 - RNA, 18 nt, Human
auaauucaguauguuuua

SEQ ID NO: 3428042 - RNA, 23 nt, Human
auaauucaguauguuuuacacug

SEQ ID NO: 3428043 - RNA, 12 nt, Human
auaauucuaaag

SEQ ID NO: 3428044 - RNA, 23 nt, Human
auaauucucauuaaaagaauauc

SEQ ID NO: 3428045 - RNA, 17 nt, Human
auaauucugaaguuaua

SEQ ID NO: 3428046 - RNA, 14 nt, Human
auaauucuguacau

SEQ ID NO: 3428047 - RNA, 19 nt, Human
auaauucuuauuuugugga

SEQ ID NO: 3428048 - RNA, 19 nt, Human
auaauucuuucaauacaga

SEQ ID NO: 3428049 - RNA, 23 nt, Human
auaauucuuucaauacagauaua

SEQ ID NO: 3428050 - RNA, 21 nt, Human
auaauucuuuuuuauuaauca

SEQ ID NO: 3428051 - RNA, 22 nt, Human
auaauucuuuuuuauuaaucac

SEQ ID NO: 3428052 - RNA, 15 nt, Human
auaauugaaguguau

SEQ ID NO: 3428053 - RNA, 19 nt, Human
auaauugaguuuucagugg

SEQ ID NO: 3428054 - RNA, 13 nt, Human
auaauugcauuca

SEQ ID NO: 3428055 - RNA, 14 nt, Human
auaauugcauucau

SEQ ID NO: 3428056 - RNA, 16 nt, Human
auaauugcauugacuu

SEQ ID NO: 3428057 - RNA, 21 nt, Human
auaauugccaaaaagugaaau

SEQ ID NO: 3428058 - RNA, 23 nt, Human
auaauugccaaaaagugaaauaa

SEQ ID NO: 3428059 - RNA, 16 nt, Human
auaauugcuauuuauu

SEQ ID NO: 3428060 - RNA, 13 nt, Human
auaauuguacaaa

SEQ ID NO: 3428061 - RNA, 19 nt, Human
auaauuguacaaaauuaag

SEQ ID NO: 3428062 - RNA, 15 nt, Human
auaauuguauauaug

SEQ ID NO: 3428063 - RNA, 17 nt, Human
auaauuguaucagaggc

SEQ ID NO: 3428064 - RNA, 20 nt, Human
auaauuguaucguauagcug

SEQ ID NO: 3428065 - RNA, 22 nt, Human
auaauuguaucguauagcugua

SEQ ID NO: 3428066 - RNA, 14 nt, Human
auaauugugugaua

SEQ ID NO: 3428067 - RNA, 17 nt, Human
auaauugugugauauuu

SEQ ID NO: 3428068 - RNA, 19 nt, Human
auaauugugugauauuuca

SEQ ID NO: 3428069 - RNA, 15 nt, Human
auaauuguucucaga

SEQ ID NO: 3428070 - RNA, 23 nt, Human
auaauuguucucagaaucccuua

SEQ ID NO: 3428071 - RNA, 12 nt, Human
auaauuguugaa

SEQ ID NO: 3428072 - RNA, 15 nt, Human
auaauuguugaaauu

SEQ ID NO: 3428073 - RNA, 23 nt, Human
auaauuguuguucuguuaacuga

SEQ ID NO: 3428074 - RNA, 19 nt, Human
auaauuuaaaaauauauuu

SEQ ID NO: 3428075 - RNA, 23 nt, Human
auaauuuaccuaagauuacaaau

SEQ ID NO: 3428076 - RNA, 18 nt, Human
auaauuuaccugaagucu

SEQ ID NO: 3428077 - RNA, 14 nt, Human
auaauuuagauggu

SEQ ID NO: 3428078 - RNA, 17 nt, Human
auaauuuaguuucauau

SEQ ID NO: 3428079 - RNA, 20 nt, Human
auaauuuaguuucauauaaa

SEQ ID NO: 3428080 - RNA, 12 nt, Human
auaauuucuaau

SEQ ID NO: 3428081 - RNA, 18 nt, Human
auaauuucuuacuaaaca

SEQ ID NO: 3428082 - RNA, 17 nt, Human
auaauuugaauuuuaug

SEQ ID NO: 3428083 - RNA, 19 nt, Human
auaauuuguacauauguaa

SEQ ID NO: 3428084 - RNA, 13 nt, Human
auaauuuguuucc

SEQ ID NO: 3428085 - RNA, 15 nt, Human
auaauuuuaaacaaa

SEQ ID NO: 3428086 - RNA, 12 nt, Human
auaauuuuaaau

SEQ ID NO: 3428087 - RNA, 13 nt, Human
auaauuuuaaaug

SEQ ID NO: 3428088 - RNA, 14 nt, Human
auaauuuuaaauuc

SEQ ID NO: 3428089 - RNA, 12 nt, Human
auaauuuuccuu

SEQ ID NO: 3428090 - RNA, 13 nt, Human
auaauuuuccuuu

SEQ ID NO: 3428091 - RNA, 19 nt, Human
auaauuuuccuuuaauaug

SEQ ID NO: 3428092 - RNA, 17 nt, Human
auaauuuucuucaugca

SEQ ID NO: 3428093 - RNA, 22 nt, Human
auaauuuucuucaugcaaugac

SEQ ID NO: 3428094 - RNA, 22 nt, Human
auaauuuugcuggaauuccuaa

SEQ ID NO: 3428095 - RNA, 13 nt, Human
auaauuuugugaa

SEQ ID NO: 3428096 - RNA, 14 nt, Human
auaauuuugugaag

SEQ ID NO: 3428097 - RNA, 15 nt, Human
auaauuuugugaagc

SEQ ID NO: 3428098 - RNA, 15 nt, Human
auaauuuuuaaagua

SEQ ID NO: 3428099 - RNA, 19 nt, Human
auaauuuuuaaaguauaua

SEQ ID NO: 3428100 - RNA, 17 nt, Human
auaauuuuuauauuuaa

SEQ ID NO: 3428101 - RNA, 23 nt, Human
auaauuuuuauauuuaauuauua

SEQ ID NO: 3428102 - RNA, 16 nt, Human
auaauuuuuuauucaa

SEQ ID NO: 3428103 - RNA, 17 nt, Human
auaauuuuuuauucaag

SEQ ID NO: 3428104 - RNA, 22 nt, Human
auaauuuuuuguaaugugugaa

SEQ ID NO: 3428105 - RNA, 23 nt, Human
auaauuuuuuuauuacugauuuu

SEQ ID NO: 3428106 - RNA, 21 nt, Human
auaauuuuuuucaauauuuau

SEQ ID NO: 3428107 - RNA, 22 nt, Human
auaauuuuuuucaauauuuauu

SEQ ID NO: 3428108 - RNA, 18 nt, Human
auacaaaaauacucagau

SEQ ID NO: 3428109 - RNA, 13 nt, Human
auacaaaaggcuc

SEQ ID NO: 3428110 - RNA, 16 nt, Human
auacaaacaagcauau

SEQ ID NO: 3428111 - RNA, 16 nt, Human
auacaaacaaucucuu

SEQ ID NO: 3428112 - RNA, 19 nt, Human
auacaaacauauuuguuaa

SEQ ID NO: 3428113 - RNA, 17 nt, Human
auacaaacugguauucu

SEQ ID NO: 3428114 - RNA, 11 nt, Human
auacaaagcau

SEQ ID NO: 3428115 - RNA, 18 nt, Human
auacaaagcgugcacaag

SEQ ID NO: 3428116 - RNA, 15 nt, Human
auacaaaugcaucuu

SEQ ID NO: 3428117 - RNA, 14 nt, Human
auacaaauggauuu

SEQ ID NO: 3428118 - RNA, 17 nt, Human
auacaaauuaaaaagau

SEQ ID NO: 3428119 - RNA, 18 nt, Human
auacaaauuaauuuuacu

SEQ ID NO: 3428120 - RNA, 17 nt, Human
auacaaauuagaaaaug

SEQ ID NO: 3428121 - RNA, 23 nt, Human
auacaaauugguugguuuugacu

SEQ ID NO: 3428122 - RNA, 17 nt, Human
auauaaguuugaaggaa

SEQ ID NO: 3428123 - RNA, 19 nt, Human
auauaaguuugaaggaaac

SEQ ID NO: 3428124 - RNA, 21 nt, Human
auauaauaaagcuacugauuu

SEQ ID NO: 3428125 - RNA, 12 nt, Human
auauaauaaagu

SEQ ID NO: 3428126 - RNA, 20 nt, Human
auauaauauauauauauauc

SEQ ID NO: 3428127 - RNA, 23 nt, Human
auauaauauauauauauaucagu

SEQ ID NO: 3428128 - RNA, 21 nt, Human
auauaaugguuucaaagauuc

SEQ ID NO: 3428129 - RNA, 14 nt, Human
auauaauuauaugu

SEQ ID NO: 3428130 - RNA, 15 nt, Human
auauaauuauauguu

SEQ ID NO: 3428131 - RNA, 14 nt, Human
auauaauuaucgga

SEQ ID NO: 3428132 - RNA, 14 nt, Human
auauaauuauguua

SEQ ID NO: 3428133 - RNA, 19 nt, Human
auauaauuauguuauugaa

SEQ ID NO: 3428134 - RNA, 16 nt, Human
auauaauuccuguuuu

SEQ ID NO: 3428135 - RNA, 14 nt, Human
auauaauucuguaa

SEQ ID NO: 3428136 - RNA, 14 nt, Human
auauaauucuguac

SEQ ID NO: 3428137 - RNA, 21 nt, Human
auauaauuuuuuuauguuuug

SEQ ID NO: 3428138 - RNA, 21 nt, Human
auauacaacaccaaaaaauau

SEQ ID NO: 3428139 - RNA, 16 nt, Human
auauacaauaacauaa

SEQ ID NO: 3428140 - RNA, 14 nt, Human
auauacaauaaugg

SEQ ID NO: 3428141 - RNA, 15 nt, Human
auauacaauaaugga

SEQ ID NO: 3428142 - RNA, 20 nt, Human
auauacaauaauggaaaaaa

SEQ ID NO: 3428143 - RNA, 17 nt, Human
auauacacacacaaaga

SEQ ID NO: 3428144 - RNA, 20 nt, Human
auauacacacacaaagagag

SEQ ID NO: 3428145 - RNA, 13 nt, Human
auauacacacagc

SEQ ID NO: 3428146 - RNA, 16 nt, Human
auauacacauauaccu

SEQ ID NO: 3428147 - RNA, 13 nt, Human
auauacacgaaua

SEQ ID NO: 3428148 - RNA, 20 nt, Human
auauacacgaauagacauca

SEQ ID NO: 3428149 - RNA, 13 nt, Human
auauacagaggaa

SEQ ID NO: 3428150 - RNA, 15 nt, Human
auauacagaugaaaa

SEQ ID NO: 3428151 - RNA, 16 nt, Human
auauacaguaacuuua

SEQ ID NO: 3428152 - RNA, 14 nt, Human
auauacauaacagg

SEQ ID NO: 3428153 - RNA, 19 nt, Human
auauauuguuaaucucugu

SEQ ID NO: 3428154 - RNA, 21 nt, Human
auauauuuaaagggaaauuga

SEQ ID NO: 3428155 - RNA, 12 nt, Human
auauauuuauaa

SEQ ID NO: 3428156 - RNA, 15 nt, Human
auauauuuauaacuc

SEQ ID NO: 3428157 - RNA, 16 nt, Human
auauauuuauuuaaag

SEQ ID NO: 3428158 - RNA, 19 nt, Human
auauauuucuaaauguuug

SEQ ID NO: 3428159 - RNA, 14 nt, Human
auauauuucuuugu

SEQ ID NO: 3428160 - RNA, 17 nt, Human
auauauuuguguauuua

SEQ ID NO: 3428161 - RNA, 22 nt, Human
auauauuuguguauuuaacagg

SEQ ID NO: 3428162 - RNA, 12 nt, Human
auauauuuuaag

SEQ ID NO: 3428163 - RNA, 18 nt, Human
auauauuuuauuuuuaga

SEQ ID NO: 3428164 - RNA, 15 nt, Human
auauauuuucuguuu

SEQ ID NO: 3428165 - RNA, 16 nt, Human
auauauuuuguaugca

SEQ ID NO: 3428166 - RNA, 19 nt, Human
auauauuuugugugaaauu

SEQ ID NO: 3428167 - RNA, 20 nt, Human
auauauuuugugugaaauug

SEQ ID NO: 3428168 - RNA, 14 nt, Human
auauauuuuuaaga

SEQ ID NO: 3428169 - RNA, 14 nt, Human
auauauuuuuauau

SEQ ID NO: 3428170 - RNA, 18 nt, Human
auauauuuuuauauuuac

SEQ ID NO: 3428171 - RNA, 20 nt, Human
auauauuuuuauauuuacua

SEQ ID NO: 3428172 - RNA, 17 nt, Human
auauauuuuuuaauuug

SEQ ID NO: 3428173 - RNA, 19 nt, Human
auauauuuuuuaauuugau

SEQ ID NO: 3428174 - RNA, 14 nt, Human
auauauuuuuugua

SEQ ID NO: 3428175 - RNA, 17 nt, Human
auaucaaaagacacagg

SEQ ID NO: 3428176 - RNA, 16 nt, Human
auaucaaauauauuca

SEQ ID NO: 3428177 - RNA, 21 nt, Human
auaucaaaugcaguauauuuc

SEQ ID NO: 3428178 - RNA, 19 nt, Human
auaucaaauuaauugugug

SEQ ID NO: 3428179 - RNA, 14 nt, Human
auaucacacacauu

SEQ ID NO: 3428180 - RNA, 18 nt, Human
auaucacauguuuucucu

SEQ ID NO: 3428181 - RNA, 16 nt, Human
auaucacccagacaua

SEQ ID NO: 3428182 - RNA, 19 nt, Human
auaucacccagacauaaag

SEQ ID NO: 3428183 - RNA, 14 nt, Human
auaucagcaagucu

SEQ ID NO: 3428184 - RNA, 20 nt, Human
auaucagccugagucuccug

SEQ ID NO: 3428185 - RNA, 21 nt, Human
auaucagccugagucuccugu

SEQ ID NO: 3428186 - RNA, 16 nt, Human
auaucagugacaguug

SEQ ID NO: 3428187 - RNA, 18 nt, Human
auaucaguuacucagccc

SEQ ID NO: 3428188 - RNA, 19 nt, Human
auaucaguuacucagcccu

SEQ ID NO: 3428189 - RNA, 21 nt, Human
auaucaguuacucagcccugg

SEQ ID NO: 3428190 - RNA, 12 nt, Human
auaucaguuuga

SEQ ID NO: 3428191 - RNA, 13 nt, Human
auaucauauguau

SEQ ID NO: 3428192 - RNA, 20 nt, Human
auaucaucagcauaccuuua

SEQ ID NO: 3428193 - RNA, 16 nt, Human
auaucaucuaccuaga

SEQ ID NO: 3428194 - RNA, 20 nt, Human
auaucaucuaccuagauuua

SEQ ID NO: 3428195 - RNA, 21 nt, Human
auaucaugagugaauaaaugu

SEQ ID NO: 3428196 - RNA, 22 nt, Human
auaucaugcuuuaaaguguaau

SEQ ID NO: 3428197 - RNA, 13 nt, Human
auaucauucuaaa

SEQ ID NO: 3428198 - RNA, 15 nt, Human
auaucauucuaaaga

SEQ ID NO: 3428199 - RNA, 23 nt, Human
auaucauuuauuuuuuacauuau

SEQ ID NO: 3428200 - RNA, 12 nt, Human
auaucauuucuu

SEQ ID NO: 3428201 - RNA, 21 nt, Human
auauccaggucaacagaauga

SEQ ID NO: 3428202 - RNA, 18 nt, Human
auauccauguacuguagu

SEQ ID NO: 3428203 - RNA, 18 nt, Human
auauccauucuuucugau

SEQ ID NO: 3428204 - RNA, 13 nt, Human
auauccccugcua

SEQ ID NO: 3428205 - RNA, 15 nt, Human
auaucccuacaugua

SEQ ID NO: 3428206 - RNA, 16 nt, Human
auaucccuacauguau

SEQ ID NO: 3428207 - RNA, 16 nt, Human
auaucccuuaaugaaa

SEQ ID NO: 3428208 - RNA, 11 nt, Human
auaucccuucc

SEQ ID NO: 3428209 - RNA, 13 nt, Human
auaucccuuccag

SEQ ID NO: 3428210 - RNA, 12 nt, Human
auauccuaauaa

SEQ ID NO: 3428211 - RNA, 14 nt, Human
auauccuaauaaaa

SEQ ID NO: 3428212 - RNA, 19 nt, Human
auauccuaggagguaauga

SEQ ID NO: 3428213 - RNA, 20 nt, Human
auauccucugcuuaaaaacu

SEQ ID NO: 3428214 - RNA, 12 nt, Human
auauccugccuc

SEQ ID NO: 3428215 - RNA, 18 nt, Human
auauccuuaucagagcua

SEQ ID NO: 3428216 - RNA, 15 nt, Human
auauccuuucuaaca

SEQ ID NO: 3428217 - RNA, 17 nt, Human
auaucgacuuguuuuug

SEQ ID NO: 3428218 - RNA, 18 nt, Human
auaucggcucacaaagag

SEQ ID NO: 3428219 - RNA, 21 nt, Human
auaucuaaaauauuauuuuau

SEQ ID NO: 3428220 - RNA, 14 nt, Human
auaucuaaaguuau

SEQ ID NO: 3428221 - RNA, 15 nt, Human
auaucuaaaguuaua

SEQ ID NO: 3428222 - RNA, 20 nt, Human
auaucuaaaguuauauuuca

SEQ ID NO: 3428223 - RNA, 18 nt, Human
auaucuaaaucuguccaa

SEQ ID NO: 3428224 - RNA, 13 nt, Human
auaucuaaauuga

SEQ ID NO: 3428225 - RNA, 14 nt, Human
auaucuaaauugaa

SEQ ID NO: 3428226 - RNA, 17 nt, Human
auaucuaaauugaauaa

SEQ ID NO: 3428227 - RNA, 18 nt, Human
auaucuaaauugaauaau

SEQ ID NO: 3428228 - RNA, 14 nt, Human
auaucuaauauaua

SEQ ID NO: 3428229 - RNA, 17 nt, Human
auaucuaauauauauga

SEQ ID NO: 3428230 - RNA, 18 nt, Human
auaucuaauauauaugaa

SEQ ID NO: 3428231 - RNA, 20 nt, Human
auaucuaauuauuuugcagu

SEQ ID NO: 3428232 - RNA, 23 nt, Human
auaucuagguuuaugacaguaau

SEQ ID NO: 3428233 - RNA, 17 nt, Human
auaucuaguaugaaauu

SEQ ID NO: 3428234 - RNA, 17 nt, Human
auaucuauaaacacugu

SEQ ID NO: 3428235 - RNA, 21 nt, Human
auaucuauauauaauucugua

SEQ ID NO: 3428236 - RNA, 18 nt, Human
auaucuauauauauaauu

SEQ ID NO: 3428237 - RNA, 16 nt, Human
auaucuaucuauuuga

SEQ ID NO: 3428238 - RNA, 13 nt, Human
auaucuaucuuau

SEQ ID NO: 3428239 - RNA, 17 nt, Human
auaucuauguuuuacca

SEQ ID NO: 3428240 - RNA, 13 nt, Human
auaucuccugaaa

SEQ ID NO: 3428241 - RNA, 17 nt, Human
auaucuccuuuguauuc

SEQ ID NO: 3428242 - RNA, 18 nt, Human
auaucugaacauuuacua

SEQ ID NO: 3428243 - RNA, 18 nt, Human
auaucugaggaauucugu

SEQ ID NO: 3428244 - RNA, 23 nt, Human
auaucugccuuuauuguguuugu

SEQ ID NO: 3428245 - RNA, 20 nt, Human
auaucuggccuaaaaucuug

SEQ ID NO: 3428246 - RNA, 19 nt, Human
auaucuggccucugcuuuc

SEQ ID NO: 3428247 - RNA, 17 nt, Human
auaucugggauucuacu

SEQ ID NO: 3428248 - RNA, 15 nt, Human
auaucuguaauggua

SEQ ID NO: 3428249 - RNA, 12 nt, Human
auaucuguaugu

SEQ ID NO: 3428250 - RNA, 13 nt, Human
auaucuguaugua

SEQ ID NO: 3428251 - RNA, 18 nt, Human
auaucuguggucuucaaa

SEQ ID NO: 3428252 - RNA, 16 nt, Human
auaucuguuuuacugc

SEQ ID NO: 3428253 - RNA, 19 nt, Human
auaucuuaaagaaacagcu

SEQ ID NO: 3428254 - RNA, 18 nt, Human
auaucuucguuaguaauc

SEQ ID NO: 3428255 - RNA, 17 nt, Human
auaucuugcgaauccaa

SEQ ID NO: 3428256 - RNA, 18 nt, Human
auaucuugcgaauccaag

SEQ ID NO: 3428257 - RNA, 23 nt, Human
auaucuugcuugaacuuacaggu

SEQ ID NO: 3428258 - RNA, 19 nt, Human
auaucuuggacaaaucaca

SEQ ID NO: 3428259 - RNA, 23 nt, Human
auaucuuugugauaauuuaagag

SEQ ID NO: 3428260 - RNA, 18 nt, Human
auaucuuuuauguuugaa

SEQ ID NO: 3428261 - RNA, 15 nt, Human
auaucuuuucuuuag

SEQ ID NO: 3428262 - RNA, 21 nt, Human
auaucuuuucuuuagagaacu

SEQ ID NO: 3428263 - RNA, 14 nt, Human
auaucuuuugaccu

SEQ ID NO: 3428264 - RNA, 21 nt, Human
auaucuuuuuauugaugugca

SEQ ID NO: 3428265 - RNA, 14 nt, Human
auaugaaaaauaug

SEQ ID NO: 3428266 - RNA, 17 nt, Human
auaugaaaaauaugaua

SEQ ID NO: 3428267 - RNA, 16 nt, Human
auaugaaaaaugagau

SEQ ID NO: 3428268 - RNA, 16 nt, Human
auaugaaaacuaaguu

SEQ ID NO: 3428269 - RNA, 15 nt, Human
auaugaaaacuauac

SEQ ID NO: 3428270 - RNA, 17 nt, Human
auaugaaaacuauacaa

SEQ ID NO: 3428271 - RNA, 16 nt, Human
auaugaaaauacaacu

SEQ ID NO: 3428272 - RNA, 17 nt, Human
auaugaacauacaaaug

SEQ ID NO: 3428273 - RNA, 18 nt, Human
auaugaacauacaaaugc

SEQ ID NO: 3428274 - RNA, 20 nt, Human
auaugaacauauuguugaaa

SEQ ID NO: 3428275 - RNA, 15 nt, Human
auaugaagacauaaa

SEQ ID NO: 3428276 - RNA, 16 nt, Human
auaugaagacauaaac

SEQ ID NO: 3428277 - RNA, 16 nt, Human
auaugaauauauagug

SEQ ID NO: 3428278 - RNA, 13 nt, Human
auaugaaucugcu

SEQ ID NO: 3428279 - RNA, 14 nt, Human
auaugaauuguaca

SEQ ID NO: 3428280 - RNA, 21 nt, Human
auaugaauuuaaauauaauuc

SEQ ID NO: 3428281 - RNA, 14 nt, Human
auaugacaaauguu

SEQ ID NO: 3428282 - RNA, 21 nt, Human
auaugacagcugucccuguca

SEQ ID NO: 3428283 - RNA, 20 nt, Human
auaugacucacaugaugcau

SEQ ID NO: 3428284 - RNA, 21 nt, Human
auaugacuguuuuucggacag

SEQ ID NO: 3428285 - RNA, 22 nt, Human
auaugagcuuccuucugugaaa

SEQ ID NO: 3428286 - RNA, 20 nt, Human
auaugaguauacaauauaua

SEQ ID NO: 3428287 - RNA, 13 nt, Human
auaccaaacaugc

SEQ ID NO: 3428288 - RNA, 17 nt, Human
auaccaaagcacauuuu

SEQ ID NO: 3428289 - RNA, 17 nt, Human
auaccaaguauuuauua

SEQ ID NO: 3428290 - RNA, 12 nt, Human
auaccaauaaag

SEQ ID NO: 3428291 - RNA, 16 nt, Human
auaccacccaaugcug

SEQ ID NO: 3428292 - RNA, 18 nt, Human
auaccacucuguaauugc

SEQ ID NO: 3428293 - RNA, 17 nt, Human
auaccacucuuuaccuu

SEQ ID NO: 3428294 - RNA, 21 nt, Human
auaccacucuuuaccuuuauu

SEQ ID NO: 3428295 - RNA, 17 nt, Human
auaccacuuuuguucuu

SEQ ID NO: 3428296 - RNA, 18 nt, Human
auaccacuuuuguucuug

SEQ ID NO: 3428297 - RNA, 17 nt, Human
auaccagccaguaaaug

SEQ ID NO: 3428298 - RNA, 16 nt, Human
auaucuguaaugguac

SEQ ID NO: 3428299 - RNA, 15 nt, Human
auaucuguauauaaa

SEQ ID NO: 3428300 - RNA, 20 nt, Human
auaucuguauuuaauuuuga

SEQ ID NO: 3428301 - RNA, 24 nt, Human
auaucuguauuuaauuuugacacu

SEQ ID NO: 3428302 - RNA, 13 nt, Human
auaucugugaaau

SEQ ID NO: 3428303 - RNA, 16 nt, Human
auaucuguuagaugcu

SEQ ID NO: 3428304 - RNA, 12 nt, Human
auaucuucacaa

SEQ ID NO: 3428305 - RNA, 14 nt, Human
auaucuucauuucu

SEQ ID NO: 3428306 - RNA, 18 nt, Human
auaucuucauuucuaaau

SEQ ID NO: 3428307 - RNA, 23 nt, Human
auaucuucguuaguaaucuguau

SEQ ID NO: 3428308 - RNA, 20 nt, Human
auaucuuggacaaaucacau

SEQ ID NO: 3428309 - RNA, 21 nt, Human
auaucuuggcagguaggaaua

SEQ ID NO: 3428310 - RNA, 23 nt, Human
auaucuuggccuaaaccucaguu

SEQ ID NO: 3428311 - RNA, 16 nt, Human
auaucuuuauuaauca

SEQ ID NO: 3428312 - RNA, 12 nt, Human
auaucuuucugc

SEQ ID NO: 3428313 - RNA, 16 nt, Human
auaucuuugugauaau

SEQ ID NO: 3428314 - RNA, 12 nt, Human
auaucuuuuaug

SEQ ID NO: 3428315 - RNA, 22 nt, Human
auaucuuuucuuuagagaacug

SEQ ID NO: 3428316 - RNA, 23 nt, Human
auaucuuuucuuuagagaacuga

SEQ ID NO: 3428317 - RNA, 15 nt, Human
auaucuuuuuauuga

SEQ ID NO: 3428318 - RNA, 16 nt, Human
auaucuuuuuauugau

SEQ ID NO: 3428319 - RNA, 22 nt, Human
auaucuuuuuauugaugugcaa

SEQ ID NO: 3428320 - RNA, 20 nt, Human
auaugaaaaaaaugcauuuu

SEQ ID NO: 3428321 - RNA, 18 nt, Human
auaugaaaaauaugauau

SEQ ID NO: 3428322 - RNA, 15 nt, Human
auaugaaaaaugaga

SEQ ID NO: 3428323 - RNA, 13 nt, Human
auaugaaagcuga

SEQ ID NO: 3428324 - RNA, 16 nt, Human
auaugaacauacaaau

SEQ ID NO: 3428325 - RNA, 17 nt, Human
auaugaacuuaacaugc

SEQ ID NO: 3428326 - RNA, 15 nt, Human
auaugaauuguacag

SEQ ID NO: 3428327 - RNA, 17 nt, Human
auaugaauuuaaauaua

SEQ ID NO: 3428328 - RNA, 18 nt, Human
auaugacaaauguuucua

SEQ ID NO: 3428329 - RNA, 23 nt, Human
auaugaccaaauaucaccaggac

SEQ ID NO: 3428330 - RNA, 13 nt, Human
auaugaccucaug

SEQ ID NO: 3428331 - RNA, 20 nt, Human
auaugacggaagaacauaga

SEQ ID NO: 3428332 - RNA, 15 nt, Human
auaugagaagaauag

SEQ ID NO: 3428333 - RNA, 23 nt, Human
auaugaggaugcagagucagcag

SEQ ID NO: 3428334 - RNA, 14 nt, Human
auaugaguauacaa

SEQ ID NO: 3428335 - RNA, 15 nt, Human
auaugaguauacaau

SEQ ID NO: 3428336 - RNA, 18 nt, Human
auaugaguauacaauaua

SEQ ID NO: 3428337 - RNA, 14 nt, Human
auaugauauguaaa

SEQ ID NO: 3428338 - RNA, 16 nt, Human
auaugauauguaaaca

SEQ ID NO: 3428339 - RNA, 14 nt, Human
auaugaucuguuuu

SEQ ID NO: 3428340 - RNA, 16 nt, Human
auaugaugacuguuuu

SEQ ID NO: 3428341 - RNA, 21 nt, Human
auaugauguuaaaaaaauaag

SEQ ID NO: 3428342 - RNA, 21 nt, Human
auaugauuaaaaauaucaaau

SEQ ID NO: 3428343 - RNA, 22 nt, Human
auaugauuaaaaauaucaaauu

SEQ ID NO: 3428344 - RNA, 16 nt, Human
auaugauuuaaaacau

SEQ ID NO: 3428345 - RNA, 22 nt, Human
aggagccucacuggggcagaca

SEQ ID NO: 3428346 - RNA, 14 nt, Human
aggagccugcccag

SEQ ID NO: 3428347 - RNA, 16 nt, Human
aggagccuguccugcc

SEQ ID NO: 3428348 - RNA, 19 nt, Human
aggagccuguccugccugu

SEQ ID NO: 3428349 - RNA, 21 nt, Human
aggagccuguccugccugugg

SEQ ID NO: 3428350 - RNA, 11 nt, Human
aggagccugug

SEQ ID NO: 3428351 - RNA, 13 nt, Human
aggagccugugaa

SEQ ID NO: 3428352 - RNA, 16 nt, Human
aggagccuuuuuaaaa

SEQ ID NO: 3428353 - RNA, 12 nt, Human
aggagcuaaggc

SEQ ID NO: 3428354 - RNA, 19 nt, Human
aggagcuaaggcucuauga

SEQ ID NO: 3428355 - RNA, 20 nt, Human
aggagcuaaggcucuaugag

SEQ ID NO: 3428356 - RNA, 22 nt, Human
aggagcuacccuuuuccuuugu

SEQ ID NO: 3428357 - RNA, 14 nt, Human
aggagcuaccugug

SEQ ID NO: 3428358 - RNA, 15 nt, Human
aggagcuaccugugu

SEQ ID NO: 3428359 - RNA, 23 nt, Human
aggagcuaccuguguggacagga

SEQ ID NO: 3428360 - RNA, 12 nt, Human
aggagcuccccu

SEQ ID NO: 3428361 - RNA, 17 nt, Human
aggagcuccccucccca

SEQ ID NO: 3428362 - RNA, 20 nt, Human
aggagcuccccuccccaacu

SEQ ID NO: 3428363 - RNA, 17 nt, Human
aggagcucuucaggccu

SEQ ID NO: 3428364 - RNA, 19 nt, Human
aggagcucuucaggccucc

SEQ ID NO: 3428365 - RNA, 15 nt, Human
aggagcugagaauag

SEQ ID NO: 3428366 - RNA, 17 nt, Human
aggagcugagaauagaa

SEQ ID NO: 3428367 - RNA, 21 nt, Human
aggagcugcccagaguugcug

SEQ ID NO: 3428368 - RNA, 17 nt, Human
aggagcugccuggaccc

SEQ ID NO: 3428369 - RNA, 18 nt, Human
aggagcugccuggacccg

SEQ ID NO: 3428370 - RNA, 19 nt, Human
aggagcugccuuggcucag

SEQ ID NO: 3428371 - RNA, 11 nt, Human
aggagcugcua

SEQ ID NO: 3428372 - RNA, 19 nt, Human
aggagcugcuauagccugg

SEQ ID NO: 3428373 - RNA, 20 nt, Human
aggagcugcuauagccuggg

SEQ ID NO: 3428374 - RNA, 13 nt, Human
aggagcugcuggc

SEQ ID NO: 3428375 - RNA, 21 nt, Human
aggagcugcuggcuugcagug

SEQ ID NO: 3428376 - RNA, 15 nt, Human
aggagcugggagccg

SEQ ID NO: 3428377 - RNA, 12 nt, Human
aggagcugggga

SEQ ID NO: 3428378 - RNA, 20 nt, Human
aggagcuuaccucccaccuu

SEQ ID NO: 3428379 - RNA, 20 nt, Human
aggagcuuccuguccuccca

SEQ ID NO: 3428380 - RNA, 20 nt, Human
aggagcuucuggggucccca

SEQ ID NO: 3428381 - RNA, 19 nt, Human
aggagcuucuuguuuccuu

SEQ ID NO: 3428382 - RNA, 18 nt, Human
aggagcuuugacucagga

SEQ ID NO: 3428383 - RNA, 14 nt, Human
aggaggaauacuga

SEQ ID NO: 3428384 - RNA, 22 nt, Human
aggaggaaucaugucaggccug

SEQ ID NO: 3428385 - RNA, 12 nt, Human
aggaggacccag

SEQ ID NO: 3428386 - RNA, 13 nt, Human
aggaggacccagg

SEQ ID NO: 3428387 - RNA, 16 nt, Human
aggaggacccagggcu

SEQ ID NO: 3428388 - RNA, 17 nt, Human
aggaggacccagggcuc

SEQ ID NO: 3428389 - RNA, 22 nt, Human
aggaggagccuguccugccugu

SEQ ID NO: 3428390 - RNA, 14 nt, Human
aggaggaggagggu

SEQ ID NO: 3428391 - RNA, 15 nt, Human
aggaggaugggcucg

SEQ ID NO: 3428392 - RNA, 15 nt, Human
aggaggaugucccug

SEQ ID NO: 3428393 - RNA, 21 nt, Human
aggaggaugucccugggccag

SEQ ID NO: 3428394 - RNA, 14 nt, Human
aggaggcagcagga

SEQ ID NO: 3428395 - RNA, 15 nt, Human
aggaggcagcaggac

SEQ ID NO: 3428396 - RNA, 20 nt, Human
aggaggcagcuguugcagug

SEQ ID NO: 3428397 - RNA, 14 nt, Human
aggaggcaggaccu

SEQ ID NO: 3428398 - RNA, 22 nt, Human
aggaggcaggcauggcccuggg

SEQ ID NO: 3428399 - RNA, 17 nt, Human
aggaggcaugccucuga

SEQ ID NO: 3428400 - RNA, 16 nt, Human
aggaggccaccucucc

SEQ ID NO: 3428401 - RNA, 20 nt, Human
aggaggccaccucuccaagg

SEQ ID NO: 3428402 - RNA, 14 nt, Human
aggaggccacguga

SEQ ID NO: 3428403 - RNA, 13 nt, Human
aggaggccaggcc

SEQ ID NO: 3428404 - RNA, 16 nt, Human
aggaggccaggcucag

SEQ ID NO: 3428405 - RNA, 17 nt, Human
aggaggccccuggccca

SEQ ID NO: 3428406 - RNA, 16 nt, Human
aggaggccggggccgg

SEQ ID NO: 3428407 - RNA, 20 nt, Human
aggaggccuugggcucugcu

SEQ ID NO: 3428408 - RNA, 23 nt, Human
aggaggcgcacuuuccuccuggc

SEQ ID NO: 3428409 - RNA, 21 nt, Human
aggaggcgucucgggagagga

SEQ ID NO: 3428410 - RNA, 23 nt, Human
aggaggcuaugcucaggggcccu

SEQ ID NO: 3428411 - RNA, 17 nt, Human
aggaggcuccagagggc

SEQ ID NO: 3428412 - RNA, 16 nt, Human
aggaggcugaggcaga

SEQ ID NO: 3428413 - RNA, 19 nt, Human
aggaggcugaggcaggagg

SEQ ID NO: 3428414 - RNA, 13 nt, Human
aggaggcugaggg

SEQ ID NO: 3428415 - RNA, 16 nt, Human
aggaggcuggcaggua

SEQ ID NO: 3428416 - RNA, 22 nt, Human
aggaggcugggacgcucugcug

SEQ ID NO: 3428417 - RNA, 15 nt, Human
aggagggaaaccuuu

SEQ ID NO: 3428418 - RNA, 13 nt, Human
aggagggagaggg

SEQ ID NO: 3428419 - RNA, 14 nt, Human
aggagggagaggga

SEQ ID NO: 3428420 - RNA, 14 nt, Human
aggagggaggggga

SEQ ID NO: 3428421 - RNA, 23 nt, Human
aggagggagguauucgugcagca

SEQ ID NO: 3428422 - RNA, 16 nt, Human
aggagggcaagggcca

SEQ ID NO: 3428423 - RNA, 15 nt, Human
aggagggcaggcauc

SEQ ID NO: 3428424 - RNA, 14 nt, Human
aggagggcauccau

SEQ ID NO: 3428425 - RNA, 20 nt, Human
aggagggcccuaccugauug

SEQ ID NO: 3428426 - RNA, 17 nt, Human
aggagggcgugacucac

SEQ ID NO: 3428427 - RNA, 16 nt, Human
aggagggcguucuuag

SEQ ID NO: 3428428 - RNA, 18 nt, Human
aggaggggaagaggccug

SEQ ID NO: 3428429 - RNA, 17 nt, Human
aggaggggauagagaga

SEQ ID NO: 3428430 - RNA, 23 nt, Human
aggaggggccccccugcccugug

SEQ ID NO: 3428431 - RNA, 20 nt, Human
aggaggggcccguugucucc

SEQ ID NO: 3428432 - RNA, 16 nt, Human
aggaggggggagggaa

SEQ ID NO: 3428433 - RNA, 20 nt, Human
aggagggggucguggagagc

SEQ ID NO: 3428434 - RNA, 18 nt, Human
aggagggucaggaaggau

SEQ ID NO: 3428435 - RNA, 14 nt, Human
aggagggugggaag

SEQ ID NO: 3428436 - RNA, 21 nt, Human
aggagggugggggagggaggu

SEQ ID NO: 3428437 - RNA, 22 nt, Human
aggagguaaugaccaugaaaga

SEQ ID NO: 3428438 - RNA, 23 nt, Human
aggagguccuuaggccucugaga

SEQ ID NO: 3428439 - RNA, 15 nt, Human
aggaggucucuaaga

SEQ ID NO: 3428440 - RNA, 14 nt, Human
aggaggugagggau

SEQ ID NO: 3428441 - RNA, 15 nt, Human
aggaggugccaacag

SEQ ID NO: 3428442 - RNA, 14 nt, Human
aggagguggcagcc

SEQ ID NO: 3428443 - RNA, 18 nt, Human
aucaucaguggagccaug

SEQ ID NO: 3428444 - RNA, 15 nt, Human
aucaucaguguagaa

SEQ ID NO: 3428445 - RNA, 16 nt, Human
aucaucaguguagaac

SEQ ID NO: 3428446 - RNA, 19 nt, Human
aucaucauaguaaaagaaa

SEQ ID NO: 3428447 - RNA, 13 nt, Human
aucaucauggcca

SEQ ID NO: 3428448 - RNA, 16 nt, Human
aucaucauuauuauua

SEQ ID NO: 3428449 - RNA, 14 nt, Human
aucauccacacaug

SEQ ID NO: 3428450 - RNA, 15 nt, Human
aucauccuaagcuau

SEQ ID NO: 3428451 - RNA, 13 nt, Human
aucauccucuggc

SEQ ID NO: 3428452 - RNA, 21 nt, Human
aucauccuuuagguaagaagu

SEQ ID NO: 3428453 - RNA, 18 nt, Human
aucauccuuuccagcaug

SEQ ID NO: 3428454 - RNA, 20 nt, Human
aucaucgaaaauucauuuca

SEQ ID NO: 3428455 - RNA, 16 nt, Human
aucaucgccagaggug

SEQ ID NO: 3428456 - RNA, 20 nt, Human
aucaucgccagaggugcuuc

SEQ ID NO: 3428457 - RNA, 16 nt, Human
aucaucuauaaagaag

SEQ ID NO: 3428458 - RNA, 15 nt, Human
aucaucuauagaaag

SEQ ID NO: 3428459 - RNA, 19 nt, Human
aucaucuauuuugaugcag

SEQ ID NO: 3428460 - RNA, 21 nt, Human
aucaucuauuuugaugcagca

SEQ ID NO: 3428461 - RNA, 23 nt, Human
aucaucuauuuugaugcagcauu

SEQ ID NO: 3428462 - RNA, 20 nt, Human
aucaucuccugccuuccucc

SEQ ID NO: 3428463 - RNA, 16 nt, Human
aucaucuguaagcugu

SEQ ID NO: 3428464 - RNA, 17 nt, Human
aucaucuguaagcuguu

SEQ ID NO: 3428465 - RNA, 13 nt, Human
aucaucuguguga

SEQ ID NO: 3428466 - RNA, 19 nt, Human
aucaucugugugaaaaugg

SEQ ID NO: 3428467 - RNA, 21 nt, Human
aucaucuugaacauuaaucca

SEQ ID NO: 3428468 - RNA, 23 nt, Human
aucaugaaacuuguuucacugaa

SEQ ID NO: 3428469 - RNA, 11 nt, Human
aucaugaagcc

SEQ ID NO: 3428470 - RNA, 14 nt, Human
aucaugaagccugu

SEQ ID NO: 3428471 - RNA, 19 nt, Human
aucaugaaucuuuguuuca

SEQ ID NO: 3428472 - RNA, 15 nt, Human
aucaugaauguguaa

SEQ ID NO: 3428473 - RNA, 18 nt, Human
aucaugcacacaauuaga

SEQ ID NO: 3428474 - RNA, 14 nt, Human
aucaugcauagagu

SEQ ID NO: 3428475 - RNA, 22 nt, Human
aucaugcaucuuacugaaggua

SEQ ID NO: 3428476 - RNA, 22 nt, Human
aucaugcauuguugaggugguc

SEQ ID NO: 3428477 - RNA, 16 nt, Human
aucaugccucugaggc

SEQ ID NO: 3428478 - RNA, 17 nt, Human
aucaugccucugaggcc

SEQ ID NO: 3428479 - RNA, 20 nt, Human
aucaugccucugaggccagc

SEQ ID NO: 3428480 - RNA, 22 nt, Human
aucaugccucugaggccagccu

SEQ ID NO: 3428481 - RNA, 23 nt, Human
aucaugccucugaggccagccug

SEQ ID NO: 3428482 - RNA, 19 nt, Human
aucaugcuggaaccugcaa

SEQ ID NO: 3428483 - RNA, 22 nt, Human
aucaugcuggaaccugcaaaaa

SEQ ID NO: 3428484 - RNA, 15 nt, Human
aucauggaaauauua

SEQ ID NO: 3428485 - RNA, 12 nt, Human
aucauggaguga

SEQ ID NO: 3428486 - RNA, 20 nt, Human
aucauggauucauuacagcu

SEQ ID NO: 3428487 - RNA, 14 nt, Human
aucauggccagcug

SEQ ID NO: 3428488 - RNA, 22 nt, Human
aucauggcuaagcuuaaaaaaa

SEQ ID NO: 3428489 - RNA, 20 nt, Human
aucauggcucacugcagccu

SEQ ID NO: 3428490 - RNA, 15 nt, Human
aucauggugaaaagc

SEQ ID NO: 3428491 - RNA, 17 nt, Human
aucaugguguaauaaga

SEQ ID NO: 3428492 - RNA, 14 nt, Human
aucauguaaagaaa

SEQ ID NO: 3428493 - RNA, 14 nt, Human
aucauguaaauuac

SEQ ID NO: 3428494 - RNA, 18 nt, Human
aucauguacuuuuuagua

SEQ ID NO: 3428495 - RNA, 18 nt, Human
aucaugucaggccugugu

SEQ ID NO: 3428496 - RNA, 14 nt, Human
aucaugucuauugu

SEQ ID NO: 3428497 - RNA, 18 nt, Human
aucaugugcgucagucca

SEQ ID NO: 3428498 - RNA, 17 nt, Human
aucauguggccccaccc

SEQ ID NO: 3428499 - RNA, 19 nt, Human
aucauguuaauccuagcug

SEQ ID NO: 3428500 - RNA, 19 nt, Human
aucauguugaucauguacu

SEQ ID NO: 3428501 - RNA, 21 nt, Human
aucauguuguuaaaauuauga

SEQ ID NO: 3428502 - RNA, 18 nt, Human
aucauguuuacagaggac

SEQ ID NO: 3428503 - RNA, 16 nt, Human
aucauguuucuuugau

SEQ ID NO: 3428504 - RNA, 16 nt, Human
aucauguuugcucucc

SEQ ID NO: 3428505 - RNA, 21 nt, Human
aucauuaaaagaacauaaguu

SEQ ID NO: 3428506 - RNA, 22 nt, Human
aucauuacccuucccugcacua

SEQ ID NO: 3428507 - RNA, 23 nt, Human
aucauuaccuuuuaccagcuuuu

SEQ ID NO: 3428508 - RNA, 11 nt, Human
aucauuagaac

SEQ ID NO: 3428509 - RNA, 16 nt, Human
aucauuaggugugacu

SEQ ID NO: 3428510 - RNA, 18 nt, Human
aggauauauuuucacuuu

SEQ ID NO: 3428511 - RNA, 23 nt, Human
aggauauccuuaucagagcuaag

SEQ ID NO: 3428512 - RNA, 15 nt, Human
aggauaucuucucca

SEQ ID NO: 3428513 - RNA, 17 nt, Human
aggauaugccugcucuu

SEQ ID NO: 3428514 - RNA, 16 nt, Human
aggauauggacacugg

SEQ ID NO: 3428515 - RNA, 18 nt, Human
aggauauggacacuggug

SEQ ID NO: 3428516 - RNA, 21 nt, Human
aggauauguucacaccuagcg

SEQ ID NO: 3428517 - RNA, 17 nt, Human
aggauauuuaagaaaau

SEQ ID NO: 3428518 - RNA, 18 nt, Human
aggauauuuaagaaaaua

SEQ ID NO: 3428519 - RNA, 19 nt, Human
aggauauuuugucaccaga

SEQ ID NO: 3428520 - RNA, 12 nt, Human
aggaucagaaag

SEQ ID NO: 3428521 - RNA, 17 nt, Human
aggaucaugguguaaua

SEQ ID NO: 3428522 - RNA, 21 nt, Human
aggaucauuuguuggaaugaa

SEQ ID NO: 3428523 - RNA, 20 nt, Human
aggauccuauucucaccagg

SEQ ID NO: 3428524 - RNA, 21 nt, Human
aggauccuauucucaccagga

SEQ ID NO: 3428525 - RNA, 22 nt, Human
aggauccuauucucaccaggaa

SEQ ID NO: 3428526 - RNA, 13 nt, Human
aggauccugagcc

SEQ ID NO: 3428527 - RNA, 16 nt, Human
aggaucuagaaugugu

SEQ ID NO: 3428528 - RNA, 18 nt, Human
aggaucuauuuuuggagg

SEQ ID NO: 3428529 - RNA, 19 nt, Human
aggaucuauuuuuggaggu

SEQ ID NO: 3428530 - RNA, 21 nt, Human
aggaucuauuuuuggagguuu

SEQ ID NO: 3428531 - RNA, 18 nt, Human
aggaucucaccaggcagc

SEQ ID NO: 3428532 - RNA, 13 nt, Human
aggaucucucagg

SEQ ID NO: 3428533 - RNA, 14 nt, Human
aggaucucucagga

SEQ ID NO: 3428534 - RNA, 18 nt, Human
aggaucucuugagccugg

SEQ ID NO: 3428535 - RNA, 21 nt, Human
aggaucucuugagccugggag

SEQ ID NO: 3428536 - RNA, 14 nt, Human
aggaucuggagaac

SEQ ID NO: 3428537 - RNA, 15 nt, Human
aggaucuuuguggcc

SEQ ID NO: 3428538 - RNA, 17 nt, Human
aggaucuuuguggccaa

SEQ ID NO: 3428539 - RNA, 18 nt, Human
aggaucuuuugaacccag

SEQ ID NO: 3428540 - RNA, 19 nt, Human
aggaugaaugaggucccag

SEQ ID NO: 3428541 - RNA, 12 nt, Human
aggaugaaugua

SEQ ID NO: 3428542 - RNA, 23 nt, Human
aggaugacaaaauucuuucuggu

SEQ ID NO: 3428543 - RNA, 16 nt, Human
aggaugagagcccaga

SEQ ID NO: 3428544 - RNA, 19 nt, Human
aggaugagcucuacccagg

SEQ ID NO: 3428545 - RNA, 22 nt, Human
aggaugagggaaaagaaaaaga

SEQ ID NO: 3428546 - RNA, 23 nt, Human
aggaugaugucuuuuuauuaaaa

SEQ ID NO: 3428547 - RNA, 19 nt, Human
aggaugcccaaagaugcag

SEQ ID NO: 3428548 - RNA, 14 nt, Human
aggaugcccagggc

SEQ ID NO: 3428549 - RNA, 17 nt, Human
aggaugcuaaaccuuag

SEQ ID NO: 3428550 - RNA, 17 nt, Human
aggaugcuaacaucuaa

SEQ ID NO: 3428551 - RNA, 19 nt, Human
aggaugcuaacaucuaaaa

SEQ ID NO: 3428552 - RNA, 22 nt, Human
aggaugcuaacaucuaaaaaua

SEQ ID NO: 3428553 - RNA, 12 nt, Human
aggaugcuggcc

SEQ ID NO: 3428554 - RNA, 15 nt, Human
aggaugcuggguggc

SEQ ID NO: 3428555 - RNA, 21 nt, Human
aggaugcuugauuccaguggu

SEQ ID NO: 3428556 - RNA, 13 nt, Human
aggaugcuuggga

SEQ ID NO: 3428557 - RNA, 15 nt, Human
aggaugcuuguacau

SEQ ID NO: 3428558 - RNA, 16 nt, Human
aggaugcuuguacaua

SEQ ID NO: 3428559 - RNA, 21 nt, Human
aggaugcuuguacauaaugcg

SEQ ID NO: 3428560 - RNA, 17 nt, Human
aggauggagagagggga

SEQ ID NO: 3428561 - RNA, 15 nt, Human
aggauggcaggacgu

SEQ ID NO: 3428562 - RNA, 15 nt, Human
aggauggccaguguc

SEQ ID NO: 3428563 - RNA, 13 nt, Human
aggauggccuggc

SEQ ID NO: 3428564 - RNA, 12 nt, Human
aggaugggaagg

SEQ ID NO: 3428565 - RNA, 22 nt, Human
aggaugggucugguuugcagag

SEQ ID NO: 3428566 - RNA, 18 nt, Human
aggauggucuuacagcag

SEQ ID NO: 3428567 - RNA, 23 nt, Human
aggaugguucccuugaugaagaa

SEQ ID NO: 3428568 - RNA, 19 nt, Human
aggauguaaacagugccug

SEQ ID NO: 3428569 - RNA, 21 nt, Human
aggauguaaacagugccugcu

SEQ ID NO: 3428570 - RNA, 22 nt, Human
aggauguacaaggacagccccu

SEQ ID NO: 3428571 - RNA, 15 nt, Human
aggauguagcuuuuc

SEQ ID NO: 3428572 - RNA, 20 nt, Human
aggauguauauuuuauauaa

SEQ ID NO: 3428573 - RNA, 21 nt, Human
aggauguauauuuuauauaaa

SEQ ID NO: 3428574 - RNA, 18 nt, Human
aggaugucacagggccaa

SEQ ID NO: 3428575 - RNA, 20 nt, Human
aggaugucccugggccaggg

SEQ ID NO: 3428576 - RNA, 17 nt, Human
aggaugucucaaacuuc

SEQ ID NO: 3428577 - RNA, 14 nt, Human
aggaugugggcagc

SEQ ID NO: 3428578 - RNA, 18 nt, Human
aggauguucugggacaca

SEQ ID NO: 3428579 - RNA, 14 nt, Human
aggauguugaaaaa

SEQ ID NO: 3428580 - RNA, 17 nt, Human
aggauuaguuuagaaca

SEQ ID NO: 3428581 - RNA, 14 nt, Human
aggauuauuggaaa

SEQ ID NO: 3428582 - RNA, 18 nt, Human
aggauucacaccccaccu

SEQ ID NO: 3428583 - RNA, 19 nt, Human
aggauucacaccccaccug

SEQ ID NO: 3428584 - RNA, 20 nt, Human
aggauucacaccccaccugc

SEQ ID NO: 3428585 - RNA, 22 nt, Human
aggauucacaccccaccugcgc

SEQ ID NO: 3428586 - RNA, 15 nt, Human
aggauuccucuuuuc

SEQ ID NO: 3428587 - RNA, 23 nt, Human
aucagaguagaaauaaaagugaa

SEQ ID NO: 3428588 - RNA, 13 nt, Human
aucagauacauca

SEQ ID NO: 3428589 - RNA, 20 nt, Human
aucagaugcuccaagauucu

SEQ ID NO: 3428590 - RNA, 22 nt, Human
aucagaugcuccaagauucuag

SEQ ID NO: 3428591 - RNA, 15 nt, Human
aucagauugcaugug

SEQ ID NO: 3428592 - RNA, 16 nt, Human
aucagauugcauguga

SEQ ID NO: 3428593 - RNA, 21 nt, Human
aucagcaaaccggggccuacu

SEQ ID NO: 3428594 - RNA, 14 nt, Human
aucagcaaagaaaa

SEQ ID NO: 3428595 - RNA, 23 nt, Human
aucagcaaagaaaaaaaaaaaag

SEQ ID NO: 3428596 - RNA, 16 nt, Human
aucagcacgauuucug

SEQ ID NO: 3428597 - RNA, 18 nt, Human
aucagcacgauuucuguu

SEQ ID NO: 3428598 - RNA, 15 nt, Human
aucagcacugaaaau

SEQ ID NO: 3428599 - RNA, 16 nt, Human
aucagccaaguuuuau

SEQ ID NO: 3428600 - RNA, 19 nt, Human
aucagccaaguuuuauaau

SEQ ID NO: 3428601 - RNA, 15 nt, Human
aucagccacauucua

SEQ ID NO: 3428602 - RNA, 13 nt, Human
aucagccagacau

SEQ ID NO: 3428603 - RNA, 14 nt, Human
aucagccagcugcc

SEQ ID NO: 3428604 - RNA, 13 nt, Human
aucagccagugac

SEQ ID NO: 3428605 - RNA, 20 nt, Human
aucagcccaacgggaagcaa

SEQ ID NO: 3428606 - RNA, 16 nt, Human
aucagccccacccugg

SEQ ID NO: 3428607 - RNA, 12 nt, Human
aucagccugagu

SEQ ID NO: 3428608 - RNA, 17 nt, Human
aucagccugagucuccu

SEQ ID NO: 3428609 - RNA, 18 nt, Human
aucagccugcuccagcug

SEQ ID NO: 3428610 - RNA, 21 nt, Human
aucagccugggcaaugugaua

SEQ ID NO: 3428611 - RNA, 14 nt, Human
aucagccugucucu

SEQ ID NO: 3428612 - RNA, 18 nt, Human
aucagccugucucuucca

SEQ ID NO: 3428613 - RNA, 15 nt, Human
aucagcguggccuug

SEQ ID NO: 3428614 - RNA, 18 nt, Human
aucagcuacuuaagagaa

SEQ ID NO: 3428615 - RNA, 19 nt, Human
aucagcuacuuaagagaaa

SEQ ID NO: 3428616 - RNA, 20 nt, Human
aucagcuacuuaagagaaau

SEQ ID NO: 3428617 - RNA, 22 nt, Human
aucagcuacuuaagagaaaugg

SEQ ID NO: 3428618 - RNA, 15 nt, Human
aucagcuccuuccug

SEQ ID NO: 3428619 - RNA, 13 nt, Human
aucagcugcuacu

SEQ ID NO: 3428620 - RNA, 13 nt, Human
aucagcugcuuug

SEQ ID NO: 3428621 - RNA, 22 nt, Human
aucagcuggucaaacaaacucu

SEQ ID NO: 3428622 - RNA, 13 nt, Human
aucagcuuauugu

SEQ ID NO: 3428623 - RNA, 13 nt, Human
aucaggaacguuu

SEQ ID NO: 3428624 - RNA, 14 nt, Human
aucaggaagagaag

SEQ ID NO: 3428625 - RNA, 17 nt, Human
aucaggaagagaaggag

SEQ ID NO: 3428626 - RNA, 19 nt, Human
aucaggaagagaaggagca

SEQ ID NO: 3428627 - RNA, 23 nt, Human
aucaggagaaagcuugguucugu

SEQ ID NO: 3428628 - RNA, 13 nt, Human
aucaggaugaacc

SEQ ID NO: 3428629 - RNA, 15 nt, Human
aucaggcacagguca

SEQ ID NO: 3428630 - RNA, 13 nt, Human
aucaggccaggcc

SEQ ID NO: 3428631 - RNA, 16 nt, Human
aucaggccaggcccuc

SEQ ID NO: 3428632 - RNA, 20 nt, Human
aucaggccaggcccucugcc

SEQ ID NO: 3428633 - RNA, 21 nt, Human
aucaggccaggcccucugccc

SEQ ID NO: 3428634 - RNA, 23 nt, Human
aucaggccaggcccucugcccac

SEQ ID NO: 3428635 - RNA, 13 nt, Human
aucaggccauugu

SEQ ID NO: 3428636 - RNA, 19 nt, Human
aucaggccuagaggccuga

SEQ ID NO: 3428637 - RNA, 16 nt, Human
aucaggccugccagac

SEQ ID NO: 3428638 - RNA, 14 nt, Human
aucaggcucccagg

SEQ ID NO: 3428639 - RNA, 17 nt, Human
aucagggccuggggccu

SEQ ID NO: 3428640 - RNA, 19 nt, Human
aucagggccuggggccuga

SEQ ID NO: 3428641 - RNA, 21 nt, Human
aucagggggaagaagcagaga

SEQ ID NO: 3428642 - RNA, 17 nt, Human
aucaggguuaguauugu

SEQ ID NO: 3428643 - RNA, 20 nt, Human
aucagguccucagagaauuu

SEQ ID NO: 3428644 - RNA, 13 nt, Human
aucagguccugcu

SEQ ID NO: 3428645 - RNA, 19 nt, Human
aucagguccugcucagcag

SEQ ID NO: 3428646 - RNA, 19 nt, Human
aucaggugcugccauccag

SEQ ID NO: 3428647 - RNA, 22 nt, Human
aucagguuaggcaguauaaaga

SEQ ID NO: 3428648 - RNA, 21 nt, Human
aucaguaaaauuauacugugu

SEQ ID NO: 3428649 - RNA, 13 nt, Human
aucaguaaacacu

SEQ ID NO: 3428650 - RNA, 17 nt, Human
aucaguaagagguguua

SEQ ID NO: 3428651 - RNA, 23 nt, Human
aucaguaagagguguuauuugga

SEQ ID NO: 3428652 - RNA, 15 nt, Human
aucaguaauauuuau

SEQ ID NO: 3428653 - RNA, 19 nt, Human
aucaguaguuugcauuuca

SEQ ID NO: 3428654 - RNA, 21 nt, Human
aucaguaguuugcauuucaga

SEQ ID NO: 3428655 - RNA, 15 nt, Human
aucaguauugaagca

SEQ ID NO: 3428656 - RNA, 13 nt, Human
aucagucaagcug

SEQ ID NO: 3428657 - RNA, 13 nt, Human
aucaguccccucc

SEQ ID NO: 3428658 - RNA, 15 nt, Human
aucaguccccuccca

SEQ ID NO: 3428659 - RNA, 16 nt, Human
aucagucccuauguau

SEQ ID NO: 3428660 - RNA, 21 nt, Human
aucagucccuauguauuugca

SEQ ID NO: 3428661 - RNA, 16 nt, Human
aucaguccuagaaugu

SEQ ID NO: 3428662 - RNA, 16 nt, Human
aucagucucagaaugu

SEQ ID NO: 3428663 - RNA, 20 nt, Human
aucagugcucgagacacagu

SEQ ID NO: 3428664 - RNA, 16 nt, Human
aucaguggacagucug

SEQ ID NO: 3428665 - RNA, 15 nt, Human
aucaguggauuuccc

SEQ ID NO: 3428666 - RNA, 16 nt, Human
aucaguggauuuccca

SEQ ID NO: 3428667 - RNA, 22 nt, Human
aucaguggcauggcuccagucu

SEQ ID NO: 3428668 - RNA, 17 nt, Human
aucagugggauuuggua

SEQ ID NO: 3428669 - RNA, 18 nt, Human
aucagugggcaggauaaa

SEQ ID NO: 3428670 - RNA, 22 nt, Human
aucagugggcaggauaaacuga

SEQ ID NO: 3428671 - RNA, 15 nt, Human
aucagugucucacac

SEQ ID NO: 3428672 - RNA, 14 nt, Human
aucagugugccccc

SEQ ID NO: 3428673 - RNA, 15 nt, Human
aucagugugcccccc

SEQ ID NO: 3428674 - RNA, 22 nt, Human
aucagugugccccccauccugg

SEQ ID NO: 3428675 - RNA, 13 nt, Human
aucaguguuaaaa

SEQ ID NO: 3428676 - RNA, 19 nt, Human
aucaguguuuuaaauucug

SEQ ID NO: 3428677 - RNA, 12 nt, Human
aucaguuaacua

SEQ ID NO: 3428678 - RNA, 21 nt, Human
aucaguuacacaugaucauaa

SEQ ID NO: 3428679 - RNA, 15 nt, Human
aucaguuacucagcc

SEQ ID NO: 3428680 - RNA, 17 nt, Human
aucaguuacucagcccu

SEQ ID NO: 3428681 - RNA, 18 nt, Human
aucaguuacucagcccug

SEQ ID NO: 3428682 - RNA, 22 nt, Human
aucaguuauacaguuauaaaau

SEQ ID NO: 3428683 - RNA, 21 nt, Human
aucaguucauuagaaauauuu

SEQ ID NO: 3428684 - RNA, 17 nt, Human
aucaguuccuuugugug

SEQ ID NO: 3428685 - RNA, 21 nt, Human
aucaguugcaauaauacuucu

SEQ ID NO: 3428686 - RNA, 14 nt, Human
aucauaaacugugu

SEQ ID NO: 3428687 - RNA, 14 nt, Human
aucauaaagucagu

SEQ ID NO: 3428688 - RNA, 17 nt, Human
aucauaagauauuuuuc

SEQ ID NO: 3428689 - RNA, 19 nt, Human
aucauacuccuaugcuuua

SEQ ID NO: 3428690 - RNA, 17 nt, Human
aucauagauuucugauu

SEQ ID NO: 3428691 - RNA, 19 nt, Human
aucauagauuucugauuuu

SEQ ID NO: 3428692 - RNA, 21 nt, Human
aucauaggaagggaccaaggc

SEQ ID NO: 3428693 - RNA, 22 nt, Human
aucauaggaagggaccaaggca

SEQ ID NO: 3428694 - RNA, 23 nt, Human
aucauaggcaccuuuuacuguga

SEQ ID NO: 3428695 - RNA, 12 nt, Human
aucauaguacag

SEQ ID NO: 3428696 - RNA, 23 nt, Human
aucauaguggcuuaaaacaacac

SEQ ID NO: 3428697 - RNA, 16 nt, Human
aucauaguuuuauuua

SEQ ID NO: 3428698 - RNA, 17 nt, Human
aucauaguuuuauuuau

SEQ ID NO: 3428699 - RNA, 19 nt, Human
aucauaguuuuauuuauau

SEQ ID NO: 3428700 - RNA, 23 nt, Human
aucauaguuuuauuuauauuuau

SEQ ID NO: 3428701 - RNA, 14 nt, Human
aucauauaaauaga

SEQ ID NO: 3428702 - RNA, 13 nt, Human
aucauauaaauau

SEQ ID NO: 3428703 - RNA, 13 nt, Human
aucauaugauucu

SEQ ID NO: 3428704 - RNA, 13 nt, Human
aucauaugugauc

SEQ ID NO: 3428705 - RNA, 18 nt, Human
aucauaugugaucugucu

SEQ ID NO: 3428706 - RNA, 22 nt, Human
aucauaugugaucugucuugua

SEQ ID NO: 3428707 - RNA, 21 nt, Human
aucauauugguauucacuaau

SEQ ID NO: 3428708 - RNA, 12 nt, Human
aucaucaagaag

SEQ ID NO: 3428709 - RNA, 20 nt, Human
aucaucaagaagggcugcau

SEQ ID NO: 3428710 - RNA, 22 nt, Human
aucaucagcauaccuuuauugu

SEQ ID NO: 3428711 - RNA, 13 nt, Human
aucaucagggccu

SEQ ID NO: 3428712 - RNA, 15 nt, Human
aucaucaguauugaa

SEQ ID NO: 3428713 - RNA, 12 nt, Human
aucucucauccu

SEQ ID NO: 3428714 - RNA, 21 nt, Human
aucucucauccuccaguaccu

SEQ ID NO: 3428715 - RNA, 17 nt, Human
aucucuccacuuucagc

SEQ ID NO: 3428716 - RNA, 18 nt, Human
aucucuccacuuucagcu

SEQ ID NO: 3428717 - RNA, 14 nt, Human
aucucuccuggccu

SEQ ID NO: 3428718 - RNA, 22 nt, Human
aucucucgugauugauaagaac

SEQ ID NO: 3428719 - RNA, 21 nt, Human
aucucucuacuccuaccucag

SEQ ID NO: 3428720 - RNA, 22 nt, Human
aucucucuacuccuaccucagc

SEQ ID NO: 3428721 - RNA, 23 nt, Human
aucucucuacuccuaccucagcc

SEQ ID NO: 3428722 - RNA, 22 nt, Human
aucucucugaauccuaagggcu

SEQ ID NO: 3428723 - RNA, 15 nt, Human
aucucucugcagcug

SEQ ID NO: 3428724 - RNA, 17 nt, Human
aucucucuuuaauauaa

SEQ ID NO: 3428725 - RNA, 13 nt, Human
aucucugaaagca

SEQ ID NO: 3428726 - RNA, 16 nt, Human
aucucugaaugcccca

SEQ ID NO: 3428727 - RNA, 21 nt, Human
aucucugcaaucuucucagaa

SEQ ID NO: 3428728 - RNA, 17 nt, Human
aucucugcuuuggaaau

SEQ ID NO: 3428729 - RNA, 21 nt, Human
aucucugucccauucccuggg

SEQ ID NO: 3428730 - RNA, 20 nt, Human
aucucugucuaccaucuccc

SEQ ID NO: 3428731 - RNA, 17 nt, Human
aucuggcuccuuuacaa

SEQ ID NO: 3428732 - RNA, 19 nt, Human
aucuggcuccuuuacaaaa

SEQ ID NO: 3428733 - RNA, 21 nt, Human
aucuggcuccuuuacaaaaga

SEQ ID NO: 3428734 - RNA, 22 nt, Human
aucuggcugcaguuuugcuauc

SEQ ID NO: 3428735 - RNA, 16 nt, Human
aucugggaacucccaa

SEQ ID NO: 3428736 - RNA, 20 nt, Human
aucugggaacucccaagaac

SEQ ID NO: 3428737 - RNA, 15 nt, Human
aucugggaagcuauu

SEQ ID NO: 3428738 - RNA, 16 nt, Human
aucugggacccuuucc

SEQ ID NO: 3428739 - RNA, 20 nt, Human
aucugggaguccccuuuucu

SEQ ID NO: 3428740 - RNA, 15 nt, Human
aucugggcacugaag

SEQ ID NO: 3428741 - RNA, 12 nt, Human
aucugggccugg

SEQ ID NO: 3428742 - RNA, 10 nt, Human
aucugggcuu

SEQ ID NO: 3428743 - RNA, 20 nt, Human
aucugggcuuccuggagcag

SEQ ID NO: 3428744 - RNA, 18 nt, Human
aucuggggagcaggcagc

SEQ ID NO: 3428745 - RNA, 19 nt, Human
aucuggggagcaggcagcc

SEQ ID NO: 3428746 - RNA, 21 nt, Human
aucuggggagcaggcagccag

SEQ ID NO: 3428747 - RNA, 22 nt, Human
aucuggggagcaggcagccagc

SEQ ID NO: 3428748 - RNA, 23 nt, Human
aucuggggcagcacccuauaaau

SEQ ID NO: 3428749 - RNA, 18 nt, Human
aucugggggaguggaaua

SEQ ID NO: 3428750 - RNA, 14 nt, Human
aucuggguagcugu

SEQ ID NO: 3428751 - RNA, 17 nt, Human
aucuggguagcuguaag

SEQ ID NO: 3428752 - RNA, 22 nt, Human
aucugggugcaugaucuugagc

SEQ ID NO: 3428753 - RNA, 19 nt, Human
aucugguagaagggaaagc

SEQ ID NO: 3428754 - RNA, 14 nt, Human
aucuggucauuugg

SEQ ID NO: 3428755 - RNA, 17 nt, Human
aucuggucccuugcagc

SEQ ID NO: 3428756 - RNA, 14 nt, Human
aucugguccuaccc

SEQ ID NO: 3428757 - RNA, 21 nt, Human
aucugguccuacccauccccg

SEQ ID NO: 3428758 - RNA, 19 nt, Human
aucuggucuuguuagaaaa

SEQ ID NO: 3428759 - RNA, 21 nt, Human
aucuggucuuguuagaaaaca

SEQ ID NO: 3428760 - RNA, 10 nt, Human
aucuggugac

SEQ ID NO: 3428761 - RNA, 16 nt, Human
aucuggugacuuuccu

SEQ ID NO: 3428762 - RNA, 17 nt, Human
aucuggugacuuuccuc

SEQ ID NO: 3428763 - RNA, 14 nt, Human
aucuggugauuucu

SEQ ID NO: 3428764 - RNA, 18 nt, Human
aucugguggucagcccua

SEQ ID NO: 3428765 - RNA, 20 nt, Human
aucugguggucagcccuagg

SEQ ID NO: 3428766 - RNA, 17 nt, Human
aucugguuaggauggca

SEQ ID NO: 3428767 - RNA, 22 nt, Human
aucugguuugacuccgcuggag

SEQ ID NO: 3428768 - RNA, 20 nt, Human
aucuguaacagguauuuugu

SEQ ID NO: 3428769 - RNA, 16 nt, Human
aucuguaagcucuuug

SEQ ID NO: 3428770 - RNA, 15 nt, Human
aucuguaagcuguuu

SEQ ID NO: 3428771 - RNA, 13 nt, Human
aucuguacaauga

SEQ ID NO: 3428772 - RNA, 15 nt, Human
aucuguacaaugaac

SEQ ID NO: 3428773 - RNA, 11 nt, Human
aucuguacauu

SEQ ID NO: 3428774 - RNA, 15 nt, Human
aucuguacauuuugu

SEQ ID NO: 3428775 - RNA, 15 nt, Human
aucuguacguaagaa

SEQ ID NO: 3428776 - RNA, 12 nt, Human
aucuguagauac

SEQ ID NO: 3428777 - RNA, 22 nt, Human
aucuguagauacuagcuaucua

SEQ ID NO: 3428778 - RNA, 21 nt, Human
aucuguagcuauaaugagcau

SEQ ID NO: 3428779 - RNA, 21 nt, Human
aucuguauaaguaagaaaaua

SEQ ID NO: 3428780 - RNA, 18 nt, Human
aucuguauacccucuguu

SEQ ID NO: 3428781 - RNA, 16 nt, Human
aucuguauauaaaaua

SEQ ID NO: 3428782 - RNA, 13 nt, Human
aucuguaucucuc

SEQ ID NO: 3428783 - RNA, 14 nt, Human
aucuguaucucucu

SEQ ID NO: 3428784 - RNA, 18 nt, Human
aucuguauuuaauuuuga

SEQ ID NO: 3428785 - RNA, 17 nt, Human
aucugucaaaacacugu

SEQ ID NO: 3428786 - RNA, 12 nt, Human
aucugucauuug

SEQ ID NO: 3428787 - RNA, 22 nt, Human
aucugucauuugagcagggcuc

SEQ ID NO: 3428788 - RNA, 18 nt, Human
aucuguccaaaggaggcu

SEQ ID NO: 3428789 - RNA, 18 nt, Human
aucuguccucagccuugc

SEQ ID NO: 3428790 - RNA, 20 nt, Human
aucugucucccaguuaugaa

SEQ ID NO: 3428791 - RNA, 23 nt, Human
aucugucugcuggucacuucuuc

SEQ ID NO: 3428792 - RNA, 16 nt, Human
aucugucugguggccc

SEQ ID NO: 3428793 - RNA, 13 nt, Human
aucugucuuguaa

SEQ ID NO: 3428794 - RNA, 14 nt, Human
aucugucuuguaau

SEQ ID NO: 3428795 - RNA, 22 nt, Human
aucugucuuguaauauuuugua

SEQ ID NO: 3428796 - RNA, 18 nt, Human
aucugugaaaggaaagag

SEQ ID NO: 3428797 - RNA, 23 nt, Human
aucugugaaaggaaagagggagg

SEQ ID NO: 3428798 - RNA, 16 nt, Human
aucugugaaauaucau

SEQ ID NO: 3428799 - RNA, 18 nt, Human
aucugugaacuugaaauu

SEQ ID NO: 3428800 - RNA, 11 nt, Human
aucugugaaua

SEQ ID NO: 3428801 - RNA, 17 nt, Human
aucugugaauugagcug

SEQ ID NO: 3428802 - RNA, 17 nt, Human
aucugugauaauuuucu

SEQ ID NO: 3428803 - RNA, 16 nt, Human
aucugugcacugccca

SEQ ID NO: 3428804 - RNA, 16 nt, Human
aucugugcauucuccu

SEQ ID NO: 3428805 - RNA, 21 nt, Human
aucugugcccagagaugggac

SEQ ID NO: 3428806 - RNA, 12 nt, Human
aucugugcccca

SEQ ID NO: 3428807 - RNA, 23 nt, Human
aucugugccccaugccuguccag

SEQ ID NO: 3428808 - RNA, 23 nt, Human
aucugugccuuuuuuauaucuug

SEQ ID NO: 3428809 - RNA, 16 nt, Human
aucugugcgugaaaca

SEQ ID NO: 3428810 - RNA, 18 nt, Human
aucugugcgugaaacaca

SEQ ID NO: 3428811 - RNA, 22 nt, Human
aucugugggcauggucaaaggc

SEQ ID NO: 3428812 - RNA, 16 nt, Human
aucuguggucuucaaa

SEQ ID NO: 3428813 - RNA, 15 nt, Human
aucuguguacaaaga

SEQ ID NO: 3428814 - RNA, 16 nt, Human
aucuguguacaaagaa

SEQ ID NO: 3428815 - RNA, 13 nt, Human
aucugugucuugu

SEQ ID NO: 3428816 - RNA, 15 nt, Human
aucugugucuuguuu

SEQ ID NO: 3428817 - RNA, 13 nt, Human
aucugugugaaaa

SEQ ID NO: 3428818 - RNA, 16 nt, Human
aucuguguuuuugaaa

SEQ ID NO: 3428819 - RNA, 23 nt, Human
aucuguuauagguccuuuagaaa

SEQ ID NO: 3428820 - RNA, 14 nt, Human
aucuguucuaacau

SEQ ID NO: 3428821 - RNA, 20 nt, Human
aucuguucugggcucuuucc

SEQ ID NO: 3428822 - RNA, 18 nt, Human
aucuguugcaaacucagc

SEQ ID NO: 3428823 - RNA, 19 nt, Human
aucuguugcaagccccucu

SEQ ID NO: 3428824 - RNA, 17 nt, Human
aucuguuuacaguguuc

SEQ ID NO: 3428825 - RNA, 13 nt, Human
aucuguuucccag

SEQ ID NO: 3428826 - RNA, 14 nt, Human
aucuguuugagaaa

SEQ ID NO: 3428827 - RNA, 15 nt, Human
aucuguuugagaaag

SEQ ID NO: 3428828 - RNA, 14 nt, Human
aucuguuuuaaauu

SEQ ID NO: 3428829 - RNA, 21 nt, Human
aucuguuuuauaccuugcuua

SEQ ID NO: 3428830 - RNA, 19 nt, Human
aucuguuuugaaggcaaaa

SEQ ID NO: 3428831 - RNA, 18 nt, Human
aucuguuuuuaaaaauca

SEQ ID NO: 3428832 - RNA, 20 nt, Human
aucuguuuuuaaaaaucaua

SEQ ID NO: 3428833 - RNA, 18 nt, Human
aucuguuuuuacguaugu

SEQ ID NO: 3428834 - RNA, 22 nt, Human
aucuguuuuuguuuauuucauu

SEQ ID NO: 3428835 - RNA, 13 nt, Human
aucuuaaaaacaa

SEQ ID NO: 3428836 - RNA, 14 nt, Human
aucuuaaaaacaac

SEQ ID NO: 3428837 - RNA, 21 nt, Human
aucuuaaaaacaacgaaagaa

SEQ ID NO: 3428838 - RNA, 19 nt, Human
aucuuaaaagcuaucuuca

SEQ ID NO: 3428839 - RNA, 20 nt, Human
aucuuaaaagcuaucuucau

SEQ ID NO: 3428840 - RNA, 14 nt, Human
aucuuaacucuuug

SEQ ID NO: 3428841 - RNA, 13 nt, Human
aucuuaauacugu

SEQ ID NO: 3428842 - RNA, 17 nt, Human
aucuuaauguauaucgu

SEQ ID NO: 3428843 - RNA, 18 nt, Human
aucuuaauguaucaaacu

SEQ ID NO: 3428844 - RNA, 16 nt, Human
aucuuaauuauuguac

SEQ ID NO: 3428845 - RNA, 12 nt, Human
aucuuaauuuug

SEQ ID NO: 3428846 - RNA, 22 nt, Human
aucuuaauuuugguuguauucu

SEQ ID NO: 3428847 - RNA, 14 nt, Human
aucuuacaaagugu

SEQ ID NO: 3428848 - RNA, 22 nt, Human
aucuuacaaaguguauuuuaua

SEQ ID NO: 3428849 - RNA, 13 nt, Human
aucuuacagcugg

SEQ ID NO: 3428850 - RNA, 16 nt, Human
aucuuacuauuucaca

SEQ ID NO: 3428851 - RNA, 20 nt, Human
aucuuagauucucugugucu

SEQ ID NO: 3428852 - RNA, 15 nt, Human
aucuuagcugccaag

SEQ ID NO: 3428853 - RNA, 20 nt, Human
aucuuaggggagagcuuucu

SEQ ID NO: 3428854 - RNA, 15 nt, Human
aucuuagggugaacc

SEQ ID NO: 3428855 - RNA, 14 nt, Human
aucuuaguuuggau

SEQ ID NO: 3428856 - RNA, 23 nt, Human
aucuuaguuuggauucuuaugua

SEQ ID NO: 3428857 - RNA, 16 nt, Human
aucuuauaauuuaaaa

SEQ ID NO: 3428858 - RNA, 23 nt, Human
aucuuauaauuuaaaauaugcuc

SEQ ID NO: 3428859 - RNA, 16 nt, Human
aucuuauacuguacaa

SEQ ID NO: 3428860 - RNA, 15 nt, Human
aucuuauaguucuag

SEQ ID NO: 3428861 - RNA, 18 nt, Human
aucuuaucauggucucag

SEQ ID NO: 3428862 - RNA, 21 nt, Human
aucuuaucucagauauuugca

SEQ ID NO: 3428863 - RNA, 20 nt, Human
aucuuauucauuuucucuaa

SEQ ID NO: 3428864 - RNA, 16 nt, Human
aucuuauuuucaugua

SEQ ID NO: 3428865 - RNA, 19 nt, Human
aucuucaaaaguaaugccu

SEQ ID NO: 3428866 - RNA, 23 nt, Human
aucuucaaaaguaaugccucugu

SEQ ID NO: 3428867 - RNA, 24 nt, Human
aucuucaaaaguaaugccucuguc

SEQ ID NO: 3428868 - RNA, 18 nt, Human
aucuucaaagccuucucc

SEQ ID NO: 3428869 - RNA, 14 nt, Human
aucuucaacaaauu

SEQ ID NO: 3428870 - RNA, 21 nt, Human
aucuucacaauggugcucauu

SEQ ID NO: 3428871 - RNA, 14 nt, Human
aucuucagagcagg

SEQ ID NO: 3428872 - RNA, 12 nt, Human
aucuucagcuuc

SEQ ID NO: 3428873 - RNA, 13 nt, Human
aucuucagcuucu

SEQ ID NO: 3428874 - RNA, 15 nt, Human
aucuucagcuucuuc

SEQ ID NO: 3428875 - RNA, 16 nt, Human
aucuucaguugucucu

SEQ ID NO: 3428876 - RNA, 15 nt, Human
augaggucagacuag

SEQ ID NO: 3428877 - RNA, 16 nt, Human
augaggucagagccug

SEQ ID NO: 3428878 - RNA, 19 nt, Human
augaggucagagccugcag

SEQ ID NO: 3428879 - RNA, 22 nt, Human
augaggucagagccugcaguua

SEQ ID NO: 3428880 - RNA, 14 nt, Human
augaggucccaggc

SEQ ID NO: 3428881 - RNA, 15 nt, Human
augaggucugaaaug

SEQ ID NO: 3428882 - RNA, 15 nt, Human
augaggugcugggag

SEQ ID NO: 3428883 - RNA, 16 nt, Human
augaggugcugggagg

SEQ ID NO: 3428884 - RNA, 18 nt, Human
augaggugcugggaggga

SEQ ID NO: 3428885 - RNA, 14 nt, Human
augagguucucucu

SEQ ID NO: 3428886 - RNA, 18 nt, Human
augaguaacuauuauuau

SEQ ID NO: 3428887 - RNA, 19 nt, Human
augaguauuaguucccugu

SEQ ID NO: 3428888 - RNA, 16 nt, Human
augagucaaugugcag

SEQ ID NO: 3428889 - RNA, 15 nt, Human
augagucccaguggg

SEQ ID NO: 3428890 - RNA, 20 nt, Human
augaguccuugaaaauauuu

SEQ ID NO: 3428891 - RNA, 19 nt, Human
augaguccuugauuucaaa

SEQ ID NO: 3428892 - RNA, 21 nt, Human
augaguccuugauuucaaagu

SEQ ID NO: 3428893 - RNA, 15 nt, Human
augagugaauaaaug

SEQ ID NO: 3428894 - RNA, 21 nt, Human
augaguggaaauuaagacuuu

SEQ ID NO: 3428895 - RNA, 16 nt, Human
augaguguaacaagaa

SEQ ID NO: 3428896 - RNA, 17 nt, Human
augaguguaacaagaaa

SEQ ID NO: 3428897 - RNA, 22 nt, Human
augaguguaacaagaaaggaga

SEQ ID NO: 3428898 - RNA, 16 nt, Human
augaguuacugugcau

SEQ ID NO: 3428899 - RNA, 23 nt, Human
augaguuagaauaauaaauauuu

SEQ ID NO: 3428900 - RNA, 17 nt, Human
augaguuaugaguuauu

SEQ ID NO: 3428901 - RNA, 13 nt, Human
augaguugcaguu

SEQ ID NO: 3428902 - RNA, 13 nt, Human
augaguuuaaaaa

SEQ ID NO: 3428903 - RNA, 13 nt, Human
augaguuucacag

SEQ ID NO: 3428904 - RNA, 13 nt, Human
augaguuuuuccc

SEQ ID NO: 3428905 - RNA, 13 nt, Human
augaguuuuugau

SEQ ID NO: 3428906 - RNA, 15 nt, Human
augauaaaaaauuuu

SEQ ID NO: 3428907 - RNA, 15 nt, Human
augauaaaacacaaa

SEQ ID NO: 3428908 - RNA, 14 nt, Human
augauaaagagaca

SEQ ID NO: 3428909 - RNA, 20 nt, Human
augauaaagagacagugaua

SEQ ID NO: 3428910 - RNA, 15 nt, Human
augauaacacuauuu

SEQ ID NO: 3428911 - RNA, 14 nt, Human
augauaacagaacu

SEQ ID NO: 3428912 - RNA, 14 nt, Human
augauaacuggaaa

SEQ ID NO: 3428913 - RNA, 15 nt, Human
augauaacuggaaac

SEQ ID NO: 3428914 - RNA, 15 nt, Human
augauacauccaaag

SEQ ID NO: 3428915 - RNA, 19 nt, Human
augauacuaauaaacuaau

SEQ ID NO: 3428916 - RNA, 21 nt, Human
augauacuaucauacuacuga

SEQ ID NO: 3428917 - RNA, 18 nt, Human
augauacucauuucuuau

SEQ ID NO: 3428918 - RNA, 16 nt, Human
augauacuucgacacu

SEQ ID NO: 3428919 - RNA, 17 nt, Human
augauaguaagaaaagu

SEQ ID NO: 3428920 - RNA, 14 nt, Human
augauaucccugau

SEQ ID NO: 3428921 - RNA, 12 nt, Human
augauaugcauu

SEQ ID NO: 3428922 - RNA, 19 nt, Human
augauauuccauaguauau

SEQ ID NO: 3428923 - RNA, 23 nt, Human
augauauugcugaagaaucuacu

SEQ ID NO: 3428924 - RNA, 15 nt, Human
augaucaaaaauaau

SEQ ID NO: 3428925 - RNA, 16 nt, Human
augaucaaauguuuaa

SEQ ID NO: 3428926 - RNA, 20 nt, Human
augaucaaauguuuaaucau

SEQ ID NO: 3428927 - RNA, 20 nt, Human
augaucaauuauaguuucug

SEQ ID NO: 3428928 - RNA, 19 nt, Human
augaucacuuaucaguuug

SEQ ID NO: 3428929 - RNA, 21 nt, Human
augauccaacuaaugccuuac

SEQ ID NO: 3428930 - RNA, 15 nt, Human
augauccaagcaaga

SEQ ID NO: 3428931 - RNA, 17 nt, Human
augauccaagcaagacu

SEQ ID NO: 3428932 - RNA, 13 nt, Human
augaucccugugu

SEQ ID NO: 3428933 - RNA, 20 nt, Human
augaucccuguguugucucu

SEQ ID NO: 3428934 - RNA, 19 nt, Human
aucucccagauaaugugaa

SEQ ID NO: 3428935 - RNA, 20 nt, Human
aucucccagauaaugugaaa

SEQ ID NO: 3428936 - RNA, 19 nt, Human
aucucccauuuuggaauuu

SEQ ID NO: 3428937 - RNA, 23 nt, Human
aucuccccuugcacuaaaguaug

SEQ ID NO: 3428938 - RNA, 15 nt, Human
aucucccgcugcugc

SEQ ID NO: 3428939 - RNA, 14 nt, Human
aucucccucccaca

SEQ ID NO: 3428940 - RNA, 20 nt, Human
aucucccugagaugggcuuc

SEQ ID NO: 3428941 - RNA, 12 nt, Human
aucucccugccg

SEQ ID NO: 3428942 - RNA, 19 nt, Human
aucucccugccgccucaau

SEQ ID NO: 3428943 - RNA, 16 nt, Human
aucucccugccuccug

SEQ ID NO: 3428944 - RNA, 13 nt, Human
aucucccugccug

SEQ ID NO: 3428945 - RNA, 15 nt, Human
aucucccugccuggc

SEQ ID NO: 3428946 - RNA, 17 nt, Human
aucucccugccuggccc

SEQ ID NO: 3428947 - RNA, 14 nt, Human
aucucccuggugcu

SEQ ID NO: 3428948 - RNA, 18 nt, Human
aucucccuggugcuuaug

SEQ ID NO: 3428949 - RNA, 23 nt, Human
aucucccuggugcuuaugcucuu

SEQ ID NO: 3428950 - RNA, 12 nt, Human
aucucccuuccu

SEQ ID NO: 3428951 - RNA, 22 nt, Human
aucuccggcucccagccucagc

SEQ ID NO: 3428952 - RNA, 20 nt, Human
aucuccuauaaucugucaaa

SEQ ID NO: 3428953 - RNA, 20 nt, Human
aucuccucgcaagcugggua

SEQ ID NO: 3428954 - RNA, 12 nt, Human
aucuccugaaaa

SEQ ID NO: 3428955 - RNA, 17 nt, Human
aucuccugacagaaggu

SEQ ID NO: 3428956 - RNA, 18 nt, Human
aucuccugacagaaggug

SEQ ID NO: 3428957 - RNA, 20 nt, Human
aucuccugaggaucagaaag

SEQ ID NO: 3428958 - RNA, 22 nt, Human
aucuccugaggaucagaaagua

SEQ ID NO: 3428959 - RNA, 17 nt, Human
aucuccugccuuccucc

SEQ ID NO: 3428960 - RNA, 20 nt, Human
aucuccugccuuccuccugg

SEQ ID NO: 3428961 - RNA, 19 nt, Human
aucuccugucuuuucaggu

SEQ ID NO: 3428962 - RNA, 18 nt, Human
aucuccugugcaugggug

SEQ ID NO: 3428963 - RNA, 16 nt, Human
aucuccuuagaaaagc

SEQ ID NO: 3428964 - RNA, 17 nt, Human
aucucgcucccucccag

SEQ ID NO: 3428965 - RNA, 19 nt, Human
aucucgcucccucccagga

SEQ ID NO: 3428966 - RNA, 15 nt, Human
aucucggcucagugc

SEQ ID NO: 3428967 - RNA, 15 nt, Human
aucucgugggagagc

SEQ ID NO: 3428968 - RNA, 17 nt, Human
aucucguuucaaaaaca

SEQ ID NO: 3428969 - RNA, 18 nt, Human
aucucuaacagcucagga

SEQ ID NO: 3428970 - RNA, 13 nt, Human
aucucuaauaugg

SEQ ID NO: 3428971 - RNA, 22 nt, Human
aucucuaauauggcaaaaaugg

SEQ ID NO: 3428972 - RNA, 15 nt, Human
aucucuaauuggaag

SEQ ID NO: 3428973 - RNA, 23 nt, Human
aucucuaauuggaagaaauuccu

SEQ ID NO: 3428974 - RNA, 18 nt, Human
aucucuacuaaaaauaca

SEQ ID NO: 3428975 - RNA, 15 nt, Human
aucucuagaauuuua

SEQ ID NO: 3428976 - RNA, 16 nt, Human
aucucuagaauuuuaa

SEQ ID NO: 3428977 - RNA, 14 nt, Human
aucucuaggaaguc

SEQ ID NO: 3428978 - RNA, 15 nt, Human
aucucucaaaacuug

SEQ ID NO: 3428979 - RNA, 14 nt, Human
aucucucaaaucug

SEQ ID NO: 3428980 - RNA, 15 nt, Human
aucucucaaaucugu

SEQ ID NO: 3428981 - RNA, 17 nt, Human
aucucucagaagggagg

SEQ ID NO: 3428982 - RNA, 14 nt, Human
aucucucaggagca

SEQ ID NO: 3428983 - RNA, 21 nt, Human
aucucucaggagcacaggcag

SEQ ID NO: 3428984 - RNA, 20 nt, Human
aucucuccacuuucagcugu

SEQ ID NO: 3428985 - RNA, 21 nt, Human
aucucuccacuuucagcuguc

SEQ ID NO: 3428986 - RNA, 11 nt, Human
aucucucccuc

SEQ ID NO: 3428987 - RNA, 12 nt, Human
aucucuccucca

SEQ ID NO: 3428988 - RNA, 12 nt, Human
aucucuccuggc

SEQ ID NO: 3428989 - RNA, 13 nt, Human
aucucuccuggcc

SEQ ID NO: 3428990 - RNA, 22 nt, Human
aucucuccuggccuauccgcug

SEQ ID NO: 3428991 - RNA, 20 nt, Human
aucucucgguuccacguccc

SEQ ID NO: 3428992 - RNA, 15 nt, Human
aucucucucuguugu

SEQ ID NO: 3428993 - RNA, 21 nt, Human
aucucucucuguuguguucgu

SEQ ID NO: 3428994 - RNA, 14 nt, Human
aucucucugcagcu

SEQ ID NO: 3428995 - RNA, 17 nt, Human
aucucucugcagcugcc

SEQ ID NO: 3428996 - RNA, 13 nt, Human
aucucucuggccc

SEQ ID NO: 3428997 - RNA, 14 nt, Human
aucucucuggcccu

SEQ ID NO: 3428998 - RNA, 15 nt, Human
aucucucuucuuuuc

SEQ ID NO: 3428999 - RNA, 13 nt, Human
aucucugaagcau

SEQ ID NO: 3429000 - RNA, 17 nt, Human
aucucugaagcauguuu

SEQ ID NO: 3429001 - RNA, 19 nt, Human
aucucugaagcauguuuca

SEQ ID NO: 3429002 - RNA, 20 nt, Human
aucucugaagcauguuucau

SEQ ID NO: 3429003 - RNA, 23 nt, Human
aucucugacuuucuuuagucuuu

SEQ ID NO: 3429004 - RNA, 23 nt, Human
aucucugauucccugauuuaaua

SEQ ID NO: 3429005 - RNA, 18 nt, Human
aucucugcaaucuucuca

SEQ ID NO: 3429006 - RNA, 23 nt, Human
aucucugggcuggaugagcuccc

SEQ ID NO: 3429007 - RNA, 21 nt, Human
aucucugggggcugaggagca

SEQ ID NO: 3429008 - RNA, 20 nt, Human
aucucugucccauucccugg

SEQ ID NO: 3429009 - RNA, 17 nt, Human
aucucugucuaccaucu

SEQ ID NO: 3429010 - RNA, 18 nt, Human
aucucugugccuucgucu

SEQ ID NO: 3429011 - RNA, 15 nt, Human
aucucugugugcaca

SEQ ID NO: 3429012 - RNA, 19 nt, Human
aucucugugugcacaaaua

SEQ ID NO: 3429013 - RNA, 13 nt, Human
aucucuguuaugu

SEQ ID NO: 3429014 - RNA, 19 nt, Human
aucucuguuauguacugua

SEQ ID NO: 3429015 - RNA, 23 nt, Human
aucucuuaaauuggguucaugau

SEQ ID NO: 3429016 - RNA, 21 nt, Human
aucucuuaagacagcaugugu

SEQ ID NO: 3429017 - RNA, 19 nt, Human
aucucuuagcuccccucca

SEQ ID NO: 3429018 - RNA, 22 nt, Human
aucucuuagcuccccuccaacc

SEQ ID NO: 3429019 - RNA, 18 nt, Human
aucucuuaucuuacgaaa

SEQ ID NO: 3429020 - RNA, 16 nt, Human
aucucuuauuuuacaa

SEQ ID NO: 3429021 - RNA, 18 nt, Human
aucugggggccucuucug

SEQ ID NO: 3429022 - RNA, 18 nt, Human
aucuggguagcuguaagg

SEQ ID NO: 3429023 - RNA, 14 nt, Human
aucuggguccuugc

SEQ ID NO: 3429024 - RNA, 18 nt, Human
aucugggucucuaaucug

SEQ ID NO: 3429025 - RNA, 15 nt, Human
aucugggugacugag

SEQ ID NO: 3429026 - RNA, 21 nt, Human
aucugggugcaugaucuugag

SEQ ID NO: 3429027 - RNA, 22 nt, Human
aucugguaccaguugaaauuuu

SEQ ID NO: 3429028 - RNA, 23 nt, Human
aucugguagaagggaaagcccau

SEQ ID NO: 3429029 - RNA, 17 nt, Human
aucugguccuacccauc

SEQ ID NO: 3429030 - RNA, 14 nt, Human
aucuggugaucucc

SEQ ID NO: 3429031 - RNA, 15 nt, Human
aucuggugauuucua

SEQ ID NO: 3429032 - RNA, 17 nt, Human
aucuggugauuucuagc

SEQ ID NO: 3429033 - RNA, 15 nt, Human
aucugguggucagcc

SEQ ID NO: 3429034 - RNA, 21 nt, Human
aucugguucauucuucagaua

SEQ ID NO: 3429035 - RNA, 15 nt, Human
aucugguuuucucuc

SEQ ID NO: 3429036 - RNA, 15 nt, Human
aucugguuuugcuau

SEQ ID NO: 3429037 - RNA, 15 nt, Human
aucuguaaaucuaca

SEQ ID NO: 3429038 - RNA, 17 nt, Human
aucuguaagaguguuua

SEQ ID NO: 3429039 - RNA, 12 nt, Human
aucuguaagcug

SEQ ID NO: 3429040 - RNA, 14 nt, Human
aucuguaagcuguu

SEQ ID NO: 3429041 - RNA, 18 nt, Human
aucuguaaugguacugac

SEQ ID NO: 3429042 - RNA, 23 nt, Human
aucuguacaaaggggaaagaaca

SEQ ID NO: 3429043 - RNA, 21 nt, Human
aucuguacauuuuguuguaaa

SEQ ID NO: 3429044 - RNA, 23 nt, Human
aucuguacuugguccaacugcaa

SEQ ID NO: 3429045 - RNA, 15 nt, Human
aucuguagggcugga

SEQ ID NO: 3429046 - RNA, 17 nt, Human
aucuguagggcuggacc

SEQ ID NO: 3429047 - RNA, 18 nt, Human
aucuguagggcuggaccu

SEQ ID NO: 3429048 - RNA, 19 nt, Human
aucuguauaaguaagaaaa

SEQ ID NO: 3429049 - RNA, 23 nt, Human
aucuguauaaguaagaaaauauu

SEQ ID NO: 3429050 - RNA, 18 nt, Human
aucuguauaauacuuugu

SEQ ID NO: 3429051 - RNA, 14 nt, Human
aucuguauauacaa

SEQ ID NO: 3429052 - RNA, 20 nt, Human
aucuguauauacaauaacau

SEQ ID NO: 3429053 - RNA, 17 nt, Human
aucuguaucuuuucucu

SEQ ID NO: 3429054 - RNA, 23 nt, Human
aucuguauguauuagugauauuu

SEQ ID NO: 3429055 - RNA, 17 nt, Human
aucuguauuuaauuuug

SEQ ID NO: 3429056 - RNA, 18 nt, Human
aucugucaaaacacugug

SEQ ID NO: 3429057 - RNA, 19 nt, Human
aucugucaaaacacugugg

SEQ ID NO: 3429058 - RNA, 20 nt, Human
aucugucaaaacacugugga

SEQ ID NO: 3429059 - RNA, 22 nt, Human
aucugucaaaacacuguggaac

SEQ ID NO: 3429060 - RNA, 23 nt, Human
aucugucaagugggaucugucac

SEQ ID NO: 3429061 - RNA, 18 nt, Human
aucugucacaccagccau

SEQ ID NO: 3429062 - RNA, 17 nt, Human
aucugucauuugagcag

SEQ ID NO: 3429063 - RNA, 19 nt, Human
aucuguccaaaggaggcug

SEQ ID NO: 3429064 - RNA, 23 nt, Human
aucuguccaaaggaggcuggcag

SEQ ID NO: 3429065 - RNA, 18 nt, Human
aucugucccccuuuagau

SEQ ID NO: 3429066 - RNA, 16 nt, Human
aucugucccugccuca

SEQ ID NO: 3429067 - RNA, 16 nt, Human
aucuguccucagccuu

SEQ ID NO: 3429068 - RNA, 17 nt, Human
aucugucuaaagauaga

SEQ ID NO: 3429069 - RNA, 18 nt, Human
aucugucuauauuuuauu

SEQ ID NO: 3429070 - RNA, 18 nt, Human
aucugucucccaguuaug

SEQ ID NO: 3429071 - RNA, 19 nt, Human
aucugucugccaaccuaaa

SEQ ID NO: 3429072 - RNA, 23 nt, Human
aucugucugccaaccuaaaacuc

SEQ ID NO: 3429073 - RNA, 14 nt, Human
aucugucugguggc

SEQ ID NO: 3429074 - RNA, 15 nt, Human
aucugucuguggcaa

SEQ ID NO: 3429075 - RNA, 15 nt, Human
aucugucuuguaaua

SEQ ID NO: 3429076 - RNA, 16 nt, Human
aucugucuuguaauau

SEQ ID NO: 3429077 - RNA, 21 nt, Human
aucugucuuguaauauuuugu

SEQ ID NO: 3429078 - RNA, 13 nt, Human
aucugucuuucca

SEQ ID NO: 3429079 - RNA, 20 nt, Human
aucugucuuuccacucugga

SEQ ID NO: 3429080 - RNA, 12 nt, Human
aucugugaaaua

SEQ ID NO: 3429081 - RNA, 17 nt, Human
aucugugaaauaucauc

SEQ ID NO: 3429082 - RNA, 21 nt, Human
aucugugaugacauucccugc

SEQ ID NO: 3429083 - RNA, 14 nt, Human
aucugugaugggag

SEQ ID NO: 3429084 - RNA, 17 nt, Human
aucugugcccagagaug

SEQ ID NO: 3429085 - RNA, 15 nt, Human
aucugugcuuuccag

SEQ ID NO: 3429086 - RNA, 16 nt, Human
aucugugcuuuccagc

SEQ ID NO: 3429087 - RNA, 18 nt, Human
aucuguguacaaagaaau

SEQ ID NO: 3429088 - RNA, 13 nt, Human
aucuguguccugg

SEQ ID NO: 3429089 - RNA, 12 nt, Human
aucugugucuug

SEQ ID NO: 3429090 - RNA, 15 nt, Human
aucugugugaaaaug

SEQ ID NO: 3429091 - RNA, 20 nt, Human
aucugugugaaacuuucauu

SEQ ID NO: 3429092 - RNA, 21 nt, Human
aucuguguuuuugaaauauua

SEQ ID NO: 3429093 - RNA, 22 nt, Human
augauccggauuuaauuugaua

SEQ ID NO: 3429094 - RNA, 23 nt, Human
augaucuaccagccucccuauuu

SEQ ID NO: 3429095 - RNA, 17 nt, Human
augaucuaggaagacuu

SEQ ID NO: 3429096 - RNA, 16 nt, Human
augaucuagguuuaac

SEQ ID NO: 3429097 - RNA, 17 nt, Human
augaucuagguuuaacu

SEQ ID NO: 3429098 - RNA, 14 nt, Human
augaucucucugaa

SEQ ID NO: 3429099 - RNA, 22 nt, Human
augaucucuucuuuuggcuucc

SEQ ID NO: 3429100 - RNA, 14 nt, Human
augaucugaaaaau

SEQ ID NO: 3429101 - RNA, 13 nt, Human
augaucugauuga

SEQ ID NO: 3429102 - RNA, 23 nt, Human
augaucugugccuuuuuuauauc

SEQ ID NO: 3429103 - RNA, 18 nt, Human
augaucuucuuuauaauu

SEQ ID NO: 3429104 - RNA, 23 nt, Human
augaucuugaguauaagaaaugc

SEQ ID NO: 3429105 - RNA, 17 nt, Human
augaucuuugcagacag

SEQ ID NO: 3429106 - RNA, 13 nt, Human
augaugaaaauau

SEQ ID NO: 3429107 - RNA, 19 nt, Human
augaugaaaauauuuaaag

SEQ ID NO: 3429108 - RNA, 23 nt, Human
augaugaaaugaggucagagccu

SEQ ID NO: 3429109 - RNA, 22 nt, Human
augaugacgacgacaacgauga

SEQ ID NO: 3429110 - RNA, 21 nt, Human
augaugaucuuuaaaauacac

SEQ ID NO: 3429111 - RNA, 15 nt, Human
augaugaugggaauu

SEQ ID NO: 3429112 - RNA, 18 nt, Human
augaugaugggaauugug

SEQ ID NO: 3429113 - RNA, 14 nt, Human
augaugauuucaga

SEQ ID NO: 3429114 - RNA, 22 nt, Human
augaugcagucuccucuuuaaa

SEQ ID NO: 3429115 - RNA, 17 nt, Human
augaugccaaccucugg

SEQ ID NO: 3429116 - RNA, 12 nt, Human
augaugccacac

SEQ ID NO: 3429117 - RNA, 24 nt, Human
augaugccacaccaagcugugcca

SEQ ID NO: 3429118 - RNA, 17 nt, Human
augaugcuauuugcaau

SEQ ID NO: 3429119 - RNA, 21 nt, Human
augaugcuuuuacugaacuuu

SEQ ID NO: 3429120 - RNA, 20 nt, Human
augauggcccauucuacuug

SEQ ID NO: 3429121 - RNA, 16 nt, Human
augaugggucaguugu

SEQ ID NO: 3429122 - RNA, 16 nt, Human
augauggucacuuaaa

SEQ ID NO: 3429123 - RNA, 16 nt, Human
augauggugcugaccu

SEQ ID NO: 3429124 - RNA, 14 nt, Human
augaugguucacgu

SEQ ID NO: 3429125 - RNA, 17 nt, Human
augaugguuuuaaacuu

SEQ ID NO: 3429126 - RNA, 14 nt, Human
augauguacagauu

SEQ ID NO: 3429127 - RNA, 16 nt, Human
augauguauuuuugua

SEQ ID NO: 3429128 - RNA, 14 nt, Human
augauguguuguga

SEQ ID NO: 3429129 - RNA, 17 nt, Human
augauguuaguuuuccu

SEQ ID NO: 3429130 - RNA, 18 nt, Human
augauguugaauauuugu

SEQ ID NO: 3429131 - RNA, 11 nt, Human
augauguuugc

SEQ ID NO: 3429132 - RNA, 14 nt, Human
augauguuugccca

SEQ ID NO: 3429133 - RNA, 24 nt, Human
augauguuuuccaugaguccccug

SEQ ID NO: 3429134 - RNA, 17 nt, Human
augauuaaaaauaucaa

SEQ ID NO: 3429135 - RNA, 16 nt, Human
augauuaaaaugguga

SEQ ID NO: 3429136 - RNA, 18 nt, Human
augauuaaauaagauucu

SEQ ID NO: 3429137 - RNA, 18 nt, Human
augauuaaguaaugauaa

SEQ ID NO: 3429138 - RNA, 14 nt, Human
augauuagcaaguu

SEQ ID NO: 3429139 - RNA, 21 nt, Human
augauucaacagguuuuccug

SEQ ID NO: 3429140 - RNA, 13 nt, Human
augauucaagcca

SEQ ID NO: 3429141 - RNA, 14 nt, Human
augauucaggugca

SEQ ID NO: 3429142 - RNA, 15 nt, Human
augauucauguuaua

SEQ ID NO: 3429143 - RNA, 13 nt, Human
augauucauuuua

SEQ ID NO: 3429144 - RNA, 13 nt, Human
augauuccuuccu

SEQ ID NO: 3429145 - RNA, 12 nt, Human
augauugaaaau

SEQ ID NO: 3429146 - RNA, 13 nt, Human
augauugaagaaa

SEQ ID NO: 3429147 - RNA, 12 nt, Human
augauugcagaa

SEQ ID NO: 3429148 - RNA, 19 nt, Human
augauugcagaauuguuua

SEQ ID NO: 3429149 - RNA, 14 nt, Human
augauugcuuuuaa

SEQ ID NO: 3429150 - RNA, 13 nt, Human
augauuggauuau

SEQ ID NO: 3429151 - RNA, 14 nt, Human
augauuggauuauu

SEQ ID NO: 3429152 - RNA, 15 nt, Human
augauuggauuauuc

SEQ ID NO: 3429153 - RNA, 14 nt, Human
augauuguaaaaua

SEQ ID NO: 3429154 - RNA, 13 nt, Human
augauuuaaaaca

SEQ ID NO: 3429155 - RNA, 14 nt, Human
augauuuaaaacau

SEQ ID NO: 3429156 - RNA, 16 nt, Human
augauuuaauaaaaua

SEQ ID NO: 3429157 - RNA, 20 nt, Human
augauuuauaguuuguacau

SEQ ID NO: 3429158 - RNA, 13 nt, Human
augauuucacaaa

SEQ ID NO: 3429159 - RNA, 15 nt, Human
augauuucacaaaua

SEQ ID NO: 3429160 - RNA, 18 nt, Human
augauuucacaaauauua

SEQ ID NO: 3429161 - RNA, 20 nt, Human
augauuucacuagaaaagcu

SEQ ID NO: 3429162 - RNA, 15 nt, Human
augauuucagaaaca

SEQ ID NO: 3429163 - RNA, 20 nt, Human
augauuucaugcuaucucug

SEQ ID NO: 3429164 - RNA, 16 nt, Human
augauuucauguacug

SEQ ID NO: 3429165 - RNA, 13 nt, Human
augauuucauuca

SEQ ID NO: 3429166 - RNA, 16 nt, Human
augcugcaacaaaaug

SEQ ID NO: 3429167 - RNA, 18 nt, Human
augcugcaggacuugaga

SEQ ID NO: 3429168 - RNA, 14 nt, Human
augcugccaaauuu

SEQ ID NO: 3429169 - RNA, 14 nt, Human
augcugccaauauc

SEQ ID NO: 3429170 - RNA, 18 nt, Human
augcugccaauauccuaa

SEQ ID NO: 3429171 - RNA, 20 nt, Human
augcugccaauauccuaaua

SEQ ID NO: 3429172 - RNA, 16 nt, Human
augcugccccugccuu

SEQ ID NO: 3429173 - RNA, 12 nt, Human
augcugccucca

SEQ ID NO: 3429174 - RNA, 12 nt, Human
augcugccugag

SEQ ID NO: 3429175 - RNA, 14 nt, Human
augcugccugccug

SEQ ID NO: 3429176 - RNA, 15 nt, Human
augcugccugccugu

SEQ ID NO: 3429177 - RNA, 22 nt, Human
augcugccuucccaugaaucug

SEQ ID NO: 3429178 - RNA, 21 nt, Human
augcugcuacuuaauuccuuu

SEQ ID NO: 3429179 - RNA, 23 nt, Human
augcugcucauccccaccugucu

SEQ ID NO: 3429180 - RNA, 13 nt, Human
augcugcugcccc

SEQ ID NO: 3429181 - RNA, 22 nt, Human
augcugcugccccugcacagca

SEQ ID NO: 3429182 - RNA, 13 nt, Human
augcugcuggcca

SEQ ID NO: 3429183 - RNA, 14 nt, Human
augcugcuggccaa

SEQ ID NO: 3429184 - RNA, 13 nt, Human
augcugcugggga

SEQ ID NO: 3429185 - RNA, 14 nt, Human
augcugcuggggaa

SEQ ID NO: 3429186 - RNA, 16 nt, Human
augcugcuggggaaga

SEQ ID NO: 3429187 - RNA, 17 nt, Human
augcugcuggggaagac

SEQ ID NO: 3429188 - RNA, 18 nt, Human
augcugcuggggaagaca

SEQ ID NO: 3429189 - RNA, 19 nt, Human
augcugcuggggaagacag

SEQ ID NO: 3429190 - RNA, 19 nt, Human
augcugcuuuaauugugaa

SEQ ID NO: 3429191 - RNA, 21 nt, Human
augcugcuuuaauugugaauu

SEQ ID NO: 3429192 - RNA, 13 nt, Human
augcugcuuuccc

SEQ ID NO: 3429193 - RNA, 20 nt, Human
augcugcuuuccccuguggg

SEQ ID NO: 3429194 - RNA, 21 nt, Human
augcugcuuuucuuuucuaac

SEQ ID NO: 3429195 - RNA, 13 nt, Human
augcugcuuuuuc

SEQ ID NO: 3429196 - RNA, 18 nt, Human
augcuggaaccugcaaaa

SEQ ID NO: 3429197 - RNA, 23 nt, Human
augcuggaaccugcaaaaaauac

SEQ ID NO: 3429198 - RNA, 21 nt, Human
augcuggacaggucugggaga

SEQ ID NO: 3429199 - RNA, 21 nt, Human
augcuggacggcauuccugcu

SEQ ID NO: 3429200 - RNA, 22 nt, Human
augcuggacggcauuccugcuu

SEQ ID NO: 3429201 - RNA, 16 nt, Human
augcuggagaagagag

SEQ ID NO: 3429202 - RNA, 18 nt, Human
augcuggagaagagagga

SEQ ID NO: 3429203 - RNA, 11 nt, Human
augcuggagcc

SEQ ID NO: 3429204 - RNA, 12 nt, Human
augcuggagccu

SEQ ID NO: 3429205 - RNA, 18 nt, Human
augcuggagccuguguaa

SEQ ID NO: 3429206 - RNA, 19 nt, Human
augcuggaugcuccuucca

SEQ ID NO: 3429207 - RNA, 19 nt, Human
augcuggaugucugccaau

SEQ ID NO: 3429208 - RNA, 23 nt, Human
augcuggcauuugcaccuaccuc

SEQ ID NO: 3429209 - RNA, 23 nt, Human
augcuggccagccuggggccugg

SEQ ID NO: 3429210 - RNA, 15 nt, Human
augcuggcccagggc

SEQ ID NO: 3429211 - RNA, 16 nt, Human
augcuggcccagggcc

SEQ ID NO: 3429212 - RNA, 20 nt, Human
augcuggccgaagauuucau

SEQ ID NO: 3429213 - RNA, 18 nt, Human
augcuggcucccagggcc

SEQ ID NO: 3429214 - RNA, 16 nt, Human
augcuggcuggccuug

SEQ ID NO: 3429215 - RNA, 18 nt, Human
augcuggcuguuggcugg

SEQ ID NO: 3429216 - RNA, 19 nt, Human
augcuggcuguuggcuggg

SEQ ID NO: 3429217 - RNA, 9 nt, Human
augcuggga

SEQ ID NO: 3429218 - RNA, 10 nt, Human
augcugggac

SEQ ID NO: 3429219 - RNA, 15 nt, Human
augcugggcucccgu

SEQ ID NO: 3429220 - RNA, 14 nt, Human
augcugggcugggu

SEQ ID NO: 3429221 - RNA, 19 nt, Human
augcuggguuggugcacag

SEQ ID NO: 3429222 - RNA, 12 nt, Human
augcuguacauc

SEQ ID NO: 3429223 - RNA, 13 nt, Human
augcuguacccag

SEQ ID NO: 3429224 - RNA, 16 nt, Human
augcuguacccaguuu

SEQ ID NO: 3429225 - RNA, 18 nt, Human
augcuguaggugguaugu

SEQ ID NO: 3429226 - RNA, 22 nt, Human
augcuguauuuuaaaagaauga

SEQ ID NO: 3429227 - RNA, 18 nt, Human
augcuguauuuucuuuuu

SEQ ID NO: 3429228 - RNA, 19 nt, Human
augcugucuggcacagccu

SEQ ID NO: 3429229 - RNA, 22 nt, Human
augcugucuggcacagccugca

SEQ ID NO: 3429230 - RNA, 13 nt, Human
augcugugaaauu

SEQ ID NO: 3429231 - RNA, 14 nt, Human
augcugugccccug

SEQ ID NO: 3429232 - RNA, 22 nt, Human
augcugugcccuaaaguguauu

SEQ ID NO: 3429233 - RNA, 21 nt, Human
augcuguggcaugggugaaga

SEQ ID NO: 3429234 - RNA, 23 nt, Human
augcuguguauaugguauauaua

SEQ ID NO: 3429235 - RNA, 23 nt, Human
augcuguucaugaaagauucaau

SEQ ID NO: 3429236 - RNA, 19 nt, Human
augcuguucucuucuucau

SEQ ID NO: 3429237 - RNA, 15 nt, Human
augcuguugauugcu

SEQ ID NO: 3429238 - RNA, 18 nt, Human
augcuguugauugcuaaa

SEQ ID NO: 3429239 - RNA, 22 nt, Human
augcuguugauugcuaaaugua

SEQ ID NO: 3429240 - RNA, 14 nt, Human
augcuguugccuca

SEQ ID NO: 3429241 - RNA, 15 nt, Human
augcuuaaaagguug

SEQ ID NO: 3429242 - RNA, 21 nt, Human
augcuuaaagaauucaaauuu

SEQ ID NO: 3429243 - RNA, 13 nt, Human
augcuuaaauuuu

SEQ ID NO: 3429244 - RNA, 14 nt, Human
augcuuaauuucua

SEQ ID NO: 3429245 - RNA, 23 nt, Human
augcuuacugauauauuuuacaa

SEQ ID NO: 3429246 - RNA, 15 nt, Human
augcuuaguaaugcu

SEQ ID NO: 3429247 - RNA, 23 nt, Human
augcuuagucccucaugcaaauc

SEQ ID NO: 3429248 - RNA, 13 nt, Human
augcuuauuccau

SEQ ID NO: 3429249 - RNA, 15 nt, Human
augcuuauuccauga

SEQ ID NO: 3429250 - RNA, 17 nt, Human
augcuuauuccaugacu

SEQ ID NO: 3429251 - RNA, 23 nt, Human
augcuuauuccaugacugcuugc

SEQ ID NO: 3429252 - RNA, 18 nt, Human
augcuucaugaaaauccu

SEQ ID NO: 3429253 - RNA, 22 nt, Human
augcuucaugaaaauccuacca

SEQ ID NO: 3429254 - RNA, 12 nt, Human
augcuucaugug

SEQ ID NO: 3429255 - RNA, 20 nt, Human
augcuucauucaauauugac

SEQ ID NO: 3429256 - RNA, 21 nt, Human
augcuucauuuguaugucaaa

SEQ ID NO: 3429257 - RNA, 17 nt, Human
augcuuccuagaaguua

SEQ ID NO: 3429258 - RNA, 21 nt, Human
augcuuccuagaaguuacuga

SEQ ID NO: 3429259 - RNA, 13 nt, Human
augcuuccuugcc

SEQ ID NO: 3429260 - RNA, 16 nt, Human
augcuuccuugccuga

SEQ ID NO: 3429261 - RNA, 23 nt, Human
augcuucuaaguaaauacaauuu

SEQ ID NO: 3429262 - RNA, 22 nt, Human
augcuucucaucuugugaaaug

SEQ ID NO: 3429263 - RNA, 14 nt, Human
augcuucuucagag

SEQ ID NO: 3429264 - RNA, 17 nt, Human
augcuucuucagagacu

SEQ ID NO: 3429265 - RNA, 22 nt, Human
augcuucuucagagacuccugc

SEQ ID NO: 3429266 - RNA, 12 nt, Human
augcuucuugga

SEQ ID NO: 3429267 - RNA, 14 nt, Human
augcuucuuucaaa

SEQ ID NO: 3429268 - RNA, 16 nt, Human
augcuugaaugccacg

SEQ ID NO: 3429269 - RNA, 11 nt, Human
augcuugccua

SEQ ID NO: 3429270 - RNA, 23 nt, Human
augcuugccuagggccuggucca

SEQ ID NO: 3429271 - RNA, 18 nt, Human
augcuugggaagacuccu

SEQ ID NO: 3429272 - RNA, 20 nt, Human
augcuuguaacaagaaaaca

SEQ ID NO: 3429273 - RNA, 19 nt, Human
augcuugugaaaauguguu

SEQ ID NO: 3429274 - RNA, 13 nt, Human
augcuuuaaacau

SEQ ID NO: 3429275 - RNA, 19 nt, Human
augcuuuauuaauguuuuc

SEQ ID NO: 3429276 - RNA, 16 nt, Human
augcuuuauuuguaaa

SEQ ID NO: 3429277 - RNA, 21 nt, Human
augcuuuauuuguaaauuuag

SEQ ID NO: 3429278 - RNA, 21 nt, Human
augcuuucagauuaaaauugu

SEQ ID NO: 3429279 - RNA, 20 nt, Human
augcuuuccaaaccuuaucu

SEQ ID NO: 3429280 - RNA, 15 nt, Human
augcuuuccauauuu

SEQ ID NO: 3429281 - RNA, 22 nt, Human
augcuuucugaagcuuuaccag

SEQ ID NO: 3429282 - RNA, 19 nt, Human
augcuuugaaauugaaccu

SEQ ID NO: 3429283 - RNA, 21 nt, Human
augcuuugaaguacaauugug

SEQ ID NO: 3429284 - RNA, 16 nt, Human
augcuuugaucccuuc

SEQ ID NO: 3429285 - RNA, 14 nt, Human
augcuuugcuuugu

SEQ ID NO: 3429286 - RNA, 22 nt, Human
augcuuugucuucagccucucc

SEQ ID NO: 3429287 - RNA, 17 nt, Human
augcuuuuaaaaaucua

SEQ ID NO: 3429288 - RNA, 17 nt, Human
augcuuuuacugaacuu

SEQ ID NO: 3429289 - RNA, 19 nt, Human
augcuuuucugucucugcc

SEQ ID NO: 3429290 - RNA, 22 nt, Human
augcuuuuuauuauuauuauuu

SEQ ID NO: 3429291 - RNA, 19 nt, Human
augcuuuuuauuucugcau

SEQ ID NO: 3429292 - RNA, 16 nt, Human
augcuuuuugaauguu

SEQ ID NO: 3429293 - RNA, 14 nt, Human
auggaaaaaaugau

SEQ ID NO: 3429294 - RNA, 18 nt, Human
aggucaggggugacacag

SEQ ID NO: 3429295 - RNA, 20 nt, Human
aggucaggggugacacagac

SEQ ID NO: 3429296 - RNA, 21 nt, Human
aggucauacaauccauucuua

SEQ ID NO: 3429297 - RNA, 22 nt, Human
aggucauacuaucuacucuccu

SEQ ID NO: 3429298 - RNA, 16 nt, Human
aggucauauuaauaua

SEQ ID NO: 3429299 - RNA, 18 nt, Human
aggucauauuaauauauu

SEQ ID NO: 3429300 - RNA, 19 nt, Human
aggucauggccacacugug

SEQ ID NO: 3429301 - RNA, 21 nt, Human
aggucauggccacacugugac

SEQ ID NO: 3429302 - RNA, 20 nt, Human
aggucauuuuuuuuaagaaa

SEQ ID NO: 3429303 - RNA, 22 nt, Human
aggucauuuuuuuuaagaaaaa

SEQ ID NO: 3429304 - RNA, 14 nt, Human
agguccaagauacc

SEQ ID NO: 3429305 - RNA, 14 nt, Human
agguccaauucucg

SEQ ID NO: 3429306 - RNA, 16 nt, Human
agguccaauuuguaaa

SEQ ID NO: 3429307 - RNA, 18 nt, Human
agguccacaggucuagac

SEQ ID NO: 3429308 - RNA, 14 nt, Human
agguccagcccauc

SEQ ID NO: 3429309 - RNA, 16 nt, Human
agguccagcccuggcu

SEQ ID NO: 3429310 - RNA, 22 nt, Human
agguugaagaccuaaccagggc

SEQ ID NO: 3429311 - RNA, 14 nt, Human
agguugaagcacca

SEQ ID NO: 3429312 - RNA, 12 nt, Human
agguugaagcca

SEQ ID NO: 3429313 - RNA, 17 nt, Human
agguugagcucuucuua

SEQ ID NO: 3429314 - RNA, 18 nt, Human
augcaaauccuaugugau

SEQ ID NO: 3429315 - RNA, 19 nt, Human
augcaaauccuaugugauu

SEQ ID NO: 3429316 - RNA, 23 nt, Human
augcaaaugagcucugaaaucuu

SEQ ID NO: 3429317 - RNA, 16 nt, Human
augcaacaggcacuca

SEQ ID NO: 3429318 - RNA, 16 nt, Human
augcaaccaagucaca

SEQ ID NO: 3429319 - RNA, 17 nt, Human
augcaagcagaggacca

SEQ ID NO: 3429320 - RNA, 22 nt, Human
augcaagcagaggaccagggcc

SEQ ID NO: 3429321 - RNA, 13 nt, Human
augcaagcaguuu

SEQ ID NO: 3429322 - RNA, 16 nt, Human
augcaagcaguuucaa

SEQ ID NO: 3429323 - RNA, 13 nt, Human
augcaaggaagga

SEQ ID NO: 3429324 - RNA, 15 nt, Human
augcaaggaccagga

SEQ ID NO: 3429325 - RNA, 21 nt, Human
augcaaggcacuguacuaggc

SEQ ID NO: 3429326 - RNA, 18 nt, Human
augcaagggacugugugu

SEQ ID NO: 3429327 - RNA, 14 nt, Human
augcaaggucauuu

SEQ ID NO: 3429328 - RNA, 16 nt, Human
augcaaguauucucau

SEQ ID NO: 3429329 - RNA, 16 nt, Human
augcaauaaaauuauu

SEQ ID NO: 3429330 - RNA, 18 nt, Human
augcaauaaaauuuaaaa

SEQ ID NO: 3429331 - RNA, 21 nt, Human
augcaauauacuggaaagcuu

SEQ ID NO: 3429332 - RNA, 15 nt, Human
augcaauauaucuaa

SEQ ID NO: 3429333 - RNA, 14 nt, Human
augcaauauuugua

SEQ ID NO: 3429334 - RNA, 14 nt, Human
augcaauccuuaca

SEQ ID NO: 3429335 - RNA, 15 nt, Human
augcaauccuuacaa

SEQ ID NO: 3429336 - RNA, 19 nt, Human
augcaauccuuacaaauga

SEQ ID NO: 3429337 - RNA, 12 nt, Human
augcaaugagau

SEQ ID NO: 3429338 - RNA, 18 nt, Human
augcaaugccucuggaau

SEQ ID NO: 3429339 - RNA, 16 nt, Human
augcaaugugcuacug

SEQ ID NO: 3429340 - RNA, 21 nt, Human
augcaauuagguuuuuccuua

SEQ ID NO: 3429341 - RNA, 16 nt, Human
augcaauucaucccag

SEQ ID NO: 3429342 - RNA, 19 nt, Human
augcaauuuauuaaaauga

SEQ ID NO: 3429343 - RNA, 20 nt, Human
augcaauuuugcauuugaau

SEQ ID NO: 3429344 - RNA, 22 nt, Human
augcacaaauucugucucugga

SEQ ID NO: 3429345 - RNA, 16 nt, Human
augcacaagaauggau

SEQ ID NO: 3429346 - RNA, 15 nt, Human
augcacacaaaacaa

SEQ ID NO: 3429347 - RNA, 23 nt, Human
augcacacauuuuuuaaaugcac

SEQ ID NO: 3429348 - RNA, 16 nt, Human
augcacagagaagcug

SEQ ID NO: 3429349 - RNA, 17 nt, Human
augcacagagaagcugg

SEQ ID NO: 3429350 - RNA, 16 nt, Human
augcacagaguuguua

SEQ ID NO: 3429351 - RNA, 13 nt, Human
augcacagauaua

SEQ ID NO: 3429352 - RNA, 22 nt, Human
augcacagauauacuuugugga

SEQ ID NO: 3429353 - RNA, 15 nt, Human
augcacaguauuugu

SEQ ID NO: 3429354 - RNA, 21 nt, Human
augcacaguauuuguaauuaa

SEQ ID NO: 3429355 - RNA, 19 nt, Human
augcacauauggacucugc

SEQ ID NO: 3429356 - RNA, 21 nt, Human
augcacauauggacucugcac

SEQ ID NO: 3429357 - RNA, 17 nt, Human
augcacaugaacuuaga

SEQ ID NO: 3429358 - RNA, 13 nt, Human
augcacauuucau

SEQ ID NO: 3429359 - RNA, 17 nt, Human
augcaccaaaucaucuc

SEQ ID NO: 3429360 - RNA, 15 nt, Human
augcaccaccaagcc

SEQ ID NO: 3429361 - RNA, 21 nt, Human
augcaccaccaagccaaggga

SEQ ID NO: 3429362 - RNA, 14 nt, Human
augcaccagcccuu

SEQ ID NO: 3429363 - RNA, 22 nt, Human
augcaccagcccuuagcaggga

SEQ ID NO: 3429364 - RNA, 20 nt, Human
augcaccugcaaucccagcu

SEQ ID NO: 3429365 - RNA, 18 nt, Human
augcacggccucgcgucu

SEQ ID NO: 3429366 - RNA, 20 nt, Human
augcacuaagucucuuuuuu

SEQ ID NO: 3429367 - RNA, 16 nt, Human
augcacuaugaggaau

SEQ ID NO: 3429368 - RNA, 17 nt, Human
augcacugacccuucca

SEQ ID NO: 3429369 - RNA, 18 nt, Human
augcacugugaaggaccc

SEQ ID NO: 3429370 - RNA, 19 nt, Human
augcacugugaaggacccu

SEQ ID NO: 3429371 - RNA, 22 nt, Human
augcacuguucccccugugcag

SEQ ID NO: 3429372 - RNA, 15 nt, Human
augcacuuaaagaag

SEQ ID NO: 3429373 - RNA, 19 nt, Human
augcacuuaaagaaguauu

SEQ ID NO: 3429374 - RNA, 19 nt, Human
augcacuuauaauuuuccu

SEQ ID NO: 3429375 - RNA, 12 nt, Human
augcacuuugcu

SEQ ID NO: 3429376 - RNA, 13 nt, Human
augcacuuugcuu

SEQ ID NO: 3429377 - RNA, 21 nt, Human
augcacuuugcuuuaauauaa

SEQ ID NO: 3429378 - RNA, 12 nt, Human
augcacuuuguu

SEQ ID NO: 3429379 - RNA, 15 nt, Human
augcacuuuguucug

SEQ ID NO: 3429380 - RNA, 16 nt, Human
augcacuuuguucugg

SEQ ID NO: 3429381 - RNA, 16 nt, Human
augcagaaagcauccc

SEQ ID NO: 3429382 - RNA, 18 nt, Human
augcagaacaaaugaaga

SEQ ID NO: 3429383 - RNA, 19 nt, Human
augcagaacaaaugaagac

SEQ ID NO: 3429384 - RNA, 12 nt, Human
augcagaauguu

SEQ ID NO: 3429385 - RNA, 20 nt, Human
augcagaauguuuuuaaaau

SEQ ID NO: 3429386 - RNA, 20 nt, Human
augcagagagccauuuugug

SEQ ID NO: 3429387 - RNA, 17 nt, Human
augcagagguccacaac

SEQ ID NO: 3429388 - RNA, 22 nt, Human
augcagauuuugcccuugacaa

SEQ ID NO: 3429389 - RNA, 16 nt, Human
augcagcaaaauguga

SEQ ID NO: 3429390 - RNA, 16 nt, Human
augcagcaaggcccug

SEQ ID NO: 3429391 - RNA, 19 nt, Human
augcagcaaggcccugcug

SEQ ID NO: 3429392 - RNA, 21 nt, Human
augcagcaaggcccugcugcc

SEQ ID NO: 3429393 - RNA, 22 nt, Human
augcagcccaugcccaccugcc

SEQ ID NO: 3429394 - RNA, 21 nt, Human
augcagcccauuucuccagaa

SEQ ID NO: 3429395 - RNA, 18 nt, Human
augcagccgccuuccuug

SEQ ID NO: 3429396 - RNA, 13 nt, Human
augcagcucaacu

SEQ ID NO: 3429397 - RNA, 15 nt, Human
augcagcucuuccug

SEQ ID NO: 3429398 - RNA, 21 nt, Human
augcagcuuauacgaaauaau

SEQ ID NO: 3429399 - RNA, 14 nt, Human
augcagcuuugcaa

SEQ ID NO: 3429400 - RNA, 18 nt, Human
augcagggauugcugcca

SEQ ID NO: 3429401 - RNA, 22 nt, Human
augcagggauugcugccacuuu

SEQ ID NO: 3429402 - RNA, 19 nt, Human
augcagggccucacacggu

SEQ ID NO: 3429403 - RNA, 17 nt, Human
augcaggggcaaacacc

SEQ ID NO: 3429404 - RNA, 18 nt, Human
augcaggugaaacccagu

SEQ ID NO: 3429405 - RNA, 10 nt, Human
augcaggugg

SEQ ID NO: 3429406 - RNA, 15 nt, Human
augcaguauugagca

SEQ ID NO: 3429407 - RNA, 21 nt, Human
augcagucuccucuuuaaaac

SEQ ID NO: 3429408 - RNA, 18 nt, Human
augcagucuguccaggcu

SEQ ID NO: 3429409 - RNA, 16 nt, Human
augcagugaauuguga

SEQ ID NO: 3429410 - RNA, 18 nt, Human
augcagugauauggcaga

SEQ ID NO: 3429411 - RNA, 21 nt, Human
augcagugauauggcagaaga

SEQ ID NO: 3429412 - RNA, 17 nt, Human
augcagugccuuucuuc

SEQ ID NO: 3429413 - RNA, 23 nt, Human
augcagugcucgcuguugcugaa

SEQ ID NO: 3429414 - RNA, 14 nt, Human
augcagugcugcuu

SEQ ID NO: 3429415 - RNA, 19 nt, Human
augcaguuacaaauuauaa

SEQ ID NO: 3429416 - RNA, 18 nt, Human
augcaguucugaagaaga

SEQ ID NO: 3429417 - RNA, 14 nt, Human
augcaguugucucu

SEQ ID NO: 3429418 - RNA, 15 nt, Human
augcaguugucucug

SEQ ID NO: 3429419 - RNA, 14 nt, Human
augcaguuugaaau

SEQ ID NO: 3429420 - RNA, 17 nt, Human
augcaguuugaaauucu

SEQ ID NO: 3429421 - RNA, 15 nt, Human
augcaguuuuccuua

SEQ ID NO: 3429422 - RNA, 21 nt, Human
augcauaaauaugcagugaua

SEQ ID NO: 3429423 - RNA, 22 nt, Human
augcauaacugacaaaucaagu

SEQ ID NO: 3429424 - RNA, 15 nt, Human
augcauaauucacau

SEQ ID NO: 3429425 - RNA, 13 nt, Human
augcauacacaca

SEQ ID NO: 3429426 - RNA, 14 nt, Human
augcauacacacac

SEQ ID NO: 3429427 - RNA, 22 nt, Human
augcauacacacacacacacag

SEQ ID NO: 3429428 - RNA, 15 nt, Human
augcauacuucaaaa

SEQ ID NO: 3429429 - RNA, 16 nt, Human
augcauacuucaaaag

SEQ ID NO: 3429430 - RNA, 17 nt, Human
augcauacuucaaaagu

SEQ ID NO: 3429431 - RNA, 18 nt, Human
augcauacuucaaaagua

SEQ ID NO: 3429432 - RNA, 20 nt, Human
augcauacuucaaaaguauu

SEQ ID NO: 3429433 - RNA, 22 nt, Human
augcauacuucaaaaguauuuu

SEQ ID NO: 3429434 - RNA, 17 nt, Human
augcauagguuuagcag

SEQ ID NO: 3429435 - RNA, 21 nt, Human
augcauagguuuagcaguaua

SEQ ID NO: 3429436 - RNA, 19 nt, Human
augcauauaaugaauaaau

SEQ ID NO: 3429437 - RNA, 21 nt, Human
augcauauaaugaauaaauca

SEQ ID NO: 3429438 - RNA, 17 nt, Human
augcauauccugagcca

SEQ ID NO: 3429439 - RNA, 18 nt, Human
augcauauccugagccau

SEQ ID NO: 3429440 - RNA, 20 nt, Human
augcauauuauuuuauguug

SEQ ID NO: 3429441 - RNA, 13 nt, Human
augcauauuguau

SEQ ID NO: 3429442 - RNA, 12 nt, Human
augcauauuugu

SEQ ID NO: 3429443 - RNA, 16 nt, Human
augcaucaauccugug

SEQ ID NO: 3429444 - RNA, 14 nt, Human
augcaucagaaagg

SEQ ID NO: 3429445 - RNA, 18 nt, Human
augcaucauucuuguuaa

SEQ ID NO: 3429446 - RNA, 17 nt, Human
augcaucauuucaggag

SEQ ID NO: 3429447 - RNA, 17 nt, Human
augcaucccacugcuga

SEQ ID NO: 3429448 - RNA, 19 nt, Human
augcauccuuugcacuguc

SEQ ID NO: 3429449 - RNA, 20 nt, Human
augcaucuggcucaccgggu

SEQ ID NO: 3429450 - RNA, 15 nt, Human
augcaucuguccuca

SEQ ID NO: 3429451 - RNA, 12 nt, Human
augcaucuguuu

SEQ ID NO: 3429452 - RNA, 14 nt, Human
augcaucuuacuga

SEQ ID NO: 3429453 - RNA, 12 nt, Human
augcaugaacaa

SEQ ID NO: 3429454 - RNA, 20 nt, Human
augcaugaaguaauaugcac

SEQ ID NO: 3429455 - RNA, 21 nt, Human
agucaccccaaguagucugcu

SEQ ID NO: 3429456 - RNA, 17 nt, Human
agucaccccggccaccu

SEQ ID NO: 3429457 - RNA, 19 nt, Human
agucaccccggccaccugc

SEQ ID NO: 3429458 - RNA, 19 nt, Human
agucacccuaccugugccu

SEQ ID NO: 3429459 - RNA, 23 nt, Human
agucacccuagcccucucccucu

SEQ ID NO: 3429460 - RNA, 17 nt, Human
agucaccuucccuugcc

SEQ ID NO: 3429461 - RNA, 21 nt, Human
agucaccuucccuugccacuu

SEQ ID NO: 3429462 - RNA, 19 nt, Human
agucaccuuuuaaauccug

SEQ ID NO: 3429463 - RNA, 20 nt, Human
agucaccuuuuaaauccugu

SEQ ID NO: 3429464 - RNA, 17 nt, Human
agucacucaauuguuuu

SEQ ID NO: 3429465 - RNA, 20 nt, Human
agucacucgauaauaaagua

SEQ ID NO: 3429466 - RNA, 17 nt, Human
agucacucuagucaaug

SEQ ID NO: 3429467 - RNA, 17 nt, Human
agucacucuuaugcugu

SEQ ID NO: 3429468 - RNA, 23 nt, Human
agucacugauguacaauuaaaaa

SEQ ID NO: 3429469 - RNA, 18 nt, Human
agucacugccacuuugca

SEQ ID NO: 3429470 - RNA, 14 nt, Human
agucacugccucuc

SEQ ID NO: 3429471 - RNA, 14 nt, Human
agucacugccugca

SEQ ID NO: 3429472 - RNA, 19 nt, Human
agucacuuacuauuguugc

SEQ ID NO: 3429473 - RNA, 20 nt, Human
agucacuugaugugccauuu

SEQ ID NO: 3429474 - RNA, 21 nt, Human
agucacuugaugugccauuuu

SEQ ID NO: 3429475 - RNA, 19 nt, Human
agucacuuuuuuuuuccaa

SEQ ID NO: 3429476 - RNA, 17 nt, Human
agucagaaaacuuuaaa

SEQ ID NO: 3429477 - RNA, 17 nt, Human
agucagaaacuguuucu

SEQ ID NO: 3429478 - RNA, 15 nt, Human
agucagaacagcaga

SEQ ID NO: 3429479 - RNA, 17 nt, Human
agucagaacagcagacu

SEQ ID NO: 3429480 - RNA, 19 nt, Human
agucagaauuagcugcuuc

SEQ ID NO: 3429481 - RNA, 15 nt, Human
agucagagacagaua

SEQ ID NO: 3429482 - RNA, 17 nt, Human
agucagagacagauacc

SEQ ID NO: 3429483 - RNA, 22 nt, Human
agucagagccccuacagcauug

SEQ ID NO: 3429484 - RNA, 23 nt, Human
agucagagccccuacagcauugu

SEQ ID NO: 3429485 - RNA, 17 nt, Human
agucagaggauggccag

SEQ ID NO: 3429486 - RNA, 20 nt, Human
agucagauggaaaauucauu

SEQ ID NO: 3429487 - RNA, 23 nt, Human
agucagauggaaaauucauuuuu

SEQ ID NO: 3429488 - RNA, 17 nt, Human
agucagauucuugcauc

SEQ ID NO: 3429489 - RNA, 14 nt, Human
agucagcagaacug

SEQ ID NO: 3429490 - RNA, 21 nt, Human
agucagccgacaacuauuucg

SEQ ID NO: 3429491 - RNA, 16 nt, Human
agucagccucucuccc

SEQ ID NO: 3429492 - RNA, 18 nt, Human
agucagcucucugcccug

SEQ ID NO: 3429493 - RNA, 18 nt, Human
agucagcuuucaucuuug

SEQ ID NO: 3429494 - RNA, 15 nt, Human
agucaggaaagagaa

SEQ ID NO: 3429495 - RNA, 16 nt, Human
agucagggaccccugc

SEQ ID NO: 3429496 - RNA, 14 nt, Human
agucagggcccaga

SEQ ID NO: 3429497 - RNA, 17 nt, Human
agucaggggcagcugac

SEQ ID NO: 3429498 - RNA, 21 nt, Human
agucagucaugauggcaccac

SEQ ID NO: 3429499 - RNA, 23 nt, Human
agucagucgccuuucagcaggca

SEQ ID NO: 3429500 - RNA, 21 nt, Human
agucaguugcucaaaaagaaa

SEQ ID NO: 3429501 - RNA, 14 nt, Human
agucaguuugcagu

SEQ ID NO: 3429502 - RNA, 20 nt, Human
agucauaaaauguaucuucc

SEQ ID NO: 3429503 - RNA, 13 nt, Human
agucauaauugca

SEQ ID NO: 3429504 - RNA, 17 nt, Human
agucauaccaaugaaaa

SEQ ID NO: 3429505 - RNA, 18 nt, Human
agucauauaaaagcuaug

SEQ ID NO: 3429506 - RNA, 21 nt, Human
agucauauuuugauuauugua

SEQ ID NO: 3429507 - RNA, 18 nt, Human
agucaucaucagggccug

SEQ ID NO: 3429508 - RNA, 19 nt, Human
agucaucaucagggccugg

SEQ ID NO: 3429509 - RNA, 22 nt, Human
agucaucaucagggccuggggc

SEQ ID NO: 3429510 - RNA, 19 nt, Human
agucaucuugcuaccagua

SEQ ID NO: 3429511 - RNA, 19 nt, Human
agucaucuuguaauuucca

SEQ ID NO: 3429512 - RNA, 14 nt, Human
agucaugaagccca

SEQ ID NO: 3429513 - RNA, 21 nt, Human
agucaugaagcccaagugaaa

SEQ ID NO: 3429514 - RNA, 14 nt, Human
agucaugagcugag

SEQ ID NO: 3429515 - RNA, 17 nt, Human
agucaugaucucccugc

SEQ ID NO: 3429516 - RNA, 18 nt, Human
agucaugaucucccugcc

SEQ ID NO: 3429517 - RNA, 12 nt, Human
auggaguauucu

SEQ ID NO: 3429518 - RNA, 20 nt, Human
auggaguccagggaagagaa

SEQ ID NO: 3429519 - RNA, 15 nt, Human
auggagucuugcucu

SEQ ID NO: 3429520 - RNA, 22 nt, Human
auggagugacggucccacacug

SEQ ID NO: 3429521 - RNA, 18 nt, Human
auggagugcuguuuuguu

SEQ ID NO: 3429522 - RNA, 20 nt, Human
auggagugcuguuuuguuau

SEQ ID NO: 3429523 - RNA, 17 nt, Human
auggaguggcagcccag

SEQ ID NO: 3429524 - RNA, 20 nt, Human
auggaguggcagcccagcca

SEQ ID NO: 3429525 - RNA, 22 nt, Human
auggaguggcagcccagccagc

SEQ ID NO: 3429526 - RNA, 18 nt, Human
auggaguguguauuguuc

SEQ ID NO: 3429527 - RNA, 19 nt, Human
auggaguuaacaucaugaa

SEQ ID NO: 3429528 - RNA, 17 nt, Human
auggaguuaacggguga

SEQ ID NO: 3429529 - RNA, 21 nt, Human
auggaguuaacgggugaauaa

SEQ ID NO: 3429530 - RNA, 13 nt, Human
auggaguuucuaa

SEQ ID NO: 3429531 - RNA, 20 nt, Human
auggauaaaauaaugcugca

SEQ ID NO: 3429532 - RNA, 22 nt, Human
auggauaaugccggugagaaua

SEQ ID NO: 3429533 - RNA, 13 nt, Human
auggauacuacau

SEQ ID NO: 3429534 - RNA, 23 nt, Human
auggauauuagucauagaagaac

SEQ ID NO: 3429535 - RNA, 18 nt, Human
auggauauuauuagaaau

SEQ ID NO: 3429536 - RNA, 16 nt, Human
auggaucacaagaugg

SEQ ID NO: 3429537 - RNA, 22 nt, Human
auggauccccagugaaaacuag

SEQ ID NO: 3429538 - RNA, 14 nt, Human
auggaucccgaaga

SEQ ID NO: 3429539 - RNA, 15 nt, Human
auggaugauuuaagu

SEQ ID NO: 3429540 - RNA, 22 nt, Human
auggaugcaaaguacaaugugu

SEQ ID NO: 3429541 - RNA, 13 nt, Human
auggaugccaaua

SEQ ID NO: 3429542 - RNA, 23 nt, Human
auggaugccaauauuaaaucugc

SEQ ID NO: 3429543 - RNA, 14 nt, Human
auggauggcuucua

SEQ ID NO: 3429544 - RNA, 19 nt, Human
auggaugggggaacucaga

SEQ ID NO: 3429545 - RNA, 18 nt, Human
auggauguccccagcaga

SEQ ID NO: 3429546 - RNA, 20 nt, Human
auggauuaaauuuaauucuu

SEQ ID NO: 3429547 - RNA, 13 nt, Human
auggauucuaaaa

SEQ ID NO: 3429548 - RNA, 22 nt, Human
auggauuguuaauuucaguccu

SEQ ID NO: 3429549 - RNA, 15 nt, Human
auggauuuccagcca

SEQ ID NO: 3429550 - RNA, 14 nt, Human
auggauuuguuaca

SEQ ID NO: 3429551 - RNA, 17 nt, Human
auggauuuguuacagcc

SEQ ID NO: 3429552 - RNA, 20 nt, Human
auggauuuucuauuguuacu

SEQ ID NO: 3429553 - RNA, 16 nt, Human
auggauuuuucuuuaa

SEQ ID NO: 3429554 - RNA, 14 nt, Human
auggcaaaaauggc

SEQ ID NO: 3429555 - RNA, 14 nt, Human
auggcaacaaacug

SEQ ID NO: 3429556 - RNA, 15 nt, Human
auggcaacagaucug

SEQ ID NO: 3429557 - RNA, 16 nt, Human
auggcaacagaucugg

SEQ ID NO: 3429558 - RNA, 17 nt, Human
auggcaacagaucugga

SEQ ID NO: 3429559 - RNA, 24 nt, Human
auggcaacagaucuggaaccucag

SEQ ID NO: 3429560 - RNA, 16 nt, Human
auggcaaccauuauaa

SEQ ID NO: 3429561 - RNA, 23 nt, Human
auggcaaguuuuccauauuuuua

SEQ ID NO: 3429562 - RNA, 23 nt, Human
auggcaauucuuugaccucaacc

SEQ ID NO: 3429563 - RNA, 23 nt, Human
auggcacagcccaaagaaggaaa

SEQ ID NO: 3429564 - RNA, 19 nt, Human
auggcacagggcaugaaau

SEQ ID NO: 3429565 - RNA, 20 nt, Human
auggcacagggcaugaaaug

SEQ ID NO: 3429566 - RNA, 20 nt, Human
auggcacuuagcuaucagaa

SEQ ID NO: 3429567 - RNA, 16 nt, Human
auggcacuugcaucug

SEQ ID NO: 3429568 - RNA, 13 nt, Human
auggcagaagaca

SEQ ID NO: 3429569 - RNA, 17 nt, Human
auggcagaagacaccag

SEQ ID NO: 3429570 - RNA, 13 nt, Human
auggcagaaggca

SEQ ID NO: 3429571 - RNA, 20 nt, Human
auggcagaaggcaaacccau

SEQ ID NO: 3429572 - RNA, 21 nt, Human
auggcagaaggcaaacccauc

SEQ ID NO: 3429573 - RNA, 22 nt, Human
auggcagaguuuguguguuguc

SEQ ID NO: 3429574 - RNA, 13 nt, Human
auggcagcagggg

SEQ ID NO: 3429575 - RNA, 14 nt, Human
auggcagcugccac

SEQ ID NO: 3429576 - RNA, 20 nt, Human
auggcaggacgugggcuggg

SEQ ID NO: 3429577 - RNA, 16 nt, Human
auggcaggauggccug

SEQ ID NO: 3429578 - RNA, 16 nt, Human
auggcagggggcugcu

SEQ ID NO: 3429579 - RNA, 17 nt, Human
auggcagggggcugcug

SEQ ID NO: 3429580 - RNA, 18 nt, Human
auggcaguguuccuauuu

SEQ ID NO: 3429581 - RNA, 15 nt, Human
auggcaguuauauuu

SEQ ID NO: 3429582 - RNA, 17 nt, Human
auggcauaaccugucuc

SEQ ID NO: 3429583 - RNA, 18 nt, Human
auggcauauuuuucacau

SEQ ID NO: 3429584 - RNA, 23 nt, Human
auggcauauuuuucacauaucua

SEQ ID NO: 3429585 - RNA, 20 nt, Human
auggcaucuucgucuucacu

SEQ ID NO: 3429586 - RNA, 15 nt, Human
auggcaugagaaaua

SEQ ID NO: 3429587 - RNA, 17 nt, Human
auggcaugagaaauaca

SEQ ID NO: 3429588 - RNA, 18 nt, Human
auggcaugagaaauacaa

SEQ ID NO: 3429589 - RNA, 19 nt, Human
auggcaugagaaauacaaa

SEQ ID NO: 3429590 - RNA, 13 nt, Human
auggcauuugcag

SEQ ID NO: 3429591 - RNA, 17 nt, Human
auggcauuugcagauuu

SEQ ID NO: 3429592 - RNA, 17 nt, Human
auggccagccccuuaga

SEQ ID NO: 3429593 - RNA, 19 nt, Human
auggccagccccuuagaca

SEQ ID NO: 3429594 - RNA, 22 nt, Human
auggccaggaaguagcacaggc

SEQ ID NO: 3429595 - RNA, 19 nt, Human
auggccaggauccucuccu

SEQ ID NO: 3429596 - RNA, 19 nt, Human
auggccagguggccacucc

SEQ ID NO: 3429597 - RNA, 22 nt, Human
auggccauggaguguacaagua

SEQ ID NO: 3429598 - RNA, 23 nt, Human
augggggaaagcaaagcacagag

SEQ ID NO: 3429599 - RNA, 18 nt, Human
augggggaaauggugccu

SEQ ID NO: 3429600 - RNA, 19 nt, Human
augggggagucugaagcag

SEQ ID NO: 3429601 - RNA, 14 nt, Human
augggggaugcuuc

SEQ ID NO: 3429602 - RNA, 22 nt, Human
auggggggccaacaccagggau

SEQ ID NO: 3429603 - RNA, 15 nt, Human
augggggguauauuu

SEQ ID NO: 3429604 - RNA, 17 nt, Human
auggggucuguaaaauc

SEQ ID NO: 3429605 - RNA, 18 nt, Human
auggggucuguaaaaucu

SEQ ID NO: 3429606 - RNA, 18 nt, Human
auggggugggccucuggu

SEQ ID NO: 3429607 - RNA, 19 nt, Human
auggggugggguagggcug

SEQ ID NO: 3429608 - RNA, 18 nt, Human
auggguaauauaaagugu

SEQ ID NO: 3429609 - RNA, 12 nt, Human
augggucacagg

SEQ ID NO: 3429610 - RNA, 14 nt, Human
augggucagagcua

SEQ ID NO: 3429611 - RNA, 17 nt, Human
augggucuggcugagcu

SEQ ID NO: 3429612 - RNA, 20 nt, Human
augggugcaaggaaaauuag

SEQ ID NO: 3429613 - RNA, 17 nt, Human
augggugcccacagugu

SEQ ID NO: 3429614 - RNA, 12 nt, Human
augggugugugu

SEQ ID NO: 3429615 - RNA, 13 nt, Human
auggguguguguu

SEQ ID NO: 3429616 - RNA, 15 nt, Human
auggguuauguguau

SEQ ID NO: 3429617 - RNA, 14 nt, Human
auggguugcauuug

SEQ ID NO: 3429618 - RNA, 23 nt, Human
augguaaaaguuacuuauucuag

SEQ ID NO: 3429619 - RNA, 14 nt, Human
augguaaaauugca

SEQ ID NO: 3429620 - RNA, 15 nt, Human
augguaaaauuuugu

SEQ ID NO: 3429621 - RNA, 20 nt, Human
augguaacugcuuucuguuc

SEQ ID NO: 3429622 - RNA, 16 nt, Human
augguaagagaaaaga

SEQ ID NO: 3429623 - RNA, 15 nt, Human
augguaaucauauua

SEQ ID NO: 3429624 - RNA, 20 nt, Human
augguaaucuuuaccuguau

SEQ ID NO: 3429625 - RNA, 23 nt, Human
augguaaucuuuaccuguauaca

SEQ ID NO: 3429626 - RNA, 14 nt, Human
augguaauuguugc

SEQ ID NO: 3429627 - RNA, 20 nt, Human
augguaauuuauaguuuaua

SEQ ID NO: 3429628 - RNA, 12 nt, Human
augguacauuuu

SEQ ID NO: 3429629 - RNA, 20 nt, Human
augguaccaaucaugaaucu

SEQ ID NO: 3429630 - RNA, 19 nt, Human
augguacuagggggaagug

SEQ ID NO: 3429631 - RNA, 23 nt, Human
augguacuguacagcuggcucua

SEQ ID NO: 3429632 - RNA, 18 nt, Human
augguagaaaaauuucac

SEQ ID NO: 3429633 - RNA, 18 nt, Human
augguagcauuuuaaaca

SEQ ID NO: 3429634 - RNA, 23 nt, Human
augguagcauuuuaaacaaaaua

SEQ ID NO: 3429635 - RNA, 19 nt, Human
augguagccagaugauaaa

SEQ ID NO: 3429636 - RNA, 17 nt, Human
augguaggaacugcugg

SEQ ID NO: 3429637 - RNA, 19 nt, Human
augguaggaagaagcucuc

SEQ ID NO: 3429638 - RNA, 18 nt, Human
augguaguuucugugguu

SEQ ID NO: 3429639 - RNA, 15 nt, Human
augguaguuuuacag

SEQ ID NO: 3429640 - RNA, 21 nt, Human
augguaguuuuacaguguuuc

SEQ ID NO: 3429641 - RNA, 14 nt, Human
augguaguuuuuuc

SEQ ID NO: 3429642 - RNA, 19 nt, Human
augguaguuuuuucaucuu

SEQ ID NO: 3429643 - RNA, 17 nt, Human
augguauaaguaacuuu

SEQ ID NO: 3429644 - RNA, 16 nt, Human
augguauuugagacau

SEQ ID NO: 3429645 - RNA, 20 nt, Human
auggucaacacuuaaggguu

SEQ ID NO: 3429646 - RNA, 16 nt, Human
auggucacacacugau

SEQ ID NO: 3429647 - RNA, 17 nt, Human
auggucacgcaccuggg

SEQ ID NO: 3429648 - RNA, 20 nt, Human
auggucacguuuggugcuuc

SEQ ID NO: 3429649 - RNA, 21 nt, Human
auggucacguuuggugcuucu

SEQ ID NO: 3429650 - RNA, 24 nt, Human
auggucacguuuggugcuucucag

SEQ ID NO: 3429651 - RNA, 16 nt, Human
auggucagcguugcau

SEQ ID NO: 3429652 - RNA, 19 nt, Human
auggucagcguugcauguc

SEQ ID NO: 3429653 - RNA, 19 nt, Human
augguccaggagaaggcca

SEQ ID NO: 3429654 - RNA, 15 nt, Human
augguccauagcacu

SEQ ID NO: 3429655 - RNA, 18 nt, Human
auggucccauccaggcag

SEQ ID NO: 3429656 - RNA, 13 nt, Human
augguccccaugg

SEQ ID NO: 3429657 - RNA, 19 nt, Human
augguccgugcuaaggacu

SEQ ID NO: 3429658 - RNA, 18 nt, Human
augguccuaaaagcaaaa

SEQ ID NO: 3429659 - RNA, 20 nt, Human
augguccuaaaagcaaaaua

SEQ ID NO: 3429660 - RNA, 12 nt, Human
augguccugggg

SEQ ID NO: 3429661 - RNA, 23 nt, Human
auggucgagaaagaggcaccagg

SEQ ID NO: 3429662 - RNA, 16 nt, Human
auggucgcccaggaga

SEQ ID NO: 3429663 - RNA, 13 nt, Human
auggucuggucua

SEQ ID NO: 3429664 - RNA, 19 nt, Human
auggugaaaccccgucucu

SEQ ID NO: 3429665 - RNA, 23 nt, Human
auggugacuuccucgccucuccc

SEQ ID NO: 3429666 - RNA, 18 nt, Human
auggugagaugcagcugg

SEQ ID NO: 3429667 - RNA, 19 nt, Human
auggugagaugcagcugga

SEQ ID NO: 3429668 - RNA, 15 nt, Human
auggugagcagcgga

SEQ ID NO: 3429669 - RNA, 13 nt, Human
auggugauguuga

SEQ ID NO: 3429670 - RNA, 16 nt, Human
auggugauuuuaaaug

SEQ ID NO: 3429671 - RNA, 19 nt, Human
auggugauuuuaaaugugu

SEQ ID NO: 3429672 - RNA, 17 nt, Human
auggugccccaggacca

SEQ ID NO: 3429673 - RNA, 18 nt, Human
auggugccccaggaccag

SEQ ID NO: 3429674 - RNA, 21 nt, Human
auggugccccaggaccagcuc

SEQ ID NO: 3429675 - RNA, 14 nt, Human
auggugccucugga

SEQ ID NO: 3429676 - RNA, 14 nt, Human
auggugccuucauu

SEQ ID NO: 3429677 - RNA, 20 nt, Human
auggugcuacgccugcaugu

SEQ ID NO: 3429678 - RNA, 15 nt, Human
auggugcucaccaug

SEQ ID NO: 3429679 - RNA, 14 nt, Human
auggugcugaccuc

SEQ ID NO: 3429680 - RNA, 12 nt, Human
auggugcugaga

SEQ ID NO: 3429681 - RNA, 14 nt, Human
augugcaaaugcaa

SEQ ID NO: 3429682 - RNA, 16 nt, Human
augugcaaguguaugc

SEQ ID NO: 3429683 - RNA, 13 nt, Human
augugcaauagaa

SEQ ID NO: 3429684 - RNA, 18 nt, Human
augugcaauugauuucuu

SEQ ID NO: 3429685 - RNA, 19 nt, Human
augugcacaucuguuuugu

SEQ ID NO: 3429686 - RNA, 18 nt, Human
augugcacugucacuuug

SEQ ID NO: 3429687 - RNA, 13 nt, Human
augugcagcagau

SEQ ID NO: 3429688 - RNA, 20 nt, Human
augugcagcagauuggaagg

SEQ ID NO: 3429689 - RNA, 20 nt, Human
augugcauuuuugugaaaug

SEQ ID NO: 3429690 - RNA, 21 nt, Human
augugcauuuuugugaaauga

SEQ ID NO: 3429691 - RNA, 17 nt, Human
augugccaaucaauagc

SEQ ID NO: 3429692 - RNA, 16 nt, Human
augugccacauuuucu

SEQ ID NO: 3429693 - RNA, 21 nt, Human
augugccagggcaaugaugaa

SEQ ID NO: 3429694 - RNA, 13 nt, Human
augugcccuccug

SEQ ID NO: 3429695 - RNA, 18 nt, Human
augugcccuccugaggga

SEQ ID NO: 3429696 - RNA, 18 nt, Human
augugccgaaugugcagg

SEQ ID NO: 3429697 - RNA, 19 nt, Human
augugccuauugcuagagc

SEQ ID NO: 3429698 - RNA, 15 nt, Human
augugccugauccag

SEQ ID NO: 3429699 - RNA, 19 nt, Human
augugccugcaccaggaga

SEQ ID NO: 3429700 - RNA, 20 nt, Human
augugcgugugugcaagugu

SEQ ID NO: 3429701 - RNA, 21 nt, Human
augugcuacaggggccagaag

SEQ ID NO: 3429702 - RNA, 19 nt, Human
augugcuauuaauauuugu

SEQ ID NO: 3429703 - RNA, 20 nt, Human
augugcucuccaaauuuuuu

SEQ ID NO: 3429704 - RNA, 13 nt, Human
augugcugcuuug

SEQ ID NO: 3429705 - RNA, 11 nt, Human
augugcugugu

SEQ ID NO: 3429706 - RNA, 14 nt, Human
augugcuguguaaa

SEQ ID NO: 3429707 - RNA, 16 nt, Human
augugcuguguaaagu

SEQ ID NO: 3429708 - RNA, 17 nt, Human
augugcuguguaaaguu

SEQ ID NO: 3429709 - RNA, 16 nt, Human
augugcuuaacaggga

SEQ ID NO: 3429710 - RNA, 21 nt, Human
augugcuuaacagggaacgug

SEQ ID NO: 3429711 - RNA, 17 nt, Human
augugcuuuucuccaau

SEQ ID NO: 3429712 - RNA, 15 nt, Human
auguggaacugcugc

SEQ ID NO: 3429713 - RNA, 23 nt, Human
auguggaacugcugccacugagg

SEQ ID NO: 3429714 - RNA, 16 nt, Human
auguggaagugugggu

SEQ ID NO: 3429715 - RNA, 15 nt, Human
auguggaauauaaag

SEQ ID NO: 3429716 - RNA, 17 nt, Human
auguggaauauaaagau

SEQ ID NO: 3429717 - RNA, 23 nt, Human
auguggagcacaaaagccucuca

SEQ ID NO: 3429718 - RNA, 16 nt, Human
auguggagccaggcgu

SEQ ID NO: 3429719 - RNA, 17 nt, Human
auguggauuuuuuccua

SEQ ID NO: 3429720 - RNA, 18 nt, Human
auguggcaaggaaaaaca

SEQ ID NO: 3429721 - RNA, 23 nt, Human
auguggcaauaaauuuuuuuuaa

SEQ ID NO: 3429722 - RNA, 16 nt, Human
auguggcagcugucuc

SEQ ID NO: 3429723 - RNA, 14 nt, Human
auguggccccaccc

SEQ ID NO: 3429724 - RNA, 20 nt, Human
auguggccccugaacaagaa

SEQ ID NO: 3429725 - RNA, 13 nt, Human
auguggcccuggc

SEQ ID NO: 3429726 - RNA, 19 nt, Human
auguggcccuggccugcug

SEQ ID NO: 3429727 - RNA, 22 nt, Human
auguggcccuggcugccggcac

SEQ ID NO: 3429728 - RNA, 16 nt, Human
auguggccgaggacuu

SEQ ID NO: 3429729 - RNA, 17 nt, Human
auguggccgaggacuuu

SEQ ID NO: 3429730 - RNA, 18 nt, Human
auguggccgaggacuuug

SEQ ID NO: 3429731 - RNA, 19 nt, Human
auguggccuaaaaaugcaa

SEQ ID NO: 3429732 - RNA, 19 nt, Human
auguggccuguggccugug

SEQ ID NO: 3429733 - RNA, 20 nt, Human
auguggccuuugaauucugu

SEQ ID NO: 3429734 - RNA, 13 nt, Human
auguggcuggaag

SEQ ID NO: 3429735 - RNA, 20 nt, Human
augugggaagaaacaaaccc

SEQ ID NO: 3429736 - RNA, 13 nt, Human
augugggcacugg

SEQ ID NO: 3429737 - RNA, 20 nt, Human
augugggcuaguugggcuuc

SEQ ID NO: 3429738 - RNA, 13 nt, Human
auguggggccagg

SEQ ID NO: 3429739 - RNA, 16 nt, Human
auguggggccagguca

SEQ ID NO: 3429740 - RNA, 17 nt, Human
augugggggucugugug

SEQ ID NO: 3429741 - RNA, 14 nt, Human
augugggucuucca

SEQ ID NO: 3429742 - RNA, 15 nt, Human
augugggucuuccag

SEQ ID NO: 3429743 - RNA, 16 nt, Human
auuaaucaguucauua

SEQ ID NO: 3429744 - RNA, 16 nt, Human
auuaaucuuaguguau

SEQ ID NO: 3429745 - RNA, 20 nt, Human
auuaaugacacuugucccca

SEQ ID NO: 3429746 - RNA, 12 nt, Human
auuaaugcacuu

SEQ ID NO: 3429747 - RNA, 15 nt, Human
auuaaugccugcuuu

SEQ ID NO: 3429748 - RNA, 18 nt, Human
auuaaugccuuuaaagua

SEQ ID NO: 3429749 - RNA, 15 nt, Human
auuaaugcuaagggc

SEQ ID NO: 3429750 - RNA, 16 nt, Human
auuaauguacuuguuu

SEQ ID NO: 3429751 - RNA, 20 nt, Human
auuaaugucaguauuucaac

SEQ ID NO: 3429752 - RNA, 18 nt, Human
auuaauguuaauucagca

SEQ ID NO: 3429753 - RNA, 22 nt, Human
auuaauguuucuaucugauuuu

SEQ ID NO: 3429754 - RNA, 16 nt, Human
auuaauuaaacauugu

SEQ ID NO: 3429755 - RNA, 14 nt, Human
auuaauuaaaugca

SEQ ID NO: 3429756 - RNA, 15 nt, Human
auuaauuaauuugga

SEQ ID NO: 3429757 - RNA, 16 nt, Human
auuaauuaucgugucu

SEQ ID NO: 3429758 - RNA, 20 nt, Human
auuaauuccuguuugucuac

SEQ ID NO: 3429759 - RNA, 14 nt, Human
auuaauucuauaag

SEQ ID NO: 3429760 - RNA, 14 nt, Human
auuaauucucuuuc

SEQ ID NO: 3429761 - RNA, 14 nt, Human
auuaauugcugcaa

SEQ ID NO: 3429762 - RNA, 12 nt, Human
auuaauugcuuu

SEQ ID NO: 3429763 - RNA, 21 nt, Human
auuaauuggcagcagauuuua

SEQ ID NO: 3429764 - RNA, 12 nt, Human
auuaauugucuu

SEQ ID NO: 3429765 - RNA, 11 nt, Human
auuaauugugu

SEQ ID NO: 3429766 - RNA, 16 nt, Human
auuaauuuaugcagaa

SEQ ID NO: 3429767 - RNA, 21 nt, Human
auuaauuucugccauuucaug

SEQ ID NO: 3429768 - RNA, 22 nt, Human
auuaauuucugccauuucaugu

SEQ ID NO: 3429769 - RNA, 14 nt, Human
auuaauuucuucac

SEQ ID NO: 3429770 - RNA, 18 nt, Human
auuaauuugauuaacaaa

SEQ ID NO: 3429771 - RNA, 15 nt, Human
auuaauuugcaucug

SEQ ID NO: 3429772 - RNA, 21 nt, Human
auuaauuuggagcacaaaauu

SEQ ID NO: 3429773 - RNA, 13 nt, Human
auuaauuuuacuc

SEQ ID NO: 3429774 - RNA, 18 nt, Human
auuaauuuuuuuauuguu

SEQ ID NO: 3429775 - RNA, 19 nt, Human
auuaauuuuuuuauuguuu

SEQ ID NO: 3429776 - RNA, 13 nt, Human
auuacaaaaacaa

SEQ ID NO: 3429777 - RNA, 15 nt, Human
auuacaaaguuaaaa

SEQ ID NO: 3429778 - RNA, 24 nt, Human
auuacaaaguuaaaauuguuauca

SEQ ID NO: 3429779 - RNA, 16 nt, Human
auuacaaaucagaagu

SEQ ID NO: 3429780 - RNA, 18 nt, Human
auuacaaaucagaaguca

SEQ ID NO: 3429781 - RNA, 19 nt, Human
auuacaaaucagaagucau

SEQ ID NO: 3429782 - RNA, 17 nt, Human
auuacaacucuauuuaa

SEQ ID NO: 3429783 - RNA, 18 nt, Human
auuacaacugaccaaguu

SEQ ID NO: 3429784 - RNA, 19 nt, Human
auuacaaguauuuuuaauu

SEQ ID NO: 3429785 - RNA, 14 nt, Human
auuacaauauuugu

SEQ ID NO: 3429786 - RNA, 17 nt, Human
auuacaauggaaacaau

SEQ ID NO: 3429787 - RNA, 18 nt, Human
auuacaauuuuaucuguu

SEQ ID NO: 3429788 - RNA, 13 nt, Human
auuacacaaaaca

SEQ ID NO: 3429789 - RNA, 14 nt, Human
auuacacaaaacaa

SEQ ID NO: 3429790 - RNA, 15 nt, Human
auuacacauuuguac

SEQ ID NO: 3429791 - RNA, 21 nt, Human
auuacaccagccucgucuuca

SEQ ID NO: 3429792 - RNA, 13 nt, Human
auuacagaaauuu

SEQ ID NO: 3429793 - RNA, 18 nt, Human
auuacagagaggagaaac

SEQ ID NO: 3429794 - RNA, 19 nt, Human
auuacagagaggagaaaca

SEQ ID NO: 3429795 - RNA, 19 nt, Human
auuacagaugggcaaauua

SEQ ID NO: 3429796 - RNA, 17 nt, Human
auuacaggaaguacugg

SEQ ID NO: 3429797 - RNA, 22 nt, Human
auuacaggcaccugccaccaug

SEQ ID NO: 3429798 - RNA, 22 nt, Human
auuacaggugugaaccaccaca

SEQ ID NO: 3429799 - RNA, 15 nt, Human
auuacaguauaauua

SEQ ID NO: 3429800 - RNA, 16 nt, Human
auuacaguauaauuaa

SEQ ID NO: 3429801 - RNA, 15 nt, Human
auuacagugccuaaa

SEQ ID NO: 3429802 - RNA, 14 nt, Human
auuacauaaauaaa

SEQ ID NO: 3429803 - RNA, 15 nt, Human
auuacauaauuuagu

SEQ ID NO: 3429804 - RNA, 21 nt, Human
auuacauauuugcauauguau

SEQ ID NO: 3429805 - RNA, 17 nt, Human
auuacauccuuguggca

SEQ ID NO: 3429806 - RNA, 15 nt, Human
auuacaucuuucaca

SEQ ID NO: 3429807 - RNA, 22 nt, Human
auuacauuccuugauaauguug

SEQ ID NO: 3429808 - RNA, 18 nt, Human
auuacauuuccaaaugaa

SEQ ID NO: 3429809 - RNA, 15 nt, Human
auuacauuuguaauu

SEQ ID NO: 3429810 - RNA, 19 nt, Human
auuaccaauaggcaaauua

SEQ ID NO: 3429811 - RNA, 22 nt, Human
auuaccaauaggcaaauuaauc

SEQ ID NO: 3429812 - RNA, 14 nt, Human
auuaccacugaaga

SEQ ID NO: 3429813 - RNA, 18 nt, Human
auuaccagcaagaauaaa

SEQ ID NO: 3429814 - RNA, 21 nt, Human
auuaccaguggcguuguugca

SEQ ID NO: 3429815 - RNA, 13 nt, Human
auuaccauggaga

SEQ ID NO: 3429816 - RNA, 15 nt, Human
auuaccauggagaca

SEQ ID NO: 3429817 - RNA, 14 nt, Human
auuaccauuuguua

SEQ ID NO: 3429818 - RNA, 18 nt, Human
auuacccccuccuucaga

SEQ ID NO: 3429819 - RNA, 20 nt, Human
auuacccccuccuucagaca

SEQ ID NO: 3429820 - RNA, 21 nt, Human
auuacccccuccuucagacac

SEQ ID NO: 3429821 - RNA, 16 nt, Human
auuacccuucuuucca

SEQ ID NO: 3429822 - RNA, 16 nt, Human
auuaccgcguuguaaa

SEQ ID NO: 3429823 - RNA, 19 nt, Human
auuaccgcguuguaaaaua

SEQ ID NO: 3429824 - RNA, 13 nt, Human
auuaccucugaua

SEQ ID NO: 3429825 - RNA, 19 nt, Human
auuaccuggauguucuuuu

SEQ ID NO: 3429826 - RNA, 16 nt, Human
auuaccuguggauauu

SEQ ID NO: 3429827 - RNA, 19 nt, Human
auuaccuguggauauuugu

SEQ ID NO: 3429828 - RNA, 21 nt, Human
auuaccuuuuaccagcuuuua

SEQ ID NO: 3429829 - RNA, 17 nt, Human
auuacgaaguucaagau

SEQ ID NO: 3429830 - RNA, 15 nt, Human
auuacgauaaggaag

SEQ ID NO: 3429831 - RNA, 17 nt, Human
auuacgauaaggaagaa

SEQ ID NO: 3429832 - RNA, 19 nt, Human
auuacgauaaggaagaaac

SEQ ID NO: 3429833 - RNA, 18 nt, Human
auuacguacuaaggauac

SEQ ID NO: 3429834 - RNA, 13 nt, Human
auuacgugagcca

SEQ ID NO: 3429835 - RNA, 16 nt, Human
auuacgugagccaggu

SEQ ID NO: 3429836 - RNA, 14 nt, Human
auuacuaacuucua

SEQ ID NO: 3429837 - RNA, 16 nt, Human
auuacuaacuucuaaa

SEQ ID NO: 3429838 - RNA, 22 nt, Human
auuacuaacuucuaaaacugua

SEQ ID NO: 3429839 - RNA, 12 nt, Human
auuacuaauuuu

SEQ ID NO: 3429840 - RNA, 20 nt, Human
auuacuacaaaauuugaaau

SEQ ID NO: 3429841 - RNA, 21 nt, Human
auuacuagacugccacaagga

SEQ ID NO: 3429842 - RNA, 15 nt, Human
auuacucugaaauug

SEQ ID NO: 3429843 - RNA, 12 nt, Human
auuacucuugua

SEQ ID NO: 3429844 - RNA, 18 nt, Human
auuacucuuguaagauuu

SEQ ID NO: 3429845 - RNA, 19 nt, Human
auuacucuuguaagauuuu

SEQ ID NO: 3429846 - RNA, 22 nt, Human
auuacucuuguaagauuuugaa

SEQ ID NO: 3429847 - RNA, 13 nt, Human
auuacucuuucuc

SEQ ID NO: 3429848 - RNA, 15 nt, Human
auuacugacauuucu

SEQ ID NO: 3429849 - RNA, 13 nt, Human
auuacugccauuc

SEQ ID NO: 3429850 - RNA, 15 nt, Human
auuacugccuugaaa

SEQ ID NO: 3429851 - RNA, 16 nt, Human
auuacugcuaaguauu

SEQ ID NO: 3429852 - RNA, 21 nt, Human
auuacugcuaaguauuuccca

SEQ ID NO: 3429853 - RNA, 18 nt, Human
auuacugcuuuaaucaga

SEQ ID NO: 3429854 - RNA, 17 nt, Human
auuacuggaucucuuaa

SEQ ID NO: 3429855 - RNA, 19 nt, Human
auuacuggaucucuuaaga

SEQ ID NO: 3429856 - RNA, 22 nt, Human
auuacuggccuuuuucauuuau

SEQ ID NO: 3429857 - RNA, 17 nt, Human
auuacuggcguggauua

SEQ ID NO: 3429858 - RNA, 18 nt, Human
auuacuggcguggauuaa

SEQ ID NO: 3429859 - RNA, 23 nt, Human
auuacuggcguggauuaaacuua

SEQ ID NO: 3429860 - RNA, 12 nt, Human
auuacugggccu

SEQ ID NO: 3429861 - RNA, 14 nt, Human
auuacugggccuua

SEQ ID NO: 3429862 - RNA, 15 nt, Human
auuacuguaagaaaa

SEQ ID NO: 3429863 - RNA, 18 nt, Human
auuacugucugguuuuaa

SEQ ID NO: 3429864 - RNA, 19 nt, Human
auuacuguugauaauucuu

SEQ ID NO: 3429865 - RNA, 20 nt, Human
auuacuguugauaauucuua

SEQ ID NO: 3429866 - RNA, 17 nt, Human
auuacuguuuauuacuu

SEQ ID NO: 3429867 - RNA, 18 nt, Human
auuacuguuuauuucugu

SEQ ID NO: 3429868 - RNA, 24 nt, Human
auuacuuacguauguuuguacuug

SEQ ID NO: 3429869 - RNA, 23 nt, Human
auuacuuaucauccacauuguuu

SEQ ID NO: 3429870 - RNA, 15 nt, Human
auuacuuaucccugc

SEQ ID NO: 3429871 - RNA, 19 nt, Human
auuacuuauuuuugacagu

SEQ ID NO: 3429872 - RNA, 17 nt, Human
auuacuuccaugaauuu

SEQ ID NO: 3429873 - RNA, 14 nt, Human
auuacuucugcuac

SEQ ID NO: 3429874 - RNA, 19 nt, Human
auuacuugauuaagauuuu

SEQ ID NO: 3429875 - RNA, 15 nt, Human
auuacuuguaaauau

SEQ ID NO: 3429876 - RNA, 15 nt, Human
auuacuuguugccua

SEQ ID NO: 3429877 - RNA, 18 nt, Human
auuacuuguugccuauaa

SEQ ID NO: 3429878 - RNA, 15 nt, Human
auuacuuuaacaugc

SEQ ID NO: 3429879 - RNA, 23 nt, Human
auuacuuuaccacccccacaccu

SEQ ID NO: 3429880 - RNA, 23 nt, Human
auuacuuuaucacuuuuugaacu

SEQ ID NO: 3429881 - RNA, 23 nt, Human
auuacuuuggggcuaauuuaaca

SEQ ID NO: 3429882 - RNA, 14 nt, Human
auuacuuugugaau

SEQ ID NO: 3429883 - RNA, 14 nt, Human
auuacuuuugcugu

SEQ ID NO: 3429884 - RNA, 21 nt, Human
auuagaaaaauagcaacuugu

SEQ ID NO: 3429885 - RNA, 21 nt, Human
auuagaaaauauucucuauuu

SEQ ID NO: 3429886 - RNA, 19 nt, Human
auuagaaaauguuauuuaa

SEQ ID NO: 3429887 - RNA, 15 nt, Human
auuagaaauaaagca

SEQ ID NO: 3429888 - RNA, 12 nt, Human
aaaacuucuuuu

SEQ ID NO: 3429889 - RNA, 15 nt, Human
aaaacuugugcuaua

SEQ ID NO: 3429890 - RNA, 15 nt, Human
aaaacuuuaaaccug

SEQ ID NO: 3429891 - RNA, 23 nt, Human
aaaacuuuauuuuauauaauaaa

SEQ ID NO: 3429892 - RNA, 20 nt, Human
aaaacuuuccucgccugaca

SEQ ID NO: 3429893 - RNA, 24 nt, Human
aaaacuuugacgagucaccuucca

SEQ ID NO: 3429894 - RNA, 13 nt, Human
aaaacuuuuauaa

SEQ ID NO: 3429895 - RNA, 22 nt, Human
aaaacuuuuauaaauuaaauau

SEQ ID NO: 3429896 - RNA, 15 nt, Human
aaaacuuuucucaga

SEQ ID NO: 3429897 - RNA, 17 nt, Human
aaaagaaaaaaaaaaga

SEQ ID NO: 3429898 - RNA, 17 nt, Human
aaaagaaaaaaaaagaa

SEQ ID NO: 3429899 - RNA, 21 nt, Human
aaaagaaaaaccacucccagu

SEQ ID NO: 3429900 - RNA, 11 nt, Human
aaaagaaaaag

SEQ ID NO: 3429901 - RNA, 12 nt, Human
aaaagaaaauaa

SEQ ID NO: 3429902 - RNA, 14 nt, Human
aaaagaaaauaaaa

SEQ ID NO: 3429903 - RNA, 16 nt, Human
auguuuauuacaguau

SEQ ID NO: 3429904 - RNA, 18 nt, Human
auguuuauuacaguauaa

SEQ ID NO: 3429905 - RNA, 19 nt, Human
auguuuauuacaguauaau

SEQ ID NO: 3429906 - RNA, 14 nt, Human
auguuuauuccuug

SEQ ID NO: 3429907 - RNA, 17 nt, Human
auguuuauucuucuaga

SEQ ID NO: 3429908 - RNA, 17 nt, Human
auguuuauuuacuaauu

SEQ ID NO: 3429909 - RNA, 21 nt, Human
auguuuauuuauucugcauuu

SEQ ID NO: 3429910 - RNA, 23 nt, Human
auguuuauuucauaaagaauugu

SEQ ID NO: 3429911 - RNA, 21 nt, Human
auguuucaaacauauauaaca

SEQ ID NO: 3429912 - RNA, 21 nt, Human
auguuucaagaggagccccca

SEQ ID NO: 3429913 - RNA, 21 nt, Human
auguuucacaccggaagguuu

SEQ ID NO: 3429914 - RNA, 15 nt, Human
auguuuccagacuuc

SEQ ID NO: 3429915 - RNA, 19 nt, Human
auguuuccagcagaagaca

SEQ ID NO: 3429916 - RNA, 18 nt, Human
auguuuccagcauuccca

SEQ ID NO: 3429917 - RNA, 19 nt, Human
auguuuccagcauucccag

SEQ ID NO: 3429918 - RNA, 15 nt, Human
auguuuccauaguuu

SEQ ID NO: 3429919 - RNA, 14 nt, Human
auguuuccuucccu

SEQ ID NO: 3429920 - RNA, 12 nt, Human
auguuucucugg

SEQ ID NO: 3429921 - RNA, 19 nt, Human
auguuucucuggccccaag

SEQ ID NO: 3429922 - RNA, 23 nt, Human
auguuucucuuugauuauuugca

SEQ ID NO: 3429923 - RNA, 21 nt, Human
auguuucuggguccugaagaa

SEQ ID NO: 3429924 - RNA, 15 nt, Human
auguuucuucuaggu

SEQ ID NO: 3429925 - RNA, 13 nt, Human
auguuucuuugau

SEQ ID NO: 3429926 - RNA, 21 nt, Human
auguuucuuuuguauguaaau

SEQ ID NO: 3429927 - RNA, 22 nt, Human
auguuugaaaugaggucuguuu

SEQ ID NO: 3429928 - RNA, 18 nt, Human
auguuugaauuuuucucu

SEQ ID NO: 3429929 - RNA, 18 nt, Human
auguuugaggagcauguu

SEQ ID NO: 3429930 - RNA, 19 nt, Human
auguuugaggagcauguuu

SEQ ID NO: 3429931 - RNA, 17 nt, Human
auguuugcaccuuucua

SEQ ID NO: 3429932 - RNA, 13 nt, Human
auguuugcauaua

SEQ ID NO: 3429933 - RNA, 14 nt, Human
auguuugcauauaa

SEQ ID NO: 3429934 - RNA, 15 nt, Human
auguuugcauauaag

SEQ ID NO: 3429935 - RNA, 15 nt, Human
auguuugccuucugc

SEQ ID NO: 3429936 - RNA, 19 nt, Human
auguuugcucagaacacau

SEQ ID NO: 3429937 - RNA, 22 nt, Human
auguuugcucagcuucuccaac

SEQ ID NO: 3429938 - RNA, 18 nt, Human
auguuugcuucauaaaug

SEQ ID NO: 3429939 - RNA, 20 nt, Human
auguuugcuucauaaaugaa

SEQ ID NO: 3429940 - RNA, 17 nt, Human
auguuuggcauguaaau

SEQ ID NO: 3429941 - RNA, 13 nt, Human
auguuuggcucug

SEQ ID NO: 3429942 - RNA, 19 nt, Human
auguuuggcucugcuuuua

SEQ ID NO: 3429943 - RNA, 10 nt, Human
auguuugugg

SEQ ID NO: 3429944 - RNA, 18 nt, Human
auguuuguggccucagaa

SEQ ID NO: 3429945 - RNA, 14 nt, Human
auguuuguuaaaaa

SEQ ID NO: 3429946 - RNA, 17 nt, Human
auguuuguuaaaaauaa

SEQ ID NO: 3429947 - RNA, 19 nt, Human
auguuuuaauuccaugaau

SEQ ID NO: 3429948 - RNA, 19 nt, Human
auguuuuagaguuaacaau

SEQ ID NO: 3429949 - RNA, 12 nt, Human
auguuuuagcau

SEQ ID NO: 3429950 - RNA, 17 nt, Human
auguuuuauauagcaag

SEQ ID NO: 3429951 - RNA, 23 nt, Human
auguuuuauuucauugguuaauu

SEQ ID NO: 3429952 - RNA, 16 nt, Human
auguuuucaaaaggua

SEQ ID NO: 3429953 - RNA, 22 nt, Human
auguuuucaaaagguauuauac

SEQ ID NO: 3429954 - RNA, 13 nt, Human
auguuuucaaaug

SEQ ID NO: 3429955 - RNA, 15 nt, Human
auguuuucaaaugga

SEQ ID NO: 3429956 - RNA, 15 nt, Human
auguuuucaaauguu

SEQ ID NO: 3429957 - RNA, 19 nt, Human
auguuuuccagcuccucau

SEQ ID NO: 3429958 - RNA, 20 nt, Human
auguuuuccauuguuugaaa

SEQ ID NO: 3429959 - RNA, 21 nt, Human
auguuuucugaaaauauaacc

SEQ ID NO: 3429960 - RNA, 12 nt, Human
auguuuugacau

SEQ ID NO: 3429961 - RNA, 14 nt, Human
auguuuugacauuu

SEQ ID NO: 3429962 - RNA, 18 nt, Human
auguuuugauaaaguagu

SEQ ID NO: 3429963 - RNA, 17 nt, Human
auguuuugguccacuuu

SEQ ID NO: 3429964 - RNA, 21 nt, Human
auguuuuguaaacuuugaaau

SEQ ID NO: 3429965 - RNA, 16 nt, Human
auguuuuguauacaaa

SEQ ID NO: 3429966 - RNA, 17 nt, Human
auguuuugugacuauau

SEQ ID NO: 3429967 - RNA, 21 nt, Human
auguuuugugacuauauagag

SEQ ID NO: 3429968 - RNA, 15 nt, Human
auguuuugugcauuu

SEQ ID NO: 3429969 - RNA, 23 nt, Human
auguuuugugcauuuguaaaugc

SEQ ID NO: 3429970 - RNA, 16 nt, Human
auguuuuguuucugaa

SEQ ID NO: 3429971 - RNA, 19 nt, Human
auguuuuguuucugaaaau

SEQ ID NO: 3429972 - RNA, 16 nt, Human
auguuuuuaaaaguuu

SEQ ID NO: 3429973 - RNA, 22 nt, Human
auguuuuuaaaaguuucaaugu

SEQ ID NO: 3429974 - RNA, 14 nt, Human
auguuuuuaaaauc

SEQ ID NO: 3429975 - RNA, 17 nt, Human
auguuuuuaaaaucuua

SEQ ID NO: 3429976 - RNA, 20 nt, Human
auguuuuuauaaaaauaaau

SEQ ID NO: 3429977 - RNA, 21 nt, Human
auguuuuuauaaaaauaaaua

SEQ ID NO: 3429978 - RNA, 20 nt, Human
auguuuuuaugauaucccug

SEQ ID NO: 3429979 - RNA, 13 nt, Human
auguuuuucaguu

SEQ ID NO: 3429980 - RNA, 19 nt, Human
auguuuuucaguucaaagu

SEQ ID NO: 3429981 - RNA, 17 nt, Human
auguuuuucuucucccu

SEQ ID NO: 3429982 - RNA, 18 nt, Human
auguuuuucuucucccuc

SEQ ID NO: 3429983 - RNA, 21 nt, Human
auguuuuugaaggcagaaagc

SEQ ID NO: 3429984 - RNA, 14 nt, Human
auuaaaaaaaaaga

SEQ ID NO: 3429985 - RNA, 14 nt, Human
auuaaaaaaaacaa

SEQ ID NO: 3429986 - RNA, 23 nt, Human
auuaaaaaaaacaaaaagaacaa

SEQ ID NO: 3429987 - RNA, 22 nt, Human
auuaaaaaacuucauguaauuu

SEQ ID NO: 3429988 - RNA, 17 nt, Human
auuaaaaaagauaaaca

SEQ ID NO: 3429989 - RNA, 17 nt, Human
auuaaaaaauuuccagu

SEQ ID NO: 3429990 - RNA, 16 nt, Human
auuaaaaacuaguagu

SEQ ID NO: 3429991 - RNA, 19 nt, Human
auuaaaaagauucuuuuuc

SEQ ID NO: 3429992 - RNA, 18 nt, Human
auuaaaaagguuuacaga

SEQ ID NO: 3429993 - RNA, 18 nt, Human
auuaaaaagucuuuuaaa

SEQ ID NO: 3429994 - RNA, 15 nt, Human
auuaaaaaguuaauc

SEQ ID NO: 3429995 - RNA, 12 nt, Human
auuaaaaauaua

SEQ ID NO: 3429996 - RNA, 17 nt, Human
auuaaaaauauaaaacu

SEQ ID NO: 3429997 - RNA, 17 nt, Human
auuaaaaauaucaaauu

SEQ ID NO: 3429998 - RNA, 14 nt, Human
auuaaaaauaugga

SEQ ID NO: 3429999 - RNA, 21 nt, Human
auuaaaaauauggaacuucua

SEQ ID NO: 3430000 - RNA, 21 nt, Human
auuaaaaaugguaaaauugca

SEQ ID NO: 3430001 - RNA, 14 nt, Human
auuaaaacaauauu

SEQ ID NO: 3430002 - RNA, 18 nt, Human
auuaaaacaauauuguuu

SEQ ID NO: 3430003 - RNA, 22 nt, Human
auuaaaacagcugcauuagaaa

SEQ ID NO: 3430004 - RNA, 20 nt, Human
auuaaaacauuggauuaucc

SEQ ID NO: 3430005 - RNA, 13 nt, Human
auuaaaacucagc

SEQ ID NO: 3430006 - RNA, 15 nt, Human
auuaaaacucagccu

SEQ ID NO: 3430007 - RNA, 22 nt, Human
auuaaaacugaagucugaaauu

SEQ ID NO: 3430008 - RNA, 13 nt, Human
auuaaaacugcuu

SEQ ID NO: 3430009 - RNA, 15 nt, Human
auuaaaagaauauuu

SEQ ID NO: 3430010 - RNA, 11 nt, Human
auuaaaagacu

SEQ ID NO: 3430011 - RNA, 15 nt, Human
auuaaaagacucauc

SEQ ID NO: 3430012 - RNA, 15 nt, Human
auuaaaagcaaauca

SEQ ID NO: 3430013 - RNA, 16 nt, Human
auuaaaagcaaaucau

SEQ ID NO: 3430014 - RNA, 12 nt, Human
auuaaaagucac

SEQ ID NO: 3430015 - RNA, 13 nt, Human
auuaaaagucaca

SEQ ID NO: 3430016 - RNA, 22 nt, Human
auuaaaagucacaauguucuuu

SEQ ID NO: 3430017 - RNA, 15 nt, Human
auuaaaaguuugaaa

SEQ ID NO: 3430018 - RNA, 13 nt, Human
auuaaaauauaau

SEQ ID NO: 3430019 - RNA, 13 nt, Human
auuaaaauaugca

SEQ ID NO: 3430020 - RNA, 16 nt, Human
auuaaaauccucaauc

SEQ ID NO: 3430021 - RNA, 15 nt, Human
auuaaaaucuuaaac

SEQ ID NO: 3430022 - RNA, 18 nt, Human
auuaaaaugaugaaggaa

SEQ ID NO: 3430023 - RNA, 19 nt, Human
auuaaaaugauuguaaaau

SEQ ID NO: 3430024 - RNA, 20 nt, Human
auuaaaaugauuguaaaaua

SEQ ID NO: 3430025 - RNA, 12 nt, Human
auuaaaauggau

SEQ ID NO: 3430026 - RNA, 15 nt, Human
auuaaaauguaugca

SEQ ID NO: 3430027 - RNA, 14 nt, Human
auuaaaauucugaa

SEQ ID NO: 3430028 - RNA, 13 nt, Human
auuaaacaaaguu

SEQ ID NO: 3430029 - RNA, 15 nt, Human
auuaaacaauuuauu

SEQ ID NO: 3430030 - RNA, 20 nt, Human
auuaaacaauuuauuuuauu

SEQ ID NO: 3430031 - RNA, 19 nt, Human
auuaaacagaugaugagaa

SEQ ID NO: 3430032 - RNA, 19 nt, Human
auuaaacagaugugaauau

SEQ ID NO: 3430033 - RNA, 19 nt, Human
auuccauugccuagcucuu

SEQ ID NO: 3430034 - RNA, 17 nt, Human
auuccauuuaucuuucu

SEQ ID NO: 3430035 - RNA, 17 nt, Human
auucccaacuagacauu

SEQ ID NO: 3430036 - RNA, 21 nt, Human
auucccaacuagacauuacca

SEQ ID NO: 3430037 - RNA, 15 nt, Human
auucccaagaaaugc

SEQ ID NO: 3430038 - RNA, 22 nt, Human
auucccaagcucuagugggaag

SEQ ID NO: 3430039 - RNA, 16 nt, Human
auucccaagcucugcu

SEQ ID NO: 3430040 - RNA, 17 nt, Human
auucccaagcucugcuc

SEQ ID NO: 3430041 - RNA, 18 nt, Human
auucccaagcucugcucc

SEQ ID NO: 3430042 - RNA, 19 nt, Human
auucccaagcucugcuccu

SEQ ID NO: 3430043 - RNA, 15 nt, Human
auucccaccaagguc

SEQ ID NO: 3430044 - RNA, 23 nt, Human
auucccagagacaggaaaauccu

SEQ ID NO: 3430045 - RNA, 17 nt, Human
auucccagagcaaaaua

SEQ ID NO: 3430046 - RNA, 12 nt, Human
auucccagccca

SEQ ID NO: 3430047 - RNA, 11 nt, Human
auucccaggag

SEQ ID NO: 3430048 - RNA, 12 nt, Human
auucccaggagu

SEQ ID NO: 3430049 - RNA, 23 nt, Human
auucccagguaggccaagguguc

SEQ ID NO: 3430050 - RNA, 15 nt, Human
auucccaucugucac

SEQ ID NO: 3430051 - RNA, 15 nt, Human
auucccaucuuuacu

SEQ ID NO: 3430052 - RNA, 23 nt, Human
auucccauuuugcaaaauuucca

SEQ ID NO: 3430053 - RNA, 16 nt, Human
auuccccacccucccc

SEQ ID NO: 3430054 - RNA, 19 nt, Human
auuccccaggaggccagcc

SEQ ID NO: 3430055 - RNA, 22 nt, Human
auuccccaggaggccagccuug

SEQ ID NO: 3430056 - RNA, 23 nt, Human
auucccccuggccaccacccccc

SEQ ID NO: 3430057 - RNA, 21 nt, Human
auuccccuaucucuagaauuu

SEQ ID NO: 3430058 - RNA, 14 nt, Human
auuccccuuccugu

SEQ ID NO: 3430059 - RNA, 21 nt, Human
auucccuaucuuuuaguuuua

SEQ ID NO: 3430060 - RNA, 22 nt, Human
auucccuaucuuuuaguuuuag

SEQ ID NO: 3430061 - RNA, 14 nt, Human
auucccuccugcua

SEQ ID NO: 3430062 - RNA, 16 nt, Human
auucccucucaucuca

SEQ ID NO: 3430063 - RNA, 14 nt, Human
auucccucucccag

SEQ ID NO: 3430064 - RNA, 14 nt, Human
auucccucucucug

SEQ ID NO: 3430065 - RNA, 15 nt, Human
auucccucucucuga

SEQ ID NO: 3430066 - RNA, 19 nt, Human
auucccugagucaccagga

SEQ ID NO: 3430067 - RNA, 19 nt, Human
auucccuggccuuucauau

SEQ ID NO: 3430068 - RNA, 14 nt, Human
auucccugggaucu

SEQ ID NO: 3430069 - RNA, 19 nt, Human
auucccuguacaauauuua

SEQ ID NO: 3430070 - RNA, 21 nt, Human
auucccuguacaauauuuaaa

SEQ ID NO: 3430071 - RNA, 18 nt, Human
auucccuucaaugcaaaa

SEQ ID NO: 3430072 - RNA, 19 nt, Human
auucccuucaucuggaacc

SEQ ID NO: 3430073 - RNA, 15 nt, Human
auucccuuccugcca

SEQ ID NO: 3430074 - RNA, 19 nt, Human
auucccuuccugccagccc

SEQ ID NO: 3430075 - RNA, 23 nt, Human
auucccuuuucaccuuuucagga

SEQ ID NO: 3430076 - RNA, 22 nt, Human
auuccggaaacuaguguacauu

SEQ ID NO: 3430077 - RNA, 15 nt, Human
auuccggauccuaag

SEQ ID NO: 3430078 - RNA, 16 nt, Human
auuccguagccagcug

SEQ ID NO: 3430079 - RNA, 12 nt, Human
auuccgucacca

SEQ ID NO: 3430080 - RNA, 20 nt, Human
auuccguuuacauuuuagac

SEQ ID NO: 3430081 - RNA, 19 nt, Human
auuccuaaaauuauggaaa

SEQ ID NO: 3430082 - RNA, 17 nt, Human
auuccuaaagaaaaaua

SEQ ID NO: 3430083 - RNA, 21 nt, Human
auuccuaacuaucacugguuu

SEQ ID NO: 3430084 - RNA, 14 nt, Human
auuccuaagaauca

SEQ ID NO: 3430085 - RNA, 22 nt, Human
auuccuacaauauauauucugg

SEQ ID NO: 3430086 - RNA, 24 nt, Human
auuccuagaaacugacacaugcug

SEQ ID NO: 3430087 - RNA, 19 nt, Human
auuccuauauccugugacu

SEQ ID NO: 3430088 - RNA, 18 nt, Human
auuccuauugugauuuga

SEQ ID NO: 3430089 - RNA, 20 nt, Human
auuccuauugugauuugacu

SEQ ID NO: 3430090 - RNA, 22 nt, Human
auuccuauugugcaauguaaau

SEQ ID NO: 3430091 - RNA, 17 nt, Human
auuccucaugaauguaa

SEQ ID NO: 3430092 - RNA, 22 nt, Human
auuccucaugaauguaaauuug

SEQ ID NO: 3430093 - RNA, 11 nt, Human
auuccuccagg

SEQ ID NO: 3430094 - RNA, 20 nt, Human
auuccucuacuaacaaucag

SEQ ID NO: 3430095 - RNA, 17 nt, Human
auuccucuuugcuuugc

SEQ ID NO: 3430096 - RNA, 15 nt, Human
auuccucuuuucucu

SEQ ID NO: 3430097 - RNA, 15 nt, Human
auuccugaagaacca

SEQ ID NO: 3430098 - RNA, 17 nt, Human
auuccugaaugaaauau

SEQ ID NO: 3430099 - RNA, 22 nt, Human
auuccugaccuccgccauccac

SEQ ID NO: 3430100 - RNA, 22 nt, Human
auuccugacgagauaagcaguu

SEQ ID NO: 3430101 - RNA, 20 nt, Human
auuccugagauuuccuccug

SEQ ID NO: 3430102 - RNA, 22 nt, Human
auuccugagauuuccuccuggc

SEQ ID NO: 3430103 - RNA, 19 nt, Human
auuccugauaugauuuaaa

SEQ ID NO: 3430104 - RNA, 20 nt, Human
auuccugauaugauuuaaaa

SEQ ID NO: 3430105 - RNA, 17 nt, Human
auuccugcagccuggag

SEQ ID NO: 3430106 - RNA, 15 nt, Human
auuccugcauuugug

SEQ ID NO: 3430107 - RNA, 15 nt, Human
auuccugccugucuc

SEQ ID NO: 3430108 - RNA, 17 nt, Human
auuccugggaaauauuc

SEQ ID NO: 3430109 - RNA, 22 nt, Human
auuccugggaaauauucccuag

SEQ ID NO: 3430110 - RNA, 10 nt, Human
auuccugggc

SEQ ID NO: 3430111 - RNA, 18 nt, Human
auuccuguagcaucuucu

SEQ ID NO: 3430112 - RNA, 18 nt, Human
auuccuguauguugucca

SEQ ID NO: 3430113 - RNA, 19 nt, Human
aguuucuaaacuggagacu

SEQ ID NO: 3430114 - RNA, 16 nt, Human
aguuucuagcuagaaa

SEQ ID NO: 3430115 - RNA, 22 nt, Human
aguuucucagauccuuguuuca

SEQ ID NO: 3430116 - RNA, 16 nt, Human
aguuucucagcuccca

SEQ ID NO: 3430117 - RNA, 21 nt, Human
aguuucuccaagcaggacaug

SEQ ID NO: 3430118 - RNA, 17 nt, Human
aguuucugaguuuuacc

SEQ ID NO: 3430119 - RNA, 18 nt, Human
aguuucugaguuuuacca

SEQ ID NO: 3430120 - RNA, 19 nt, Human
aguuucugccgcagcccug

SEQ ID NO: 3430121 - RNA, 20 nt, Human
aguuucugucguuaaaaaca

SEQ ID NO: 3430122 - RNA, 23 nt, Human
aguuucugugguuggcugggaaa

SEQ ID NO: 3430123 - RNA, 17 nt, Human
aguuucuguucugugga

SEQ ID NO: 3430124 - RNA, 21 nt, Human
aguuucuguucuguggaaagu

SEQ ID NO: 3430125 - RNA, 18 nt, Human
aguuucuguuugauucuu

SEQ ID NO: 3430126 - RNA, 17 nt, Human
aguuucuuagcuuuuua

SEQ ID NO: 3430127 - RNA, 16 nt, Human
aguuucuucaaucuga

SEQ ID NO: 3430128 - RNA, 21 nt, Human
aguuucuucugcgccucaggc

SEQ ID NO: 3430129 - RNA, 20 nt, Human
aguuucuuuauuuuguguaa

SEQ ID NO: 3430130 - RNA, 22 nt, Human
aguuucuuuauuuuguguaaaa

SEQ ID NO: 3430131 - RNA, 18 nt, Human
aguuucuuuccugccuuc

SEQ ID NO: 3430132 - RNA, 19 nt, Human
aguuucuuuccugccuucu

SEQ ID NO: 3430133 - RNA, 14 nt, Human
aguuugaaauucug

SEQ ID NO: 3430134 - RNA, 15 nt, Human
aguuugaaauucuga

SEQ ID NO: 3430135 - RNA, 23 nt, Human
aguuugaaauucugaauuugcaa

SEQ ID NO: 3430136 - RNA, 15 nt, Human
aguuugaagaccgcc

SEQ ID NO: 3430137 - RNA, 16 nt, Human
aguuugaaggaaacag

SEQ ID NO: 3430138 - RNA, 21 nt, Human
aguuugaaggaggugagggau

SEQ ID NO: 3430139 - RNA, 14 nt, Human
aguuugaggaaauu

SEQ ID NO: 3430140 - RNA, 20 nt, Human
aguuugaggaaauuugcagc

SEQ ID NO: 3430141 - RNA, 14 nt, Human
aguuugaggcugca

SEQ ID NO: 3430142 - RNA, 16 nt, Human
aguuugauaaauagug

SEQ ID NO: 3430143 - RNA, 17 nt, Human
aguuugauauuaaagga

SEQ ID NO: 3430144 - RNA, 22 nt, Human
aguuugaucuuccucugcuaaa

SEQ ID NO: 3430145 - RNA, 17 nt, Human
aguuugaugaggcccuc

SEQ ID NO: 3430146 - RNA, 16 nt, Human
aguuugauuaaauucu

SEQ ID NO: 3430147 - RNA, 22 nt, Human
aguuugcacucaaaucuuaaga

SEQ ID NO: 3430148 - RNA, 14 nt, Human
aguuugcagaaaag

SEQ ID NO: 3430149 - RNA, 23 nt, Human
aguuugcagaaaagcaccugccg

SEQ ID NO: 3430150 - RNA, 20 nt, Human
aguuugcauuccugauauga

SEQ ID NO: 3430151 - RNA, 15 nt, Human
aguuugcauuucaga

SEQ ID NO: 3430152 - RNA, 17 nt, Human
aguuugcauuucagaaa

SEQ ID NO: 3430153 - RNA, 11 nt, Human
aguuugcugua

SEQ ID NO: 3430154 - RNA, 11 nt, Human
aguuugcuuag

SEQ ID NO: 3430155 - RNA, 12 nt, Human
aguuuggccaga

SEQ ID NO: 3430156 - RNA, 22 nt, Human
aguuuggccgggugcgguggcu

SEQ ID NO: 3430157 - RNA, 21 nt, Human
aguuugggaucccugucuuuc

SEQ ID NO: 3430158 - RNA, 20 nt, Human
aguuuggggguuuugcuguu

SEQ ID NO: 3430159 - RNA, 18 nt, Human
aguuuggguaaaauacuu

SEQ ID NO: 3430160 - RNA, 14 nt, Human
aguuuggucuggac

SEQ ID NO: 3430161 - RNA, 15 nt, Human
aguuuggucuggacu

SEQ ID NO: 3430162 - RNA, 20 nt, Human
aguuugguucacuuacagau

SEQ ID NO: 3430163 - RNA, 16 nt, Human
aguuugguuucuagca

SEQ ID NO: 3430164 - RNA, 15 nt, Human
aguuuguacaugcau

SEQ ID NO: 3430165 - RNA, 17 nt, Human
aguuuguagguaaaaug

SEQ ID NO: 3430166 - RNA, 13 nt, Human
aguuuguauauac

SEQ ID NO: 3430167 - RNA, 22 nt, Human
aguuuguaugccaagugagaag

SEQ ID NO: 3430168 - RNA, 18 nt, Human
aguuugucacaugaaaca

SEQ ID NO: 3430169 - RNA, 15 nt, Human
aguuuguccauuugu

SEQ ID NO: 3430170 - RNA, 17 nt, Human
aguuugucgcucaugug

SEQ ID NO: 3430171 - RNA, 19 nt, Human
aguuugucgcucaugugug

SEQ ID NO: 3430172 - RNA, 19 nt, Human
aguuugucuauuuuaaaau

SEQ ID NO: 3430173 - RNA, 19 nt, Human
aguuugugcugguguaugu

SEQ ID NO: 3430174 - RNA, 16 nt, Human
aguuugugugucuuaa

SEQ ID NO: 3430175 - RNA, 16 nt, Human
aguuuguguguugucu

SEQ ID NO: 3430176 - RNA, 22 nt, Human
auugggaguccaggcacaggau

SEQ ID NO: 3430177 - RNA, 16 nt, Human
auugggauuuucuaca

SEQ ID NO: 3430178 - RNA, 17 nt, Human
auugggcaagugauuga

SEQ ID NO: 3430179 - RNA, 20 nt, Human
auugggcagcgcccuuccuc

SEQ ID NO: 3430180 - RNA, 20 nt, Human
auuggggauucuuaaaguug

SEQ ID NO: 3430181 - RNA, 22 nt, Human
auuggggauucuuaaaguugaa

SEQ ID NO: 3430182 - RNA, 14 nt, Human
auuggggcucccag

SEQ ID NO: 3430183 - RNA, 20 nt, Human
auuggggcucccagccaggc

SEQ ID NO: 3430184 - RNA, 23 nt, Human
auuggggcucccagccaggcccu

SEQ ID NO: 3430185 - RNA, 17 nt, Human
auugggggaggaaaagu

SEQ ID NO: 3430186 - RNA, 19 nt, Human
auugggggggccaaaagga

SEQ ID NO: 3430187 - RNA, 17 nt, Human
auuggguuaugaauauu

SEQ ID NO: 3430188 - RNA, 22 nt, Human
auuggguucaugaugcagucuc

SEQ ID NO: 3430189 - RNA, 18 nt, Human
auugguaccuugcacaca

SEQ ID NO: 3430190 - RNA, 17 nt, Human
auugguaucaagaaagu

SEQ ID NO: 3430191 - RNA, 18 nt, Human
auugguauucacuaaucu

SEQ ID NO: 3430192 - RNA, 14 nt, Human
auugguccagcuug

SEQ ID NO: 3430193 - RNA, 15 nt, Human
auugguccagcuugc

SEQ ID NO: 3430194 - RNA, 17 nt, Human
auugguccagcuugcuc

SEQ ID NO: 3430195 - RNA, 21 nt, Human
auugguggcagauuuuacaaa

SEQ ID NO: 3430196 - RNA, 16 nt, Human
auugguggcuuuccuu

SEQ ID NO: 3430197 - RNA, 17 nt, Human
auuggugguucucagca

SEQ ID NO: 3430198 - RNA, 12 nt, Human
auugguguugac

SEQ ID NO: 3430199 - RNA, 18 nt, Human
auugguguugucauugua

SEQ ID NO: 3430200 - RNA, 16 nt, Human
auugguucccuuugcu

SEQ ID NO: 3430201 - RNA, 15 nt, Human
auugguuuaaagaaa

SEQ ID NO: 3430202 - RNA, 18 nt, Human
auugguuuaaagaaagug

SEQ ID NO: 3430203 - RNA, 14 nt, Human
auugguuucucuuc

SEQ ID NO: 3430204 - RNA, 17 nt, Human
auugguuucucuucucc

SEQ ID NO: 3430205 - RNA, 21 nt, Human
auugguuuuaauugaaggaaa

SEQ ID NO: 3430206 - RNA, 15 nt, Human
auugguuuuaugaug

SEQ ID NO: 3430207 - RNA, 15 nt, Human
auugguuuuccugug

SEQ ID NO: 3430208 - RNA, 14 nt, Human
auuguaaaacaggu

SEQ ID NO: 3430209 - RNA, 23 nt, Human
auuguaaaagcauuuuguaauaa

SEQ ID NO: 3430210 - RNA, 15 nt, Human
auuguaaaauuguau

SEQ ID NO: 3430211 - RNA, 17 nt, Human
auuguaaaauuguauag

SEQ ID NO: 3430212 - RNA, 17 nt, Human
auuguaaacaaacucuu

SEQ ID NO: 3430213 - RNA, 19 nt, Human
auuguaaaccgcuuuggcc

SEQ ID NO: 3430214 - RNA, 12 nt, Human
auuguaaaguaa

SEQ ID NO: 3430215 - RNA, 16 nt, Human
auuguaaauacaaguu

SEQ ID NO: 3430216 - RNA, 23 nt, Human
auuguaaauacaaguucuauuua

SEQ ID NO: 3430217 - RNA, 16 nt, Human
auuguaaauauguuuu

SEQ ID NO: 3430218 - RNA, 15 nt, Human
auuguaaauuuuaga

SEQ ID NO: 3430219 - RNA, 18 nt, Human
auuguaacagacauuguu

SEQ ID NO: 3430220 - RNA, 16 nt, Human
auuguaacguugcugu

SEQ ID NO: 3430221 - RNA, 18 nt, Human
auuguaacguugcugugg

SEQ ID NO: 3430222 - RNA, 15 nt, Human
auuguaacuguucuu

SEQ ID NO: 3430223 - RNA, 21 nt, Human
auuguaagaaauacuguacaa

SEQ ID NO: 3430224 - RNA, 19 nt, Human
auuguaagcguauggcuuu

SEQ ID NO: 3430225 - RNA, 23 nt, Human
auuguaauaggcguaacuaauuu

SEQ ID NO: 3430226 - RNA, 13 nt, Human
auuguaaucacug

SEQ ID NO: 3430227 - RNA, 16 nt, Human
auuguaaucugaauaa

SEQ ID NO: 3430228 - RNA, 15 nt, Human
auuguaauguuacug

SEQ ID NO: 3430229 - RNA, 17 nt, Human
auuguaauguuacugau

SEQ ID NO: 3430230 - RNA, 16 nt, Human
auuguaauuauaucug

SEQ ID NO: 3430231 - RNA, 17 nt, Human
auuguaauuauaucuga

SEQ ID NO: 3430232 - RNA, 21 nt, Human
auuguaauuauaucugaggaa

SEQ ID NO: 3430233 - RNA, 18 nt, Human
auuguacaaaauuaagca

SEQ ID NO: 3430234 - RNA, 17 nt, Human
auuguacaaaguauuaa

SEQ ID NO: 3430235 - RNA, 22 nt, Human
auuguacaaaguauuaagcaua

SEQ ID NO: 3430236 - RNA, 14 nt, Human
auuguacagcuguu

SEQ ID NO: 3430237 - RNA, 20 nt, Human
auuguacagcuguuuaagau

SEQ ID NO: 3430238 - RNA, 16 nt, Human
auuguacaguuuguuu

SEQ ID NO: 3430239 - RNA, 21 nt, Human
auuguacaguuuguuuacaca

SEQ ID NO: 3430240 - RNA, 15 nt, Human
auuguacaguuuuua

SEQ ID NO: 3430241 - RNA, 20 nt, Human
auuguacauauuuguggaau

SEQ ID NO: 3430242 - RNA, 19 nt, Human
auuguaccucucuuauaga

SEQ ID NO: 3430243 - RNA, 14 nt, Human
auuguaccuuuuaa

SEQ ID NO: 3430244 - RNA, 22 nt, Human
auuguaccuuuuaacaccugau

SEQ ID NO: 3430245 - RNA, 15 nt, Human
auuguacguuuaaag

SEQ ID NO: 3430246 - RNA, 19 nt, Human
auuguacguuuaaagugua

SEQ ID NO: 3430247 - RNA, 18 nt, Human
auuguacuaccuguguau

SEQ ID NO: 3430248 - RNA, 18 nt, Human
auuguacucaauggauuu

SEQ ID NO: 3430249 - RNA, 15 nt, Human
auuguacuuugugcu

SEQ ID NO: 3430250 - RNA, 17 nt, Human
auuguagagccagaggu

SEQ ID NO: 3430251 - RNA, 18 nt, Human
auuguagagccagagguc

SEQ ID NO: 3430252 - RNA, 15 nt, Human
auuguagcauuucuu

SEQ ID NO: 3430253 - RNA, 20 nt, Human
auuguagcgucuuucuuuuu

SEQ ID NO: 3430254 - RNA, 15 nt, Human
auuguaggugcaaga

SEQ ID NO: 3430255 - RNA, 14 nt, Human
auuguaguuaauga

SEQ ID NO: 3430256 - RNA, 14 nt, Human
auuguauaaaaaua

SEQ ID NO: 3430257 - RNA, 17 nt, Human
auuguauaaaaauagaa

SEQ ID NO: 3430258 - RNA, 21 nt, Human
auuguauaaacuaucaguuug

SEQ ID NO: 3430259 - RNA, 16 nt, Human
auuguauaacagguua

SEQ ID NO: 3430260 - RNA, 17 nt, Human
auuguauaacagguuau

SEQ ID NO: 3430261 - RNA, 18 nt, Human
auuguauaacagguuauu

SEQ ID NO: 3430262 - RNA, 17 nt, Human
auuguauauuacaauga

SEQ ID NO: 3430263 - RNA, 19 nt, Human
auuguauauuacaaugauc

SEQ ID NO: 3430264 - RNA, 13 nt, Human
auuguauauucac

SEQ ID NO: 3430265 - RNA, 14 nt, Human
auuguauauucacu

SEQ ID NO: 3430266 - RNA, 13 nt, Human
auuguauauugua

SEQ ID NO: 3430267 - RNA, 17 nt, Human
auuguauauuguaauuu

SEQ ID NO: 3430268 - RNA, 18 nt, Human
auuguauauuuuuaucua

SEQ ID NO: 3430269 - RNA, 19 nt, Human
auuguauauuuuuaucuau

SEQ ID NO: 3430270 - RNA, 14 nt, Human
auuguaucagaggc

SEQ ID NO: 3430271 - RNA, 15 nt, Human
auuguaucagaggcc

SEQ ID NO: 3430272 - RNA, 17 nt, Human
auuguaucguauagcug

SEQ ID NO: 3430273 - RNA, 18 nt, Human
auuguaucuagugcagcu

SEQ ID NO: 3430274 - RNA, 21 nt, Human
auuguaucuagugcagcugau

SEQ ID NO: 3430275 - RNA, 13 nt, Human
auuguaugaugug

SEQ ID NO: 3430276 - RNA, 12 nt, Human
auuguauugcug

SEQ ID NO: 3430277 - RNA, 14 nt, Human
auuguauugcuguc

SEQ ID NO: 3430278 - RNA, 13 nt, Human
auuguauuguuag

SEQ ID NO: 3430279 - RNA, 11 nt, Human
auuguauuuau

SEQ ID NO: 3430280 - RNA, 15 nt, Human
auuguauuuaugugu

SEQ ID NO: 3430281 - RNA, 18 nt, Human
auuguauuuauucaauaa

SEQ ID NO: 3430282 - RNA, 19 nt, Human
auuguauuuauucaauaaa

SEQ ID NO: 3430283 - RNA, 14 nt, Human
auuguauuuuagua

SEQ ID NO: 3430284 - RNA, 21 nt, Human
auugucaaugcuggagaaaaa

SEQ ID NO: 3430285 - RNA, 19 nt, Human
auugucaccugcuucucug

SEQ ID NO: 3430286 - RNA, 21 nt, Human
auugucaccugcuucucugcc

SEQ ID NO: 3430287 - RNA, 13 nt, Human
auugucacuuuuu

SEQ ID NO: 3430288 - RNA, 13 nt, Human
auugucagcuacu

SEQ ID NO: 3430289 - RNA, 15 nt, Human
auugucauuaaaggu

SEQ ID NO: 3430290 - RNA, 12 nt, Human
auugucccucug

SEQ ID NO: 3430291 - RNA, 23 nt, Human
auugucccucugccccauccucc

SEQ ID NO: 3430292 - RNA, 21 nt, Human
auuguccuauuaguguuauau

SEQ ID NO: 3430293 - RNA, 22 nt, Human
auugucgaaaagagucuuccaa

SEQ ID NO: 3430294 - RNA, 12 nt, Human
auugucucagag

SEQ ID NO: 3430295 - RNA, 10 nt, Human
auugucuccc

SEQ ID NO: 3430296 - RNA, 19 nt, Human
auugucucguuugugauuc

SEQ ID NO: 3430297 - RNA, 14 nt, Human
auugucuguaaauc

SEQ ID NO: 3430298 - RNA, 15 nt, Human
auugucugugaagug

SEQ ID NO: 3430299 - RNA, 16 nt, Human
auugucuuaauauugu

SEQ ID NO: 3430300 - RNA, 15 nt, Human
auugucuuaauggau

SEQ ID NO: 3430301 - RNA, 17 nt, Human
auugucuuaauggauga

SEQ ID NO: 3430302 - RNA, 19 nt, Human
auugucuuaauggaugaaa

SEQ ID NO: 3430303 - RNA, 21 nt, Human
auugucuuaauggaugaaauc

SEQ ID NO: 3430304 - RNA, 18 nt, Human
auugucuucggaaaccuu

SEQ ID NO: 3430305 - RNA, 20 nt, Human
auugucuucggaaaccuugg

SEQ ID NO: 3430306 - RNA, 18 nt, Human
auugucuuuugucaugug

SEQ ID NO: 3430307 - RNA, 17 nt, Human
auugugaaccaaugcaa

SEQ ID NO: 3430308 - RNA, 19 nt, Human
auugugaauugauaauaaa

SEQ ID NO: 3430309 - RNA, 15 nt, Human
auugugaccaaguua

SEQ ID NO: 3430310 - RNA, 16 nt, Human
auugugaccaaguuau

SEQ ID NO: 3430311 - RNA, 21 nt, Human
auugugaugguucguucuguu

SEQ ID NO: 3430312 - RNA, 22 nt, Human
auugugauuagacagaacaccu

SEQ ID NO: 3430313 - RNA, 14 nt, Human
auugugauuugacu

SEQ ID NO: 3430314 - RNA, 18 nt, Human
auugugauuugacuguuu

SEQ ID NO: 3430315 - RNA, 17 nt, Human
auugugcaauguaaaua

SEQ ID NO: 3430316 - RNA, 16 nt, Human
auugugcaauguguau

SEQ ID NO: 3430317 - RNA, 18 nt, Human
auugugcaauguguauaa

SEQ ID NO: 3430318 - RNA, 19 nt, Human
auugugcacauacuugaga

SEQ ID NO: 3430319 - RNA, 16 nt, Human
auugugccaauaugua

SEQ ID NO: 3430320 - RNA, 13 nt, Human
auugugccccugc

SEQ ID NO: 3430321 - RNA, 19 nt, Human
auacagauuuugauagcaa

SEQ ID NO: 3430322 - RNA, 22 nt, Human
auacagauuuugauagcaaagc

SEQ ID NO: 3430323 - RNA, 13 nt, Human
auacagcagcaag

SEQ ID NO: 3430324 - RNA, 20 nt, Human
auacagcagcaagaaaaaaa

SEQ ID NO: 3430325 - RNA, 18 nt, Human
auacagccaaagauaauc

SEQ ID NO: 3430326 - RNA, 13 nt, Human
auacagcucagaa

SEQ ID NO: 3430327 - RNA, 20 nt, Human
auacagcuguauugucugaa

SEQ ID NO: 3430328 - RNA, 19 nt, Human
auacaggaaaagcugcuga

SEQ ID NO: 3430329 - RNA, 22 nt, Human
auacaggaaaagcugcugacag

SEQ ID NO: 3430330 - RNA, 23 nt, Human
auacaggaaaagcugcugacagu

SEQ ID NO: 3430331 - RNA, 15 nt, Human
auacaggaaacaguu

SEQ ID NO: 3430332 - RNA, 15 nt, Human
auacaggaacaacau

SEQ ID NO: 3430333 - RNA, 21 nt, Human
auacaggaugaugacuaugga

SEQ ID NO: 3430334 - RNA, 17 nt, Human
auacaggauuauuuuga

SEQ ID NO: 3430335 - RNA, 18 nt, Human
auacaggggaauauuuua

SEQ ID NO: 3430336 - RNA, 21 nt, Human
auacaggucauauuaauauau

SEQ ID NO: 3430337 - RNA, 16 nt, Human
auacaguacaggcagc

SEQ ID NO: 3430338 - RNA, 19 nt, Human
auacaguagugagaagaau

SEQ ID NO: 3430339 - RNA, 20 nt, Human
auacaguagugagaagaaua

SEQ ID NO: 3430340 - RNA, 14 nt, Human
auacaguauucugu

SEQ ID NO: 3430341 - RNA, 20 nt, Human
auacagucucugagaacugg

SEQ ID NO: 3430342 - RNA, 22 nt, Human
auacagucuuccacaaagaaaa

SEQ ID NO: 3430343 - RNA, 13 nt, Human
auacagugcagag

SEQ ID NO: 3430344 - RNA, 21 nt, Human
auacagugcagagccuucuca

SEQ ID NO: 3430345 - RNA, 18 nt, Human
auacaguuacucagaauu

SEQ ID NO: 3430346 - RNA, 20 nt, Human
auacaguuguuggccuccgg

SEQ ID NO: 3430347 - RNA, 21 nt, Human
auacaguuuauuuuuaaagau

SEQ ID NO: 3430348 - RNA, 17 nt, Human
auacaguuuuaaagaau

SEQ ID NO: 3430349 - RNA, 21 nt, Human
auacaguuuuaugcucuuuuu

SEQ ID NO: 3430350 - RNA, 22 nt, Human
auacaguuuucagaaaaagaaa

SEQ ID NO: 3430351 - RNA, 17 nt, Human
auugacauugaaaucua

SEQ ID NO: 3430352 - RNA, 13 nt, Human
auugacauuugua

SEQ ID NO: 3430353 - RNA, 16 nt, Human
auugaccaagaacugc

SEQ ID NO: 3430354 - RNA, 17 nt, Human
auugaccaagaacugca

SEQ ID NO: 3430355 - RNA, 18 nt, Human
auugaccaagaacugcau

SEQ ID NO: 3430356 - RNA, 20 nt, Human
auugaccaagaacugcaugg

SEQ ID NO: 3430357 - RNA, 14 nt, Human
auugaccaucugcu

SEQ ID NO: 3430358 - RNA, 22 nt, Human
auugaccauuuuuuaauuuacu

SEQ ID NO: 3430359 - RNA, 18 nt, Human
auugacccacaagaaaug

SEQ ID NO: 3430360 - RNA, 12 nt, Human
auugaccugcuc

SEQ ID NO: 3430361 - RNA, 21 nt, Human
auugaccugcuccgcugcucc

SEQ ID NO: 3430362 - RNA, 22 nt, Human
auugacgacaagugcugaacag

SEQ ID NO: 3430363 - RNA, 22 nt, Human
auugacgguuuuuuauuauugu

SEQ ID NO: 3430364 - RNA, 19 nt, Human
auugacuaacucaaauaca

SEQ ID NO: 3430365 - RNA, 21 nt, Human
auugacuaucaaacugaagcc

SEQ ID NO: 3430366 - RNA, 16 nt, Human
auugacucuggguccu

SEQ ID NO: 3430367 - RNA, 22 nt, Human
auugacucuggguccuuccuga

SEQ ID NO: 3430368 - RNA, 14 nt, Human
auugacucuugagu

SEQ ID NO: 3430369 - RNA, 15 nt, Human
auugacucuugaguu

SEQ ID NO: 3430370 - RNA, 19 nt, Human
auugacucuugaguuguuu

SEQ ID NO: 3430371 - RNA, 11 nt, Human
auugacuucuu

SEQ ID NO: 3430372 - RNA, 15 nt, Human
auugacuuuuauaaa

SEQ ID NO: 3430373 - RNA, 13 nt, Human
auugacuuuuuau

SEQ ID NO: 3430374 - RNA, 18 nt, Human
auugagaaagagcacuua

SEQ ID NO: 3430375 - RNA, 21 nt, Human
auugagaaagagcacuuaaga

SEQ ID NO: 3430376 - RNA, 14 nt, Human
auugagaacugcau

SEQ ID NO: 3430377 - RNA, 18 nt, Human
auugagaagaaaaacuca

SEQ ID NO: 3430378 - RNA, 20 nt, Human
auugagaaguuuuguacaga

SEQ ID NO: 3430379 - RNA, 14 nt, Human
auugagacaaaaau

SEQ ID NO: 3430380 - RNA, 15 nt, Human
auugagacaaaaauu

SEQ ID NO: 3430381 - RNA, 16 nt, Human
auugagacaaaaauua

SEQ ID NO: 3430382 - RNA, 22 nt, Human
auugagaccgugaagauacuuu

SEQ ID NO: 3430383 - RNA, 18 nt, Human
auugagaccuacaggcug

SEQ ID NO: 3430384 - RNA, 22 nt, Human
auugagagaauggaaaacagac

SEQ ID NO: 3430385 - RNA, 17 nt, Human
auugagagagaugugua

SEQ ID NO: 3430386 - RNA, 20 nt, Human
auugagaguaacuuaaguua

SEQ ID NO: 3430387 - RNA, 17 nt, Human
auugagaugauuaaaau

SEQ ID NO: 3430388 - RNA, 19 nt, Human
auugagauuagagggaggu

SEQ ID NO: 3430389 - RNA, 20 nt, Human
auugagcagaauucauucau

SEQ ID NO: 3430390 - RNA, 21 nt, Human
auugagccuaaaaauaaagca

SEQ ID NO: 3430391 - RNA, 22 nt, Human
auugagccuaaaaauaaagcac

SEQ ID NO: 3430392 - RNA, 19 nt, Human
auugagcugauauaaauuc

SEQ ID NO: 3430393 - RNA, 22 nt, Human
auugagcugauauaaauucugu

SEQ ID NO: 3430394 - RNA, 17 nt, Human
auugagcugcagaaacg

SEQ ID NO: 3430395 - RNA, 21 nt, Human
auugagcuggaccucaccaag

SEQ ID NO: 3430396 - RNA, 20 nt, Human
auugaggaaaaauaugugaa

SEQ ID NO: 3430397 - RNA, 12 nt, Human
auugaggaagag

SEQ ID NO: 3430398 - RNA, 22 nt, Human
auugaggccaagaauauugcaa

SEQ ID NO: 3430399 - RNA, 12 nt, Human
auugaggccugc

SEQ ID NO: 3430400 - RNA, 19 nt, Human
auugaggcuuuguguugua

SEQ ID NO: 3430401 - RNA, 20 nt, Human
auugaguaaugguguagaac

SEQ ID NO: 3430402 - RNA, 22 nt, Human
auugaguaaugguguagaacac

SEQ ID NO: 3430403 - RNA, 15 nt, Human
auugaguauuguuua

SEQ ID NO: 3430404 - RNA, 22 nt, Human
auugaguucuuccuguaaucuu

SEQ ID NO: 3430405 - RNA, 16 nt, Human
auugauaagagggcac

SEQ ID NO: 3430406 - RNA, 22 nt, Human
auugauaagagggcacacacug

SEQ ID NO: 3430407 - RNA, 16 nt, Human
auugauaaguucauac

SEQ ID NO: 3430408 - RNA, 12 nt, Human
auugauaauaaa

SEQ ID NO: 3430409 - RNA, 21 nt, Human
auugauacucuuucuaaugcu

SEQ ID NO: 3430410 - RNA, 16 nt, Human
auugauaugaaaaaua

SEQ ID NO: 3430411 - RNA, 13 nt, Human
auugauauuguga

SEQ ID NO: 3430412 - RNA, 16 nt, Human
auugauauuugugcau

SEQ ID NO: 3430413 - RNA, 19 nt, Human
auugauauuugugcauuuu

SEQ ID NO: 3430414 - RNA, 22 nt, Human
auugauauuugugcauuuucua

SEQ ID NO: 3430415 - RNA, 17 nt, Human
auugaucaaauucauuu

SEQ ID NO: 3430416 - RNA, 20 nt, Human
auugaucauuuuccccccac

SEQ ID NO: 3430417 - RNA, 22 nt, Human
auugauccagaaagaaaacuug

SEQ ID NO: 3430418 - RNA, 17 nt, Human
auugaugaaaagauuua

SEQ ID NO: 3430419 - RNA, 20 nt, Human
auugaugcaugcuauucaca

SEQ ID NO: 3430420 - RNA, 17 nt, Human
auugaugugcaaaaauu

SEQ ID NO: 3430421 - RNA, 19 nt, Human
auugauguguuuauuuaua

SEQ ID NO: 3430422 - RNA, 16 nt, Human
auugauguugaugcaa

SEQ ID NO: 3430423 - RNA, 13 nt, Human
auugauguuuuca

SEQ ID NO: 3430424 - RNA, 17 nt, Human
auugauguuuucauaga

SEQ ID NO: 3430425 - RNA, 12 nt, Human
auugauuagaaa

SEQ ID NO: 3430426 - RNA, 22 nt, Human
auugauuauucugauuccacuu

SEQ ID NO: 3430427 - RNA, 14 nt, Human
auugauugcuuuuu

SEQ ID NO: 3430428 - RNA, 13 nt, Human
auugauugggaaa

SEQ ID NO: 3430429 - RNA, 23 nt, Human
auugauugggaaaacauuugcug

SEQ ID NO: 3430430 - RNA, 23 nt, Human
auugauugggcacaucauuucaa

SEQ ID NO: 3430431 - RNA, 16 nt, Human
auugauuucaagaccu

SEQ ID NO: 3430432 - RNA, 14 nt, Human
auugauuugauugg

SEQ ID NO: 3430433 - RNA, 20 nt, Human
auugauuugcauugaacaca

SEQ ID NO: 3430434 - RNA, 15 nt, Human
auugauuuuaaaaug

SEQ ID NO: 3430435 - RNA, 12 nt, Human
auugauuuugaa

SEQ ID NO: 3430436 - RNA, 19 nt, Human
auugauuuuuauaaauacu

SEQ ID NO: 3430437 - RNA, 14 nt, Human
auugcaaaauacau

SEQ ID NO: 3430438 - RNA, 17 nt, Human
auugcaaaauacaugaa

SEQ ID NO: 3430439 - RNA, 18 nt, Human
auugcaaaauacaugaag

SEQ ID NO: 3430440 - RNA, 19 nt, Human
auugcaaaauagcauuugu

SEQ ID NO: 3430441 - RNA, 13 nt, Human
auugcaaagcaaa

SEQ ID NO: 3430442 - RNA, 23 nt, Human
auugcaaagguuccaacuguaua

SEQ ID NO: 3430443 - RNA, 13 nt, Human
auugcaacaaaau

SEQ ID NO: 3430444 - RNA, 16 nt, Human
auugcaacaaaauaca

SEQ ID NO: 3430445 - RNA, 15 nt, Human
auugcaauaaaguau

SEQ ID NO: 3430446 - RNA, 17 nt, Human
auugcaauaaaguauaa

SEQ ID NO: 3430447 - RNA, 19 nt, Human
auugcaaucuauaauauuu

SEQ ID NO: 3430448 - RNA, 13 nt, Human
auugcacaauauu

SEQ ID NO: 3430449 - RNA, 16 nt, Human
auugcacagaaguccu

SEQ ID NO: 3430450 - RNA, 14 nt, Human
auugcacagggaga

SEQ ID NO: 3430451 - RNA, 18 nt, Human
auugcacaugucuuaaug

SEQ ID NO: 3430452 - RNA, 20 nt, Human
auugcacaugucuuaaugaa

SEQ ID NO: 3430453 - RNA, 15 nt, Human
auugcacauuguaaa

SEQ ID NO: 3430454 - RNA, 17 nt, Human
auugcacccagcccaga

SEQ ID NO: 3430455 - RNA, 19 nt, Human
auugcacguggccucuuga

SEQ ID NO: 3430456 - RNA, 20 nt, Human
auugcacuccagccugggug

SEQ ID NO: 3430457 - RNA, 20 nt, Human
auugcacucuaaaagguuca

SEQ ID NO: 3430458 - RNA, 22 nt, Human
auugcagaacuaaacucauuua

SEQ ID NO: 3430459 - RNA, 16 nt, Human
auugcagaauuguuua

SEQ ID NO: 3430460 - RNA, 20 nt, Human
auugcagaauuguuuagauu

SEQ ID NO: 3430461 - RNA, 14 nt, Human
auugcagcuuuaug

SEQ ID NO: 3430462 - RNA, 17 nt, Human
auugcagcuuuauguuc

SEQ ID NO: 3430463 - RNA, 14 nt, Human
auugcaggauggug

SEQ ID NO: 3430464 - RNA, 23 nt, Human
auagugcucgcuuucuauguagu

SEQ ID NO: 3430465 - RNA, 17 nt, Human
auagugcuuaaaaauca

SEQ ID NO: 3430466 - RNA, 18 nt, Human
auaguggaaaaacacaug

SEQ ID NO: 3430467 - RNA, 16 nt, Human
auagugggaccacaua

SEQ ID NO: 3430468 - RNA, 16 nt, Human
auaguggggagacuuc

SEQ ID NO: 3430469 - RNA, 21 nt, Human
auagugggguuccaugaguua

SEQ ID NO: 3430470 - RNA, 18 nt, Human
auagugguucuuggaaaa

SEQ ID NO: 3430471 - RNA, 18 nt, Human
auaguguaacuugcuuaa

SEQ ID NO: 3430472 - RNA, 23 nt, Human
auaguguaacuugcuuaaauuuc

SEQ ID NO: 3430473 - RNA, 20 nt, Human
auaguguaggcuuuacuuag

SEQ ID NO: 3430474 - RNA, 12 nt, Human
auagugucuuug

SEQ ID NO: 3430475 - RNA, 15 nt, Human
auaguguguucugau

SEQ ID NO: 3430476 - RNA, 20 nt, Human
auaguguuaaucaauuuaaa

SEQ ID NO: 3430477 - RNA, 17 nt, Human
auaguguuauugagaga

SEQ ID NO: 3430478 - RNA, 21 nt, Human
auaguuaaauguuaccucuga

SEQ ID NO: 3430479 - RNA, 17 nt, Human
auaguuacuguaaaaug

SEQ ID NO: 3430480 - RNA, 18 nt, Human
auaguuacuguaaaaugc

SEQ ID NO: 3430481 - RNA, 13 nt, Human
auaguuacugugu

SEQ ID NO: 3430482 - RNA, 17 nt, Human
auaguuacuguguaaac

SEQ ID NO: 3430483 - RNA, 17 nt, Human
auaguuacuguguaauu

SEQ ID NO: 3430484 - RNA, 18 nt, Human
auaguuacuguguaauua

SEQ ID NO: 3430485 - RNA, 16 nt, Human
auaguuacuguuguga

SEQ ID NO: 3430486 - RNA, 16 nt, Human
auaguuagcuaauaaa

SEQ ID NO: 3430487 - RNA, 23 nt, Human
auaguuaggauagcauuuuugau

SEQ ID NO: 3430488 - RNA, 15 nt, Human
auaguuauguaaaua

SEQ ID NO: 3430489 - RNA, 16 nt, Human
auaguuauguaaauaa

SEQ ID NO: 3430490 - RNA, 18 nt, Human
auaguuauguaaauaauu

SEQ ID NO: 3430491 - RNA, 21 nt, Human
auaguucagaauuuaguguau

SEQ ID NO: 3430492 - RNA, 22 nt, Human
auaguucccuagucuauucauu

SEQ ID NO: 3430493 - RNA, 18 nt, Human
auaguuccuaagaagcuu

SEQ ID NO: 3430494 - RNA, 15 nt, Human
auaguuccugcuaaa

SEQ ID NO: 3430495 - RNA, 12 nt, Human
auaguucuagac

SEQ ID NO: 3430496 - RNA, 13 nt, Human
auaguucuagaca

SEQ ID NO: 3430497 - RNA, 20 nt, Human
auaguugagccagcagacau

SEQ ID NO: 3430498 - RNA, 22 nt, Human
auaguugagccagcagacauug

SEQ ID NO: 3430499 - RNA, 13 nt, Human
auaguugagcccc

SEQ ID NO: 3430500 - RNA, 18 nt, Human
auaguugcauagcaguau

SEQ ID NO: 3430501 - RNA, 20 nt, Human
auaguugcauagcaguauau

SEQ ID NO: 3430502 - RNA, 12 nt, Human
auaguugcuuuu

SEQ ID NO: 3430503 - RNA, 20 nt, Human
auaguugcuuuugaaggaau

SEQ ID NO: 3430504 - RNA, 21 nt, Human
auaguugcuuuugaaggaaua

SEQ ID NO: 3430505 - RNA, 23 nt, Human
auaguuggaggugauuccaguga

SEQ ID NO: 3430506 - RNA, 22 nt, Human
auaguuggcuaggaccccucca

SEQ ID NO: 3430507 - RNA, 13 nt, Human
auaguuguaacua

SEQ ID NO: 3430508 - RNA, 14 nt, Human
auaguuuacaugua

SEQ ID NO: 3430509 - RNA, 15 nt, Human
auaguuuacuauuuu

SEQ ID NO: 3430510 - RNA, 21 nt, Human
auaguuucagauauauaucau

SEQ ID NO: 3430511 - RNA, 13 nt, Human
auaguuucugagg

SEQ ID NO: 3430512 - RNA, 14 nt, Human
auaguuucugaggc

SEQ ID NO: 3430513 - RNA, 13 nt, Human
auaguuucuuuau

SEQ ID NO: 3430514 - RNA, 22 nt, Human
auaguuucuuuauuuuguguaa

SEQ ID NO: 3430515 - RNA, 23 nt, Human
auaguuuggauauguaaaacauu

SEQ ID NO: 3430516 - RNA, 14 nt, Human
auaguuuggcauuu

SEQ ID NO: 3430517 - RNA, 18 nt, Human
auaguuuggcauuugcac

SEQ ID NO: 3430518 - RNA, 15 nt, Human
auaguuuuacuuuua

SEQ ID NO: 3430519 - RNA, 21 nt, Human
auaguuuuacuuuuaaacugu

SEQ ID NO: 3430520 - RNA, 22 nt, Human
auaguuuuacuuuuaaacugug

SEQ ID NO: 3430521 - RNA, 20 nt, Human
auaguuuucauccauaacug

SEQ ID NO: 3430522 - RNA, 19 nt, Human
auaguuuuuaagguuauuu

SEQ ID NO: 3430523 - RNA, 16 nt, Human
auauaaaaaaucaugc

SEQ ID NO: 3430524 - RNA, 13 nt, Human
auauaaaaacaaa

SEQ ID NO: 3430525 - RNA, 18 nt, Human
auauaaaaagaaaagaua

SEQ ID NO: 3430526 - RNA, 17 nt, Human
auauaaaaauauauaua

SEQ ID NO: 3430527 - RNA, 16 nt, Human
auauaaaagacugacc

SEQ ID NO: 3430528 - RNA, 18 nt, Human
auauaaaagaucuugcag

SEQ ID NO: 3430529 - RNA, 20 nt, Human
auauaaaaggcaaaugugua

SEQ ID NO: 3430530 - RNA, 24 nt, Human
auauaaaauaaauauauauaaacc

SEQ ID NO: 3430531 - RNA, 19 nt, Human
auauaaaauggcaacaaac

SEQ ID NO: 3430532 - RNA, 12 nt, Human
auauaaaauuau

SEQ ID NO: 3430533 - RNA, 16 nt, Human
auauaaagacguuuua

SEQ ID NO: 3430534 - RNA, 19 nt, Human
auauaaagcaucuaaacuu

SEQ ID NO: 3430535 - RNA, 15 nt, Human
auauaaaguauucuu

SEQ ID NO: 3430536 - RNA, 20 nt, Human
auauaaaguauucuuuuucu

SEQ ID NO: 3430537 - RNA, 13 nt, Human
auauaaaguuuua

SEQ ID NO: 3430538 - RNA, 19 nt, Human
auauaaaguuuuauauauu

SEQ ID NO: 3430539 - RNA, 17 nt, Human
auauaaauaaauauaua

SEQ ID NO: 3430540 - RNA, 15 nt, Human
auauaaauagaaugu

SEQ ID NO: 3430541 - RNA, 19 nt, Human
auauaaauagaauguaaau

SEQ ID NO: 3430542 - RNA, 17 nt, Human
auauaaauauauauaaa

SEQ ID NO: 3430543 - RNA, 16 nt, Human
auauaaauauauuauu

SEQ ID NO: 3430544 - RNA, 12 nt, Human
auauaaaugcaa

SEQ ID NO: 3430545 - RNA, 14 nt, Human
auauaaaugcaaau

SEQ ID NO: 3430546 - RNA, 15 nt, Human
auauaaaugcaaaua

SEQ ID NO: 3430547 - RNA, 23 nt, Human
auauaaaugcaaauaacaaaugc

SEQ ID NO: 3430548 - RNA, 22 nt, Human
auauaaaugcuuuuaaaaaucu

SEQ ID NO: 3430549 - RNA, 15 nt, Human
auauaaauggcuggu

SEQ ID NO: 3430550 - RNA, 13 nt, Human
auauaaaugggaa

SEQ ID NO: 3430551 - RNA, 18 nt, Human
auauaaaugggaacauuu

SEQ ID NO: 3430552 - RNA, 21 nt, Human
auauaaaugggaacauuuauu

SEQ ID NO: 3430553 - RNA, 12 nt, Human
auauaaaugugu

SEQ ID NO: 3430554 - RNA, 16 nt, Human
auauaaauguguguau

SEQ ID NO: 3430555 - RNA, 12 nt, Human
auauaaauucug

SEQ ID NO: 3430556 - RNA, 14 nt, Human
auuugugugcuaaa

SEQ ID NO: 3430557 - RNA, 15 nt, Human
auuugugugcuaaac

SEQ ID NO: 3430558 - RNA, 20 nt, Human
auuugugugcuaaacgugua

SEQ ID NO: 3430559 - RNA, 20 nt, Human
auuuguguggagucauuucu

SEQ ID NO: 3430560 - RNA, 22 nt, Human
auuuguguugaagagguuuuaa

SEQ ID NO: 3430561 - RNA, 14 nt, Human
auuuguuaaaauac

SEQ ID NO: 3430562 - RNA, 15 nt, Human
auuuguuaaauauuu

SEQ ID NO: 3430563 - RNA, 12 nt, Human
auuuguuaaugg

SEQ ID NO: 3430564 - RNA, 23 nt, Human
auuuguuaauuuagaaaacuuua

SEQ ID NO: 3430565 - RNA, 14 nt, Human
auuuguuacagcca

SEQ ID NO: 3430566 - RNA, 21 nt, Human
auuuguuaguuccuguaugaa

SEQ ID NO: 3430567 - RNA, 21 nt, Human
auuuguuauggcagaugacaa

SEQ ID NO: 3430568 - RNA, 15 nt, Human
auuuguuauucuuaa

SEQ ID NO: 3430569 - RNA, 18 nt, Human
auuuguuauuuguacagu

SEQ ID NO: 3430570 - RNA, 17 nt, Human
auuuguuauuuucagua

SEQ ID NO: 3430571 - RNA, 17 nt, Human
auuuguuauuuugcaac

SEQ ID NO: 3430572 - RNA, 21 nt, Human
auuuguucauagacccucuca

SEQ ID NO: 3430573 - RNA, 22 nt, Human
auuuguucauagacccucucaa

SEQ ID NO: 3430574 - RNA, 15 nt, Human
auuuguucauguuug

SEQ ID NO: 3430575 - RNA, 13 nt, Human
auuuguucucugu

SEQ ID NO: 3430576 - RNA, 16 nt, Human
auuuguucugggagua

SEQ ID NO: 3430577 - RNA, 16 nt, Human
auuuguucuucaagaa

SEQ ID NO: 3430578 - RNA, 17 nt, Human
auuuguucuuguauuua

SEQ ID NO: 3430579 - RNA, 14 nt, Human
auuuguugaaauua

SEQ ID NO: 3430580 - RNA, 16 nt, Human
auuuguugaaauuaug

SEQ ID NO: 3430581 - RNA, 18 nt, Human
auuuguugaaauuaugua

SEQ ID NO: 3430582 - RNA, 19 nt, Human
auuuguugacaaaauuuuc

SEQ ID NO: 3430583 - RNA, 13 nt, Human
auuuguugagagu

SEQ ID NO: 3430584 - RNA, 22 nt, Human
auuuguugagagugugaccaaa

SEQ ID NO: 3430585 - RNA, 14 nt, Human
auuuguuggaauga

SEQ ID NO: 3430586 - RNA, 15 nt, Human
auuuguuggaaugaa

SEQ ID NO: 3430587 - RNA, 13 nt, Human
auuuguuuaugua

SEQ ID NO: 3430588 - RNA, 14 nt, Human
auuuguuugaacug

SEQ ID NO: 3430589 - RNA, 23 nt, Human
auuuguuugaacugauaaagaug

SEQ ID NO: 3430590 - RNA, 18 nt, Human
auuuguuuugacggauga

SEQ ID NO: 3430591 - RNA, 21 nt, Human
auuuguuuuguguuguuugaa

SEQ ID NO: 3430592 - RNA, 15 nt, Human
auuuguuuuguuuac

SEQ ID NO: 3430593 - RNA, 18 nt, Human
auuuguuuuguuuacaga

SEQ ID NO: 3430594 - RNA, 14 nt, Human
auuuguuuuucuca

SEQ ID NO: 3430595 - RNA, 15 nt, Human
auuuguuuuucucac

SEQ ID NO: 3430596 - RNA, 18 nt, Human
auuuuaaaaaagccuucc

SEQ ID NO: 3430597 - RNA, 16 nt, Human
auuuuaaaaaaugguc

SEQ ID NO: 3430598 - RNA, 23 nt, Human
auuuuaaaaaguccauaccuuau

SEQ ID NO: 3430599 - RNA, 21 nt, Human
auuuuaaaaagucuucacucu

SEQ ID NO: 3430600 - RNA, 17 nt, Human
auuuuaaaaauacauau

SEQ ID NO: 3430601 - RNA, 16 nt, Human
auuuuaaaaauggugg

SEQ ID NO: 3430602 - RNA, 23 nt, Human
auuuuaaaaauguuaaaauguau

SEQ ID NO: 3430603 - RNA, 13 nt, Human
auuuuaaaacaau

SEQ ID NO: 3430604 - RNA, 23 nt, Human
auuuuaaaacuucaucugucugu

SEQ ID NO: 3430605 - RNA, 16 nt, Human
auuuuaaaagaaugau

SEQ ID NO: 3430606 - RNA, 17 nt, Human
auuuuaaaagaaugauu

SEQ ID NO: 3430607 - RNA, 18 nt, Human
auuuuaaaagaaugauua

SEQ ID NO: 3430608 - RNA, 20 nt, Human
auuuuaaaagauaaauauua

SEQ ID NO: 3430609 - RNA, 17 nt, Human
auauuguguugugaaug

SEQ ID NO: 3430610 - RNA, 13 nt, Human
auauuguguuugu

SEQ ID NO: 3430611 - RNA, 21 nt, Human
auauuguguuuguguauuuac

SEQ ID NO: 3430612 - RNA, 14 nt, Human
auauuguuaaucuc

SEQ ID NO: 3430613 - RNA, 15 nt, Human
auauuguucaaacaa

SEQ ID NO: 3430614 - RNA, 14 nt, Human
auauuguuccuaag

SEQ ID NO: 3430615 - RNA, 21 nt, Human
auauuguugacaacugugacu

SEQ ID NO: 3430616 - RNA, 20 nt, Human
auauuguugcauugcuuuuu

SEQ ID NO: 3430617 - RNA, 18 nt, Human
auauuguuguauaauuuc

SEQ ID NO: 3430618 - RNA, 12 nt, Human
auauuguuucua

SEQ ID NO: 3430619 - RNA, 14 nt, Human
auauuguuugguaa

SEQ ID NO: 3430620 - RNA, 16 nt, Human
auauuguuugguaaau

SEQ ID NO: 3430621 - RNA, 17 nt, Human
auauuguuuucagugua

SEQ ID NO: 3430622 - RNA, 13 nt, Human
auauuguuuuucu

SEQ ID NO: 3430623 - RNA, 14 nt, Human
auauuuaaaaauaa

SEQ ID NO: 3430624 - RNA, 14 nt, Human
auauuuaaaaaugu

SEQ ID NO: 3430625 - RNA, 15 nt, Human
auauuuaaaaauguc

SEQ ID NO: 3430626 - RNA, 16 nt, Human
auauuuaaaaaugucu

SEQ ID NO: 3430627 - RNA, 20 nt, Human
auuuggagacacaacuauuu

SEQ ID NO: 3430628 - RNA, 21 nt, Human
auuuggagacacaacuauuuu

SEQ ID NO: 3430629 - RNA, 17 nt, Human
auuuggagacucugugg

SEQ ID NO: 3430630 - RNA, 17 nt, Human
auuuggagagaaauauu

SEQ ID NO: 3430631 - RNA, 19 nt, Human
auuuggagggaagcucuug

SEQ ID NO: 3430632 - RNA, 23 nt, Human
auuuggagggaagcucuuggagc

SEQ ID NO: 3430633 - RNA, 15 nt, Human
auuuggagggccugg

SEQ ID NO: 3430634 - RNA, 20 nt, Human
auuuggauuuaaaagccugc

SEQ ID NO: 3430635 - RNA, 16 nt, Human
auuuggcaucccuggg

SEQ ID NO: 3430636 - RNA, 18 nt, Human
auuuggcauuccccacuu

SEQ ID NO: 3430637 - RNA, 19 nt, Human
auuuggcauuuauuuguga

SEQ ID NO: 3430638 - RNA, 19 nt, Human
auuuggccugcacuaauuu

SEQ ID NO: 3430639 - RNA, 19 nt, Human
auuugggaaacuugucacu

SEQ ID NO: 3430640 - RNA, 18 nt, Human
auuugggaagugaagacu

SEQ ID NO: 3430641 - RNA, 16 nt, Human
auuugggacccugcuu

SEQ ID NO: 3430642 - RNA, 22 nt, Human
auuugggagaagggcagaguua

SEQ ID NO: 3430643 - RNA, 19 nt, Human
auuugggccugcuccagac

SEQ ID NO: 3430644 - RNA, 21 nt, Human
auuugggccugcuccagaccu

SEQ ID NO: 3430645 - RNA, 18 nt, Human
auuugggcugaauguaug

SEQ ID NO: 3430646 - RNA, 19 nt, Human
auuugggcugaauguaugu

SEQ ID NO: 3430647 - RNA, 22 nt, Human
auuugggcugaauguauguaaa

SEQ ID NO: 3430648 - RNA, 15 nt, Human
auuuggggcuuccaa

SEQ ID NO: 3430649 - RNA, 21 nt, Human
auuuggggcuugcaugccaaa

SEQ ID NO: 3430650 - RNA, 21 nt, Human
auuugggguagcuagaggaac

SEQ ID NO: 3430651 - RNA, 15 nt, Human
auuugggguauuuau

SEQ ID NO: 3430652 - RNA, 23 nt, Human
auuugguaaggggaauugaggac

SEQ ID NO: 3430653 - RNA, 18 nt, Human
auuugguucuaggccggg

SEQ ID NO: 3430654 - RNA, 18 nt, Human
auuugguuuagaacauaa

SEQ ID NO: 3430655 - RNA, 12 nt, Human
auuugguuuuca

SEQ ID NO: 3430656 - RNA, 14 nt, Human
auuugguuuucaca

SEQ ID NO: 3430657 - RNA, 17 nt, Human
auuugguuuucacauug

SEQ ID NO: 3430658 - RNA, 21 nt, Human
auuugguuuucacauuggaaa

SEQ ID NO: 3430659 - RNA, 22 nt, Human
auuuguaaaaacagcauugcuu

SEQ ID NO: 3430660 - RNA, 22 nt, Human
auuuguaaaaugacaaucaugu

SEQ ID NO: 3430661 - RNA, 17 nt, Human
auuuguaaagcuauuua

SEQ ID NO: 3430662 - RNA, 19 nt, Human
auuuguaaagcuauuuaug

SEQ ID NO: 3430663 - RNA, 13 nt, Human
auuuguaaauuua

SEQ ID NO: 3430664 - RNA, 22 nt, Human
auuuguaaguuuaugucuaaag

SEQ ID NO: 3430665 - RNA, 18 nt, Human
auuuguaauaaaguauau

SEQ ID NO: 3430666 - RNA, 22 nt, Human
auuuguaauagauguuugauag

SEQ ID NO: 3430667 - RNA, 23 nt, Human
auuuguaaugucuugagcucuau

SEQ ID NO: 3430668 - RNA, 13 nt, Human
auuuguaauuaaa

SEQ ID NO: 3430669 - RNA, 19 nt, Human
auuuguaauuaaaagcaaa

SEQ ID NO: 3430670 - RNA, 21 nt, Human
auuuguaauuaaaagcaaauc

SEQ ID NO: 3430671 - RNA, 23 nt, Human
auuuguaauugcuuacauuuuua

SEQ ID NO: 3430672 - RNA, 18 nt, Human
auuuguacauauguaaaa

SEQ ID NO: 3430673 - RNA, 21 nt, Human
auuuguacauauguaaaauaa

SEQ ID NO: 3430674 - RNA, 18 nt, Human
auuuguacuacaguucuu

SEQ ID NO: 3430675 - RNA, 19 nt, Human
auuuguacuauuuaacuga

SEQ ID NO: 3430676 - RNA, 20 nt, Human
auuuguacuauuuaacugac

SEQ ID NO: 3430677 - RNA, 23 nt, Human
auuuguacugaaaaaugguaauu

SEQ ID NO: 3430678 - RNA, 22 nt, Human
auuuguaguggaaacauuuaua

SEQ ID NO: 3430679 - RNA, 18 nt, Human
auuuguaguguuggagaa

SEQ ID NO: 3430680 - RNA, 19 nt, Human
auuuguaguguuggagaag

SEQ ID NO: 3430681 - RNA, 22 nt, Human
auuuguaguguuggagaagaac

SEQ ID NO: 3430682 - RNA, 15 nt, Human
auuuguauaaaauaa

SEQ ID NO: 3430683 - RNA, 21 nt, Human
auuuguauaaaauaauuuuua

SEQ ID NO: 3430684 - RNA, 14 nt, Human
auuuguauaaaaug

SEQ ID NO: 3430685 - RNA, 15 nt, Human
auuuguauauauaca

SEQ ID NO: 3430686 - RNA, 16 nt, Human
auuuguauaugguauu

SEQ ID NO: 3430687 - RNA, 19 nt, Human
auuuguaucucugaagcau

SEQ ID NO: 3430688 - RNA, 14 nt, Human
auuuguaugauauu

SEQ ID NO: 3430689 - RNA, 16 nt, Human
auuuguauuuauucuu

SEQ ID NO: 3430690 - RNA, 21 nt, Human
auuuguauuuuuuugcaagug

SEQ ID NO: 3430691 - RNA, 17 nt, Human
auuugucauuuucauua

SEQ ID NO: 3430692 - RNA, 21 nt, Human
auuugucauuuucauuagcaa

SEQ ID NO: 3430693 - RNA, 14 nt, Human
auuugucauuuuga

SEQ ID NO: 3430694 - RNA, 20 nt, Human
auuuguccucuuuacaugaa

SEQ ID NO: 3430695 - RNA, 18 nt, Human
auuugucgauauuuccau

SEQ ID NO: 3430696 - RNA, 17 nt, Human
auuugucuauucuccag

SEQ ID NO: 3430697 - RNA, 21 nt, Human
auuugucuuuuuguuguaaaa

SEQ ID NO: 3430698 - RNA, 17 nt, Human
auuugugaacucagcca

SEQ ID NO: 3430699 - RNA, 20 nt, Human
auuugugaacucagccaagc

SEQ ID NO: 3430700 - RNA, 15 nt, Human
auuugugacaaaaaa

SEQ ID NO: 3430701 - RNA, 15 nt, Human
auuugugauacaaug

SEQ ID NO: 3430702 - RNA, 17 nt, Human
auuugugauacaaugcu

SEQ ID NO: 3430703 - RNA, 15 nt, Human
auuugugauagcacu

SEQ ID NO: 3430704 - RNA, 17 nt, Human
auuugugauagcacuuu

SEQ ID NO: 3430705 - RNA, 18 nt, Human
auuugugauagcacuuuc

SEQ ID NO: 3430706 - RNA, 19 nt, Human
auuugugcccccaaccauu

SEQ ID NO: 3430707 - RNA, 18 nt, Human
auuugugcuauaguauuu

SEQ ID NO: 3430708 - RNA, 18 nt, Human
auuuguggaaaauaacuc

SEQ ID NO: 3430709 - RNA, 11 nt, Human
auuuguggaau

SEQ ID NO: 3430710 - RNA, 20 nt, Human
auuuguggugauauagaauu

SEQ ID NO: 3430711 - RNA, 15 nt, Human
auuuguggugauuug

SEQ ID NO: 3430712 - RNA, 14 nt, Human
auuuguguauuuaa

SEQ ID NO: 3430713 - RNA, 13 nt, Human
auuuguguguuac

SEQ ID NO: 3430714 - RNA, 17 nt, Human
auuuguguguuacaaug

SEQ ID NO: 3430715 - RNA, 18 nt, Human
auuuguguguucacuaaa

SEQ ID NO: 3430716 - RNA, 18 nt, Human
auuuguguugaagagguu

SEQ ID NO: 3430717 - RNA, 14 nt, Human
auuuguuaaaauua

SEQ ID NO: 3430718 - RNA, 17 nt, Human
auuuguuaaauauuuac

SEQ ID NO: 3430719 - RNA, 18 nt, Human
auuuguuaaauauuuaca

SEQ ID NO: 3430720 - RNA, 18 nt, Human
auuuguuaauaguuccug

SEQ ID NO: 3430721 - RNA, 19 nt, Human
auuuguuaauuuagaaaac

SEQ ID NO: 3430722 - RNA, 22 nt, Human
auuuguuaguuccuguaugaaa

SEQ ID NO: 3430723 - RNA, 17 nt, Human
auuuguuauuuguacag

SEQ ID NO: 3430724 - RNA, 18 nt, Human
auuuguucacugaaggug

SEQ ID NO: 3430725 - RNA, 13 nt, Human
auuuguucauauu

SEQ ID NO: 3430726 - RNA, 13 nt, Human
auuuguucauguu

SEQ ID NO: 3430727 - RNA, 16 nt, Human
auuuguucauguuugg

SEQ ID NO: 3430728 - RNA, 14 nt, Human
auuuguucccaaga

SEQ ID NO: 3430729 - RNA, 19 nt, Human
auuuguucuauagcuuuuc

SEQ ID NO: 3430730 - RNA, 14 nt, Human
auuuguuuaaaagg

SEQ ID NO: 3430731 - RNA, 15 nt, Human
auuuguuuaaaagga

SEQ ID NO: 3430732 - RNA, 16 nt, Human
auuuguuuaaaaggau

SEQ ID NO: 3430733 - RNA, 14 nt, Human
auuuguuuaaagua

SEQ ID NO: 3430734 - RNA, 18 nt, Human
auuuguuucuuucucuga

SEQ ID NO: 3430735 - RNA, 13 nt, Human
auuuguuugaacu

SEQ ID NO: 3430736 - RNA, 20 nt, Human
auuuguuugaacugauaaag

SEQ ID NO: 3430737 - RNA, 22 nt, Human
auuuguuugaacugauaaagau

SEQ ID NO: 3430738 - RNA, 17 nt, Human
auuuguuugugcuucua

SEQ ID NO: 3430739 - RNA, 17 nt, Human
auuuguuuguuuuccuu

SEQ ID NO: 3430740 - RNA, 18 nt, Human
auuuguuuuagaaugaug

SEQ ID NO: 3430741 - RNA, 14 nt, Human
auuuguuuucaugg

SEQ ID NO: 3430742 - RNA, 15 nt, Human
auuuguuuucauggu

SEQ ID NO: 3430743 - RNA, 16 nt, Human
auuuguuuuuaaacug

SEQ ID NO: 3430744 - RNA, 20 nt, Human
auuuguuuuuaaacuguaca

SEQ ID NO: 3430745 - RNA, 22 nt, Human
auuuguuuuuaaacuguacagu

SEQ ID NO: 3430746 - RNA, 16 nt, Human
auuuguuuuucauuca

SEQ ID NO: 3430747 - RNA, 14 nt, Human
auuuuaaaaaaggg

SEQ ID NO: 3430748 - RNA, 16 nt, Human
auuuuaaaaacauaga

SEQ ID NO: 3430749 - RNA, 19 nt, Human
auuuuaaaaagauuuguuu

SEQ ID NO: 3430750 - RNA, 14 nt, Human
auuuuaaaaauaca

SEQ ID NO: 3430751 - RNA, 22 nt, Human
auuuuaaaaauacagauagaua

SEQ ID NO: 3430752 - RNA, 22 nt, Human
auuuuaaaaauacauaucgcug

SEQ ID NO: 3430753 - RNA, 21 nt, Human
auauuuucaugcuguucauga

SEQ ID NO: 3430754 - RNA, 21 nt, Human
auauuuuccuaguagaucuau

SEQ ID NO: 3430755 - RNA, 13 nt, Human
auauuuuccuaua

SEQ ID NO: 3430756 - RNA, 19 nt, Human
auauuuuccuauauuacgg

SEQ ID NO: 3430757 - RNA, 19 nt, Human
auauuuuccugauagcaua

SEQ ID NO: 3430758 - RNA, 13 nt, Human
auauuuucuauuu

SEQ ID NO: 3430759 - RNA, 16 nt, Human
auauuuucucuaggaa

SEQ ID NO: 3430760 - RNA, 15 nt, Human
auauuuucugugugu

SEQ ID NO: 3430761 - RNA, 17 nt, Human
auauuuucuguguguuc

SEQ ID NO: 3430762 - RNA, 22 nt, Human
auauuuucuguguguuccuggc

SEQ ID NO: 3430763 - RNA, 13 nt, Human
auauuuucuguuu

SEQ ID NO: 3430764 - RNA, 19 nt, Human
auauuuucuuccaagcaaa

SEQ ID NO: 3430765 - RNA, 23 nt, Human
auauuuucuuccaagcaaaggug

SEQ ID NO: 3430766 - RNA, 13 nt, Human
auauuuucuuucu

SEQ ID NO: 3430767 - RNA, 19 nt, Human
auauuuugaaucaauaaua

SEQ ID NO: 3430768 - RNA, 16 nt, Human
auauuuugaucuucaa

SEQ ID NO: 3430769 - RNA, 17 nt, Human
auauuuugaucuucaac

SEQ ID NO: 3430770 - RNA, 17 nt, Human
auauuuugauuauugua

SEQ ID NO: 3430771 - RNA, 12 nt, Human
auauuuugcagu

SEQ ID NO: 3430772 - RNA, 19 nt, Human
auauuuuguaaaauguauu

SEQ ID NO: 3430773 - RNA, 14 nt, Human
auauuuuguauaua

SEQ ID NO: 3430774 - RNA, 21 nt, Human
auauuuugucauaucaaauaa

SEQ ID NO: 3430775 - RNA, 13 nt, Human
auauuuuguguga

SEQ ID NO: 3430776 - RNA, 19 nt, Human
auauuuuuaaaaaaugaaa

SEQ ID NO: 3430777 - RNA, 20 nt, Human
auauuuuuaaaauauuuauu

SEQ ID NO: 3430778 - RNA, 15 nt, Human
auauuuuuaaagauc

SEQ ID NO: 3430779 - RNA, 16 nt, Human
auauuuuuaagauaau

SEQ ID NO: 3430780 - RNA, 19 nt, Human
auauuuuuaauaaaaguug

SEQ ID NO: 3430781 - RNA, 15 nt, Human
auauuuuuaauuaaa

SEQ ID NO: 3430782 - RNA, 20 nt, Human
auauuuuuauaauaaacaua

SEQ ID NO: 3430783 - RNA, 14 nt, Human
auauuuuuauagac

SEQ ID NO: 3430784 - RNA, 21 nt, Human
auauuuuuauauuuccuuuau

SEQ ID NO: 3430785 - RNA, 15 nt, Human
auauuuuuaucuaua

SEQ ID NO: 3430786 - RNA, 16 nt, Human
auauuuuuaucuauau

SEQ ID NO: 3430787 - RNA, 12 nt, Human
auauuuuucaca

SEQ ID NO: 3430788 - RNA, 15 nt, Human
auauuuuucacauau

SEQ ID NO: 3430789 - RNA, 11 nt, Human
caaagccagaa

SEQ ID NO: 3430790 - RNA, 20 nt, Human
caaagccagcguccuccucu

SEQ ID NO: 3430791 - RNA, 22 nt, Human
caaagccagcguccuccucugu

SEQ ID NO: 3430792 - RNA, 14 nt, Human
caaagccagggucu

SEQ ID NO: 3430793 - RNA, 15 nt, Human
caaagccagggucuc

SEQ ID NO: 3430794 - RNA, 22 nt, Human
caaagccagggucucucccuca

SEQ ID NO: 3430795 - RNA, 18 nt, Human
caaagccaggucccucuc

SEQ ID NO: 3430796 - RNA, 21 nt, Human
caaagccaggucccucucauu

SEQ ID NO: 3430797 - RNA, 13 nt, Human
caaagcccagcuu

SEQ ID NO: 3430798 - RNA, 16 nt, Human
caaagccccaugcugg

SEQ ID NO: 3430799 - RNA, 18 nt, Human
caaagcccccagagccca

SEQ ID NO: 3430800 - RNA, 19 nt, Human
caaagcccccagagcccag

SEQ ID NO: 3430801 - RNA, 22 nt, Human
caaagcccccagagcccaggcu

SEQ ID NO: 3430802 - RNA, 22 nt, Human
caaagccuguucauggcagaug

SEQ ID NO: 3430803 - RNA, 18 nt, Human
caaagccuuaucaagugu

SEQ ID NO: 3430804 - RNA, 21 nt, Human
caaagccuugugucuacagag

SEQ ID NO: 3430805 - RNA, 23 nt, Human
caaagccuugugucuacagagaa

SEQ ID NO: 3430806 - RNA, 16 nt, Human
caaagcggggggaggg

SEQ ID NO: 3430807 - RNA, 17 nt, Human
caaagcuaggccuggcc

SEQ ID NO: 3430808 - RNA, 19 nt, Human
caaagcuaggccuggccag

SEQ ID NO: 3430809 - RNA, 18 nt, Human
caaagcucaaauaaaaau

SEQ ID NO: 3430810 - RNA, 23 nt, Human
caaagcucuauuaagauuuccaa

SEQ ID NO: 3430811 - RNA, 19 nt, Human
caaagcucuguggccacau

SEQ ID NO: 3430812 - RNA, 22 nt, Human
caaagcugagccugcagggaag

SEQ ID NO: 3430813 - RNA, 15 nt, Human
caaagcugcccacug

SEQ ID NO: 3430814 - RNA, 20 nt, Human
caaagcugcccacuguuucu

SEQ ID NO: 3430815 - RNA, 17 nt, Human
caaagcugcuaaaucuc

SEQ ID NO: 3430816 - RNA, 16 nt, Human
caaagcuguuaaacug

SEQ ID NO: 3430817 - RNA, 19 nt, Human
caaagcuguuaaacuguua

SEQ ID NO: 3430818 - RNA, 17 nt, Human
caaagcuguucuuccug

SEQ ID NO: 3430819 - RNA, 16 nt, Human
caaagcuuccauucca

SEQ ID NO: 3430820 - RNA, 20 nt, Human
caaagcuuccauuccacauc

SEQ ID NO: 3430821 - RNA, 19 nt, Human
caaagcuuggaagagccug

SEQ ID NO: 3430822 - RNA, 21 nt, Human
caaagcuuggaagagccugca

SEQ ID NO: 3430823 - RNA, 22 nt, Human
caaagcuuuccugccccaggcc

SEQ ID NO: 3430824 - RNA, 15 nt, Human
caaagcuuuccugga

SEQ ID NO: 3430825 - RNA, 17 nt, Human
caaagcuuuugcauauu

SEQ ID NO: 3430826 - RNA, 14 nt, Human
caaagcuuuuugaa

SEQ ID NO: 3430827 - RNA, 20 nt, Human
caaagcuuuuugaaaaccaa

SEQ ID NO: 3430828 - RNA, 18 nt, Human
caaaggaaaaagcacaag

SEQ ID NO: 3430829 - RNA, 23 nt, Human
caaaggaagcuuucucugcuuca

SEQ ID NO: 3430830 - RNA, 16 nt, Human
caaaggaccucagcug

SEQ ID NO: 3430831 - RNA, 18 nt, Human
caaaggacuugacuugca

SEQ ID NO: 3430832 - RNA, 16 nt, Human
caaaggagccugugaa

SEQ ID NO: 3430833 - RNA, 23 nt, Human
caaaggagccugugaacccagga

SEQ ID NO: 3430834 - RNA, 19 nt, Human
caaaggagcucgaaggaua

SEQ ID NO: 3430835 - RNA, 16 nt, Human
caaaggaguagaaaga

SEQ ID NO: 3430836 - RNA, 13 nt, Human
caaaggauacugu

SEQ ID NO: 3430837 - RNA, 17 nt, Human
caaaggaugugauauau

SEQ ID NO: 3430838 - RNA, 21 nt, Human
caaaggaugugauauauaagu

SEQ ID NO: 3430839 - RNA, 20 nt, Human
caaaggauuaauugcugcaa

SEQ ID NO: 3430840 - RNA, 23 nt, Human
caaaggcacauggaauauauuuu

SEQ ID NO: 3430841 - RNA, 13 nt, Human
caaaggccaaacu

SEQ ID NO: 3430842 - RNA, 16 nt, Human
caaaggccaaacugcu

SEQ ID NO: 3430843 - RNA, 18 nt, Human
caaaggccagaccugcag

SEQ ID NO: 3430844 - RNA, 22 nt, Human
caaaggccagaccugcagacgc

SEQ ID NO: 3430845 - RNA, 19 nt, Human
caaaggccauggagagcug

SEQ ID NO: 3430846 - RNA, 21 nt, Human
caaaggccauggagagcugga

SEQ ID NO: 3430847 - RNA, 23 nt, Human
caaaggccuaauucuaugccugu

SEQ ID NO: 3430848 - RNA, 23 nt, Human
caaaggcgcagugcuucucuaca

SEQ ID NO: 3430849 - RNA, 14 nt, Human
caaaggcugagaac

SEQ ID NO: 3430850 - RNA, 23 nt, Human
caaaggcugagaacacugugaaa

SEQ ID NO: 3430851 - RNA, 15 nt, Human
caaaggcugguggca

SEQ ID NO: 3430852 - RNA, 15 nt, Human
caaaggcuuugcccu

SEQ ID NO: 3430853 - RNA, 21 nt, Human
caaagggcacagcaucuguag

SEQ ID NO: 3430854 - RNA, 12 nt, Human
caaagggccagg

SEQ ID NO: 3430855 - RNA, 12 nt, Human
caaagggcccag

SEQ ID NO: 3430856 - RNA, 14 nt, Human
caaagggcccagau

SEQ ID NO: 3430857 - RNA, 21 nt, Human
caaagggccugcccagacaag

SEQ ID NO: 3430858 - RNA, 17 nt, Human
caaaggggaaagaacau

SEQ ID NO: 3430859 - RNA, 19 nt, Human
caaaggggaucauaaaguu

SEQ ID NO: 3430860 - RNA, 22 nt, Human
caaagggggaggagaagaaaau

SEQ ID NO: 3430861 - RNA, 17 nt, Human
caaaggguccagaagga

SEQ ID NO: 3430862 - RNA, 18 nt, Human
caaagggugaaaauuauu

SEQ ID NO: 3430863 - RNA, 14 nt, Human
caaagguauaauuu

SEQ ID NO: 3430864 - RNA, 13 nt, Human
caaaggugaagga

SEQ ID NO: 3430865 - RNA, 18 nt, Human
caaaggugaaggaauaua

SEQ ID NO: 3430866 - RNA, 19 nt, Human
caaaggugaaggaauauau

SEQ ID NO: 3430867 - RNA, 12 nt, Human
caaagguucuag

SEQ ID NO: 3430868 - RNA, 23 nt, Human
caaagguuuaaaugaacaagaga

SEQ ID NO: 3430869 - RNA, 21 nt, Human
caaaguaaaacuugcugccug

SEQ ID NO: 3430870 - RNA, 20 nt, Human
caaaguacaauguguuuuuc

SEQ ID NO: 3430871 - RNA, 16 nt, Human
caaaguacacuguuuc

SEQ ID NO: 3430872 - RNA, 17 nt, Human
caaaguacagguacuuu

SEQ ID NO: 3430873 - RNA, 21 nt, Human
caaaguacagguacuuugucu

SEQ ID NO: 3430874 - RNA, 11 nt, Human
caaaguacugu

SEQ ID NO: 3430875 - RNA, 12 nt, Human
caaaguacugua

SEQ ID NO: 3430876 - RNA, 13 nt, Human
caaaguacuguaa

SEQ ID NO: 3430877 - RNA, 20 nt, Human
caaaguauaaauuuguguaa

SEQ ID NO: 3430878 - RNA, 13 nt, Human
caaaguauaacca

SEQ ID NO: 3430879 - RNA, 23 nt, Human
caaaguaugugguuuuguaauuu

SEQ ID NO: 3430880 - RNA, 15 nt, Human
caaaguauuaagcau

SEQ ID NO: 3430881 - RNA, 21 nt, Human
caaaguauuaagcauauauuu

SEQ ID NO: 3430882 - RNA, 18 nt, Human
caaaguauuguaaauuau

SEQ ID NO: 3430883 - RNA, 22 nt, Human
caaaguauuguaaauuauauuu

SEQ ID NO: 3430884 - RNA, 22 nt, Human
caaagucaggaaucaucaggaa

SEQ ID NO: 3430885 - RNA, 23 nt, Human
caaagucauaauugcauugacuu

SEQ ID NO: 3430886 - RNA, 18 nt, Human
caaagucaugauguuuuu

SEQ ID NO: 3430887 - RNA, 20 nt, Human
caaagucaugcaaaggcugg

SEQ ID NO: 3430888 - RNA, 14 nt, Human
caaaguccuuuuuu

SEQ ID NO: 3430889 - RNA, 17 nt, Human
caaaguccuuuuuuucc

SEQ ID NO: 3430890 - RNA, 16 nt, Human
caaagucuaaaguuua

SEQ ID NO: 3430891 - RNA, 17 nt, Human
caaagucuaaaguuuac

SEQ ID NO: 3430892 - RNA, 14 nt, Human
caaagucuccagcc

SEQ ID NO: 3430893 - RNA, 20 nt, Human
caaagucugcucucauauaa

SEQ ID NO: 3430894 - RNA, 13 nt, Human
caaagucugugug

SEQ ID NO: 3430895 - RNA, 20 nt, Human
caaagucuuaaaauaacuua

SEQ ID NO: 3430896 - RNA, 22 nt, Human
caaagucuuaaaauaacuuaua

SEQ ID NO: 3430897 - RNA, 19 nt, Human
caaacaguagguuggcagu

SEQ ID NO: 3430898 - RNA, 16 nt, Human
caaacagucucaggaa

SEQ ID NO: 3430899 - RNA, 22 nt, Human
caaacaugaaguguguuuccuu

SEQ ID NO: 3430900 - RNA, 19 nt, Human
caaacaugagguucucucu

SEQ ID NO: 3430901 - RNA, 20 nt, Human
caaacaugggguuggcuggg

SEQ ID NO: 3430902 - RNA, 13 nt, Human
caaacauguauuu

SEQ ID NO: 3430903 - RNA, 19 nt, Human
caaacauuaauguugauuu

SEQ ID NO: 3430904 - RNA, 20 nt, Human
caaacauuaauguugauuuc

SEQ ID NO: 3430905 - RNA, 16 nt, Human
caaacauuaguacuuu

SEQ ID NO: 3430906 - RNA, 17 nt, Human
caaacauuaguacuuua

SEQ ID NO: 3430907 - RNA, 11 nt, Human
caaacauugug

SEQ ID NO: 3430908 - RNA, 18 nt, Human
caaacauuguguugacau

SEQ ID NO: 3430909 - RNA, 19 nt, Human
caaacauuguguugacauu

SEQ ID NO: 3430910 - RNA, 19 nt, Human
caaacauuuucucuuagaa

SEQ ID NO: 3430911 - RNA, 20 nt, Human
caaacauuuucucuuagaaa

SEQ ID NO: 3430912 - RNA, 15 nt, Human
caaacauuuugaaag

SEQ ID NO: 3430913 - RNA, 20 nt, Human
caaacauuuugaaagucugu

SEQ ID NO: 3430914 - RNA, 17 nt, Human
caaaccaaaucacugaa

SEQ ID NO: 3430915 - RNA, 14 nt, Human
caaaccacaacuga

SEQ ID NO: 3430916 - RNA, 15 nt, Human
caaaccacaacugac

SEQ ID NO: 3430917 - RNA, 14 nt, Human
caaaccacacugga

SEQ ID NO: 3430918 - RNA, 15 nt, Human
caaaccacacuggac

SEQ ID NO: 3430919 - RNA, 22 nt, Human
caaaccaccagaagcccagaau

SEQ ID NO: 3430920 - RNA, 14 nt, Human
caaaccaggacccu

SEQ ID NO: 3430921 - RNA, 16 nt, Human
caaaccaucauugaaa

SEQ ID NO: 3430922 - RNA, 17 nt, Human
caaaccaucauugaaau

SEQ ID NO: 3430923 - RNA, 19 nt, Human
caaaccaucauugaaaucu

SEQ ID NO: 3430924 - RNA, 20 nt, Human
caaacccagacggcuccacu

SEQ ID NO: 3430925 - RNA, 17 nt, Human
caaaccccacccuaguu

SEQ ID NO: 3430926 - RNA, 19 nt, Human
caaacccccauucuguccu

SEQ ID NO: 3430927 - RNA, 16 nt, Human
caaacccccuuugugc

SEQ ID NO: 3430928 - RNA, 18 nt, Human
caaaccccgaccaccugc

SEQ ID NO: 3430929 - RNA, 21 nt, Human
caaaccccgaccaccugccca

SEQ ID NO: 3430930 - RNA, 20 nt, Human
caaacccuagccuugcuugu

SEQ ID NO: 3430931 - RNA, 21 nt, Human
caaacccugucaaacauuagu

SEQ ID NO: 3430932 - RNA, 23 nt, Human
caaaccgccagcgaacuugacaa

SEQ ID NO: 3430933 - RNA, 15 nt, Human
caaaccuaauugcac

SEQ ID NO: 3430934 - RNA, 13 nt, Human
caaaccucaccaa

SEQ ID NO: 3430935 - RNA, 21 nt, Human
caaaccuccaaaacuccugcc

SEQ ID NO: 3430936 - RNA, 15 nt, Human
caaaccuccucuucu

SEQ ID NO: 3430937 - RNA, 14 nt, Human
caaaccucuguuca

SEQ ID NO: 3430938 - RNA, 15 nt, Human
caaaccucuguucag

SEQ ID NO: 3430939 - RNA, 19 nt, Human
caaaccugaccccugcuca

SEQ ID NO: 3430940 - RNA, 16 nt, Human
caaaccugccuggguu

SEQ ID NO: 3430941 - RNA, 17 nt, Human
caaaccuuaucuccaca

SEQ ID NO: 3430942 - RNA, 21 nt, Human
caaaccuuaucuccacaaccu

SEQ ID NO: 3430943 - RNA, 15 nt, Human
caaaccuuuaacuaa

SEQ ID NO: 3430944 - RNA, 20 nt, Human
caaaccuuuauuuuagaauu

SEQ ID NO: 3430945 - RNA, 14 nt, Human
caaaccuuugagua

SEQ ID NO: 3430946 - RNA, 15 nt, Human
caaaccuuugaguag

SEQ ID NO: 3430947 - RNA, 23 nt, Human
caaacgcccuuuccuccucaggc

SEQ ID NO: 3430948 - RNA, 13 nt, Human
caaacgcuaaaga

SEQ ID NO: 3430949 - RNA, 22 nt, Human
caaacgcuaaagagcccuugcc

SEQ ID NO: 3430950 - RNA, 23 nt, Human
caaacgcuaaagagcccuugccu

SEQ ID NO: 3430951 - RNA, 12 nt, Human
caaacgcugccu

SEQ ID NO: 3430952 - RNA, 13 nt, Human
caaacgcugccug

SEQ ID NO: 3430953 - RNA, 14 nt, Human
caaacgguacacag

SEQ ID NO: 3430954 - RNA, 14 nt, Human
caaacguauguaaa

SEQ ID NO: 3430955 - RNA, 20 nt, Human
caaacuaacaggcuuaguga

SEQ ID NO: 3430956 - RNA, 18 nt, Human
caaacuaaggugcuaaau

SEQ ID NO: 3430957 - RNA, 20 nt, Human
caaacuacagaccugcuuuu

SEQ ID NO: 3430958 - RNA, 22 nt, Human
caaacuacagaccugcuuuuug

SEQ ID NO: 3430959 - RNA, 16 nt, Human
caaacuacugaaugaa

SEQ ID NO: 3430960 - RNA, 23 nt, Human
caaacuacugaaugaagcaguau

SEQ ID NO: 3430961 - RNA, 14 nt, Human
caaacuacuugauu

SEQ ID NO: 3430962 - RNA, 16 nt, Human
caaacuacuugauuuu

SEQ ID NO: 3430963 - RNA, 13 nt, Human
caaacuagggcca

SEQ ID NO: 3430964 - RNA, 14 nt, Human
caaacuauuucuua

SEQ ID NO: 3430965 - RNA, 23 nt, Human
caaacucaaugcuuuauuuguaa

SEQ ID NO: 3430966 - RNA, 14 nt, Human
caaacucagccuca

SEQ ID NO: 3430967 - RNA, 23 nt, Human
caaacucauaacagucuuacugc

SEQ ID NO: 3430968 - RNA, 18 nt, Human
caaacuccugaccucagg

SEQ ID NO: 3430969 - RNA, 13 nt, Human
caaacucugcugu

SEQ ID NO: 3430970 - RNA, 16 nt, Human
caaacugaaaagcuga

SEQ ID NO: 3430971 - RNA, 22 nt, Human
caaacugaaugaaacccccaca

SEQ ID NO: 3430972 - RNA, 16 nt, Human
caaacugacucuuaag

SEQ ID NO: 3430973 - RNA, 17 nt, Human
caaacugacucuuaaga

SEQ ID NO: 3430974 - RNA, 21 nt, Human
caaacugacucuuaagaagac

SEQ ID NO: 3430975 - RNA, 13 nt, Human
caaacugcaauag

SEQ ID NO: 3430976 - RNA, 20 nt, Human
caaacugcaauagagacugu

SEQ ID NO: 3430977 - RNA, 14 nt, Human
caaacugcacauga

SEQ ID NO: 3430978 - RNA, 13 nt, Human
caaacugcaugcc

SEQ ID NO: 3430979 - RNA, 14 nt, Human
caaacugcaugccc

SEQ ID NO: 3430980 - RNA, 16 nt, Human
caaacugcaugcccag

SEQ ID NO: 3430981 - RNA, 18 nt, Human
caaacugcaugcccagag

SEQ ID NO: 3430982 - RNA, 17 nt, Human
caaacugccuaagcccu

SEQ ID NO: 3430983 - RNA, 22 nt, Human
caaacugcuggacgucuuucuu

SEQ ID NO: 3430984 - RNA, 21 nt, Human
caaacugcuucccuuacuuug

SEQ ID NO: 3430985 - RNA, 17 nt, Human
caaacuggagucuggag

SEQ ID NO: 3430986 - RNA, 16 nt, Human
caaacugggaaccccu

SEQ ID NO: 3430987 - RNA, 22 nt, Human
caaacugggaaccccuuuccca

SEQ ID NO: 3430988 - RNA, 16 nt, Human
caaacuggggccucca

SEQ ID NO: 3430989 - RNA, 21 nt, Human
caaacuggggccuccagaacu

SEQ ID NO: 3430990 - RNA, 19 nt, Human
caaacugguauucuguucu

SEQ ID NO: 3430991 - RNA, 16 nt, Human
caaacugguuauuuaa

SEQ ID NO: 3430992 - RNA, 12 nt, Human
caaacuguaaaa

SEQ ID NO: 3430993 - RNA, 20 nt, Human
caaacuguaaauaaaaagaa

SEQ ID NO: 3430994 - RNA, 14 nt, Human
auccaaaagaaaaa

SEQ ID NO: 3430995 - RNA, 15 nt, Human
auccaaaagaaaaac

SEQ ID NO: 3430996 - RNA, 19 nt, Human
auccaaaauguguauuucu

SEQ ID NO: 3430997 - RNA, 19 nt, Human
auccaaaguccccauucag

SEQ ID NO: 3430998 - RNA, 16 nt, Human
auccaacuccagcaac

SEQ ID NO: 3430999 - RNA, 18 nt, Human
auccaagcaaaugugaau

SEQ ID NO: 3431000 - RNA, 12 nt, Human
auccaagccucc

SEQ ID NO: 3431001 - RNA, 23 nt, Human
auccaagcuuuuuuaaaguaaaa

SEQ ID NO: 3431002 - RNA, 14 nt, Human
auccaaggagaaac

SEQ ID NO: 3431003 - RNA, 12 nt, Human
auccaaguggcc

SEQ ID NO: 3431004 - RNA, 14 nt, Human
auccaaguuaaaug

SEQ ID NO: 3431005 - RNA, 16 nt, Human
auccaaguuaaaugua

SEQ ID NO: 3431006 - RNA, 21 nt, Human
auccaaguuaaauguagaguu

SEQ ID NO: 3431007 - RNA, 24 nt, Human
auccaauauuuucuuuaaugcuuu

SEQ ID NO: 3431008 - RNA, 13 nt, Human
auccaaucaaucu

SEQ ID NO: 3431009 - RNA, 18 nt, Human
auccaaucaaucuugcau

SEQ ID NO: 3431010 - RNA, 14 nt, Human
auccaauccucacu

SEQ ID NO: 3431011 - RNA, 20 nt, Human
auccaaucuaaccacaucaa

SEQ ID NO: 3431012 - RNA, 22 nt, Human
auccaaugcucaagaaacaacu

SEQ ID NO: 3431013 - RNA, 20 nt, Human
auccaauggguuuuucccug

SEQ ID NO: 3431014 - RNA, 12 nt, Human
auccaauguuag

SEQ ID NO: 3431015 - RNA, 23 nt, Human
auccaauguuagagacuuuuuuc

SEQ ID NO: 3431016 - RNA, 22 nt, Human
auccaauuagcuuauguuaacu

SEQ ID NO: 3431017 - RNA, 15 nt, Human
auccacacacagagg

SEQ ID NO: 3431018 - RNA, 13 nt, Human
auccacagagagu

SEQ ID NO: 3431019 - RNA, 15 nt, Human
auccacaugaaaaua

SEQ ID NO: 3431020 - RNA, 18 nt, Human
auccacauguuucagagc

SEQ ID NO: 3431021 - RNA, 13 nt, Human
auccacauuguuu

SEQ ID NO: 3431022 - RNA, 14 nt, Human
auccaccaccuccc

SEQ ID NO: 3431023 - RNA, 16 nt, Human
auccacccauauguua

SEQ ID NO: 3431024 - RNA, 23 nt, Human
auccaccccaauccucccagaaa

SEQ ID NO: 3431025 - RNA, 20 nt, Human
auccacccgccucagccucc

SEQ ID NO: 3431026 - RNA, 15 nt, Human
auccaccuccuucuc

SEQ ID NO: 3431027 - RNA, 16 nt, Human
auccacucccaggcag

SEQ ID NO: 3431028 - RNA, 19 nt, Human
auccacucuacccucccac

SEQ ID NO: 3431029 - RNA, 23 nt, Human
auccacucuacccucccaccccc

SEQ ID NO: 3431030 - RNA, 18 nt, Human
auccacucugcaggaaau

SEQ ID NO: 3431031 - RNA, 19 nt, Human
auccacucugccugcuuac

SEQ ID NO: 3431032 - RNA, 23 nt, Human
auccacuuuaucuugaauaaugu

SEQ ID NO: 3431033 - RNA, 12 nt, Human
auccacuuugca

SEQ ID NO: 3431034 - RNA, 18 nt, Human
auccagaaaacugugauu

SEQ ID NO: 3431035 - RNA, 15 nt, Human
auccagaaagaaaaa

SEQ ID NO: 3431036 - RNA, 18 nt, Human
auccagaaagaaaacuug

SEQ ID NO: 3431037 - RNA, 18 nt, Human
auccagacaucaugaauu

SEQ ID NO: 3431038 - RNA, 21 nt, Human
auccagacaucaugaauuuua

SEQ ID NO: 3431039 - RNA, 16 nt, Human
auccagacucagagcu

SEQ ID NO: 3431040 - RNA, 22 nt, Human
auccagaguuuagaggaaaaaa

SEQ ID NO: 3431041 - RNA, 23 nt, Human
auccccucuccccccccccucca

SEQ ID NO: 3431042 - RNA, 18 nt, Human
auccccuggacugggagg

SEQ ID NO: 3431043 - RNA, 18 nt, Human
auccccuuccuaccaccc

SEQ ID NO: 3431044 - RNA, 21 nt, Human
auccccuucucaucacucccc

SEQ ID NO: 3431045 - RNA, 20 nt, Human
auccccuucuccccugcacu

SEQ ID NO: 3431046 - RNA, 21 nt, Human
auccccuucuccccugcacug

SEQ ID NO: 3431047 - RNA, 22 nt, Human
auccccuucuccccugcacugu

SEQ ID NO: 3431048 - RNA, 23 nt, Human
auccccuucuccccugcacugua

SEQ ID NO: 3431049 - RNA, 16 nt, Human
auccccuugaacucuu

SEQ ID NO: 3431050 - RNA, 21 nt, Human
auccccuugaggucucagccc

SEQ ID NO: 3431051 - RNA, 22 nt, Human
auccccuugaggucucagcccc

SEQ ID NO: 3431052 - RNA, 13 nt, Human
aucccgagucugg

SEQ ID NO: 3431053 - RNA, 16 nt, Human
aucccgagucugggac

SEQ ID NO: 3431054 - RNA, 17 nt, Human
aucccgcucuuuuccua

SEQ ID NO: 3431055 - RNA, 15 nt, Human
aucccggaggaaauc

SEQ ID NO: 3431056 - RNA, 20 nt, Human
aucccgugcaaaacaugcua

SEQ ID NO: 3431057 - RNA, 13 nt, Human
aucccguguucuc

SEQ ID NO: 3431058 - RNA, 16 nt, Human
aucccuaaugcugcag

SEQ ID NO: 3431059 - RNA, 22 nt, Human
aucccuacccccuaagagccau

SEQ ID NO: 3431060 - RNA, 15 nt, Human
aucccuacuguaauu

SEQ ID NO: 3431061 - RNA, 22 nt, Human
aucccuagacuuuaggcuuuca

SEQ ID NO: 3431062 - RNA, 22 nt, Human
aucccuaggucuugggagcucu

SEQ ID NO: 3431063 - RNA, 21 nt, Human
aucccuagucuucaagcagau

SEQ ID NO: 3431064 - RNA, 14 nt, Human
aucccuaugcugcc

SEQ ID NO: 3431065 - RNA, 16 nt, Human
aucccucaccuucuga

SEQ ID NO: 3431066 - RNA, 16 nt, Human
aucccuccccaguuca

SEQ ID NO: 3431067 - RNA, 13 nt, Human
aucccucccucca

SEQ ID NO: 3431068 - RNA, 14 nt, Human
aucccucccuccac

SEQ ID NO: 3431069 - RNA, 16 nt, Human
aucccucccuccaccu

SEQ ID NO: 3431070 - RNA, 17 nt, Human
aucccucccuccaccuc

SEQ ID NO: 3431071 - RNA, 23 nt, Human
aucccucccuccaccucccugca

SEQ ID NO: 3431072 - RNA, 13 nt, Human
aucccuccuguug

SEQ ID NO: 3431073 - RNA, 15 nt, Human
aucccuccuuaagag

SEQ ID NO: 3431074 - RNA, 20 nt, Human
aucccucgauauuuuuaaag

SEQ ID NO: 3431075 - RNA, 21 nt, Human
aucccucuacagagcuucccu

SEQ ID NO: 3431076 - RNA, 14 nt, Human
aucccucucuggau

SEQ ID NO: 3431077 - RNA, 20 nt, Human
aucccugaaucccccuugcc

SEQ ID NO: 3431078 - RNA, 20 nt, Human
aucccugaggcuggacucca

SEQ ID NO: 3431079 - RNA, 15 nt, Human
aucccugaucccuuc

SEQ ID NO: 3431080 - RNA, 14 nt, Human
aucccugccagcuc

SEQ ID NO: 3431081 - RNA, 12 nt, Human
aucccugcucac

SEQ ID NO: 3431082 - RNA, 15 nt, Human
aucccugcucacugc

SEQ ID NO: 3431083 - RNA, 11 nt, Human
aucccuggccc

SEQ ID NO: 3431084 - RNA, 16 nt, Human
aucccugggccugcug

SEQ ID NO: 3431085 - RNA, 12 nt, Human
aucccugugagg

SEQ ID NO: 3431086 - RNA, 12 nt, Human
aucccuguucau

SEQ ID NO: 3431087 - RNA, 17 nt, Human
aucccuguuuaauauuu

SEQ ID NO: 3431088 - RNA, 20 nt, Human
aucccuguuuaauauuuaaa

SEQ ID NO: 3431089 - RNA, 21 nt, Human
aucccuuccuuuuagccuagu

SEQ ID NO: 3431090 - RNA, 16 nt, Human
aucccuucucacagca

SEQ ID NO: 3431091 - RNA, 22 nt, Human
aucccuugaccaggccugggcc

SEQ ID NO: 3431092 - RNA, 17 nt, Human
aucccuuggacauuuua

SEQ ID NO: 3431093 - RNA, 13 nt, Human
aucccuuuauuac

SEQ ID NO: 3431094 - RNA, 22 nt, Human
aucccuuuauuacccccuccuu

SEQ ID NO: 3431095 - RNA, 14 nt, Human
aucccuuuucuuga

SEQ ID NO: 3431096 - RNA, 15 nt, Human
aucccuuuuucaaug

SEQ ID NO: 3431097 - RNA, 22 nt, Human
aucccuuuuucauaaauuauuu

SEQ ID NO: 3431098 - RNA, 19 nt, Human
auccgaaccuccucuguga

SEQ ID NO: 3431099 - RNA, 13 nt, Human
auccgccagggcc

SEQ ID NO: 3431100 - RNA, 15 nt, Human
auccgccagggccca

SEQ ID NO: 3431101 - RNA, 16 nt, Human
auccgcccgccucggc

SEQ ID NO: 3431102 - RNA, 15 nt, Human
auccgcgugugccug

SEQ ID NO: 3431103 - RNA, 16 nt, Human
auccgcgugugccugu

SEQ ID NO: 3431104 - RNA, 13 nt, Human
auccgcucucuuc

SEQ ID NO: 3431105 - RNA, 17 nt, Human
auccggggccagcuccg

SEQ ID NO: 3431106 - RNA, 16 nt, Human
auccguaguucccuga

SEQ ID NO: 3431107 - RNA, 20 nt, Human
auccgugccucuuuuuaaag

SEQ ID NO: 3431108 - RNA, 23 nt, Human
auccguguugcagguucauggau

SEQ ID NO: 3431109 - RNA, 19 nt, Human
auccuaaaacaaaagcuca

SEQ ID NO: 3431110 - RNA, 23 nt, Human
auccuaaaacaaaagcucaucca

SEQ ID NO: 3431111 - RNA, 13 nt, Human
auccuaaagaaca

SEQ ID NO: 3431112 - RNA, 14 nt, Human
auccuaagaaauau

SEQ ID NO: 3431113 - RNA, 12 nt, Human
auccuaagcuau

SEQ ID NO: 3431114 - RNA, 22 nt, Human
auccuaagggucgaaagcucua

SEQ ID NO: 3431115 - RNA, 15 nt, Human
auccuaauaaaaagg

SEQ ID NO: 3431116 - RNA, 18 nt, Human
auccuaauaaaaagguga

SEQ ID NO: 3431117 - RNA, 21 nt, Human
auccuaaugacuucuaaaaau

SEQ ID NO: 3431118 - RNA, 16 nt, Human
auccuaauuucuccuc

SEQ ID NO: 3431119 - RNA, 19 nt, Human
auccuaauuucuccucccu

SEQ ID NO: 3431120 - RNA, 23 nt, Human
auccuaauuucuccucccuuccu

SEQ ID NO: 3431121 - RNA, 18 nt, Human
auccuacaagacacagug

SEQ ID NO: 3431122 - RNA, 14 nt, Human
auccuaccaaccuc

SEQ ID NO: 3431123 - RNA, 15 nt, Human
auccuaccaaccucu

SEQ ID NO: 3431124 - RNA, 21 nt, Human
auccuaccacaaugcagugcc

SEQ ID NO: 3431125 - RNA, 14 nt, Human
auccuacccccugu

SEQ ID NO: 3431126 - RNA, 23 nt, Human
auccuagagauuugguguacaau

SEQ ID NO: 3431127 - RNA, 16 nt, Human
auccuagauccuaagg

SEQ ID NO: 3431128 - RNA, 15 nt, Human
auccuagcugugugc

SEQ ID NO: 3431129 - RNA, 16 nt, Human
auccuaggcugacacc

SEQ ID NO: 3431130 - RNA, 13 nt, Human
auccuagggccug

SEQ ID NO: 3431131 - RNA, 20 nt, Human
auccuagucauucuucccua

SEQ ID NO: 3431132 - RNA, 13 nt, Human
auccuaguuccac

SEQ ID NO: 3431133 - RNA, 15 nt, Human
auccuaguuccacca

SEQ ID NO: 3431134 - RNA, 18 nt, Human
auccuauauagaaugcug

SEQ ID NO: 3431135 - RNA, 16 nt, Human
auccuaucucuccaac

SEQ ID NO: 3431136 - RNA, 21 nt, Human
auccuaugcaugguuucagca

SEQ ID NO: 3431137 - RNA, 17 nt, Human
auccuaugugauuuuaa

SEQ ID NO: 3431138 - RNA, 20 nt, Human
auccuauguuuuuguucaaa

SEQ ID NO: 3431139 - RNA, 13 nt, Human
auccuauucuuuc

SEQ ID NO: 3431140 - RNA, 19 nt, Human
auccucaaacacugcaggc

SEQ ID NO: 3431141 - RNA, 21 nt, Human
auccucaaacacugcaggcau

SEQ ID NO: 3431142 - RNA, 16 nt, Human
auccucaaagaaagug

SEQ ID NO: 3431143 - RNA, 21 nt, Human
auccucaaagaaaguguauug

SEQ ID NO: 3431144 - RNA, 15 nt, Human
auccucaauccagcu

SEQ ID NO: 3431145 - RNA, 19 nt, Human
auccucaguuuuugugaaa

SEQ ID NO: 3431146 - RNA, 17 nt, Human
auccucauacccacccc

SEQ ID NO: 3431147 - RNA, 22 nt, Human
auccucauacccacccccaccc

SEQ ID NO: 3431148 - RNA, 21 nt, Human
auccucauauggcccaguguc

SEQ ID NO: 3431149 - RNA, 13 nt, Human
auccuccagcagg

SEQ ID NO: 3431150 - RNA, 11 nt, Human
auccuccagcu

SEQ ID NO: 3431151 - RNA, 13 nt, Human
auccuccaggugc

SEQ ID NO: 3431152 - RNA, 15 nt, Human
auccuccagguuuuu

SEQ ID NO: 3431153 - RNA, 20 nt, Human
auccuccagguuuuucaauu

SEQ ID NO: 3431154 - RNA, 15 nt, Human
auccuccccuggacu

SEQ ID NO: 3431155 - RNA, 15 nt, Human
auccucccuguaacu

SEQ ID NO: 3431156 - RNA, 16 nt, Human
auccuccguccagccg

SEQ ID NO: 3431157 - RNA, 21 nt, Human
caagaugggcaucuuuuguau

SEQ ID NO: 3431158 - RNA, 13 nt, Human
caagaugucuguc

SEQ ID NO: 3431159 - RNA, 14 nt, Human
caagauuaaaugua

SEQ ID NO: 3431160 - RNA, 23 nt, Human
caagauucccagagacaggaaaa

SEQ ID NO: 3431161 - RNA, 13 nt, Human
caagauucccagg

SEQ ID NO: 3431162 - RNA, 19 nt, Human
caagauucccaggaguucu

SEQ ID NO: 3431163 - RNA, 18 nt, Human
caagauucuagaugauua

SEQ ID NO: 3431164 - RNA, 17 nt, Human
caagauucugaaacauu

SEQ ID NO: 3431165 - RNA, 16 nt, Human
caagauugagcucucu

SEQ ID NO: 3431166 - RNA, 19 nt, Human
caagauugagcucucugcc

SEQ ID NO: 3431167 - RNA, 16 nt, Human
caagauugcuuaaaau

SEQ ID NO: 3431168 - RNA, 16 nt, Human
caagauugucauuagu

SEQ ID NO: 3431169 - RNA, 15 nt, Human
caagauuguguccca

SEQ ID NO: 3431170 - RNA, 16 nt, Human
caagauuuagaaaaaa

SEQ ID NO: 3431171 - RNA, 16 nt, Human
caagauuuccuugugc

SEQ ID NO: 3431172 - RNA, 18 nt, Human
caagauuuuccacaagau

SEQ ID NO: 3431173 - RNA, 19 nt, Human
caagauuuuccucuuguga

SEQ ID NO: 3431174 - RNA, 16 nt, Human
caagauuuuccuuuuu

SEQ ID NO: 3431175 - RNA, 17 nt, Human
caagauuuuccuuuuuu

SEQ ID NO: 3431176 - RNA, 22 nt, Human
caagauuuuccuuuuuuauaca

SEQ ID NO: 3431177 - RNA, 16 nt, Human
caagauuuuuuaauug

SEQ ID NO: 3431178 - RNA, 14 nt, Human
caagcaaaaucaug

SEQ ID NO: 3431179 - RNA, 23 nt, Human
caagcaaaaucauggaaugguua

SEQ ID NO: 3431180 - RNA, 22 nt, Human
caagcaaccuggguccaaauaa

SEQ ID NO: 3431181 - RNA, 13 nt, Human
caagcaagaaaca

SEQ ID NO: 3431182 - RNA, 15 nt, Human
caagcaauccuccug

SEQ ID NO: 3431183 - RNA, 17 nt, Human
caagcaauccuccugag

SEQ ID NO: 3431184 - RNA, 17 nt, Human
caagcacagcagccugg

SEQ ID NO: 3431185 - RNA, 14 nt, Human
caagcacagucagg

SEQ ID NO: 3431186 - RNA, 13 nt, Human
caagagaagcauu

SEQ ID NO: 3431187 - RNA, 13 nt, Human
caagagacaugcu

SEQ ID NO: 3431188 - RNA, 13 nt, Human
caagagagaaaga

SEQ ID NO: 3431189 - RNA, 14 nt, Human
caagagagaaagaa

SEQ ID NO: 3431190 - RNA, 21 nt, Human
caagagagaaccuaacuguau

SEQ ID NO: 3431191 - RNA, 21 nt, Human
caagagagcagcaaggucuug

SEQ ID NO: 3431192 - RNA, 24 nt, Human
caagagagggccaugcaauucauc

SEQ ID NO: 3431193 - RNA, 16 nt, Human
caagagauaagucuuu

SEQ ID NO: 3431194 - RNA, 18 nt, Human
caagagauauuuugggca

SEQ ID NO: 3431195 - RNA, 14 nt, Human
caagagauugcuaa

SEQ ID NO: 3431196 - RNA, 15 nt, Human
caagagauugcuaau

SEQ ID NO: 3431197 - RNA, 14 nt, Human
caagagcacacuug

SEQ ID NO: 3431198 - RNA, 14 nt, Human
caagagcagccugu

SEQ ID NO: 3431199 - RNA, 16 nt, Human
caagagcagccugugg

SEQ ID NO: 3431200 - RNA, 17 nt, Human
caagagcagccuguggc

SEQ ID NO: 3431201 - RNA, 18 nt, Human
caagagcagccuguggca

SEQ ID NO: 3431202 - RNA, 21 nt, Human
caagagcagccuguggcaucu

SEQ ID NO: 3431203 - RNA, 20 nt, Human
caagagcaucaugccucuga

SEQ ID NO: 3431204 - RNA, 19 nt, Human
caagagcccagcagggccu

SEQ ID NO: 3431205 - RNA, 16 nt, Human
caagagcccaggccuc

SEQ ID NO: 3431206 - RNA, 17 nt, Human
caagagcccccuugaca

SEQ ID NO: 3431207 - RNA, 19 nt, Human
caagagccugaucucuucc

SEQ ID NO: 3431208 - RNA, 23 nt, Human
caagagccugaucucuuccuguu

SEQ ID NO: 3431209 - RNA, 14 nt, Human
caagagccuuaaaa

SEQ ID NO: 3431210 - RNA, 15 nt, Human
caagagccuuaaaac

SEQ ID NO: 3431211 - RNA, 17 nt, Human
caagagccuuaaaacau

SEQ ID NO: 3431212 - RNA, 18 nt, Human
caagagccuuggugucca

SEQ ID NO: 3431213 - RNA, 23 nt, Human
caagagccuugguguccaccugg

SEQ ID NO: 3431214 - RNA, 19 nt, Human
caagagcuacauaauuuag

SEQ ID NO: 3431215 - RNA, 16 nt, Human
caagagcugcccuccu

SEQ ID NO: 3431216 - RNA, 18 nt, Human
caagagcugcccuccuug

SEQ ID NO: 3431217 - RNA, 18 nt, Human
caaucaagucuguuuacu

SEQ ID NO: 3431218 - RNA, 21 nt, Human
caaucaauaaacagcagguga

SEQ ID NO: 3431219 - RNA, 16 nt, Human
caaucaaucuugcaug

SEQ ID NO: 3431220 - RNA, 11 nt, Human
caaucacuguc

SEQ ID NO: 3431221 - RNA, 15 nt, Human
caaucacuguccucc

SEQ ID NO: 3431222 - RNA, 20 nt, Human
caaucagagaccaggcccug

SEQ ID NO: 3431223 - RNA, 13 nt, Human
caaucagcacuga

SEQ ID NO: 3431224 - RNA, 15 nt, Human
caaucagcacugaaa

SEQ ID NO: 3431225 - RNA, 17 nt, Human
caaucagcacugaaaau

SEQ ID NO: 3431226 - RNA, 17 nt, Human
caaucagccuaguugau

SEQ ID NO: 3431227 - RNA, 16 nt, Human
caaucagcuccuuccu

SEQ ID NO: 3431228 - RNA, 11 nt, Human
caaucagcugc

SEQ ID NO: 3431229 - RNA, 13 nt, Human
caaucagcugcuu

SEQ ID NO: 3431230 - RNA, 17 nt, Human
caaucaguagcuuaaga

SEQ ID NO: 3431231 - RNA, 21 nt, Human
caaucaguagcuuaagaaaaa

SEQ ID NO: 3431232 - RNA, 22 nt, Human
caaucaguagcuuaagaaaaaa

SEQ ID NO: 3431233 - RNA, 15 nt, Human
caaucaguauaauuc

SEQ ID NO: 3431234 - RNA, 22 nt, Human
caaucaguccccucccaucugg

SEQ ID NO: 3431235 - RNA, 17 nt, Human
caaucaugaaauaugca

SEQ ID NO: 3431236 - RNA, 18 nt, Human
caaucauugcugaaaaug

SEQ ID NO: 3431237 - RNA, 22 nt, Human
caaucauuguacaguuuguuua

SEQ ID NO: 3431238 - RNA, 19 nt, Human
caaucauuguuuugaauau

SEQ ID NO: 3431239 - RNA, 13 nt, Human
caaucauuucuca

SEQ ID NO: 3431240 - RNA, 17 nt, Human
caaucauuucucacugu

SEQ ID NO: 3431241 - RNA, 18 nt, Human
caaucauuucucacugug

SEQ ID NO: 3431242 - RNA, 17 nt, Human
caaucauuuuaauuauu

SEQ ID NO: 3431243 - RNA, 17 nt, Human
caauccagcgguucuca

SEQ ID NO: 3431244 - RNA, 20 nt, Human
caauccagguacgcacagac

SEQ ID NO: 3431245 - RNA, 23 nt, Human
caauccagguacgcacagacagg

SEQ ID NO: 3431246 - RNA, 17 nt, Human
caauccauaacuuuagu

SEQ ID NO: 3431247 - RNA, 15 nt, Human
caauccauguaaggu

SEQ ID NO: 3431248 - RNA, 12 nt, Human
caaucccagcua

SEQ ID NO: 3431249 - RNA, 17 nt, Human
caaucccagcuaccuca

SEQ ID NO: 3431250 - RNA, 16 nt, Human
caauccccagcccuuu

SEQ ID NO: 3431251 - RNA, 15 nt, Human
caauccccucauuca

SEQ ID NO: 3431252 - RNA, 12 nt, Human
caauccccuccu

SEQ ID NO: 3431253 - RNA, 16 nt, Human
caauccccuccuuggg

SEQ ID NO: 3431254 - RNA, 17 nt, Human
caauccuaacacauuau

SEQ ID NO: 3431255 - RNA, 19 nt, Human
caauccuaauuucuccucc

SEQ ID NO: 3431256 - RNA, 13 nt, Human
caauccuccugag

SEQ ID NO: 3431257 - RNA, 13 nt, Human
caauccucuaagc

SEQ ID NO: 3431258 - RNA, 12 nt, Human
caauccugcccc

SEQ ID NO: 3431259 - RNA, 13 nt, Human
caauccuuacaaa

SEQ ID NO: 3431260 - RNA, 14 nt, Human
caauccuuuauuau

SEQ ID NO: 3431261 - RNA, 15 nt, Human
caaucuaaccacauc

SEQ ID NO: 3431262 - RNA, 14 nt, Human
caaucuauuauuuc

SEQ ID NO: 3431263 - RNA, 13 nt, Human
caaucuauuuauu

SEQ ID NO: 3431264 - RNA, 17 nt, Human
caaucugacauucucag

SEQ ID NO: 3431265 - RNA, 19 nt, Human
caaucuggggaaauaauaa

SEQ ID NO: 3431266 - RNA, 16 nt, Human
caaucuguaaacugug

SEQ ID NO: 3431267 - RNA, 18 nt, Human
caaucuguaaacugugua

SEQ ID NO: 3431268 - RNA, 14 nt, Human
caaucugucaguuc

SEQ ID NO: 3431269 - RNA, 12 nt, Human
caaucugugggc

SEQ ID NO: 3431270 - RNA, 18 nt, Human
caaucuucaauccuugaa

SEQ ID NO: 3431271 - RNA, 21 nt, Human
caaucuuccuguuuaaaaaac

SEQ ID NO: 3431272 - RNA, 15 nt, Human
caaucuuuaaaccaa

SEQ ID NO: 3431273 - RNA, 18 nt, Human
caaucuuuagaaaaggca

SEQ ID NO: 3431274 - RNA, 14 nt, Human
caaucuuugaaaga

SEQ ID NO: 3431275 - RNA, 19 nt, Human
caaucuuugaaagacuucc

SEQ ID NO: 3431276 - RNA, 16 nt, Human
caaucuuuuuuacucu

SEQ ID NO: 3431277 - RNA, 20 nt, Human
caaugaaaagucguuuucca

SEQ ID NO: 3431278 - RNA, 21 nt, Human
caaugaaaugaauuaaagugg

SEQ ID NO: 3431279 - RNA, 23 nt, Human
caaugaaaugaauuaaaguggac

SEQ ID NO: 3431280 - RNA, 17 nt, Human
caaugaacaucccuuuu

SEQ ID NO: 3431281 - RNA, 20 nt, Human
caaugaacccccaugaugua

SEQ ID NO: 3431282 - RNA, 21 nt, Human
caaugaagccagcucacagug

SEQ ID NO: 3431283 - RNA, 20 nt, Human
caaugaaggaaauaaaaaag

SEQ ID NO: 3431284 - RNA, 13 nt, Human
caaugaaguugaa

SEQ ID NO: 3431285 - RNA, 20 nt, Human
caaugaauaaaaacucaagg

SEQ ID NO: 3431286 - RNA, 22 nt, Human
caaugaaugaaugaauggcuaa

SEQ ID NO: 3431287 - RNA, 21 nt, Human
caaugacacagucuuggcuca

SEQ ID NO: 3431288 - RNA, 15 nt, Human
caaugacaucuucaa

SEQ ID NO: 3431289 - RNA, 13 nt, Human
caaugacaugaau

SEQ ID NO: 3431290 - RNA, 14 nt, Human
caaugacaugaauu

SEQ ID NO: 3431291 - RNA, 11 nt, Human
caaugacuacu

SEQ ID NO: 3431292 - RNA, 20 nt, Human
caaugacugugcuacugucu

SEQ ID NO: 3431293 - RNA, 21 nt, Human
caaugacugugcuacugucuu

SEQ ID NO: 3431294 - RNA, 19 nt, Human
caaugagacuugccuuccu

SEQ ID NO: 3431295 - RNA, 13 nt, Human
caaugagagcaua

SEQ ID NO: 3431296 - RNA, 19 nt, Human
caaugagauagaagauguu

SEQ ID NO: 3431297 - RNA, 19 nt, Human
caaugagaucauugugaag

SEQ ID NO: 3431298 - RNA, 14 nt, Human
caaugagcuuucug

SEQ ID NO: 3431299 - RNA, 20 nt, Human
caaugauaguaagaaaagug

SEQ ID NO: 3431300 - RNA, 22 nt, Human
caaugaucuagguuuaacucag

SEQ ID NO: 3431301 - RNA, 21 nt, Human
caaugaugaaugagaaucuac

SEQ ID NO: 3431302 - RNA, 21 nt, Human
caaugauggcaauuuuguaac

SEQ ID NO: 3431303 - RNA, 24 nt, Human
caaugauggcaauuuuguaacgaa

SEQ ID NO: 3431304 - RNA, 14 nt, Human
caaugauguccaga

SEQ ID NO: 3431305 - RNA, 20 nt, Human
caaugauuauuuucauuaca

SEQ ID NO: 3431306 - RNA, 15 nt, Human
caaugauuguuaauu

SEQ ID NO: 3431307 - RNA, 14 nt, Human
caaugcaaaccauc

SEQ ID NO: 3431308 - RNA, 18 nt, Human
caaugcaaaccaucauug

SEQ ID NO: 3431309 - RNA, 22 nt, Human
caaugcaaaccaucauugaaau

SEQ ID NO: 3431310 - RNA, 18 nt, Human
caaugcaagacgcccucu

SEQ ID NO: 3431311 - RNA, 23 nt, Human
caaugcaccuaaagaaaaacaaa

SEQ ID NO: 3431312 - RNA, 17 nt, Human
caaugcacuuuguucug

SEQ ID NO: 3431313 - RNA, 22 nt, Human
caaugcacuuuguucuggcucu

SEQ ID NO: 3431314 - RNA, 13 nt, Human
caaugcagaacuc

SEQ ID NO: 3431315 - RNA, 13 nt, Human
caaugcagcaagg

SEQ ID NO: 3431316 - RNA, 22 nt, Human
caaugcagcaaggcccugcugc

SEQ ID NO: 3431317 - RNA, 20 nt, Human
caaugcaugcagccacugug

SEQ ID NO: 3431318 - RNA, 15 nt, Human
caaugccacagcccu

SEQ ID NO: 3431319 - RNA, 17 nt, Human
caaugccacagcccugu

SEQ ID NO: 3431320 - RNA, 19 nt, Human
caaugccacagcccuguca

SEQ ID NO: 3431321 - RNA, 15 nt, Human
caaugccacauacuu

SEQ ID NO: 3431322 - RNA, 19 nt, Human
caaugccacauacuugcag

SEQ ID NO: 3431323 - RNA, 20 nt, Human
caaugccauccucaaacacu

SEQ ID NO: 3431324 - RNA, 12 nt, Human
caaugccucgac

SEQ ID NO: 3431325 - RNA, 13 nt, Human
caaugcugauguc

SEQ ID NO: 3431326 - RNA, 14 nt, Human
caaugcugauuugg

SEQ ID NO: 3431327 - RNA, 12 nt, Human
caaugcuggcug

SEQ ID NO: 3431328 - RNA, 21 nt, Human
caaugcuggcuguuggcuggg

SEQ ID NO: 3431329 - RNA, 17 nt, Human
caaugcuguauuuuaaa

SEQ ID NO: 3431330 - RNA, 18 nt, Human
caaugcuucuagaguuuu

SEQ ID NO: 3431331 - RNA, 17 nt, Human
aucugggggaguggaau

SEQ ID NO: 3431332 - RNA, 15 nt, Human
aucuggguagcugua

SEQ ID NO: 3431333 - RNA, 17 nt, Human
aucuggguucacugcaa

SEQ ID NO: 3431334 - RNA, 17 nt, Human
aucugguagauuuuuaa

SEQ ID NO: 3431335 - RNA, 20 nt, Human
aucugguagggggaaaaugu

SEQ ID NO: 3431336 - RNA, 18 nt, Human
aucugguauuaaaugcca

SEQ ID NO: 3431337 - RNA, 14 nt, Human
aucugguuuugcua

SEQ ID NO: 3431338 - RNA, 14 nt, Human
aucuguaaacugug

SEQ ID NO: 3431339 - RNA, 17 nt, Human
aucuguaaacuguguau

SEQ ID NO: 3431340 - RNA, 16 nt, Human
aucuguaaaucuacac

SEQ ID NO: 3431341 - RNA, 11 nt, Human
aucuguaacag

SEQ ID NO: 3431342 - RNA, 23 nt, Human
aucuguaacagguauuuuguuuc

SEQ ID NO: 3431343 - RNA, 17 nt, Human
aucuguaagcuguuugg

SEQ ID NO: 3431344 - RNA, 19 nt, Human
aucuguaaguaacuucaca

SEQ ID NO: 3431345 - RNA, 22 nt, Human
aucuguacauuuuguuguaaaa

SEQ ID NO: 3431346 - RNA, 16 nt, Human
aucuguaccucugccu

SEQ ID NO: 3431347 - RNA, 17 nt, Human
aucuguacuucuucgau

SEQ ID NO: 3431348 - RNA, 20 nt, Human
aucuguauaaguaagaaaau

SEQ ID NO: 3431349 - RNA, 24 nt, Human
aucuguauaauacuuuguauacaa

SEQ ID NO: 3431350 - RNA, 17 nt, Human
aucuguauauaaaauau

SEQ ID NO: 3431351 - RNA, 19 nt, Human
aucuguauauaaaauauuu

SEQ ID NO: 3431352 - RNA, 15 nt, Human
aucuguaucucucuc

SEQ ID NO: 3431353 - RNA, 15 nt, Human
aucugucaaaacacu

SEQ ID NO: 3431354 - RNA, 21 nt, Human
aucugucaagaguaguuauau

SEQ ID NO: 3431355 - RNA, 22 nt, Human
aucugucaagaguaguuauaua

SEQ ID NO: 3431356 - RNA, 13 nt, Human
aucuguccaagga

SEQ ID NO: 3431357 - RNA, 14 nt, Human
aucuguccaaggaa

SEQ ID NO: 3431358 - RNA, 15 nt, Human
aucugucccccuuua

SEQ ID NO: 3431359 - RNA, 22 nt, Human
aucugucugccaaccuaaaacu

SEQ ID NO: 3431360 - RNA, 11 nt, Human
aucugucugcu

SEQ ID NO: 3431361 - RNA, 14 nt, Human
aucugucugcuggu

SEQ ID NO: 3431362 - RNA, 17 nt, Human
aucugucuuuccacucu

SEQ ID NO: 3431363 - RNA, 21 nt, Human
aucugucuuuccacucuggau

SEQ ID NO: 3431364 - RNA, 11 nt, Human
aucugugaaau

SEQ ID NO: 3431365 - RNA, 21 nt, Human
aucugugaaaugcuggcauuu

SEQ ID NO: 3431366 - RNA, 19 nt, Human
aucugugaacuugaaauuu

SEQ ID NO: 3431367 - RNA, 21 nt, Human
aucugugaaguaguucuguuu

SEQ ID NO: 3431368 - RNA, 12 nt, Human
aucugugaauaa

SEQ ID NO: 3431369 - RNA, 13 nt, Human
aucugugaauaag

SEQ ID NO: 3431370 - RNA, 16 nt, Human
aucugugaauucagau

SEQ ID NO: 3431371 - RNA, 22 nt, Human
aucugugaggggcucucucaug

SEQ ID NO: 3431372 - RNA, 22 nt, Human
aucugugcaaauccuugauacu

SEQ ID NO: 3431373 - RNA, 13 nt, Human
aucugugccccau

SEQ ID NO: 3431374 - RNA, 15 nt, Human
aucugugccccaugc

SEQ ID NO: 3431375 - RNA, 16 nt, Human
aucugugcuguuucaa

SEQ ID NO: 3431376 - RNA, 21 nt, Human
aucugugcuguuucaaaguuc

SEQ ID NO: 3431377 - RNA, 18 nt, Human
caaugugaacuuuauuaa

SEQ ID NO: 3431378 - RNA, 14 nt, Human
caaugugaaucaga

SEQ ID NO: 3431379 - RNA, 18 nt, Human
caaugugaaucagacccu

SEQ ID NO: 3431380 - RNA, 17 nt, Human
caaugugaccaggggug

SEQ ID NO: 3431381 - RNA, 17 nt, Human
caaugugauaaaacccc

SEQ ID NO: 3431382 - RNA, 13 nt, Human
caaugugcagugu

SEQ ID NO: 3431383 - RNA, 13 nt, Human
caaugugccccca

SEQ ID NO: 3431384 - RNA, 23 nt, Human
caaugugcuacugauuguuucau

SEQ ID NO: 3431385 - RNA, 13 nt, Human
caaugugcucucg

SEQ ID NO: 3431386 - RNA, 21 nt, Human
caauguggccuaaaaaugcaa

SEQ ID NO: 3431387 - RNA, 16 nt, Human
caauguguauaaacaa

SEQ ID NO: 3431388 - RNA, 20 nt, Human
caauguguauaaacaagaaa

SEQ ID NO: 3431389 - RNA, 21 nt, Human
caauguguauaaacaagaaaa

SEQ ID NO: 3431390 - RNA, 15 nt, Human
caauguguauaaauu

SEQ ID NO: 3431391 - RNA, 16 nt, Human
caauguguauaaauug

SEQ ID NO: 3431392 - RNA, 17 nt, Human
caauguguauaaauugu

SEQ ID NO: 3431393 - RNA, 22 nt, Human
caaugugugccgagcccuugcc

SEQ ID NO: 3431394 - RNA, 19 nt, Human
caauguguggcugaagacu

SEQ ID NO: 3431395 - RNA, 15 nt, Human
caauguguguauaug

SEQ ID NO: 3431396 - RNA, 16 nt, Human
caauguguguauaugg

SEQ ID NO: 3431397 - RNA, 20 nt, Human
caauguguugauacauuccc

SEQ ID NO: 3431398 - RNA, 16 nt, Human
caauguguuuuucucc

SEQ ID NO: 3431399 - RNA, 20 nt, Human
caauguuaaauuaauuauaa

SEQ ID NO: 3431400 - RNA, 14 nt, Human
caauguuaaggaaa

SEQ ID NO: 3431401 - RNA, 24 nt, Human
caauguuaaggaaacucuuaucuc

SEQ ID NO: 3431402 - RNA, 15 nt, Human
caauguuagccucaa

SEQ ID NO: 3431403 - RNA, 22 nt, Human
caauguuagccucaauuucuga

SEQ ID NO: 3431404 - RNA, 12 nt, Human
caauguucauug

SEQ ID NO: 3431405 - RNA, 18 nt, Human
caauguucauuguaaugu

SEQ ID NO: 3431406 - RNA, 22 nt, Human
caauguucauuguaauguuacu

SEQ ID NO: 3431407 - RNA, 23 nt, Human
caauguucauuguaauguuacug

SEQ ID NO: 3431408 - RNA, 14 nt, Human
caauguucucucuu

SEQ ID NO: 3431409 - RNA, 14 nt, Human
caauguucuuuaua

SEQ ID NO: 3431410 - RNA, 16 nt, Human
caauguucuuuauaua

SEQ ID NO: 3431411 - RNA, 14 nt, Human
caauguuguagugu

SEQ ID NO: 3431412 - RNA, 17 nt, Human
caauguuguuuuaagac

SEQ ID NO: 3431413 - RNA, 16 nt, Human
caauguuuaaaaaagu

SEQ ID NO: 3431414 - RNA, 20 nt, Human
caauguuuaaaaaaguuuaa

SEQ ID NO: 3431415 - RNA, 21 nt, Human
caauguuuaaaaaaguuuaaa

SEQ ID NO: 3431416 - RNA, 18 nt, Human
caauguuucuuuuaucac

SEQ ID NO: 3431417 - RNA, 18 nt, Human
caauguuuuuaaaaaucu

SEQ ID NO: 3431418 - RNA, 22 nt, Human
caauuaaaaauugucuucaugu

SEQ ID NO: 3431419 - RNA, 12 nt, Human
caauuaaacgga

SEQ ID NO: 3431420 - RNA, 20 nt, Human
caauuaaacggauuauuuuu

SEQ ID NO: 3431421 - RNA, 18 nt, Human
caauuaaagaaauaauuu

SEQ ID NO: 3431422 - RNA, 14 nt, Human
caauuaaaggcaaa

SEQ ID NO: 3431423 - RNA, 12 nt, Human
caauuaaaugua

SEQ ID NO: 3431424 - RNA, 23 nt, Human
caauuaaggauuuuaugcuuuaa

SEQ ID NO: 3431425 - RNA, 15 nt, Human
caauuaauuccuuca

SEQ ID NO: 3431426 - RNA, 18 nt, Human
caauuaauuccuucagca

SEQ ID NO: 3431427 - RNA, 23 nt, Human
caauuaauugcuauuguguuauu

SEQ ID NO: 3431428 - RNA, 19 nt, Human
caauuaauuuuuuuauugu

SEQ ID NO: 3431429 - RNA, 20 nt, Human
caauuaauuuuuuuauuguu

SEQ ID NO: 3431430 - RNA, 15 nt, Human
caauuacauguuugg

SEQ ID NO: 3431431 - RNA, 17 nt, Human
caauuaccagaaagaua

SEQ ID NO: 3431432 - RNA, 23 nt, Human
caauuaggcagacucuuuaugcu

SEQ ID NO: 3431433 - RNA, 18 nt, Human
caauuaguaacauucaug

SEQ ID NO: 3431434 - RNA, 21 nt, Human
caauuauaagaggauaugaac

SEQ ID NO: 3431435 - RNA, 15 nt, Human
caauuauaguuucug

SEQ ID NO: 3431436 - RNA, 23 nt, Human
caauuauaucaguccucuuucaa

SEQ ID NO: 3431437 - RNA, 14 nt, Human
caauuaugaaaaua

SEQ ID NO: 3431438 - RNA, 16 nt, Human
caauuaugaagauuua

SEQ ID NO: 3431439 - RNA, 15 nt, Human
caauuauguuaaacu

SEQ ID NO: 3431440 - RNA, 14 nt, Human
caauuauugauaua

SEQ ID NO: 3431441 - RNA, 20 nt, Human
caauuauugauauauauuau

SEQ ID NO: 3431442 - RNA, 14 nt, Human
caauucaaaaaugu

SEQ ID NO: 3431443 - RNA, 15 nt, Human
caauucaaaaguucc

SEQ ID NO: 3431444 - RNA, 14 nt, Human
caauucaacacucc

SEQ ID NO: 3431445 - RNA, 17 nt, Human
caauucaacccuuugcc

SEQ ID NO: 3431446 - RNA, 13 nt, Human
caauucagacagg

SEQ ID NO: 3431447 - RNA, 14 nt, Human
caauucagacaggc

SEQ ID NO: 3431448 - RNA, 15 nt, Human
caauucagacaggca

SEQ ID NO: 3431449 - RNA, 21 nt, Human
caauucagugcuguacuugau

SEQ ID NO: 3431450 - RNA, 15 nt, Human
caauuccaacaguuu

SEQ ID NO: 3431451 - RNA, 18 nt, Human
caauuccaacaguuuaau

SEQ ID NO: 3431452 - RNA, 18 nt, Human
caauuccaugcuauaaaa

SEQ ID NO: 3431453 - RNA, 18 nt, Human
caauucccaccuaugagu

SEQ ID NO: 3431454 - RNA, 17 nt, Human
caauuccccucugcugc

SEQ ID NO: 3431455 - RNA, 21 nt, Human
caauuccguagccagcugcuc

SEQ ID NO: 3431456 - RNA, 22 nt, Human
caauuccgucuucuuaaucuga

SEQ ID NO: 3431457 - RNA, 14 nt, Human
caauuccucuggga

SEQ ID NO: 3431458 - RNA, 15 nt, Human
caauuccucugggaa

SEQ ID NO: 3431459 - RNA, 12 nt, Human
caauuccugggc

SEQ ID NO: 3431460 - RNA, 14 nt, Human
caauucuccugccu

SEQ ID NO: 3431461 - RNA, 19 nt, Human
caauucuccugccuuugcc

SEQ ID NO: 3431462 - RNA, 20 nt, Human
caauucuccugccuuugccu

SEQ ID NO: 3431463 - RNA, 17 nt, Human
caauucucgagcuuggg

SEQ ID NO: 3431464 - RNA, 14 nt, Human
caauucuguuuuua

SEQ ID NO: 3431465 - RNA, 19 nt, Human
caauucuuacaaacaugug

SEQ ID NO: 3431466 - RNA, 20 nt, Human
caauucuucccuaucuuugc

SEQ ID NO: 3431467 - RNA, 15 nt, Human
caauucuugccaaau

SEQ ID NO: 3431468 - RNA, 13 nt, Human
caauucuuuauac

SEQ ID NO: 3431469 - RNA, 22 nt, Human
caauugaaagugggcaaaagcu

SEQ ID NO: 3431470 - RNA, 22 nt, Human
caauugaaggaucaucugaagg

SEQ ID NO: 3431471 - RNA, 23 nt, Human
caauugaaguaaaauguggcagg

SEQ ID NO: 3431472 - RNA, 18 nt, Human
caauugaaguaaacuuuu

SEQ ID NO: 3431473 - RNA, 21 nt, Human
caauugaauuaaauuaggaau

SEQ ID NO: 3431474 - RNA, 21 nt, Human
caauugacaacaguuacauaa

SEQ ID NO: 3431475 - RNA, 22 nt, Human
caauugacaacaguuacauaau

SEQ ID NO: 3431476 - RNA, 19 nt, Human
augaaguuuccuuggcugg

SEQ ID NO: 3431477 - RNA, 14 nt, Human
augaaguuuuacau

SEQ ID NO: 3431478 - RNA, 19 nt, Human
augaaguuuuuuuuauaca

SEQ ID NO: 3431479 - RNA, 17 nt, Human
augaauaaagacaccua

SEQ ID NO: 3431480 - RNA, 18 nt, Human
augaauaaugccuuugua

SEQ ID NO: 3431481 - RNA, 19 nt, Human
augaauaaugccuuuguaa

SEQ ID NO: 3431482 - RNA, 20 nt, Human
augaauaauggaaaaugcca

SEQ ID NO: 3431483 - RNA, 15 nt, Human
augaauaauuuccca

SEQ ID NO: 3431484 - RNA, 22 nt, Human
augaauaauuucccaauuagga

SEQ ID NO: 3431485 - RNA, 20 nt, Human
augaauacaaacaauggaaa

SEQ ID NO: 3431486 - RNA, 21 nt, Human
augaauacauuuccaaaaugg

SEQ ID NO: 3431487 - RNA, 17 nt, Human
augaauacgagcaagcu

SEQ ID NO: 3431488 - RNA, 12 nt, Human
augaauacuuug

SEQ ID NO: 3431489 - RNA, 16 nt, Human
augaauauaaugaaug

SEQ ID NO: 3431490 - RNA, 18 nt, Human
augaauaucauacaaauc

SEQ ID NO: 3431491 - RNA, 22 nt, Human
augaauaucuauuaauauaugu

SEQ ID NO: 3431492 - RNA, 21 nt, Human
augaauauuuaguguucauaa

SEQ ID NO: 3431493 - RNA, 13 nt, Human
augaauauuuuga

SEQ ID NO: 3431494 - RNA, 21 nt, Human
augaaucaaaagugccucaag

SEQ ID NO: 3431495 - RNA, 12 nt, Human
augaaucaaugg

SEQ ID NO: 3431496 - RNA, 17 nt, Human
augaaucacuguuuuua

SEQ ID NO: 3431497 - RNA, 15 nt, Human
augaaucgcuucucu

SEQ ID NO: 3431498 - RNA, 14 nt, Human
augaaucuaagcag

SEQ ID NO: 3431499 - RNA, 18 nt, Human
augaaucuauuauacugu

SEQ ID NO: 3431500 - RNA, 23 nt, Human
augaaucuauuauacuguauuaa

SEQ ID NO: 3431501 - RNA, 17 nt, Human
augaaucugcucacuuu

SEQ ID NO: 3431502 - RNA, 17 nt, Human
augaaugaaacauuuug

SEQ ID NO: 3431503 - RNA, 15 nt, Human
augaaugagucuguu

SEQ ID NO: 3431504 - RNA, 15 nt, Human
augaaugcacacuag

SEQ ID NO: 3431505 - RNA, 15 nt, Human
augaaugcuuaaaga

SEQ ID NO: 3431506 - RNA, 23 nt, Human
augaauggagauuugaaggucug

SEQ ID NO: 3431507 - RNA, 21 nt, Human
augaauguaaauuuguacuau

SEQ ID NO: 3431508 - RNA, 16 nt, Human
augaauguaucaggaa

SEQ ID NO: 3431509 - RNA, 16 nt, Human
augaauguaugugcac

SEQ ID NO: 3431510 - RNA, 18 nt, Human
augaauguaugugcacug

SEQ ID NO: 3431511 - RNA, 16 nt, Human
augaaugucaguguga

SEQ ID NO: 3431512 - RNA, 16 nt, Human
augaauuaaauaaacc

SEQ ID NO: 3431513 - RNA, 15 nt, Human
augaauuaaguuuuu

SEQ ID NO: 3431514 - RNA, 22 nt, Human
augaauuacauuuguauaaaau

SEQ ID NO: 3431515 - RNA, 21 nt, Human
augaauuaguuuuauaugcuu

SEQ ID NO: 3431516 - RNA, 23 nt, Human
augaauuauccuauuucaguacu

SEQ ID NO: 3431517 - RNA, 17 nt, Human
augaauuauuacagugu

SEQ ID NO: 3431518 - RNA, 17 nt, Human
augaauucuuaugcuua

SEQ ID NO: 3431519 - RNA, 11 nt, Human
augaauuuaaa

SEQ ID NO: 3431520 - RNA, 18 nt, Human
augaauuuuagcuuuugu

SEQ ID NO: 3431521 - RNA, 23 nt, Human
augacaaaaucaucuuugugaag

SEQ ID NO: 3431522 - RNA, 16 nt, Human
augacaaaauucuuuc

SEQ ID NO: 3431523 - RNA, 20 nt, Human
augacaaagcagauucagaa

SEQ ID NO: 3431524 - RNA, 13 nt, Human
augacaaauguuu

SEQ ID NO: 3431525 - RNA, 15 nt, Human
augacaaauguuucu

SEQ ID NO: 3431526 - RNA, 17 nt, Human
augacaacuacagaaaa

SEQ ID NO: 3431527 - RNA, 16 nt, Human
augacaacuucuaauu

SEQ ID NO: 3431528 - RNA, 20 nt, Human
augacaacuucuaauugcca

SEQ ID NO: 3431529 - RNA, 21 nt, Human
augacaagaaaggcugcugua

SEQ ID NO: 3431530 - RNA, 13 nt, Human
augacaagauggu

SEQ ID NO: 3431531 - RNA, 17 nt, Human
augacaagaugguacaa

SEQ ID NO: 3431532 - RNA, 16 nt, Human
augacaagccccaggc

SEQ ID NO: 3431533 - RNA, 19 nt, Human
augacaagugagacaaaaa

SEQ ID NO: 3431534 - RNA, 14 nt, Human
augacaaugaugau

SEQ ID NO: 3431535 - RNA, 14 nt, Human
augacacaugcaag

SEQ ID NO: 3431536 - RNA, 22 nt, Human
augacacaugcaaggucauuuu

SEQ ID NO: 3431537 - RNA, 16 nt, Human
augacacuagaaaacu

SEQ ID NO: 3431538 - RNA, 23 nt, Human
augacacucauauaauuauaugu

SEQ ID NO: 3431539 - RNA, 21 nt, Human
augacacugagaacagaucuc

SEQ ID NO: 3431540 - RNA, 16 nt, Human
augacacuguucagga

SEQ ID NO: 3431541 - RNA, 18 nt, Human
augacagaaaauauguau

SEQ ID NO: 3431542 - RNA, 19 nt, Human
augacagaaaauauguauu

SEQ ID NO: 3431543 - RNA, 15 nt, Human
augacagccugcagc

SEQ ID NO: 3431544 - RNA, 15 nt, Human
augacagcugucccu

SEQ ID NO: 3431545 - RNA, 16 nt, Human
augacagcugucccug

SEQ ID NO: 3431546 - RNA, 17 nt, Human
augacagcugucccugu

SEQ ID NO: 3431547 - RNA, 20 nt, Human
augacaggcauccaaggaag

SEQ ID NO: 3431548 - RNA, 22 nt, Human
augacaggccugaagauauuac

SEQ ID NO: 3431549 - RNA, 16 nt, Human
augacagguaaauuaa

SEQ ID NO: 3431550 - RNA, 12 nt, Human
augacaguaauu

SEQ ID NO: 3431551 - RNA, 20 nt, Human
augacaguaauuguguuuac

SEQ ID NO: 3431552 - RNA, 23 nt, Human
augacaguaguaccaaaugcuuu

SEQ ID NO: 3431553 - RNA, 21 nt, Human
augacaguccgucaaaacaga

SEQ ID NO: 3431554 - RNA, 22 nt, Human
augacaguccgucaaaacagau

SEQ ID NO: 3431555 - RNA, 18 nt, Human
augacauaacagugcagg

SEQ ID NO: 3431556 - RNA, 14 nt, Human
augacaucacuugu

SEQ ID NO: 3431557 - RNA, 18 nt, Human
augacaucacuuguacaa

SEQ ID NO: 3431558 - RNA, 19 nt, Human
augacaucacuuguacaaa

SEQ ID NO: 3431559 - RNA, 16 nt, Human
augacaucucaggggc

SEQ ID NO: 3431560 - RNA, 24 nt, Human
augacaucuucaaagcuugaagau

SEQ ID NO: 3431561 - RNA, 12 nt, Human
augacaugaauu

SEQ ID NO: 3431562 - RNA, 15 nt, Human
augacaugaauuuua

SEQ ID NO: 3431563 - RNA, 14 nt, Human
augacaugcacuga

SEQ ID NO: 3431564 - RNA, 23 nt, Human
augacaugcacugacccuuccag

SEQ ID NO: 3431565 - RNA, 23 nt, Human
augacauguuauauauuuuuugu

SEQ ID NO: 3431566 - RNA, 14 nt, Human
augacauucccugc

SEQ ID NO: 3431567 - RNA, 18 nt, Human
augacauuuauuuuucau

SEQ ID NO: 3431568 - RNA, 23 nt, Human
augaccaaauaucaccaggacug

SEQ ID NO: 3431569 - RNA, 20 nt, Human
augaccagaagggaaacagu

SEQ ID NO: 3431570 - RNA, 21 nt, Human
augaccagaugcgucccaaga

SEQ ID NO: 3431571 - RNA, 14 nt, Human
augacccaccccug

SEQ ID NO: 3431572 - RNA, 12 nt, Human
augacccagugg

SEQ ID NO: 3431573 - RNA, 11 nt, Human
augaccccucc

SEQ ID NO: 3431574 - RNA, 14 nt, Human
augaccccugccca

SEQ ID NO: 3431575 - RNA, 12 nt, Human
augaccuccagc

SEQ ID NO: 3431576 - RNA, 16 nt, Human
cacagcuuagauuuca

SEQ ID NO: 3431577 - RNA, 18 nt, Human
cacagcuucagccaggag

SEQ ID NO: 3431578 - RNA, 19 nt, Human
cacagcuugaccugaggcu

SEQ ID NO: 3431579 - RNA, 20 nt, Human
cacagcuuguuuuggacuuu

SEQ ID NO: 3431580 - RNA, 19 nt, Human
cacaggaaccacaagacug

SEQ ID NO: 3431581 - RNA, 20 nt, Human
cacaggaaccacaagacugc

SEQ ID NO: 3431582 - RNA, 16 nt, Human
cacaggacacagucag

SEQ ID NO: 3431583 - RNA, 17 nt, Human
cacaggacacagucaga

SEQ ID NO: 3431584 - RNA, 20 nt, Human
cacaggacaugcgguagcca

SEQ ID NO: 3431585 - RNA, 17 nt, Human
cacaggacauuucucua

SEQ ID NO: 3431586 - RNA, 19 nt, Human
cacaggacccccuuccccu

SEQ ID NO: 3431587 - RNA, 15 nt, Human
cacaggacccucgcc

SEQ ID NO: 3431588 - RNA, 15 nt, Human
cacaggacucugccu

SEQ ID NO: 3431589 - RNA, 15 nt, Human
cacaggagcauuugg

SEQ ID NO: 3431590 - RNA, 14 nt, Human
cacaggagcuaccu

SEQ ID NO: 3431591 - RNA, 19 nt, Human
cacaggaggcaagcaagcu

SEQ ID NO: 3431592 - RNA, 15 nt, Human
cacaggaggcaggca

SEQ ID NO: 3431593 - RNA, 19 nt, Human
cacaggaggcaggcauggc

SEQ ID NO: 3431594 - RNA, 12 nt, Human
cacaggaggggg

SEQ ID NO: 3431595 - RNA, 22 nt, Human
cacaggaguguccucuucccuc

SEQ ID NO: 3431596 - RNA, 23 nt, Human
cacaggauccuauucucaccagg

SEQ ID NO: 3431597 - RNA, 19 nt, Human
cacaggauggucucugcca

SEQ ID NO: 3431598 - RNA, 17 nt, Human
cacaggcaacugaggca

SEQ ID NO: 3431599 - RNA, 22 nt, Human
cacaggcaacugaggcagacag

SEQ ID NO: 3431600 - RNA, 16 nt, Human
cacaggcagccagugc

SEQ ID NO: 3431601 - RNA, 17 nt, Human
cacaggcagccagugcc

SEQ ID NO: 3431602 - RNA, 19 nt, Human
cacaggcagccagugcccu

SEQ ID NO: 3431603 - RNA, 20 nt, Human
cacaggcagccagugcccug

SEQ ID NO: 3431604 - RNA, 23 nt, Human
cacaggcagccagugcccugagc

SEQ ID NO: 3431605 - RNA, 12 nt, Human
cacaggcagcuu

SEQ ID NO: 3431606 - RNA, 13 nt, Human
cacaggcagcuuu

SEQ ID NO: 3431607 - RNA, 10 nt, Human
cacaggcagg

SEQ ID NO: 3431608 - RNA, 17 nt, Human
cacaggcauuuccuggg

SEQ ID NO: 3431609 - RNA, 19 nt, Human
cacaggcauuuccugggug

SEQ ID NO: 3431610 - RNA, 15 nt, Human
cacaggccacccugu

SEQ ID NO: 3431611 - RNA, 12 nt, Human
cacaggcccccu

SEQ ID NO: 3431612 - RNA, 21 nt, Human
cacaggcccccuugagugggg

SEQ ID NO: 3431613 - RNA, 22 nt, Human
cacaggcccccuugaguggggu

SEQ ID NO: 3431614 - RNA, 14 nt, Human
cacaggcccggcuc

SEQ ID NO: 3431615 - RNA, 16 nt, Human
cacaggcccggcucca

SEQ ID NO: 3431616 - RNA, 19 nt, Human
cacaggcccggcuccaggc

SEQ ID NO: 3431617 - RNA, 19 nt, Human
cacaggcccuuuccucagg

SEQ ID NO: 3431618 - RNA, 11 nt, Human
cacaggccucc

SEQ ID NO: 3431619 - RNA, 14 nt, Human
cacaggccucccug

SEQ ID NO: 3431620 - RNA, 15 nt, Human
caauuguguagccuu

SEQ ID NO: 3431621 - RNA, 16 nt, Human
caauuguguagccuuu

SEQ ID NO: 3431622 - RNA, 20 nt, Human
caauuguuuguucuguuuuc

SEQ ID NO: 3431623 - RNA, 17 nt, Human
caauuuaaaauauagau

SEQ ID NO: 3431624 - RNA, 18 nt, Human
caauuuaaacccauuuua

SEQ ID NO: 3431625 - RNA, 12 nt, Human
caauuuaaagca

SEQ ID NO: 3431626 - RNA, 11 nt, Human
caauuuaaaug

SEQ ID NO: 3431627 - RNA, 13 nt, Human
caauuuaaauguu

SEQ ID NO: 3431628 - RNA, 23 nt, Human
caauuuaaguguuggaaaaaauu

SEQ ID NO: 3431629 - RNA, 20 nt, Human
caauuuacaaaguguguauu

SEQ ID NO: 3431630 - RNA, 23 nt, Human
caauuuauuaaaaugauuguaaa

SEQ ID NO: 3431631 - RNA, 13 nt, Human
caauuuauuuuau

SEQ ID NO: 3431632 - RNA, 14 nt, Human
caauuuauuuuauu

SEQ ID NO: 3431633 - RNA, 22 nt, Human
caauuucacgacacacuuugau

SEQ ID NO: 3431634 - RNA, 14 nt, Human
caauuucagacucc

SEQ ID NO: 3431635 - RNA, 12 nt, Human
caauuucccccu

SEQ ID NO: 3431636 - RNA, 15 nt, Human
caauuuccuuuauau

SEQ ID NO: 3431637 - RNA, 16 nt, Human
caauuucuacuuugaa

SEQ ID NO: 3431638 - RNA, 20 nt, Human
caauuucuguguugccaagc

SEQ ID NO: 3431639 - RNA, 19 nt, Human
caauuugauacauaauaaa

SEQ ID NO: 3431640 - RNA, 13 nt, Human
caauuugaugugg

SEQ ID NO: 3431641 - RNA, 15 nt, Human
caauuugcacauuaa

SEQ ID NO: 3431642 - RNA, 22 nt, Human
caauuugcacauuaaaugacuc

SEQ ID NO: 3431643 - RNA, 19 nt, Human
caauuugggagauauauuu

SEQ ID NO: 3431644 - RNA, 18 nt, Human
caauuugggcuuccuguu

SEQ ID NO: 3431645 - RNA, 22 nt, Human
caauuugucauuuugaagcuaa

SEQ ID NO: 3431646 - RNA, 23 nt, Human
caauuugucauuuugaagcuaau

SEQ ID NO: 3431647 - RNA, 16 nt, Human
caauuuguuugugcuu

SEQ ID NO: 3431648 - RNA, 13 nt, Human
caauuuuaaacau

SEQ ID NO: 3431649 - RNA, 15 nt, Human
caauuuuaaacauau

SEQ ID NO: 3431650 - RNA, 22 nt, Human
caauuuuaacacacauaaagga

SEQ ID NO: 3431651 - RNA, 22 nt, Human
caauuuuauaaggacuuccuga

SEQ ID NO: 3431652 - RNA, 20 nt, Human
caauuuucacuguguccagg

SEQ ID NO: 3431653 - RNA, 19 nt, Human
caauuuucagauuugcaca

SEQ ID NO: 3431654 - RNA, 21 nt, Human
caauuuuccuucagauauuuu

SEQ ID NO: 3431655 - RNA, 17 nt, Human
caauuuuccuugaagcc

SEQ ID NO: 3431656 - RNA, 13 nt, Human
caauuuucuccca

SEQ ID NO: 3431657 - RNA, 17 nt, Human
caauuuucucccaggaa

SEQ ID NO: 3431658 - RNA, 19 nt, Human
caauuuucuggaauacaug

SEQ ID NO: 3431659 - RNA, 13 nt, Human
caauuuuguuucu

SEQ ID NO: 3431660 - RNA, 16 nt, Human
caauuuuguuucugua

SEQ ID NO: 3431661 - RNA, 17 nt, Human
caauuuuguuucuguac

SEQ ID NO: 3431662 - RNA, 13 nt, Human
caauuuuuaaugg

SEQ ID NO: 3431663 - RNA, 22 nt, Human
caauuuuuaauggcagcagaaa

SEQ ID NO: 3431664 - RNA, 14 nt, Human
caauuuuucugcac

SEQ ID NO: 3431665 - RNA, 18 nt, Human
caauuuuucugcacugag

SEQ ID NO: 3431666 - RNA, 16 nt, Human
caauuuuugccuucau

SEQ ID NO: 3431667 - RNA, 19 nt, Human
caauuuuugucucagaagu

SEQ ID NO: 3431668 - RNA, 21 nt, Human
caauuuuuuaagugaaaauau

SEQ ID NO: 3431669 - RNA, 17 nt, Human
caauuuuuuguucuuca

SEQ ID NO: 3431670 - RNA, 21 nt, Human
caauuuuuuuaauuuuguauu

SEQ ID NO: 3431671 - RNA, 22 nt, Human
caauuuuuuuaauuuuguauuu

SEQ ID NO: 3431672 - RNA, 22 nt, Human
cacaaaaaaaauuuaaaaaaau

SEQ ID NO: 3431673 - RNA, 12 nt, Human
cacaaaaaagaa

SEQ ID NO: 3431674 - RNA, 13 nt, Human
cacaaaaaagaag

SEQ ID NO: 3431675 - RNA, 13 nt, Human
cacaaaacaaagc

SEQ ID NO: 3431676 - RNA, 15 nt, Human
cacaaaacaacccua

SEQ ID NO: 3431677 - RNA, 16 nt, Human
cacaaaacccagaccu

SEQ ID NO: 3431678 - RNA, 16 nt, Human
cacaaaaguuucucuu

SEQ ID NO: 3431679 - RNA, 23 nt, Human
cacaaacacauuguuauuuucag

SEQ ID NO: 3431680 - RNA, 13 nt, Human
cacaaacagaggc

SEQ ID NO: 3431681 - RNA, 15 nt, Human
cacaaacagaggccg

SEQ ID NO: 3431682 - RNA, 17 nt, Human
cacaaaccuucugccuu

SEQ ID NO: 3431683 - RNA, 22 nt, Human
cacaaacucuaucggagaacau

SEQ ID NO: 3431684 - RNA, 19 nt, Human
cacaaagaaaauuccuaua

SEQ ID NO: 3431685 - RNA, 20 nt, Human
cacaaagaaaauuccuauaa

SEQ ID NO: 3431686 - RNA, 23 nt, Human
cacaaagaaccaccaggaaagca

SEQ ID NO: 3431687 - RNA, 15 nt, Human
cacaaagacccuggc

SEQ ID NO: 3431688 - RNA, 18 nt, Human
cacaaagcacaguuugaa

SEQ ID NO: 3431689 - RNA, 11 nt, Human
cacaaagccca

SEQ ID NO: 3431690 - RNA, 18 nt, Human
cacaaagcggggggaggg

SEQ ID NO: 3431691 - RNA, 19 nt, Human
cacaaagcggggggagggu

SEQ ID NO: 3431692 - RNA, 13 nt, Human
cacaaagcuuuug

SEQ ID NO: 3431693 - RNA, 18 nt, Human
cacaaaggaccucagcug

SEQ ID NO: 3431694 - RNA, 13 nt, Human
cacaaaggagagc

SEQ ID NO: 3431695 - RNA, 18 nt, Human
cacaaaggccaaacugcu

SEQ ID NO: 3431696 - RNA, 17 nt, Human
cacaaagguagcuuuuc

SEQ ID NO: 3431697 - RNA, 16 nt, Human
cacaaagguauaauuu

SEQ ID NO: 3431698 - RNA, 14 nt, Human
cacaaauauuaaaa

SEQ ID NO: 3431699 - RNA, 23 nt, Human
cacaaauauuauuuguguuuccu

SEQ ID NO: 3431700 - RNA, 13 nt, Human
cacaaauauuuau

SEQ ID NO: 3431701 - RNA, 14 nt, Human
cacaaaugacuuua

SEQ ID NO: 3431702 - RNA, 15 nt, Human
cacaaaugacuuuau

SEQ ID NO: 3431703 - RNA, 20 nt, Human
cacaaaugacuuuauuauuu

SEQ ID NO: 3431704 - RNA, 20 nt, Human
cacaaauuucacuuauaccu

SEQ ID NO: 3431705 - RNA, 17 nt, Human
cacaacaaaaauuugaa

SEQ ID NO: 3431706 - RNA, 16 nt, Human
cacaacccccagcucc

SEQ ID NO: 3431707 - RNA, 17 nt, Human
cacaacccccagcuccc

SEQ ID NO: 3431708 - RNA, 18 nt, Human
cacaacccccagcucccg

SEQ ID NO: 3431709 - RNA, 14 nt, Human
cacaaccugaaccu

SEQ ID NO: 3431710 - RNA, 23 nt, Human
cacaaccuucuguggcucacaga

SEQ ID NO: 3431711 - RNA, 11 nt, Human
cacaacuagga

SEQ ID NO: 3431712 - RNA, 18 nt, Human
cacaacuaguuuuguuua

SEQ ID NO: 3431713 - RNA, 23 nt, Human
cacaacucacuccuuuuaaagaa

SEQ ID NO: 3431714 - RNA, 16 nt, Human
cacaacugacacagga

SEQ ID NO: 3431715 - RNA, 18 nt, Human
cacaacugacacaggaaa

SEQ ID NO: 3431716 - RNA, 19 nt, Human
cacaacugcaauaacuucu

SEQ ID NO: 3431717 - RNA, 23 nt, Human
cacaacuuaaaaagucugcauua

SEQ ID NO: 3431718 - RNA, 15 nt, Human
cacaacuuuuaacca

SEQ ID NO: 3431719 - RNA, 15 nt, Human
cacaagaaaugaaag

SEQ ID NO: 3431720 - RNA, 14 nt, Human
cacaagaaauuuga

SEQ ID NO: 3431721 - RNA, 20 nt, Human
cacaagaaauuugauuucua

SEQ ID NO: 3431722 - RNA, 23 nt, Human
cacaagaauggaucacaagaugg

SEQ ID NO: 3431723 - RNA, 23 nt, Human
cacaagacccaaaaggcagaagc

SEQ ID NO: 3431724 - RNA, 21 nt, Human
cacaagagcccagcagggccu

SEQ ID NO: 3431725 - RNA, 20 nt, Human
cacaagagcccaggccuccu

SEQ ID NO: 3431726 - RNA, 15 nt, Human
cacaagauugguguu

SEQ ID NO: 3431727 - RNA, 17 nt, Human
cacaagauugguguuuu

SEQ ID NO: 3431728 - RNA, 22 nt, Human
cacaagauugguguuuuuuucu

SEQ ID NO: 3431729 - RNA, 23 nt, Human
cacaagauugguguuuuuuucua

SEQ ID NO: 3431730 - RNA, 22 nt, Human
cacaagcagagugcacagcugu

SEQ ID NO: 3431731 - RNA, 21 nt, Human
cacaagccacaagucuuccag

SEQ ID NO: 3431732 - RNA, 12 nt, Human
cacaagccacag

SEQ ID NO: 3431733 - RNA, 15 nt, Human
cacaagccacagaag

SEQ ID NO: 3431734 - RNA, 15 nt, Human
cacaagcccacagca

SEQ ID NO: 3431735 - RNA, 20 nt, Human
cacaagccucugcccaggca

SEQ ID NO: 3431736 - RNA, 14 nt, Human
cacaagccuucggc

SEQ ID NO: 3431737 - RNA, 17 nt, Human
cacaagcuccaagcucc

SEQ ID NO: 3431738 - RNA, 17 nt, Human
cacaagcugcacccuca

SEQ ID NO: 3431739 - RNA, 16 nt, Human
cacaagcuggaagcac

SEQ ID NO: 3431740 - RNA, 14 nt, Human
cacaaggacuuccu

SEQ ID NO: 3431741 - RNA, 13 nt, Human
cacauagauuaau

SEQ ID NO: 3431742 - RNA, 18 nt, Human
cacauagauuaauggcac

SEQ ID NO: 3431743 - RNA, 13 nt, Human
cacauagcugucu

SEQ ID NO: 3431744 - RNA, 16 nt, Human
cacauaguuuuucagu

SEQ ID NO: 3431745 - RNA, 14 nt, Human
cacauauacacaca

SEQ ID NO: 3431746 - RNA, 16 nt, Human
cacauauacacacaca

SEQ ID NO: 3431747 - RNA, 22 nt, Human
cacauauaccuauaaugugugu

SEQ ID NO: 3431748 - RNA, 15 nt, Human
cacauauccaggcac

SEQ ID NO: 3431749 - RNA, 18 nt, Human
cacauauccaggcaccag

SEQ ID NO: 3431750 - RNA, 19 nt, Human
cacauauccaggcaccagg

SEQ ID NO: 3431751 - RNA, 23 nt, Human
cacauaucuaguaugaaauuaua

SEQ ID NO: 3431752 - RNA, 13 nt, Human
cacauaugagggg

SEQ ID NO: 3431753 - RNA, 19 nt, Human
cacauaugcaccuuguguc

SEQ ID NO: 3431754 - RNA, 21 nt, Human
cacauaugcaccuugugucug

SEQ ID NO: 3431755 - RNA, 23 nt, Human
cacauauuugaagggucuuucuc

SEQ ID NO: 3431756 - RNA, 14 nt, Human
cacauauuuuaaaa

SEQ ID NO: 3431757 - RNA, 17 nt, Human
cacauauuuuaaaauuu

SEQ ID NO: 3431758 - RNA, 14 nt, Human
cacauauuuuucca

SEQ ID NO: 3431759 - RNA, 14 nt, Human
cacaucaaaccuuu

SEQ ID NO: 3431760 - RNA, 20 nt, Human
cacaucagcacgauuucugu

SEQ ID NO: 3431761 - RNA, 22 nt, Human
cacaucagcacgauuucuguuu

SEQ ID NO: 3431762 - RNA, 14 nt, Human
cacaucaucuguaa

SEQ ID NO: 3431763 - RNA, 15 nt, Human
cacaucaucuguaag

SEQ ID NO: 3431764 - RNA, 18 nt, Human
cacauccaacuccagcaa

SEQ ID NO: 3431765 - RNA, 23 nt, Human
augcuggcuggccuuguggucca

SEQ ID NO: 3431766 - RNA, 20 nt, Human
augcuggcuguuggcugggg

SEQ ID NO: 3431767 - RNA, 12 nt, Human
augcugggcugg

SEQ ID NO: 3431768 - RNA, 21 nt, Human
augcugggcuggcucccucuu

SEQ ID NO: 3431769 - RNA, 22 nt, Human
augcuggggcaagucccugacu

SEQ ID NO: 3431770 - RNA, 11 nt, Human
augcuggguug

SEQ ID NO: 3431771 - RNA, 21 nt, Human
augcugguuuuccuaaaugca

SEQ ID NO: 3431772 - RNA, 13 nt, Human
augcugguuuuuc

SEQ ID NO: 3431773 - RNA, 20 nt, Human
augcuguaacuuaaaauagg

SEQ ID NO: 3431774 - RNA, 16 nt, Human
augcuguacauacuuu

SEQ ID NO: 3431775 - RNA, 23 nt, Human
augcuguacaucuauuuuggauu

SEQ ID NO: 3431776 - RNA, 20 nt, Human
augcuguagacaucuguccu

SEQ ID NO: 3431777 - RNA, 14 nt, Human
augcuguauuuuaa

SEQ ID NO: 3431778 - RNA, 22 nt, Human
augcugucaacuaugauauggu

SEQ ID NO: 3431779 - RNA, 19 nt, Human
augcugucccuuacgugag

SEQ ID NO: 3431780 - RNA, 22 nt, Human
augcugucuacacuaagagaga

SEQ ID NO: 3431781 - RNA, 17 nt, Human
augcugucuggcacagc

SEQ ID NO: 3431782 - RNA, 17 nt, Human
augcugugccccuggcc

SEQ ID NO: 3431783 - RNA, 17 nt, Human
augcugugcuaugaauu

SEQ ID NO: 3431784 - RNA, 14 nt, Human
augcuguguaagcu

SEQ ID NO: 3431785 - RNA, 14 nt, Human
augcugugugacuc

SEQ ID NO: 3431786 - RNA, 19 nt, Human
augcuguucaugaaagauu

SEQ ID NO: 3431787 - RNA, 18 nt, Human
augcuguucucuucuuca

SEQ ID NO: 3431788 - RNA, 11 nt, Human
augcuguugau

SEQ ID NO: 3431789 - RNA, 17 nt, Human
augcuguugauugcuaa

SEQ ID NO: 3431790 - RNA, 19 nt, Human
augcuguugauugcuaaau

SEQ ID NO: 3431791 - RNA, 21 nt, Human
augcuguugauugcuaaaugu

SEQ ID NO: 3431792 - RNA, 23 nt, Human
augcuguugauugcuaaauguaa

SEQ ID NO: 3431793 - RNA, 15 nt, Human
augcuguugccucau

SEQ ID NO: 3431794 - RNA, 16 nt, Human
augcuuaaaauaagca

SEQ ID NO: 3431795 - RNA, 17 nt, Human
augcuuaaaauaagcag

SEQ ID NO: 3431796 - RNA, 20 nt, Human
cacaguacagcaugugccuu

SEQ ID NO: 3431797 - RNA, 16 nt, Human
cacaguacauaauaca

SEQ ID NO: 3431798 - RNA, 23 nt, Human
cacaguacauaauacacuugccc

SEQ ID NO: 3431799 - RNA, 16 nt, Human
cacaguagagccagcu

SEQ ID NO: 3431800 - RNA, 13 nt, Human
cacaguagucuug

SEQ ID NO: 3431801 - RNA, 16 nt, Human
cacaguagucuugaug

SEQ ID NO: 3431802 - RNA, 14 nt, Human
cacaguauuuguaa

SEQ ID NO: 3431803 - RNA, 15 nt, Human
cacagucacugcucu

SEQ ID NO: 3431804 - RNA, 13 nt, Human
cacaguccaggaa

SEQ ID NO: 3431805 - RNA, 18 nt, Human
cacaguccaggaacaagc

SEQ ID NO: 3431806 - RNA, 17 nt, Human
cacagucccacugugca

SEQ ID NO: 3431807 - RNA, 13 nt, Human
cacaguccuuacc

SEQ ID NO: 3431808 - RNA, 15 nt, Human
cacaguccuuaccag

SEQ ID NO: 3431809 - RNA, 22 nt, Human
cacaguccuuaccagcagagca

SEQ ID NO: 3431810 - RNA, 20 nt, Human
cacagucuccggccucucca

SEQ ID NO: 3431811 - RNA, 22 nt, Human
cacagugaaggcuguccuuacc

SEQ ID NO: 3431812 - RNA, 17 nt, Human
cacagugacccuuccca

SEQ ID NO: 3431813 - RNA, 18 nt, Human
cacagugacucgggcucc

SEQ ID NO: 3431814 - RNA, 19 nt, Human
cacagugacucgggcuccu

SEQ ID NO: 3431815 - RNA, 21 nt, Human
cacagugacucgggcuccugu

SEQ ID NO: 3431816 - RNA, 19 nt, Human
cacagugagucgaggacag

SEQ ID NO: 3431817 - RNA, 22 nt, Human
cacagugagucgaggacaggga

SEQ ID NO: 3431818 - RNA, 14 nt, Human
cacagugauuuuuu

SEQ ID NO: 3431819 - RNA, 17 nt, Human
cacagugcaucucagcc

SEQ ID NO: 3431820 - RNA, 18 nt, Human
cacagugcucuuuucucc

SEQ ID NO: 3431821 - RNA, 13 nt, Human
cacagugcugucu

SEQ ID NO: 3431822 - RNA, 22 nt, Human
cacagugcuuuccguggcacug

SEQ ID NO: 3431823 - RNA, 22 nt, Human
cacaguggaaagacagcuucuc

SEQ ID NO: 3431824 - RNA, 13 nt, Human
cacaguggaacca

SEQ ID NO: 3431825 - RNA, 13 nt, Human
cacagugggaacu

SEQ ID NO: 3431826 - RNA, 19 nt, Human
cacagugggaacucugaca

SEQ ID NO: 3431827 - RNA, 19 nt, Human
cacagugggagccagggcu

SEQ ID NO: 3431828 - RNA, 17 nt, Human
cacagugguggcagggc

SEQ ID NO: 3431829 - RNA, 15 nt, Human
cacaguguaccauua

SEQ ID NO: 3431830 - RNA, 17 nt, Human
cacaguguaccauuaaa

SEQ ID NO: 3431831 - RNA, 18 nt, Human
cacaguguaccauuaaaa

SEQ ID NO: 3431832 - RNA, 16 nt, Human
cacagugucugggcug

SEQ ID NO: 3431833 - RNA, 17 nt, Human
cacagugucugggcuga

SEQ ID NO: 3431834 - RNA, 13 nt, Human
cacagugugaaua

SEQ ID NO: 3431835 - RNA, 14 nt, Human
cacagugugauuuu

SEQ ID NO: 3431836 - RNA, 17 nt, Human
cacaguguuggcgagag

SEQ ID NO: 3431837 - RNA, 13 nt, Human
cacaguuauuaca

SEQ ID NO: 3431838 - RNA, 13 nt, Human
cacaguuccccua

SEQ ID NO: 3431839 - RNA, 22 nt, Human
cacaguuccucgcccugggucu

SEQ ID NO: 3431840 - RNA, 18 nt, Human
cacaguucuuugggccag

SEQ ID NO: 3431841 - RNA, 23 nt, Human
cacaguucuuugggccagacaug

SEQ ID NO: 3431842 - RNA, 12 nt, Human
cacaguugccac

SEQ ID NO: 3431843 - RNA, 17 nt, Human
cacaguugccaccaccu

SEQ ID NO: 3431844 - RNA, 18 nt, Human
cacaguugcucuaugcuu

SEQ ID NO: 3431845 - RNA, 17 nt, Human
cacaguuggcuggauga

SEQ ID NO: 3431846 - RNA, 21 nt, Human
cacaguuggugggguccugcc

SEQ ID NO: 3431847 - RNA, 13 nt, Human
cacaguuugaaau

SEQ ID NO: 3431848 - RNA, 15 nt, Human
cacaguuugaaauaa

SEQ ID NO: 3431849 - RNA, 20 nt, Human
cacaguuuucugagaaagac

SEQ ID NO: 3431850 - RNA, 20 nt, Human
cacaguuuugguugcuuuaa

SEQ ID NO: 3431851 - RNA, 23 nt, Human
cacaguuuugguugcuuuaauau

SEQ ID NO: 3431852 - RNA, 17 nt, Human
cacaguuuuuccuggaa

SEQ ID NO: 3431853 - RNA, 18 nt, Human
cacauaaaggauaaacuu

SEQ ID NO: 3431854 - RNA, 15 nt, Human
cacauaaaugcagcc

SEQ ID NO: 3431855 - RNA, 18 nt, Human
cacauaaaugcagcccau

SEQ ID NO: 3431856 - RNA, 13 nt, Human
cacauaacagaau

SEQ ID NO: 3431857 - RNA, 22 nt, Human
cacauaagccaaaacugagcau

SEQ ID NO: 3431858 - RNA, 19 nt, Human
cacauaagcucagaaucca

SEQ ID NO: 3431859 - RNA, 21 nt, Human
cacauaagggguuugccauuu

SEQ ID NO: 3431860 - RNA, 18 nt, Human
cacauaauuaaagugucc

SEQ ID NO: 3431861 - RNA, 22 nt, Human
cacauaauucaggaagcagcuu

SEQ ID NO: 3431862 - RNA, 14 nt, Human
cacauaauuuuucu

SEQ ID NO: 3431863 - RNA, 20 nt, Human
cacauacacccaaacacuua

SEQ ID NO: 3431864 - RNA, 19 nt, Human
cacauacccucuucaugga

SEQ ID NO: 3431865 - RNA, 16 nt, Human
cacauacuugagacug

SEQ ID NO: 3431866 - RNA, 21 nt, Human
cacauagaaaguaaauaaaag

SEQ ID NO: 3431867 - RNA, 16 nt, Human
cacauagacugugcgc

SEQ ID NO: 3431868 - RNA, 17 nt, Human
cacauagcccacuuaca

SEQ ID NO: 3431869 - RNA, 20 nt, Human
cacauagcccacuuacauuu

SEQ ID NO: 3431870 - RNA, 23 nt, Human
cacauagcuacccaaaagagaaa

SEQ ID NO: 3431871 - RNA, 16 nt, Human
cacauagcugucuaga

SEQ ID NO: 3431872 - RNA, 21 nt, Human
cacauagugaugguuccccug

SEQ ID NO: 3431873 - RNA, 14 nt, Human
cacauauaccuaua

SEQ ID NO: 3431874 - RNA, 23 nt, Human
cacauauaccuauaaugugugua

SEQ ID NO: 3431875 - RNA, 22 nt, Human
cacauaugcaccuugugucugu

SEQ ID NO: 3431876 - RNA, 13 nt, Human
cacauauugauuu

SEQ ID NO: 3431877 - RNA, 17 nt, Human
cacauauuucagugagg

SEQ ID NO: 3431878 - RNA, 16 nt, Human
cacauauuugaagggu

SEQ ID NO: 3431879 - RNA, 15 nt, Human
cacauauuuuaaaau

SEQ ID NO: 3431880 - RNA, 18 nt, Human
cacaucaaauaagaaaua

SEQ ID NO: 3431881 - RNA, 15 nt, Human
cacaucagaaaggaa

SEQ ID NO: 3431882 - RNA, 21 nt, Human
cacaucagcacgauuucuguu

SEQ ID NO: 3431883 - RNA, 24 nt, Human
cacaucagcuccacuuucagugaa

SEQ ID NO: 3431884 - RNA, 21 nt, Human
cacauccaggcaauggccuaa

SEQ ID NO: 3431885 - RNA, 21 nt, Human
cacauccauucccaagaaaug

SEQ ID NO: 3431886 - RNA, 21 nt, Human
cacauccauuucaucuauuuc

SEQ ID NO: 3431887 - RNA, 23 nt, Human
cacauccauuucaucuauuucug

SEQ ID NO: 3431888 - RNA, 16 nt, Human
cacauccccgcuggcu

SEQ ID NO: 3431889 - RNA, 12 nt, Human
cacaucccuggg

SEQ ID NO: 3431890 - RNA, 22 nt, Human
cacaucccugggccugcugcug

SEQ ID NO: 3431891 - RNA, 18 nt, Human
cacauccgcgugugccug

SEQ ID NO: 3431892 - RNA, 19 nt, Human
cacauccgcgugugccugu

SEQ ID NO: 3431893 - RNA, 20 nt, Human
cacauccggaggagaagaag

SEQ ID NO: 3431894 - RNA, 14 nt, Human
cacauccuccgucc

SEQ ID NO: 3431895 - RNA, 18 nt, Human
cacauccuccguccagcc

SEQ ID NO: 3431896 - RNA, 19 nt, Human
cacauccuugacuuuuuag

SEQ ID NO: 3431897 - RNA, 13 nt, Human
cacaucucaacag

SEQ ID NO: 3431898 - RNA, 13 nt, Human
cacaucucuaucu

SEQ ID NO: 3431899 - RNA, 11 nt, Human
cacaucucugc

SEQ ID NO: 3431900 - RNA, 12 nt, Human
cacaucugccuu

SEQ ID NO: 3431901 - RNA, 12 nt, Human
cacaucuguguc

SEQ ID NO: 3431902 - RNA, 13 nt, Human
cacaucuugcucu

SEQ ID NO: 3431903 - RNA, 16 nt, Human
cacaucuugcucugcu

SEQ ID NO: 3431904 - RNA, 17 nt, Human
cacaucuugcucugcug

SEQ ID NO: 3431905 - RNA, 21 nt, Human
cacaucuugcucugcugacag

SEQ ID NO: 3431906 - RNA, 21 nt, Human
cacaucuuucacacuuccacc

SEQ ID NO: 3431907 - RNA, 14 nt, Human
cacaucuuuccugu

SEQ ID NO: 3431908 - RNA, 13 nt, Human
cacaugaagaaau

SEQ ID NO: 3431909 - RNA, 21 nt, Human
caccacgauguggcccuggcc

SEQ ID NO: 3431910 - RNA, 22 nt, Human
caccacgggacaucacagggug

SEQ ID NO: 3431911 - RNA, 15 nt, Human
caccacgguggucac

SEQ ID NO: 3431912 - RNA, 18 nt, Human
caccacuacauucuguua

SEQ ID NO: 3431913 - RNA, 19 nt, Human
caccacuacauucuguuaa

SEQ ID NO: 3431914 - RNA, 20 nt, Human
caccacuaggacucugaggc

SEQ ID NO: 3431915 - RNA, 16 nt, Human
caccacucaagaccaa

SEQ ID NO: 3431916 - RNA, 19 nt, Human
caccacuggccaccaggcu

SEQ ID NO: 3431917 - RNA, 13 nt, Human
caccagaagccca

SEQ ID NO: 3431918 - RNA, 14 nt, Human
caccagaagcccag

SEQ ID NO: 3431919 - RNA, 14 nt, Human
caccagacacccag

SEQ ID NO: 3431920 - RNA, 17 nt, Human
caccagacacccaggac

SEQ ID NO: 3431921 - RNA, 18 nt, Human
caccagacacccaggacu

SEQ ID NO: 3431922 - RNA, 17 nt, Human
caccagacggggcugga

SEQ ID NO: 3431923 - RNA, 20 nt, Human
caccagagaccguccucacc

SEQ ID NO: 3431924 - RNA, 21 nt, Human
caccagagaccguccucaccc

SEQ ID NO: 3431925 - RNA, 12 nt, Human
caccagagcaga

SEQ ID NO: 3431926 - RNA, 21 nt, Human
caccagagcauuuccaacacc

SEQ ID NO: 3431927 - RNA, 20 nt, Human
caccagagcccaccuuggcu

SEQ ID NO: 3431928 - RNA, 16 nt, Human
caccagaggcugcaga

SEQ ID NO: 3431929 - RNA, 23 nt, Human
caccagaggcugcagaaggccaa

SEQ ID NO: 3431930 - RNA, 13 nt, Human
caccagaugcuga

SEQ ID NO: 3431931 - RNA, 23 nt, Human
caccagaugcugaaaauguccuu

SEQ ID NO: 3431932 - RNA, 15 nt, Human
caccagcaucaccug

SEQ ID NO: 3431933 - RNA, 18 nt, Human
caccagcaucaccugccu

SEQ ID NO: 3431934 - RNA, 14 nt, Human
caccagcauuccuu

SEQ ID NO: 3431935 - RNA, 15 nt, Human
caccagcauuccuuu

SEQ ID NO: 3431936 - RNA, 21 nt, Human
caccagccaggcucugugcug

SEQ ID NO: 3431937 - RNA, 14 nt, Human
caccagcccagaag

SEQ ID NO: 3431938 - RNA, 21 nt, Human
caccagcccauggcccugugc

SEQ ID NO: 3431939 - RNA, 16 nt, Human
caccagccccaaucca

SEQ ID NO: 3431940 - RNA, 13 nt, Human
caccagccccagu

SEQ ID NO: 3431941 - RNA, 18 nt, Human
caccagccccagugccca

SEQ ID NO: 3431942 - RNA, 14 nt, Human
caccagccccugcc

SEQ ID NO: 3431943 - RNA, 21 nt, Human
caccagccccugccccagccc

SEQ ID NO: 3431944 - RNA, 19 nt, Human
caccagcccuuagcaggga

SEQ ID NO: 3431945 - RNA, 16 nt, Human
caccagccggggaaga

SEQ ID NO: 3431946 - RNA, 10 nt, Human
caccagcugc

SEQ ID NO: 3431947 - RNA, 15 nt, Human
caccagcugcaaagu

SEQ ID NO: 3431948 - RNA, 14 nt, Human
caccagcugccucu

SEQ ID NO: 3431949 - RNA, 17 nt, Human
caccagcugccucuucu

SEQ ID NO: 3431950 - RNA, 14 nt, Human
caccagcugugucc

SEQ ID NO: 3431951 - RNA, 19 nt, Human
caccagcuucuccaggcuc

SEQ ID NO: 3431952 - RNA, 12 nt, Human
caccaggaaugu

SEQ ID NO: 3431953 - RNA, 17 nt, Human
caccaggagaaccacua

SEQ ID NO: 3431954 - RNA, 19 nt, Human
caccaggagaaccacuaca

SEQ ID NO: 3431955 - RNA, 22 nt, Human
caccaggauagagacuggaaca

SEQ ID NO: 3431956 - RNA, 15 nt, Human
caccaggauggcccu

SEQ ID NO: 3431957 - RNA, 20 nt, Human
caccaggcacgaacccaccu

SEQ ID NO: 3431958 - RNA, 24 nt, Human
caccaggcacgaacccaccugcug

SEQ ID NO: 3431959 - RNA, 13 nt, Human
caccaggcagccu

SEQ ID NO: 3431960 - RNA, 15 nt, Human
caccaggccaccucc

SEQ ID NO: 3431961 - RNA, 18 nt, Human
caccugcugagagaccca

SEQ ID NO: 3431962 - RNA, 19 nt, Human
caccugcugagagacccaa

SEQ ID NO: 3431963 - RNA, 17 nt, Human
caccugcugauguggca

SEQ ID NO: 3431964 - RNA, 14 nt, Human
caccugcuggcccc

SEQ ID NO: 3431965 - RNA, 22 nt, Human
caccugcuggccccucaccugg

SEQ ID NO: 3431966 - RNA, 19 nt, Human
caccugcuucucugcccag

SEQ ID NO: 3431967 - RNA, 22 nt, Human
caccuggaagcauuuguuucua

SEQ ID NO: 3431968 - RNA, 21 nt, Human
caccuggccaccugagguggg

SEQ ID NO: 3431969 - RNA, 11 nt, Human
caccuggcccc

SEQ ID NO: 3431970 - RNA, 14 nt, Human
caccuggccccaug

SEQ ID NO: 3431971 - RNA, 16 nt, Human
caccuggccccauguc

SEQ ID NO: 3431972 - RNA, 20 nt, Human
caccuggccccaugucucuc

SEQ ID NO: 3431973 - RNA, 22 nt, Human
caccuggccccaugucucucag

SEQ ID NO: 3431974 - RNA, 11 nt, Human
caccuggcccu

SEQ ID NO: 3431975 - RNA, 19 nt, Human
caccuggcccucucugaag

SEQ ID NO: 3431976 - RNA, 22 nt, Human
caccuggcccugcuuccugcuu

SEQ ID NO: 3431977 - RNA, 12 nt, Human
caccuggccucu

SEQ ID NO: 3431978 - RNA, 13 nt, Human
caccuggccucug

SEQ ID NO: 3431979 - RNA, 15 nt, Human
caccuggccucugca

SEQ ID NO: 3431980 - RNA, 17 nt, Human
caccuggcucucaccuc

SEQ ID NO: 3431981 - RNA, 23 nt, Human
caccuggcucuguggcgagccau

SEQ ID NO: 3431982 - RNA, 20 nt, Human
caccuggcugagguuccucu

SEQ ID NO: 3431983 - RNA, 21 nt, Human
caccuggcugagguuccucug

SEQ ID NO: 3431984 - RNA, 23 nt, Human
caccuggcugagguuccucugcc

SEQ ID NO: 3431985 - RNA, 21 nt, Human
caccuggcuuguuuauuuugu

SEQ ID NO: 3431986 - RNA, 20 nt, Human
caccugggauuacaagcaug

SEQ ID NO: 3431987 - RNA, 11 nt, Human
caccugggcac

SEQ ID NO: 3431988 - RNA, 12 nt, Human
caccugggcacc

SEQ ID NO: 3431989 - RNA, 21 nt, Human
caccugggcccuggggccugu

SEQ ID NO: 3431990 - RNA, 22 nt, Human
caccugggcccuggggccugua

SEQ ID NO: 3431991 - RNA, 18 nt, Human
caccugggcgucaucugg

SEQ ID NO: 3431992 - RNA, 16 nt, Human
caccugggcuuaagaa

SEQ ID NO: 3431993 - RNA, 19 nt, Human
caccugggcuuaagaaauc

SEQ ID NO: 3431994 - RNA, 14 nt, Human
caccuggggagugg

SEQ ID NO: 3431995 - RNA, 15 nt, Human
caccuggggcaguca

SEQ ID NO: 3431996 - RNA, 20 nt, Human
caccuggggcagucaccugc

SEQ ID NO: 3431997 - RNA, 18 nt, Human
caccuggggugugggagg

SEQ ID NO: 3431998 - RNA, 15 nt, Human
caccugguggccucu

SEQ ID NO: 3431999 - RNA, 11 nt, Human
caccugguugc

SEQ ID NO: 3432000 - RNA, 17 nt, Human
caccuguaaaacuuuau

SEQ ID NO: 3432001 - RNA, 15 nt, Human
caccuguaaaccuga

SEQ ID NO: 3432002 - RNA, 20 nt, Human
caccuguaaugugcgaggga

SEQ ID NO: 3432003 - RNA, 22 nt, Human
caccuguacucaggaggcugag

SEQ ID NO: 3432004 - RNA, 18 nt, Human
caccuguacucuuccgaa

SEQ ID NO: 3432005 - RNA, 16 nt, Human
caccuguacuggagag

SEQ ID NO: 3432006 - RNA, 17 nt, Human
caccuguacuggagagc

SEQ ID NO: 3432007 - RNA, 20 nt, Human
caccuguagucccagcuacu

SEQ ID NO: 3432008 - RNA, 13 nt, Human
caccugucaaaca

SEQ ID NO: 3432009 - RNA, 20 nt, Human
caccugucaaacaaagccag

SEQ ID NO: 3432010 - RNA, 13 nt, Human
caccugucccacc

SEQ ID NO: 3432011 - RNA, 14 nt, Human
caccugucccaccu

SEQ ID NO: 3432012 - RNA, 15 nt, Human
caccugucccaccuc

SEQ ID NO: 3432013 - RNA, 22 nt, Human
caccuguccccacccuccacuc

SEQ ID NO: 3432014 - RNA, 23 nt, Human
caccugucugcuccagcucuggc

SEQ ID NO: 3432015 - RNA, 16 nt, Human
caccugucugucuguc

SEQ ID NO: 3432016 - RNA, 10 nt, Human
caccuguggg

SEQ ID NO: 3432017 - RNA, 19 nt, Human
caccuguugcuuacaauuu

SEQ ID NO: 3432018 - RNA, 19 nt, Human
caccuguuuuuaagcuguu

SEQ ID NO: 3432019 - RNA, 16 nt, Human
caccuuagacaguccc

SEQ ID NO: 3432020 - RNA, 21 nt, Human
caccuuagacagucccugcca

SEQ ID NO: 3432021 - RNA, 20 nt, Human
caccuuagaccaccaagccu

SEQ ID NO: 3432022 - RNA, 13 nt, Human
caccuuagcuggc

SEQ ID NO: 3432023 - RNA, 13 nt, Human
caccuuaggcagg

SEQ ID NO: 3432024 - RNA, 15 nt, Human
caccuuaguggcuuu

SEQ ID NO: 3432025 - RNA, 19 nt, Human
caccuucaccuucauccau

SEQ ID NO: 3432026 - RNA, 19 nt, Human
caccuucaguuuuuguguu

SEQ ID NO: 3432027 - RNA, 15 nt, Human
caccuucauuuugag

SEQ ID NO: 3432028 - RNA, 18 nt, Human
caccuuccagcuccugua

SEQ ID NO: 3432029 - RNA, 12 nt, Human
caccuucccagc

SEQ ID NO: 3432030 - RNA, 14 nt, Human
caccuucccaugcc

SEQ ID NO: 3432031 - RNA, 14 nt, Human
caccuucccuugcc

SEQ ID NO: 3432032 - RNA, 21 nt, Human
caccuucccuugccacuuugc

SEQ ID NO: 3432033 - RNA, 14 nt, Human
caccuuccucacuu

SEQ ID NO: 3432034 - RNA, 20 nt, Human
caccuuccucacuuccauac

SEQ ID NO: 3432035 - RNA, 21 nt, Human
caccuucguuuacuaugccug

SEQ ID NO: 3432036 - RNA, 22 nt, Human
caccuucguuuacuaugccugu

SEQ ID NO: 3432037 - RNA, 21 nt, Human
caccuucuagucuuggccagc

SEQ ID NO: 3432038 - RNA, 21 nt, Human
caccuucuauagcaucacuua

SEQ ID NO: 3432039 - RNA, 14 nt, Human
caccuucucacaug

SEQ ID NO: 3432040 - RNA, 16 nt, Human
caccuugacagggcac

SEQ ID NO: 3432041 - RNA, 22 nt, Human
caccuugcagcucuccccuucu

SEQ ID NO: 3432042 - RNA, 14 nt, Human
caccuugcggggau

SEQ ID NO: 3432043 - RNA, 18 nt, Human
caccuuggacauccuccu

SEQ ID NO: 3432044 - RNA, 22 nt, Human
caccuuggacauccuccuccca

SEQ ID NO: 3432045 - RNA, 17 nt, Human
caccuuggcaccagaca

SEQ ID NO: 3432046 - RNA, 14 nt, Human
caccuuggcucaag

SEQ ID NO: 3432047 - RNA, 15 nt, Human
caccuuggcucaagu

SEQ ID NO: 3432048 - RNA, 14 nt, Human
caccuuggcugcag

SEQ ID NO: 3432049 - RNA, 18 nt, Human
caccuuggcugcagggag

SEQ ID NO: 3432050 - RNA, 13 nt, Human
caccuugugccug

SEQ ID NO: 3432051 - RNA, 18 nt, Human
caccuugugccuggggug

SEQ ID NO: 3432052 - RNA, 23 nt, Human
caccuugugcuggggacaggucc

SEQ ID NO: 3432053 - RNA, 14 nt, Human
caccuuguggcaag

SEQ ID NO: 3432054 - RNA, 16 nt, Human
caccuggcccugcuuc

SEQ ID NO: 3432055 - RNA, 17 nt, Human
caccuggcccuggggcc

SEQ ID NO: 3432056 - RNA, 15 nt, Human
caccuggcucugugg

SEQ ID NO: 3432057 - RNA, 22 nt, Human
caccuggcugagguuccucugc

SEQ ID NO: 3432058 - RNA, 22 nt, Human
caccuggcuuguuuauuuugug

SEQ ID NO: 3432059 - RNA, 21 nt, Human
caccugggacagggagcagcc

SEQ ID NO: 3432060 - RNA, 19 nt, Human
caccugggcaccuggggag

SEQ ID NO: 3432061 - RNA, 17 nt, Human
caccugggcccuggggc

SEQ ID NO: 3432062 - RNA, 18 nt, Human
caccugggcccuggggcc

SEQ ID NO: 3432063 - RNA, 23 nt, Human
caccugggcccuggggccuguac

SEQ ID NO: 3432064 - RNA, 19 nt, Human
caccuggggcagucaccug

SEQ ID NO: 3432065 - RNA, 14 nt, Human
caccuggggcugcu

SEQ ID NO: 3432066 - RNA, 22 nt, Human
caccuggggugugggaggcccg

SEQ ID NO: 3432067 - RNA, 15 nt, Human
caccugguggccaug

SEQ ID NO: 3432068 - RNA, 17 nt, Human
caccugguggccaugcu

SEQ ID NO: 3432069 - RNA, 21 nt, Human
caccugguuccggaauccugu

SEQ ID NO: 3432070 - RNA, 23 nt, Human
caccugguuccggaauccugucc

SEQ ID NO: 3432071 - RNA, 18 nt, Human
caccuguaaucccagcac

SEQ ID NO: 3432072 - RNA, 15 nt, Human
caccuguacucagga

SEQ ID NO: 3432073 - RNA, 23 nt, Human
caccuguacucaggaggcugagg

SEQ ID NO: 3432074 - RNA, 17 nt, Human
caccuguacucuuccga

SEQ ID NO: 3432075 - RNA, 21 nt, Human
caccugucaaacaaagccaga

SEQ ID NO: 3432076 - RNA, 23 nt, Human
caccugucaaacaaagccagaag

SEQ ID NO: 3432077 - RNA, 14 nt, Human
caccugucaggccu

SEQ ID NO: 3432078 - RNA, 14 nt, Human
caccugucccagaa

SEQ ID NO: 3432079 - RNA, 15 nt, Human
caccugucccagaaa

SEQ ID NO: 3432080 - RNA, 20 nt, Human
caccuguccccacccuccac

SEQ ID NO: 3432081 - RNA, 17 nt, Human
caccugucucagccucc

SEQ ID NO: 3432082 - RNA, 19 nt, Human
caccugucucagccuccca

SEQ ID NO: 3432083 - RNA, 12 nt, Human
caccugucuguc

SEQ ID NO: 3432084 - RNA, 22 nt, Human
caccugucugucugucuguccc

SEQ ID NO: 3432085 - RNA, 19 nt, Human
caccugugaguuuaaagca

SEQ ID NO: 3432086 - RNA, 20 nt, Human
caccugugaguuuaaagcaa

SEQ ID NO: 3432087 - RNA, 20 nt, Human
caccuguggguguagccagg

SEQ ID NO: 3432088 - RNA, 22 nt, Human
caccuguggguguagccaggua

SEQ ID NO: 3432089 - RNA, 11 nt, Human
caccuguuacu

SEQ ID NO: 3432090 - RNA, 16 nt, Human
caccuuaaauuaaaca

SEQ ID NO: 3432091 - RNA, 18 nt, Human
caccuuaaauuaaacaau

SEQ ID NO: 3432092 - RNA, 17 nt, Human
caccuuaccaacuuucu

SEQ ID NO: 3432093 - RNA, 14 nt, Human
caccuuagacaguc

SEQ ID NO: 3432094 - RNA, 18 nt, Human
caccuuagacagucccug

SEQ ID NO: 3432095 - RNA, 18 nt, Human
caccuuagaccaccaagc

SEQ ID NO: 3432096 - RNA, 21 nt, Human
caccuuagaccaccaagccuu

SEQ ID NO: 3432097 - RNA, 23 nt, Human
caccuuagaccaccaagccuuga

SEQ ID NO: 3432098 - RNA, 17 nt, Human
caccuuaggcagggaag

SEQ ID NO: 3432099 - RNA, 15 nt, Human
caccuuaucuuaaag

SEQ ID NO: 3432100 - RNA, 19 nt, Human
caccuucaauuccugggcc

SEQ ID NO: 3432101 - RNA, 22 nt, Human
caccuucauuuugaggggagga

SEQ ID NO: 3432102 - RNA, 13 nt, Human
caccuucccagcu

SEQ ID NO: 3432103 - RNA, 21 nt, Human
caccuucccagcucucccucu

SEQ ID NO: 3432104 - RNA, 15 nt, Human
caccuucccuugcca

SEQ ID NO: 3432105 - RNA, 22 nt, Human
caccuugaagaaccucucacuu

SEQ ID NO: 3432106 - RNA, 16 nt, Human
caccuugcaacacaca

SEQ ID NO: 3432107 - RNA, 18 nt, Human
caccuugcaacacacaga

SEQ ID NO: 3432108 - RNA, 21 nt, Human
caccuugcaacacacagacac

SEQ ID NO: 3432109 - RNA, 15 nt, Human
caccuugcagcucuc

SEQ ID NO: 3432110 - RNA, 13 nt, Human
caccuugccuugc

SEQ ID NO: 3432111 - RNA, 23 nt, Human
caccuugcuccuccuucugcugc

SEQ ID NO: 3432112 - RNA, 19 nt, Human
caccuugcuuuuuuacuua

SEQ ID NO: 3432113 - RNA, 17 nt, Human
caccuuggacauccucc

SEQ ID NO: 3432114 - RNA, 21 nt, Human
caccuuggacauccuccuccc

SEQ ID NO: 3432115 - RNA, 13 nt, Human
caccuuggcugca

SEQ ID NO: 3432116 - RNA, 15 nt, Human
caccuuggcugcagg

SEQ ID NO: 3432117 - RNA, 14 nt, Human
caccuugguuccug

SEQ ID NO: 3432118 - RNA, 19 nt, Human
caccuuguuggagccugca

SEQ ID NO: 3432119 - RNA, 14 nt, Human
caccuuuauuaaaa

SEQ ID NO: 3432120 - RNA, 18 nt, Human
caccuuuauuaaaaucuu

SEQ ID NO: 3432121 - RNA, 17 nt, Human
caccuuucagcccacgu

SEQ ID NO: 3432122 - RNA, 14 nt, Human
caccuuugaagaag

SEQ ID NO: 3432123 - RNA, 19 nt, Human
caccuuuggaaagcucuga

SEQ ID NO: 3432124 - RNA, 13 nt, Human
caccuuuguagca

SEQ ID NO: 3432125 - RNA, 14 nt, Human
caccuuuguagcac

SEQ ID NO: 3432126 - RNA, 14 nt, Human
caccuuugucccca

SEQ ID NO: 3432127 - RNA, 14 nt, Human
caccuuuguguauu

SEQ ID NO: 3432128 - RNA, 20 nt, Human
caccuuuguuuuuuguugga

SEQ ID NO: 3432129 - RNA, 13 nt, Human
caccuuuuaaauc

SEQ ID NO: 3432130 - RNA, 15 nt, Human
caccuuuuaaauccu

SEQ ID NO: 3432131 - RNA, 18 nt, Human
caccuuuuaacucaccuc

SEQ ID NO: 3432132 - RNA, 14 nt, Human
caccuuuuacugug

SEQ ID NO: 3432133 - RNA, 14 nt, Human
caccuuuuuuccua

SEQ ID NO: 3432134 - RNA, 16 nt, Human
cacgaacccaccugcu

SEQ ID NO: 3432135 - RNA, 21 nt, Human
cacgaagguaaaaaguauuuu

SEQ ID NO: 3432136 - RNA, 15 nt, Human
cacgacacugcagcc

SEQ ID NO: 3432137 - RNA, 18 nt, Human
cacgaccggggccagcac

SEQ ID NO: 3432138 - RNA, 17 nt, Human
cacgaccuaggcaguag

SEQ ID NO: 3432139 - RNA, 19 nt, Human
cacgaccucggcucacugc

SEQ ID NO: 3432140 - RNA, 13 nt, Human
cacgacugucucc

SEQ ID NO: 3432141 - RNA, 16 nt, Human
cacgacugucuccaug

SEQ ID NO: 3432142 - RNA, 16 nt, Human
cacgagaccccggcuu

SEQ ID NO: 3432143 - RNA, 13 nt, Human
cacgagagcccgg

SEQ ID NO: 3432144 - RNA, 17 nt, Human
cacgagcaggcuacugu

SEQ ID NO: 3432145 - RNA, 20 nt, Human
cacgagcaggcuacugucag

SEQ ID NO: 3432146 - RNA, 12 nt, Human
cacgagccaccu

SEQ ID NO: 3432147 - RNA, 22 nt, Human
cacgaggaaucugugggucugg

SEQ ID NO: 3432148 - RNA, 23 nt, Human
cacgaggaaucugugggucuggg

SEQ ID NO: 3432149 - RNA, 21 nt, Human
cacgagggcuggcuggccuca

SEQ ID NO: 3432150 - RNA, 22 nt, Human
cacgagggcuggcuggccucac

SEQ ID NO: 3432151 - RNA, 15 nt, Human
cacgauccugccacc

SEQ ID NO: 3432152 - RNA, 14 nt, Human
cacgauguggcccu

SEQ ID NO: 3432153 - RNA, 21 nt, Human
cacgauguggcccuggccugc

SEQ ID NO: 3432154 - RNA, 15 nt, Human
cacgauucauuuuug

SEQ ID NO: 3432155 - RNA, 21 nt, Human
cacgauuuucuccagcucaga

SEQ ID NO: 3432156 - RNA, 22 nt, Human
cacgcacacacacacacaggag

SEQ ID NO: 3432157 - RNA, 19 nt, Human
cacgcaccucccauccuaa

SEQ ID NO: 3432158 - RNA, 23 nt, Human
cacgcacuggguugcgggacaga

SEQ ID NO: 3432159 - RNA, 21 nt, Human
cacgcagccaggacaccgggc

SEQ ID NO: 3432160 - RNA, 16 nt, Human
cacgcaggaacuccca

SEQ ID NO: 3432161 - RNA, 17 nt, Human
cacgcaggaacucccag

SEQ ID NO: 3432162 - RNA, 23 nt, Human
auguagcaaacccugucaaacau

SEQ ID NO: 3432163 - RNA, 19 nt, Human
auguagcacauaaacuuug

SEQ ID NO: 3432164 - RNA, 19 nt, Human
auguagccccucuccugga

SEQ ID NO: 3432165 - RNA, 16 nt, Human
auguagcguguuuaca

SEQ ID NO: 3432166 - RNA, 21 nt, Human
auguagcguguuuacaugugu

SEQ ID NO: 3432167 - RNA, 22 nt, Human
auguagcguguuuacaugugua

SEQ ID NO: 3432168 - RNA, 22 nt, Human
auguagcucugcaucuccuguc

SEQ ID NO: 3432169 - RNA, 22 nt, Human
auguagcucuuugucagggagu

SEQ ID NO: 3432170 - RNA, 16 nt, Human
auguaggaaaaaaaua

SEQ ID NO: 3432171 - RNA, 23 nt, Human
auguaggagcugccuuggcucag

SEQ ID NO: 3432172 - RNA, 16 nt, Human
auguagguaugaauaa

SEQ ID NO: 3432173 - RNA, 12 nt, Human
auguagguccuc

SEQ ID NO: 3432174 - RNA, 21 nt, Human
auguagguccucagaaagugu

SEQ ID NO: 3432175 - RNA, 17 nt, Human
auguaguaacacuaaua

SEQ ID NO: 3432176 - RNA, 20 nt, Human
auguaguaacacuaauauau

SEQ ID NO: 3432177 - RNA, 16 nt, Human
auguaguaauugacau

SEQ ID NO: 3432178 - RNA, 18 nt, Human
auguaguaauugacaugu

SEQ ID NO: 3432179 - RNA, 23 nt, Human
auguaguaucaaauauuagaugu

SEQ ID NO: 3432180 - RNA, 21 nt, Human
auguaguauuuuuuguauaau

SEQ ID NO: 3432181 - RNA, 22 nt, Human
auguaguauuuuuuguauaauu

SEQ ID NO: 3432182 - RNA, 17 nt, Human
auguaguucugcuccag

SEQ ID NO: 3432183 - RNA, 15 nt, Human
auguaguugauguau

SEQ ID NO: 3432184 - RNA, 14 nt, Human
auguaguuugagga

SEQ ID NO: 3432185 - RNA, 19 nt, Human
auguaguuugaggaaauuu

SEQ ID NO: 3432186 - RNA, 24 nt, Human
auguaguuugaggaaauuugcagc

SEQ ID NO: 3432187 - RNA, 14 nt, Human
auguauaaaauaca

SEQ ID NO: 3432188 - RNA, 21 nt, Human
auguauaaagcaacuguuaug

SEQ ID NO: 3432189 - RNA, 22 nt, Human
auguauaaagcaacuguuauga

SEQ ID NO: 3432190 - RNA, 12 nt, Human
auguauaaauau

SEQ ID NO: 3432191 - RNA, 16 nt, Human
auguauaaauauacag

SEQ ID NO: 3432192 - RNA, 17 nt, Human
auguauaaauauacagu

SEQ ID NO: 3432193 - RNA, 20 nt, Human
auguauaacuuuaacuucug

SEQ ID NO: 3432194 - RNA, 23 nt, Human
auguauaauauuuuuaauuaaau

SEQ ID NO: 3432195 - RNA, 21 nt, Human
auguauaauucaaagcaccaa

SEQ ID NO: 3432196 - RNA, 15 nt, Human
auguauacugccacu

SEQ ID NO: 3432197 - RNA, 14 nt, Human
cacugccugcuccc

SEQ ID NO: 3432198 - RNA, 20 nt, Human
cacugccugcucccauccug

SEQ ID NO: 3432199 - RNA, 12 nt, Human
cacugccuuuuu

SEQ ID NO: 3432200 - RNA, 22 nt, Human
cacugcgaagacccucuugccc

SEQ ID NO: 3432201 - RNA, 20 nt, Human
cacugcggggcuuggcugag

SEQ ID NO: 3432202 - RNA, 21 nt, Human
cacugcggggcuuggcugaga

SEQ ID NO: 3432203 - RNA, 18 nt, Human
cacugcuaagaauauuug

SEQ ID NO: 3432204 - RNA, 21 nt, Human
cacugcuaggcgagugccagg

SEQ ID NO: 3432205 - RNA, 22 nt, Human
cacugcucccuaagccagccug

SEQ ID NO: 3432206 - RNA, 14 nt, Human
cacugcucccugaa

SEQ ID NO: 3432207 - RNA, 18 nt, Human
cacugcucccugaagcca

SEQ ID NO: 3432208 - RNA, 17 nt, Human
cacugcuccguggagga

SEQ ID NO: 3432209 - RNA, 15 nt, Human
cacugcucuaacagc

SEQ ID NO: 3432210 - RNA, 18 nt, Human
cacugcucuaacagcccu

SEQ ID NO: 3432211 - RNA, 15 nt, Human
cacugcucucaccuu

SEQ ID NO: 3432212 - RNA, 23 nt, Human
cacugcucucaccuugguuccug

SEQ ID NO: 3432213 - RNA, 17 nt, Human
cacugcucuccagccug

SEQ ID NO: 3432214 - RNA, 19 nt, Human
cacugcugcaaggccuuuc

SEQ ID NO: 3432215 - RNA, 15 nt, Human
cacugcugcccagcc

SEQ ID NO: 3432216 - RNA, 23 nt, Human
cacugcugcuucuccauggccac

SEQ ID NO: 3432217 - RNA, 13 nt, Human
cacugcugggugg

SEQ ID NO: 3432218 - RNA, 14 nt, Human
cacugcuggguggc

SEQ ID NO: 3432219 - RNA, 17 nt, Human
cacugcuggguggccca

SEQ ID NO: 3432220 - RNA, 20 nt, Human
cacugcuggguggcccaucc

SEQ ID NO: 3432221 - RNA, 22 nt, Human
cacugcuggguggcccaucccc

SEQ ID NO: 3432222 - RNA, 11 nt, Human
cacugcuguga

SEQ ID NO: 3432223 - RNA, 22 nt, Human
cacugcuuccagugaggcucug

SEQ ID NO: 3432224 - RNA, 20 nt, Human
cacugcuugaacuaggcuga

SEQ ID NO: 3432225 - RNA, 19 nt, Human
cacugcuugaugaagcaag

SEQ ID NO: 3432226 - RNA, 12 nt, Human
cacuggaaaggg

SEQ ID NO: 3432227 - RNA, 19 nt, Human
cacuggaaaggggagagcc

SEQ ID NO: 3432228 - RNA, 22 nt, Human
cacuggaaaggggagagccugc

SEQ ID NO: 3432229 - RNA, 13 nt, Human
cacuggaacucag

SEQ ID NO: 3432230 - RNA, 15 nt, Human
cacuggaccccagca

SEQ ID NO: 3432231 - RNA, 17 nt, Human
cacuggaccccagcaag

SEQ ID NO: 3432232 - RNA, 15 nt, Human
cacuggacuccggcc

SEQ ID NO: 3432233 - RNA, 16 nt, Human
cacuggacugaccugg

SEQ ID NO: 3432234 - RNA, 12 nt, Human
cacuggagcaca

SEQ ID NO: 3432235 - RNA, 13 nt, Human
cacuggagcacaa

SEQ ID NO: 3432236 - RNA, 17 nt, Human
cacuggagcaccaggca

SEQ ID NO: 3432237 - RNA, 14 nt, Human
cacuggagcagaag

SEQ ID NO: 3432238 - RNA, 19 nt, Human
cacuggagcagaaggggag

SEQ ID NO: 3432239 - RNA, 20 nt, Human
cacuggagccaucucuuccu

SEQ ID NO: 3432240 - RNA, 12 nt, Human
cacuggagccca

SEQ ID NO: 3432241 - RNA, 15 nt, Human
cacuggagcccagga

SEQ ID NO: 3432242 - RNA, 19 nt, Human
cacuggaggagagaagaau

SEQ ID NO: 3432243 - RNA, 18 nt, Human
cacuggagugcagggagg

SEQ ID NO: 3432244 - RNA, 19 nt, Human
cacuggaguggcucgccag

SEQ ID NO: 3432245 - RNA, 22 nt, Human
cacuggaguuacauuaauguua

SEQ ID NO: 3432246 - RNA, 21 nt, Human
cacuggaugggcugcagcaga

SEQ ID NO: 3432247 - RNA, 20 nt, Human
cacuggcaaacagggccucu

SEQ ID NO: 3432248 - RNA, 22 nt, Human
cacuggcaaacagggccucugc

SEQ ID NO: 3432249 - RNA, 18 nt, Human
cacuggcaaugguaguuu

SEQ ID NO: 3432250 - RNA, 19 nt, Human
cacuggcagacuguguaaa

SEQ ID NO: 3432251 - RNA, 13 nt, Human
cacuggcagcccc

SEQ ID NO: 3432252 - RNA, 17 nt, Human
cacuggcagccccagca

SEQ ID NO: 3432253 - RNA, 12 nt, Human
cacuggccacca

SEQ ID NO: 3432254 - RNA, 14 nt, Human
cacuggccaccagg

SEQ ID NO: 3432255 - RNA, 19 nt, Human
cacuggccaccaggcuggc

SEQ ID NO: 3432256 - RNA, 20 nt, Human
cacuggccaccaggcuggcg

SEQ ID NO: 3432257 - RNA, 24 nt, Human
cacuggccaccaggcuggcgcagc

SEQ ID NO: 3432258 - RNA, 14 nt, Human
cacuggccaucccu

SEQ ID NO: 3432259 - RNA, 17 nt, Human
cacuggccaucuccacc

SEQ ID NO: 3432260 - RNA, 13 nt, Human
cacuggccccuca

SEQ ID NO: 3432261 - RNA, 17 nt, Human
cacuggccccugagauc

SEQ ID NO: 3432262 - RNA, 20 nt, Human
cacuggccggagucagugcc

SEQ ID NO: 3432263 - RNA, 21 nt, Human
cacuggccuucugaugaaaug

SEQ ID NO: 3432264 - RNA, 14 nt, Human
cacuggcucaccca

SEQ ID NO: 3432265 - RNA, 11 nt, Human
cacuggcucuc

SEQ ID NO: 3432266 - RNA, 15 nt, Human
cacuggcucuccaag

SEQ ID NO: 3432267 - RNA, 16 nt, Human
cacuggcucuccaagu

SEQ ID NO: 3432268 - RNA, 18 nt, Human
cacuggcucuccaagugc

SEQ ID NO: 3432269 - RNA, 21 nt, Human
cacuggcucuccaagugccag

SEQ ID NO: 3432270 - RNA, 14 nt, Human
cacuggcugccagc

SEQ ID NO: 3432271 - RNA, 15 nt, Human
cacuggcugccagcu

SEQ ID NO: 3432272 - RNA, 13 nt, Human
cacuggcugccuc

SEQ ID NO: 3432273 - RNA, 22 nt, Human
cacuggcugccuccacucccac

SEQ ID NO: 3432274 - RNA, 18 nt, Human
cacuggcugugggcuccc

SEQ ID NO: 3432275 - RNA, 20 nt, Human
cacuggcugugggcucccuu

SEQ ID NO: 3432276 - RNA, 18 nt, Human
cacugggaaacagaggcu

SEQ ID NO: 3432277 - RNA, 20 nt, Human
cacugggagaggugccagca

SEQ ID NO: 3432278 - RNA, 14 nt, Human
cacugggaggccag

SEQ ID NO: 3432279 - RNA, 15 nt, Human
cacugggcacaacug

SEQ ID NO: 3432280 - RNA, 15 nt, Human
cacugggcucccggg

SEQ ID NO: 3432281 - RNA, 20 nt, Human
cacugggcuuggggaccaga

SEQ ID NO: 3432282 - RNA, 17 nt, Human
cacuggggauugggccc

SEQ ID NO: 3432283 - RNA, 23 nt, Human
cacuggggauugggccccugcca

SEQ ID NO: 3432284 - RNA, 21 nt, Human
cacuggggcagacaauaaacc

SEQ ID NO: 3432285 - RNA, 13 nt, Human
cacuggggcaggg

SEQ ID NO: 3432286 - RNA, 15 nt, Human
cacuggggcaggggc

SEQ ID NO: 3432287 - RNA, 16 nt, Human
cacuggggccuacagc

SEQ ID NO: 3432288 - RNA, 18 nt, Human
cacuggggcucagagccg

SEQ ID NO: 3432289 - RNA, 19 nt, Human
cacuggggcucagagccgg

SEQ ID NO: 3432290 - RNA, 13 nt, Human
cacuggggcuggc

SEQ ID NO: 3432291 - RNA, 14 nt, Human
cacugggggagggg

SEQ ID NO: 3432292 - RNA, 18 nt, Human
cacugggguccuggggcc

SEQ ID NO: 3432293 - RNA, 20 nt, Human
cacugggguccuggggccuc

SEQ ID NO: 3432294 - RNA, 13 nt, Human
cacuggggugccg

SEQ ID NO: 3432295 - RNA, 15 nt, Human
cacuggggugccgcc

SEQ ID NO: 3432296 - RNA, 21 nt, Human
cacuggggugccgccugcccg

SEQ ID NO: 3432297 - RNA, 18 nt, Human
cacuggguggggugagga

SEQ ID NO: 3432298 - RNA, 21 nt, Human
cacuggguggggugaggacca

SEQ ID NO: 3432299 - RNA, 23 nt, Human
cacuggguggggugaggaccacu

SEQ ID NO: 3432300 - RNA, 15 nt, Human
cacugggugguggcc

SEQ ID NO: 3432301 - RNA, 17 nt, Human
cacugggugguggccug

SEQ ID NO: 3432302 - RNA, 19 nt, Human
cacugguagguugggacac

SEQ ID NO: 3432303 - RNA, 20 nt, Human
cacugguauuccugccucca

SEQ ID NO: 3432304 - RNA, 22 nt, Human
cacugguccccaacaaugugag

SEQ ID NO: 3432305 - RNA, 20 nt, Human
cacuggucuguuugcauuug

SEQ ID NO: 3432306 - RNA, 13 nt, Human
cacuggugacaug

SEQ ID NO: 3432307 - RNA, 17 nt, Human
cacuggugccaugucag

SEQ ID NO: 3432308 - RNA, 23 nt, Human
cacugguggcccgacagccuggc

SEQ ID NO: 3432309 - RNA, 14 nt, Human
cacugguuugaaga

SEQ ID NO: 3432310 - RNA, 14 nt, Human
cacugguuugguuc

SEQ ID NO: 3432311 - RNA, 15 nt, Human
cacugguuuuaaaua

SEQ ID NO: 3432312 - RNA, 13 nt, Human
cacuguaaaauga

SEQ ID NO: 3432313 - RNA, 16 nt, Human
cacuguaaaaugaaau

SEQ ID NO: 3432314 - RNA, 22 nt, Human
cacuguaagacucauucccuag

SEQ ID NO: 3432315 - RNA, 20 nt, Human
cacuguacaagguaccccuu

SEQ ID NO: 3432316 - RNA, 19 nt, Human
cacuguacuugcucuugau

SEQ ID NO: 3432317 - RNA, 17 nt, Human
cacuguagcucuaaaau

SEQ ID NO: 3432318 - RNA, 19 nt, Human
cacuguagcucuaaaaucu

SEQ ID NO: 3432319 - RNA, 20 nt, Human
cacuguaguaaauaaugcuu

SEQ ID NO: 3432320 - RNA, 22 nt, Human
cacuguaguaaauaaugcuuug

SEQ ID NO: 3432321 - RNA, 12 nt, Human
cacgcaggagca

SEQ ID NO: 3432322 - RNA, 19 nt, Human
cacgcaggagcacacccag

SEQ ID NO: 3432323 - RNA, 14 nt, Human
cacgccacugcacu

SEQ ID NO: 3432324 - RNA, 19 nt, Human
cacgccagauucuuuccug

SEQ ID NO: 3432325 - RNA, 20 nt, Human
cacgccagauucuuuccuga

SEQ ID NO: 3432326 - RNA, 14 nt, Human
cacgcccaugugug

SEQ ID NO: 3432327 - RNA, 17 nt, Human
cacgcccccacugguga

SEQ ID NO: 3432328 - RNA, 23 nt, Human
cacgcccccacuggugacauguc

SEQ ID NO: 3432329 - RNA, 21 nt, Human
cacgcccgggguggccacagc

SEQ ID NO: 3432330 - RNA, 15 nt, Human
cacgcccguccugcc

SEQ ID NO: 3432331 - RNA, 20 nt, Human
cacgcccucauuacggcucc

SEQ ID NO: 3432332 - RNA, 15 nt, Human
cacgcccuccccucc

SEQ ID NO: 3432333 - RNA, 21 nt, Human
cacgcccuccccuccccugcu

SEQ ID NO: 3432334 - RNA, 21 nt, Human
cacgccgggaaccaagcagga

SEQ ID NO: 3432335 - RNA, 15 nt, Human
cacgccuagccucac

SEQ ID NO: 3432336 - RNA, 14 nt, Human
cacgccucccacug

SEQ ID NO: 3432337 - RNA, 16 nt, Human
cacgccucccacuggg

SEQ ID NO: 3432338 - RNA, 17 nt, Human
cacgccucccacugggg

SEQ ID NO: 3432339 - RNA, 14 nt, Human
cacgccuguaaucc

SEQ ID NO: 3432340 - RNA, 17 nt, Human
cacgccuguaaucccag

SEQ ID NO: 3432341 - RNA, 23 nt, Human
cacugucccucaaaugacccaaa

SEQ ID NO: 3432342 - RNA, 15 nt, Human
cacugucccuccugg

SEQ ID NO: 3432343 - RNA, 16 nt, Human
cacugucccuccuggu

SEQ ID NO: 3432344 - RNA, 17 nt, Human
cacugucccuugccuca

SEQ ID NO: 3432345 - RNA, 16 nt, Human
cacuguccuauuauau

SEQ ID NO: 3432346 - RNA, 12 nt, Human
cacuguccugcu

SEQ ID NO: 3432347 - RNA, 20 nt, Human
cacuguccugcuccacagug

SEQ ID NO: 3432348 - RNA, 21 nt, Human
cacuguccugcuccacagugu

SEQ ID NO: 3432349 - RNA, 16 nt, Human
cacuguccugggcgcc

SEQ ID NO: 3432350 - RNA, 19 nt, Human
cacuguccugggcgcccug

SEQ ID NO: 3432351 - RNA, 23 nt, Human
cacuguccugggcgcccuggaag

SEQ ID NO: 3432352 - RNA, 11 nt, Human
cacugucugag

SEQ ID NO: 3432353 - RNA, 13 nt, Human
cacugucuuuccu

SEQ ID NO: 3432354 - RNA, 14 nt, Human
cacugugaaggacc

SEQ ID NO: 3432355 - RNA, 15 nt, Human
cacugugaaggaccc

SEQ ID NO: 3432356 - RNA, 22 nt, Human
cacugugacccccagcuccggc

SEQ ID NO: 3432357 - RNA, 17 nt, Human
cacugugagcucccagg

SEQ ID NO: 3432358 - RNA, 22 nt, Human
cacugugcaggugcuauuguua

SEQ ID NO: 3432359 - RNA, 13 nt, Human
cacugugcccugg

SEQ ID NO: 3432360 - RNA, 16 nt, Human
cacugugcccuggugg

SEQ ID NO: 3432361 - RNA, 21 nt, Human
cacugugccuuugcaaaucag

SEQ ID NO: 3432362 - RNA, 16 nt, Human
cacugugcucagggcu

SEQ ID NO: 3432363 - RNA, 13 nt, Human
cacugugcugagu

SEQ ID NO: 3432364 - RNA, 19 nt, Human
cacuguggaacuaauaaau

SEQ ID NO: 3432365 - RNA, 20 nt, Human
cacuguggaacuaauaaaua

SEQ ID NO: 3432366 - RNA, 21 nt, Human
cacuguggaacugcuauuuuc

SEQ ID NO: 3432367 - RNA, 24 nt, Human
cacuguggacuuggucaccagcuc

SEQ ID NO: 3432368 - RNA, 15 nt, Human
cacugugggugugug

SEQ ID NO: 3432369 - RNA, 16 nt, Human
cacuguggguguguga

SEQ ID NO: 3432370 - RNA, 13 nt, Human
cacuguguauauu

SEQ ID NO: 3432371 - RNA, 16 nt, Human
cacuguguauauuuga

SEQ ID NO: 3432372 - RNA, 18 nt, Human
cacuguguauauuugauu

SEQ ID NO: 3432373 - RNA, 20 nt, Human
cacuguguauauuugauuua

SEQ ID NO: 3432374 - RNA, 15 nt, Human
cacugugugcuauuu

SEQ ID NO: 3432375 - RNA, 15 nt, Human
cacuguguuccuucc

SEQ ID NO: 3432376 - RNA, 16 nt, Human
cacuguuagaacacua

SEQ ID NO: 3432377 - RNA, 23 nt, Human
cacuguuagaacacuauuuucag

SEQ ID NO: 3432378 - RNA, 19 nt, Human
cacuguuauuuucagcaug

SEQ ID NO: 3432379 - RNA, 14 nt, Human
cacuguucccucug

SEQ ID NO: 3432380 - RNA, 23 nt, Human
cacuguucuauucaucucaagga

SEQ ID NO: 3432381 - RNA, 14 nt, Human
cacuguucucugcc

SEQ ID NO: 3432382 - RNA, 19 nt, Human
cacuguucucugcccucca

SEQ ID NO: 3432383 - RNA, 19 nt, Human
cacuguucugaaagugacu

SEQ ID NO: 3432384 - RNA, 14 nt, Human
cacuguugaaaauu

SEQ ID NO: 3432385 - RNA, 16 nt, Human
cacuguugauaaaaac

SEQ ID NO: 3432386 - RNA, 14 nt, Human
cacuguugauguau

SEQ ID NO: 3432387 - RNA, 16 nt, Human
cacuguugauguaucu

SEQ ID NO: 3432388 - RNA, 18 nt, Human
cacuguugauguaucuga

SEQ ID NO: 3432389 - RNA, 15 nt, Human
cacuguugcccaggc

SEQ ID NO: 3432390 - RNA, 19 nt, Human
cacuguugcccaggcuggc

SEQ ID NO: 3432391 - RNA, 21 nt, Human
cacuguuuaaguacuguuuac

SEQ ID NO: 3432392 - RNA, 12 nt, Human
cacuguuuagau

SEQ ID NO: 3432393 - RNA, 23 nt, Human
cacuguuuagauuugccauagag

SEQ ID NO: 3432394 - RNA, 21 nt, Human
cacuguuuauacacuguguaa

SEQ ID NO: 3432395 - RNA, 18 nt, Human
cacuguuucucugcuguu

SEQ ID NO: 3432396 - RNA, 17 nt, Human
cacuguuucucuugagc

SEQ ID NO: 3432397 - RNA, 19 nt, Human
cacuguuucuugcuuguac

SEQ ID NO: 3432398 - RNA, 22 nt, Human
cacuguuuguuuacaaaaucag

SEQ ID NO: 3432399 - RNA, 21 nt, Human
cacuguuuuuagacaccuuca

SEQ ID NO: 3432400 - RNA, 13 nt, Human
cacuguuuuucca

SEQ ID NO: 3432401 - RNA, 16 nt, Human
cacuguuuuuccauag

SEQ ID NO: 3432402 - RNA, 17 nt, Human
cacuuaaaaugugcagu

SEQ ID NO: 3432403 - RNA, 17 nt, Human
cacuuaaagaaguauuu

SEQ ID NO: 3432404 - RNA, 15 nt, Human
cacuuaaauaucaau

SEQ ID NO: 3432405 - RNA, 12 nt, Human
cacuuaacaaac

SEQ ID NO: 3432406 - RNA, 23 nt, Human
cacuuaaccaagacaaaaagcca

SEQ ID NO: 3432407 - RNA, 15 nt, Human
cacuuaagagaauau

SEQ ID NO: 3432408 - RNA, 17 nt, Human
cacuuaaggcacucugu

SEQ ID NO: 3432409 - RNA, 22 nt, Human
cacuuaaguuaguuccacugag

SEQ ID NO: 3432410 - RNA, 14 nt, Human
cacuuaauguaugu

SEQ ID NO: 3432411 - RNA, 14 nt, Human
cacuuaauucuguu

SEQ ID NO: 3432412 - RNA, 21 nt, Human
cacuuacagauaggccuucuu

SEQ ID NO: 3432413 - RNA, 23 nt, Human
cacuuacagauaggccuucuugu

SEQ ID NO: 3432414 - RNA, 19 nt, Human
cacuuacauauauuuuuaa

SEQ ID NO: 3432415 - RNA, 14 nt, Human
cacuuaccuucaau

SEQ ID NO: 3432416 - RNA, 22 nt, Human
cacuuaccuucaauaaaguauc

SEQ ID NO: 3432417 - RNA, 21 nt, Human
cacuuacugguaggaccaagc

SEQ ID NO: 3432418 - RNA, 16 nt, Human
cacuuacuguuucugu

SEQ ID NO: 3432419 - RNA, 15 nt, Human
cacuuaggcuuugua

SEQ ID NO: 3432420 - RNA, 14 nt, Human
cacuuauagccucu

SEQ ID NO: 3432421 - RNA, 16 nt, Human
cacuuauagccucugu

SEQ ID NO: 3432422 - RNA, 22 nt, Human
cacuuauauguucuaauuaaua

SEQ ID NO: 3432423 - RNA, 15 nt, Human
cacuuaucccucucc

SEQ ID NO: 3432424 - RNA, 16 nt, Human
cacuuaucccucucca

SEQ ID NO: 3432425 - RNA, 16 nt, Human
cacuuaucugaucaga

SEQ ID NO: 3432426 - RNA, 21 nt, Human
cacuuaugaaugauuugcaua

SEQ ID NO: 3432427 - RNA, 23 nt, Human
cacuuauguuacugguguccagc

SEQ ID NO: 3432428 - RNA, 17 nt, Human
cacuuauucucaagaag

SEQ ID NO: 3432429 - RNA, 15 nt, Human
cacuuauugaauaua

SEQ ID NO: 3432430 - RNA, 14 nt, Human
cacuuauugcuuug

SEQ ID NO: 3432431 - RNA, 15 nt, Human
cacuuauugcuuuga

SEQ ID NO: 3432432 - RNA, 16 nt, Human
cacuuauuguaaauuu

SEQ ID NO: 3432433 - RNA, 20 nt, Human
cacuuauuuaugaaccugcc

SEQ ID NO: 3432434 - RNA, 16 nt, Human
cacuucaaacuacuuu

SEQ ID NO: 3432435 - RNA, 17 nt, Human
cacuucaaggugacaga

SEQ ID NO: 3432436 - RNA, 22 nt, Human
cacuucaaggugacagaaggac

SEQ ID NO: 3432437 - RNA, 19 nt, Human
cacuucaauaauuguccau

SEQ ID NO: 3432438 - RNA, 15 nt, Human
cacuucaaugcacau

SEQ ID NO: 3432439 - RNA, 13 nt, Human
cacuucacagagu

SEQ ID NO: 3432440 - RNA, 18 nt, Human
cacuucacuccagccugg

SEQ ID NO: 3432441 - RNA, 20 nt, Human
cacuucaggcucuucuccuu

SEQ ID NO: 3432442 - RNA, 23 nt, Human
cacuucaggcucuucuccuuuca

SEQ ID NO: 3432443 - RNA, 19 nt, Human
cacuucagggcuuuacucc

SEQ ID NO: 3432444 - RNA, 22 nt, Human
cacuucaggguucuccucuccc

SEQ ID NO: 3432445 - RNA, 20 nt, Human
cacuucagguauaccucacu

SEQ ID NO: 3432446 - RNA, 15 nt, Human
cacuucauaauccag

SEQ ID NO: 3432447 - RNA, 15 nt, Human
cacuucaucuucuca

SEQ ID NO: 3432448 - RNA, 22 nt, Human
cacuucauucuugaaagcugug

SEQ ID NO: 3432449 - RNA, 19 nt, Human
cacuuccaaaauucuuauu

SEQ ID NO: 3432450 - RNA, 14 nt, Human
cacuuccaccagcc

SEQ ID NO: 3432451 - RNA, 16 nt, Human
cacuuccaccagccug

SEQ ID NO: 3432452 - RNA, 20 nt, Human
cacuuccauaaucuggacuc

SEQ ID NO: 3432453 - RNA, 13 nt, Human
cacuuccauggga

SEQ ID NO: 3432454 - RNA, 14 nt, Human
cacuucccacccug

SEQ ID NO: 3432455 - RNA, 19 nt, Human
cacuucccucaucucuccu

SEQ ID NO: 3432456 - RNA, 15 nt, Human
cacuucccucuguuu

SEQ ID NO: 3432457 - RNA, 10 nt, Human
cacuucccug

SEQ ID NO: 3432458 - RNA, 15 nt, Human
cacuucccugacacu

SEQ ID NO: 3432459 - RNA, 20 nt, Human
cacuucccugacacugcggg

SEQ ID NO: 3432460 - RNA, 15 nt, Human
cacuucccugcugcc

SEQ ID NO: 3432461 - RNA, 17 nt, Human
cacuuccuacaagagca

SEQ ID NO: 3432462 - RNA, 14 nt, Human
cacuuccuguccag

SEQ ID NO: 3432463 - RNA, 15 nt, Human
cacuuccuuuuaacu

SEQ ID NO: 3432464 - RNA, 21 nt, Human
cacuucgggaggucgaggcag

SEQ ID NO: 3432465 - RNA, 19 nt, Human
cacuucguucgcagagcuu

SEQ ID NO: 3432466 - RNA, 17 nt, Human
cacuucuaaauagcaau

SEQ ID NO: 3432467 - RNA, 18 nt, Human
cacuucuaaaugaagugc

SEQ ID NO: 3432468 - RNA, 23 nt, Human
cacuucuaaguugaguauauuau

SEQ ID NO: 3432469 - RNA, 20 nt, Human
cacuucuaggguaugggaaa

SEQ ID NO: 3432470 - RNA, 21 nt, Human
cacuucucacaucuuaugcua

SEQ ID NO: 3432471 - RNA, 16 nt, Human
cacuucucaucacaca

SEQ ID NO: 3432472 - RNA, 20 nt, Human
cacuucucaucacacacaug

SEQ ID NO: 3432473 - RNA, 16 nt, Human
cacuucugaccacacu

SEQ ID NO: 3432474 - RNA, 23 nt, Human
cacuucuggauauagcuagguga

SEQ ID NO: 3432475 - RNA, 20 nt, Human
cacuucugggcuucaucugg

SEQ ID NO: 3432476 - RNA, 19 nt, Human
cacuucuggucaaucaaca

SEQ ID NO: 3432477 - RNA, 14 nt, Human
cacuucuguccugu

SEQ ID NO: 3432478 - RNA, 21 nt, Human
cacuucugugagacccccaca

SEQ ID NO: 3432479 - RNA, 12 nt, Human
cacuucuuccuu

SEQ ID NO: 3432480 - RNA, 15 nt, Human
cacuacaccacacac

SEQ ID NO: 3432481 - RNA, 21 nt, Human
cacuacaccacacacaacagc

SEQ ID NO: 3432482 - RNA, 14 nt, Human
cacuacacccagca

SEQ ID NO: 3432483 - RNA, 15 nt, Human
cacuacacccagcaa

SEQ ID NO: 3432484 - RNA, 17 nt, Human
cacuacacccagcaaua

SEQ ID NO: 3432485 - RNA, 18 nt, Human
cacuggaggcaugugaug

SEQ ID NO: 3432486 - RNA, 18 nt, Human
cacuggagguugaagcca

SEQ ID NO: 3432487 - RNA, 21 nt, Human
cacuggagguugaagccaagu

SEQ ID NO: 3432488 - RNA, 16 nt, Human
cacuggaguccagucu

SEQ ID NO: 3432489 - RNA, 16 nt, Human
cacuggagugcaggga

SEQ ID NO: 3432490 - RNA, 17 nt, Human
cacuggagugcagggag

SEQ ID NO: 3432491 - RNA, 20 nt, Human
cacuggagugcagggaggag

SEQ ID NO: 3432492 - RNA, 20 nt, Human
cacuggaguggcucgccagg

SEQ ID NO: 3432493 - RNA, 21 nt, Human
cacuggaguggcucgccaggc

SEQ ID NO: 3432494 - RNA, 15 nt, Human
cacuggaugcagaaa

SEQ ID NO: 3432495 - RNA, 17 nt, Human
cacuggcaaacagggcc

SEQ ID NO: 3432496 - RNA, 18 nt, Human
cacuggcaaacagggccu

SEQ ID NO: 3432497 - RNA, 21 nt, Human
cacuggcagacuguguaaaau

SEQ ID NO: 3432498 - RNA, 19 nt, Human
cacuggcagccccagcacc

SEQ ID NO: 3432499 - RNA, 16 nt, Human
cacuggcaucuuugcu

SEQ ID NO: 3432500 - RNA, 19 nt, Human
cacuggcauugucccugug

SEQ ID NO: 3432501 - RNA, 10 nt, Human
cacuggccac

SEQ ID NO: 3432502 - RNA, 15 nt, Human
cacuggccaccaggc

SEQ ID NO: 3432503 - RNA, 17 nt, Human
cacuggccaccaggcug

SEQ ID NO: 3432504 - RNA, 14 nt, Human
cacuggccccaccc

SEQ ID NO: 3432505 - RNA, 16 nt, Human
cacuggccccacccuc

SEQ ID NO: 3432506 - RNA, 23 nt, Human
cacuggccuucugaugaaauguu

SEQ ID NO: 3432507 - RNA, 15 nt, Human
cacuggcucacccag

SEQ ID NO: 3432508 - RNA, 14 nt, Human
cacuggcucuccaa

SEQ ID NO: 3432509 - RNA, 22 nt, Human
cacuggcucuccaagugccaga

SEQ ID NO: 3432510 - RNA, 17 nt, Human
cacuggcucuccuggcc

SEQ ID NO: 3432511 - RNA, 21 nt, Human
cacuggcucuccuggcccugg

SEQ ID NO: 3432512 - RNA, 15 nt, Human
cacuggcucucucca

SEQ ID NO: 3432513 - RNA, 16 nt, Human
cacuggcucucuccag

SEQ ID NO: 3432514 - RNA, 18 nt, Human
cacuggcugccagcuauu

SEQ ID NO: 3432515 - RNA, 20 nt, Human
cacuggcugccagcuauuuu

SEQ ID NO: 3432516 - RNA, 14 nt, Human
cacuggcugccucc

SEQ ID NO: 3432517 - RNA, 15 nt, Human
cacuggcugccucca

SEQ ID NO: 3432518 - RNA, 23 nt, Human
cacuggcugccuccacucccacu

SEQ ID NO: 3432519 - RNA, 22 nt, Human
cacuggcugucaguaugacauu

SEQ ID NO: 3432520 - RNA, 17 nt, Human
cacuggcugugggcucc

SEQ ID NO: 3432521 - RNA, 16 nt, Human
cacugggagaggugcc

SEQ ID NO: 3432522 - RNA, 23 nt, Human
cacugggagaggugccagcaacu

SEQ ID NO: 3432523 - RNA, 12 nt, Human
cacugggaucac

SEQ ID NO: 3432524 - RNA, 22 nt, Human
cacugggaucacaggugucagc

SEQ ID NO: 3432525 - RNA, 23 nt, Human
cacugggaugagccgcugugagc

SEQ ID NO: 3432526 - RNA, 19 nt, Human
auuaaaaacuaguaguucu

SEQ ID NO: 3432527 - RNA, 17 nt, Human
auuaaaaagauucuuuu

SEQ ID NO: 3432528 - RNA, 22 nt, Human
auuaaaaagauucuuuuucuga

SEQ ID NO: 3432529 - RNA, 13 nt, Human
auuaaaaaguuaa

SEQ ID NO: 3432530 - RNA, 13 nt, Human
auuaaaaauauaa

SEQ ID NO: 3432531 - RNA, 20 nt, Human
auuaaaaaucucaaauuucu

SEQ ID NO: 3432532 - RNA, 22 nt, Human
auuaaaaaucucaaauuucuaa

SEQ ID NO: 3432533 - RNA, 23 nt, Human
auuaaaaaucucaaauuucuaaa

SEQ ID NO: 3432534 - RNA, 17 nt, Human
auuaaaaaugguaaaau

SEQ ID NO: 3432535 - RNA, 18 nt, Human
auuaaaaaugguaaaauu

SEQ ID NO: 3432536 - RNA, 19 nt, Human
auuaaaaaugguaaaauug

SEQ ID NO: 3432537 - RNA, 20 nt, Human
auuaaaacaauauuguuucu

SEQ ID NO: 3432538 - RNA, 21 nt, Human
auuaaaacaauauuguuucua

SEQ ID NO: 3432539 - RNA, 23 nt, Human
auuaaaacacaacaucuuuuucu

SEQ ID NO: 3432540 - RNA, 13 nt, Human
auuaaaacauugg

SEQ ID NO: 3432541 - RNA, 14 nt, Human
auuaaaacauugga

SEQ ID NO: 3432542 - RNA, 11 nt, Human
auuaaaaccac

SEQ ID NO: 3432543 - RNA, 17 nt, Human
auuaaaacuaaauuuca

SEQ ID NO: 3432544 - RNA, 15 nt, Human
auuaaaacugaauug

SEQ ID NO: 3432545 - RNA, 16 nt, Human
auuaaaacugcuuuuu

SEQ ID NO: 3432546 - RNA, 22 nt, Human
auuaaaacuuaaccgcaucaga

SEQ ID NO: 3432547 - RNA, 13 nt, Human
auuaaaacuucuu

SEQ ID NO: 3432548 - RNA, 14 nt, Human
auuaaaacuucuua

SEQ ID NO: 3432549 - RNA, 22 nt, Human
auuaaaacuucuuaaauaucuu

SEQ ID NO: 3432550 - RNA, 12 nt, Human
auuaaaagacuc

SEQ ID NO: 3432551 - RNA, 13 nt, Human
auuaaaagacuca

SEQ ID NO: 3432552 - RNA, 14 nt, Human
auuaaaagacucau

SEQ ID NO: 3432553 - RNA, 22 nt, Human
auuaaaagcaaaucauuuguuu

SEQ ID NO: 3432554 - RNA, 18 nt, Human
auuaaaauauaaucucua

SEQ ID NO: 3432555 - RNA, 12 nt, Human
auuaaaauauuu

SEQ ID NO: 3432556 - RNA, 14 nt, Human
auuaaaauauuuca

SEQ ID NO: 3432557 - RNA, 21 nt, Human
auuaaaauggugacuuaaucc

SEQ ID NO: 3432558 - RNA, 11 nt, Human
auuaaaaugua

SEQ ID NO: 3432559 - RNA, 17 nt, Human
auuaaaauguaugcaug

SEQ ID NO: 3432560 - RNA, 17 nt, Human
auuaaaauucugaauuu

SEQ ID NO: 3432561 - RNA, 13 nt, Human
auuaaaauuguug

SEQ ID NO: 3432562 - RNA, 16 nt, Human
auuaaacaauuuauuu

SEQ ID NO: 3432563 - RNA, 17 nt, Human
auuaaacaauuuauuuu

SEQ ID NO: 3432564 - RNA, 19 nt, Human
auuaaacaauuuauuuuau

SEQ ID NO: 3432565 - RNA, 14 nt, Human
auuaaacagaugau

SEQ ID NO: 3432566 - RNA, 14 nt, Human
auuaaacaugacuc

SEQ ID NO: 3432567 - RNA, 14 nt, Human
auuaaaccaucucc

SEQ ID NO: 3432568 - RNA, 18 nt, Human
auuaaaccaucucccugg

SEQ ID NO: 3432569 - RNA, 16 nt, Human
auuaaaccugucucca

SEQ ID NO: 3432570 - RNA, 21 nt, Human
auuaaacgauuuuuaaaaugu

SEQ ID NO: 3432571 - RNA, 22 nt, Human
auuaaacgauuuuuaaaaugua

SEQ ID NO: 3432572 - RNA, 13 nt, Human
auuaaacggauua

SEQ ID NO: 3432573 - RNA, 21 nt, Human
auuaaacuuaaucuaaaugga

SEQ ID NO: 3432574 - RNA, 12 nt, Human
auuaaacuuaug

SEQ ID NO: 3432575 - RNA, 21 nt, Human
auuaaacuuccaaagaaaguu

SEQ ID NO: 3432576 - RNA, 18 nt, Human
auuaaagaaaaaaaugua

SEQ ID NO: 3432577 - RNA, 22 nt, Human
auuaaagaaaaaaauguauuuu

SEQ ID NO: 3432578 - RNA, 18 nt, Human
auuaaagaaaauaaaauu

SEQ ID NO: 3432579 - RNA, 15 nt, Human
auuaaagaauaugaa

SEQ ID NO: 3432580 - RNA, 23 nt, Human
auuaaagcagucacuuuuccugu

SEQ ID NO: 3432581 - RNA, 12 nt, Human
auuaaagccaug

SEQ ID NO: 3432582 - RNA, 16 nt, Human
auuaaagccauguuua

SEQ ID NO: 3432583 - RNA, 17 nt, Human
auuaaagccauguuuau

SEQ ID NO: 3432584 - RNA, 18 nt, Human
auuaaagcuaaaguaucu

SEQ ID NO: 3432585 - RNA, 18 nt, Human
auuaaaggaagcacucug

SEQ ID NO: 3432586 - RNA, 19 nt, Human
auuaaaggcauaaaugacu

SEQ ID NO: 3432587 - RNA, 13 nt, Human
auuaaagucagaa

SEQ ID NO: 3432588 - RNA, 17 nt, Human
auuaaagugcuaagguu

SEQ ID NO: 3432589 - RNA, 23 nt, Human
auuaaagugcuaagguucuaagg

SEQ ID NO: 3432590 - RNA, 20 nt, Human
auuaaaguguccauugacau

SEQ ID NO: 3432591 - RNA, 22 nt, Human
auuaaaguguccauugacaugu

SEQ ID NO: 3432592 - RNA, 12 nt, Human
auuaaaguucua

SEQ ID NO: 3432593 - RNA, 19 nt, Human
auuaaaguucuagugaccg

SEQ ID NO: 3432594 - RNA, 14 nt, Human
auuaaaguuucaaa

SEQ ID NO: 3432595 - RNA, 18 nt, Human
auuaaaguuucaaaaauc

SEQ ID NO: 3432596 - RNA, 21 nt, Human
auuaaaguuucaaaaaucuga

SEQ ID NO: 3432597 - RNA, 16 nt, Human
auuaaaguuugcuugu

SEQ ID NO: 3432598 - RNA, 19 nt, Human
auuaaauaaaaucaauuuu

SEQ ID NO: 3432599 - RNA, 15 nt, Human
auuaaauaagauucu

SEQ ID NO: 3432600 - RNA, 16 nt, Human
auuaaauacaaaacuu

SEQ ID NO: 3432601 - RNA, 19 nt, Human
auuaaauacagacacuaag

SEQ ID NO: 3432602 - RNA, 19 nt, Human
auuaaauacauauggaugu

SEQ ID NO: 3432603 - RNA, 23 nt, Human
auuaaauacauauggauguuacu

SEQ ID NO: 3432604 - RNA, 22 nt, Human
auuaaauauagauuagaaaaau

SEQ ID NO: 3432605 - RNA, 15 nt, Human
auuaaauauauguau

SEQ ID NO: 3432606 - RNA, 19 nt, Human
auuaaauauauguauguaa

SEQ ID NO: 3432607 - RNA, 20 nt, Human
auuaaauauguuagcaaaga

SEQ ID NO: 3432608 - RNA, 13 nt, Human
auuaaaugaauau

SEQ ID NO: 3432609 - RNA, 16 nt, Human
auuaaaugcccagccc

SEQ ID NO: 3432610 - RNA, 17 nt, Human
auuaaaugcccagcccc

SEQ ID NO: 3432611 - RNA, 21 nt, Human
auuaaauguagcuucagucau

SEQ ID NO: 3432612 - RNA, 14 nt, Human
auuaaaugucuuau

SEQ ID NO: 3432613 - RNA, 13 nt, Human
auuaaauuaagac

SEQ ID NO: 3432614 - RNA, 12 nt, Human
auuaaauuacau

SEQ ID NO: 3432615 - RNA, 14 nt, Human
auuaaauuacauuu

SEQ ID NO: 3432616 - RNA, 15 nt, Human
auuaaauuacauuug

SEQ ID NO: 3432617 - RNA, 12 nt, Human
auuaaauuaccu

SEQ ID NO: 3432618 - RNA, 18 nt, Human
auuaaauuaguuugugaa

SEQ ID NO: 3432619 - RNA, 14 nt, Human
auuaaauucacaaa

SEQ ID NO: 3432620 - RNA, 18 nt, Human
auuaaauucacaaacuuu

SEQ ID NO: 3432621 - RNA, 14 nt, Human
auuaaauucugagc

SEQ ID NO: 3432622 - RNA, 14 nt, Human
auuaaauucuugca

SEQ ID NO: 3432623 - RNA, 20 nt, Human
auuaaauucuugcaaaguau

SEQ ID NO: 3432624 - RNA, 15 nt, Human
auuaaauuguaaaac

SEQ ID NO: 3432625 - RNA, 18 nt, Human
auuaaauuuaauucuuca

SEQ ID NO: 3432626 - RNA, 21 nt, Human
auuaaauuuguugacaaaauu

SEQ ID NO: 3432627 - RNA, 18 nt, Human
auuaaauuuugaguucua

SEQ ID NO: 3432628 - RNA, 16 nt, Human
auuaaauuuuuccuua

SEQ ID NO: 3432629 - RNA, 18 nt, Human
auuaaauuuuuuguugac

SEQ ID NO: 3432630 - RNA, 18 nt, Human
auuacauuuauuuaucca

SEQ ID NO: 3432631 - RNA, 17 nt, Human
auuacauuuccaaauga

SEQ ID NO: 3432632 - RNA, 22 nt, Human
auuacauuuccaaaugaaugac

SEQ ID NO: 3432633 - RNA, 18 nt, Human
auuacauuuguaauuuaa

SEQ ID NO: 3432634 - RNA, 13 nt, Human
auuacauuuguau

SEQ ID NO: 3432635 - RNA, 16 nt, Human
auuacauuuguauaaa

SEQ ID NO: 3432636 - RNA, 17 nt, Human
auuacauuuguauaaaa

SEQ ID NO: 3432637 - RNA, 20 nt, Human
auuacauuuguauaaaauaa

SEQ ID NO: 3432638 - RNA, 12 nt, Human
auuaccaaaaua

SEQ ID NO: 3432639 - RNA, 16 nt, Human
auuaccaaccuguuac

SEQ ID NO: 3432640 - RNA, 19 nt, Human
auuaccacagacauacuaa

SEQ ID NO: 3432641 - RNA, 15 nt, Human
auuaccaccaucccg

SEQ ID NO: 3432642 - RNA, 19 nt, Human
auuaccacugaagauagaa

SEQ ID NO: 3432643 - RNA, 20 nt, Human
auuaccagacgguucaccag

SEQ ID NO: 3432644 - RNA, 23 nt, Human
auuaccaguaaaguguaacauau

SEQ ID NO: 3432645 - RNA, 23 nt, Human
auuaccagucuuuaaaggcccag

SEQ ID NO: 3432646 - RNA, 20 nt, Human
auuaccaugagaagagggcc

SEQ ID NO: 3432647 - RNA, 15 nt, Human
auuaccauguaaugg

SEQ ID NO: 3432648 - RNA, 20 nt, Human
auuaccgcguuguaaaauau

SEQ ID NO: 3432649 - RNA, 14 nt, Human
auuaccuaaugaaa

SEQ ID NO: 3432650 - RNA, 13 nt, Human
auuaccuccugag

SEQ ID NO: 3432651 - RNA, 22 nt, Human
auuaccuuuuaccagcuuuuaa

SEQ ID NO: 3432652 - RNA, 20 nt, Human
auuacgauaaggaagaaaca

SEQ ID NO: 3432653 - RNA, 16 nt, Human
auuacggcuccucucu

SEQ ID NO: 3432654 - RNA, 15 nt, Human
auuacguaugucugg

SEQ ID NO: 3432655 - RNA, 21 nt, Human
auuacuacaaaauuugaaauu

SEQ ID NO: 3432656 - RNA, 18 nt, Human
auuacuaugacugcuccc

SEQ ID NO: 3432657 - RNA, 19 nt, Human
auuacucaaaguaaaagcg

SEQ ID NO: 3432658 - RNA, 17 nt, Human
auuacucaguaauuugu

SEQ ID NO: 3432659 - RNA, 21 nt, Human
auuacuccuauuuuuguaaac

SEQ ID NO: 3432660 - RNA, 15 nt, Human
auuacucuuguaaga

SEQ ID NO: 3432661 - RNA, 13 nt, Human
auuacugacauuu

SEQ ID NO: 3432662 - RNA, 16 nt, Human
auuacugacauuucuu

SEQ ID NO: 3432663 - RNA, 21 nt, Human
auuacugacauuucuucuagu

SEQ ID NO: 3432664 - RNA, 17 nt, Human
auuacugcuaaguauuu

SEQ ID NO: 3432665 - RNA, 19 nt, Human
auuacugcuaaguauuucc

SEQ ID NO: 3432666 - RNA, 23 nt, Human
auuacugcuaaguauuucccagc

SEQ ID NO: 3432667 - RNA, 20 nt, Human
auuacugcuuuaaucagaaa

SEQ ID NO: 3432668 - RNA, 21 nt, Human
auuacuggcguggauuaaacu

SEQ ID NO: 3432669 - RNA, 22 nt, Human
auuacuggcguggauuaaacuu

SEQ ID NO: 3432670 - RNA, 13 nt, Human
auuacugggccuu

SEQ ID NO: 3432671 - RNA, 23 nt, Human
auuacugggccuuagugggccag

SEQ ID NO: 3432672 - RNA, 16 nt, Human
auuacuguaagaaaau

SEQ ID NO: 3432673 - RNA, 13 nt, Human
auuacugucaaua

SEQ ID NO: 3432674 - RNA, 16 nt, Human
auuacugucaauaaac

SEQ ID NO: 3432675 - RNA, 20 nt, Human
auuacuguuuauuacuucca

SEQ ID NO: 3432676 - RNA, 17 nt, Human
auuacuguuuauuucug

SEQ ID NO: 3432677 - RNA, 13 nt, Human
auuacuguuugga

SEQ ID NO: 3432678 - RNA, 20 nt, Human
auuacuguuugucuucuccc

SEQ ID NO: 3432679 - RNA, 22 nt, Human
auuacuguuugucuucucccca

SEQ ID NO: 3432680 - RNA, 23 nt, Human
auuacuguuugucuucuccccag

SEQ ID NO: 3432681 - RNA, 12 nt, Human
auuacuuaaaaa

SEQ ID NO: 3432682 - RNA, 13 nt, Human
auuacuuagagga

SEQ ID NO: 3432683 - RNA, 15 nt, Human
auuacuuaguauugc

SEQ ID NO: 3432684 - RNA, 19 nt, Human
auuacuuaucauccacauu

SEQ ID NO: 3432685 - RNA, 22 nt, Human
auuacuucacuauacaaacaaa

SEQ ID NO: 3432686 - RNA, 15 nt, Human
auuacuuccaugaau

SEQ ID NO: 3432687 - RNA, 16 nt, Human
auuacuuccaugaauu

SEQ ID NO: 3432688 - RNA, 12 nt, Human
auuacuucugcu

SEQ ID NO: 3432689 - RNA, 13 nt, Human
auuacuucugcua

SEQ ID NO: 3432690 - RNA, 22 nt, Human
cacugggcuuggggaccagagc

SEQ ID NO: 3432691 - RNA, 16 nt, Human
cacuggggaaaacucc

SEQ ID NO: 3432692 - RNA, 21 nt, Human
cacuggggaaauaacagcugu

SEQ ID NO: 3432693 - RNA, 20 nt, Human
cacuggggacuuggccucuc

SEQ ID NO: 3432694 - RNA, 21 nt, Human
cacuggggagcccgucucagu

SEQ ID NO: 3432695 - RNA, 22 nt, Human
cacuggggagcccgucucagug

SEQ ID NO: 3432696 - RNA, 15 nt, Human
cacuggggauugggc

SEQ ID NO: 3432697 - RNA, 12 nt, Human
cacuggggcuca

SEQ ID NO: 3432698 - RNA, 16 nt, Human
cacuggggcucagagc

SEQ ID NO: 3432699 - RNA, 17 nt, Human
cacuggggcucagagcc

SEQ ID NO: 3432700 - RNA, 22 nt, Human
cacuggggcucagagccggggu

SEQ ID NO: 3432701 - RNA, 16 nt, Human
cacuggggcuggcaca

SEQ ID NO: 3432702 - RNA, 19 nt, Human
cacugggguccagggagca

SEQ ID NO: 3432703 - RNA, 19 nt, Human
cacugggguccuggggccu

SEQ ID NO: 3432704 - RNA, 20 nt, Human
cacuggggugccgccugccc

SEQ ID NO: 3432705 - RNA, 15 nt, Human
cacugggugggguga

SEQ ID NO: 3432706 - RNA, 19 nt, Human
cacuggguggggugaggac

SEQ ID NO: 3432707 - RNA, 18 nt, Human
cacugggugguggccugg

SEQ ID NO: 3432708 - RNA, 21 nt, Human
cacuggguugcgggacagagu

SEQ ID NO: 3432709 - RNA, 23 nt, Human
cacuggucacggauuugugucug

SEQ ID NO: 3432710 - RNA, 14 nt, Human
cacuggucugcugu

SEQ ID NO: 3432711 - RNA, 16 nt, Human
cacuggucugcuguuc

SEQ ID NO: 3432712 - RNA, 21 nt, Human
cacugguggcccgacagccug

SEQ ID NO: 3432713 - RNA, 19 nt, Human
cacuggugugaccugaggg

SEQ ID NO: 3432714 - RNA, 20 nt, Human
cacuggugugaccugagggc

SEQ ID NO: 3432715 - RNA, 23 nt, Human
cacuggugugagggccccugccu

SEQ ID NO: 3432716 - RNA, 12 nt, Human
cacugguucuca

SEQ ID NO: 3432717 - RNA, 12 nt, Human
cacugguuuuaa

SEQ ID NO: 3432718 - RNA, 17 nt, Human
cacuguaaaaugaaauu

SEQ ID NO: 3432719 - RNA, 13 nt, Human
cacuguaaaaugu

SEQ ID NO: 3432720 - RNA, 14 nt, Human
cacuguacacauaa

SEQ ID NO: 3432721 - RNA, 17 nt, Human
cacuguaccauauagca

SEQ ID NO: 3432722 - RNA, 14 nt, Human
cacuguacuaaccu

SEQ ID NO: 3432723 - RNA, 20 nt, Human
cacuguacuugcucuugaug

SEQ ID NO: 3432724 - RNA, 21 nt, Human
cacuguagcauuacagugggu

SEQ ID NO: 3432725 - RNA, 14 nt, Human
cacuguaguucuaa

SEQ ID NO: 3432726 - RNA, 15 nt, Human
cacuguaguucuaag

SEQ ID NO: 3432727 - RNA, 16 nt, Human
cacuguaguucuaaga

SEQ ID NO: 3432728 - RNA, 15 nt, Human
cacuguauaaauagg

SEQ ID NO: 3432729 - RNA, 16 nt, Human
cacuguauaaauagga

SEQ ID NO: 3432730 - RNA, 23 nt, Human
cacuguauuacauaaauaaauua

SEQ ID NO: 3432731 - RNA, 21 nt, Human
cacugucaccacccugcucau

SEQ ID NO: 3432732 - RNA, 16 nt, Human
cacugucacccuccac

SEQ ID NO: 3432733 - RNA, 22 nt, Human
cacugucacuguuucucugcug

SEQ ID NO: 3432734 - RNA, 22 nt, Human
cacugucagcagggacuguaaa

SEQ ID NO: 3432735 - RNA, 16 nt, Human
cacugucaugcuucau

SEQ ID NO: 3432736 - RNA, 13 nt, Human
cacugucccuccu

SEQ ID NO: 3432737 - RNA, 12 nt, Human
cacugucccuug

SEQ ID NO: 3432738 - RNA, 18 nt, Human
cacugucccuugccucaa

SEQ ID NO: 3432739 - RNA, 17 nt, Human
cacuguccuccaagcca

SEQ ID NO: 3432740 - RNA, 18 nt, Human
cacuguccuccaagccag

SEQ ID NO: 3432741 - RNA, 15 nt, Human
cacuguccugggccu

SEQ ID NO: 3432742 - RNA, 21 nt, Human
cacuguccugggcgcccugga

SEQ ID NO: 3432743 - RNA, 10 nt, Human
cacugucuga

SEQ ID NO: 3432744 - RNA, 13 nt, Human
cacugucugagag

SEQ ID NO: 3432745 - RNA, 13 nt, Human
cacugucugucug

SEQ ID NO: 3432746 - RNA, 18 nt, Human
cacugucugucuggucca

SEQ ID NO: 3432747 - RNA, 21 nt, Human
cacugucuuauggauucauuu

SEQ ID NO: 3432748 - RNA, 14 nt, Human
cacugucuugaaga

SEQ ID NO: 3432749 - RNA, 19 nt, Human
cacugucuuuaauucugua

SEQ ID NO: 3432750 - RNA, 13 nt, Human
cacugugacacac

SEQ ID NO: 3432751 - RNA, 16 nt, Human
cacugugacacacuac

SEQ ID NO: 3432752 - RNA, 17 nt, Human
cacugugacacacuaca

SEQ ID NO: 3432753 - RNA, 14 nt, Human
cacugugaccccca

SEQ ID NO: 3432754 - RNA, 19 nt, Human
cacugugacccccagcucc

SEQ ID NO: 3432755 - RNA, 14 nt, Human
cacugugccaugug

SEQ ID NO: 3432756 - RNA, 15 nt, Human
cacugugccaugugc

SEQ ID NO: 3432757 - RNA, 12 nt, Human
cacugugcccug

SEQ ID NO: 3432758 - RNA, 14 nt, Human
cacugugcccuggu

SEQ ID NO: 3432759 - RNA, 13 nt, Human
cacugugccucag

SEQ ID NO: 3432760 - RNA, 21 nt, Human
cacugugccucagagaccagg

SEQ ID NO: 3432761 - RNA, 22 nt, Human
cacugugccucagagaccaggg

SEQ ID NO: 3432762 - RNA, 22 nt, Human
cacugugcgucuugguguaauu

SEQ ID NO: 3432763 - RNA, 22 nt, Human
cacugugcguggggcucccgcc

SEQ ID NO: 3432764 - RNA, 14 nt, Human
cacugugcuauaaa

SEQ ID NO: 3432765 - RNA, 13 nt, Human
cacugugcucagg

SEQ ID NO: 3432766 - RNA, 14 nt, Human
cacugugcuguugu

SEQ ID NO: 3432767 - RNA, 15 nt, Human
cacugugcuguuguu

SEQ ID NO: 3432768 - RNA, 19 nt, Human
cacugugcuguuguuauga

SEQ ID NO: 3432769 - RNA, 14 nt, Human
cacugugggaaggc

SEQ ID NO: 3432770 - RNA, 17 nt, Human
cacugugggaaggccag

SEQ ID NO: 3432771 - RNA, 21 nt, Human
cacugugggaaggccagcugc

SEQ ID NO: 3432772 - RNA, 16 nt, Human
cacugugggacucuuc

SEQ ID NO: 3432773 - RNA, 19 nt, Human
cacuguggguagacacaca

SEQ ID NO: 3432774 - RNA, 19 nt, Human
cacugugggugugugacuc

SEQ ID NO: 3432775 - RNA, 16 nt, Human
cagauauauuuuucac

SEQ ID NO: 3432776 - RNA, 20 nt, Human
cagauaucuuggacaaauca

SEQ ID NO: 3432777 - RNA, 18 nt, Human
cagauaugauauguaaac

SEQ ID NO: 3432778 - RNA, 17 nt, Human
cagauaugauucaaaug

SEQ ID NO: 3432779 - RNA, 16 nt, Human
cagauauuuauauuuu

SEQ ID NO: 3432780 - RNA, 21 nt, Human
cagauauuuauauuuuuauuu

SEQ ID NO: 3432781 - RNA, 11 nt, Human
cagauauuuuu

SEQ ID NO: 3432782 - RNA, 20 nt, Human
cagauauuuuuucagaaaua

SEQ ID NO: 3432783 - RNA, 23 nt, Human
cagaucaauggcgcagugccucu

SEQ ID NO: 3432784 - RNA, 22 nt, Human
cagaucacagcuucagccagga

SEQ ID NO: 3432785 - RNA, 14 nt, Human
cagaucacgagguc

SEQ ID NO: 3432786 - RNA, 13 nt, Human
cagaucacuacug

SEQ ID NO: 3432787 - RNA, 16 nt, Human
cagaucacuacugcag

SEQ ID NO: 3432788 - RNA, 18 nt, Human
cagaucacugaauuuaua

SEQ ID NO: 3432789 - RNA, 13 nt, Human
cagaucacugcca

SEQ ID NO: 3432790 - RNA, 23 nt, Human
cagaucauagauuucugauuuua

SEQ ID NO: 3432791 - RNA, 18 nt, Human
cagaucaucuuggaacug

SEQ ID NO: 3432792 - RNA, 16 nt, Human
cagaucauuaucagcc

SEQ ID NO: 3432793 - RNA, 12 nt, Human
cagauccagccu

SEQ ID NO: 3432794 - RNA, 14 nt, Human
cagauccaggagcu

SEQ ID NO: 3432795 - RNA, 19 nt, Human
cagauccaggagcuccagu

SEQ ID NO: 3432796 - RNA, 23 nt, Human
cagauccagggacagaggcccca

SEQ ID NO: 3432797 - RNA, 13 nt, Human
cagauccuccuca

SEQ ID NO: 3432798 - RNA, 19 nt, Human
cagauccucucuggggcug

SEQ ID NO: 3432799 - RNA, 12 nt, Human
cagauccuggaa

SEQ ID NO: 3432800 - RNA, 13 nt, Human
cagauccuggaaa

SEQ ID NO: 3432801 - RNA, 14 nt, Human
cagauccuggaaau

SEQ ID NO: 3432802 - RNA, 15 nt, Human
cagauccuuguuuca

SEQ ID NO: 3432803 - RNA, 18 nt, Human
cagauccuuguuucaaac

SEQ ID NO: 3432804 - RNA, 18 nt, Human
cagaucggaucuguugca

SEQ ID NO: 3432805 - RNA, 21 nt, Human
cagaucuagucaaucaagucu

SEQ ID NO: 3432806 - RNA, 14 nt, Human
cagaucuccaaagc

SEQ ID NO: 3432807 - RNA, 16 nt, Human
cagaucugccuaagga

SEQ ID NO: 3432808 - RNA, 21 nt, Human
cagaucugccuaaggacuucu

SEQ ID NO: 3432809 - RNA, 14 nt, Human
cagaucuggaaccu

SEQ ID NO: 3432810 - RNA, 23 nt, Human
cagaucuggaaccucagccuggc

SEQ ID NO: 3432811 - RNA, 23 nt, Human
cagaucuguauauuuuuuucuaa

SEQ ID NO: 3432812 - RNA, 14 nt, Human
cagaucugugcccc

SEQ ID NO: 3432813 - RNA, 18 nt, Human
cagaucugugccccaugc

SEQ ID NO: 3432814 - RNA, 21 nt, Human
cagaucugugccccaugccug

SEQ ID NO: 3432815 - RNA, 23 nt, Human
cagaucugugccccaugccuguc

SEQ ID NO: 3432816 - RNA, 18 nt, Human
cagaucuuggacucauga

SEQ ID NO: 3432817 - RNA, 20 nt, Human
cagaucuuggacucaugagg

SEQ ID NO: 3432818 - RNA, 15 nt, Human
cagaucuuucagaaa

SEQ ID NO: 3432819 - RNA, 17 nt, Human
cagaucuuucagaaaua

SEQ ID NO: 3432820 - RNA, 19 nt, Human
cagaugaaugauaaacucu

SEQ ID NO: 3432821 - RNA, 18 nt, Human
cagaugaccccuccccua

SEQ ID NO: 3432822 - RNA, 14 nt, Human
cagaugacuagaaa

SEQ ID NO: 3432823 - RNA, 14 nt, Human
cagaugagaacaaa

SEQ ID NO: 3432824 - RNA, 15 nt, Human
cagaugagaacaaag

SEQ ID NO: 3432825 - RNA, 18 nt, Human
cagaugagaacaaagcug

SEQ ID NO: 3432826 - RNA, 20 nt, Human
cagaugagcagaagcucucg

SEQ ID NO: 3432827 - RNA, 14 nt, Human
cagaugagucacac

SEQ ID NO: 3432828 - RNA, 23 nt, Human
cagaugaugccaaccucuggagc

SEQ ID NO: 3432829 - RNA, 16 nt, Human
cagaugauucuauguc

SEQ ID NO: 3432830 - RNA, 18 nt, Human
cagaugauuuccccccuc

SEQ ID NO: 3432831 - RNA, 23 nt, Human
cagaugcaaagaggcaagaggcu

SEQ ID NO: 3432832 - RNA, 15 nt, Human
cagaugcaaugugcu

SEQ ID NO: 3432833 - RNA, 14 nt, Human
cagaugcaccagcc

SEQ ID NO: 3432834 - RNA, 17 nt, Human
cagaugcaccagcccuu

SEQ ID NO: 3432835 - RNA, 16 nt, Human
cagaugcagcucaaga

SEQ ID NO: 3432836 - RNA, 14 nt, Human
cagaugcagcucuu

SEQ ID NO: 3432837 - RNA, 15 nt, Human
cagaugcagcucuuc

SEQ ID NO: 3432838 - RNA, 14 nt, Human
cagaugcagggcag

SEQ ID NO: 3432839 - RNA, 17 nt, Human
cagaugcagggcaguca

SEQ ID NO: 3432840 - RNA, 18 nt, Human
cagaugccacccuagcca

SEQ ID NO: 3432841 - RNA, 22 nt, Human
cagaugcccagagggcccaggc

SEQ ID NO: 3432842 - RNA, 17 nt, Human
cagaugccccuuucugg

SEQ ID NO: 3432843 - RNA, 19 nt, Human
cagaugcccgagggagggg

SEQ ID NO: 3432844 - RNA, 14 nt, Human
cagaugccuccacc

SEQ ID NO: 3432845 - RNA, 22 nt, Human
cagaugccuccaccccccagaa

SEQ ID NO: 3432846 - RNA, 12 nt, Human
cagaugccuccu

SEQ ID NO: 3432847 - RNA, 17 nt, Human
cagaugccuccuuccuc

SEQ ID NO: 3432848 - RNA, 20 nt, Human
cagaugcgucccaagauguu

SEQ ID NO: 3432849 - RNA, 21 nt, Human
cagaugcgucccaagauguug

SEQ ID NO: 3432850 - RNA, 21 nt, Human
cagaugcuaaaaucccuggau

SEQ ID NO: 3432851 - RNA, 23 nt, Human
cagaugcuagcgcguugccuguc

SEQ ID NO: 3432852 - RNA, 14 nt, Human
cagaugcucugaga

SEQ ID NO: 3432853 - RNA, 17 nt, Human
cagaugcugauguucag

SEQ ID NO: 3432854 - RNA, 18 nt, Human
cagaugcugauguucagu

SEQ ID NO: 3432855 - RNA, 20 nt, Human
cagaugcugauguucagugu

SEQ ID NO: 3432856 - RNA, 21 nt, Human
cagaugcugauguucagugua

SEQ ID NO: 3432857 - RNA, 19 nt, Human
cagauggaaaauucauuuu

SEQ ID NO: 3432858 - RNA, 19 nt, Human
cagauggaaugcuguguua

SEQ ID NO: 3432859 - RNA, 21 nt, Human
cagauggauuugccugugcca

SEQ ID NO: 3432860 - RNA, 19 nt, Human
cagauggcagcuuuuaaaa

SEQ ID NO: 3432861 - RNA, 16 nt, Human
cagauggccagccccu

SEQ ID NO: 3432862 - RNA, 13 nt, Human
cagauggcccgga

SEQ ID NO: 3432863 - RNA, 21 nt, Human
cagauggcccggaugcugcuu

SEQ ID NO: 3432864 - RNA, 22 nt, Human
cagaugggaggaaagagagcag

SEQ ID NO: 3432865 - RNA, 23 nt, Human
cagaugggaggaaagagagcagg

SEQ ID NO: 3432866 - RNA, 23 nt, Human
cagaugggcauaugugucagugg

SEQ ID NO: 3432867 - RNA, 14 nt, Human
cagauggggccucu

SEQ ID NO: 3432868 - RNA, 14 nt, Human
cagauguaauguuu

SEQ ID NO: 3432869 - RNA, 15 nt, Human
cagauguaggaggga

SEQ ID NO: 3432870 - RNA, 17 nt, Human
cagauguaggagggacu

SEQ ID NO: 3432871 - RNA, 18 nt, Human
cagauguaggagggacug

SEQ ID NO: 3432872 - RNA, 16 nt, Human
cagauguccaucagau

SEQ ID NO: 3432873 - RNA, 19 nt, Human
cagauguccaucagaugac

SEQ ID NO: 3432874 - RNA, 21 nt, Human
cagauguccaucagaugacaa

SEQ ID NO: 3432875 - RNA, 22 nt, Human
cagaugucccuugaugcacaga

SEQ ID NO: 3432876 - RNA, 19 nt, Human
cagauguccuaauggugau

SEQ ID NO: 3432877 - RNA, 22 nt, Human
cagauguccuaauggugaugca

SEQ ID NO: 3432878 - RNA, 16 nt, Human
cagaugucuucugccu

SEQ ID NO: 3432879 - RNA, 16 nt, Human
cagaugugaugcuuga

SEQ ID NO: 3432880 - RNA, 20 nt, Human
cagaugugcagcagauugga

SEQ ID NO: 3432881 - RNA, 18 nt, Human
cagaugugcuauaaucug

SEQ ID NO: 3432882 - RNA, 22 nt, Human
cagaugugcuauaaucuguuuu

SEQ ID NO: 3432883 - RNA, 17 nt, Human
cagauguggagccaggc

SEQ ID NO: 3432884 - RNA, 18 nt, Human
cagauguggagccaggcg

SEQ ID NO: 3432885 - RNA, 23 nt, Human
cagauguggcuacugacauaucu

SEQ ID NO: 3432886 - RNA, 15 nt, Human
cagauguuaaaauaa

SEQ ID NO: 3432887 - RNA, 21 nt, Human
cagauguuaaaauaaaugguu

SEQ ID NO: 3432888 - RNA, 18 nt, Human
cagauguuuccagacuuc

SEQ ID NO: 3432889 - RNA, 18 nt, Human
cagauguuuuacgucugg

SEQ ID NO: 3432890 - RNA, 12 nt, Human
cagauuaauauu

SEQ ID NO: 3432891 - RNA, 18 nt, Human
cagauuauucacugauuu

SEQ ID NO: 3432892 - RNA, 15 nt, Human
cagauucagaaauga

SEQ ID NO: 3432893 - RNA, 13 nt, Human
cagauucaggcau

SEQ ID NO: 3432894 - RNA, 16 nt, Human
cagauucagucuugcc

SEQ ID NO: 3432895 - RNA, 23 nt, Human
cagauuccaggcgaugugcaagu

SEQ ID NO: 3432896 - RNA, 19 nt, Human
cagauucccagagcaaaau

SEQ ID NO: 3432897 - RNA, 17 nt, Human
cagauuccccuguguca

SEQ ID NO: 3432898 - RNA, 12 nt, Human
cagauuccuucc

SEQ ID NO: 3432899 - RNA, 15 nt, Human
cagaauucucuaguu

SEQ ID NO: 3432900 - RNA, 18 nt, Human
cagaauucucuaguuuga

SEQ ID NO: 3432901 - RNA, 16 nt, Human
cagaauugaaacacuu

SEQ ID NO: 3432902 - RNA, 17 nt, Human
cagaauugugucugcag

SEQ ID NO: 3432903 - RNA, 18 nt, Human
cagaauuuaguguaucca

SEQ ID NO: 3432904 - RNA, 14 nt, Human
cagaauuucccaaa

SEQ ID NO: 3432905 - RNA, 17 nt, Human
cagaauuucccaaagca

SEQ ID NO: 3432906 - RNA, 18 nt, Human
cagaauuucccaaagcag

SEQ ID NO: 3432907 - RNA, 16 nt, Human
cagaauuuggaaaucc

SEQ ID NO: 3432908 - RNA, 22 nt, Human
cagaauuuguguugaaggaacu

SEQ ID NO: 3432909 - RNA, 15 nt, Human
cagaauuuuaggaac

SEQ ID NO: 3432910 - RNA, 22 nt, Human
cagaauuuuauacuuucccuac

SEQ ID NO: 3432911 - RNA, 23 nt, Human
cagaauuuuauacuuucccuacc

SEQ ID NO: 3432912 - RNA, 19 nt, Human
cagacaaaaacagccucac

SEQ ID NO: 3432913 - RNA, 21 nt, Human
cagacaaaaacagccucacag

SEQ ID NO: 3432914 - RNA, 22 nt, Human
cagacaaaaacagccucacaga

SEQ ID NO: 3432915 - RNA, 21 nt, Human
cagacaaaguaauuccucuca

SEQ ID NO: 3432916 - RNA, 13 nt, Human
cagacaacagaag

SEQ ID NO: 3432917 - RNA, 15 nt, Human
cagacaacagaaguc

SEQ ID NO: 3432918 - RNA, 22 nt, Human
cagacaacagaagucaugaagc

SEQ ID NO: 3432919 - RNA, 17 nt, Human
cagacucucagcccaga

SEQ ID NO: 3432920 - RNA, 18 nt, Human
cagacucucagcccagaa

SEQ ID NO: 3432921 - RNA, 12 nt, Human
cagacucucugu

SEQ ID NO: 3432922 - RNA, 14 nt, Human
cagacucuggucuu

SEQ ID NO: 3432923 - RNA, 18 nt, Human
cagacucuugccuguuuc

SEQ ID NO: 3432924 - RNA, 19 nt, Human
cagacucuuuaugcuugca

SEQ ID NO: 3432925 - RNA, 22 nt, Human
cagacucuuucgauacccagga

SEQ ID NO: 3432926 - RNA, 20 nt, Human
cagacugaacuuaccgugag

SEQ ID NO: 3432927 - RNA, 23 nt, Human
cagacugacaguuuacagacgcu

SEQ ID NO: 3432928 - RNA, 16 nt, Human
cagacugaucaggacc

SEQ ID NO: 3432929 - RNA, 13 nt, Human
cagacugcaccca

SEQ ID NO: 3432930 - RNA, 21 nt, Human
cagacugcagguuggacccca

SEQ ID NO: 3432931 - RNA, 18 nt, Human
cagacugcauguaguugg

SEQ ID NO: 3432932 - RNA, 19 nt, Human
cagacugcuaguguucugu

SEQ ID NO: 3432933 - RNA, 20 nt, Human
cagacugcugggacuggcca

SEQ ID NO: 3432934 - RNA, 23 nt, Human
cagacuggcacaguuuucugaga

SEQ ID NO: 3432935 - RNA, 16 nt, Human
cagacuggccugagga

SEQ ID NO: 3432936 - RNA, 16 nt, Human
cagacuggggcauccu

SEQ ID NO: 3432937 - RNA, 18 nt, Human
cagacuggggcauccugu

SEQ ID NO: 3432938 - RNA, 20 nt, Human
cagacuggugagcagacugg

SEQ ID NO: 3432939 - RNA, 23 nt, Human
cagacugguugaguucagguagc

SEQ ID NO: 3432940 - RNA, 14 nt, Human
cagacuguguauuc

SEQ ID NO: 3432941 - RNA, 18 nt, Human
cagacuguugucccugca

SEQ ID NO: 3432942 - RNA, 13 nt, Human
cagacuucuccag

SEQ ID NO: 3432943 - RNA, 15 nt, Human
cagacuucuccagac

SEQ ID NO: 3432944 - RNA, 19 nt, Human
cagacuugccaugugacuc

SEQ ID NO: 3432945 - RNA, 11 nt, Human
cagacuuguug

SEQ ID NO: 3432946 - RNA, 20 nt, Human
cagacuuugcuucccauugu

SEQ ID NO: 3432947 - RNA, 23 nt, Human
cagacuuuggaaaaugcauugua

SEQ ID NO: 3432948 - RNA, 17 nt, Human
cagagaaaccagcuucc

SEQ ID NO: 3432949 - RNA, 19 nt, Human
cagagaaaccagcuuccuu

SEQ ID NO: 3432950 - RNA, 21 nt, Human
cagagaaaccagcuuccuuca

SEQ ID NO: 3432951 - RNA, 19 nt, Human
cagagaaacuuaagcaaag

SEQ ID NO: 3432952 - RNA, 20 nt, Human
cagagaaacuuaagcaaagg

SEQ ID NO: 3432953 - RNA, 15 nt, Human
cagagaaagaagaga

SEQ ID NO: 3432954 - RNA, 18 nt, Human
cagagaaagaagagacag

SEQ ID NO: 3432955 - RNA, 19 nt, Human
cagagaaagaagagacagg

SEQ ID NO: 3432956 - RNA, 23 nt, Human
cagagaaagaagagacaggaggg

SEQ ID NO: 3432957 - RNA, 13 nt, Human
cagagaaagagga

SEQ ID NO: 3432958 - RNA, 18 nt, Human
cagagaaagaggaagcuu

SEQ ID NO: 3432959 - RNA, 15 nt, Human
cagagaaagggacaa

SEQ ID NO: 3432960 - RNA, 11 nt, Human
cagagaaccca

SEQ ID NO: 3432961 - RNA, 21 nt, Human
cagagaacuaacacuauuuua

SEQ ID NO: 3432962 - RNA, 13 nt, Human
cagagaagaaaga

SEQ ID NO: 3432963 - RNA, 14 nt, Human
cagagaagccagcu

SEQ ID NO: 3432964 - RNA, 15 nt, Human
cagagaagccagcuu

SEQ ID NO: 3432965 - RNA, 16 nt, Human
cagagaagccagcuug

SEQ ID NO: 3432966 - RNA, 12 nt, Human
cagagaagccau

SEQ ID NO: 3432967 - RNA, 13 nt, Human
cagagaagccauc

SEQ ID NO: 3432968 - RNA, 18 nt, Human
cagagaagccaucaccuc

SEQ ID NO: 3432969 - RNA, 15 nt, Human
cagagaagccuucaa

SEQ ID NO: 3432970 - RNA, 17 nt, Human
cagagaagccuucaagc

SEQ ID NO: 3432971 - RNA, 22 nt, Human
cagagaagccuucaagcucuga

SEQ ID NO: 3432972 - RNA, 19 nt, Human
cagagaagcggauuuccag

SEQ ID NO: 3432973 - RNA, 21 nt, Human
cagagaagcuauaaauuccuc

SEQ ID NO: 3432974 - RNA, 23 nt, Human
cagagaagcuauaaauuccucuu

SEQ ID NO: 3432975 - RNA, 13 nt, Human
cagagaagcuggg

SEQ ID NO: 3432976 - RNA, 20 nt, Human
cagagaaggcaggaaugugu

SEQ ID NO: 3432977 - RNA, 13 nt, Human
cagagaagugaca

SEQ ID NO: 3432978 - RNA, 14 nt, Human
cagagaagugacag

SEQ ID NO: 3432979 - RNA, 23 nt, Human
cagagaagugacagggaagcuac

SEQ ID NO: 3432980 - RNA, 24 nt, Human
cagagaagugacagggaagcuaca

SEQ ID NO: 3432981 - RNA, 22 nt, Human
cagagaauauaacaugaaauga

SEQ ID NO: 3432982 - RNA, 18 nt, Human
cagagaauaucaagauga

SEQ ID NO: 3432983 - RNA, 16 nt, Human
cagagaauaugucugc

SEQ ID NO: 3432984 - RNA, 21 nt, Human
cagagaaugaaagggcccaga

SEQ ID NO: 3432985 - RNA, 14 nt, Human
cagagaauucuuag

SEQ ID NO: 3432986 - RNA, 15 nt, Human
cagagaauuucuacc

SEQ ID NO: 3432987 - RNA, 16 nt, Human
cagagaauuucuacca

SEQ ID NO: 3432988 - RNA, 22 nt, Human
cagagacaacagguaaaacagg

SEQ ID NO: 3432989 - RNA, 20 nt, Human
cagagacaaggagggcacag

SEQ ID NO: 3432990 - RNA, 13 nt, Human
cagagacaccugc

SEQ ID NO: 3432991 - RNA, 17 nt, Human
cagagacaccugcaccu

SEQ ID NO: 3432992 - RNA, 14 nt, Human
cagagacagagagg

SEQ ID NO: 3432993 - RNA, 16 nt, Human
cagagacagauaccuc

SEQ ID NO: 3432994 - RNA, 19 nt, Human
cagagacagauaccuccaa

SEQ ID NO: 3432995 - RNA, 20 nt, Human
cagagacagauaccuccaac

SEQ ID NO: 3432996 - RNA, 13 nt, Human
cagagacaggaaa

SEQ ID NO: 3432997 - RNA, 15 nt, Human
cagagacaggaaaau

SEQ ID NO: 3432998 - RNA, 22 nt, Human
cagagacaggaagucuucaggg

SEQ ID NO: 3432999 - RNA, 14 nt, Human
cagagacaggccca

SEQ ID NO: 3433000 - RNA, 19 nt, Human
cagagacaggcccaagaga

SEQ ID NO: 3433001 - RNA, 20 nt, Human
cagagacauacuugaagggc

SEQ ID NO: 3433002 - RNA, 21 nt, Human
cagagacauacuugaagggcc

SEQ ID NO: 3433003 - RNA, 14 nt, Human
cagagacaugcaga

SEQ ID NO: 3433004 - RNA, 17 nt, Human
cagagacaugcagagau

SEQ ID NO: 3433005 - RNA, 23 nt, Human
cagagaccaagauggcccauccu

SEQ ID NO: 3433006 - RNA, 15 nt, Human
cagagaccaggcccu

SEQ ID NO: 3433007 - RNA, 16 nt, Human
cagagaccaggcccug

SEQ ID NO: 3433008 - RNA, 22 nt, Human
cagagaccaggcccuggcuaag

SEQ ID NO: 3433009 - RNA, 16 nt, Human
cagagaccaggcugug

SEQ ID NO: 3433010 - RNA, 12 nt, Human
cagagaccaggg

SEQ ID NO: 3433011 - RNA, 15 nt, Human
cagagaccagggcuc

SEQ ID NO: 3433012 - RNA, 20 nt, Human
cagagaccaucccugaaggc

SEQ ID NO: 3433013 - RNA, 21 nt, Human
cagagaccaucccugaaggcc

SEQ ID NO: 3433014 - RNA, 14 nt, Human
cagagaccauugca

SEQ ID NO: 3433015 - RNA, 19 nt, Human
cagagacccucugccacca

SEQ ID NO: 3433016 - RNA, 17 nt, Human
cagagaccguccucacc

SEQ ID NO: 3433017 - RNA, 20 nt, Human
cagagaccguccucaccccu

SEQ ID NO: 3433018 - RNA, 19 nt, Human
cagagacucagggccccag

SEQ ID NO: 3433019 - RNA, 20 nt, Human
cagagacucagggccccagc

SEQ ID NO: 3433020 - RNA, 14 nt, Human
cagagacuccugca

SEQ ID NO: 3433021 - RNA, 18 nt, Human
cagagacuccugcaggca

SEQ ID NO: 3433022 - RNA, 19 nt, Human
cagagacuccugcaggcag

SEQ ID NO: 3433023 - RNA, 20 nt, Human
cagagacuccugcaggcagc

SEQ ID NO: 3433024 - RNA, 11 nt, Human
cagagagaaac

SEQ ID NO: 3433025 - RNA, 15 nt, Human
cagagagaagagccc

SEQ ID NO: 3433026 - RNA, 18 nt, Human
cagagagaagagccccac

SEQ ID NO: 3433027 - RNA, 14 nt, Human
cagagagaagccug

SEQ ID NO: 3433028 - RNA, 18 nt, Human
cagagagacagacuugag

SEQ ID NO: 3433029 - RNA, 14 nt, Human
cagagagaccgagg

SEQ ID NO: 3433030 - RNA, 15 nt, Human
cagagagagagaaag

SEQ ID NO: 3433031 - RNA, 17 nt, Human
cagagagagagaaagag

SEQ ID NO: 3433032 - RNA, 12 nt, Human
cagagagagugu

SEQ ID NO: 3433033 - RNA, 20 nt, Human
cagagagccauuuugugaau

SEQ ID NO: 3433034 - RNA, 21 nt, Human
cagagagccauuuugugaaug

SEQ ID NO: 3433035 - RNA, 20 nt, Human
cagagagccuggugcugcug

SEQ ID NO: 3433036 - RNA, 21 nt, Human
cagagagcggucucaggcugg

SEQ ID NO: 3433037 - RNA, 22 nt, Human
cagagagcggucucaggcuggu

SEQ ID NO: 3433038 - RNA, 21 nt, Human
cagagaggaaauucuccacug

SEQ ID NO: 3433039 - RNA, 15 nt, Human
cagagaggaaucaga

SEQ ID NO: 3433040 - RNA, 17 nt, Human
cagagaggacgugggcg

SEQ ID NO: 3433041 - RNA, 21 nt, Human
cagagaggacgugggcggcag

SEQ ID NO: 3433042 - RNA, 18 nt, Human
cagagagggugacaagau

SEQ ID NO: 3433043 - RNA, 13 nt, Human
cagagaggguggg

SEQ ID NO: 3433044 - RNA, 20 nt, Human
cagagaggguggugaccucu

SEQ ID NO: 3433045 - RNA, 22 nt, Human
cagagaggguggugaccucugc

SEQ ID NO: 3433046 - RNA, 23 nt, Human
cagagaggguggugaccucugcc

SEQ ID NO: 3433047 - RNA, 19 nt, Human
cagagaggucaagcccagg

SEQ ID NO: 3433048 - RNA, 21 nt, Human
cagagaggucaagcccaggag

SEQ ID NO: 3433049 - RNA, 18 nt, Human
cagagagguuugcagucc

SEQ ID NO: 3433050 - RNA, 14 nt, Human
cagagagucccacu

SEQ ID NO: 3433051 - RNA, 20 nt, Human
cagagagucccacugccuca

SEQ ID NO: 3433052 - RNA, 22 nt, Human
cagagagucccacugccucagg

SEQ ID NO: 3433053 - RNA, 16 nt, Human
cagagaguccucugga

SEQ ID NO: 3433054 - RNA, 15 nt, Human
cagagaguccugugc

SEQ ID NO: 3433055 - RNA, 23 nt, Human
cagagagugagagacauuaacuc

SEQ ID NO: 3433056 - RNA, 18 nt, Human
cagagaguggcuccuccc

SEQ ID NO: 3433057 - RNA, 14 nt, Human
cagagaugccucca

SEQ ID NO: 3433058 - RNA, 15 nt, Human
cagagaugccuccac

SEQ ID NO: 3433059 - RNA, 21 nt, Human
cagagaugccuccaccgcugc

SEQ ID NO: 3433060 - RNA, 21 nt, Human
cagagauggagguucucucgg

SEQ ID NO: 3433061 - RNA, 18 nt, Human
cagagaugucaucagagc

SEQ ID NO: 3433062 - RNA, 18 nt, Human
cagcaccguucugugcac

SEQ ID NO: 3433063 - RNA, 15 nt, Human
cagcuacuugggagg

SEQ ID NO: 3433064 - RNA, 16 nt, Human
cagcuacuugggaggc

SEQ ID NO: 3433065 - RNA, 17 nt, Human
cagcuacuuuaacacca

SEQ ID NO: 3433066 - RNA, 17 nt, Human
cagcuauaccugugccu

SEQ ID NO: 3433067 - RNA, 19 nt, Human
cagcuaucgaacuucacaa

SEQ ID NO: 3433068 - RNA, 13 nt, Human
cagcuaugcuggu

SEQ ID NO: 3433069 - RNA, 15 nt, Human
cagcuaugggagccc

SEQ ID NO: 3433070 - RNA, 18 nt, Human
cagcuaugggagccccag

SEQ ID NO: 3433071 - RNA, 23 nt, Human
cagcuaugggagccccagggucu

SEQ ID NO: 3433072 - RNA, 18 nt, Human
cagcuauugauauaaaua

SEQ ID NO: 3433073 - RNA, 14 nt, Human
cagcuauuuuguga

SEQ ID NO: 3433074 - RNA, 16 nt, Human
cagcuauuuuuacuag

SEQ ID NO: 3433075 - RNA, 15 nt, Human
cagcucaaaggcaca

SEQ ID NO: 3433076 - RNA, 19 nt, Human
cagcucaaaggcacaguga

SEQ ID NO: 3433077 - RNA, 13 nt, Human
cagcucaagucuu

SEQ ID NO: 3433078 - RNA, 20 nt, Human
cagcucacccagccccaggg

SEQ ID NO: 3433079 - RNA, 14 nt, Human
cagcucaccccugg

SEQ ID NO: 3433080 - RNA, 13 nt, Human
cagcucacgcuuc

SEQ ID NO: 3433081 - RNA, 13 nt, Human
cagcucacugcaa

SEQ ID NO: 3433082 - RNA, 15 nt, Human
cagcucagaaccaca

SEQ ID NO: 3433083 - RNA, 13 nt, Human
cagcucagaaccc

SEQ ID NO: 3433084 - RNA, 19 nt, Human
cagcucagagaggguggga

SEQ ID NO: 3433085 - RNA, 20 nt, Human
cagcucagcacugccugcuc

SEQ ID NO: 3433086 - RNA, 13 nt, Human
cagcucagcgcca

SEQ ID NO: 3433087 - RNA, 18 nt, Human
cagcucagcgccagccug

SEQ ID NO: 3433088 - RNA, 13 nt, Human
cagcucaggaucu

SEQ ID NO: 3433089 - RNA, 14 nt, Human
cagcucaggggcag

SEQ ID NO: 3433090 - RNA, 15 nt, Human
cagcucaggggcagc

SEQ ID NO: 3433091 - RNA, 18 nt, Human
cagcucagucccaucaga

SEQ ID NO: 3433092 - RNA, 12 nt, Human
cagcucagugag

SEQ ID NO: 3433093 - RNA, 22 nt, Human
cagcucauccaugccucagaag

SEQ ID NO: 3433094 - RNA, 17 nt, Human
cagcucaugcccccuuu

SEQ ID NO: 3433095 - RNA, 16 nt, Human
cagcucauuaaacuuu

SEQ ID NO: 3433096 - RNA, 22 nt, Human
cagcucauuauaaugucauuaa

SEQ ID NO: 3433097 - RNA, 17 nt, Human
cagcuccaaccugcaaa

SEQ ID NO: 3433098 - RNA, 23 nt, Human
cagcuccaaccugcaaagaucug

SEQ ID NO: 3433099 - RNA, 18 nt, Human
cagcuccagcucaccagc

SEQ ID NO: 3433100 - RNA, 21 nt, Human
cagcuccagguggcucugagg

SEQ ID NO: 3433101 - RNA, 16 nt, Human
cagcuccaguuggagu

SEQ ID NO: 3433102 - RNA, 12 nt, Human
cagcucccacaa

SEQ ID NO: 3433103 - RNA, 19 nt, Human
cagcucccacaagccucug

SEQ ID NO: 3433104 - RNA, 23 nt, Human
cagcucccaccccacccccuuca

SEQ ID NO: 3433105 - RNA, 23 nt, Human
cagcucccauaaccgcugauucu

SEQ ID NO: 3433106 - RNA, 14 nt, Human
cagcucccauuucu

SEQ ID NO: 3433107 - RNA, 19 nt, Human
cagcucccauuucuacucu

SEQ ID NO: 3433108 - RNA, 12 nt, Human
cagcuccccaag

SEQ ID NO: 3433109 - RNA, 15 nt, Human
cagcuccccagaguc

SEQ ID NO: 3433110 - RNA, 14 nt, Human
cagcucccccuccc

SEQ ID NO: 3433111 - RNA, 15 nt, Human
cagcucccccucccu

SEQ ID NO: 3433112 - RNA, 13 nt, Human
cagcucccccugu

SEQ ID NO: 3433113 - RNA, 15 nt, Human
cagcucccccugucc

SEQ ID NO: 3433114 - RNA, 16 nt, Human
cagcuccccucggaga

SEQ ID NO: 3433115 - RNA, 17 nt, Human
cagcuccccucggagaa

SEQ ID NO: 3433116 - RNA, 20 nt, Human
cagcuccccucggagaagag

SEQ ID NO: 3433117 - RNA, 23 nt, Human
cagcucccgcuccgggcuccgac

SEQ ID NO: 3433118 - RNA, 20 nt, Human
cagcucccuaggagaccaag

SEQ ID NO: 3433119 - RNA, 16 nt, Human
auugcauucuauugcc

SEQ ID NO: 3433120 - RNA, 17 nt, Human
auugcauucuauugccu

SEQ ID NO: 3433121 - RNA, 22 nt, Human
auugcauucuauugccuucuuu

SEQ ID NO: 3433122 - RNA, 14 nt, Human
auugcauugacuuu

SEQ ID NO: 3433123 - RNA, 16 nt, Human
auugcauuugcuuuug

SEQ ID NO: 3433124 - RNA, 19 nt, Human
auugcauuuuuuaaaacaa

SEQ ID NO: 3433125 - RNA, 15 nt, Human
auugccaaaaaggau

SEQ ID NO: 3433126 - RNA, 20 nt, Human
auugccaaaaagugaaauaa

SEQ ID NO: 3433127 - RNA, 22 nt, Human
auugccaaaacccagcugcacc

SEQ ID NO: 3433128 - RNA, 22 nt, Human
auugccaagcucaggaccaggc

SEQ ID NO: 3433129 - RNA, 14 nt, Human
auugccaccaggag

SEQ ID NO: 3433130 - RNA, 12 nt, Human
auugccaccucu

SEQ ID NO: 3433131 - RNA, 16 nt, Human
auugccagugucuuuc

SEQ ID NO: 3433132 - RNA, 18 nt, Human
auugccagugucuuucuu

SEQ ID NO: 3433133 - RNA, 16 nt, Human
auugccauauugcaca

SEQ ID NO: 3433134 - RNA, 17 nt, Human
auugccauauugcacau

SEQ ID NO: 3433135 - RNA, 19 nt, Human
auugccauauugcacaugu

SEQ ID NO: 3433136 - RNA, 17 nt, Human
auugcccacgcuggagu

SEQ ID NO: 3433137 - RNA, 16 nt, Human
auugcccagucuuuca

SEQ ID NO: 3433138 - RNA, 18 nt, Human
auugcccauccaucugcu

SEQ ID NO: 3433139 - RNA, 16 nt, Human
auugcccaugauauaa

SEQ ID NO: 3433140 - RNA, 19 nt, Human
auugcccaugauauaacuu

SEQ ID NO: 3433141 - RNA, 21 nt, Human
auugccuaagaauaaacauuu

SEQ ID NO: 3433142 - RNA, 18 nt, Human
auugccuauuucaguggc

SEQ ID NO: 3433143 - RNA, 15 nt, Human
auugccucacuucag

SEQ ID NO: 3433144 - RNA, 14 nt, Human
auugccucugagag

SEQ ID NO: 3433145 - RNA, 15 nt, Human
auugccugcagagag

SEQ ID NO: 3433146 - RNA, 16 nt, Human
auugccugcagagaga

SEQ ID NO: 3433147 - RNA, 17 nt, Human
auugccugcagagagaa

SEQ ID NO: 3433148 - RNA, 20 nt, Human
auugccuucucaccagcugc

SEQ ID NO: 3433149 - RNA, 21 nt, Human
auugccuucucaccagcugca

SEQ ID NO: 3433150 - RNA, 22 nt, Human
auugccuucucaccagcugcaa

SEQ ID NO: 3433151 - RNA, 15 nt, Human
auugccuucuuugaa

SEQ ID NO: 3433152 - RNA, 19 nt, Human
auugccuucuuugaagaag

SEQ ID NO: 3433153 - RNA, 21 nt, Human
auugccuucuuugaagaaggu

SEQ ID NO: 3433154 - RNA, 16 nt, Human
auugccuuugaauguu

SEQ ID NO: 3433155 - RNA, 17 nt, Human
auugccuuuuaauuuuu

SEQ ID NO: 3433156 - RNA, 13 nt, Human
auugcgagagaug

SEQ ID NO: 3433157 - RNA, 19 nt, Human
auugcgccauugcacucca

SEQ ID NO: 3433158 - RNA, 16 nt, Human
auugcuaaauguaaca

SEQ ID NO: 3433159 - RNA, 17 nt, Human
auugcuaaauguaacag

SEQ ID NO: 3433160 - RNA, 14 nt, Human
auugcuaauguugc

SEQ ID NO: 3433161 - RNA, 15 nt, Human
auugcuaauguugcu

SEQ ID NO: 3433162 - RNA, 14 nt, Human
auugcuaauugcug

SEQ ID NO: 3433163 - RNA, 16 nt, Human
auugcuaauugcuguu

SEQ ID NO: 3433164 - RNA, 23 nt, Human
auugcuacuuccugccuggucuc

SEQ ID NO: 3433165 - RNA, 16 nt, Human
auugcuagauaaaagc

SEQ ID NO: 3433166 - RNA, 13 nt, Human
auugcuaguauuu

SEQ ID NO: 3433167 - RNA, 19 nt, Human
auugcuaguauuugaauua

SEQ ID NO: 3433168 - RNA, 23 nt, Human
auugcuaucuggaggccuuccag

SEQ ID NO: 3433169 - RNA, 15 nt, Human
auugcuauuguguua

SEQ ID NO: 3433170 - RNA, 23 nt, Human
auugcucaaguucauugaugacc

SEQ ID NO: 3433171 - RNA, 16 nt, Human
auugcugaaaauggua

SEQ ID NO: 3433172 - RNA, 22 nt, Human
auugcugagagaaauauggaac

SEQ ID NO: 3433173 - RNA, 23 nt, Human
auugcugagagaaauauggaacu

SEQ ID NO: 3433174 - RNA, 14 nt, Human
auugcugagccucu

SEQ ID NO: 3433175 - RNA, 16 nt, Human
auugcugagccucugc

SEQ ID NO: 3433176 - RNA, 15 nt, Human
auugcugauggugca

SEQ ID NO: 3433177 - RNA, 23 nt, Human
auugcugcaaggacauucuugua

SEQ ID NO: 3433178 - RNA, 20 nt, Human
auugcugccccaucagugcu

SEQ ID NO: 3433179 - RNA, 21 nt, Human
auugcugccccaucagugcuc

SEQ ID NO: 3433180 - RNA, 12 nt, Human
auugcugcuuga

SEQ ID NO: 3433181 - RNA, 17 nt, Human
auugcugcuuguacacu

SEQ ID NO: 3433182 - RNA, 22 nt, Human
auugcuguaggaucuaaggcug

SEQ ID NO: 3433183 - RNA, 17 nt, Human
auugcugucugcagccu

SEQ ID NO: 3433184 - RNA, 18 nt, Human
auugcugugcuuuaugga

SEQ ID NO: 3433185 - RNA, 19 nt, Human
auugcuguguccaacucca

SEQ ID NO: 3433186 - RNA, 17 nt, Human
auugcugugugucccag

SEQ ID NO: 3433187 - RNA, 20 nt, Human
auugcuguuaugucuguuua

SEQ ID NO: 3433188 - RNA, 17 nt, Human
auugcuguugaaagcaa

SEQ ID NO: 3433189 - RNA, 18 nt, Human
auugcuguugaaagcaaa

SEQ ID NO: 3433190 - RNA, 22 nt, Human
auugcuguugaaagcaaaaaug

SEQ ID NO: 3433191 - RNA, 15 nt, Human
auugcuguugcuuga

SEQ ID NO: 3433192 - RNA, 19 nt, Human
auugcuguuguccaacuau

SEQ ID NO: 3433193 - RNA, 16 nt, Human
auugcuuacauuuuua

SEQ ID NO: 3433194 - RNA, 16 nt, Human
auugcuuaguaaaauu

SEQ ID NO: 3433195 - RNA, 19 nt, Human
auugcuuauuauguaggua

SEQ ID NO: 3433196 - RNA, 20 nt, Human
auugcuuauuuauuguauuc

SEQ ID NO: 3433197 - RNA, 20 nt, Human
auugcuucacaacccaucua

SEQ ID NO: 3433198 - RNA, 19 nt, Human
auugcuuccuccuccccaa

SEQ ID NO: 3433199 - RNA, 13 nt, Human
auugcuucuguag

SEQ ID NO: 3433200 - RNA, 15 nt, Human
auugcuucuguagua

SEQ ID NO: 3433201 - RNA, 16 nt, Human
auugcuugaaagaaaa

SEQ ID NO: 3433202 - RNA, 14 nt, Human
auugcuugcacaaa

SEQ ID NO: 3433203 - RNA, 13 nt, Human
auugcuuuauaaa

SEQ ID NO: 3433204 - RNA, 14 nt, Human
auugcuuuccacug

SEQ ID NO: 3433205 - RNA, 18 nt, Human
auugcuuuggucauauga

SEQ ID NO: 3433206 - RNA, 21 nt, Human
auugcuuuguauuguauauua

SEQ ID NO: 3433207 - RNA, 13 nt, Human
auugcuuuuaaaa

SEQ ID NO: 3433208 - RNA, 15 nt, Human
auuguauauuacaau

SEQ ID NO: 3433209 - RNA, 18 nt, Human
auuguauauuacaaugau

SEQ ID NO: 3433210 - RNA, 21 nt, Human
auuguaucagaggccuauaau

SEQ ID NO: 3433211 - RNA, 14 nt, Human
auuguaucuagugc

SEQ ID NO: 3433212 - RNA, 16 nt, Human
auuguaucuagugcag

SEQ ID NO: 3433213 - RNA, 17 nt, Human
auuguaugaaguuugaa

SEQ ID NO: 3433214 - RNA, 15 nt, Human
auuguauguggucau

SEQ ID NO: 3433215 - RNA, 16 nt, Human
auuguauuuauucaau

SEQ ID NO: 3433216 - RNA, 14 nt, Human
auuguauuuauucc

SEQ ID NO: 3433217 - RNA, 15 nt, Human
auuguauuuuaguau

SEQ ID NO: 3433218 - RNA, 17 nt, Human
auugucaccugcuucuc

SEQ ID NO: 3433219 - RNA, 14 nt, Human
auugucagauauuu

SEQ ID NO: 3433220 - RNA, 19 nt, Human
auugucagcuacuaaugau

SEQ ID NO: 3433221 - RNA, 21 nt, Human
auugucauaucagcacauauu

SEQ ID NO: 3433222 - RNA, 15 nt, Human
auugucaucaggaga

SEQ ID NO: 3433223 - RNA, 13 nt, Human
auugucauuaaag

SEQ ID NO: 3433224 - RNA, 14 nt, Human
auugucauuaguga

SEQ ID NO: 3433225 - RNA, 15 nt, Human
auugucauuccugua

SEQ ID NO: 3433226 - RNA, 13 nt, Human
auuguccagagcu

SEQ ID NO: 3433227 - RNA, 19 nt, Human
auuguccccgacccuugcc

SEQ ID NO: 3433228 - RNA, 20 nt, Human
auuguccccgacccuugccg

SEQ ID NO: 3433229 - RNA, 18 nt, Human
auugucccuggcuuccuu

SEQ ID NO: 3433230 - RNA, 14 nt, Human
auuguccuauuagu

SEQ ID NO: 3433231 - RNA, 15 nt, Human
auuguccuuuugcaa

SEQ ID NO: 3433232 - RNA, 16 nt, Human
auuguccuuuugcaaa

SEQ ID NO: 3433233 - RNA, 17 nt, Human
auuguccuuuugcaaag

SEQ ID NO: 3433234 - RNA, 18 nt, Human
auuguccuuuugcaaaga

SEQ ID NO: 3433235 - RNA, 15 nt, Human
auugucgcuauugau

SEQ ID NO: 3433236 - RNA, 22 nt, Human
auugucguauaggcauguaaac

SEQ ID NO: 3433237 - RNA, 12 nt, Human
auugucuauuua

SEQ ID NO: 3433238 - RNA, 13 nt, Human
auugucuauuuau

SEQ ID NO: 3433239 - RNA, 19 nt, Human
auugucucccgccccccac

SEQ ID NO: 3433240 - RNA, 16 nt, Human
auugucucccuuccag

SEQ ID NO: 3433241 - RNA, 15 nt, Human
auugucuccuugagu

SEQ ID NO: 3433242 - RNA, 16 nt, Human
auugucugaacuugca

SEQ ID NO: 3433243 - RNA, 18 nt, Human
auugucugaacuugcauu

SEQ ID NO: 3433244 - RNA, 23 nt, Human
auugucuucggaaaccuuggugu

SEQ ID NO: 3433245 - RNA, 14 nt, Human
auugucuuguucug

SEQ ID NO: 3433246 - RNA, 20 nt, Human
auugucuuuauaugaacaua

SEQ ID NO: 3433247 - RNA, 18 nt, Human
auugucuuuggugcuuuu

SEQ ID NO: 3433248 - RNA, 15 nt, Human
auugugaaauuauuc

SEQ ID NO: 3433249 - RNA, 16 nt, Human
auugugaacauuugug

SEQ ID NO: 3433250 - RNA, 17 nt, Human
auugugaauaaugauuu

SEQ ID NO: 3433251 - RNA, 14 nt, Human
auugugaauugaua

SEQ ID NO: 3433252 - RNA, 23 nt, Human
auugugaucagaccauaauguua

SEQ ID NO: 3433253 - RNA, 19 nt, Human
auugugauguauauuccuu

SEQ ID NO: 3433254 - RNA, 14 nt, Human
auugugaugugucc

SEQ ID NO: 3433255 - RNA, 15 nt, Human
auugugauguguccu

SEQ ID NO: 3433256 - RNA, 16 nt, Human
auugugauuggccugu

SEQ ID NO: 3433257 - RNA, 14 nt, Human
auugugauuucccg

SEQ ID NO: 3433258 - RNA, 23 nt, Human
auugugauuucccguggccccag

SEQ ID NO: 3433259 - RNA, 19 nt, Human
auugugauuugacuguuuu

SEQ ID NO: 3433260 - RNA, 17 nt, Human
auugugcaauguguaua

SEQ ID NO: 3433261 - RNA, 20 nt, Human
auugugcaguacuuugugca

SEQ ID NO: 3433262 - RNA, 19 nt, Human
auugugccaauauguauug

SEQ ID NO: 3433263 - RNA, 23 nt, Human
auugugcgcuaaacuuuucugau

SEQ ID NO: 3433264 - RNA, 13 nt, Human
auugugcuagugc

SEQ ID NO: 3433265 - RNA, 12 nt, Human
auugugcugcca

SEQ ID NO: 3433266 - RNA, 13 nt, Human
auugugcugccau

SEQ ID NO: 3433267 - RNA, 20 nt, Human
auugugcuucacaguagagc

SEQ ID NO: 3433268 - RNA, 12 nt, Human
auugugcuucuc

SEQ ID NO: 3433269 - RNA, 19 nt, Human
auugugcuucuccccagaa

SEQ ID NO: 3433270 - RNA, 20 nt, Human
auugugcuucuccccagaau

SEQ ID NO: 3433271 - RNA, 14 nt, Human
auuguggaauguug

SEQ ID NO: 3433272 - RNA, 15 nt, Human
auuguggaauguugg

SEQ ID NO: 3433273 - RNA, 20 nt, Human
auuguggaauguuggauaag

SEQ ID NO: 3433274 - RNA, 18 nt, Human
auuguggauaacaaagau

SEQ ID NO: 3433275 - RNA, 18 nt, Human
auuguggcuauccugauu

SEQ ID NO: 3433276 - RNA, 14 nt, Human
auugugggaagggg

SEQ ID NO: 3433277 - RNA, 16 nt, Human
auugugggcauaaacu

SEQ ID NO: 3433278 - RNA, 20 nt, Human
auuguggggaugaugaaaua

SEQ ID NO: 3433279 - RNA, 22 nt, Human
auugugguaggccuuuuaacau

SEQ ID NO: 3433280 - RNA, 14 nt, Human
auuguggugccaca

SEQ ID NO: 3433281 - RNA, 23 nt, Human
auugugguuauuuuuauacagua

SEQ ID NO: 3433282 - RNA, 15 nt, Human
auuguguagccuuuu

SEQ ID NO: 3433283 - RNA, 17 nt, Human
auugugucagacuguuu

SEQ ID NO: 3433284 - RNA, 13 nt, Human
auugugucuuuug

SEQ ID NO: 3433285 - RNA, 18 nt, Human
cagcaaaaccauugcuuc

SEQ ID NO: 3433286 - RNA, 22 nt, Human
cagcaaaaugugaaugggaaaa

SEQ ID NO: 3433287 - RNA, 21 nt, Human
cagcaaacacuccacccucca

SEQ ID NO: 3433288 - RNA, 16 nt, Human
cagcaaacagaucacu

SEQ ID NO: 3433289 - RNA, 14 nt, Human
cagcaaaccaagag

SEQ ID NO: 3433290 - RNA, 24 nt, Human
cagcaaaccauuuuuaaaguagaa

SEQ ID NO: 3433291 - RNA, 16 nt, Human
cagcaaaccggggccu

SEQ ID NO: 3433292 - RNA, 20 nt, Human
cagcaaagaggacucgcuug

SEQ ID NO: 3433293 - RNA, 12 nt, Human
cagcaaagcccc

SEQ ID NO: 3433294 - RNA, 22 nt, Human
cagcaaagccccaugcuggagc

SEQ ID NO: 3433295 - RNA, 23 nt, Human
cagcaaagcccccagagcccagg

SEQ ID NO: 3433296 - RNA, 18 nt, Human
cagcaaauccuuugugaa

SEQ ID NO: 3433297 - RNA, 22 nt, Human
cagcaaaugcaaaaacucuuug

SEQ ID NO: 3433298 - RNA, 19 nt, Human
cagcaaauuaauuggcagc

SEQ ID NO: 3433299 - RNA, 14 nt, Human
cagcaaauuuauaa

SEQ ID NO: 3433300 - RNA, 16 nt, Human
cagcaaauuuauaauu

SEQ ID NO: 3433301 - RNA, 17 nt, Human
cagcaaauuuauaauuu

SEQ ID NO: 3433302 - RNA, 14 nt, Human
cagcaaauuuucag

SEQ ID NO: 3433303 - RNA, 19 nt, Human
cagcaacaauaaauagaca

SEQ ID NO: 3433304 - RNA, 23 nt, Human
cagcaacacaaagcuuuugcaua

SEQ ID NO: 3433305 - RNA, 19 nt, Human
cagcaacacagccugggcc

SEQ ID NO: 3433306 - RNA, 13 nt, Human
cagcaacagaaaa

SEQ ID NO: 3433307 - RNA, 17 nt, Human
cagcaacagaaaaaugg

SEQ ID NO: 3433308 - RNA, 12 nt, Human
cagcaaccccag

SEQ ID NO: 3433309 - RNA, 18 nt, Human
cagcaacgaucacaaaug

SEQ ID NO: 3433310 - RNA, 23 nt, Human
cagcaacgaucacaaaugacuuu

SEQ ID NO: 3433311 - RNA, 23 nt, Human
cagcaacgcaggcccccaggugc

SEQ ID NO: 3433312 - RNA, 17 nt, Human
cagcaacgcuuguagaa

SEQ ID NO: 3433313 - RNA, 20 nt, Human
cagcaacggggaggccaagu

SEQ ID NO: 3433314 - RNA, 15 nt, Human
cagcaacugaauaaa

SEQ ID NO: 3433315 - RNA, 22 nt, Human
cagcaacuuguccuagcacaga

SEQ ID NO: 3433316 - RNA, 18 nt, Human
cagcaacuugucuuuuuc

SEQ ID NO: 3433317 - RNA, 19 nt, Human
cagcaacuugucuuuuucu

SEQ ID NO: 3433318 - RNA, 14 nt, Human
cagcaagaaaaaaa

SEQ ID NO: 3433319 - RNA, 19 nt, Human
cagcaagaaaaaaaaaugc

SEQ ID NO: 3433320 - RNA, 15 nt, Human
cagcaagaauauugu

SEQ ID NO: 3433321 - RNA, 19 nt, Human
cagcaagcccuacagagcu

SEQ ID NO: 3433322 - RNA, 18 nt, Human
cagcaaggagauuuacaa

SEQ ID NO: 3433323 - RNA, 15 nt, Human
cagcaaggcaccugc

SEQ ID NO: 3433324 - RNA, 17 nt, Human
cagcaaggccaccucuu

SEQ ID NO: 3433325 - RNA, 21 nt, Human
cagcaaggccaccucuuccug

SEQ ID NO: 3433326 - RNA, 23 nt, Human
cagcaaggccaccucuuccuggc

SEQ ID NO: 3433327 - RNA, 20 nt, Human
cagcaaggggcucugcccuc

SEQ ID NO: 3433328 - RNA, 23 nt, Human
cagcaagggugaugggaaagcau

SEQ ID NO: 3433329 - RNA, 16 nt, Human
cagcaaggucuugcuc

SEQ ID NO: 3433330 - RNA, 15 nt, Human
cagcaagucaggguu

SEQ ID NO: 3433331 - RNA, 14 nt, Human
cagcaagucucuuu

SEQ ID NO: 3433332 - RNA, 12 nt, Human
cagcaagugaga

SEQ ID NO: 3433333 - RNA, 17 nt, Human
cagcaagugagagcugg

SEQ ID NO: 3433334 - RNA, 19 nt, Human
cagcaagugagagcugggu

SEQ ID NO: 3433335 - RNA, 22 nt, Human
cagcaagugguccuagaggccc

SEQ ID NO: 3433336 - RNA, 15 nt, Human
cagcaagugugaaua

SEQ ID NO: 3433337 - RNA, 13 nt, Human
cagcaauaaagca

SEQ ID NO: 3433338 - RNA, 20 nt, Human
cagcaauauauuaccagcaa

SEQ ID NO: 3433339 - RNA, 23 nt, Human
cagcaauauauuaccagcaagaa

SEQ ID NO: 3433340 - RNA, 15 nt, Human
cagcaauauguaaau

SEQ ID NO: 3433341 - RNA, 19 nt, Human
cagcaaugacaucucaggg

SEQ ID NO: 3433342 - RNA, 22 nt, Human
cagcaaugauguccagaagaau

SEQ ID NO: 3433343 - RNA, 22 nt, Human
cagcaauuacaacggagucaaa

SEQ ID NO: 3433344 - RNA, 19 nt, Human
cagcaauuaugaaaauaau

SEQ ID NO: 3433345 - RNA, 14 nt, Human
cagcaauuuaaaug

SEQ ID NO: 3433346 - RNA, 15 nt, Human
cagcaauuuaaaugu

SEQ ID NO: 3433347 - RNA, 16 nt, Human
cagcacaaacacaagg

SEQ ID NO: 3433348 - RNA, 20 nt, Human
cagcacaaauuaguuauaua

SEQ ID NO: 3433349 - RNA, 19 nt, Human
cagcacacagggcagugag

SEQ ID NO: 3433350 - RNA, 13 nt, Human
cagcacacucagc

SEQ ID NO: 3433351 - RNA, 13 nt, Human
cagcacagagagg

SEQ ID NO: 3433352 - RNA, 19 nt, Human
cagcacagauaaaaagugg

SEQ ID NO: 3433353 - RNA, 19 nt, Human
caggcaccuuaguggcuuu

SEQ ID NO: 3433354 - RNA, 16 nt, Human
caggcacgaacccacc

SEQ ID NO: 3433355 - RNA, 17 nt, Human
caggcacgaacccaccu

SEQ ID NO: 3433356 - RNA, 19 nt, Human
caggcacgaacccaccugc

SEQ ID NO: 3433357 - RNA, 14 nt, Human
caggcacgguuugg

SEQ ID NO: 3433358 - RNA, 23 nt, Human
caggcacuagccuuuggcucugg

SEQ ID NO: 3433359 - RNA, 21 nt, Human
caggcacugcaaaccgccacc

SEQ ID NO: 3433360 - RNA, 22 nt, Human
caggcacugcccugguggcccu

SEQ ID NO: 3433361 - RNA, 18 nt, Human
caggcacugggcaugagg

SEQ ID NO: 3433362 - RNA, 21 nt, Human
caggcacuuaagcacaagcag

SEQ ID NO: 3433363 - RNA, 12 nt, Human
caggcacuuggc

SEQ ID NO: 3433364 - RNA, 16 nt, Human
caggcacuuggcagcc

SEQ ID NO: 3433365 - RNA, 12 nt, Human
caggcagaaaga

SEQ ID NO: 3433366 - RNA, 16 nt, Human
caggcagacacggauc

SEQ ID NO: 3433367 - RNA, 14 nt, Human
caggcagaggccca

SEQ ID NO: 3433368 - RNA, 17 nt, Human
caggcagaggcccaggc

SEQ ID NO: 3433369 - RNA, 18 nt, Human
caggcagaggcccaggcu

SEQ ID NO: 3433370 - RNA, 20 nt, Human
caggcagaggcccaggcugc

SEQ ID NO: 3433371 - RNA, 18 nt, Human
caggcagauacaggaaaa

SEQ ID NO: 3433372 - RNA, 14 nt, Human
caggcagauccagg

SEQ ID NO: 3433373 - RNA, 17 nt, Human
caggcagauccaggacu

SEQ ID NO: 3433374 - RNA, 19 nt, Human
caggcagaucugugcccca

SEQ ID NO: 3433375 - RNA, 22 nt, Human
caggcagaucugugccccaugc

SEQ ID NO: 3433376 - RNA, 14 nt, Human
caggcagcagagac

SEQ ID NO: 3433377 - RNA, 13 nt, Human
caggcagcauuua

SEQ ID NO: 3433378 - RNA, 16 nt, Human
caggcagccagcaucu

SEQ ID NO: 3433379 - RNA, 14 nt, Human
caggcagccaggcc

SEQ ID NO: 3433380 - RNA, 15 nt, Human
caggcagccagugcc

SEQ ID NO: 3433381 - RNA, 16 nt, Human
caggcagccucugggg

SEQ ID NO: 3433382 - RNA, 16 nt, Human
caggcagccucuguca

SEQ ID NO: 3433383 - RNA, 21 nt, Human
caggcagccucugucaggccu

SEQ ID NO: 3433384 - RNA, 22 nt, Human
caggcagccucugucaggccuu

SEQ ID NO: 3433385 - RNA, 13 nt, Human
caggcagccugga

SEQ ID NO: 3433386 - RNA, 12 nt, Human
caggcagcgaug

SEQ ID NO: 3433387 - RNA, 21 nt, Human
caggcagcgauggucucagaa

SEQ ID NO: 3433388 - RNA, 15 nt, Human
caggcagcgccaagc

SEQ ID NO: 3433389 - RNA, 22 nt, Human
caggcagcucauaagagccaca

SEQ ID NO: 3433390 - RNA, 23 nt, Human
caggcagcucauaagagccacag

SEQ ID NO: 3433391 - RNA, 22 nt, Human
caggcagcuuuuucucucccac

SEQ ID NO: 3433392 - RNA, 14 nt, Human
caggcaggagcccu

SEQ ID NO: 3433393 - RNA, 12 nt, Human
caggcaggcugu

SEQ ID NO: 3433394 - RNA, 13 nt, Human
caggcaggcugug

SEQ ID NO: 3433395 - RNA, 19 nt, Human
caggcaggcugugcgcuga

SEQ ID NO: 3433396 - RNA, 12 nt, Human
caggcagggaga

SEQ ID NO: 3433397 - RNA, 16 nt, Human
caggcagggcaggacc

SEQ ID NO: 3433398 - RNA, 22 nt, Human
caggcagggcaggaccagccca

SEQ ID NO: 3433399 - RNA, 14 nt, Human
caggcagggcucuc

SEQ ID NO: 3433400 - RNA, 16 nt, Human
caggcagggcucuccu

SEQ ID NO: 3433401 - RNA, 17 nt, Human
caggcagggcugacucu

SEQ ID NO: 3433402 - RNA, 23 nt, Human
caggcagggcugacucuaggugc

SEQ ID NO: 3433403 - RNA, 18 nt, Human
caggcaggggcccugcag

SEQ ID NO: 3433404 - RNA, 20 nt, Human
caggcaggggcccugcagcu

SEQ ID NO: 3433405 - RNA, 13 nt, Human
caggcaggggccu

SEQ ID NO: 3433406 - RNA, 21 nt, Human
caggcaggggccuccaugggc

SEQ ID NO: 3433407 - RNA, 14 nt, Human
caggcagguccagg

SEQ ID NO: 3433408 - RNA, 15 nt, Human
caggcagguccaggg

SEQ ID NO: 3433409 - RNA, 13 nt, Human
caggcaggucuug

SEQ ID NO: 3433410 - RNA, 23 nt, Human
caggcaggucuugaacuccuggc

SEQ ID NO: 3433411 - RNA, 16 nt, Human
caggcaggugccugga

SEQ ID NO: 3433412 - RNA, 18 nt, Human
caggcagucgggggcugg

SEQ ID NO: 3433413 - RNA, 19 nt, Human
caggcagucgggggcuggc

SEQ ID NO: 3433414 - RNA, 20 nt, Human
caggcagucgggggcuggcc

SEQ ID NO: 3433415 - RNA, 17 nt, Human
caggcaguuggccagag

SEQ ID NO: 3433416 - RNA, 17 nt, Human
caggcauagaggcuucu

SEQ ID NO: 3433417 - RNA, 14 nt, Human
caggcauaggccug

SEQ ID NO: 3433418 - RNA, 16 nt, Human
caggcauaggccuggg

SEQ ID NO: 3433419 - RNA, 19 nt, Human
caggcauaggccugggugc

SEQ ID NO: 3433420 - RNA, 15 nt, Human
caggcaucacagcua

SEQ ID NO: 3433421 - RNA, 15 nt, Human
caggcaucugauuug

SEQ ID NO: 3433422 - RNA, 20 nt, Human
caggcaugaacauguacugu

SEQ ID NO: 3433423 - RNA, 14 nt, Human
caggcaugccugug

SEQ ID NO: 3433424 - RNA, 15 nt, Human
caggcauggcccugg

SEQ ID NO: 3433425 - RNA, 15 nt, Human
caggcaugggccacc

SEQ ID NO: 3433426 - RNA, 17 nt, Human
caggcaugguggcccac

SEQ ID NO: 3433427 - RNA, 18 nt, Human
caggcauguucucugagg

SEQ ID NO: 3433428 - RNA, 15 nt, Human
caggcauuccccagg

SEQ ID NO: 3433429 - RNA, 20 nt, Human
caggcauuccccaggaggcc

SEQ ID NO: 3433430 - RNA, 24 nt, Human
caggcauuccccaggaggccagcc

SEQ ID NO: 3433431 - RNA, 14 nt, Human
caggcauugaggaa

SEQ ID NO: 3433432 - RNA, 19 nt, Human
caggcauugccaagggcuu

SEQ ID NO: 3433433 - RNA, 15 nt, Human
caggcauuggauauu

SEQ ID NO: 3433434 - RNA, 16 nt, Human
caggcauuuagcccuc

SEQ ID NO: 3433435 - RNA, 18 nt, Human
caggcauuuccugggugg

SEQ ID NO: 3433436 - RNA, 23 nt, Human
caggcauuugacugaagaugcag

SEQ ID NO: 3433437 - RNA, 13 nt, Human
caggcauuuguuc

SEQ ID NO: 3433438 - RNA, 19 nt, Human
caggccaagagcagaggca

SEQ ID NO: 3433439 - RNA, 13 nt, Human
caggccacaagac

SEQ ID NO: 3433440 - RNA, 18 nt, Human
caggccacaagacccuug

SEQ ID NO: 3433441 - RNA, 20 nt, Human
caggccacaagacccuugug

SEQ ID NO: 3433442 - RNA, 18 nt, Human
caggccacacuucaaacu

SEQ ID NO: 3433443 - RNA, 12 nt, Human
caggccaccucc

SEQ ID NO: 3433444 - RNA, 15 nt, Human
caggccaccucccca

SEQ ID NO: 3433445 - RNA, 16 nt, Human
caggccaccuccccag

SEQ ID NO: 3433446 - RNA, 21 nt, Human
caggccaccugcccccuucuc

SEQ ID NO: 3433447 - RNA, 23 nt, Human
caggccaccugcccccuucuccc

SEQ ID NO: 3433448 - RNA, 17 nt, Human
caggccaccuggcucuc

SEQ ID NO: 3433449 - RNA, 13 nt, Human
caggccagaggga

SEQ ID NO: 3433450 - RNA, 13 nt, Human
caggccagccucc

SEQ ID NO: 3433451 - RNA, 15 nt, Human
caggccagcugccuc

SEQ ID NO: 3433452 - RNA, 13 nt, Human
caggccagcugcu

SEQ ID NO: 3433453 - RNA, 21 nt, Human
caggccagcugcuugggcuuc

SEQ ID NO: 3433454 - RNA, 13 nt, Human
caggccagcugug

SEQ ID NO: 3433455 - RNA, 15 nt, Human
caggccaggacucug

SEQ ID NO: 3433456 - RNA, 19 nt, Human
caggccaggacucugcagc

SEQ ID NO: 3433457 - RNA, 15 nt, Human
caggccaggcccucu

SEQ ID NO: 3433458 - RNA, 16 nt, Human
caggccaggcccucug

SEQ ID NO: 3433459 - RNA, 20 nt, Human
caggccaggcccucugccca

SEQ ID NO: 3433460 - RNA, 18 nt, Human
caggccaggcuccuuccu

SEQ ID NO: 3433461 - RNA, 21 nt, Human
caggccagggggccagucccu

SEQ ID NO: 3433462 - RNA, 12 nt, Human
caggccaggucc

SEQ ID NO: 3433463 - RNA, 15 nt, Human
caggccaggugcagu

SEQ ID NO: 3433464 - RNA, 16 nt, Human
caggccaggugcagug

SEQ ID NO: 3433465 - RNA, 16 nt, Human
caggccaguaagggaa

SEQ ID NO: 3433466 - RNA, 22 nt, Human
caggccaguaagggaaauagaa

SEQ ID NO: 3433467 - RNA, 15 nt, Human
caggccaucagaggc

SEQ ID NO: 3433468 - RNA, 18 nt, Human
caggccauccggccccca

SEQ ID NO: 3433469 - RNA, 16 nt, Human
caggccaucuuccagg

SEQ ID NO: 3433470 - RNA, 21 nt, Human
caggccauuccccgucucugg

SEQ ID NO: 3433471 - RNA, 19 nt, Human
caggcccaaagccucgaca

SEQ ID NO: 3433472 - RNA, 22 nt, Human
caggcccaacugugagcaagga

SEQ ID NO: 3433473 - RNA, 19 nt, Human
caggcccaagagaugaaga

SEQ ID NO: 3433474 - RNA, 14 nt, Human
caggcccacccugc

SEQ ID NO: 3433475 - RNA, 24 nt, Human
caggcccacccugcuuggcccagg

SEQ ID NO: 3433476 - RNA, 12 nt, Human
caggcccaccua

SEQ ID NO: 3433477 - RNA, 16 nt, Human
caggcccacugugccu

SEQ ID NO: 3433478 - RNA, 10 nt, Human
caggcccagc

SEQ ID NO: 3433479 - RNA, 17 nt, Human
caggcccaggcuccaga

SEQ ID NO: 3433480 - RNA, 23 nt, Human
caggccccaaaaccacagcccug

SEQ ID NO: 3433481 - RNA, 13 nt, Human
caggccccaggaa

SEQ ID NO: 3433482 - RNA, 16 nt, Human
caggccccaggaagcc

SEQ ID NO: 3433483 - RNA, 18 nt, Human
caggccccaggcagggcc

SEQ ID NO: 3433484 - RNA, 14 nt, Human
caggccccaugacc

SEQ ID NO: 3433485 - RNA, 13 nt, Human
caggcccccacca

SEQ ID NO: 3433486 - RNA, 16 nt, Human
caggcccccaccacac

SEQ ID NO: 3433487 - RNA, 22 nt, Human
caggcccccaccacacauccca

SEQ ID NO: 3433488 - RNA, 23 nt, Human
caggcccccaccacacaucccag

SEQ ID NO: 3433489 - RNA, 19 nt, Human
caggcccccaggugccagu

SEQ ID NO: 3433490 - RNA, 14 nt, Human
caggccccccuguc

SEQ ID NO: 3433491 - RNA, 16 nt, Human
auuucagagaggccuu

SEQ ID NO: 3433492 - RNA, 16 nt, Human
auuucagauguaaugu

SEQ ID NO: 3433493 - RNA, 18 nt, Human
auuucagauguaauguuu

SEQ ID NO: 3433494 - RNA, 16 nt, Human
auuucagcagcugcag

SEQ ID NO: 3433495 - RNA, 22 nt, Human
auuucaggggucgucaccaccu

SEQ ID NO: 3433496 - RNA, 15 nt, Human
auuucagggugcagc

SEQ ID NO: 3433497 - RNA, 21 nt, Human
auuucagguuuuguaaagaug

SEQ ID NO: 3433498 - RNA, 16 nt, Human
caggcuggcgcagcca

SEQ ID NO: 3433499 - RNA, 16 nt, Human
caggcuggcuccagau

SEQ ID NO: 3433500 - RNA, 18 nt, Human
caggcugggaacucaucu

SEQ ID NO: 3433501 - RNA, 19 nt, Human
cagcgcuggguccacccca

SEQ ID NO: 3433502 - RNA, 21 nt, Human
cagcggaaagcccugugcucc

SEQ ID NO: 3433503 - RNA, 15 nt, Human
cagcggccccuccca

SEQ ID NO: 3433504 - RNA, 17 nt, Human
cagcggccccucccaca

SEQ ID NO: 3433505 - RNA, 17 nt, Human
cagcggccccuugacuc

SEQ ID NO: 3433506 - RNA, 17 nt, Human
cagcggcuggaauuggg

SEQ ID NO: 3433507 - RNA, 17 nt, Human
cagcggcuggugcaggg

SEQ ID NO: 3433508 - RNA, 22 nt, Human
cagcgggaauggcagcugccac

SEQ ID NO: 3433509 - RNA, 16 nt, Human
cagcggggacagcucc

SEQ ID NO: 3433510 - RNA, 18 nt, Human
cagcggggacagcuccuu

SEQ ID NO: 3433511 - RNA, 19 nt, Human
cagcggggacagcuccuuc

SEQ ID NO: 3433512 - RNA, 16 nt, Human
cagcggggaggggagg

SEQ ID NO: 3433513 - RNA, 14 nt, Human
cagcggggcgaagc

SEQ ID NO: 3433514 - RNA, 21 nt, Human
cagcgggggaggcccgcagag

SEQ ID NO: 3433515 - RNA, 15 nt, Human
cagcguaaaauggug

SEQ ID NO: 3433516 - RNA, 17 nt, Human
cagcgucccuagcagug

SEQ ID NO: 3433517 - RNA, 13 nt, Human
cagcgucccuggc

SEQ ID NO: 3433518 - RNA, 15 nt, Human
cagcgucccuggcgc

SEQ ID NO: 3433519 - RNA, 18 nt, Human
cagcguccuccucuguga

SEQ ID NO: 3433520 - RNA, 15 nt, Human
cagcguccuguccac

SEQ ID NO: 3433521 - RNA, 19 nt, Human
cagcgugcuuuaaaaaaua

SEQ ID NO: 3433522 - RNA, 14 nt, Human
cagcguugcauguc

SEQ ID NO: 3433523 - RNA, 18 nt, Human
cagcuaaauuuucugaaa

SEQ ID NO: 3433524 - RNA, 18 nt, Human
cagcuaacauggaaguac

SEQ ID NO: 3433525 - RNA, 20 nt, Human
cagcuaacauggaaguacua

SEQ ID NO: 3433526 - RNA, 12 nt, Human
cagcuaagaaaa

SEQ ID NO: 3433527 - RNA, 13 nt, Human
cagcuaagaaccu

SEQ ID NO: 3433528 - RNA, 13 nt, Human
cagcuaagcucac

SEQ ID NO: 3433529 - RNA, 14 nt, Human
cagcuaagcucacg

SEQ ID NO: 3433530 - RNA, 22 nt, Human
cagcuaaggaggggaaaaaaau

SEQ ID NO: 3433531 - RNA, 19 nt, Human
cagcuaagggaagacauuu

SEQ ID NO: 3433532 - RNA, 23 nt, Human
cagcuaagggaagacauuucuuu

SEQ ID NO: 3433533 - RNA, 21 nt, Human
cagcuaagggguggggcugcg

SEQ ID NO: 3433534 - RNA, 12 nt, Human
cagcuacaacag

SEQ ID NO: 3433535 - RNA, 16 nt, Human
cagcuacacagagcuu

SEQ ID NO: 3433536 - RNA, 15 nt, Human
cagcuacagcuuucu

SEQ ID NO: 3433537 - RNA, 18 nt, Human
cagcuaccagguguucua

SEQ ID NO: 3433538 - RNA, 17 nt, Human
cagcuacccuguguaua

SEQ ID NO: 3433539 - RNA, 21 nt, Human
cagcuacucagaagccugagg

SEQ ID NO: 3433540 - RNA, 12 nt, Human
cagcuacucagg

SEQ ID NO: 3433541 - RNA, 15 nt, Human
cagcuacuccggagg

SEQ ID NO: 3433542 - RNA, 24 nt, Human
cagcuacucgggaggcugaggcag

SEQ ID NO: 3433543 - RNA, 23 nt, Human
cagcuacucuccccacgagggcu

SEQ ID NO: 3433544 - RNA, 19 nt, Human
cagcuacugauuuuuguga

SEQ ID NO: 3433545 - RNA, 20 nt, Human
cagcuacuuaagagaaaugg

SEQ ID NO: 3433546 - RNA, 18 nt, Human
cagcuacuugggaggcug

SEQ ID NO: 3433547 - RNA, 17 nt, Human
cagcuacuugguuugug

SEQ ID NO: 3433548 - RNA, 19 nt, Human
cagcuacuugguuuguguu

SEQ ID NO: 3433549 - RNA, 21 nt, Human
cagcuagcaaaagaaguaaca

SEQ ID NO: 3433550 - RNA, 17 nt, Human
cagcuaggaacaaaucu

SEQ ID NO: 3433551 - RNA, 19 nt, Human
cagcuaggaacaaaucuuc

SEQ ID NO: 3433552 - RNA, 21 nt, Human
cagcuaggaacaaaucuuccu

SEQ ID NO: 3433553 - RNA, 19 nt, Human
cagcuagugacccacaugc

SEQ ID NO: 3433554 - RNA, 20 nt, Human
cagcuagugacccacaugcc

SEQ ID NO: 3433555 - RNA, 24 nt, Human
cagcuaucgaacuucacaacuagg

SEQ ID NO: 3433556 - RNA, 17 nt, Human
cagcuaucucucaguga

SEQ ID NO: 3433557 - RNA, 18 nt, Human
cagcuaucucucagugaa

SEQ ID NO: 3433558 - RNA, 13 nt, Human
cagcuaugcaaaa

SEQ ID NO: 3433559 - RNA, 21 nt, Human
cagcuaugggagccccagggu

SEQ ID NO: 3433560 - RNA, 20 nt, Human
cagcuauguuauauugaaaa

SEQ ID NO: 3433561 - RNA, 15 nt, Human
cagcucaagagaucc

SEQ ID NO: 3433562 - RNA, 22 nt, Human
cagcucaagagaucccaaguag

SEQ ID NO: 3433563 - RNA, 19 nt, Human
cagcucaagucuucccuga

SEQ ID NO: 3433564 - RNA, 15 nt, Human
cagcucaccagcccc

SEQ ID NO: 3433565 - RNA, 16 nt, Human
cagcucaccagcccca

SEQ ID NO: 3433566 - RNA, 17 nt, Human
cagcucaccagccccag

SEQ ID NO: 3433567 - RNA, 18 nt, Human
cagcucaccccccacacu

SEQ ID NO: 3433568 - RNA, 13 nt, Human
cagcucaccucuc

SEQ ID NO: 3433569 - RNA, 16 nt, Human
cagcucaccucucccu

SEQ ID NO: 3433570 - RNA, 17 nt, Human
cagcucacgucacacuu

SEQ ID NO: 3433571 - RNA, 12 nt, Human
cagcucacugca

SEQ ID NO: 3433572 - RNA, 12 nt, Human
cagcucagaacc

SEQ ID NO: 3433573 - RNA, 15 nt, Human
cagcucagaacccag

SEQ ID NO: 3433574 - RNA, 17 nt, Human
cagcucagaacccaggg

SEQ ID NO: 3433575 - RNA, 19 nt, Human
cagcucagaacccagggcu

SEQ ID NO: 3433576 - RNA, 21 nt, Human
cagcucagaacccagggcucu

SEQ ID NO: 3433577 - RNA, 21 nt, Human
cagcucagaaguuucuucuuu

SEQ ID NO: 3433578 - RNA, 12 nt, Human
cagcucagagag

SEQ ID NO: 3433579 - RNA, 17 nt, Human
cagcucagagagggugg

SEQ ID NO: 3433580 - RNA, 15 nt, Human
cagcucagcacugcc

SEQ ID NO: 3433581 - RNA, 10 nt, Human
cagcucagga

SEQ ID NO: 3433582 - RNA, 13 nt, Human
cagcucaggacag

SEQ ID NO: 3433583 - RNA, 16 nt, Human
cagcucaggacagaug

SEQ ID NO: 3433584 - RNA, 23 nt, Human
cagcucaggcacacuucuucuug

SEQ ID NO: 3433585 - RNA, 18 nt, Human
cagcucaggggcagcuca

SEQ ID NO: 3433586 - RNA, 12 nt, Human
cagcucaguccc

SEQ ID NO: 3433587 - RNA, 14 nt, Human
cagcucauaagagc

SEQ ID NO: 3433588 - RNA, 14 nt, Human
cagcuccaaccugc

SEQ ID NO: 3433589 - RNA, 20 nt, Human
cagcuccaaccugcaaagau

SEQ ID NO: 3433590 - RNA, 18 nt, Human
cagcuccaagaccuguug

SEQ ID NO: 3433591 - RNA, 15 nt, Human
cagcuccacccuggc

SEQ ID NO: 3433592 - RNA, 23 nt, Human
cagcuccacucugacuggcacag

SEQ ID NO: 3433593 - RNA, 20 nt, Human
cagcuccagccccuuuccaa

SEQ ID NO: 3433594 - RNA, 22 nt, Human
cagcuccagccccuuuccaaaa

SEQ ID NO: 3433595 - RNA, 13 nt, Human
cagcuccagcuca

SEQ ID NO: 3433596 - RNA, 14 nt, Human
cagcuccagcucac

SEQ ID NO: 3433597 - RNA, 17 nt, Human
cagcuccagcucaccag

SEQ ID NO: 3433598 - RNA, 17 nt, Human
cagcuccagguggcucu

SEQ ID NO: 3433599 - RNA, 21 nt, Human
cagcucccaaggcucugagca

SEQ ID NO: 3433600 - RNA, 12 nt, Human
cagcucccaccc

SEQ ID NO: 3433601 - RNA, 19 nt, Human
cagcucccaccccaccccc

SEQ ID NO: 3433602 - RNA, 11 nt, Human
cagcucccagg

SEQ ID NO: 3433603 - RNA, 10 nt, Human
cagcuccccc

SEQ ID NO: 3433604 - RNA, 12 nt, Human
cagcucccccgg

SEQ ID NO: 3433605 - RNA, 16 nt, Human
cagcucccccucccuc

SEQ ID NO: 3433606 - RNA, 20 nt, Human
cagcucccccucccuccccu

SEQ ID NO: 3433607 - RNA, 14 nt, Human
cagcucccccuguc

SEQ ID NO: 3433608 - RNA, 16 nt, Human
cagcucccccuguccc

SEQ ID NO: 3433609 - RNA, 17 nt, Human
cagcucccccugucccc

SEQ ID NO: 3433610 - RNA, 18 nt, Human
cagcucccccuguccccu

SEQ ID NO: 3433611 - RNA, 19 nt, Human
cagcucccccuguccccuc

SEQ ID NO: 3433612 - RNA, 22 nt, Human
cagcuccccucggagaagagcu

SEQ ID NO: 3433613 - RNA, 20 nt, Human
cagcucccgcuccgggcucc

SEQ ID NO: 3433614 - RNA, 21 nt, Human
cagcucccucaaagaggcagu

SEQ ID NO: 3433615 - RNA, 13 nt, Human
cagcucccugcca

SEQ ID NO: 3433616 - RNA, 20 nt, Human
cagcucccuggcuucugugg

SEQ ID NO: 3433617 - RNA, 14 nt, Human
cagcucccuucucu

SEQ ID NO: 3433618 - RNA, 15 nt, Human
cagcucccuucucug

SEQ ID NO: 3433619 - RNA, 14 nt, Human
cagcucccuucugu

SEQ ID NO: 3433620 - RNA, 17 nt, Human
cagcuccgccucugucc

SEQ ID NO: 3433621 - RNA, 13 nt, Human
cagcuccuaaccc

SEQ ID NO: 3433622 - RNA, 14 nt, Human
cagcuccucccaca

SEQ ID NO: 3433623 - RNA, 22 nt, Human
cagcuccucccuuguucucuaa

SEQ ID NO: 3433624 - RNA, 19 nt, Human
cagcuccuccgugcuuccu

SEQ ID NO: 3433625 - RNA, 14 nt, Human
cagcuccucugucu

SEQ ID NO: 3433626 - RNA, 19 nt, Human
cagcuccugaccaguugca

SEQ ID NO: 3433627 - RNA, 22 nt, Human
cagcuccugaccaguugcaguc

SEQ ID NO: 3433628 - RNA, 13 nt, Human
cagcuccuuccug

SEQ ID NO: 3433629 - RNA, 20 nt, Human
cagcuccuugggaggaagca

SEQ ID NO: 3433630 - RNA, 19 nt, Human
cagcucgaauuaagaauau

SEQ ID NO: 3433631 - RNA, 14 nt, Human
cagcucgauccaaa

SEQ ID NO: 3433632 - RNA, 14 nt, Human
cagcucggcucagc

SEQ ID NO: 3433633 - RNA, 13 nt, Human
cagcucggggagc

SEQ ID NO: 3433634 - RNA, 16 nt, Human
cagcucgguacccggg

SEQ ID NO: 3433635 - RNA, 15 nt, Human
cagcucuaauaaaac

SEQ ID NO: 3433636 - RNA, 15 nt, Human
cagcucuacccugca

SEQ ID NO: 3433637 - RNA, 12 nt, Human
cagcucucagcc

SEQ ID NO: 3433638 - RNA, 17 nt, Human
cagcucucaucugaggc

SEQ ID NO: 3433639 - RNA, 23 nt, Human
cagcucucaugcugccccugccu

SEQ ID NO: 3433640 - RNA, 13 nt, Human
cagcucuccaguc

SEQ ID NO: 3433641 - RNA, 14 nt, Human
cagcucuccaguca

SEQ ID NO: 3433642 - RNA, 15 nt, Human
cagcucucccucugg

SEQ ID NO: 3433643 - RNA, 17 nt, Human
cagcucucccucuggcc

SEQ ID NO: 3433644 - RNA, 14 nt, Human
cagggcacagggcc

SEQ ID NO: 3433645 - RNA, 21 nt, Human
cagggcacagggccuggccca

SEQ ID NO: 3433646 - RNA, 22 nt, Human
cagggcacagggccuggcccau

SEQ ID NO: 3433647 - RNA, 22 nt, Human
cagggcacccuguggcccuggc

SEQ ID NO: 3433648 - RNA, 15 nt, Human
cagggcacugcugcu

SEQ ID NO: 3433649 - RNA, 14 nt, Human
cagggcacuucaca

SEQ ID NO: 3433650 - RNA, 18 nt, Human
cagggcacuucacagagu

SEQ ID NO: 3433651 - RNA, 15 nt, Human
cagggcagagccggg

SEQ ID NO: 3433652 - RNA, 13 nt, Human
cagggcagccagg

SEQ ID NO: 3433653 - RNA, 23 nt, Human
cagggcagccagggagagcccag

SEQ ID NO: 3433654 - RNA, 15 nt, Human
cagggcagcgccagg

SEQ ID NO: 3433655 - RNA, 15 nt, Human
cagggcagcugggcc

SEQ ID NO: 3433656 - RNA, 17 nt, Human
cagggcaggaccagccc

SEQ ID NO: 3433657 - RNA, 13 nt, Human
cagggcagggccc

SEQ ID NO: 3433658 - RNA, 17 nt, Human
cagggcagggcucugau

SEQ ID NO: 3433659 - RNA, 21 nt, Human
cagggcagucauuggcugucu

SEQ ID NO: 3433660 - RNA, 21 nt, Human
cagggcaucuccaggaaggcg

SEQ ID NO: 3433661 - RNA, 13 nt, Human
cagggcaucuccu

SEQ ID NO: 3433662 - RNA, 14 nt, Human
cagggcaucuccug

SEQ ID NO: 3433663 - RNA, 16 nt, Human
auuuggauaucuguua

SEQ ID NO: 3433664 - RNA, 20 nt, Human
auuuggaucucuucuuaaug

SEQ ID NO: 3433665 - RNA, 14 nt, Human
auuuggaugcagag

SEQ ID NO: 3433666 - RNA, 23 nt, Human
auuuggauuuaaaagccugcuca

SEQ ID NO: 3433667 - RNA, 17 nt, Human
auuuggcaucccugggc

SEQ ID NO: 3433668 - RNA, 16 nt, Human
auuuggccugcacuaa

SEQ ID NO: 3433669 - RNA, 16 nt, Human
auuuggcuuaaauaua

SEQ ID NO: 3433670 - RNA, 19 nt, Human
auuuggcuugacaaaggca

SEQ ID NO: 3433671 - RNA, 23 nt, Human
auuugggaagguuuguguuuucu

SEQ ID NO: 3433672 - RNA, 22 nt, Human
auuugggacccugcuuuagagc

SEQ ID NO: 3433673 - RNA, 18 nt, Human
auuugggagaagggcaga

SEQ ID NO: 3433674 - RNA, 19 nt, Human
auuugggagacaugugaca

SEQ ID NO: 3433675 - RNA, 14 nt, Human
auuugggcagagag

SEQ ID NO: 3433676 - RNA, 17 nt, Human
auuugggcugaauguau

SEQ ID NO: 3433677 - RNA, 14 nt, Human
auuuggggacagau

SEQ ID NO: 3433678 - RNA, 22 nt, Human
auuuggggacagauucagucuu

SEQ ID NO: 3433679 - RNA, 23 nt, Human
auuugggguagcuagaggaacca

SEQ ID NO: 3433680 - RNA, 12 nt, Human
auuuggggugga

SEQ ID NO: 3433681 - RNA, 17 nt, Human
auuugggguugcaucag

SEQ ID NO: 3433682 - RNA, 22 nt, Human
auuugggguugcaucagaaaug

SEQ ID NO: 3433683 - RNA, 23 nt, Human
auuugggguugcaucagaaaugu

SEQ ID NO: 3433684 - RNA, 16 nt, Human
auuuggguccaggagg

SEQ ID NO: 3433685 - RNA, 16 nt, Human
auuugggugguaagag

SEQ ID NO: 3433686 - RNA, 17 nt, Human
auuuggguucugccugc

SEQ ID NO: 3433687 - RNA, 23 nt, Human
auuuggucaagauuuugaaugcu

SEQ ID NO: 3433688 - RNA, 15 nt, Human
auuuggugaauuuga

SEQ ID NO: 3433689 - RNA, 19 nt, Human
auuuggugaauuugaaucu

SEQ ID NO: 3433690 - RNA, 17 nt, Human
auuuggugguuucagaa

SEQ ID NO: 3433691 - RNA, 20 nt, Human
auuuggugguuucagaaaug

SEQ ID NO: 3433692 - RNA, 21 nt, Human
auuuggugguuucagaaaugu

SEQ ID NO: 3433693 - RNA, 21 nt, Human
auuugguucauuaauucuaua

SEQ ID NO: 3433694 - RNA, 20 nt, Human
auuugguuuggccaucucug

SEQ ID NO: 3433695 - RNA, 14 nt, Human
auuugguuuuccug

SEQ ID NO: 3433696 - RNA, 23 nt, Human
auuuguaaaaacagcauugcuuu

SEQ ID NO: 3433697 - RNA, 23 nt, Human
auuuguaaaagaacaguaaacau

SEQ ID NO: 3433698 - RNA, 15 nt, Human
auuuguaaaaugaca

SEQ ID NO: 3433699 - RNA, 19 nt, Human
auuuguaaaaugacaauca

SEQ ID NO: 3433700 - RNA, 15 nt, Human
auuuguaaauauuaa

SEQ ID NO: 3433701 - RNA, 16 nt, Human
auuuguaaccucagcu

SEQ ID NO: 3433702 - RNA, 21 nt, Human
auuuguaaccucagcucuggg

SEQ ID NO: 3433703 - RNA, 14 nt, Human
auuuguaaguuuau

SEQ ID NO: 3433704 - RNA, 17 nt, Human
auuuguaaguuucaggu

SEQ ID NO: 3433705 - RNA, 22 nt, Human
auuuguaauuaaaagcaaauca

SEQ ID NO: 3433706 - RNA, 16 nt, Human
auuuguaauuaaauua

SEQ ID NO: 3433707 - RNA, 15 nt, Human
auuuguaauugcuua

SEQ ID NO: 3433708 - RNA, 19 nt, Human
auuuguaauugcuuacauu

SEQ ID NO: 3433709 - RNA, 13 nt, Human
auuuguaauuuaa

SEQ ID NO: 3433710 - RNA, 19 nt, Human
auuuguacagaauuuugga

SEQ ID NO: 3433711 - RNA, 18 nt, Human
auuuguacaguucaguuc

SEQ ID NO: 3433712 - RNA, 16 nt, Human
auuuguacauauguaa

SEQ ID NO: 3433713 - RNA, 18 nt, Human
auuuguacuauuuaacug

SEQ ID NO: 3433714 - RNA, 22 nt, Human
auuuguacuguuuaauguucug

SEQ ID NO: 3433715 - RNA, 15 nt, Human
auuuguacuuucugu

SEQ ID NO: 3433716 - RNA, 20 nt, Human
auuuguacuuucuguuaaaa

SEQ ID NO: 3433717 - RNA, 22 nt, Human
auuuguacuuucuguuaaaaug

SEQ ID NO: 3433718 - RNA, 24 nt, Human
auuuguacuuucuguuaaaaugca

SEQ ID NO: 3433719 - RNA, 22 nt, Human
auuuguaggaaggucucauucu

SEQ ID NO: 3433720 - RNA, 19 nt, Human
auuuguaggggaacucauu

SEQ ID NO: 3433721 - RNA, 15 nt, Human
auuuguaucacaaau

SEQ ID NO: 3433722 - RNA, 23 nt, Human
auuuguaucucugaagcauguuu

SEQ ID NO: 3433723 - RNA, 18 nt, Human
auuuguauguugugaaga

SEQ ID NO: 3433724 - RNA, 16 nt, Human
auuuguauuuugugug

SEQ ID NO: 3433725 - RNA, 17 nt, Human
auuugucaaugacaguu

SEQ ID NO: 3433726 - RNA, 20 nt, Human
auuugucaauuuaugaauau

SEQ ID NO: 3433727 - RNA, 19 nt, Human
auuugucaugcugggauuu

SEQ ID NO: 3433728 - RNA, 14 nt, Human
auuugucauuuuca

SEQ ID NO: 3433729 - RNA, 15 nt, Human
auuugucauuuucau

SEQ ID NO: 3433730 - RNA, 15 nt, Human
auuuguccaauucuc

SEQ ID NO: 3433731 - RNA, 20 nt, Human
auuugucucugucacccuug

SEQ ID NO: 3433732 - RNA, 21 nt, Human
auuugucugaaacauuucaua

SEQ ID NO: 3433733 - RNA, 15 nt, Human
auuugucuugccuua

SEQ ID NO: 3433734 - RNA, 14 nt, Human
auuugucuuuuugu

SEQ ID NO: 3433735 - RNA, 22 nt, Human
auuugucuuuuuguuguaaaac

SEQ ID NO: 3433736 - RNA, 17 nt, Human
auuugugacaaaaaauu

SEQ ID NO: 3433737 - RNA, 19 nt, Human
auuugugacuaauuguaua

SEQ ID NO: 3433738 - RNA, 20 nt, Human
auuugugacuaauuguauaa

SEQ ID NO: 3433739 - RNA, 12 nt, Human
auuugugagacu

SEQ ID NO: 3433740 - RNA, 14 nt, Human
auuugugauacaau

SEQ ID NO: 3433741 - RNA, 17 nt, Human
auuugugauauauguau

SEQ ID NO: 3433742 - RNA, 14 nt, Human
auuugugccagaau

SEQ ID NO: 3433743 - RNA, 14 nt, Human
auuugugccagagg

SEQ ID NO: 3433744 - RNA, 20 nt, Human
auuugugcuagaaauuuuca

SEQ ID NO: 3433745 - RNA, 21 nt, Human
auuugugcuauaguauuugau

SEQ ID NO: 3433746 - RNA, 12 nt, Human
auuuguggaaua

SEQ ID NO: 3433747 - RNA, 21 nt, Human
auuuguggguuuuuauuuccu

SEQ ID NO: 3433748 - RNA, 16 nt, Human
auuuguguaauaaagu

SEQ ID NO: 3433749 - RNA, 21 nt, Human
auuuguguaauaaaguguuuu

SEQ ID NO: 3433750 - RNA, 22 nt, Human
auuuguguaauaaaguguuuuc

SEQ ID NO: 3433751 - RNA, 13 nt, Human
auuuguguaauag

SEQ ID NO: 3433752 - RNA, 17 nt, Human
auuugugucacaaagaa

SEQ ID NO: 3433753 - RNA, 12 nt, Human
auuugugugugu

SEQ ID NO: 3433754 - RNA, 15 nt, Human
auuugugugugugca

SEQ ID NO: 3433755 - RNA, 20 nt, Human
auuugugugugugcaagugu

SEQ ID NO: 3433756 - RNA, 22 nt, Human
auuuguguguuauaccuugauu

SEQ ID NO: 3433757 - RNA, 22 nt, Human
auuuguguguucacuaaacucu

SEQ ID NO: 3433758 - RNA, 22 nt, Human
auuuguguguuuuuagcuguga

SEQ ID NO: 3433759 - RNA, 15 nt, Human
auuuguguugaagag

SEQ ID NO: 3433760 - RNA, 15 nt, Human
auuuguguugaagga

SEQ ID NO: 3433761 - RNA, 19 nt, Human
auuuguguugaaggaacuu

SEQ ID NO: 3433762 - RNA, 21 nt, Human
auuuguguuuuaauuuaaaca

SEQ ID NO: 3433763 - RNA, 21 nt, Human
auuuguuaaaauuaucaauau

SEQ ID NO: 3433764 - RNA, 15 nt, Human
auuuguuauggcaga

SEQ ID NO: 3433765 - RNA, 17 nt, Human
auuuguuauucuuaaga

SEQ ID NO: 3433766 - RNA, 19 nt, Human
auuuguuauuuguacaguu

SEQ ID NO: 3433767 - RNA, 23 nt, Human
auuuguucacugaaggugauuca

SEQ ID NO: 3433768 - RNA, 14 nt, Human
auuuguucauguuu

SEQ ID NO: 3433769 - RNA, 17 nt, Human
auuuguucccaagagca

SEQ ID NO: 3433770 - RNA, 14 nt, Human
auuuguucucuguc

SEQ ID NO: 3433771 - RNA, 16 nt, Human
auuuguucuuguauuu

SEQ ID NO: 3433772 - RNA, 18 nt, Human
auuuguugauucucucca

SEQ ID NO: 3433773 - RNA, 11 nt, Human
auuuguugcau

SEQ ID NO: 3433774 - RNA, 13 nt, Human
auuuguuggaaug

SEQ ID NO: 3433775 - RNA, 20 nt, Human
auuuguuguucuuucagaaa

SEQ ID NO: 3433776 - RNA, 16 nt, Human
auuuguuuaaaaagua

SEQ ID NO: 3433777 - RNA, 20 nt, Human
auuuguuuaugguaaaaaau

SEQ ID NO: 3433778 - RNA, 22 nt, Human
auuuguuuaugguaaaaaauuu

SEQ ID NO: 3433779 - RNA, 17 nt, Human
auuuguuuauguaauuu

SEQ ID NO: 3433780 - RNA, 18 nt, Human
auuuguuuauguaauuuc

SEQ ID NO: 3433781 - RNA, 23 nt, Human
auuuguuuauuuuuauauagcuu

SEQ ID NO: 3433782 - RNA, 16 nt, Human
auuuguuuccagcaug

SEQ ID NO: 3433783 - RNA, 13 nt, Human
auuuguuucuacu

SEQ ID NO: 3433784 - RNA, 20 nt, Human
auuuguuucuuucucugagg

SEQ ID NO: 3433785 - RNA, 16 nt, Human
auuuguuugaacugau

SEQ ID NO: 3433786 - RNA, 12 nt, Human
auuuguuugcau

SEQ ID NO: 3433787 - RNA, 21 nt, Human
auuuguuugguuauagugcaa

SEQ ID NO: 3433788 - RNA, 22 nt, Human
auuuuuuuuuccuucagugccu

SEQ ID NO: 3433789 - RNA, 19 nt, Human
auuuuuuuuuuaaauuauu

SEQ ID NO: 3433790 - RNA, 18 nt, Human
auuuuuuuuuuuugaaaa

SEQ ID NO: 3433791 - RNA, 16 nt, Human
caaaaaaaaaguuuua

SEQ ID NO: 3433792 - RNA, 17 nt, Human
caaaaaaaaaguuuuau

SEQ ID NO: 3433793 - RNA, 18 nt, Human
caaaaaaaauuagccggg

SEQ ID NO: 3433794 - RNA, 15 nt, Human
caaaaaaaauuuaaa

SEQ ID NO: 3433795 - RNA, 16 nt, Human
caaaaaaacacuaguu

SEQ ID NO: 3433796 - RNA, 17 nt, Human
caaaaaaaccacaaagg

SEQ ID NO: 3433797 - RNA, 15 nt, Human
caaaaaaaguuguau

SEQ ID NO: 3433798 - RNA, 16 nt, Human
caaaaaaauccagaaa

SEQ ID NO: 3433799 - RNA, 18 nt, Human
caaaaaacaauauuuauu

SEQ ID NO: 3433800 - RNA, 22 nt, Human
caaaaaacaauauuuauuguau

SEQ ID NO: 3433801 - RNA, 23 nt, Human
caaaaaacaauauuuauuguauu

SEQ ID NO: 3433802 - RNA, 11 nt, Human
caaaaaacuac

SEQ ID NO: 3433803 - RNA, 21 nt, Human
caaaaaacucgaggacuguau

SEQ ID NO: 3433804 - RNA, 14 nt, Human
caaaaaacugcagu

SEQ ID NO: 3433805 - RNA, 16 nt, Human
caaaaaauuagccggg

SEQ ID NO: 3433806 - RNA, 10 nt, Human
caaaaacaaa

SEQ ID NO: 3433807 - RNA, 14 nt, Human
caaaaacacagcaa

SEQ ID NO: 3433808 - RNA, 17 nt, Human
caaaaacacagcaaggg

SEQ ID NO: 3433809 - RNA, 20 nt, Human
caaaaacacaguguuuuugu

SEQ ID NO: 3433810 - RNA, 15 nt, Human
caaaaacagccucac

SEQ ID NO: 3433811 - RNA, 22 nt, Human
caaaaacagguauauacuuuga

SEQ ID NO: 3433812 - RNA, 20 nt, Human
caaaaacauggccuuugcuu

SEQ ID NO: 3433813 - RNA, 23 nt, Human
caaaaacauguaugugcauuuca

SEQ ID NO: 3433814 - RNA, 12 nt, Human
caaaaaccaaau

SEQ ID NO: 3433815 - RNA, 18 nt, Human
caaaaaccaguauuguac

SEQ ID NO: 3433816 - RNA, 21 nt, Human
caaaaacccagcaacagaaaa

SEQ ID NO: 3433817 - RNA, 14 nt, Human
caaaaacuauuugg

SEQ ID NO: 3433818 - RNA, 13 nt, Human
caaaaacuguuuu

SEQ ID NO: 3433819 - RNA, 13 nt, Human
caaaaacuuguua

SEQ ID NO: 3433820 - RNA, 22 nt, Human
caaaaagaaaaaaaaaaagaaa

SEQ ID NO: 3433821 - RNA, 20 nt, Human
caaaaagaaaagaaaauuuu

SEQ ID NO: 3433822 - RNA, 16 nt, Human
caaaaagaaaugacua

SEQ ID NO: 3433823 - RNA, 13 nt, Human
caaaaagaacaaa

SEQ ID NO: 3433824 - RNA, 21 nt, Human
caaaaagacacuugauacuug

SEQ ID NO: 3433825 - RNA, 15 nt, Human
caaaaagaccagacu

SEQ ID NO: 3433826 - RNA, 22 nt, Human
caaaaagauaccuuaaaauuug

SEQ ID NO: 3433827 - RNA, 23 nt, Human
caaaaagauaccuuaaaauuuga

SEQ ID NO: 3433828 - RNA, 15 nt, Human
caaaaagcaaaauca

SEQ ID NO: 3433829 - RNA, 14 nt, Human
caaaaagcuucccc

SEQ ID NO: 3433830 - RNA, 15 nt, Human
caaaaagcuucugug

SEQ ID NO: 3433831 - RNA, 14 nt, Human
caaaaauacucuaa

SEQ ID NO: 3433832 - RNA, 15 nt, Human
caaaaauacucuaau

SEQ ID NO: 3433833 - RNA, 17 nt, Human
caaaaauacucuaauuc

SEQ ID NO: 3433834 - RNA, 18 nt, Human
caaaaauacucuaauucu

SEQ ID NO: 3433835 - RNA, 20 nt, Human
caaaaauacucuaauucuaa

SEQ ID NO: 3433836 - RNA, 14 nt, Human
caaaaauagcuaaa

SEQ ID NO: 3433837 - RNA, 15 nt, Human
caaaaauauaaaaua

SEQ ID NO: 3433838 - RNA, 15 nt, Human
caaaaauauaacuua

SEQ ID NO: 3433839 - RNA, 17 nt, Human
caaaaauaucccuuccg

SEQ ID NO: 3433840 - RNA, 15 nt, Human
caaaaauauuuuaug

SEQ ID NO: 3433841 - RNA, 17 nt, Human
caaaaauauuuuaugau

SEQ ID NO: 3433842 - RNA, 16 nt, Human
caaaaaucagccagac

SEQ ID NO: 3433843 - RNA, 15 nt, Human
caaaaauccaaauau

SEQ ID NO: 3433844 - RNA, 15 nt, Human
caaaaaucugaagau

SEQ ID NO: 3433845 - RNA, 16 nt, Human
caaaaaucugccuggg

SEQ ID NO: 3433846 - RNA, 17 nt, Human
caaaaaugaacugaagu

SEQ ID NO: 3433847 - RNA, 13 nt, Human
caaaaaugcuaau

SEQ ID NO: 3433848 - RNA, 14 nt, Human
caaaaaugcuaaua

SEQ ID NO: 3433849 - RNA, 14 nt, Human
caaaaauguacaaa

SEQ ID NO: 3433850 - RNA, 22 nt, Human
caaaaauguacaaaauaaaguu

SEQ ID NO: 3433851 - RNA, 20 nt, Human
caaaaauuagccgggcgugg

SEQ ID NO: 3433852 - RNA, 11 nt, Human
caaaaauuauc

SEQ ID NO: 3433853 - RNA, 19 nt, Human
caaaaauuaucuauuugua

SEQ ID NO: 3433854 - RNA, 19 nt, Human
caaaaauucaacucagacu

SEQ ID NO: 3433855 - RNA, 16 nt, Human
caaaaauucucaguuc

SEQ ID NO: 3433856 - RNA, 14 nt, Human
caaaaauuuuguga

SEQ ID NO: 3433857 - RNA, 16 nt, Human
caaaaauuuugugaca

SEQ ID NO: 3433858 - RNA, 17 nt, Human
caaaaauuuugugacau

SEQ ID NO: 3433859 - RNA, 15 nt, Human
caaaaauuuuuggau

SEQ ID NO: 3433860 - RNA, 22 nt, Human
caaaaauuuuuggauugacagu

SEQ ID NO: 3433861 - RNA, 18 nt, Human
caaaacaaaaauuaggua

SEQ ID NO: 3433862 - RNA, 22 nt, Human
caaaacaaaaauuagguauuuu

SEQ ID NO: 3433863 - RNA, 13 nt, Human
caaaacaaaacaa

SEQ ID NO: 3433864 - RNA, 16 nt, Human
caaaacaaaacaaaac

SEQ ID NO: 3433865 - RNA, 12 nt, Human
caggaggccagc

SEQ ID NO: 3433866 - RNA, 14 nt, Human
caggaggccagccu

SEQ ID NO: 3433867 - RNA, 16 nt, Human
caggaggccagccuug

SEQ ID NO: 3433868 - RNA, 17 nt, Human
caggaggccagccuuga

SEQ ID NO: 3433869 - RNA, 18 nt, Human
caggaggccaggccggcg

SEQ ID NO: 3433870 - RNA, 22 nt, Human
caggaggcgcccuuggcuucug

SEQ ID NO: 3433871 - RNA, 13 nt, Human
caggaggcugagg

SEQ ID NO: 3433872 - RNA, 17 nt, Human
caggaggcugaggcaga

SEQ ID NO: 3433873 - RNA, 20 nt, Human
caggaggcugaggcaggagg

SEQ ID NO: 3433874 - RNA, 18 nt, Human
caggaggcuggaggaagg

SEQ ID NO: 3433875 - RNA, 21 nt, Human
caggaggcuuggaaagcauca

SEQ ID NO: 3433876 - RNA, 21 nt, Human
caggagggacaaaggagccug

SEQ ID NO: 3433877 - RNA, 19 nt, Human
caggagggacagucucacc

SEQ ID NO: 3433878 - RNA, 15 nt, Human
caggagggagcagag

SEQ ID NO: 3433879 - RNA, 22 nt, Human
caggagggagcauagaaggcag

SEQ ID NO: 3433880 - RNA, 12 nt, Human
caggagggaggg

SEQ ID NO: 3433881 - RNA, 22 nt, Human
caggagggauuggccgcuuggc

SEQ ID NO: 3433882 - RNA, 16 nt, Human
caggagggcaagggcc

SEQ ID NO: 3433883 - RNA, 17 nt, Human
caggagggcaagggcca

SEQ ID NO: 3433884 - RNA, 19 nt, Human
caggagggcaagggccaug

SEQ ID NO: 3433885 - RNA, 18 nt, Human
caggagggcacuggagcu

SEQ ID NO: 3433886 - RNA, 21 nt, Human
caggagggcggccuccuucug

SEQ ID NO: 3433887 - RNA, 22 nt, Human
caggagggcguucuuaggcugc

SEQ ID NO: 3433888 - RNA, 24 nt, Human
caggaggggaacacugcccucgca

SEQ ID NO: 3433889 - RNA, 22 nt, Human
caggaggggagugaggcaggug

SEQ ID NO: 3433890 - RNA, 20 nt, Human
caggagggggucguggagag

SEQ ID NO: 3433891 - RNA, 15 nt, Human
caggagguggagguu

SEQ ID NO: 3433892 - RNA, 17 nt, Human
caggagguuggagggaa

SEQ ID NO: 3433893 - RNA, 14 nt, Human
caggaguaaaagag

SEQ ID NO: 3433894 - RNA, 20 nt, Human
caggaguaaaagagucaagu

SEQ ID NO: 3433895 - RNA, 20 nt, Human
caggaguagcugagcucaca

SEQ ID NO: 3433896 - RNA, 22 nt, Human
caggaguagugaagacuccaga

SEQ ID NO: 3433897 - RNA, 17 nt, Human
caggagucccaaggaaa

SEQ ID NO: 3433898 - RNA, 18 nt, Human
caggagucccaaggaaag

SEQ ID NO: 3433899 - RNA, 13 nt, Human
caggagucccugg

SEQ ID NO: 3433900 - RNA, 14 nt, Human
caggagucccuggu

SEQ ID NO: 3433901 - RNA, 22 nt, Human
caggagucucugguagccugca

SEQ ID NO: 3433902 - RNA, 18 nt, Human
caggaguggguggggagu

SEQ ID NO: 3433903 - RNA, 17 nt, Human
caggaguuagaggccag

SEQ ID NO: 3433904 - RNA, 20 nt, Human
caggaguuagaggccagccu

SEQ ID NO: 3433905 - RNA, 21 nt, Human
caggaguuagaggccagccug

SEQ ID NO: 3433906 - RNA, 21 nt, Human
caggaguucaauaaaugucug

SEQ ID NO: 3433907 - RNA, 15 nt, Human
caggaguucugcuca

SEQ ID NO: 3433908 - RNA, 22 nt, Human
caggaguucugcucauucuaau

SEQ ID NO: 3433909 - RNA, 21 nt, Human
caggaguuuaagaccagccug

SEQ ID NO: 3433910 - RNA, 21 nt, Human
caggaguuugagaccagccug

SEQ ID NO: 3433911 - RNA, 13 nt, Human
caggaguuuggcc

SEQ ID NO: 3433912 - RNA, 17 nt, Human
caggaguuuggccagaa

SEQ ID NO: 3433913 - RNA, 18 nt, Human
caggauaauaaaguguuu

SEQ ID NO: 3433914 - RNA, 15 nt, Human
caggauacuggcaca

SEQ ID NO: 3433915 - RNA, 20 nt, Human
caggauacuggcacagaggu

SEQ ID NO: 3433916 - RNA, 16 nt, Human
caggauagagacugga

SEQ ID NO: 3433917 - RNA, 18 nt, Human
caggauagauaacucuuu

SEQ ID NO: 3433918 - RNA, 19 nt, Human
caggauagauaacucuuug

SEQ ID NO: 3433919 - RNA, 15 nt, Human
caggauaguugcucc

SEQ ID NO: 3433920 - RNA, 14 nt, Human
caggauauauuuua

SEQ ID NO: 3433921 - RNA, 21 nt, Human
caggauauucucacagcucca

SEQ ID NO: 3433922 - RNA, 12 nt, Human
caggaucagcca

SEQ ID NO: 3433923 - RNA, 13 nt, Human
caggaucagucug

SEQ ID NO: 3433924 - RNA, 15 nt, Human
caggaucaguuaacu

SEQ ID NO: 3433925 - RNA, 18 nt, Human
caggaucaugguguaaua

SEQ ID NO: 3433926 - RNA, 13 nt, Human
caggauccagccu

SEQ ID NO: 3433927 - RNA, 14 nt, Human
caggauccagccuc

SEQ ID NO: 3433928 - RNA, 12 nt, Human
caggaucuauuu

SEQ ID NO: 3433929 - RNA, 18 nt, Human
caggaucuauuuuuggag

SEQ ID NO: 3433930 - RNA, 14 nt, Human
caggaugaagcauu

SEQ ID NO: 3433931 - RNA, 17 nt, Human
caggaugaccuggauaa

SEQ ID NO: 3433932 - RNA, 20 nt, Human
caggaugacgguauuaugcu

SEQ ID NO: 3433933 - RNA, 11 nt, Human
caggccagccu

SEQ ID NO: 3433934 - RNA, 21 nt, Human
caggccagccuccgagaggga

SEQ ID NO: 3433935 - RNA, 23 nt, Human
caggccagccuccgagagggaga

SEQ ID NO: 3433936 - RNA, 17 nt, Human
caggccagcugcuuggg

SEQ ID NO: 3433937 - RNA, 19 nt, Human
caggccagcugcuugggcu

SEQ ID NO: 3433938 - RNA, 13 nt, Human
caggccaggacuc

SEQ ID NO: 3433939 - RNA, 16 nt, Human
caggccaggacucugc

SEQ ID NO: 3433940 - RNA, 17 nt, Human
caggccaggacucugca

SEQ ID NO: 3433941 - RNA, 18 nt, Human
caggccaggacucugcag

SEQ ID NO: 3433942 - RNA, 14 nt, Human
caggccaggccacc

SEQ ID NO: 3433943 - RNA, 18 nt, Human
caggccaggccaccagga

SEQ ID NO: 3433944 - RNA, 14 nt, Human
caggccaggccagc

SEQ ID NO: 3433945 - RNA, 12 nt, Human
caggccaggccc

SEQ ID NO: 3433946 - RNA, 13 nt, Human
caggccaggcccu

SEQ ID NO: 3433947 - RNA, 14 nt, Human
caggccaggcccuc

SEQ ID NO: 3433948 - RNA, 21 nt, Human
caggccaggcccucugcccac

SEQ ID NO: 3433949 - RNA, 12 nt, Human
caggccaggcuc

SEQ ID NO: 3433950 - RNA, 16 nt, Human
caggccagguccagag

SEQ ID NO: 3433951 - RNA, 21 nt, Human
caggccaucaucaguggagcc

SEQ ID NO: 3433952 - RNA, 15 nt, Human
caggccaucuuccag

SEQ ID NO: 3433953 - RNA, 18 nt, Human
caggccauuccccgucuc

SEQ ID NO: 3433954 - RNA, 20 nt, Human
caggccauugugaaccaaug

SEQ ID NO: 3433955 - RNA, 17 nt, Human
caggcccaaggcucccg

SEQ ID NO: 3433956 - RNA, 13 nt, Human
caggcccacagua

SEQ ID NO: 3433957 - RNA, 13 nt, Human
caggcccacccug

SEQ ID NO: 3433958 - RNA, 14 nt, Human
caggcccacucagg

SEQ ID NO: 3433959 - RNA, 19 nt, Human
caggcccacugugccucag

SEQ ID NO: 3433960 - RNA, 12 nt, Human
caggcccagcau

SEQ ID NO: 3433961 - RNA, 16 nt, Human
caggcccagccgaccc

SEQ ID NO: 3433962 - RNA, 20 nt, Human
caggcccagccgacccccuc

SEQ ID NO: 3433963 - RNA, 12 nt, Human
caggccccaagg

SEQ ID NO: 3433964 - RNA, 15 nt, Human
caggccccaggaaag

SEQ ID NO: 3433965 - RNA, 17 nt, Human
caggccccaggaagccg

SEQ ID NO: 3433966 - RNA, 18 nt, Human
caggccccaugaccucca

SEQ ID NO: 3433967 - RNA, 19 nt, Human
caggccccaugaccuccag

SEQ ID NO: 3433968 - RNA, 13 nt, Human
caggcccccaagc

SEQ ID NO: 3433969 - RNA, 15 nt, Human
caggcccccaagccu

SEQ ID NO: 3433970 - RNA, 17 nt, Human
caggcccccaagccugc

SEQ ID NO: 3433971 - RNA, 18 nt, Human
caggcccccaagccugca

SEQ ID NO: 3433972 - RNA, 17 nt, Human
caggcccccaccacaca

SEQ ID NO: 3433973 - RNA, 18 nt, Human
caggcccccaccacacau

SEQ ID NO: 3433974 - RNA, 20 nt, Human
caggcccccaccacacaucc

SEQ ID NO: 3433975 - RNA, 15 nt, Human
caggcccccaccacu

SEQ ID NO: 3433976 - RNA, 18 nt, Human
caggcccccaccuggcuc

SEQ ID NO: 3433977 - RNA, 19 nt, Human
caggcccccaccuggcuca

SEQ ID NO: 3433978 - RNA, 17 nt, Human
caggcccccgccuuggc

SEQ ID NO: 3433979 - RNA, 17 nt, Human
caggccccgaggaccca

SEQ ID NO: 3433980 - RNA, 21 nt, Human
caggccccgaggacccagacc

SEQ ID NO: 3433981 - RNA, 23 nt, Human
caggccccgaggacccagaccca

SEQ ID NO: 3433982 - RNA, 19 nt, Human
caggccccgcuuguccagc

SEQ ID NO: 3433983 - RNA, 16 nt, Human
caggccccuggaggcu

SEQ ID NO: 3433984 - RNA, 23 nt, Human
caggccccuggaggcugccuccc

SEQ ID NO: 3433985 - RNA, 18 nt, Human
caggcccggcuccaggcu

SEQ ID NO: 3433986 - RNA, 15 nt, Human
caggcccggggcugg

SEQ ID NO: 3433987 - RNA, 17 nt, Human
caggcccgucuguccau

SEQ ID NO: 3433988 - RNA, 23 nt, Human
caggcccgucuguccaucugccc

SEQ ID NO: 3433989 - RNA, 15 nt, Human
caggcccucugccca

SEQ ID NO: 3433990 - RNA, 17 nt, Human
caggcccucugcccacu

SEQ ID NO: 3433991 - RNA, 11 nt, Human
caggcccugca

SEQ ID NO: 3433992 - RNA, 15 nt, Human
caggcccugcacugu

SEQ ID NO: 3433993 - RNA, 19 nt, Human
caggcccugcacuguccug

SEQ ID NO: 3433994 - RNA, 16 nt, Human
caggcccugcuccugc

SEQ ID NO: 3433995 - RNA, 17 nt, Human
caggcccugcuccugca

SEQ ID NO: 3433996 - RNA, 19 nt, Human
caggcccugcuccugcagc

SEQ ID NO: 3433997 - RNA, 22 nt, Human
caggcccugcuccugcagcaug

SEQ ID NO: 3433998 - RNA, 15 nt, Human
caggcccuggccucc

SEQ ID NO: 3433999 - RNA, 17 nt, Human
caggcccuggccucccc

SEQ ID NO: 3434000 - RNA, 17 nt, Human
caggcccuuccucucca

SEQ ID NO: 3434001 - RNA, 14 nt, Human
caggccgcagcucu

SEQ ID NO: 3434002 - RNA, 15 nt, Human
caggccgcagcucuu

SEQ ID NO: 3434003 - RNA, 22 nt, Human
caggccgcagcucuugcccuuc

SEQ ID NO: 3434004 - RNA, 16 nt, Human
caggccgccccagccu

SEQ ID NO: 3434005 - RNA, 21 nt, Human
caggccgccccagccucugag

SEQ ID NO: 3434006 - RNA, 14 nt, Human
caggccgcccugcg

SEQ ID NO: 3434007 - RNA, 17 nt, Human
caggccggcagccccag

SEQ ID NO: 3434008 - RNA, 22 nt, Human
caggccggcagccccagccugc

SEQ ID NO: 3434009 - RNA, 13 nt, Human
caggccggccagc

SEQ ID NO: 3434010 - RNA, 16 nt, Human
caggccggccagccuc

SEQ ID NO: 3434011 - RNA, 20 nt, Human
caggccggcgagcccugugg

SEQ ID NO: 3434012 - RNA, 20 nt, Human
caggccggcuugccacaccc

SEQ ID NO: 3434013 - RNA, 13 nt, Human
caggccgggaaaa

SEQ ID NO: 3434014 - RNA, 13 nt, Human
caggccgggcaga

SEQ ID NO: 3434015 - RNA, 13 nt, Human
caggccgggccug

SEQ ID NO: 3434016 - RNA, 17 nt, Human
caggccgggccuguaca

SEQ ID NO: 3434017 - RNA, 19 nt, Human
caggccgggguggagcaug

SEQ ID NO: 3434018 - RNA, 20 nt, Human
caggccgggguggagcaugg

SEQ ID NO: 3434019 - RNA, 18 nt, Human
caggccgugacgucuggg

SEQ ID NO: 3434020 - RNA, 19 nt, Human
caggccgugacgucugggu

SEQ ID NO: 3434021 - RNA, 20 nt, Human
caggccgugacgucugggug

SEQ ID NO: 3434022 - RNA, 17 nt, Human
caggccuacuccugucu

SEQ ID NO: 3434023 - RNA, 20 nt, Human
caggccuacuccugucuucu

SEQ ID NO: 3434024 - RNA, 20 nt, Human
caggccuagaggccugacug

SEQ ID NO: 3434025 - RNA, 17 nt, Human
caggccucaccucuacc

SEQ ID NO: 3434026 - RNA, 16 nt, Human
caggccucagggcucc

SEQ ID NO: 3434027 - RNA, 15 nt, Human
caggccuccagcuca

SEQ ID NO: 3434028 - RNA, 17 nt, Human
caggccuccagcucagc

SEQ ID NO: 3434029 - RNA, 16 nt, Human
caggccucccugccag

SEQ ID NO: 3434030 - RNA, 23 nt, Human
cagugccgccgccucgcccaccg

SEQ ID NO: 3434031 - RNA, 13 nt, Human
cagugccugcuga

SEQ ID NO: 3434032 - RNA, 21 nt, Human
cagugccuggauccccucugu

SEQ ID NO: 3434033 - RNA, 18 nt, Human
cagugccugggaauguau

SEQ ID NO: 3434034 - RNA, 22 nt, Human
cagugccuggguggaugggcca

SEQ ID NO: 3434035 - RNA, 17 nt, Human
cagugccuuaccuccug

SEQ ID NO: 3434036 - RNA, 18 nt, Human
cagugccuuaccuccugc

SEQ ID NO: 3434037 - RNA, 20 nt, Human
cagugccuuaccuccugccc

SEQ ID NO: 3434038 - RNA, 19 nt, Human
cagugccuuauggaacacu

SEQ ID NO: 3434039 - RNA, 23 nt, Human
cagugccuuauggaacacucuga

SEQ ID NO: 3434040 - RNA, 14 nt, Human
cagugccuuccaua

SEQ ID NO: 3434041 - RNA, 22 nt, Human
cagugccuuccuguuuuucaca

SEQ ID NO: 3434042 - RNA, 21 nt, Human
cagugccuuggggaauuuccu

SEQ ID NO: 3434043 - RNA, 23 nt, Human
cagugccuuucuucucuccagug

SEQ ID NO: 3434044 - RNA, 24 nt, Human
cagugcgcgugcacguggagagcu

SEQ ID NO: 3434045 - RNA, 21 nt, Human
cagugcgggaggaauuucuga

SEQ ID NO: 3434046 - RNA, 16 nt, Human
cagugcuaaaaauggg

SEQ ID NO: 3434047 - RNA, 16 nt, Human
cagugcuagugagcug

SEQ ID NO: 3434048 - RNA, 23 nt, Human
cagugcuauuuugugcccacugu

SEQ ID NO: 3434049 - RNA, 20 nt, Human
cagugcucgcuguugcugaa

SEQ ID NO: 3434050 - RNA, 21 nt, Human
cagugcucgcuguugcugaau

SEQ ID NO: 3434051 - RNA, 16 nt, Human
cagugcugaucuaaaa

SEQ ID NO: 3434052 - RNA, 22 nt, Human
cagugcugccuguccccaugcu

SEQ ID NO: 3434053 - RNA, 18 nt, Human
cagugcugggauuacagg

SEQ ID NO: 3434054 - RNA, 19 nt, Human
cagugcuguccaugcuucu

SEQ ID NO: 3434055 - RNA, 22 nt, Human
cagugcuguccaugcuucucau

SEQ ID NO: 3434056 - RNA, 15 nt, Human
cagugcuguggccug

SEQ ID NO: 3434057 - RNA, 17 nt, Human
cagugcuguggccuggg

SEQ ID NO: 3434058 - RNA, 19 nt, Human
cagugcuguggccugggca

SEQ ID NO: 3434059 - RNA, 20 nt, Human
cagugcuguggccugggcaa

SEQ ID NO: 3434060 - RNA, 12 nt, Human
cagugcugugug

SEQ ID NO: 3434061 - RNA, 24 nt, Human
cagugcuuagcaaaaaauaaugac

SEQ ID NO: 3434062 - RNA, 17 nt, Human
cagugcuucagccugag

SEQ ID NO: 3434063 - RNA, 18 nt, Human
cagugcuucagccugagg

SEQ ID NO: 3434064 - RNA, 19 nt, Human
cagugcuucagccugaggc

SEQ ID NO: 3434065 - RNA, 17 nt, Human
cagugcuucucuacaga

SEQ ID NO: 3434066 - RNA, 17 nt, Human
cagugcuugccacagag

SEQ ID NO: 3434067 - RNA, 17 nt, Human
cagugcuuggcccagga

SEQ ID NO: 3434068 - RNA, 18 nt, Human
cagugcuuggcccaggag

SEQ ID NO: 3434069 - RNA, 19 nt, Human
cagugcuuggcccaggagu

SEQ ID NO: 3434070 - RNA, 20 nt, Human
cagugcuuuuaagugaaaau

SEQ ID NO: 3434071 - RNA, 18 nt, Human
caguggaaccguugccaa

SEQ ID NO: 3434072 - RNA, 13 nt, Human
caguggacaccag

SEQ ID NO: 3434073 - RNA, 22 nt, Human
caguggacaccaggagucccug

SEQ ID NO: 3434074 - RNA, 21 nt, Human
caguggaccgcccuuuucccc

SEQ ID NO: 3434075 - RNA, 22 nt, Human
caguggaccgcccuuuuccccu

SEQ ID NO: 3434076 - RNA, 19 nt, Human
caguggacuuuccaccccc

SEQ ID NO: 3434077 - RNA, 13 nt, Human
cagggguugcagu

SEQ ID NO: 3434078 - RNA, 22 nt, Human
cagggguugcagugagcggaga

SEQ ID NO: 3434079 - RNA, 21 nt, Human
caggguaacugugcugaaugc

SEQ ID NO: 3434080 - RNA, 14 nt, Human
caggguagaaaaag

SEQ ID NO: 3434081 - RNA, 19 nt, Human
caggguagaaaaaggagcu

SEQ ID NO: 3434082 - RNA, 16 nt, Human
caggguaggcuggagu

SEQ ID NO: 3434083 - RNA, 13 nt, Human
caggguaugaaga

SEQ ID NO: 3434084 - RNA, 17 nt, Human
caggguaugaagagugu

SEQ ID NO: 3434085 - RNA, 18 nt, Human
cauaggucacuggcucuc

SEQ ID NO: 3434086 - RNA, 21 nt, Human
cauaggucugaaauuuuucuu

SEQ ID NO: 3434087 - RNA, 22 nt, Human
cauagguucacaccauuuuguu

SEQ ID NO: 3434088 - RNA, 21 nt, Human
cauaguaacuucuuauggaau

SEQ ID NO: 3434089 - RNA, 21 nt, Human
cauaguaaguucagcacuugu

SEQ ID NO: 3434090 - RNA, 16 nt, Human
cauaguaccauuuaua

SEQ ID NO: 3434091 - RNA, 20 nt, Human
cauaguaccauuuauacaaa

SEQ ID NO: 3434092 - RNA, 22 nt, Human
cauaguaccauuuauacaaauu

SEQ ID NO: 3434093 - RNA, 20 nt, Human
cauaguaguaugaugauaca

SEQ ID NO: 3434094 - RNA, 17 nt, Human
cauaguaguuuuuacag

SEQ ID NO: 3434095 - RNA, 17 nt, Human
cauaguauauuaaaaau

SEQ ID NO: 3434096 - RNA, 16 nt, Human
cauaguaugguggcug

SEQ ID NO: 3434097 - RNA, 18 nt, Human
cauaguauucaugacuau

SEQ ID NO: 3434098 - RNA, 18 nt, Human
cauaguauuccauugugu

SEQ ID NO: 3434099 - RNA, 18 nt, Human
cauagugaccggcugcuu

SEQ ID NO: 3434100 - RNA, 22 nt, Human
cauagugaccggcugcuuuucc

SEQ ID NO: 3434101 - RNA, 21 nt, Human
cauagugagaccccugucucc

SEQ ID NO: 3434102 - RNA, 18 nt, Human
cauagugaugguuccccu

SEQ ID NO: 3434103 - RNA, 19 nt, Human
cauagugaugguuccccug

SEQ ID NO: 3434104 - RNA, 19 nt, Human
cauagugcauuguuucugu

SEQ ID NO: 3434105 - RNA, 19 nt, Human
cauagugcuaacaugaaga

SEQ ID NO: 3434106 - RNA, 19 nt, Human
cauaguggugggcaccuau

SEQ ID NO: 3434107 - RNA, 15 nt, Human
cauaguuacuguaaa

SEQ ID NO: 3434108 - RNA, 21 nt, Human
cauaguuacuguaaaaugcaa

SEQ ID NO: 3434109 - RNA, 13 nt, Human
cauaguuacugug

SEQ ID NO: 3434110 - RNA, 16 nt, Human
cauaguuacuguguaa

SEQ ID NO: 3434111 - RNA, 12 nt, Human
cauaguucagaa

SEQ ID NO: 3434112 - RNA, 21 nt, Human
cauaguucugagcugccagug

SEQ ID NO: 3434113 - RNA, 21 nt, Human
cauaguuguagacaaaguaca

SEQ ID NO: 3434114 - RNA, 14 nt, Human
cauaguuuggcauu

SEQ ID NO: 3434115 - RNA, 15 nt, Human
cauaguuuggcauuu

SEQ ID NO: 3434116 - RNA, 14 nt, Human
cauaguuuuaaacu

SEQ ID NO: 3434117 - RNA, 18 nt, Human
cauaguuuuaaacucauu

SEQ ID NO: 3434118 - RNA, 16 nt, Human
cauaguuuuucagucu

SEQ ID NO: 3434119 - RNA, 15 nt, Human
cauauaaaauaaugc

SEQ ID NO: 3434120 - RNA, 21 nt, Human
cauauaaaauaaugcaaagaa

SEQ ID NO: 3434121 - RNA, 19 nt, Human
cauauaaacaucacacaca

SEQ ID NO: 3434122 - RNA, 20 nt, Human
cauauaaauagaauguaaau

SEQ ID NO: 3434123 - RNA, 17 nt, Human
cauauaaauugucuuaa

SEQ ID NO: 3434124 - RNA, 20 nt, Human
cauauaacuuauauuguaag

SEQ ID NO: 3434125 - RNA, 23 nt, Human
cauauaacuuauauuguaagaaa

SEQ ID NO: 3434126 - RNA, 20 nt, Human
cauauaagacaaauauuccu

SEQ ID NO: 3434127 - RNA, 19 nt, Human
cauauaagggaaguaguua

SEQ ID NO: 3434128 - RNA, 15 nt, Human
cauauaaguuugaag

SEQ ID NO: 3434129 - RNA, 22 nt, Human
cauauaaguuugaaggaaacag

SEQ ID NO: 3434130 - RNA, 14 nt, Human
cauauaauauaugu

SEQ ID NO: 3434131 - RNA, 16 nt, Human
cauauaauauauguuu

SEQ ID NO: 3434132 - RNA, 19 nt, Human
cauauaauauauguuuuaa

SEQ ID NO: 3434133 - RNA, 14 nt, Human
cauauaaugaauaa

SEQ ID NO: 3434134 - RNA, 16 nt, Human
cauauaaugaauaaau

SEQ ID NO: 3434135 - RNA, 18 nt, Human
cauauacaacaccaaaaa

SEQ ID NO: 3434136 - RNA, 22 nt, Human
cauauacaacaccaaaaaauau

SEQ ID NO: 3434137 - RNA, 23 nt, Human
cauauacaacaccaaaaaauauc

SEQ ID NO: 3434138 - RNA, 13 nt, Human
cauauacacacac

SEQ ID NO: 3434139 - RNA, 15 nt, Human
cauauacacacacac

SEQ ID NO: 3434140 - RNA, 17 nt, Human
cauauacagcucagaag

SEQ ID NO: 3434141 - RNA, 15 nt, Human
cauauaccuauaaug

SEQ ID NO: 3434142 - RNA, 18 nt, Human
cauauaccuauaaugugu

SEQ ID NO: 3434143 - RNA, 21 nt, Human
cauauaccuauaaugugugua

SEQ ID NO: 3434144 - RNA, 22 nt, Human
cauauaccuauaauguguguau

SEQ ID NO: 3434145 - RNA, 18 nt, Human
cauauacuguucuucauu

SEQ ID NO: 3434146 - RNA, 21 nt, Human
cauauacuguucuucauuuua

SEQ ID NO: 3434147 - RNA, 19 nt, Human
cauauagccauugaucaua

SEQ ID NO: 3434148 - RNA, 14 nt, Human
cauauaguguacag

SEQ ID NO: 3434149 - RNA, 13 nt, Human
cauauauaacaau

SEQ ID NO: 3434150 - RNA, 19 nt, Human
cauauauaacagauacauu

SEQ ID NO: 3434151 - RNA, 20 nt, Human
cauauauacacacacaaaga

SEQ ID NO: 3434152 - RNA, 21 nt, Human
cauauauagacagcuuugacu

SEQ ID NO: 3434153 - RNA, 17 nt, Human
cauauauauacuauuaa

SEQ ID NO: 3434154 - RNA, 11 nt, Human
cauauauauau

SEQ ID NO: 3434155 - RNA, 13 nt, Human
cauauauauaugu

SEQ ID NO: 3434156 - RNA, 17 nt, Human
cauauauaucuaucuua

SEQ ID NO: 3434157 - RNA, 17 nt, Human
cauauaugaggacuugu

SEQ ID NO: 3434158 - RNA, 21 nt, Human
cauauauguguccauuuccuu

SEQ ID NO: 3434159 - RNA, 22 nt, Human
cauauauuggguuccauucuca

SEQ ID NO: 3434160 - RNA, 13 nt, Human
cauauauuuguau

SEQ ID NO: 3434161 - RNA, 21 nt, Human
cauauauuuuuauauuuacua

SEQ ID NO: 3434162 - RNA, 14 nt, Human
cauaucacacacau

SEQ ID NO: 3434163 - RNA, 17 nt, Human
cauaucauccacacaug

SEQ ID NO: 3434164 - RNA, 20 nt, Human
cauaucauccacacaugaau

SEQ ID NO: 3434165 - RNA, 18 nt, Human
cauauccauagugacuuu

SEQ ID NO: 3434166 - RNA, 18 nt, Human
cauauccccucucccccc

SEQ ID NO: 3434167 - RNA, 13 nt, Human
cauaucccuucca

SEQ ID NO: 3434168 - RNA, 17 nt, Human
cauaucccuuccagaug

SEQ ID NO: 3434169 - RNA, 17 nt, Human
cauauccguauauaucc

SEQ ID NO: 3434170 - RNA, 15 nt, Human
cauauccugagccau

SEQ ID NO: 3434171 - RNA, 11 nt, Human
cauauccugcc

SEQ ID NO: 3434172 - RNA, 14 nt, Human
cauauccugccuca

SEQ ID NO: 3434173 - RNA, 22 nt, Human
cauauccuggugccccccaccc

SEQ ID NO: 3434174 - RNA, 18 nt, Human
cauaucggcucacaaaga

SEQ ID NO: 3434175 - RNA, 11 nt, Human
cauaucuaacc

SEQ ID NO: 3434176 - RNA, 20 nt, Human
cauaucucuuaucuuacgaa

SEQ ID NO: 3434177 - RNA, 20 nt, Human
cauaucuuaaagaaacagcu

SEQ ID NO: 3434178 - RNA, 23 nt, Human
cauaucuuaaagaaacagcuuuc

SEQ ID NO: 3434179 - RNA, 22 nt, Human
cauaucuugcgaauccaagcuc

SEQ ID NO: 3434180 - RNA, 23 nt, Human
cauaucuugcgaauccaagcucc

SEQ ID NO: 3434181 - RNA, 14 nt, Human
cauaucuuuauuaa

SEQ ID NO: 3434182 - RNA, 11 nt, Human
cauaugaaaaa

SEQ ID NO: 3434183 - RNA, 22 nt, Human
cauaugaaaaaaaugcauuuua

SEQ ID NO: 3434184 - RNA, 16 nt, Human
cauaugaaaggugcca

SEQ ID NO: 3434185 - RNA, 13 nt, Human
cauaugaaauccu

SEQ ID NO: 3434186 - RNA, 19 nt, Human
cauaugacauucaugccug

SEQ ID NO: 3434187 - RNA, 21 nt, Human
cauaugacauucaugccuggc

SEQ ID NO: 3434188 - RNA, 17 nt, Human
cauaugaguguggaagc

SEQ ID NO: 3434189 - RNA, 15 nt, Human
cauaugaucugucug

SEQ ID NO: 3434190 - RNA, 21 nt, Human
cauaugauguacauguacuga

SEQ ID NO: 3434191 - RNA, 16 nt, Human
cauaugcaccuugugu

SEQ ID NO: 3434192 - RNA, 18 nt, Human
cauaugcaccuugugucu

SEQ ID NO: 3434193 - RNA, 19 nt, Human
cauaugcaccuugugucug

SEQ ID NO: 3434194 - RNA, 23 nt, Human
cauaugcaccuugugucuguaca

SEQ ID NO: 3434195 - RNA, 22 nt, Human
cauaugccugggcagaaggaag

SEQ ID NO: 3434196 - RNA, 17 nt, Human
cauaugcuaccaccagc

SEQ ID NO: 3434197 - RNA, 18 nt, Human
cauaugcuaccaccagcu

SEQ ID NO: 3434198 - RNA, 20 nt, Human
cauaugcuaccaccagcugu

SEQ ID NO: 3434199 - RNA, 15 nt, Human
cauaugcuucuuuaa

SEQ ID NO: 3434200 - RNA, 15 nt, Human
cauauggacucugca

SEQ ID NO: 3434201 - RNA, 17 nt, Human
cauauggacucugcaca

SEQ ID NO: 3434202 - RNA, 20 nt, Human
cauauggacucugcacauga

SEQ ID NO: 3434203 - RNA, 18 nt, Human
cauauggauccacuggcu

SEQ ID NO: 3434204 - RNA, 15 nt, Human
cauauggcccagugu

SEQ ID NO: 3434205 - RNA, 17 nt, Human
cauauggguuagauguu

SEQ ID NO: 3434206 - RNA, 15 nt, Human
cauauguacauaaau

SEQ ID NO: 3434207 - RNA, 16 nt, Human
cauauguacauaaauu

SEQ ID NO: 3434208 - RNA, 20 nt, Human
cauauguagacuauauacau

SEQ ID NO: 3434209 - RNA, 17 nt, Human
cauauguauuccugauc

SEQ ID NO: 3434210 - RNA, 18 nt, Human
cauauguuaagcagcuaa

SEQ ID NO: 3434211 - RNA, 17 nt, Human
cauauguugaauacuuu

SEQ ID NO: 3434212 - RNA, 19 nt, Human
cauauuaagaaugaucuga

SEQ ID NO: 3434213 - RNA, 21 nt, Human
cauauuaaguaagucucaagg

SEQ ID NO: 3434214 - RNA, 19 nt, Human
cauauuacaauauuugugu

SEQ ID NO: 3434215 - RNA, 16 nt, Human
cauauuaccacagaca

SEQ ID NO: 3434216 - RNA, 22 nt, Human
cauauuaccacagacauacuaa

SEQ ID NO: 3434217 - RNA, 19 nt, Human
cauauuacuguacauggga

SEQ ID NO: 3434218 - RNA, 12 nt, Human
cauauuagaaaa

SEQ ID NO: 3434219 - RNA, 19 nt, Human
cauauuagaaaacuuuguu

SEQ ID NO: 3434220 - RNA, 16 nt, Human
cauccucaaacacugc

SEQ ID NO: 3434221 - RNA, 19 nt, Human
cauccucaaacacugcagg

SEQ ID NO: 3434222 - RNA, 19 nt, Human
cauccucagaugcucaaag

SEQ ID NO: 3434223 - RNA, 15 nt, Human
cauccucauacccac

SEQ ID NO: 3434224 - RNA, 14 nt, Human
cauccuccaagaau

SEQ ID NO: 3434225 - RNA, 12 nt, Human
cauccuccagcc

SEQ ID NO: 3434226 - RNA, 14 nt, Human
cauccuccagcuuc

SEQ ID NO: 3434227 - RNA, 13 nt, Human
cauccuccccuuc

SEQ ID NO: 3434228 - RNA, 14 nt, Human
cauccuccccuucc

SEQ ID NO: 3434229 - RNA, 19 nt, Human
cauccuccccuucccugca

SEQ ID NO: 3434230 - RNA, 20 nt, Human
cauccuccgccucccggguu

SEQ ID NO: 3434231 - RNA, 20 nt, Human
cauccuccguccagccgcca

SEQ ID NO: 3434232 - RNA, 11 nt, Human
cauccuccuca

SEQ ID NO: 3434233 - RNA, 12 nt, Human
cauccuccucag

SEQ ID NO: 3434234 - RNA, 13 nt, Human
cauccuccuccca

SEQ ID NO: 3434235 - RNA, 17 nt, Human
cauccuccuccuuccua

SEQ ID NO: 3434236 - RNA, 16 nt, Human
cauccuccuggaaccu

SEQ ID NO: 3434237 - RNA, 23 nt, Human
cauccuccuggaaccuugcuguc

SEQ ID NO: 3434238 - RNA, 11 nt, Human
cauccucucca

SEQ ID NO: 3434239 - RNA, 17 nt, Human
cauccucuggagccagc

SEQ ID NO: 3434240 - RNA, 20 nt, Human
cauccucuuccauauggauc

SEQ ID NO: 3434241 - RNA, 20 nt, Human
cauccucuuucucuuuucua

SEQ ID NO: 3434242 - RNA, 15 nt, Human
cauccugaacagcau

SEQ ID NO: 3434243 - RNA, 16 nt, Human
cauccugacucugccc

SEQ ID NO: 3434244 - RNA, 12 nt, Human
cauccugagccc

SEQ ID NO: 3434245 - RNA, 20 nt, Human
cauccugagccccgcccucu

SEQ ID NO: 3434246 - RNA, 16 nt, Human
cauccugccuucaugg

SEQ ID NO: 3434247 - RNA, 12 nt, Human
cauccuggaaua

SEQ ID NO: 3434248 - RNA, 15 nt, Human
cauccuggcacccgg

SEQ ID NO: 3434249 - RNA, 22 nt, Human
cauccuggcacccggccccugc

SEQ ID NO: 3434250 - RNA, 23 nt, Human
cauccuggcacccggccccugcu

SEQ ID NO: 3434251 - RNA, 16 nt, Human
cauccuggcccaucag

SEQ ID NO: 3434252 - RNA, 23 nt, Human
cauccuggccuggcacaucagaa

SEQ ID NO: 3434253 - RNA, 11 nt, Human
cauccuggcug

SEQ ID NO: 3434254 - RNA, 13 nt, Human
caacaucuuuucu

SEQ ID NO: 3434255 - RNA, 15 nt, Human
caacaugcacugaug

SEQ ID NO: 3434256 - RNA, 22 nt, Human
caacaugcuucaugaaaauccu

SEQ ID NO: 3434257 - RNA, 15 nt, Human
caacauggugucugg

SEQ ID NO: 3434258 - RNA, 16 nt, Human
caacauggugucugga

SEQ ID NO: 3434259 - RNA, 20 nt, Human
caacauguagcugaguuuaa

SEQ ID NO: 3434260 - RNA, 23 nt, Human
caacauguauaauauuuuuaauu

SEQ ID NO: 3434261 - RNA, 17 nt, Human
caacauguggcuccucc

SEQ ID NO: 3434262 - RNA, 18 nt, Human
caacauguggcuccuccc

SEQ ID NO: 3434263 - RNA, 21 nt, Human
caacauguggcuccucccagc

SEQ ID NO: 3434264 - RNA, 21 nt, Human
caacauguguacuuaauuucu

SEQ ID NO: 3434265 - RNA, 18 nt, Human
caacauguuacugaccag

SEQ ID NO: 3434266 - RNA, 15 nt, Human
caacauguuauuugu

SEQ ID NO: 3434267 - RNA, 22 nt, Human
caacauugcuggcuggaaggga

SEQ ID NO: 3434268 - RNA, 22 nt, Human
caacauuucuauagccaaaaau

SEQ ID NO: 3434269 - RNA, 14 nt, Human
caacauuucucaau

SEQ ID NO: 3434270 - RNA, 16 nt, Human
caacauuucucaauaa

SEQ ID NO: 3434271 - RNA, 21 nt, Human
caacauuuugagaacaaagau

SEQ ID NO: 3434272 - RNA, 22 nt, Human
caaccaagaauguuaugugcaa

SEQ ID NO: 3434273 - RNA, 20 nt, Human
caaccaagucaugugcauuu

SEQ ID NO: 3434274 - RNA, 13 nt, Human
caaccacaaaacu

SEQ ID NO: 3434275 - RNA, 16 nt, Human
caaccaccuuucagau

SEQ ID NO: 3434276 - RNA, 21 nt, Human
caaccacuaagaauucaaacu

SEQ ID NO: 3434277 - RNA, 17 nt, Human
caaccacuguaaaauga

SEQ ID NO: 3434278 - RNA, 21 nt, Human
caaccacuguaaaaugaaauu

SEQ ID NO: 3434279 - RNA, 12 nt, Human
caaccagaccug

SEQ ID NO: 3434280 - RNA, 22 nt, Human
caaccagcaucccuugaccagg

SEQ ID NO: 3434281 - RNA, 15 nt, Human
caaccagcuaagaaa

SEQ ID NO: 3434282 - RNA, 17 nt, Human
caaccagggagcugcag

SEQ ID NO: 3434283 - RNA, 14 nt, Human
caaccauccaauua

SEQ ID NO: 3434284 - RNA, 15 nt, Human
caaccauggacuuua

SEQ ID NO: 3434285 - RNA, 22 nt, Human
caaccaugucauuucagaaguu

SEQ ID NO: 3434286 - RNA, 22 nt, Human
caaccauuauaaccuuaauuua

SEQ ID NO: 3434287 - RNA, 13 nt, Human
caaccauuccaga

SEQ ID NO: 3434288 - RNA, 16 nt, Human
caaccauuccagacug

SEQ ID NO: 3434289 - RNA, 14 nt, Human
caaccauuccccau

SEQ ID NO: 3434290 - RNA, 13 nt, Human
caaccauuuccuc

SEQ ID NO: 3434291 - RNA, 17 nt, Human
caacccaaaccuggaga

SEQ ID NO: 3434292 - RNA, 16 nt, Human
caacccagccgcugcc

SEQ ID NO: 3434293 - RNA, 17 nt, Human
caacccagccgcugccc

SEQ ID NO: 3434294 - RNA, 22 nt, Human
caacccaggagcauccaccucc

SEQ ID NO: 3434295 - RNA, 19 nt, Human
caacccaucuaccccugga

SEQ ID NO: 3434296 - RNA, 17 nt, Human
caaccccaagccagccc

SEQ ID NO: 3434297 - RNA, 14 nt, Human
caacccccacccca

SEQ ID NO: 3434298 - RNA, 13 nt, Human
caacccccagcac

SEQ ID NO: 3434299 - RNA, 15 nt, Human
caaccccccagcacu

SEQ ID NO: 3434300 - RNA, 19 nt, Human
caaccccccagcacugagg

SEQ ID NO: 3434301 - RNA, 17 nt, Human
caaccccucgcccaguc

SEQ ID NO: 3434302 - RNA, 21 nt, Human
caaccccucgcccagucccag

SEQ ID NO: 3434303 - RNA, 22 nt, Human
caaccccuguggagcccgcacc

SEQ ID NO: 3434304 - RNA, 20 nt, Human
caaccccuuaagcccuggcc

SEQ ID NO: 3434305 - RNA, 21 nt, Human
caaccccuuaagcccuggccc

SEQ ID NO: 3434306 - RNA, 19 nt, Human
caaccccuucgcuccugug

SEQ ID NO: 3434307 - RNA, 21 nt, Human
caaccccuucgcuccuguguc

SEQ ID NO: 3434308 - RNA, 22 nt, Human
caacccgucuggcccaccaggg

SEQ ID NO: 3434309 - RNA, 16 nt, Human
caacccgugccaaguc

SEQ ID NO: 3434310 - RNA, 23 nt, Human
caacccgugccaaguccaggucc

SEQ ID NO: 3434311 - RNA, 16 nt, Human
caacccguggaggcug

SEQ ID NO: 3434312 - RNA, 18 nt, Human
caacccguggaggcugcu

SEQ ID NO: 3434313 - RNA, 20 nt, Human
caacccuaucuccugacaga

SEQ ID NO: 3434314 - RNA, 21 nt, Human
caacccucagagccaccccua

SEQ ID NO: 3434315 - RNA, 11 nt, Human
caacccucagg

SEQ ID NO: 3434316 - RNA, 14 nt, Human
caacccucccucag

SEQ ID NO: 3434317 - RNA, 19 nt, Human
caacccucccucagccccu

SEQ ID NO: 3434318 - RNA, 20 nt, Human
caacccucccucagccccuc

SEQ ID NO: 3434319 - RNA, 22 nt, Human
caacccuccuaucaccuccccu

SEQ ID NO: 3434320 - RNA, 13 nt, Human
caacccugccccu

SEQ ID NO: 3434321 - RNA, 23 nt, Human
caacccuggagaguucaauggcu

SEQ ID NO: 3434322 - RNA, 11 nt, Human
caacccugucu

SEQ ID NO: 3434323 - RNA, 12 nt, Human
caacccugucug

SEQ ID NO: 3434324 - RNA, 17 nt, Human
caacccuguuuccugag

SEQ ID NO: 3434325 - RNA, 17 nt, Human
caacccuguuuuauacu

SEQ ID NO: 3434326 - RNA, 19 nt, Human
caacccuguuuuauacugu

SEQ ID NO: 3434327 - RNA, 15 nt, Human
caacccuuaccccuu

SEQ ID NO: 3434328 - RNA, 20 nt, Human
caacccuuaccccuuagccu

SEQ ID NO: 3434329 - RNA, 18 nt, Human
caacccuucccucaccuu

SEQ ID NO: 3434330 - RNA, 21 nt, Human
caaccgcuucccuauuuauuu

SEQ ID NO: 3434331 - RNA, 15 nt, Human
caaccguggcccuuc

SEQ ID NO: 3434332 - RNA, 22 nt, Human
caaccguggcccuuccuggaca

SEQ ID NO: 3434333 - RNA, 13 nt, Human
caaccuaaauuug

SEQ ID NO: 3434334 - RNA, 18 nt, Human
caaccuaccaccccuucc

SEQ ID NO: 3434335 - RNA, 21 nt, Human
caaccuaccaccccuuccugu

SEQ ID NO: 3434336 - RNA, 18 nt, Human
caaccucaacugccuacu

SEQ ID NO: 3434337 - RNA, 17 nt, Human
caaccucagggcuccca

SEQ ID NO: 3434338 - RNA, 18 nt, Human
caaccucagggcucccag

SEQ ID NO: 3434339 - RNA, 19 nt, Human
caaccucagggcucccagg

SEQ ID NO: 3434340 - RNA, 18 nt, Human
caaccucaguaauuuaga

SEQ ID NO: 3434341 - RNA, 18 nt, Human
caaccucauccuccuucu

SEQ ID NO: 3434342 - RNA, 14 nt, Human
caaccuccaccucc

SEQ ID NO: 3434343 - RNA, 16 nt, Human
caaccucccaacccag

SEQ ID NO: 3434344 - RNA, 16 nt, Human
caaccucccucuuguu

SEQ ID NO: 3434345 - RNA, 19 nt, Human
caaccucccucuuguuuug

SEQ ID NO: 3434346 - RNA, 15 nt, Human
caaccuccugggcua

SEQ ID NO: 3434347 - RNA, 13 nt, Human
caaccucgcucca

SEQ ID NO: 3434348 - RNA, 21 nt, Human
caaccucgcuccaacuccaac

SEQ ID NO: 3434349 - RNA, 18 nt, Human
caaccucuucuggcucaa

SEQ ID NO: 3434350 - RNA, 16 nt, Human
caaccugaaccuagga

SEQ ID NO: 3434351 - RNA, 24 nt, Human
caaccugaauacccuuuucugacc

SEQ ID NO: 3434352 - RNA, 20 nt, Human
caaccugaccaacauggaga

SEQ ID NO: 3434353 - RNA, 17 nt, Human
caaccugauugugucuc

SEQ ID NO: 3434354 - RNA, 15 nt, Human
caaccugcucuccuc

SEQ ID NO: 3434355 - RNA, 18 nt, Human
caaccugcucuccucuug

SEQ ID NO: 3434356 - RNA, 11 nt, Human
caaccuggaga

SEQ ID NO: 3434357 - RNA, 14 nt, Human
caaccuggguccaa

SEQ ID NO: 3434358 - RNA, 18 nt, Human
caaccuggguccaaauaa

SEQ ID NO: 3434359 - RNA, 19 nt, Human
caaccuggguccaaauaaa

SEQ ID NO: 3434360 - RNA, 21 nt, Human
caaccuguaaauuauuuuaaa

SEQ ID NO: 3434361 - RNA, 14 nt, Human
caaccugugaucaa

SEQ ID NO: 3434362 - RNA, 20 nt, Human
caaccuguuaccuacuuuga

SEQ ID NO: 3434363 - RNA, 20 nt, Human
caaccuguucugcuuuccuc

SEQ ID NO: 3434364 - RNA, 23 nt, Human
caaccuuacuuacagcauaaggg

SEQ ID NO: 3434365 - RNA, 19 nt, Human
caaggccgaagcucuggcu

SEQ ID NO: 3434366 - RNA, 21 nt, Human
caaggccgaagcucuggcuga

SEQ ID NO: 3434367 - RNA, 19 nt, Human
caaggccgcuguucaccca

SEQ ID NO: 3434368 - RNA, 13 nt, Human
caaggccucccac

SEQ ID NO: 3434369 - RNA, 14 nt, Human
caaggccucccaca

SEQ ID NO: 3434370 - RNA, 16 nt, Human
caaggccugcucccug

SEQ ID NO: 3434371 - RNA, 21 nt, Human
caaggccugguguuucuugau

SEQ ID NO: 3434372 - RNA, 12 nt, Human
caaggccuuaag

SEQ ID NO: 3434373 - RNA, 18 nt, Human
caaggccuuccccuggca

SEQ ID NO: 3434374 - RNA, 15 nt, Human
caaggccuuucugug

SEQ ID NO: 3434375 - RNA, 15 nt, Human
caaggcgcuaacuug

SEQ ID NO: 3434376 - RNA, 13 nt, Human
caaggcggccccu

SEQ ID NO: 3434377 - RNA, 14 nt, Human
caaggcggccccuc

SEQ ID NO: 3434378 - RNA, 16 nt, Human
caaggcggccccuccc

SEQ ID NO: 3434379 - RNA, 19 nt, Human
caaggcgggagcaucucuu

SEQ ID NO: 3434380 - RNA, 13 nt, Human
caaggcggugcuu

SEQ ID NO: 3434381 - RNA, 16 nt, Human
caaggcggugcuugau

SEQ ID NO: 3434382 - RNA, 21 nt, Human
caaggcgguggacuugaacuu

SEQ ID NO: 3434383 - RNA, 19 nt, Human
caaggcuagaucaugaaga

SEQ ID NO: 3434384 - RNA, 14 nt, Human
caaggcuaugugau

SEQ ID NO: 3434385 - RNA, 19 nt, Human
caaggcuccugaucauucu

SEQ ID NO: 3434386 - RNA, 20 nt, Human
caaggcugaccaagagagaa

SEQ ID NO: 3434387 - RNA, 17 nt, Human
caaggcugauuaaacca

SEQ ID NO: 3434388 - RNA, 15 nt, Human
caaggcugcagugag

SEQ ID NO: 3434389 - RNA, 22 nt, Human
caaggcugcagugagccgagau

SEQ ID NO: 3434390 - RNA, 13 nt, Human
caaggcuggcagg

SEQ ID NO: 3434391 - RNA, 17 nt, Human
caaggcugugcucccug

SEQ ID NO: 3434392 - RNA, 15 nt, Human
caaggcuguggacca

SEQ ID NO: 3434393 - RNA, 22 nt, Human
caaggcuuagacccucaugcug

SEQ ID NO: 3434394 - RNA, 17 nt, Human
caaggcuuauauucaac

SEQ ID NO: 3434395 - RNA, 15 nt, Human
caaggcuucagucuc

SEQ ID NO: 3434396 - RNA, 15 nt, Human
caaggcuuucucuac

SEQ ID NO: 3434397 - RNA, 12 nt, Human
caagggaaaggg

SEQ ID NO: 3434398 - RNA, 16 nt, Human
caagggaaaggggugc

SEQ ID NO: 3434399 - RNA, 20 nt, Human
caagggaaaggggugcuuuu

SEQ ID NO: 3434400 - RNA, 16 nt, Human
caagggaaccuguguc

SEQ ID NO: 3434401 - RNA, 18 nt, Human
caagggaauguaacugcu

SEQ ID NO: 3434402 - RNA, 14 nt, Human
caagggaggcccag

SEQ ID NO: 3434403 - RNA, 14 nt, Human
caagggaggcugcu

SEQ ID NO: 3434404 - RNA, 17 nt, Human
caagggaggcugcugcu

SEQ ID NO: 3434405 - RNA, 19 nt, Human
caagggcaaaaagucuaca

SEQ ID NO: 3434406 - RNA, 17 nt, Human
caagggcaaaauuccca

SEQ ID NO: 3434407 - RNA, 14 nt, Human
caagggcagaaagu

SEQ ID NO: 3434408 - RNA, 20 nt, Human
caagggccaugcugaaggga

SEQ ID NO: 3434409 - RNA, 15 nt, Human
caagggccuggccug

SEQ ID NO: 3434410 - RNA, 16 nt, Human
caagggcgcaagagua

SEQ ID NO: 3434411 - RNA, 14 nt, Human
caagggcuccccac

SEQ ID NO: 3434412 - RNA, 17 nt, Human
caagggcuccccacugc

SEQ ID NO: 3434413 - RNA, 19 nt, Human
caagggcuccccacugccu

SEQ ID NO: 3434414 - RNA, 21 nt, Human
caagggcuuacacguggagga

SEQ ID NO: 3434415 - RNA, 18 nt, Human
caagggcuucugcacccu

SEQ ID NO: 3434416 - RNA, 23 nt, Human
caaggggaauguuugccucugcc

SEQ ID NO: 3434417 - RNA, 18 nt, Human
caaggggcagucuggagg

SEQ ID NO: 3434418 - RNA, 19 nt, Human
caaggggcagucuggaggg

SEQ ID NO: 3434419 - RNA, 18 nt, Human
caaggggcccaaauucuu

SEQ ID NO: 3434420 - RNA, 14 nt, Human
caaggggccugagc

SEQ ID NO: 3434421 - RNA, 22 nt, Human
caaggggcuucagguccaggcu

SEQ ID NO: 3434422 - RNA, 18 nt, Human
caagggucaggccuuuga

SEQ ID NO: 3434423 - RNA, 16 nt, Human
caagggucuagggaga

SEQ ID NO: 3434424 - RNA, 18 nt, Human
caaggguuaaggccugaa

SEQ ID NO: 3434425 - RNA, 15 nt, Human
caagguaaaauucua

SEQ ID NO: 3434426 - RNA, 17 nt, Human
caagguaaaauucuaaa

SEQ ID NO: 3434427 - RNA, 22 nt, Human
caagguaauuucuugugccucu

SEQ ID NO: 3434428 - RNA, 14 nt, Human
caagguacucuggu

SEQ ID NO: 3434429 - RNA, 16 nt, Human
caagguacucugguga

SEQ ID NO: 3434430 - RNA, 20 nt, Human
caagguagaaugaccuugua

SEQ ID NO: 3434431 - RNA, 16 nt, Human
caagguagcccuggcc

SEQ ID NO: 3434432 - RNA, 21 nt, Human
caagguagcccuggccagagg

SEQ ID NO: 3434433 - RNA, 23 nt, Human
caagguaggguaggcagccugag

SEQ ID NO: 3434434 - RNA, 19 nt, Human
caaggucacuguuuccugg

SEQ ID NO: 3434435 - RNA, 22 nt, Human
caaggucauggccacacuguga

SEQ ID NO: 3434436 - RNA, 23 nt, Human
caaggucauggccacacugugac

SEQ ID NO: 3434437 - RNA, 15 nt, Human
caaggucauuucuuc

SEQ ID NO: 3434438 - RNA, 14 nt, Human
caaggucuuugguu

SEQ ID NO: 3434439 - RNA, 21 nt, Human
caaggugacagaaggaccagc

SEQ ID NO: 3434440 - RNA, 14 nt, Human
caagguggagugga

SEQ ID NO: 3434441 - RNA, 21 nt, Human
caagguggaguggaugccuca

SEQ ID NO: 3434442 - RNA, 22 nt, Human
caaggugggccuugcuaccuca

SEQ ID NO: 3434443 - RNA, 12 nt, Human
caaggugggcug

SEQ ID NO: 3434444 - RNA, 16 nt, Human
caaggugggcugagcc

SEQ ID NO: 3434445 - RNA, 19 nt, Human
caaggugggcugagcccug

SEQ ID NO: 3434446 - RNA, 23 nt, Human
caagguggucugcucgggcccag

SEQ ID NO: 3434447 - RNA, 20 nt, Human
caagguguccuacagaaaaa

SEQ ID NO: 3434448 - RNA, 21 nt, Human
caagguuauaauuuuuuuuaa

SEQ ID NO: 3434449 - RNA, 17 nt, Human
caagguuauaugaauau

SEQ ID NO: 3434450 - RNA, 21 nt, Human
caagguuauaugcacuuucuc

SEQ ID NO: 3434451 - RNA, 16 nt, Human
caagguuccacagagu

SEQ ID NO: 3434452 - RNA, 13 nt, Human
caagguucugggu

SEQ ID NO: 3434453 - RNA, 13 nt, Human
caagguuggagcc

SEQ ID NO: 3434454 - RNA, 14 nt, Human
caagguuggagccc

SEQ ID NO: 3434455 - RNA, 22 nt, Human
caagguuuaaacuucucugaag

SEQ ID NO: 3434456 - RNA, 21 nt, Human
caagguuuaaagagucuagau

SEQ ID NO: 3434457 - RNA, 22 nt, Human
caagguuuaaagagucuagauu

SEQ ID NO: 3434458 - RNA, 17 nt, Human
caagguuuaaguuauua

SEQ ID NO: 3434459 - RNA, 17 nt, Human
caagguuuaggcuggug

SEQ ID NO: 3434460 - RNA, 14 nt, Human
caaguaacaaaaau

SEQ ID NO: 3434461 - RNA, 14 nt, Human
caaguaagaagaca

SEQ ID NO: 3434462 - RNA, 20 nt, Human
caaguaagagacucagccug

SEQ ID NO: 3434463 - RNA, 21 nt, Human
caaguaagagacucagccugc

SEQ ID NO: 3434464 - RNA, 15 nt, Human
caaguaagaggcugg

SEQ ID NO: 3434465 - RNA, 19 nt, Human
caguggugcgaucuggguu

SEQ ID NO: 3434466 - RNA, 19 nt, Human
caguggugguuuucuguuc

SEQ ID NO: 3434467 - RNA, 13 nt, Human
cagugguugcugu

SEQ ID NO: 3434468 - RNA, 14 nt, Human
cagugguugcuguu

SEQ ID NO: 3434469 - RNA, 22 nt, Human
cagugguuugagacacugguuu

SEQ ID NO: 3434470 - RNA, 15 nt, Human
caguguaaagugugu

SEQ ID NO: 3434471 - RNA, 17 nt, Human
caguguaaauaguuacu

SEQ ID NO: 3434472 - RNA, 19 nt, Human
caguguaaauaguuacucc

SEQ ID NO: 3434473 - RNA, 16 nt, Human
caguguaauuucuuug

SEQ ID NO: 3434474 - RNA, 18 nt, Human
caguguacagucuuguau

SEQ ID NO: 3434475 - RNA, 20 nt, Human
caguguacauaguguaaugu

SEQ ID NO: 3434476 - RNA, 15 nt, Human
caguguaccauuaaa

SEQ ID NO: 3434477 - RNA, 14 nt, Human
caguguacccccgc

SEQ ID NO: 3434478 - RNA, 18 nt, Human
caguguacccccgcccag

SEQ ID NO: 3434479 - RNA, 19 nt, Human
caguguacccccgcccagg

SEQ ID NO: 3434480 - RNA, 22 nt, Human
caguguacccccgcccaggcug

SEQ ID NO: 3434481 - RNA, 13 nt, Human
caguguagauuuu

SEQ ID NO: 3434482 - RNA, 14 nt, Human
caguguagccccaa

SEQ ID NO: 3434483 - RNA, 22 nt, Human
caguguagccccaagaaggcug

SEQ ID NO: 3434484 - RNA, 15 nt, Human
caguguaguuaauuu

SEQ ID NO: 3434485 - RNA, 17 nt, Human
caguguauggaaauaaa

SEQ ID NO: 3434486 - RNA, 14 nt, Human
caguguauguagaa

SEQ ID NO: 3434487 - RNA, 15 nt, Human
caguguauuuguauu

SEQ ID NO: 3434488 - RNA, 16 nt, Human
cagugucaaauaaaca

SEQ ID NO: 3434489 - RNA, 18 nt, Human
cagugucaaguugugcuu

SEQ ID NO: 3434490 - RNA, 14 nt, Human
cagugucaaugcag

SEQ ID NO: 3434491 - RNA, 11 nt, Human
cagugucauuu

SEQ ID NO: 3434492 - RNA, 20 nt, Human
cagugucauuuaugaaaaga

SEQ ID NO: 3434493 - RNA, 17 nt, Human
caguguccaaagcaggg

SEQ ID NO: 3434494 - RNA, 20 nt, Human
caguguccauggacucagaa

SEQ ID NO: 3434495 - RNA, 15 nt, Human
caguguccccuccac

SEQ ID NO: 3434496 - RNA, 18 nt, Human
caguguccuccccucaag

SEQ ID NO: 3434497 - RNA, 16 nt, Human
caguguccugagcuca

SEQ ID NO: 3434498 - RNA, 19 nt, Human
caguguccugagcucagcg

SEQ ID NO: 3434499 - RNA, 22 nt, Human
caguguccugagcucagcgugg

SEQ ID NO: 3434500 - RNA, 20 nt, Human
caguguccuuagaacauuuu

SEQ ID NO: 3434501 - RNA, 12 nt, Human
cagugucucaca

SEQ ID NO: 3434502 - RNA, 18 nt, Human
cagugucucacacuggcg

SEQ ID NO: 3434503 - RNA, 20 nt, Human
cagugucucacagcccugcu

SEQ ID NO: 3434504 - RNA, 18 nt, Human
cagugucugggcugacug

SEQ ID NO: 3434505 - RNA, 13 nt, Human
cagugucuguguu

SEQ ID NO: 3434506 - RNA, 13 nt, Human
cagugucuuccau

SEQ ID NO: 3434507 - RNA, 14 nt, Human
cagugucuuccaua

SEQ ID NO: 3434508 - RNA, 22 nt, Human
cagugucuuccauaauguauaa

SEQ ID NO: 3434509 - RNA, 17 nt, Human
cagugucuuccuguggg

SEQ ID NO: 3434510 - RNA, 13 nt, Human
cauuccugccugu

SEQ ID NO: 3434511 - RNA, 19 nt, Human
cauuccuggaaaccacagu

SEQ ID NO: 3434512 - RNA, 20 nt, Human
cauuccugguacccagccau

SEQ ID NO: 3434513 - RNA, 24 nt, Human
cauuccugguacccagccaucugc

SEQ ID NO: 3434514 - RNA, 12 nt, Human
cauuccuguucc

SEQ ID NO: 3434515 - RNA, 11 nt, Human
cauuccuucuc

SEQ ID NO: 3434516 - RNA, 13 nt, Human
cauuccuucuuuu

SEQ ID NO: 3434517 - RNA, 17 nt, Human
cauucgcgcucugcuca

SEQ ID NO: 3434518 - RNA, 21 nt, Human
cauucgggccccaccugcagc

SEQ ID NO: 3434519 - RNA, 22 nt, Human
cauucgggccccaccugcagcu

SEQ ID NO: 3434520 - RNA, 23 nt, Human
cauucgggccccaccugcagcuc

SEQ ID NO: 3434521 - RNA, 17 nt, Human
cauaucuaguaugaaau

SEQ ID NO: 3434522 - RNA, 13 nt, Human
cauaucuaucaga

SEQ ID NO: 3434523 - RNA, 23 nt, Human
cauaucucuuaucuuacgaaaaa

SEQ ID NO: 3434524 - RNA, 12 nt, Human
cauaucugccuu

SEQ ID NO: 3434525 - RNA, 18 nt, Human
cauaucuuaaagaaacag

SEQ ID NO: 3434526 - RNA, 19 nt, Human
cauaugaaaggugccaugg

SEQ ID NO: 3434527 - RNA, 21 nt, Human
cauaugaaaggugccauggaa

SEQ ID NO: 3434528 - RNA, 14 nt, Human
cauaugacaaaugu

SEQ ID NO: 3434529 - RNA, 18 nt, Human
cauaugaccucaugcauc

SEQ ID NO: 3434530 - RNA, 22 nt, Human
cauaugacucacaugaugcaua

SEQ ID NO: 3434531 - RNA, 22 nt, Human
cauaugagccgugaacugugca

SEQ ID NO: 3434532 - RNA, 22 nt, Human
cauaugaguaagggcacugacg

SEQ ID NO: 3434533 - RNA, 14 nt, Human
cauaugagugugga

SEQ ID NO: 3434534 - RNA, 23 nt, Human
cauaugaguuucauagcuaagaa

SEQ ID NO: 3434535 - RNA, 20 nt, Human
cauaugauuucacuagaaaa

SEQ ID NO: 3434536 - RNA, 14 nt, Human
cauaugcaaacaua

SEQ ID NO: 3434537 - RNA, 20 nt, Human
cauaugcaccuugugucugu

SEQ ID NO: 3434538 - RNA, 15 nt, Human
cauaugccugggcag

SEQ ID NO: 3434539 - RNA, 22 nt, Human
cauaugcuaccaccagcugugu

SEQ ID NO: 3434540 - RNA, 23 nt, Human
cauaugcuguauauccuuucuaa

SEQ ID NO: 3434541 - RNA, 18 nt, Human
cauauggacucugcacau

SEQ ID NO: 3434542 - RNA, 17 nt, Human
cauauggauccacuggc

SEQ ID NO: 3434543 - RNA, 18 nt, Human
cauauggauuuucuauug

SEQ ID NO: 3434544 - RNA, 20 nt, Human
cauauggauuuucuauuguu

SEQ ID NO: 3434545 - RNA, 21 nt, Human
cauauguaccauguacaugaa

SEQ ID NO: 3434546 - RNA, 16 nt, Human
cauauguauacaugug

SEQ ID NO: 3434547 - RNA, 16 nt, Human
cauaugucacuagaau

SEQ ID NO: 3434548 - RNA, 17 nt, Human
cauaugugaauauggac

SEQ ID NO: 3434549 - RNA, 14 nt, Human
cauaugugaucugu

SEQ ID NO: 3434550 - RNA, 15 nt, Human
cauauguuacacuaa

SEQ ID NO: 3434551 - RNA, 16 nt, Human
cauauguugaauacuu

SEQ ID NO: 3434552 - RNA, 19 nt, Human
cauauguugaauacuuuuu

SEQ ID NO: 3434553 - RNA, 15 nt, Human
cauauuaagaaugau

SEQ ID NO: 3434554 - RNA, 19 nt, Human
cauauuaauauauuuccau

SEQ ID NO: 3434555 - RNA, 17 nt, Human
cauauuaccacagacau

SEQ ID NO: 3434556 - RNA, 13 nt, Human
cauauuagaaaac

SEQ ID NO: 3434557 - RNA, 16 nt, Human
cauauuagaaaacuuu

SEQ ID NO: 3434558 - RNA, 23 nt, Human
cauauuagcgacaacagauugga

SEQ ID NO: 3434559 - RNA, 20 nt, Human
cauauuaggaaaauaugggu

SEQ ID NO: 3434560 - RNA, 21 nt, Human
cauauuauaaaggauaaagaa

SEQ ID NO: 3434561 - RNA, 23 nt, Human
cauauuauaucagacugcuuuga

SEQ ID NO: 3434562 - RNA, 13 nt, Human
cauauuaugucuu

SEQ ID NO: 3434563 - RNA, 14 nt, Human
cauauucauucaug

SEQ ID NO: 3434564 - RNA, 22 nt, Human
cauauuccugcagccuggaggc

SEQ ID NO: 3434565 - RNA, 17 nt, Human
cauauucuaaaaccauu

SEQ ID NO: 3434566 - RNA, 18 nt, Human
cauauucuguuggccagu

SEQ ID NO: 3434567 - RNA, 16 nt, Human
cauauugaugaaaaga

SEQ ID NO: 3434568 - RNA, 21 nt, Human
cauauugauuuccguuaaaau

SEQ ID NO: 3434569 - RNA, 18 nt, Human
cauauugcacaugucuua

SEQ ID NO: 3434570 - RNA, 21 nt, Human
cauauugcacaugucuuaaug

SEQ ID NO: 3434571 - RNA, 21 nt, Human
cauauugcugagagaaauaug

SEQ ID NO: 3434572 - RNA, 14 nt, Human
cauauuguacacuu

SEQ ID NO: 3434573 - RNA, 18 nt, Human
cauauugugauucugccu

SEQ ID NO: 3434574 - RNA, 21 nt, Human
cauauugugccaauauguauu

SEQ ID NO: 3434575 - RNA, 16 nt, Human
cauauuuaauguuuua

SEQ ID NO: 3434576 - RNA, 18 nt, Human
cauauuuaauguuuuaaa

SEQ ID NO: 3434577 - RNA, 17 nt, Human
cauauuuaauuugaagg

SEQ ID NO: 3434578 - RNA, 17 nt, Human
cauauuuaccucagccu

SEQ ID NO: 3434579 - RNA, 17 nt, Human
cauauuuacuaccuuau

SEQ ID NO: 3434580 - RNA, 20 nt, Human
cauauuuacuucuuauacau

SEQ ID NO: 3434581 - RNA, 17 nt, Human
cauauuuauaaaaauaa

SEQ ID NO: 3434582 - RNA, 22 nt, Human
cauauuuauccaaaauguguau

SEQ ID NO: 3434583 - RNA, 17 nt, Human
cauauuuauccauuugu

SEQ ID NO: 3434584 - RNA, 14 nt, Human
cauauuuauuuucu

SEQ ID NO: 3434585 - RNA, 22 nt, Human
cauauuucccaugauuucaugu

SEQ ID NO: 3434586 - RNA, 14 nt, Human
cauauuucuuuggc

SEQ ID NO: 3434587 - RNA, 13 nt, Human
cauauuugcacua

SEQ ID NO: 3434588 - RNA, 13 nt, Human
cauauuuggaaga

SEQ ID NO: 3434589 - RNA, 15 nt, Human
cauauuuggaagaaa

SEQ ID NO: 3434590 - RNA, 13 nt, Human
cauauuuguaaaa

SEQ ID NO: 3434591 - RNA, 14 nt, Human
cauauuuguaaaau

SEQ ID NO: 3434592 - RNA, 15 nt, Human
cauauuuguaaaaug

SEQ ID NO: 3434593 - RNA, 20 nt, Human
cauauuuguacuuucuguua

SEQ ID NO: 3434594 - RNA, 14 nt, Human
cauauuuguuaaau

SEQ ID NO: 3434595 - RNA, 19 nt, Human
cauauuuguuaaauauuua

SEQ ID NO: 3434596 - RNA, 21 nt, Human
cauauuuguuaaauauuuaca

SEQ ID NO: 3434597 - RNA, 19 nt, Human
cauauuuuaaaauuuguuc

SEQ ID NO: 3434598 - RNA, 16 nt, Human
cauauuuuaaacagag

SEQ ID NO: 3434599 - RNA, 16 nt, Human
cauauuuuaauuucaa

SEQ ID NO: 3434600 - RNA, 23 nt, Human
cauauuuuaauuucaagcuuauu

SEQ ID NO: 3434601 - RNA, 22 nt, Human
cauauuuuacuuggaaauauua

SEQ ID NO: 3434602 - RNA, 17 nt, Human
cauauuuuauucuuuua

SEQ ID NO: 3434603 - RNA, 12 nt, Human
cauauuuucaug

SEQ ID NO: 3434604 - RNA, 19 nt, Human
cauauuuugauuauuguau

SEQ ID NO: 3434605 - RNA, 20 nt, Human
cauauuuugauuauuguauu

SEQ ID NO: 3434606 - RNA, 15 nt, Human
caucaaaaaaggcag

SEQ ID NO: 3434607 - RNA, 18 nt, Human
caucaaaaacuuuggagu

SEQ ID NO: 3434608 - RNA, 19 nt, Human
caucaaaagacaauucuuu

SEQ ID NO: 3434609 - RNA, 19 nt, Human
caucaaaauauuucaguga

SEQ ID NO: 3434610 - RNA, 15 nt, Human
caucaaaaugcuuuu

SEQ ID NO: 3434611 - RNA, 11 nt, Human
caucaaagagg

SEQ ID NO: 3434612 - RNA, 16 nt, Human
caucaaauggaagaca

SEQ ID NO: 3434613 - RNA, 13 nt, Human
caucaacaaaaau

SEQ ID NO: 3434614 - RNA, 15 nt, Human
caucaacaaaaauug

SEQ ID NO: 3434615 - RNA, 14 nt, Human
caucaacaucuugg

SEQ ID NO: 3434616 - RNA, 16 nt, Human
caucaacuaaaguugu

SEQ ID NO: 3434617 - RNA, 22 nt, Human
caucaacuaaaguuguacuuua

SEQ ID NO: 3434618 - RNA, 22 nt, Human
caucaagaauggggaucacaga

SEQ ID NO: 3434619 - RNA, 16 nt, Human
caucaagacuggaagg

SEQ ID NO: 3434620 - RNA, 16 nt, Human
caucaagacuuugcua

SEQ ID NO: 3434621 - RNA, 22 nt, Human
caucaagacuuugcuaaagaca

SEQ ID NO: 3434622 - RNA, 20 nt, Human
caucaaggacacgggccugu

SEQ ID NO: 3434623 - RNA, 21 nt, Human
caucaaggacacgggccuguc

SEQ ID NO: 3434624 - RNA, 17 nt, Human
caucaaggggucacuua

SEQ ID NO: 3434625 - RNA, 22 nt, Human
caucaagucuuucacauuuaaa

SEQ ID NO: 3434626 - RNA, 21 nt, Human
caucaaguuauugacaaacuc

SEQ ID NO: 3434627 - RNA, 23 nt, Human
caucaaguuauugacaaacucuc

SEQ ID NO: 3434628 - RNA, 16 nt, Human
caucaauccugauucc

SEQ ID NO: 3434629 - RNA, 18 nt, Human
caucaauguucauuguaa

SEQ ID NO: 3434630 - RNA, 14 nt, Human
caucacaagaacac

SEQ ID NO: 3434631 - RNA, 17 nt, Human
caucacaccugcccuaa

SEQ ID NO: 3434632 - RNA, 14 nt, Human
caucacacugggug

SEQ ID NO: 3434633 - RNA, 12 nt, Human
caucacagcagc

SEQ ID NO: 3434634 - RNA, 16 nt, Human
caucacagcagccucc

SEQ ID NO: 3434635 - RNA, 13 nt, Human
caucacagcccag

SEQ ID NO: 3434636 - RNA, 16 nt, Human
caucacagcccagccc

SEQ ID NO: 3434637 - RNA, 17 nt, Human
caucacagcccagcccg

SEQ ID NO: 3434638 - RNA, 14 nt, Human
caucacagcuuguu

SEQ ID NO: 3434639 - RNA, 15 nt, Human
caucacagcuuguuu

SEQ ID NO: 3434640 - RNA, 13 nt, Human
caucacagggcag

SEQ ID NO: 3434641 - RNA, 18 nt, Human
caucacagggugggccuc

SEQ ID NO: 3434642 - RNA, 12 nt, Human
caucacccgcua

SEQ ID NO: 3434643 - RNA, 22 nt, Human
caucaccgacgcgucuccuguu

SEQ ID NO: 3434644 - RNA, 21 nt, Human
caucaccuacucacacaggca

SEQ ID NO: 3434645 - RNA, 12 nt, Human
caucaccucagg

SEQ ID NO: 3434646 - RNA, 15 nt, Human
caucaccucaggcca

SEQ ID NO: 3434647 - RNA, 14 nt, Human
caucaccuccacca

SEQ ID NO: 3434648 - RNA, 13 nt, Human
caucaccucugua

SEQ ID NO: 3434649 - RNA, 18 nt, Human
caucaccuuagaccacca

SEQ ID NO: 3434650 - RNA, 17 nt, Human
caucaccuuaggcaggg

SEQ ID NO: 3434651 - RNA, 23 nt, Human
caucaccuuaggcagggaagugu

SEQ ID NO: 3434652 - RNA, 19 nt, Human
caucacguuagcuguccca

SEQ ID NO: 3434653 - RNA, 21 nt, Human
caucacuauccaugcaccaaa

SEQ ID NO: 3434654 - RNA, 16 nt, Human
cacacuuccuguccag

SEQ ID NO: 3434655 - RNA, 18 nt, Human
cacacuugagaggaugaa

SEQ ID NO: 3434656 - RNA, 21 nt, Human
cacacuugagaggaugaaugu

SEQ ID NO: 3434657 - RNA, 18 nt, Human
cacacuugucggcuccag

SEQ ID NO: 3434658 - RNA, 22 nt, Human
cacacuugucggcuccaguccc

SEQ ID NO: 3434659 - RNA, 21 nt, Human
cacacuugugugugggcugug

SEQ ID NO: 3434660 - RNA, 15 nt, Human
cacacuuguuccagc

SEQ ID NO: 3434661 - RNA, 18 nt, Human
cacacuuguuccagcucu

SEQ ID NO: 3434662 - RNA, 18 nt, Human
cacacuuuggcccagggu

SEQ ID NO: 3434663 - RNA, 17 nt, Human
cacacuuuuuaagaaau

SEQ ID NO: 3434664 - RNA, 15 nt, Human
cacagaaaacuagaa

SEQ ID NO: 3434665 - RNA, 23 nt, Human
cacagaaaagaaaguucaugcuu

SEQ ID NO: 3434666 - RNA, 16 nt, Human
cacagaaaauauacug

SEQ ID NO: 3434667 - RNA, 17 nt, Human
cacagaaaauauacugu

SEQ ID NO: 3434668 - RNA, 22 nt, Human
cacagaaaauauacuguaaaga

SEQ ID NO: 3434669 - RNA, 18 nt, Human
cacagaaaauggaagaca

SEQ ID NO: 3434670 - RNA, 19 nt, Human
cacagaaaauggaagacag

SEQ ID NO: 3434671 - RNA, 23 nt, Human
cacagaaaauggaagacagcucu

SEQ ID NO: 3434672 - RNA, 21 nt, Human
cacagaaacacaauauuuugu

SEQ ID NO: 3434673 - RNA, 15 nt, Human
cacagaaagacugag

SEQ ID NO: 3434674 - RNA, 18 nt, Human
cacagaaagacugagcuc

SEQ ID NO: 3434675 - RNA, 18 nt, Human
cacagaaagagagcacug

SEQ ID NO: 3434676 - RNA, 23 nt, Human
cacagaaagccuaucaaagaccu

SEQ ID NO: 3434677 - RNA, 15 nt, Human
cacagaaauauauau

SEQ ID NO: 3434678 - RNA, 20 nt, Human
cacagaaauauauauacaua

SEQ ID NO: 3434679 - RNA, 21 nt, Human
cacagaaauauauauacauau

SEQ ID NO: 3434680 - RNA, 17 nt, Human
cacagaaaugagaucag

SEQ ID NO: 3434681 - RNA, 13 nt, Human
cacagaaaugcug

SEQ ID NO: 3434682 - RNA, 17 nt, Human
cacagaaaugcugcugg

SEQ ID NO: 3434683 - RNA, 19 nt, Human
cacagaagaggcugguucu

SEQ ID NO: 3434684 - RNA, 16 nt, Human
cacagaagcacaugca

SEQ ID NO: 3434685 - RNA, 18 nt, Human
cacagaagccaggagcaa

SEQ ID NO: 3434686 - RNA, 12 nt, Human
cacagaaguccu

SEQ ID NO: 3434687 - RNA, 13 nt, Human
cacagaaguccug

SEQ ID NO: 3434688 - RNA, 14 nt, Human
cacagaaguccugu

SEQ ID NO: 3434689 - RNA, 19 nt, Human
cacagaaugcaaccaaguc

SEQ ID NO: 3434690 - RNA, 17 nt, Human
cacagacacacacacgc

SEQ ID NO: 3434691 - RNA, 13 nt, Human
cacagacaggacc

SEQ ID NO: 3434692 - RNA, 22 nt, Human
cacagacaggaccccugcaguu

SEQ ID NO: 3434693 - RNA, 18 nt, Human
cacagacauacuaaccag

SEQ ID NO: 3434694 - RNA, 16 nt, Human
cacagacccugcccug

SEQ ID NO: 3434695 - RNA, 17 nt, Human
cacagacccugcccugu

SEQ ID NO: 3434696 - RNA, 18 nt, Human
cacagacccugcccugug

SEQ ID NO: 3434697 - RNA, 22 nt, Human
caucccucccuccaccucccug

SEQ ID NO: 3434698 - RNA, 16 nt, Human
caucccuccuuaagag

SEQ ID NO: 3434699 - RNA, 19 nt, Human
caucccugaaggccccgcc

SEQ ID NO: 3434700 - RNA, 20 nt, Human
caucccuggcccccucccug

SEQ ID NO: 3434701 - RNA, 21 nt, Human
caucccuggcccccucccugg

SEQ ID NO: 3434702 - RNA, 12 nt, Human
caucccugggcc

SEQ ID NO: 3434703 - RNA, 18 nt, Human
caucccuuaccugggaaa

SEQ ID NO: 3434704 - RNA, 16 nt, Human
caucccuucucuucca

SEQ ID NO: 3434705 - RNA, 16 nt, Human
caucccuuugcccaga

SEQ ID NO: 3434706 - RNA, 13 nt, Human
caucccuuuuuga

SEQ ID NO: 3434707 - RNA, 16 nt, Human
cauccgaggcaggguc

SEQ ID NO: 3434708 - RNA, 20 nt, Human
cauccgcaggugcugguccc

SEQ ID NO: 3434709 - RNA, 15 nt, Human
cauccgccagggccc

SEQ ID NO: 3434710 - RNA, 20 nt, Human
cauccgcgugugccugugug

SEQ ID NO: 3434711 - RNA, 15 nt, Human
cauccggcagccugg

SEQ ID NO: 3434712 - RNA, 14 nt, Human
cauccggggccagc

SEQ ID NO: 3434713 - RNA, 17 nt, Human
cauccgugagcagugug

SEQ ID NO: 3434714 - RNA, 21 nt, Human
cauccgugccucuuuuuaaag

SEQ ID NO: 3434715 - RNA, 16 nt, Human
cauccuaaaagccacc

SEQ ID NO: 3434716 - RNA, 21 nt, Human
cauccuaacuccaugucucug

SEQ ID NO: 3434717 - RNA, 16 nt, Human
cauccuaagaaauaug

SEQ ID NO: 3434718 - RNA, 21 nt, Human
cauccuacaacucacauuaga

SEQ ID NO: 3434719 - RNA, 19 nt, Human
cauccuacaagacacagug

SEQ ID NO: 3434720 - RNA, 15 nt, Human
cauccuaccaaugca

SEQ ID NO: 3434721 - RNA, 19 nt, Human
cauccuaccaaugcaugca

SEQ ID NO: 3434722 - RNA, 15 nt, Human
cauccuacccccugu

SEQ ID NO: 3434723 - RNA, 18 nt, Human
cauccuacccccugugcc

SEQ ID NO: 3434724 - RNA, 23 nt, Human
cauccuacccucgggcccaccug

SEQ ID NO: 3434725 - RNA, 14 nt, Human
cauccuacccuuuu

SEQ ID NO: 3434726 - RNA, 15 nt, Human
cauccuaccgucuuu

SEQ ID NO: 3434727 - RNA, 18 nt, Human
cauccucaaacacugcag

SEQ ID NO: 3434728 - RNA, 18 nt, Human
cauccuccacguucugcu

SEQ ID NO: 3434729 - RNA, 12 nt, Human
cauccuccagcu

SEQ ID NO: 3434730 - RNA, 13 nt, Human
cauccuccagcuu

SEQ ID NO: 3434731 - RNA, 13 nt, Human
cauccuccagggc

SEQ ID NO: 3434732 - RNA, 16 nt, Human
cauccuccucagaucu

SEQ ID NO: 3434733 - RNA, 16 nt, Human
cauccuccucccaccc

SEQ ID NO: 3434734 - RNA, 20 nt, Human
cauccuccuccgauuucuaa

SEQ ID NO: 3434735 - RNA, 16 nt, Human
cauccuccuccuuccu

SEQ ID NO: 3434736 - RNA, 22 nt, Human
cauccuccuggaaccuugcugu

SEQ ID NO: 3434737 - RNA, 15 nt, Human
cauccucuguacaga

SEQ ID NO: 3434738 - RNA, 18 nt, Human
cauccucuguacagagcc

SEQ ID NO: 3434739 - RNA, 19 nt, Human
cauccucuguacagagccc

SEQ ID NO: 3434740 - RNA, 21 nt, Human
cauccucuguacagagcccac

SEQ ID NO: 3434741 - RNA, 15 nt, Human
cauccucuucugcuu

SEQ ID NO: 3434742 - RNA, 18 nt, Human
cauccucuucugcuuagg

SEQ ID NO: 3434743 - RNA, 15 nt, Human
cauccucuuuuucca

SEQ ID NO: 3434744 - RNA, 19 nt, Human
cauccugacucugcccccu

SEQ ID NO: 3434745 - RNA, 20 nt, Human
cauccugacucugcccccug

SEQ ID NO: 3434746 - RNA, 22 nt, Human
cauccugacucugcccccugcu

SEQ ID NO: 3434747 - RNA, 19 nt, Human
cauccugagccccgcccuc

SEQ ID NO: 3434748 - RNA, 21 nt, Human
cauccugagccccgcccucuu

SEQ ID NO: 3434749 - RNA, 12 nt, Human
cauccugcagcc

SEQ ID NO: 3434750 - RNA, 12 nt, Human
cauccugcaggc

SEQ ID NO: 3434751 - RNA, 17 nt, Human
cauccugccagccccac

SEQ ID NO: 3434752 - RNA, 20 nt, Human
cauccugccuuagagccagg

SEQ ID NO: 3434753 - RNA, 22 nt, Human
cauccugcugcccuuaggccac

SEQ ID NO: 3434754 - RNA, 12 nt, Human
cauccuggccca

SEQ ID NO: 3434755 - RNA, 13 nt, Human
cauccuggcccau

SEQ ID NO: 3434756 - RNA, 19 nt, Human
cauccuggcccaucagugu

SEQ ID NO: 3434757 - RNA, 21 nt, Human
cauccuggccuggcacaucag

SEQ ID NO: 3434758 - RNA, 15 nt, Human
cauccuggcugcggc

SEQ ID NO: 3434759 - RNA, 14 nt, Human
cauccuggcuggag

SEQ ID NO: 3434760 - RNA, 15 nt, Human
cauccugucccacca

SEQ ID NO: 3434761 - RNA, 12 nt, Human
cauccugugaag

SEQ ID NO: 3434762 - RNA, 17 nt, Human
cauccuuagcaacagcc

SEQ ID NO: 3434763 - RNA, 20 nt, Human
cauccuuauccuucaucuuu

SEQ ID NO: 3434764 - RNA, 22 nt, Human
cauccuucaagaacucugggcu

SEQ ID NO: 3434765 - RNA, 23 nt, Human
cauccuucaagaacucugggcug

SEQ ID NO: 3434766 - RNA, 23 nt, Human
cauccuucaucuggauuccagag

SEQ ID NO: 3434767 - RNA, 17 nt, Human
cauccuuccuucccacc

SEQ ID NO: 3434768 - RNA, 15 nt, Human
cauccuucugccuuu

SEQ ID NO: 3434769 - RNA, 19 nt, Human
cauccuuggucuuuguauc

SEQ ID NO: 3434770 - RNA, 20 nt, Human
cauccuuggucuuuguaucu

SEQ ID NO: 3434771 - RNA, 22 nt, Human
cauccuugucuuauucccuucc

SEQ ID NO: 3434772 - RNA, 21 nt, Human
cauccuuuaggguucugccuc

SEQ ID NO: 3434773 - RNA, 17 nt, Human
cauccuuucacuucuuu

SEQ ID NO: 3434774 - RNA, 14 nt, Human
cauccuuuccagca

SEQ ID NO: 3434775 - RNA, 16 nt, Human
cauccuuugcagggca

SEQ ID NO: 3434776 - RNA, 13 nt, Human
caucgaaugugua

SEQ ID NO: 3434777 - RNA, 18 nt, Human
caucgcaccauucugacu

SEQ ID NO: 3434778 - RNA, 19 nt, Human
caucgcaccauucugacuc

SEQ ID NO: 3434779 - RNA, 21 nt, Human
caucgccaacuaagcgaggca

SEQ ID NO: 3434780 - RNA, 16 nt, Human
caucgccgggacucca

SEQ ID NO: 3434781 - RNA, 15 nt, Human
caucgcuggccccuu

SEQ ID NO: 3434782 - RNA, 14 nt, Human
caucggaaaaauaa

SEQ ID NO: 3434783 - RNA, 19 nt, Human
caucggacaagacccccag

SEQ ID NO: 3434784 - RNA, 21 nt, Human
caucggacaagacccccagca

SEQ ID NO: 3434785 - RNA, 14 nt, Human
caucggccuagggc

SEQ ID NO: 3434786 - RNA, 17 nt, Human
caucgguccugucuccc

SEQ ID NO: 3434787 - RNA, 22 nt, Human
caucgguccugucuccccucug

SEQ ID NO: 3434788 - RNA, 21 nt, Human
caucggugaaacuaacagaua

SEQ ID NO: 3434789 - RNA, 18 nt, Human
caucguaggugauuugaa

SEQ ID NO: 3434790 - RNA, 16 nt, Human
caucgucauuugcugu

SEQ ID NO: 3434791 - RNA, 20 nt, Human
caucgugaaacccugucucu

SEQ ID NO: 3434792 - RNA, 16 nt, Human
caucgugaagaagccu

SEQ ID NO: 3434793 - RNA, 13 nt, Human
caucuaaaaauau

SEQ ID NO: 3434794 - RNA, 14 nt, Human
caucuaaaaauaua

SEQ ID NO: 3434795 - RNA, 21 nt, Human
caucuaaaaauauacauguuu

SEQ ID NO: 3434796 - RNA, 17 nt, Human
caucuaaacuuuaauau

SEQ ID NO: 3434797 - RNA, 20 nt, Human
caucuaaacuuuaauaugua

SEQ ID NO: 3434798 - RNA, 13 nt, Human
cacaucucugaaa

SEQ ID NO: 3434799 - RNA, 13 nt, Human
cacaucugcauuu

SEQ ID NO: 3434800 - RNA, 13 nt, Human
cacaucugccuua

SEQ ID NO: 3434801 - RNA, 16 nt, Human
cacaucugugucuugu

SEQ ID NO: 3434802 - RNA, 17 nt, Human
cacaucugugucuuguu

SEQ ID NO: 3434803 - RNA, 18 nt, Human
cacaucugugucuuguuu

SEQ ID NO: 3434804 - RNA, 14 nt, Human
cacaucuuccacag

SEQ ID NO: 3434805 - RNA, 22 nt, Human
cacaucuucccuagaggguucc

SEQ ID NO: 3434806 - RNA, 20 nt, Human
cacaucuugaucugcucagc

SEQ ID NO: 3434807 - RNA, 18 nt, Human
cacaucuugcucugcuga

SEQ ID NO: 3434808 - RNA, 22 nt, Human
cacaucuugcucugcugacaga

SEQ ID NO: 3434809 - RNA, 23 nt, Human
cacaucuugcucugcugacagac

SEQ ID NO: 3434810 - RNA, 13 nt, Human
cacaucuuggcac

SEQ ID NO: 3434811 - RNA, 22 nt, Human
cacaucuuuaucuguucuugcu

SEQ ID NO: 3434812 - RNA, 22 nt, Human
cacaugaagaaauacugcacuu

SEQ ID NO: 3434813 - RNA, 24 nt, Human
cacaugaaucccacccacauguga

SEQ ID NO: 3434814 - RNA, 23 nt, Human
cacaugaccugaucacuagccug

SEQ ID NO: 3434815 - RNA, 16 nt, Human
cacaugagauaauaug

SEQ ID NO: 3434816 - RNA, 13 nt, Human
cacaugagcauca

SEQ ID NO: 3434817 - RNA, 18 nt, Human
cacaugagcuauuuccau

SEQ ID NO: 3434818 - RNA, 18 nt, Human
cacaugagucccaguggg

SEQ ID NO: 3434819 - RNA, 17 nt, Human
cacaugauccugcaauu

SEQ ID NO: 3434820 - RNA, 17 nt, Human
cacaugcaaggucauuu

SEQ ID NO: 3434821 - RNA, 19 nt, Human
cacaugcaaggucauuuuu

SEQ ID NO: 3434822 - RNA, 17 nt, Human
cacaugcauacacacac

SEQ ID NO: 3434823 - RNA, 18 nt, Human
cacaugcccuaaugucug

SEQ ID NO: 3434824 - RNA, 20 nt, Human
cacaugcccuaaugucugua

SEQ ID NO: 3434825 - RNA, 19 nt, Human
cacaugccucucucaggcc

SEQ ID NO: 3434826 - RNA, 16 nt, Human
cacaugcugagucucc

SEQ ID NO: 3434827 - RNA, 21 nt, Human
cacaugcugagucucccaagg

SEQ ID NO: 3434828 - RNA, 23 nt, Human
cacaugcuggacaggucugggag

SEQ ID NO: 3434829 - RNA, 20 nt, Human
cacaugcuucccuuuccuga

SEQ ID NO: 3434830 - RNA, 21 nt, Human
cacaugcuugaugguuuaugu

SEQ ID NO: 3434831 - RNA, 23 nt, Human
cacauggccccucccccugccag

SEQ ID NO: 3434832 - RNA, 15 nt, Human
cacauggccuaugca

SEQ ID NO: 3434833 - RNA, 12 nt, Human
cacauggcuucc

SEQ ID NO: 3434834 - RNA, 23 nt, Human
cacaugucaccguggaccuuccu

SEQ ID NO: 3434835 - RNA, 21 nt, Human
cacaugucagcaaguccuaag

SEQ ID NO: 3434836 - RNA, 22 nt, Human
cacauguccaagaagcccagga

SEQ ID NO: 3434837 - RNA, 12 nt, Human
cacauguccagu

SEQ ID NO: 3434838 - RNA, 14 nt, Human
cacaugucuuaaug

SEQ ID NO: 3434839 - RNA, 15 nt, Human
cacaugucuuaauga

SEQ ID NO: 3434840 - RNA, 23 nt, Human
cacaugucuuaaugaaguuugaa

SEQ ID NO: 3434841 - RNA, 15 nt, Human
cacaugucuuguaca

SEQ ID NO: 3434842 - RNA, 20 nt, Human
cacaugucuuguacaugugu

SEQ ID NO: 3434843 - RNA, 14 nt, Human
cacaugugcacaug

SEQ ID NO: 3434844 - RNA, 15 nt, Human
cacaugugcacaugc

SEQ ID NO: 3434845 - RNA, 17 nt, Human
cacaugugcacaugcac

SEQ ID NO: 3434846 - RNA, 19 nt, Human
cacauguguccaucccagc

SEQ ID NO: 3434847 - RNA, 16 nt, Human
cacauguuuucaaaug

SEQ ID NO: 3434848 - RNA, 20 nt, Human
cacauuaaaaaaugaaauau

SEQ ID NO: 3434849 - RNA, 15 nt, Human
cacauuaaaugacuc

SEQ ID NO: 3434850 - RNA, 23 nt, Human
cacauuaagccuuccacacucac

SEQ ID NO: 3434851 - RNA, 18 nt, Human
cacauuaauggucuaaaa

SEQ ID NO: 3434852 - RNA, 22 nt, Human
cacauuaauggucuaaaaauaa

SEQ ID NO: 3434853 - RNA, 20 nt, Human
cacauuacuagaguuggcau

SEQ ID NO: 3434854 - RNA, 15 nt, Human
cacauuagaauuagu

SEQ ID NO: 3434855 - RNA, 20 nt, Human
cacauuagauuuuauuuuac

SEQ ID NO: 3434856 - RNA, 19 nt, Human
cacauuaggcauugagacu

SEQ ID NO: 3434857 - RNA, 20 nt, Human
cacauuaucgggagcagugu

SEQ ID NO: 3434858 - RNA, 19 nt, Human
cacauucaacccuggagag

SEQ ID NO: 3434859 - RNA, 16 nt, Human
cacauucaauaagcau

SEQ ID NO: 3434860 - RNA, 17 nt, Human
cacauuccccuggggac

SEQ ID NO: 3434861 - RNA, 20 nt, Human
cacauucuggcucagggagg

SEQ ID NO: 3434862 - RNA, 15 nt, Human
cacauucuuauaaau

SEQ ID NO: 3434863 - RNA, 23 nt, Human
cacauucuuauaaauaugaagcu

SEQ ID NO: 3434864 - RNA, 13 nt, Human
cacauucuuguuu

SEQ ID NO: 3434865 - RNA, 23 nt, Human
cacauugagcugauauaaauucu

SEQ ID NO: 3434866 - RNA, 17 nt, Human
cacauugagcugugcaa

SEQ ID NO: 3434867 - RNA, 14 nt, Human
cacauugcauucua

SEQ ID NO: 3434868 - RNA, 17 nt, Human
cacauuguuauuuucag

SEQ ID NO: 3434869 - RNA, 18 nt, Human
cacauuguuugcugcuau

SEQ ID NO: 3434870 - RNA, 17 nt, Human
cacauuuagucucuuua

SEQ ID NO: 3434871 - RNA, 17 nt, Human
cacauuuauucugcuca

SEQ ID NO: 3434872 - RNA, 18 nt, Human
cacauuuauucugcucac

SEQ ID NO: 3434873 - RNA, 17 nt, Human
cacauuucacugucugu

SEQ ID NO: 3434874 - RNA, 18 nt, Human
cacauuuccccagaccug

SEQ ID NO: 3434875 - RNA, 13 nt, Human
cacauuucuuuuu

SEQ ID NO: 3434876 - RNA, 17 nt, Human
cacauuugauucugugu

SEQ ID NO: 3434877 - RNA, 17 nt, Human
cacauuuggaauacuuu

SEQ ID NO: 3434878 - RNA, 19 nt, Human
cacauuuggaauacuuuuu

SEQ ID NO: 3434879 - RNA, 17 nt, Human
cacauuugucuucuuuc

SEQ ID NO: 3434880 - RNA, 15 nt, Human
cacauuuuauuuuau

SEQ ID NO: 3434881 - RNA, 16 nt, Human
cacauuuucagccaaa

SEQ ID NO: 3434882 - RNA, 21 nt, Human
cacauuuucuuaauccagucu

SEQ ID NO: 3434883 - RNA, 13 nt, Human
cacauuuuguaua

SEQ ID NO: 3434884 - RNA, 15 nt, Human
cacauuuuguauaau

SEQ ID NO: 3434885 - RNA, 23 nt, Human
cacauuuuuauaccuguuuaaau

SEQ ID NO: 3434886 - RNA, 14 nt, Human
cacauuuuucagau

SEQ ID NO: 3434887 - RNA, 18 nt, Human
cacauuuuucagauauaa

SEQ ID NO: 3434888 - RNA, 18 nt, Human
cacauuuuuuuuuuuaau

SEQ ID NO: 3434889 - RNA, 20 nt, Human
caccaaaaaaauccagaaac

SEQ ID NO: 3434890 - RNA, 12 nt, Human
caccaaaaaaua

SEQ ID NO: 3434891 - RNA, 15 nt, Human
caccaaaacugcucc

SEQ ID NO: 3434892 - RNA, 16 nt, Human
caccaaacauacuaga

SEQ ID NO: 3434893 - RNA, 13 nt, Human
caccaaagagaau

SEQ ID NO: 3434894 - RNA, 17 nt, Human
caccaaagagaaugccc

SEQ ID NO: 3434895 - RNA, 15 nt, Human
caccaaagaugcagc

SEQ ID NO: 3434896 - RNA, 18 nt, Human
caccaaagcugcccacug

SEQ ID NO: 3434897 - RNA, 14 nt, Human
caccaaaucaaaau

SEQ ID NO: 3434898 - RNA, 15 nt, Human
caccaacaccacggu

SEQ ID NO: 3434899 - RNA, 20 nt, Human
caccaacauacucccaucug

SEQ ID NO: 3434900 - RNA, 23 nt, Human
caccaacauacucccaucuguga

SEQ ID NO: 3434901 - RNA, 15 nt, Human
caccaacccucaggg

SEQ ID NO: 3434902 - RNA, 16 nt, Human
caccaacgucugugcc

SEQ ID NO: 3434903 - RNA, 17 nt, Human
caccaacgucugugcca

SEQ ID NO: 3434904 - RNA, 14 nt, Human
caccaacucuugca

SEQ ID NO: 3434905 - RNA, 14 nt, Human
caccaagcacagca

SEQ ID NO: 3434906 - RNA, 15 nt, Human
cauggcauccuccag

SEQ ID NO: 3434907 - RNA, 19 nt, Human
cauggcaugcuuaaauuuu

SEQ ID NO: 3434908 - RNA, 22 nt, Human
cauggcaugggggccucagggc

SEQ ID NO: 3434909 - RNA, 13 nt, Human
cauggccagcagc

SEQ ID NO: 3434910 - RNA, 14 nt, Human
cauggccagcagca

SEQ ID NO: 3434911 - RNA, 20 nt, Human
cauggccagcagcaccugcc

SEQ ID NO: 3434912 - RNA, 23 nt, Human
cauggccagcagcaccugcccua

SEQ ID NO: 3434913 - RNA, 16 nt, Human
cauggccagcuaauuu

SEQ ID NO: 3434914 - RNA, 21 nt, Human
cauggccagcuggaggcaggg

SEQ ID NO: 3434915 - RNA, 16 nt, Human
cauggccccucugacc

SEQ ID NO: 3434916 - RNA, 18 nt, Human
cauggccccucugaccug

SEQ ID NO: 3434917 - RNA, 14 nt, Human
cauggcccucccag

SEQ ID NO: 3434918 - RNA, 15 nt, Human
cauggcccugagcga

SEQ ID NO: 3434919 - RNA, 16 nt, Human
cauggcccugccaugc

SEQ ID NO: 3434920 - RNA, 12 nt, Human
cauggcccuggg

SEQ ID NO: 3434921 - RNA, 14 nt, Human
cauggcccuggggu

SEQ ID NO: 3434922 - RNA, 16 nt, Human
cauggccggcuuucag

SEQ ID NO: 3434923 - RNA, 20 nt, Human
cauggccggcuuucaggagc

SEQ ID NO: 3434924 - RNA, 22 nt, Human
cauggccggcuuucaggagcuc

SEQ ID NO: 3434925 - RNA, 22 nt, Human
cauggccucuucagaucucuaa

SEQ ID NO: 3434926 - RNA, 16 nt, Human
cauggccugcaaacug

SEQ ID NO: 3434927 - RNA, 19 nt, Human
cauggccuuaugaggcagg

SEQ ID NO: 3434928 - RNA, 19 nt, Human
cauggcgaaaacaucuccu

SEQ ID NO: 3434929 - RNA, 21 nt, Human
cauggcgaaaacaucuccuua

SEQ ID NO: 3434930 - RNA, 14 nt, Human
cauggcgugucccu

SEQ ID NO: 3434931 - RNA, 22 nt, Human
cauggcuaaggcaccagccggg

SEQ ID NO: 3434932 - RNA, 15 nt, Human
cauggcuauuuuaua

SEQ ID NO: 3434933 - RNA, 17 nt, Human
cauggcugagcugccca

SEQ ID NO: 3434934 - RNA, 22 nt, Human
cauggcuggagcuagaauuuga

SEQ ID NO: 3434935 - RNA, 21 nt, Human
cauggcugggaacugcagacc

SEQ ID NO: 3434936 - RNA, 20 nt, Human
cauggcuguguuugcagccu

SEQ ID NO: 3434937 - RNA, 17 nt, Human
cauggcuuaaugcuucu

SEQ ID NO: 3434938 - RNA, 18 nt, Human
cauggcuuaaugcuucuu

SEQ ID NO: 3434939 - RNA, 20 nt, Human
cauggcuuaauguuuauucc

SEQ ID NO: 3434940 - RNA, 13 nt, Human
cauggcuuccucc

SEQ ID NO: 3434941 - RNA, 20 nt, Human
caugggaaaguauucucuuu

SEQ ID NO: 3434942 - RNA, 17 nt, Human
caccacacccagcccac

SEQ ID NO: 3434943 - RNA, 16 nt, Human
caccacacccagccuc

SEQ ID NO: 3434944 - RNA, 17 nt, Human
caccacacccagccuca

SEQ ID NO: 3434945 - RNA, 14 nt, Human
caccacagacacac

SEQ ID NO: 3434946 - RNA, 19 nt, Human
caccacagacacacacacg

SEQ ID NO: 3434947 - RNA, 21 nt, Human
caccacaggcccuuuccucag

SEQ ID NO: 3434948 - RNA, 23 nt, Human
caccacauaaggucagcucagag

SEQ ID NO: 3434949 - RNA, 13 nt, Human
caccaccaagcca

SEQ ID NO: 3434950 - RNA, 15 nt, Human
caccaccaggucucc

SEQ ID NO: 3434951 - RNA, 11 nt, Human
caccacccaaa

SEQ ID NO: 3434952 - RNA, 18 nt, Human
caccaccccaacaaacca

SEQ ID NO: 3434953 - RNA, 14 nt, Human
caccaccccuacca

SEQ ID NO: 3434954 - RNA, 23 nt, Human
caccacccgcuuucuugcugguu

SEQ ID NO: 3434955 - RNA, 17 nt, Human
caccacccuccuuccca

SEQ ID NO: 3434956 - RNA, 20 nt, Human
caccacccugcucauccacu

SEQ ID NO: 3434957 - RNA, 22 nt, Human
caccaccuaggccacuccucca

SEQ ID NO: 3434958 - RNA, 13 nt, Human
caccaccucccuc

SEQ ID NO: 3434959 - RNA, 12 nt, Human
caccaccucucc

SEQ ID NO: 3434960 - RNA, 14 nt, Human
caccaccuucccag

SEQ ID NO: 3434961 - RNA, 15 nt, Human
caccaccuucccagc

SEQ ID NO: 3434962 - RNA, 19 nt, Human
caccaccuucccagcucuc

SEQ ID NO: 3434963 - RNA, 22 nt, Human
caccaccuucccagcucucccu

SEQ ID NO: 3434964 - RNA, 22 nt, Human
caccacgauguggcccuggccu

SEQ ID NO: 3434965 - RNA, 15 nt, Human
caccacgucacuuca

SEQ ID NO: 3434966 - RNA, 16 nt, Human
caccacuacauucugu

SEQ ID NO: 3434967 - RNA, 17 nt, Human
caccacuacauucuguu

SEQ ID NO: 3434968 - RNA, 20 nt, Human
caccacuacauucuguuaau

SEQ ID NO: 3434969 - RNA, 21 nt, Human
caccacuauaaaaugucuuca

SEQ ID NO: 3434970 - RNA, 18 nt, Human
caccacucaaaggccaga

SEQ ID NO: 3434971 - RNA, 16 nt, Human
caccacuccauuccca

SEQ ID NO: 3434972 - RNA, 12 nt, Human
caccacucuggc

SEQ ID NO: 3434973 - RNA, 15 nt, Human
caccacucuggcagc

SEQ ID NO: 3434974 - RNA, 19 nt, Human
caccacucuggcagccaca

SEQ ID NO: 3434975 - RNA, 13 nt, Human
caccacuggccac

SEQ ID NO: 3434976 - RNA, 15 nt, Human
caccacuggccacca

SEQ ID NO: 3434977 - RNA, 18 nt, Human
caccacuggccaccaggc

SEQ ID NO: 3434978 - RNA, 15 nt, Human
caccagaagcccaga

SEQ ID NO: 3434979 - RNA, 15 nt, Human
caccagacacccagg

SEQ ID NO: 3434980 - RNA, 16 nt, Human
caccagacacccagga

SEQ ID NO: 3434981 - RNA, 16 nt, Human
caccagagaccguccu

SEQ ID NO: 3434982 - RNA, 19 nt, Human
caccagagaccguccucac

SEQ ID NO: 3434983 - RNA, 18 nt, Human
caccagagcaaccucuca

SEQ ID NO: 3434984 - RNA, 16 nt, Human
caccagagcagaugca

SEQ ID NO: 3434985 - RNA, 17 nt, Human
caccagagcagaugcag

SEQ ID NO: 3434986 - RNA, 19 nt, Human
caccagagcagaugcagag

SEQ ID NO: 3434987 - RNA, 20 nt, Human
caccagagcagaugcagaga

SEQ ID NO: 3434988 - RNA, 15 nt, Human
caccagagcccaccu

SEQ ID NO: 3434989 - RNA, 21 nt, Human
caccagaggcugcagaaggcc

SEQ ID NO: 3434990 - RNA, 13 nt, Human
caccagaucugau

SEQ ID NO: 3434991 - RNA, 15 nt, Human
caccagaugugacag

SEQ ID NO: 3434992 - RNA, 12 nt, Human
caccagcagccu

SEQ ID NO: 3434993 - RNA, 20 nt, Human
caccagcaucaccugccugu

SEQ ID NO: 3434994 - RNA, 11 nt, Human
caccagccagc

SEQ ID NO: 3434995 - RNA, 12 nt, Human
caccagccagcg

SEQ ID NO: 3434996 - RNA, 13 nt, Human
caccagccaggcu

SEQ ID NO: 3434997 - RNA, 20 nt, Human
caccagccaggcucugugcu

SEQ ID NO: 3434998 - RNA, 17 nt, Human
caccagccccagugccc

SEQ ID NO: 3434999 - RNA, 13 nt, Human
caccagccccugc

SEQ ID NO: 3435000 - RNA, 15 nt, Human
caccagcccggccug

SEQ ID NO: 3435001 - RNA, 19 nt, Human
caccagcccggccugcucc

SEQ ID NO: 3435002 - RNA, 21 nt, Human
caccagcguuugaggggcugg

SEQ ID NO: 3435003 - RNA, 12 nt, Human
caccagcuccuc

SEQ ID NO: 3435004 - RNA, 14 nt, Human
caccagcugcaaag

SEQ ID NO: 3435005 - RNA, 18 nt, Human
caccagcugcaaaguguu

SEQ ID NO: 3435006 - RNA, 22 nt, Human
caccagcuguguccggcccagu

SEQ ID NO: 3435007 - RNA, 17 nt, Human
caccagcuucuccaggc

SEQ ID NO: 3435008 - RNA, 13 nt, Human
caccaggaagccg

SEQ ID NO: 3435009 - RNA, 17 nt, Human
caccaggaauguuaaag

SEQ ID NO: 3435010 - RNA, 16 nt, Human
caccaggagaaccacu

SEQ ID NO: 3435011 - RNA, 23 nt, Human
caccaggcacgaacccaccugcu

SEQ ID NO: 3435012 - RNA, 15 nt, Human
caccaggcagccucu

SEQ ID NO: 3435013 - RNA, 16 nt, Human
caccaggccccccugu

SEQ ID NO: 3435014 - RNA, 14 nt, Human
caccaggcugcuca

SEQ ID NO: 3435015 - RNA, 15 nt, Human
caccaggcuggcgca

SEQ ID NO: 3435016 - RNA, 22 nt, Human
caccaggcuggcgcagccaagg

SEQ ID NO: 3435017 - RNA, 16 nt, Human
caccaggcugugggcc

SEQ ID NO: 3435018 - RNA, 17 nt, Human
caccaggcugugggccu

SEQ ID NO: 3435019 - RNA, 18 nt, Human
caccaggcugugggccuc

SEQ ID NO: 3435020 - RNA, 20 nt, Human
caccaggcuugccugcaggc

SEQ ID NO: 3435021 - RNA, 13 nt, Human
caccagggaagau

SEQ ID NO: 3435022 - RNA, 21 nt, Human
caccagggaaggggacaagga

SEQ ID NO: 3435023 - RNA, 17 nt, Human
caccagggcaucucugg

SEQ ID NO: 3435024 - RNA, 22 nt, Human
caccagggccaaaagcuucccu

SEQ ID NO: 3435025 - RNA, 16 nt, Human
caccagggccagccuc

SEQ ID NO: 3435026 - RNA, 17 nt, Human
caccagggccagccucu

SEQ ID NO: 3435027 - RNA, 16 nt, Human
caccaggggcaggcac

SEQ ID NO: 3435028 - RNA, 20 nt, Human
caccaggggcaggcacagca

SEQ ID NO: 3435029 - RNA, 22 nt, Human
caccaggguccuuuugacacug

SEQ ID NO: 3435030 - RNA, 22 nt, Human
caccaggguugaccccagagga

SEQ ID NO: 3435031 - RNA, 23 nt, Human
caccaggguugaccccagaggau

SEQ ID NO: 3435032 - RNA, 22 nt, Human
caccaggucucccgggaagcca

SEQ ID NO: 3435033 - RNA, 22 nt, Human
caccaguacauucucaguuuuu

SEQ ID NO: 3435034 - RNA, 20 nt, Human
caccagucccuguccggaau

SEQ ID NO: 3435035 - RNA, 14 nt, Human
caccagugaccugg

SEQ ID NO: 3435036 - RNA, 13 nt, Human
caccagugccucu

SEQ ID NO: 3435037 - RNA, 13 nt, Human
caccagugucccc

SEQ ID NO: 3435038 - RNA, 14 nt, Human
caccaguguccccu

SEQ ID NO: 3435039 - RNA, 17 nt, Human
caccaguguccuccccu

SEQ ID NO: 3435040 - RNA, 18 nt, Human
caccaguguccuccccuc

SEQ ID NO: 3435041 - RNA, 23 nt, Human
caccaguguccuccccucaagga

SEQ ID NO: 3435042 - RNA, 18 nt, Human
caccagugugggguucug

SEQ ID NO: 3435043 - RNA, 23 nt, Human
caccagugugggguucugcuggg

SEQ ID NO: 3435044 - RNA, 21 nt, Human
caccaguguguggcuuucaga

SEQ ID NO: 3435045 - RNA, 16 nt, Human
caccauaccuuugcua

SEQ ID NO: 3435046 - RNA, 23 nt, Human
caccauacgagcaccuccagccu

SEQ ID NO: 3435047 - RNA, 15 nt, Human
caccauaugaauugu

SEQ ID NO: 3435048 - RNA, 21 nt, Human
caccauauuggccagucuggu

SEQ ID NO: 3435049 - RNA, 15 nt, Human
caccaucaagccacc

SEQ ID NO: 3435050 - RNA, 16 nt, Human
caccaucaagccacca

SEQ ID NO: 3435051 - RNA, 24 nt, Human
caccaucaagccaccaacauacuc

SEQ ID NO: 3435052 - RNA, 22 nt, Human
caccaucacagcuuguuuugga

SEQ ID NO: 3435053 - RNA, 18 nt, Human
caccaucaugucuggcua

SEQ ID NO: 3435054 - RNA, 13 nt, Human
caccauccccucc

SEQ ID NO: 3435055 - RNA, 18 nt, Human
caccauccgccagggccc

SEQ ID NO: 3435056 - RNA, 15 nt, Human
caccauccugcagcc

SEQ ID NO: 3435057 - RNA, 20 nt, Human
caccauccugcagccuccuc

SEQ ID NO: 3435058 - RNA, 21 nt, Human
caccauccugcagccuccucc

SEQ ID NO: 3435059 - RNA, 13 nt, Human
caccaucucaggc

SEQ ID NO: 3435060 - RNA, 18 nt, Human
caccaucucaggccaccu

SEQ ID NO: 3435061 - RNA, 19 nt, Human
caccaucucaggccaccug

SEQ ID NO: 3435062 - RNA, 10 nt, Human
caccaucugc

SEQ ID NO: 3435063 - RNA, 19 nt, Human
caccaucugcugucuuuuc

SEQ ID NO: 3435064 - RNA, 11 nt, Human
caccaugaaac

SEQ ID NO: 3435065 - RNA, 15 nt, Human
caccaugauuccuuu

SEQ ID NO: 3435066 - RNA, 16 nt, Human
caccauggccagccaa

SEQ ID NO: 3435067 - RNA, 20 nt, Human
caccauguugcccaggcugg

SEQ ID NO: 3435068 - RNA, 20 nt, Human
caccauguuggccaggcugg

SEQ ID NO: 3435069 - RNA, 20 nt, Human
caccauguuggccaggcuug

SEQ ID NO: 3435070 - RNA, 14 nt, Human
caccauuauaauga

SEQ ID NO: 3435071 - RNA, 20 nt, Human
cauguuguaaugcugcacuu

SEQ ID NO: 3435072 - RNA, 19 nt, Human
cauguugucuaagaaauug

SEQ ID NO: 3435073 - RNA, 13 nt, Human
cauguugugccuc

SEQ ID NO: 3435074 - RNA, 20 nt, Human
cauguugugccucccuggug

SEQ ID NO: 3435075 - RNA, 18 nt, Human
cauguuguuaaaauuaug

SEQ ID NO: 3435076 - RNA, 14 nt, Human
cauguuuaaaccug

SEQ ID NO: 3435077 - RNA, 11 nt, Human
cauguuuaaga

SEQ ID NO: 3435078 - RNA, 16 nt, Human
cauguuuaagauuuaa

SEQ ID NO: 3435079 - RNA, 15 nt, Human
cauguuuagacuuua

SEQ ID NO: 3435080 - RNA, 13 nt, Human
cauguuuauaaau

SEQ ID NO: 3435081 - RNA, 15 nt, Human
cauguuuaucugcuu

SEQ ID NO: 3435082 - RNA, 13 nt, Human
cauguuuaugaaa

SEQ ID NO: 3435083 - RNA, 14 nt, Human
cauguuuaugaaaa

SEQ ID NO: 3435084 - RNA, 13 nt, Human
cauguuuauuaca

SEQ ID NO: 3435085 - RNA, 18 nt, Human
cauguuuauuuuucuugu

SEQ ID NO: 3435086 - RNA, 20 nt, Human
cauguuuauuuuucuugucu

SEQ ID NO: 3435087 - RNA, 21 nt, Human
ccacuaagaauucaaacuggg

SEQ ID NO: 3435088 - RNA, 13 nt, Human
ccacuaagcagag

SEQ ID NO: 3435089 - RNA, 18 nt, Human
ccacuaagcagaggaggg

SEQ ID NO: 3435090 - RNA, 19 nt, Human
ccacuaagcagaggagggg

SEQ ID NO: 3435091 - RNA, 22 nt, Human
ccacuaagcagaggaggggccg

SEQ ID NO: 3435092 - RNA, 14 nt, Human
ccacuacaccuggc

SEQ ID NO: 3435093 - RNA, 15 nt, Human
ccacuacaccuggcu

SEQ ID NO: 3435094 - RNA, 16 nt, Human
ccacuacaccuggcug

SEQ ID NO: 3435095 - RNA, 14 nt, Human
ccacuacacuccag

SEQ ID NO: 3435096 - RNA, 22 nt, Human
ccacuacaugcagcccaugccc

SEQ ID NO: 3435097 - RNA, 11 nt, Human
ccacuacauuc

SEQ ID NO: 3435098 - RNA, 18 nt, Human
ccacuacauucuguuaau

SEQ ID NO: 3435099 - RNA, 22 nt, Human
ccacuacggaauaguuggcuag

SEQ ID NO: 3435100 - RNA, 16 nt, Human
ccacuacucaaaaauu

SEQ ID NO: 3435101 - RNA, 14 nt, Human
ccacuacugcagca

SEQ ID NO: 3435102 - RNA, 20 nt, Human
ccacuacugcagcaccucca

SEQ ID NO: 3435103 - RNA, 16 nt, Human
ccacuagccucagggg

SEQ ID NO: 3435104 - RNA, 18 nt, Human
ccacuaggacucugaggc

SEQ ID NO: 3435105 - RNA, 21 nt, Human
ccacuaggcugggugcccaca

SEQ ID NO: 3435106 - RNA, 16 nt, Human
ccacuagugcaaauca

SEQ ID NO: 3435107 - RNA, 20 nt, Human
ccacuauaaaaugucuucaa

SEQ ID NO: 3435108 - RNA, 16 nt, Human
ccacuauccuucguga

SEQ ID NO: 3435109 - RNA, 15 nt, Human
ccacucaaaggccag

SEQ ID NO: 3435110 - RNA, 15 nt, Human
ccacucaagaccaaa

SEQ ID NO: 3435111 - RNA, 23 nt, Human
ccacucaagaccaaauggaaaca

SEQ ID NO: 3435112 - RNA, 16 nt, Human
ccacucaagccaagca

SEQ ID NO: 3435113 - RNA, 21 nt, Human
ccacucacaugacacccguga

SEQ ID NO: 3435114 - RNA, 16 nt, Human
ccacucaccagugucc

SEQ ID NO: 3435115 - RNA, 12 nt, Human
ccacucaccccg

SEQ ID NO: 3435116 - RNA, 22 nt, Human
ccacucacgaauauuaugccca

SEQ ID NO: 3435117 - RNA, 18 nt, Human
ccacucagccccuaggag

SEQ ID NO: 3435118 - RNA, 14 nt, Human
ccacucagcuuccu

SEQ ID NO: 3435119 - RNA, 13 nt, Human
ccacucaggaggc

SEQ ID NO: 3435120 - RNA, 18 nt, Human
ccacucaggcauuugacu

SEQ ID NO: 3435121 - RNA, 18 nt, Human
ccacucaguccauagcag

SEQ ID NO: 3435122 - RNA, 22 nt, Human
ccacuccagaccccuggcuuuu

SEQ ID NO: 3435123 - RNA, 18 nt, Human
ccacuccagcgcugagug

SEQ ID NO: 3435124 - RNA, 20 nt, Human
ccacuccagcuccuucgcuu

SEQ ID NO: 3435125 - RNA, 12 nt, Human
ccacucccacuu

SEQ ID NO: 3435126 - RNA, 14 nt, Human
ccacucccaggcag

SEQ ID NO: 3435127 - RNA, 17 nt, Human
cauuucccaucugcacc

SEQ ID NO: 3435128 - RNA, 23 nt, Human
cauuuccccucugcacccagaac

SEQ ID NO: 3435129 - RNA, 22 nt, Human
cauuuccguaauucuuauucca

SEQ ID NO: 3435130 - RNA, 15 nt, Human
cauuuccuaaauaua

SEQ ID NO: 3435131 - RNA, 17 nt, Human
cauuuccuauguaacug

SEQ ID NO: 3435132 - RNA, 14 nt, Human
cauuuccucagacu

SEQ ID NO: 3435133 - RNA, 18 nt, Human
cauuuccucgcagccucu

SEQ ID NO: 3435134 - RNA, 13 nt, Human
cauuuccugacag

SEQ ID NO: 3435135 - RNA, 19 nt, Human
cauuuccugagaccacaga

SEQ ID NO: 3435136 - RNA, 19 nt, Human
cauuuccugcccuuccuca

SEQ ID NO: 3435137 - RNA, 20 nt, Human
cauuuccugcccuuccucag

SEQ ID NO: 3435138 - RNA, 23 nt, Human
cauuuccugcccuuccucaguuu

SEQ ID NO: 3435139 - RNA, 12 nt, Human
cauuuccugggu

SEQ ID NO: 3435140 - RNA, 14 nt, Human
cauuuccugggugg

SEQ ID NO: 3435141 - RNA, 13 nt, Human
cauuuccuguguc

SEQ ID NO: 3435142 - RNA, 16 nt, Human
cauuuccuucaaggca

SEQ ID NO: 3435143 - RNA, 21 nt, Human
cauuucgguggcuagucaagc

SEQ ID NO: 3435144 - RNA, 12 nt, Human
cauuucuaaaau

SEQ ID NO: 3435145 - RNA, 23 nt, Human
cauuucuaaaggccucuuccuug

SEQ ID NO: 3435146 - RNA, 19 nt, Human
cauuucuaacucugaugua

SEQ ID NO: 3435147 - RNA, 20 nt, Human
cauuucuaacucugauguaa

SEQ ID NO: 3435148 - RNA, 19 nt, Human
cauuucuaauuauguagcu

SEQ ID NO: 3435149 - RNA, 16 nt, Human
cauuucuaauuccugu

SEQ ID NO: 3435150 - RNA, 17 nt, Human
cauuucuacucucccau

SEQ ID NO: 3435151 - RNA, 22 nt, Human
cauuucuacucucccauggcuu

SEQ ID NO: 3435152 - RNA, 18 nt, Human
cauuucuacugugacuga

SEQ ID NO: 3435153 - RNA, 20 nt, Human
cauuucuagcgcauggccug

SEQ ID NO: 3435154 - RNA, 14 nt, Human
cauuucuauaaaua

SEQ ID NO: 3435155 - RNA, 12 nt, Human
cauuucuauuaa

SEQ ID NO: 3435156 - RNA, 14 nt, Human
cauuucuauuuauu

SEQ ID NO: 3435157 - RNA, 23 nt, Human
cauuucuauuuauuuacugagcu

SEQ ID NO: 3435158 - RNA, 12 nt, Human
cauuucucacug

SEQ ID NO: 3435159 - RNA, 17 nt, Human
cauuucucauguugaaa

SEQ ID NO: 3435160 - RNA, 14 nt, Human
cauuucucuggggu

SEQ ID NO: 3435161 - RNA, 15 nt, Human
cauuucucuuacugc

SEQ ID NO: 3435162 - RNA, 13 nt, Human
cauuucugaggug

SEQ ID NO: 3435163 - RNA, 21 nt, Human
cauuucugaggugcacuggga

SEQ ID NO: 3435164 - RNA, 22 nt, Human
cauuucugaguuucauucuccu

SEQ ID NO: 3435165 - RNA, 19 nt, Human
cauuucugauacuuucugu

SEQ ID NO: 3435166 - RNA, 11 nt, Human
cauuucugauu

SEQ ID NO: 3435167 - RNA, 17 nt, Human
cauuucuguaaauacca

SEQ ID NO: 3435168 - RNA, 23 nt, Human
cauuucuugugauguuuugagag

SEQ ID NO: 3435169 - RNA, 18 nt, Human
cauuucuuugugcuuugg

SEQ ID NO: 3435170 - RNA, 15 nt, Human
cauuucuuuucuuuu

SEQ ID NO: 3435171 - RNA, 17 nt, Human
cauuucuuuucuuuuua

SEQ ID NO: 3435172 - RNA, 20 nt, Human
cauuucuuuucuuuuuacau

SEQ ID NO: 3435173 - RNA, 15 nt, Human
cauuucuuuuuggga

SEQ ID NO: 3435174 - RNA, 19 nt, Human
cauuugaaaauuuugaugu

SEQ ID NO: 3435175 - RNA, 19 nt, Human
cauuugaaaccccuguagg

SEQ ID NO: 3435176 - RNA, 21 nt, Human
cauuugaaaccccuguaggcc

SEQ ID NO: 3435177 - RNA, 11 nt, Human
cauuugaaaga

SEQ ID NO: 3435178 - RNA, 10 nt, Human
cauuugaaug

SEQ ID NO: 3435179 - RNA, 12 nt, Human
cauuugaaugca

SEQ ID NO: 3435180 - RNA, 23 nt, Human
cauuugacugaagaugcagcuca

SEQ ID NO: 3435181 - RNA, 16 nt, Human
cauuugagcagggcuc

SEQ ID NO: 3435182 - RNA, 18 nt, Human
cauuugaggucuguucuu

SEQ ID NO: 3435183 - RNA, 22 nt, Human
cauuugaggucuguucuuucca

SEQ ID NO: 3435184 - RNA, 14 nt, Human
cauuugagucucuu

SEQ ID NO: 3435185 - RNA, 22 nt, Human
cauuugaguuauuuuaauuauc

SEQ ID NO: 3435186 - RNA, 22 nt, Human
cauuugauaaaguaaggcaugg

SEQ ID NO: 3435187 - RNA, 14 nt, Human
cauuugauaaugau

SEQ ID NO: 3435188 - RNA, 16 nt, Human
cauuugauaaugauaa

SEQ ID NO: 3435189 - RNA, 23 nt, Human
cauuugauaaugauaaaacaccu

SEQ ID NO: 3435190 - RNA, 19 nt, Human
cauuugaugcaugucuuuu

SEQ ID NO: 3435191 - RNA, 20 nt, Human
cauuugaugcaugucuuuua

SEQ ID NO: 3435192 - RNA, 19 nt, Human
cauuugcaauaacagcugc

SEQ ID NO: 3435193 - RNA, 21 nt, Human
cauuugcacuggaguucuaug

SEQ ID NO: 3435194 - RNA, 14 nt, Human
cauuugcagggucc

SEQ ID NO: 3435195 - RNA, 19 nt, Human
cauuugcaggguccucuuc

SEQ ID NO: 3435196 - RNA, 18 nt, Human
cauuugccuauucccaca

SEQ ID NO: 3435197 - RNA, 16 nt, Human
cauuugccuugcagaa

SEQ ID NO: 3435198 - RNA, 22 nt, Human
cauuugccuugcagaacugcca

SEQ ID NO: 3435199 - RNA, 20 nt, Human
cauuugcgcacaacuuaaaa

SEQ ID NO: 3435200 - RNA, 22 nt, Human
cauuugcguuccaugaugcugg

SEQ ID NO: 3435201 - RNA, 20 nt, Human
cauuugcuaacuagcuugga

SEQ ID NO: 3435202 - RNA, 19 nt, Human
cauuugcucuucagaugcc

SEQ ID NO: 3435203 - RNA, 20 nt, Human
cauuugcucuucagaugcca

SEQ ID NO: 3435204 - RNA, 22 nt, Human
cauuugcucuucagaugccacu

SEQ ID NO: 3435205 - RNA, 11 nt, Human
cauuugcugaa

SEQ ID NO: 3435206 - RNA, 15 nt, Human
cauuugcuguuuuaa

SEQ ID NO: 3435207 - RNA, 16 nt, Human
cauuugcuuuuucacc

SEQ ID NO: 3435208 - RNA, 19 nt, Human
cauuugcuuuuugugauau

SEQ ID NO: 3435209 - RNA, 15 nt, Human
cauuuggaggcaauc

SEQ ID NO: 3435210 - RNA, 17 nt, Human
cauuuggagggccuggg

SEQ ID NO: 3435211 - RNA, 21 nt, Human
cauuuggcagggguggcugcc

SEQ ID NO: 3435212 - RNA, 20 nt, Human
cauuuggcuuuccagucaua

SEQ ID NO: 3435213 - RNA, 23 nt, Human
cauuugggaguuuuuaugagaaa

SEQ ID NO: 3435214 - RNA, 12 nt, Human
cauuugggcaga

SEQ ID NO: 3435215 - RNA, 22 nt, Human
cauuugggguagcuagaggaac

SEQ ID NO: 3435216 - RNA, 17 nt, Human
cauuuggguccaggagg

SEQ ID NO: 3435217 - RNA, 21 nt, Human
cauuuggugguuucagaaaug

SEQ ID NO: 3435218 - RNA, 22 nt, Human
cauuuggugguuucagaaaugu

SEQ ID NO: 3435219 - RNA, 23 nt, Human
cauuuggugguuucagaaaugug

SEQ ID NO: 3435220 - RNA, 20 nt, Human
cauuugguucauuaauucua

SEQ ID NO: 3435221 - RNA, 13 nt, Human
cauuuguaaaacu

SEQ ID NO: 3435222 - RNA, 18 nt, Human
cauuuguaaaugcugugu

SEQ ID NO: 3435223 - RNA, 13 nt, Human
cauuuguaauaaa

SEQ ID NO: 3435224 - RNA, 16 nt, Human
cauuuguaauaaagua

SEQ ID NO: 3435225 - RNA, 18 nt, Human
cauuuguaauaaaguaua

SEQ ID NO: 3435226 - RNA, 14 nt, Human
cauuuguaauuuaa

SEQ ID NO: 3435227 - RNA, 13 nt, Human
cauuuguagguag

SEQ ID NO: 3435228 - RNA, 16 nt, Human
cauuuguauaaaauaa

SEQ ID NO: 3435229 - RNA, 19 nt, Human
cauuuguauaaaauaauuu

SEQ ID NO: 3435230 - RNA, 12 nt, Human
cauuuguauauu

SEQ ID NO: 3435231 - RNA, 23 nt, Human
cauuuuuuuucuuugaauaaaug

SEQ ID NO: 3435232 - RNA, 22 nt, Human
cauuuuuuuuuuuaauuuugua

SEQ ID NO: 3435233 - RNA, 23 nt, Human
ccaaaaaagcuguauuuugaaaa

SEQ ID NO: 3435234 - RNA, 19 nt, Human
ccaaaaaauaucuaguaau

SEQ ID NO: 3435235 - RNA, 17 nt, Human
ccaaaaaaugcuugcuu

SEQ ID NO: 3435236 - RNA, 11 nt, Human
ccaaaaacaaa

SEQ ID NO: 3435237 - RNA, 16 nt, Human
ccaaaaaccaguauug

SEQ ID NO: 3435238 - RNA, 12 nt, Human
ccaaaaauagcu

SEQ ID NO: 3435239 - RNA, 19 nt, Human
ccaaaaauguguaagaaca

SEQ ID NO: 3435240 - RNA, 13 nt, Human
ccaaaaauuauua

SEQ ID NO: 3435241 - RNA, 14 nt, Human
ccaaaacaauguuu

SEQ ID NO: 3435242 - RNA, 22 nt, Human
ccaaaacauuccguuuacauuu

SEQ ID NO: 3435243 - RNA, 21 nt, Human
ccaaaaccgccagcucuguuc

SEQ ID NO: 3435244 - RNA, 14 nt, Human
ccaaaacuccugcc

SEQ ID NO: 3435245 - RNA, 17 nt, Human
ccaaaacucuccucugc

SEQ ID NO: 3435246 - RNA, 12 nt, Human
ccaaaagaaaaa

SEQ ID NO: 3435247 - RNA, 15 nt, Human
ccaaaagaaacugac

SEQ ID NO: 3435248 - RNA, 16 nt, Human
ccaaaaggaaaaagcu

SEQ ID NO: 3435249 - RNA, 23 nt, Human
ccaaaagguuuaagaaauagaau

SEQ ID NO: 3435250 - RNA, 18 nt, Human
ccaaaaguggccucuuug

SEQ ID NO: 3435251 - RNA, 21 nt, Human
ccaaaaguggccucuuugucu

SEQ ID NO: 3435252 - RNA, 20 nt, Human
ccaaaaguuacauguuugca

SEQ ID NO: 3435253 - RNA, 17 nt, Human
ccaaaaguuuuccugag

SEQ ID NO: 3435254 - RNA, 16 nt, Human
ccaaaauaagaaaaga

SEQ ID NO: 3435255 - RNA, 18 nt, Human
ccaaaauaagaaaagaug

SEQ ID NO: 3435256 - RNA, 22 nt, Human
ccaaaauaaugucuuguuaaua

SEQ ID NO: 3435257 - RNA, 15 nt, Human
ccaaaaugacaucuu

SEQ ID NO: 3435258 - RNA, 16 nt, Human
ccaaaaugacaucuuu

SEQ ID NO: 3435259 - RNA, 19 nt, Human
ccaaaaugacaucuuuuua

SEQ ID NO: 3435260 - RNA, 22 nt, Human
ccaaaaugcucuagugccuucu

SEQ ID NO: 3435261 - RNA, 15 nt, Human
ccaaaaugugccuau

SEQ ID NO: 3435262 - RNA, 17 nt, Human
ccaaaauguugcugaaa

SEQ ID NO: 3435263 - RNA, 17 nt, Human
ccaaacacacagaaggg

SEQ ID NO: 3435264 - RNA, 20 nt, Human
ccaaacaccuuccagcuccu

SEQ ID NO: 3435265 - RNA, 13 nt, Human
ccaaacagcaaac

SEQ ID NO: 3435266 - RNA, 23 nt, Human
ccaaacagcaaaccaagagauug

SEQ ID NO: 3435267 - RNA, 16 nt, Human
ccaaacagcugccucu

SEQ ID NO: 3435268 - RNA, 16 nt, Human
ccaaacaggcccuccu

SEQ ID NO: 3435269 - RNA, 17 nt, Human
ccaaacauaugcacauu

SEQ ID NO: 3435270 - RNA, 19 nt, Human
ccaaacauccuacaagaca

SEQ ID NO: 3435271 - RNA, 14 nt, Human
ccaaacauguauuu

SEQ ID NO: 3435272 - RNA, 12 nt, Human
ccaaacauuaau

SEQ ID NO: 3435273 - RNA, 15 nt, Human
ccaaacauuaauguu

SEQ ID NO: 3435274 - RNA, 21 nt, Human
ccaaacauuaauguugauuuc

SEQ ID NO: 3435275 - RNA, 14 nt, Human
ccaaaccacuuuuu

SEQ ID NO: 3435276 - RNA, 16 nt, Human
ccaaacccaugaggca

SEQ ID NO: 3435277 - RNA, 16 nt, Human
ccaaacccccauucug

SEQ ID NO: 3435278 - RNA, 14 nt, Human
ccaaaccuagcccc

SEQ ID NO: 3435279 - RNA, 16 nt, Human
ccaaaccucaccaacu

SEQ ID NO: 3435280 - RNA, 18 nt, Human
ccaaaccuucacacacag

SEQ ID NO: 3435281 - RNA, 17 nt, Human
ccaaacucaccugcccc

SEQ ID NO: 3435282 - RNA, 17 nt, Human
ccaaacugauccaguau

SEQ ID NO: 3435283 - RNA, 12 nt, Human
ccaaacugccua

SEQ ID NO: 3435284 - RNA, 19 nt, Human
ccaaacugccuaagcccuc

SEQ ID NO: 3435285 - RNA, 13 nt, Human
ccaaacugcugga

SEQ ID NO: 3435286 - RNA, 16 nt, Human
ccaaacuuggauuuuu

SEQ ID NO: 3435287 - RNA, 17 nt, Human
ccaaagaaaugaacauu

SEQ ID NO: 3435288 - RNA, 23 nt, Human
ccaaagaaaugaacauuccaagg

SEQ ID NO: 3435289 - RNA, 14 nt, Human
ccaaagaacagccu

SEQ ID NO: 3435290 - RNA, 15 nt, Human
ccaaagaaccaaaga

SEQ ID NO: 3435291 - RNA, 20 nt, Human
cacgcugucuccagaccccc

SEQ ID NO: 3435292 - RNA, 23 nt, Human
cacgcugucuccagacccccacc

SEQ ID NO: 3435293 - RNA, 16 nt, Human
cacgcugugggcaggu

SEQ ID NO: 3435294 - RNA, 19 nt, Human
cacgcuugcguaugucugu

SEQ ID NO: 3435295 - RNA, 18 nt, Human
cacgcuuucagcgaauga

SEQ ID NO: 3435296 - RNA, 14 nt, Human
cacgcuuucuagcu

SEQ ID NO: 3435297 - RNA, 22 nt, Human
cacggaagagccuugcggaagg

SEQ ID NO: 3435298 - RNA, 20 nt, Human
cacggaccaaagggagucug

SEQ ID NO: 3435299 - RNA, 19 nt, Human
cacggacgcuggcucccca

SEQ ID NO: 3435300 - RNA, 20 nt, Human
cacggagauaugaagagcaa

SEQ ID NO: 3435301 - RNA, 16 nt, Human
cacggagccacuccuc

SEQ ID NO: 3435302 - RNA, 22 nt, Human
cacggagcggauugcaaagcaa

SEQ ID NO: 3435303 - RNA, 23 nt, Human
cacggauccauguagcaggacug

SEQ ID NO: 3435304 - RNA, 13 nt, Human
cacggaucugaga

SEQ ID NO: 3435305 - RNA, 14 nt, Human
cacggaucugagaa

SEQ ID NO: 3435306 - RNA, 17 nt, Human
cacggcaaaggaagacg

SEQ ID NO: 3435307 - RNA, 21 nt, Human
cacggcaggacaacgaggaag

SEQ ID NO: 3435308 - RNA, 22 nt, Human
cacggcaggacaacgaggaagc

SEQ ID NO: 3435309 - RNA, 15 nt, Human
cacggccaacaaagc

SEQ ID NO: 3435310 - RNA, 17 nt, Human
cacggccaacaaagcug

SEQ ID NO: 3435311 - RNA, 19 nt, Human
cacggccacaucaaagagg

SEQ ID NO: 3435312 - RNA, 14 nt, Human
cacggccgcuccag

SEQ ID NO: 3435313 - RNA, 17 nt, Human
cacggccgcuccagggg

SEQ ID NO: 3435314 - RNA, 20 nt, Human
cacggccuuucuagccuggc

SEQ ID NO: 3435315 - RNA, 20 nt, Human
cacggcuaagaggcugcuga

SEQ ID NO: 3435316 - RNA, 19 nt, Human
cacggcucacugcagccuc

SEQ ID NO: 3435317 - RNA, 22 nt, Human
cacggcuccucgagaucccaac

SEQ ID NO: 3435318 - RNA, 19 nt, Human
cacggcucuguccccagcc

SEQ ID NO: 3435319 - RNA, 18 nt, Human
cacgggacggaagugcuu

SEQ ID NO: 3435320 - RNA, 15 nt, Human
cacgggagauuucuu

SEQ ID NO: 3435321 - RNA, 15 nt, Human
cacgggcagccuggc

SEQ ID NO: 3435322 - RNA, 18 nt, Human
cacgggcagccuggcucc

SEQ ID NO: 3435323 - RNA, 14 nt, Human
cacgggccugucca

SEQ ID NO: 3435324 - RNA, 17 nt, Human
cacgggccuguccacag

SEQ ID NO: 3435325 - RNA, 22 nt, Human
cacgggggcagcugauacaaau

SEQ ID NO: 3435326 - RNA, 15 nt, Human
cacgggguauuuuag

SEQ ID NO: 3435327 - RNA, 21 nt, Human
cacggguaaaucuaguaccau

SEQ ID NO: 3435328 - RNA, 14 nt, Human
cacggguggucccc

SEQ ID NO: 3435329 - RNA, 16 nt, Human
cacggucuucccucuu

SEQ ID NO: 3435330 - RNA, 15 nt, Human
cacggugccuuuuuu

SEQ ID NO: 3435331 - RNA, 17 nt, Human
cacggugccuuuuuuca

SEQ ID NO: 3435332 - RNA, 19 nt, Human
cacguaaugaaacuuggau

SEQ ID NO: 3435333 - RNA, 14 nt, Human
cacguacacacaca

SEQ ID NO: 3435334 - RNA, 20 nt, Human
cacguaguagggucaggcca

SEQ ID NO: 3435335 - RNA, 21 nt, Human
cacguaguagggucaggccac

SEQ ID NO: 3435336 - RNA, 23 nt, Human
cacguaguagggucaggccacgg

SEQ ID NO: 3435337 - RNA, 17 nt, Human
cacgucaucuaguuuua

SEQ ID NO: 3435338 - RNA, 16 nt, Human
cacguccucgcucccg

SEQ ID NO: 3435339 - RNA, 13 nt, Human
cacguccugagaa

SEQ ID NO: 3435340 - RNA, 14 nt, Human
cacguccugucagu

SEQ ID NO: 3435341 - RNA, 19 nt, Human
cacguccugucagugccgc

SEQ ID NO: 3435342 - RNA, 23 nt, Human
cacgucuauuucaucagaacagc

SEQ ID NO: 3435343 - RNA, 16 nt, Human
cacgucugacccucuc

SEQ ID NO: 3435344 - RNA, 15 nt, Human
cacgucuuccuucug

SEQ ID NO: 3435345 - RNA, 23 nt, Human
cacgucuuccuucugccugagcu

SEQ ID NO: 3435346 - RNA, 13 nt, Human
cacgugacagccg

SEQ ID NO: 3435347 - RNA, 20 nt, Human
cacgugagaaucccuggcaa

SEQ ID NO: 3435348 - RNA, 18 nt, Human
cacguggcauguggccug

SEQ ID NO: 3435349 - RNA, 20 nt, Human
cacguggcauguggccugug

SEQ ID NO: 3435350 - RNA, 22 nt, Human
cacguggcauguggccuguggc

SEQ ID NO: 3435351 - RNA, 17 nt, Human
cacguggccucuugagc

SEQ ID NO: 3435352 - RNA, 18 nt, Human
cacgugguaaaacacuug

SEQ ID NO: 3435353 - RNA, 23 nt, Human
cacgugguuggggcccugcccug

SEQ ID NO: 3435354 - RNA, 14 nt, Human
cacgugucuuccac

SEQ ID NO: 3435355 - RNA, 19 nt, Human
cacguguggaccccugcgg

SEQ ID NO: 3435356 - RNA, 16 nt, Human
cacgugugugacucag

SEQ ID NO: 3435357 - RNA, 16 nt, Human
cacguguuugugcugu

SEQ ID NO: 3435358 - RNA, 22 nt, Human
cacguguuuuauuccuguaugu

SEQ ID NO: 3435359 - RNA, 19 nt, Human
cacguucucacacccaccg

SEQ ID NO: 3435360 - RNA, 16 nt, Human
cacguugccucuacuu

SEQ ID NO: 3435361 - RNA, 12 nt, Human
cacguuucuaaa

SEQ ID NO: 3435362 - RNA, 14 nt, Human
cacguuucuaaagg

SEQ ID NO: 3435363 - RNA, 14 nt, Human
cacguuuugaaaua

SEQ ID NO: 3435364 - RNA, 15 nt, Human
cacguuuuguuuugu

SEQ ID NO: 3435365 - RNA, 21 nt, Human
cacuaaacuuggugcuuauug

SEQ ID NO: 3435366 - RNA, 21 nt, Human
cacuaaagcaugaaaugugaa

SEQ ID NO: 3435367 - RNA, 22 nt, Human
cacuaaagcaugaaaugugaau

SEQ ID NO: 3435368 - RNA, 15 nt, Human
cacuaaagccagccu

SEQ ID NO: 3435369 - RNA, 12 nt, Human
cacuaaauguua

SEQ ID NO: 3435370 - RNA, 20 nt, Human
cacuaaauguuaaagaugua

SEQ ID NO: 3435371 - RNA, 23 nt, Human
cacuaaauguuaaagauguagca

SEQ ID NO: 3435372 - RNA, 16 nt, Human
cacuaacaugauuugg

SEQ ID NO: 3435373 - RNA, 16 nt, Human
cacuaaccacgcugga

SEQ ID NO: 3435374 - RNA, 16 nt, Human
cacuaacgaaauauca

SEQ ID NO: 3435375 - RNA, 13 nt, Human
cacucugugccca

SEQ ID NO: 3435376 - RNA, 18 nt, Human
cacucugugcccaugggc

SEQ ID NO: 3435377 - RNA, 20 nt, Human
cacucuguuauuuagacuca

SEQ ID NO: 3435378 - RNA, 12 nt, Human
cacucuguuccu

SEQ ID NO: 3435379 - RNA, 14 nt, Human
cacucuuaugcugu

SEQ ID NO: 3435380 - RNA, 21 nt, Human
cacucuuaugcuguacccagu

SEQ ID NO: 3435381 - RNA, 17 nt, Human
cacucuuauugcccacg

SEQ ID NO: 3435382 - RNA, 11 nt, Human
cacucuuccag

SEQ ID NO: 3435383 - RNA, 21 nt, Human
cacucuuccagaaucccaaga

SEQ ID NO: 3435384 - RNA, 17 nt, Human
cacucuugaaaaaugca

SEQ ID NO: 3435385 - RNA, 14 nt, Human
cacucuuggagccu

SEQ ID NO: 3435386 - RNA, 21 nt, Human
cacucuuguuucucccgugcu

SEQ ID NO: 3435387 - RNA, 19 nt, Human
cacucuuuaccuuuauuga

SEQ ID NO: 3435388 - RNA, 16 nt, Human
cacucuuuauagugca

SEQ ID NO: 3435389 - RNA, 16 nt, Human
cacucuuucuccugcu

SEQ ID NO: 3435390 - RNA, 14 nt, Human
cacucuuucuuuca

SEQ ID NO: 3435391 - RNA, 15 nt, Human
cacucuuucuuucaa

SEQ ID NO: 3435392 - RNA, 13 nt, Human
cacugaaaaaaua

SEQ ID NO: 3435393 - RNA, 14 nt, Human
cacugaaaaacaac

SEQ ID NO: 3435394 - RNA, 14 nt, Human
cacugaaaaauuau

SEQ ID NO: 3435395 - RNA, 21 nt, Human
cacugaaaagguucuucaucc

SEQ ID NO: 3435396 - RNA, 22 nt, Human
cacugaaaagguucuucauccc

SEQ ID NO: 3435397 - RNA, 13 nt, Human
cacugaaaguuuu

SEQ ID NO: 3435398 - RNA, 16 nt, Human
cacugaaaguuuugua

SEQ ID NO: 3435399 - RNA, 21 nt, Human
cacugaaaguuuuguaaaaga

SEQ ID NO: 3435400 - RNA, 23 nt, Human
cacugaaaguuuuguaaaagaaa

SEQ ID NO: 3435401 - RNA, 16 nt, Human
cacugaaauaugugaa

SEQ ID NO: 3435402 - RNA, 17 nt, Human
cacugaaaucugucaag

SEQ ID NO: 3435403 - RNA, 21 nt, Human
cacugaaaugccuuacuuugu

SEQ ID NO: 3435404 - RNA, 12 nt, Human
cacugaagagga

SEQ ID NO: 3435405 - RNA, 13 nt, Human
cacugaagaggag

SEQ ID NO: 3435406 - RNA, 16 nt, Human
cacugaagaggaggag

SEQ ID NO: 3435407 - RNA, 14 nt, Human
cacugaagaguaug

SEQ ID NO: 3435408 - RNA, 17 nt, Human
cacugaagauagaagaa

SEQ ID NO: 3435409 - RNA, 13 nt, Human
cacugaagcuggg

SEQ ID NO: 3435410 - RNA, 17 nt, Human
cacugaagcugggauuc

SEQ ID NO: 3435411 - RNA, 14 nt, Human
cacugaauauuuau

SEQ ID NO: 3435412 - RNA, 15 nt, Human
cacugaaucuguaca

SEQ ID NO: 3435413 - RNA, 16 nt, Human
cacugaaucuguacag

SEQ ID NO: 3435414 - RNA, 15 nt, Human
cacugaauuaaucau

SEQ ID NO: 3435415 - RNA, 13 nt, Human
cacugacacaaag

SEQ ID NO: 3435416 - RNA, 22 nt, Human
cacugacaccuuugcaggcaug

SEQ ID NO: 3435417 - RNA, 11 nt, Human
cacugacagau

SEQ ID NO: 3435418 - RNA, 14 nt, Human
cacugacagccucc

SEQ ID NO: 3435419 - RNA, 23 nt, Human
cacugacauuguuggccaaagcc

SEQ ID NO: 3435420 - RNA, 13 nt, Human
cacugaccagaac

SEQ ID NO: 3435421 - RNA, 23 nt, Human
cacugaccauccacucuacccuc

SEQ ID NO: 3435422 - RNA, 19 nt, Human
cacugacccacagccucug

SEQ ID NO: 3435423 - RNA, 22 nt, Human
cacugaccuuggagagacacag

SEQ ID NO: 3435424 - RNA, 15 nt, Human
cacugacuacuggcu

SEQ ID NO: 3435425 - RNA, 19 nt, Human
cacugacuacuggcucuca

SEQ ID NO: 3435426 - RNA, 12 nt, Human
cacugacucugg

SEQ ID NO: 3435427 - RNA, 16 nt, Human
cacugacugcagggac

SEQ ID NO: 3435428 - RNA, 14 nt, Human
cacugacugggacc

SEQ ID NO: 3435429 - RNA, 19 nt, Human
cacugagaagauugugaau

SEQ ID NO: 3435430 - RNA, 18 nt, Human
cacugagaauguaagaac

SEQ ID NO: 3435431 - RNA, 23 nt, Human
cacugagacagcccgggcucugc

SEQ ID NO: 3435432 - RNA, 19 nt, Human
cacugagauaccagcgagg

SEQ ID NO: 3435433 - RNA, 14 nt, Human
cacugagcaaagca

SEQ ID NO: 3435434 - RNA, 16 nt, Human
cacugagcacuguuuu

SEQ ID NO: 3435435 - RNA, 16 nt, Human
cacugagcccccccaa

SEQ ID NO: 3435436 - RNA, 13 nt, Human
cacugaggaagaa

SEQ ID NO: 3435437 - RNA, 14 nt, Human
cacugaggaagaac

SEQ ID NO: 3435438 - RNA, 15 nt, Human
cacugaggaagaacg

SEQ ID NO: 3435439 - RNA, 17 nt, Human
cacugaggaagaacggg

SEQ ID NO: 3435440 - RNA, 15 nt, Human
cacugaggaccagcc

SEQ ID NO: 3435441 - RNA, 16 nt, Human
cacugaggcagggaag

SEQ ID NO: 3435442 - RNA, 20 nt, Human
cacugaggggggauccaguu

SEQ ID NO: 3435443 - RNA, 22 nt, Human
cacugaguuuuccauggcagga

SEQ ID NO: 3435444 - RNA, 16 nt, Human
cacugauauauuuaaa

SEQ ID NO: 3435445 - RNA, 17 nt, Human
cacugaugcuguucucu

SEQ ID NO: 3435446 - RNA, 15 nt, Human
cacugaugcuuagau

SEQ ID NO: 3435447 - RNA, 19 nt, Human
cacugauggaaacaaagug

SEQ ID NO: 3435448 - RNA, 19 nt, Human
cacugauggacaaggaggu

SEQ ID NO: 3435449 - RNA, 19 nt, Human
cacugauguuguguuuuua

SEQ ID NO: 3435450 - RNA, 16 nt, Human
cacugauuuggagaua

SEQ ID NO: 3435451 - RNA, 13 nt, Human
cacugcaacauga

SEQ ID NO: 3435452 - RNA, 17 nt, Human
cacugcaaccuccaccu

SEQ ID NO: 3435453 - RNA, 14 nt, Human
cacugcaaccuccg

SEQ ID NO: 3435454 - RNA, 19 nt, Human
cacugcaagagccuuggug

SEQ ID NO: 3435455 - RNA, 18 nt, Human
cacugcaaucauauguga

SEQ ID NO: 3435456 - RNA, 19 nt, Human
cacugcaauccugucuuuc

SEQ ID NO: 3435457 - RNA, 18 nt, Human
cacugcacaauaacuccu

SEQ ID NO: 3435458 - RNA, 19 nt, Human
cacugcacagagcucucca

SEQ ID NO: 3435459 - RNA, 19 nt, Human
cacugcacagugcaucuca

SEQ ID NO: 3435460 - RNA, 22 nt, Human
cacugcacagugcaucucagcc

SEQ ID NO: 3435461 - RNA, 15 nt, Human
cacugcaccaccgag

SEQ ID NO: 3435462 - RNA, 14 nt, Human
cacugcacccccuc

SEQ ID NO: 3435463 - RNA, 16 nt, Human
cacugcacccccuccu

SEQ ID NO: 3435464 - RNA, 14 nt, Human
cacugcaccgggcc

SEQ ID NO: 3435465 - RNA, 16 nt, Human
cacugcaccgggccac

SEQ ID NO: 3435466 - RNA, 19 nt, Human
cacugcaccgggccacaga

SEQ ID NO: 3435467 - RNA, 18 nt, Human
cacugcacguuuucaucu

SEQ ID NO: 3435468 - RNA, 15 nt, Human
cacugcacuccagcc

SEQ ID NO: 3435469 - RNA, 16 nt, Human
cacugcacuccagccu

SEQ ID NO: 3435470 - RNA, 18 nt, Human
cacugcacuccagccugg

SEQ ID NO: 3435471 - RNA, 18 nt, Human
cacugcacucuagccgga

SEQ ID NO: 3435472 - RNA, 19 nt, Human
cacugcagccucaaccucc

SEQ ID NO: 3435473 - RNA, 22 nt, Human
cacugcagccucaaccuccugg

SEQ ID NO: 3435474 - RNA, 23 nt, Human
cacugcagccucaaccuccuggg

SEQ ID NO: 3435475 - RNA, 23 nt, Human
cacugcagccuccgcuucccugg

SEQ ID NO: 3435476 - RNA, 14 nt, Human
cacugcagccucga

SEQ ID NO: 3435477 - RNA, 22 nt, Human
cacugcagccucgaacuccugg

SEQ ID NO: 3435478 - RNA, 16 nt, Human
cacugcaggccccgcu

SEQ ID NO: 3435479 - RNA, 13 nt, Human
cacugcaggggcc

SEQ ID NO: 3435480 - RNA, 18 nt, Human
cacugcaugagcuuuuau

SEQ ID NO: 3435481 - RNA, 19 nt, Human
cacugcauggcucccacag

SEQ ID NO: 3435482 - RNA, 11 nt, Human
cacugccacac

SEQ ID NO: 3435483 - RNA, 12 nt, Human
cacugccacugg

SEQ ID NO: 3435484 - RNA, 12 nt, Human
cacugccagcag

SEQ ID NO: 3435485 - RNA, 13 nt, Human
cacugccagcagc

SEQ ID NO: 3435486 - RNA, 20 nt, Human
cacugccagcagcagcaggu

SEQ ID NO: 3435487 - RNA, 22 nt, Human
cacugccagcagcagcagguga

SEQ ID NO: 3435488 - RNA, 22 nt, Human
cacugccagcauuucccuuccu

SEQ ID NO: 3435489 - RNA, 16 nt, Human
cacugccaggagggac

SEQ ID NO: 3435490 - RNA, 22 nt, Human
cacugccaggagggacaaagga

SEQ ID NO: 3435491 - RNA, 21 nt, Human
cacugccaggccagccuccga

SEQ ID NO: 3435492 - RNA, 21 nt, Human
cacugccauaaaacauuaaga

SEQ ID NO: 3435493 - RNA, 18 nt, Human
cacugccauaugauuuac

SEQ ID NO: 3435494 - RNA, 17 nt, Human
cacugccaucugaugcc

SEQ ID NO: 3435495 - RNA, 19 nt, Human
cacugccaugcagggccuc

SEQ ID NO: 3435496 - RNA, 12 nt, Human
ccacagcccugu

SEQ ID NO: 3435497 - RNA, 16 nt, Human
ccacagcccugucagc

SEQ ID NO: 3435498 - RNA, 20 nt, Human
ccacagcccuuuugucucug

SEQ ID NO: 3435499 - RNA, 18 nt, Human
ccacagcgagggcagcug

SEQ ID NO: 3435500 - RNA, 20 nt, Human
ccacagcgagggcagcugcu

SEQ ID NO: 3435501 - RNA, 19 nt, Human
ccacagcgcuggccgggac

SEQ ID NO: 3435502 - RNA, 23 nt, Human
ccacagcgcuggccgggaccccg

SEQ ID NO: 3435503 - RNA, 15 nt, Human
ccacagcuccuuuuc

SEQ ID NO: 3435504 - RNA, 16 nt, Human
ccacagcuccuuuucc

SEQ ID NO: 3435505 - RNA, 16 nt, Human
ccacagcugagaaugu

SEQ ID NO: 3435506 - RNA, 14 nt, Human
ccacagcugccucu

SEQ ID NO: 3435507 - RNA, 12 nt, Human
ccacagcugcug

SEQ ID NO: 3435508 - RNA, 13 nt, Human
ccacagcugcugg

SEQ ID NO: 3435509 - RNA, 16 nt, Human
ccacagcugcuggaga

SEQ ID NO: 3435510 - RNA, 11 nt, Human
ccacagcuucc

SEQ ID NO: 3435511 - RNA, 14 nt, Human
ccacaggaaagugu

SEQ ID NO: 3435512 - RNA, 20 nt, Human
ccacaggaaccacaagacug

SEQ ID NO: 3435513 - RNA, 22 nt, Human
ccacaggaggcaagcaagcucu

SEQ ID NO: 3435514 - RNA, 18 nt, Human
ccacaggcaugucccaug

SEQ ID NO: 3435515 - RNA, 16 nt, Human
ccacaggcccuuccuc

SEQ ID NO: 3435516 - RNA, 17 nt, Human
ccacaggcccuuccucu

SEQ ID NO: 3435517 - RNA, 23 nt, Human
ccacaggcccuuccucuccacug

SEQ ID NO: 3435518 - RNA, 21 nt, Human
ccacaggcccuuuccucaggc

SEQ ID NO: 3435519 - RNA, 22 nt, Human
ccacaggcccuuuccucaggca

SEQ ID NO: 3435520 - RNA, 15 nt, Human
ccacaggccucccug

SEQ ID NO: 3435521 - RNA, 16 nt, Human
cacugcccgagcuggu

SEQ ID NO: 3435522 - RNA, 17 nt, Human
cacugcccgcacacccu

SEQ ID NO: 3435523 - RNA, 18 nt, Human
cacugcccgcacacccuc

SEQ ID NO: 3435524 - RNA, 19 nt, Human
cacugcccugguggcccuc

SEQ ID NO: 3435525 - RNA, 13 nt, Human
cacugcccuucuc

SEQ ID NO: 3435526 - RNA, 12 nt, Human
cacugccucagg

SEQ ID NO: 3435527 - RNA, 13 nt, Human
cacugccucaggu

SEQ ID NO: 3435528 - RNA, 14 nt, Human
cacugccucagguu

SEQ ID NO: 3435529 - RNA, 16 nt, Human
cacugccucagguucc

SEQ ID NO: 3435530 - RNA, 17 nt, Human
cacugccucagguuccu

SEQ ID NO: 3435531 - RNA, 23 nt, Human
cacugccucgggaaccucacucu

SEQ ID NO: 3435532 - RNA, 12 nt, Human
cacugccucugc

SEQ ID NO: 3435533 - RNA, 10 nt, Human
cacugccugc

SEQ ID NO: 3435534 - RNA, 22 nt, Human
cacugccugcagaggucugugc

SEQ ID NO: 3435535 - RNA, 23 nt, Human
cacugccugcagaggucugugcu

SEQ ID NO: 3435536 - RNA, 16 nt, Human
cacugccugccuuaag

SEQ ID NO: 3435537 - RNA, 13 nt, Human
cacugccugcucc

SEQ ID NO: 3435538 - RNA, 12 nt, Human
cacugccugggc

SEQ ID NO: 3435539 - RNA, 19 nt, Human
cacugccugggcugacccc

SEQ ID NO: 3435540 - RNA, 22 nt, Human
cacugccuucgauacaccgggc

SEQ ID NO: 3435541 - RNA, 15 nt, Human
cacugcgccacugcu

SEQ ID NO: 3435542 - RNA, 18 nt, Human
cacugcgcuuuauuuucu

SEQ ID NO: 3435543 - RNA, 19 nt, Human
cacugcggggcuuggcuga

SEQ ID NO: 3435544 - RNA, 17 nt, Human
cacugcuaggugggcca

SEQ ID NO: 3435545 - RNA, 19 nt, Human
cacugcucaagaagacaug

SEQ ID NO: 3435546 - RNA, 22 nt, Human
cacugcucaagaagacauggag

SEQ ID NO: 3435547 - RNA, 13 nt, Human
cacugcucacacu

SEQ ID NO: 3435548 - RNA, 11 nt, Human
cacugcucccu

SEQ ID NO: 3435549 - RNA, 21 nt, Human
cacugcucccuaagccagccu

SEQ ID NO: 3435550 - RNA, 23 nt, Human
cacugcucccuaagccagccugg

SEQ ID NO: 3435551 - RNA, 19 nt, Human
cacugcucccugaagccag

SEQ ID NO: 3435552 - RNA, 20 nt, Human
cacugcucccugaagccagc

SEQ ID NO: 3435553 - RNA, 21 nt, Human
cacugcucccugaagccagcc

SEQ ID NO: 3435554 - RNA, 22 nt, Human
cacugcucccugaagccagccu

SEQ ID NO: 3435555 - RNA, 13 nt, Human
cacugcucucacc

SEQ ID NO: 3435556 - RNA, 20 nt, Human
cacugcugauauuuucucua

SEQ ID NO: 3435557 - RNA, 18 nt, Human
cacugcugcaaggccuuu

SEQ ID NO: 3435558 - RNA, 17 nt, Human
cacugcuggagaggccc

SEQ ID NO: 3435559 - RNA, 12 nt, Human
cacugcuggcug

SEQ ID NO: 3435560 - RNA, 13 nt, Human
cacugcuggcugc

SEQ ID NO: 3435561 - RNA, 16 nt, Human
cacugcuggcugccuu

SEQ ID NO: 3435562 - RNA, 21 nt, Human
cacugcuggcugccuuagaac

SEQ ID NO: 3435563 - RNA, 17 nt, Human
cacugcugugaacaagu

SEQ ID NO: 3435564 - RNA, 18 nt, Human
cacugcuguuauauuuca

SEQ ID NO: 3435565 - RNA, 13 nt, Human
cacugcuuaacuu

SEQ ID NO: 3435566 - RNA, 15 nt, Human
cacugcuuccaguga

SEQ ID NO: 3435567 - RNA, 19 nt, Human
cacugcuuccagugaggcu

SEQ ID NO: 3435568 - RNA, 15 nt, Human
cacugcuugaggaaa

SEQ ID NO: 3435569 - RNA, 18 nt, Human
cacugcuuuuggccugga

SEQ ID NO: 3435570 - RNA, 18 nt, Human
cacuggaaaggggagagc

SEQ ID NO: 3435571 - RNA, 23 nt, Human
cacuggaaaggggagagccugcu

SEQ ID NO: 3435572 - RNA, 17 nt, Human
cacuggaacacuaauga

SEQ ID NO: 3435573 - RNA, 19 nt, Human
cacuggacuccggcccucc

SEQ ID NO: 3435574 - RNA, 17 nt, Human
cacuggacugaccuggu

SEQ ID NO: 3435575 - RNA, 10 nt, Human
cacuggagca

SEQ ID NO: 3435576 - RNA, 11 nt, Human
cacuggagccc

SEQ ID NO: 3435577 - RNA, 20 nt, Human
cacuggagguugaagccaag

SEQ ID NO: 3435578 - RNA, 23 nt, Human
cacuggagugcagggaggagagg

SEQ ID NO: 3435579 - RNA, 23 nt, Human
cacuggaugcaaagaaaaucaga

SEQ ID NO: 3435580 - RNA, 14 nt, Human
cacuggcauugucc

SEQ ID NO: 3435581 - RNA, 22 nt, Human
cacuggcauugucccugugccu

SEQ ID NO: 3435582 - RNA, 16 nt, Human
cacuggccaccaggcu

SEQ ID NO: 3435583 - RNA, 21 nt, Human
cacuggccaccaggcuggcgc

SEQ ID NO: 3435584 - RNA, 22 nt, Human
cacuggccaccaggcuggcgca

SEQ ID NO: 3435585 - RNA, 13 nt, Human
cacuggccccacc

SEQ ID NO: 3435586 - RNA, 22 nt, Human
cacuggccccuagaaucagccu

SEQ ID NO: 3435587 - RNA, 20 nt, Human
cacuggccuucugaugaaau

SEQ ID NO: 3435588 - RNA, 13 nt, Human
cacuggcgaggag

SEQ ID NO: 3435589 - RNA, 23 nt, Human
cacuggcgcaucauaugcaguga

SEQ ID NO: 3435590 - RNA, 23 nt, Human
cacuggcguagaaguuuuuguac

SEQ ID NO: 3435591 - RNA, 17 nt, Human
cacuggcucacccaguc

SEQ ID NO: 3435592 - RNA, 12 nt, Human
cacuggcucucc

SEQ ID NO: 3435593 - RNA, 17 nt, Human
cacuggcucuccaagug

SEQ ID NO: 3435594 - RNA, 15 nt, Human
cacuggcucuccugg

SEQ ID NO: 3435595 - RNA, 17 nt, Human
cacuggcucucuccagg

SEQ ID NO: 3435596 - RNA, 18 nt, Human
cacuggcucucuccagga

SEQ ID NO: 3435597 - RNA, 21 nt, Human
cacuggcugagcggaugcauc

SEQ ID NO: 3435598 - RNA, 16 nt, Human
cacuggcugccuccac

SEQ ID NO: 3435599 - RNA, 18 nt, Human
cacuggcugccuccacuc

SEQ ID NO: 3435600 - RNA, 20 nt, Human
cacuggcugccuccacuccc

SEQ ID NO: 3435601 - RNA, 21 nt, Human
cacuggcugccuccacuccca

SEQ ID NO: 3435602 - RNA, 13 nt, Human
cacuggcuguggg

SEQ ID NO: 3435603 - RNA, 13 nt, Human
cacugggaaacag

SEQ ID NO: 3435604 - RNA, 19 nt, Human
cacugggagaaaugaaaaa

SEQ ID NO: 3435605 - RNA, 18 nt, Human
cacugggaggcuccccuu

SEQ ID NO: 3435606 - RNA, 20 nt, Human
cacugggaggcuccccuucu

SEQ ID NO: 3435607 - RNA, 11 nt, Human
cacugggccaa

SEQ ID NO: 3435608 - RNA, 20 nt, Human
cacugggccaauucaauaca

SEQ ID NO: 3435609 - RNA, 16 nt, Human
cacugggcucccgggc

SEQ ID NO: 3435610 - RNA, 23 nt, Human
cacugggcuuggggaccagagcu

SEQ ID NO: 3435611 - RNA, 16 nt, Human
cacuggggauugggcc

SEQ ID NO: 3435612 - RNA, 14 nt, Human
cacuggggcacuug

SEQ ID NO: 3435613 - RNA, 19 nt, Human
cacuggggcaggggccggg

SEQ ID NO: 3435614 - RNA, 15 nt, Human
cacugggggagggga

SEQ ID NO: 3435615 - RNA, 15 nt, Human
cacugggguccuggg

SEQ ID NO: 3435616 - RNA, 22 nt, Human
cacugggugcccaagcucagaa

SEQ ID NO: 3435617 - RNA, 22 nt, Human
cacugggugguggccugguccc

SEQ ID NO: 3435618 - RNA, 15 nt, Human
cacuggguugacuuu

SEQ ID NO: 3435619 - RNA, 21 nt, Human
cacugguacuuagaguuucug

SEQ ID NO: 3435620 - RNA, 22 nt, Human
cacugguacuuagaguuucugu

SEQ ID NO: 3435621 - RNA, 20 nt, Human
cacugguagaccaaaauaaa

SEQ ID NO: 3435622 - RNA, 21 nt, Human
cacugguagguugggacacca

SEQ ID NO: 3435623 - RNA, 22 nt, Human
cacugguagguugggacaccag

SEQ ID NO: 3435624 - RNA, 16 nt, Human
cacugguauuccugcc

SEQ ID NO: 3435625 - RNA, 15 nt, Human
cacuggucugcuguc

SEQ ID NO: 3435626 - RNA, 13 nt, Human
cacugguggcccg

SEQ ID NO: 3435627 - RNA, 22 nt, Human
cacugguggggauaggccagcc

SEQ ID NO: 3435628 - RNA, 15 nt, Human
cacugguugcacuua

SEQ ID NO: 3435629 - RNA, 18 nt, Human
cacugguuuguucccugu

SEQ ID NO: 3435630 - RNA, 12 nt, Human
cacuguaaaaug

SEQ ID NO: 3435631 - RNA, 18 nt, Human
cacuguaaaaugaaauua

SEQ ID NO: 3435632 - RNA, 20 nt, Human
cacuguacccagucucaaag

SEQ ID NO: 3435633 - RNA, 15 nt, Human
cacuguacuugcucu

SEQ ID NO: 3435634 - RNA, 18 nt, Human
cacuguagaaugauuuca

SEQ ID NO: 3435635 - RNA, 19 nt, Human
cacuguaguaaauaaugcu

SEQ ID NO: 3435636 - RNA, 20 nt, Human
cacuguaguucuaagacuca

SEQ ID NO: 3435637 - RNA, 17 nt, Human
cacuguauaaauaggag

SEQ ID NO: 3435638 - RNA, 15 nt, Human
cacuguaugagugga

SEQ ID NO: 3435639 - RNA, 20 nt, Human
cacuguauguuauagaacuu

SEQ ID NO: 3435640 - RNA, 18 nt, Human
cacuguauuacauaaaua

SEQ ID NO: 3435641 - RNA, 17 nt, Human
cacuguauuuguaucuc

SEQ ID NO: 3435642 - RNA, 14 nt, Human
cacugucaagauga

SEQ ID NO: 3435643 - RNA, 20 nt, Human
cacugucacccuccaccucu

SEQ ID NO: 3435644 - RNA, 16 nt, Human
cacugucacuuugcuc

SEQ ID NO: 3435645 - RNA, 20 nt, Human
cacugucacuuugcucuggg

SEQ ID NO: 3435646 - RNA, 15 nt, Human
cacugucaggaagaa

SEQ ID NO: 3435647 - RNA, 14 nt, Human
cacugucccuccug

SEQ ID NO: 3435648 - RNA, 22 nt, Human
cacuguccuccacacaagggaa

SEQ ID NO: 3435649 - RNA, 11 nt, Human
cacuguccugc

SEQ ID NO: 3435650 - RNA, 13 nt, Human
cacuguccugcuc

SEQ ID NO: 3435651 - RNA, 16 nt, Human
cacuguccugcuccac

SEQ ID NO: 3435652 - RNA, 14 nt, Human
cacuguccugggcg

SEQ ID NO: 3435653 - RNA, 12 nt, Human
cacugucucagu

SEQ ID NO: 3435654 - RNA, 18 nt, Human
cacugucugagaguuuag

SEQ ID NO: 3435655 - RNA, 10 nt, Human
cacugucugu

SEQ ID NO: 3435656 - RNA, 14 nt, Human
cacugucuucuuca

SEQ ID NO: 3435657 - RNA, 18 nt, Human
cacugucuuuaauucugu

SEQ ID NO: 3435658 - RNA, 13 nt, Human
cacugugaagagc

SEQ ID NO: 3435659 - RNA, 12 nt, Human
cacugugacaca

SEQ ID NO: 3435660 - RNA, 15 nt, Human
cacugugacacacua

SEQ ID NO: 3435661 - RNA, 16 nt, Human
ccaggcauugccaagg

SEQ ID NO: 3435662 - RNA, 20 nt, Human
ccaggcauuuagcccucaca

SEQ ID NO: 3435663 - RNA, 13 nt, Human
ccaggccaccucc

SEQ ID NO: 3435664 - RNA, 12 nt, Human
ccaggccagagg

SEQ ID NO: 3435665 - RNA, 14 nt, Human
ccaggccagaggga

SEQ ID NO: 3435666 - RNA, 23 nt, Human
ccagagaacccagcccacccccg

SEQ ID NO: 3435667 - RNA, 23 nt, Human
ccagagaagcaucggagggaauu

SEQ ID NO: 3435668 - RNA, 20 nt, Human
ccagagaagccccuucccca

SEQ ID NO: 3435669 - RNA, 18 nt, Human
ccagagaagugacaggga

SEQ ID NO: 3435670 - RNA, 20 nt, Human
ccagagaagugacagggaag

SEQ ID NO: 3435671 - RNA, 14 nt, Human
ccagagacaggaaa

SEQ ID NO: 3435672 - RNA, 22 nt, Human
ccagagacauacuugaagggcc

SEQ ID NO: 3435673 - RNA, 19 nt, Human
ccagagaccguccucaccc

SEQ ID NO: 3435674 - RNA, 21 nt, Human
ccagagaccguccucaccccu

SEQ ID NO: 3435675 - RNA, 19 nt, Human
ccagagacggaagccuuuu

SEQ ID NO: 3435676 - RNA, 14 nt, Human
ccagagacuuuagg

SEQ ID NO: 3435677 - RNA, 16 nt, Human
ccagagagaagagccc

SEQ ID NO: 3435678 - RNA, 20 nt, Human
ccagagagaagagccccacu

SEQ ID NO: 3435679 - RNA, 18 nt, Human
ccagagagcaacucugag

SEQ ID NO: 3435680 - RNA, 20 nt, Human
ccagagagcaacucugagau

SEQ ID NO: 3435681 - RNA, 19 nt, Human
ccagagagcccgaggaggu

SEQ ID NO: 3435682 - RNA, 20 nt, Human
ccagagagcccgaggaggug

SEQ ID NO: 3435683 - RNA, 21 nt, Human
ccagagagccuggugcugcug

SEQ ID NO: 3435684 - RNA, 16 nt, Human
ccagagaggaaucaga

SEQ ID NO: 3435685 - RNA, 13 nt, Human
ccagagagggugg

SEQ ID NO: 3435686 - RNA, 14 nt, Human
ccagagaggguggu

SEQ ID NO: 3435687 - RNA, 21 nt, Human
ccagagaggguggugaccucu

SEQ ID NO: 3435688 - RNA, 15 nt, Human
ccagagaguccucug

SEQ ID NO: 3435689 - RNA, 13 nt, Human
ccagagauccaaa

SEQ ID NO: 3435690 - RNA, 20 nt, Human
ccagagauccaaaagaagcc

SEQ ID NO: 3435691 - RNA, 16 nt, Human
ccagagaugccuccac

SEQ ID NO: 3435692 - RNA, 18 nt, Human
ccagagaugccuccaccg

SEQ ID NO: 3435693 - RNA, 23 nt, Human
ccagagaugccuccaccgcugcc

SEQ ID NO: 3435694 - RNA, 16 nt, Human
ccagagaugggacugg

SEQ ID NO: 3435695 - RNA, 15 nt, Human
ccagagauucauuuu

SEQ ID NO: 3435696 - RNA, 17 nt, Human
ccagagauucauuuucu

SEQ ID NO: 3435697 - RNA, 20 nt, Human
ccagagcaagcuuuuuuauu

SEQ ID NO: 3435698 - RNA, 12 nt, Human
ccagagcacugu

SEQ ID NO: 3435699 - RNA, 17 nt, Human
ccagagcagaugcagag

SEQ ID NO: 3435700 - RNA, 14 nt, Human
ccagagcaggaagc

SEQ ID NO: 3435701 - RNA, 21 nt, Human
ccagagcauuacgugagccag

SEQ ID NO: 3435702 - RNA, 21 nt, Human
ccagagcauuccagucaggcu

SEQ ID NO: 3435703 - RNA, 13 nt, Human
ccagagccacaca

SEQ ID NO: 3435704 - RNA, 19 nt, Human
ccagagccacacaugggca

SEQ ID NO: 3435705 - RNA, 13 nt, Human
ccagagccacagu

SEQ ID NO: 3435706 - RNA, 23 nt, Human
ccagagccaggggggugaggagc

SEQ ID NO: 3435707 - RNA, 15 nt, Human
ccagagccauggacu

SEQ ID NO: 3435708 - RNA, 14 nt, Human
ccagagccccacac

SEQ ID NO: 3435709 - RNA, 23 nt, Human
ccagagccccacagccccaucug

SEQ ID NO: 3435710 - RNA, 22 nt, Human
ccagagcccccgggaagggcgc

SEQ ID NO: 3435711 - RNA, 20 nt, Human
ccagagccucaaaugagaaa

SEQ ID NO: 3435712 - RNA, 16 nt, Human
ccagagccuggggcuc

SEQ ID NO: 3435713 - RNA, 22 nt, Human
ccagagcggaggcugugugccu

SEQ ID NO: 3435714 - RNA, 12 nt, Human
ccagagcugcca

SEQ ID NO: 3435715 - RNA, 22 nt, Human
cagaaaguaauuucuucucaaa

SEQ ID NO: 3435716 - RNA, 12 nt, Human
cagaaagugccu

SEQ ID NO: 3435717 - RNA, 19 nt, Human
cagaaagugccugacacac

SEQ ID NO: 3435718 - RNA, 16 nt, Human
cagaaagugccuuuca

SEQ ID NO: 3435719 - RNA, 19 nt, Human
cagaaagugccuuucagga

SEQ ID NO: 3435720 - RNA, 22 nt, Human
cagaaaguggccaugccacccu

SEQ ID NO: 3435721 - RNA, 23 nt, Human
cagaaaguggccaugccacccug

SEQ ID NO: 3435722 - RNA, 17 nt, Human
cagaaaguggugcucag

SEQ ID NO: 3435723 - RNA, 21 nt, Human
cagaaaguggugcucaguugu

SEQ ID NO: 3435724 - RNA, 16 nt, Human
cagaaagugugcuuua

SEQ ID NO: 3435725 - RNA, 11 nt, Human
cagaaaguuau

SEQ ID NO: 3435726 - RNA, 16 nt, Human
cagaaaguuauugaua

SEQ ID NO: 3435727 - RNA, 19 nt, Human
cagaaauacagauaaauga

SEQ ID NO: 3435728 - RNA, 23 nt, Human
cagaaauacagauuuugauagca

SEQ ID NO: 3435729 - RNA, 19 nt, Human
cagaaauacauauuuccaa

SEQ ID NO: 3435730 - RNA, 20 nt, Human
cagaaauauaacacauuuuu

SEQ ID NO: 3435731 - RNA, 21 nt, Human
cagaaauauaacacauuuuuu

SEQ ID NO: 3435732 - RNA, 22 nt, Human
cagaaauauauauacauaugua

SEQ ID NO: 3435733 - RNA, 21 nt, Human
cagaaaugcugccugccuguc

SEQ ID NO: 3435734 - RNA, 17 nt, Human
cagaaaugcugcuggcc

SEQ ID NO: 3435735 - RNA, 23 nt, Human
cagaaauggugagauguauguuu

SEQ ID NO: 3435736 - RNA, 16 nt, Human
cagaaauuagccgggc

SEQ ID NO: 3435737 - RNA, 16 nt, Human
cagaaauucaauuugg

SEQ ID NO: 3435738 - RNA, 20 nt, Human
cagaaauucaauuuggauuu

SEQ ID NO: 3435739 - RNA, 19 nt, Human
cagaaauucuguuuuuaaa

SEQ ID NO: 3435740 - RNA, 20 nt, Human
cagaaauucuguuuuuaaaa

SEQ ID NO: 3435741 - RNA, 20 nt, Human
cagaaauuggaacagaaugu

SEQ ID NO: 3435742 - RNA, 11 nt, Human
cagaaauuggu

SEQ ID NO: 3435743 - RNA, 15 nt, Human
cagaaauugguaccu

SEQ ID NO: 3435744 - RNA, 17 nt, Human
cagaaauugguaccuug

SEQ ID NO: 3435745 - RNA, 21 nt, Human
cagaaauuguauauuguaauu

SEQ ID NO: 3435746 - RNA, 22 nt, Human
cagaaauuuaauucauguuucu

SEQ ID NO: 3435747 - RNA, 23 nt, Human
cagaaauuuaauucauguuucuu

SEQ ID NO: 3435748 - RNA, 12 nt, Human
cagaacaaauga

SEQ ID NO: 3435749 - RNA, 16 nt, Human
cagaacaaaugaagac

SEQ ID NO: 3435750 - RNA, 15 nt, Human
cagaacacauaauuc

SEQ ID NO: 3435751 - RNA, 19 nt, Human
cagaacacauuucaaauga

SEQ ID NO: 3435752 - RNA, 16 nt, Human
cagaacagcuucaggu

SEQ ID NO: 3435753 - RNA, 18 nt, Human
cagaacagcuucagguua

SEQ ID NO: 3435754 - RNA, 18 nt, Human
cagaacagcuucauguuc

SEQ ID NO: 3435755 - RNA, 13 nt, Human
cagaacaggguca

SEQ ID NO: 3435756 - RNA, 14 nt, Human
cagaacagggucau

SEQ ID NO: 3435757 - RNA, 20 nt, Human
cagaacagguguuggugaca

SEQ ID NO: 3435758 - RNA, 14 nt, Human
cagaacaguaucuu

SEQ ID NO: 3435759 - RNA, 14 nt, Human
cagaacaguaugaa

SEQ ID NO: 3435760 - RNA, 11 nt, Human
cagaacaguga

SEQ ID NO: 3435761 - RNA, 12 nt, Human
cagaacagugau

SEQ ID NO: 3435762 - RNA, 17 nt, Human
cagaacagugguggcaa

SEQ ID NO: 3435763 - RNA, 19 nt, Human
cagaacaguuaagcagccg

SEQ ID NO: 3435764 - RNA, 22 nt, Human
cagaacaguuaagcagccgcca

SEQ ID NO: 3435765 - RNA, 16 nt, Human
cagaacaguuuguaca

SEQ ID NO: 3435766 - RNA, 16 nt, Human
cagaacauagacagaa

SEQ ID NO: 3435767 - RNA, 19 nt, Human
cagaacauagacagaagaa

SEQ ID NO: 3435768 - RNA, 21 nt, Human
cagaacauagacagaagaaac

SEQ ID NO: 3435769 - RNA, 16 nt, Human
cagaacaucauuagaa

SEQ ID NO: 3435770 - RNA, 16 nt, Human
cagaaccaaagcucaa

SEQ ID NO: 3435771 - RNA, 16 nt, Human
cagaaccacacuugaa

SEQ ID NO: 3435772 - RNA, 14 nt, Human
cagaaccacagggc

SEQ ID NO: 3435773 - RNA, 12 nt, Human
cagaacccaggg

SEQ ID NO: 3435774 - RNA, 20 nt, Human
cagaacccagggcucugccc

SEQ ID NO: 3435775 - RNA, 23 nt, Human
cagaaccccuacaugaaacagaa

SEQ ID NO: 3435776 - RNA, 22 nt, Human
cagaacccuggugaggaagcuc

SEQ ID NO: 3435777 - RNA, 22 nt, Human
cagaacccuuggagccaaugga

SEQ ID NO: 3435778 - RNA, 14 nt, Human
cagaacccuuggcu

SEQ ID NO: 3435779 - RNA, 12 nt, Human
cagaaccucuuc

SEQ ID NO: 3435780 - RNA, 13 nt, Human
cagaaccuggagg

SEQ ID NO: 3435781 - RNA, 20 nt, Human
cagaaccuggagggcuagaa

SEQ ID NO: 3435782 - RNA, 14 nt, Human
cagaaccuguccuu

SEQ ID NO: 3435783 - RNA, 21 nt, Human
cagaacucaaauggggccaga

SEQ ID NO: 3435784 - RNA, 21 nt, Human
cagaacucgguguccccacca

SEQ ID NO: 3435785 - RNA, 13 nt, Human
cagaacucugugu

SEQ ID NO: 3435786 - RNA, 19 nt, Human
cagaacucuuaaaaauguu

SEQ ID NO: 3435787 - RNA, 22 nt, Human
cagaacucuuccuccaaggaca

SEQ ID NO: 3435788 - RNA, 15 nt, Human
cagaacucuuucaaa

SEQ ID NO: 3435789 - RNA, 22 nt, Human
cagaacugaaccggcuuuacca

SEQ ID NO: 3435790 - RNA, 13 nt, Human
cagaacugagcuc

SEQ ID NO: 3435791 - RNA, 24 nt, Human
cagaacugagcuccucugggcagg

SEQ ID NO: 3435792 - RNA, 21 nt, Human
cagaacugccauuauuuucug

SEQ ID NO: 3435793 - RNA, 16 nt, Human
cagaacugugccacaa

SEQ ID NO: 3435794 - RNA, 16 nt, Human
cagaacuucagaaaga

SEQ ID NO: 3435795 - RNA, 14 nt, Human
cagaacuucccuga

SEQ ID NO: 3435796 - RNA, 15 nt, Human
cagaacuugaaugug

SEQ ID NO: 3435797 - RNA, 16 nt, Human
cagaacuugaaugugu

SEQ ID NO: 3435798 - RNA, 17 nt, Human
cagaacuugcugcuguc

SEQ ID NO: 3435799 - RNA, 18 nt, Human
cagaacuugcugcugucu

SEQ ID NO: 3435800 - RNA, 22 nt, Human
cagaagaaaauagaauugacau

SEQ ID NO: 3435801 - RNA, 14 nt, Human
cagaagaaacaagg

SEQ ID NO: 3435802 - RNA, 16 nt, Human
cagaagaaaggaacau

SEQ ID NO: 3435803 - RNA, 15 nt, Human
cagaagaaauaaaua

SEQ ID NO: 3435804 - RNA, 17 nt, Human
cagaagaaauaaauaua

SEQ ID NO: 3435805 - RNA, 17 nt, Human
cagaagaagagaagcug

SEQ ID NO: 3435806 - RNA, 19 nt, Human
cagaagaagagaagcugcu

SEQ ID NO: 3435807 - RNA, 21 nt, Human
cagaagaagagaagcugcuga

SEQ ID NO: 3435808 - RNA, 15 nt, Human
cagaagaaggcagca

SEQ ID NO: 3435809 - RNA, 15 nt, Human
cagaagaauauucag

SEQ ID NO: 3435810 - RNA, 23 nt, Human
cccaccgggcugggagcucugca

SEQ ID NO: 3435811 - RNA, 18 nt, Human
cccaccgguccagcuggc

SEQ ID NO: 3435812 - RNA, 17 nt, Human
cccaccguccgcccugc

SEQ ID NO: 3435813 - RNA, 19 nt, Human
cccaccguccgcccugcuc

SEQ ID NO: 3435814 - RNA, 19 nt, Human
cccaccguggaggaggaag

SEQ ID NO: 3435815 - RNA, 20 nt, Human
cccaccguggaggaggaagg

SEQ ID NO: 3435816 - RNA, 12 nt, Human
cccaccucagcc

SEQ ID NO: 3435817 - RNA, 14 nt, Human
cccaccucagccuc

SEQ ID NO: 3435818 - RNA, 12 nt, Human
cccaccuccagc

SEQ ID NO: 3435819 - RNA, 13 nt, Human
cccaccuccagcc

SEQ ID NO: 3435820 - RNA, 18 nt, Human
cccaccuccagcccggga

SEQ ID NO: 3435821 - RNA, 14 nt, Human
cccaccuccaggcu

SEQ ID NO: 3435822 - RNA, 19 nt, Human
cccaccucccccacuccca

SEQ ID NO: 3435823 - RNA, 13 nt, Human
cccaccucccugc

SEQ ID NO: 3435824 - RNA, 16 nt, Human
cccaccucccugccca

SEQ ID NO: 3435825 - RNA, 17 nt, Human
cccaccucucucacucc

SEQ ID NO: 3435826 - RNA, 15 nt, Human
cccaccucugugacc

SEQ ID NO: 3435827 - RNA, 13 nt, Human
cccaccugagcuu

SEQ ID NO: 3435828 - RNA, 16 nt, Human
cccaccugcagcuccc

SEQ ID NO: 3435829 - RNA, 20 nt, Human
cccaccugcagggcugcccu

SEQ ID NO: 3435830 - RNA, 23 nt, Human
cccaccugccacuaggcugggug

SEQ ID NO: 3435831 - RNA, 12 nt, Human
cccaccuggcca

SEQ ID NO: 3435832 - RNA, 16 nt, Human
cccaccuggccucugc

SEQ ID NO: 3435833 - RNA, 21 nt, Human
cccaccuggccucugcacucc

SEQ ID NO: 3435834 - RNA, 22 nt, Human
cccaccugucaaacaaagccag

SEQ ID NO: 3435835 - RNA, 23 nt, Human
cccaccugucaaacaaagccaga

SEQ ID NO: 3435836 - RNA, 19 nt, Human
cccaccuucaauuccuggg

SEQ ID NO: 3435837 - RNA, 17 nt, Human
cccaccuuggcugcagg

SEQ ID NO: 3435838 - RNA, 20 nt, Human
cccaccuuguuggagccugc

SEQ ID NO: 3435839 - RNA, 17 nt, Human
cccacgaaacugcccug

SEQ ID NO: 3435840 - RNA, 20 nt, Human
cccacgacugcccggcaggg

SEQ ID NO: 3435841 - RNA, 21 nt, Human
cccacgacugcccggcagggu

SEQ ID NO: 3435842 - RNA, 17 nt, Human
cccacgagaccccggcu

SEQ ID NO: 3435843 - RNA, 19 nt, Human
cccacgcccccacugguga

SEQ ID NO: 3435844 - RNA, 22 nt, Human
cccacgcccucauuacggcucc

SEQ ID NO: 3435845 - RNA, 15 nt, Human
cccacgcucaccccc

SEQ ID NO: 3435846 - RNA, 13 nt, Human
cccacgcuucucu

SEQ ID NO: 3435847 - RNA, 22 nt, Human
cccacggaaaaugccaaucucu

SEQ ID NO: 3435848 - RNA, 16 nt, Human
cccacggccgcuccag

SEQ ID NO: 3435849 - RNA, 19 nt, Human
cccacggcuaagaggcugc

SEQ ID NO: 3435850 - RNA, 15 nt, Human
cccacgucagcuggg

SEQ ID NO: 3435851 - RNA, 13 nt, Human
cccacguccuguc

SEQ ID NO: 3435852 - RNA, 17 nt, Human
cccacguccugucagug

SEQ ID NO: 3435853 - RNA, 12 nt, Human
cccacgugggag

SEQ ID NO: 3435854 - RNA, 16 nt, Human
cccacguucucacacc

SEQ ID NO: 3435855 - RNA, 17 nt, Human
cccacguucucacaccc

SEQ ID NO: 3435856 - RNA, 21 nt, Human
cccacguucucacacccaccg

SEQ ID NO: 3435857 - RNA, 18 nt, Human
cccacguucucucugccu

SEQ ID NO: 3435858 - RNA, 16 nt, Human
cccacucaagccaagc

SEQ ID NO: 3435859 - RNA, 19 nt, Human
cccacuccaucugguagaa

SEQ ID NO: 3435860 - RNA, 17 nt, Human
cccacuccccaccuuca

SEQ ID NO: 3435861 - RNA, 12 nt, Human
cccacucccugc

SEQ ID NO: 3435862 - RNA, 19 nt, Human
cccacuccggcccuccaga

SEQ ID NO: 3435863 - RNA, 19 nt, Human
cccacuccuaggacauguu

SEQ ID NO: 3435864 - RNA, 12 nt, Human
cccacuccugcu

SEQ ID NO: 3435865 - RNA, 21 nt, Human
cccacucgugauaagucaaca

SEQ ID NO: 3435866 - RNA, 11 nt, Human
cccacucucag

SEQ ID NO: 3435867 - RNA, 13 nt, Human
cccacucucauuc

SEQ ID NO: 3435868 - RNA, 19 nt, Human
cccacucucauuccccagg

SEQ ID NO: 3435869 - RNA, 12 nt, Human
cccacucuccua

SEQ ID NO: 3435870 - RNA, 15 nt, Human
cccacucugcucuga

SEQ ID NO: 3435871 - RNA, 16 nt, Human
cccacugcacacaccu

SEQ ID NO: 3435872 - RNA, 18 nt, Human
cccacugcacccccuccu

SEQ ID NO: 3435873 - RNA, 19 nt, Human
cccacugcaggccccgcuu

SEQ ID NO: 3435874 - RNA, 23 nt, Human
cccacugcaggccccgcuugucc

SEQ ID NO: 3435875 - RNA, 14 nt, Human
cccacugccuuuga

SEQ ID NO: 3435876 - RNA, 22 nt, Human
cccacugcuuuuggucugugug

SEQ ID NO: 3435877 - RNA, 13 nt, Human
cccacuggagcag

SEQ ID NO: 3435878 - RNA, 22 nt, Human
cccacuggagcagaaggggaga

SEQ ID NO: 3435879 - RNA, 23 nt, Human
cccacuggcugugggcucccuuc

SEQ ID NO: 3435880 - RNA, 23 nt, Human
cccacuguacuugcucuugaugc

SEQ ID NO: 3435881 - RNA, 17 nt, Human
cccacuguaugauuuau

SEQ ID NO: 3435882 - RNA, 14 nt, Human
cccacuguccuggg

SEQ ID NO: 3435883 - RNA, 23 nt, Human
cccacuguccugggcgcccugga

SEQ ID NO: 3435884 - RNA, 15 nt, Human
cccacugugccucag

SEQ ID NO: 3435885 - RNA, 23 nt, Human
cccacuguuucucuugagcuggc

SEQ ID NO: 3435886 - RNA, 17 nt, Human
cccacuucccugacacu

SEQ ID NO: 3435887 - RNA, 18 nt, Human
cccacuucucaucacaca

SEQ ID NO: 3435888 - RNA, 22 nt, Human
cccacuucucaucacacacaug

SEQ ID NO: 3435889 - RNA, 23 nt, Human
cccacuucucaucacacacaugg

SEQ ID NO: 3435890 - RNA, 12 nt, Human
cccacuucugcc

SEQ ID NO: 3435891 - RNA, 14 nt, Human
cccacuucugccag

SEQ ID NO: 3435892 - RNA, 21 nt, Human
cccacuugccucuuccuugaa

SEQ ID NO: 3435893 - RNA, 22 nt, Human
cccacuugucacugacacaaag

SEQ ID NO: 3435894 - RNA, 14 nt, Human
cccacuuguccuua

SEQ ID NO: 3435895 - RNA, 21 nt, Human
cccacuuugcuguuccuuacu

SEQ ID NO: 3435896 - RNA, 20 nt, Human
cccagaaaaaaaaaaacuua

SEQ ID NO: 3435897 - RNA, 20 nt, Human
cccagaaaagaaagcuacag

SEQ ID NO: 3435898 - RNA, 15 nt, Human
cccagaaaaggacag

SEQ ID NO: 3435899 - RNA, 16 nt, Human
cccagaaaaggacaga

SEQ ID NO: 3435900 - RNA, 17 nt, Human
cccagaaaaggacagaa

SEQ ID NO: 3435901 - RNA, 14 nt, Human
cccagaaccugucc

SEQ ID NO: 3435902 - RNA, 15 nt, Human
cccagaaccuguccu

SEQ ID NO: 3435903 - RNA, 17 nt, Human
cccagaaccuguccuug

SEQ ID NO: 3435904 - RNA, 14 nt, Human
cccagaacucugcc

SEQ ID NO: 3435905 - RNA, 15 nt, Human
cccagaacuucccug

SEQ ID NO: 3435906 - RNA, 19 nt, Human
cccagaacuucccugauug

SEQ ID NO: 3435907 - RNA, 16 nt, Human
cccagaagaaaauucu

SEQ ID NO: 3435908 - RNA, 22 nt, Human
cccagaauaaguuauugcaguu

SEQ ID NO: 3435909 - RNA, 12 nt, Human
cccagaaucaaa

SEQ ID NO: 3435910 - RNA, 15 nt, Human
cccagaaucccagcc

SEQ ID NO: 3435911 - RNA, 16 nt, Human
cccagaaucccagccg

SEQ ID NO: 3435912 - RNA, 19 nt, Human
cccagaaucccagccggcc

SEQ ID NO: 3435913 - RNA, 20 nt, Human
cccagaaugagacauccagc

SEQ ID NO: 3435914 - RNA, 18 nt, Human
cccagaaugucagauucc

SEQ ID NO: 3435915 - RNA, 21 nt, Human
cccagaaugucagauuccuuu

SEQ ID NO: 3435916 - RNA, 20 nt, Human
cccagacacaucgcacugug

SEQ ID NO: 3435917 - RNA, 23 nt, Human
cccagacacaucgcacuguggau

SEQ ID NO: 3435918 - RNA, 19 nt, Human
cccagacagacaucucugc

SEQ ID NO: 3435919 - RNA, 14 nt, Human
cccagacagcuccc

SEQ ID NO: 3435920 - RNA, 17 nt, Human
cccagacauaaaggaaa

SEQ ID NO: 3435921 - RNA, 13 nt, Human
cccagacccagug

SEQ ID NO: 3435922 - RNA, 13 nt, Human
cccagaccccgac

SEQ ID NO: 3435923 - RNA, 19 nt, Human
cccagaccccucuggccag

SEQ ID NO: 3435924 - RNA, 21 nt, Human
cccagaccuguuagcagacag

SEQ ID NO: 3435925 - RNA, 23 nt, Human
ccaggagcuccaguguccugagc

SEQ ID NO: 3435926 - RNA, 17 nt, Human
ccaggagcugcucacua

SEQ ID NO: 3435927 - RNA, 21 nt, Human
ccaggagcugggcagaaggcc

SEQ ID NO: 3435928 - RNA, 21 nt, Human
ccaggagcuucuuguuuccuu

SEQ ID NO: 3435929 - RNA, 18 nt, Human
ccaggaggacccagggcu

SEQ ID NO: 3435930 - RNA, 21 nt, Human
ccaggaggacccagggcucug

SEQ ID NO: 3435931 - RNA, 20 nt, Human
ccaggaggcagggaggcagc

SEQ ID NO: 3435932 - RNA, 16 nt, Human
ccaggaggcugaggug

SEQ ID NO: 3435933 - RNA, 22 nt, Human
ccaggagggacaaaggagccug

SEQ ID NO: 3435934 - RNA, 23 nt, Human
ccaggagggacaaaggagccugu

SEQ ID NO: 3435935 - RNA, 15 nt, Human
ccaggagggaggcag

SEQ ID NO: 3435936 - RNA, 20 nt, Human
ccaggaggggaacacugccc

SEQ ID NO: 3435937 - RNA, 18 nt, Human
ccaggaggugccacugga

SEQ ID NO: 3435938 - RNA, 19 nt, Human
ccaggagucccacuccaag

SEQ ID NO: 3435939 - RNA, 21 nt, Human
ccaggaguguggccacguggg

SEQ ID NO: 3435940 - RNA, 20 nt, Human
ccaggaguucgaggcugcag

SEQ ID NO: 3435941 - RNA, 15 nt, Human
ccaggaguucugcuc

SEQ ID NO: 3435942 - RNA, 16 nt, Human
ccaggaguucugcuca

SEQ ID NO: 3435943 - RNA, 23 nt, Human
ccaggaguuuaagaccagccugg

SEQ ID NO: 3435944 - RNA, 22 nt, Human
ccaggaguuugaggcugcagcg

SEQ ID NO: 3435945 - RNA, 15 nt, Human
ccaggauacuggcac

SEQ ID NO: 3435946 - RNA, 23 nt, Human
ccaggauagugggcaccccacug

SEQ ID NO: 3435947 - RNA, 16 nt, Human
ccaggauauauuuuau

SEQ ID NO: 3435948 - RNA, 15 nt, Human
ccaggaucauggugu

SEQ ID NO: 3435949 - RNA, 17 nt, Human
ccaggaucaugguguaa

SEQ ID NO: 3435950 - RNA, 23 nt, Human
ccaggaucaugguguaauaagac

SEQ ID NO: 3435951 - RNA, 18 nt, Human
ccaggaucccaagccucc

SEQ ID NO: 3435952 - RNA, 19 nt, Human
ccaggaucccaagccuccu

SEQ ID NO: 3435953 - RNA, 22 nt, Human
ccaggaucccaagccuccugcu

SEQ ID NO: 3435954 - RNA, 18 nt, Human
cagagaggacuguaggga

SEQ ID NO: 3435955 - RNA, 20 nt, Human
cagagaggacuguagggagg

SEQ ID NO: 3435956 - RNA, 18 nt, Human
cagagaggagaaacacau

SEQ ID NO: 3435957 - RNA, 21 nt, Human
cagagaggagaaacacaucuu

SEQ ID NO: 3435958 - RNA, 15 nt, Human
cagagaggcuguggu

SEQ ID NO: 3435959 - RNA, 16 nt, Human
cagagaggcugugguu

SEQ ID NO: 3435960 - RNA, 21 nt, Human
cagagagggagagcagagaaa

SEQ ID NO: 3435961 - RNA, 12 nt, Human
cagagagggcag

SEQ ID NO: 3435962 - RNA, 16 nt, Human
cagagagggcaggcau

SEQ ID NO: 3435963 - RNA, 21 nt, Human
cagagagggcaggcaugaagu

SEQ ID NO: 3435964 - RNA, 15 nt, Human
cagagagggggccac

SEQ ID NO: 3435965 - RNA, 20 nt, Human
cagagagggggccaccuccc

SEQ ID NO: 3435966 - RNA, 12 nt, Human
cagagagggugg

SEQ ID NO: 3435967 - RNA, 23 nt, Human
cagagagguuugcagucccaagc

SEQ ID NO: 3435968 - RNA, 18 nt, Human
cagagagucccacugccu

SEQ ID NO: 3435969 - RNA, 14 nt, Human
cagagaguccucug

SEQ ID NO: 3435970 - RNA, 15 nt, Human
cagagaguccucugg

SEQ ID NO: 3435971 - RNA, 14 nt, Human
cagagaguggcucc

SEQ ID NO: 3435972 - RNA, 15 nt, Human
cagagauaggccugu

SEQ ID NO: 3435973 - RNA, 19 nt, Human
cagagauccaaaagaagcc

SEQ ID NO: 3435974 - RNA, 23 nt, Human
cagagauccaaaagaagccccca

SEQ ID NO: 3435975 - RNA, 21 nt, Human
cagagaugcaccaccaagcca

SEQ ID NO: 3435976 - RNA, 19 nt, Human
cagagaugccuccaccgcu

SEQ ID NO: 3435977 - RNA, 23 nt, Human
cagagaugccucccugagcuaga

SEQ ID NO: 3435978 - RNA, 15 nt, Human
cagagaugggacugg

SEQ ID NO: 3435979 - RNA, 19 nt, Human
cagagaugggacugggagg

SEQ ID NO: 3435980 - RNA, 22 nt, Human
cagagaugggacugggagggcc

SEQ ID NO: 3435981 - RNA, 23 nt, Human
cagagaugggacugggagggccc

SEQ ID NO: 3435982 - RNA, 22 nt, Human
cagagauguccauuuuuacaag

SEQ ID NO: 3435983 - RNA, 21 nt, Human
cagagauucauuuucuagaua

SEQ ID NO: 3435984 - RNA, 17 nt, Human
cagagauugaacuccaa

SEQ ID NO: 3435985 - RNA, 21 nt, Human
cagagauuggaaugggcagcu

SEQ ID NO: 3435986 - RNA, 23 nt, Human
cagagauuggaaugggcagcuca

SEQ ID NO: 3435987 - RNA, 16 nt, Human
cagagauuucucauug

SEQ ID NO: 3435988 - RNA, 15 nt, Human
cagagcaaccucuca

SEQ ID NO: 3435989 - RNA, 22 nt, Human
cagagcaacgaccagggccgag

SEQ ID NO: 3435990 - RNA, 18 nt, Human
cagagcaagauccugucu

SEQ ID NO: 3435991 - RNA, 16 nt, Human
cagagcaagucugcag

SEQ ID NO: 3435992 - RNA, 16 nt, Human
cagagcaccugcuguc

SEQ ID NO: 3435993 - RNA, 18 nt, Human
cagagcaccuuagacagu

SEQ ID NO: 3435994 - RNA, 22 nt, Human
cagagcaccuuagacagucccu

SEQ ID NO: 3435995 - RNA, 23 nt, Human
cagagcaccuuugcacaggaugc

SEQ ID NO: 3435996 - RNA, 22 nt, Human
cagagcacuagguucaauuccc

SEQ ID NO: 3435997 - RNA, 14 nt, Human
cagagcagagacca

SEQ ID NO: 3435998 - RNA, 13 nt, Human
cagagcagaugca

SEQ ID NO: 3435999 - RNA, 19 nt, Human
cagagcagaugcagagagc

SEQ ID NO: 3436000 - RNA, 13 nt, Human
cagagcagcagug

SEQ ID NO: 3436001 - RNA, 20 nt, Human
cagagcagcagugaaaacaa

SEQ ID NO: 3436002 - RNA, 21 nt, Human
cagagcaggaagcauucagag

SEQ ID NO: 3436003 - RNA, 14 nt, Human
cagagcaggaggcc

SEQ ID NO: 3436004 - RNA, 19 nt, Human
cagagcaggaggccccugg

SEQ ID NO: 3436005 - RNA, 15 nt, Human
cagagcaggggcagg

SEQ ID NO: 3436006 - RNA, 12 nt, Human
cagagcagucug

SEQ ID NO: 3436007 - RNA, 15 nt, Human
cagagcagugggccu

SEQ ID NO: 3436008 - RNA, 18 nt, Human
cagagcauuccagucagg

SEQ ID NO: 3436009 - RNA, 22 nt, Human
cagagcauuccagucaggcucu

SEQ ID NO: 3436010 - RNA, 21 nt, Human
cagagccaaggggcuucaggu

SEQ ID NO: 3436011 - RNA, 15 nt, Human
cagagccacacaugg

SEQ ID NO: 3436012 - RNA, 13 nt, Human
cagagccaggaag

SEQ ID NO: 3436013 - RNA, 23 nt, Human
cagagccaggaagaucccccaga

SEQ ID NO: 3436014 - RNA, 11 nt, Human
cagagccaugg

SEQ ID NO: 3436015 - RNA, 15 nt, Human
cagagcccaccuugg

SEQ ID NO: 3436016 - RNA, 19 nt, Human
cagagcccaccuuggcuca

SEQ ID NO: 3436017 - RNA, 16 nt, Human
cagagcccacgccccc

SEQ ID NO: 3436018 - RNA, 21 nt, Human
cagagcccacgcccccacugg

SEQ ID NO: 3436019 - RNA, 14 nt, Human
cagagcccaggcuc

SEQ ID NO: 3436020 - RNA, 13 nt, Human
cagagccccacac

SEQ ID NO: 3436021 - RNA, 15 nt, Human
cagagccccacagcc

SEQ ID NO: 3436022 - RNA, 21 nt, Human
cagagccccuacagcauuguu

SEQ ID NO: 3436023 - RNA, 22 nt, Human
cagagccccuccuccagccccu

SEQ ID NO: 3436024 - RNA, 20 nt, Human
cagagccguaaaaacugaag

SEQ ID NO: 3436025 - RNA, 14 nt, Human
cagagccucgcucu

SEQ ID NO: 3436026 - RNA, 13 nt, Human
cagagccugcccc

SEQ ID NO: 3436027 - RNA, 19 nt, Human
cagagccugccccagcgcu

SEQ ID NO: 3436028 - RNA, 12 nt, Human
cagagccugggg

SEQ ID NO: 3436029 - RNA, 19 nt, Human
cagagccuucucagaagca

SEQ ID NO: 3436030 - RNA, 20 nt, Human
cagagccuucucagaagcac

SEQ ID NO: 3436031 - RNA, 13 nt, Human
cagagcgcacagg

SEQ ID NO: 3436032 - RNA, 15 nt, Human
cagagcgcacaggga

SEQ ID NO: 3436033 - RNA, 19 nt, Human
cagagcgccgugaguucuc

SEQ ID NO: 3436034 - RNA, 19 nt, Human
cagagcggaggcugugugc

SEQ ID NO: 3436035 - RNA, 15 nt, Human
cagagcgugagcuga

SEQ ID NO: 3436036 - RNA, 19 nt, Human
cagagcgugagcugagcag

SEQ ID NO: 3436037 - RNA, 21 nt, Human
cagagcguggcugugcucuca

SEQ ID NO: 3436038 - RNA, 18 nt, Human
cagagcuaaacuccuucc

SEQ ID NO: 3436039 - RNA, 16 nt, Human
cagagcuaucauuaug

SEQ ID NO: 3436040 - RNA, 12 nt, Human
cagagcucacaa

SEQ ID NO: 3436041 - RNA, 23 nt, Human
cagagcuccuccuugucuuggca

SEQ ID NO: 3436042 - RNA, 21 nt, Human
cagagcucuggagccaccugu

SEQ ID NO: 3436043 - RNA, 21 nt, Human
cagagcugaagaguugccccg

SEQ ID NO: 3436044 - RNA, 20 nt, Human
cagagcugauggagaaggaa

SEQ ID NO: 3436045 - RNA, 13 nt, Human
cagagcugccacc

SEQ ID NO: 3436046 - RNA, 16 nt, Human
cagagcugccaccugc

SEQ ID NO: 3436047 - RNA, 15 nt, Human
cagagcugcccucuc

SEQ ID NO: 3436048 - RNA, 17 nt, Human
cagagcugcccucuccu

SEQ ID NO: 3436049 - RNA, 22 nt, Human
cagagcugcggugucucccugc

SEQ ID NO: 3436050 - RNA, 18 nt, Human
cagagcuggcucugagcg

SEQ ID NO: 3436051 - RNA, 15 nt, Human
cagagcugggaggca

SEQ ID NO: 3436052 - RNA, 20 nt, Human
cagagcugggaggcauggcc

SEQ ID NO: 3436053 - RNA, 23 nt, Human
cagagcugggaggcauggcccug

SEQ ID NO: 3436054 - RNA, 20 nt, Human
cagagcuggggcugagggau

SEQ ID NO: 3436055 - RNA, 12 nt, Human
cagagcugggug

SEQ ID NO: 3436056 - RNA, 17 nt, Human
cagagcugguggaccca

SEQ ID NO: 3436057 - RNA, 20 nt, Human
cagagcugguggacccaggg

SEQ ID NO: 3436058 - RNA, 21 nt, Human
cagagcugguggacccaggga

SEQ ID NO: 3436059 - RNA, 12 nt, Human
cagagcugugga

SEQ ID NO: 3436060 - RNA, 21 nt, Human
cagagcuguuuauggccucag

SEQ ID NO: 3436061 - RNA, 22 nt, Human
cagagcuguuuauggccucagc

SEQ ID NO: 3436062 - RNA, 20 nt, Human
cagagcuucuuccaggugcc

SEQ ID NO: 3436063 - RNA, 19 nt, Human
cagagcuuggacuggaugc

SEQ ID NO: 3436064 - RNA, 15 nt, Human
cagagcuuuggucug

SEQ ID NO: 3436065 - RNA, 17 nt, Human
cagagcuuuggucugug

SEQ ID NO: 3436066 - RNA, 23 nt, Human
cagaggaaacaauauuuauaaag

SEQ ID NO: 3436067 - RNA, 19 nt, Human
cagaggaaagcaaaggaga

SEQ ID NO: 3436068 - RNA, 20 nt, Human
cagaggaaagcaaaggagau

SEQ ID NO: 3436069 - RNA, 20 nt, Human
cagaggaacuguccagagag

SEQ ID NO: 3436070 - RNA, 12 nt, Human
cagaggaagagc

SEQ ID NO: 3436071 - RNA, 18 nt, Human
cagaggaaggggccagag

SEQ ID NO: 3436072 - RNA, 18 nt, Human
cagaggaauccuggcagc

SEQ ID NO: 3436073 - RNA, 22 nt, Human
cagaggacaccuguacuggaga

SEQ ID NO: 3436074 - RNA, 13 nt, Human
cagaggaccagca

SEQ ID NO: 3436075 - RNA, 14 nt, Human
cagaggacugugau

SEQ ID NO: 3436076 - RNA, 13 nt, Human
cagaggagagagg

SEQ ID NO: 3436077 - RNA, 21 nt, Human
cagaggagagauagccugugg

SEQ ID NO: 3436078 - RNA, 23 nt, Human
cagaggagagucccagagcagga

SEQ ID NO: 3436079 - RNA, 20 nt, Human
cagaggagccaccaguucuc

SEQ ID NO: 3436080 - RNA, 15 nt, Human
cagaggagccuuuuu

SEQ ID NO: 3436081 - RNA, 22 nt, Human
cagaggagggcagcagaagggg

SEQ ID NO: 3436082 - RNA, 20 nt, Human
cagaggaggggccgcugcca

SEQ ID NO: 3436083 - RNA, 17 nt, Human
cagaggaguacagguga

SEQ ID NO: 3436084 - RNA, 23 nt, Human
cagaggaugagcucuacccaggg

SEQ ID NO: 3436085 - RNA, 20 nt, Human
cagaggcagccccauucugc

SEQ ID NO: 3436086 - RNA, 23 nt, Human
cagaggcagccccauucugccug

SEQ ID NO: 3436087 - RNA, 22 nt, Human
ccagggugagagcugcucugga

SEQ ID NO: 3436088 - RNA, 15 nt, Human
ccagggugcccagaa

SEQ ID NO: 3436089 - RNA, 14 nt, Human
ccaggguuccccca

SEQ ID NO: 3436090 - RNA, 22 nt, Human
ccaggguugaucacacucuggg

SEQ ID NO: 3436091 - RNA, 21 nt, Human
ccaggguuggcaccuuccccc

SEQ ID NO: 3436092 - RNA, 16 nt, Human
ccagguaaugagggac

SEQ ID NO: 3436093 - RNA, 14 nt, Human
ccagguacgcacag

SEQ ID NO: 3436094 - RNA, 14 nt, Human
ccagguagcuggga

SEQ ID NO: 3436095 - RNA, 15 nt, Human
ccagguaucuccagg

SEQ ID NO: 3436096 - RNA, 17 nt, Human
ccagguauggcucugca

SEQ ID NO: 3436097 - RNA, 14 nt, Human
cccaugggcaggag

SEQ ID NO: 3436098 - RNA, 23 nt, Human
cccauggguuguguguuuauuuc

SEQ ID NO: 3436099 - RNA, 19 nt, Human
cccauguauggccaggaag

SEQ ID NO: 3436100 - RNA, 23 nt, Human
cccauguauuuaucucuauuuaa

SEQ ID NO: 3436101 - RNA, 16 nt, Human
cccaugucucgacuca

SEQ ID NO: 3436102 - RNA, 16 nt, Human
cccaugucucucagaa

SEQ ID NO: 3436103 - RNA, 22 nt, Human
cccaugucuuucuccaaaguua

SEQ ID NO: 3436104 - RNA, 19 nt, Human
cccaugugccugcaccagg

SEQ ID NO: 3436105 - RNA, 22 nt, Human
cccaugugccugcaccaggaga

SEQ ID NO: 3436106 - RNA, 23 nt, Human
cccauguggugaugauguguaua

SEQ ID NO: 3436107 - RNA, 19 nt, Human
cccaugugugagugugugc

SEQ ID NO: 3436108 - RNA, 21 nt, Human
cccauuaaggggaagaaugaa

SEQ ID NO: 3436109 - RNA, 16 nt, Human
cccauuaggacaauca

SEQ ID NO: 3436110 - RNA, 20 nt, Human
cccauuaugcgcuguggcca

SEQ ID NO: 3436111 - RNA, 14 nt, Human
cccauucccuggga

SEQ ID NO: 3436112 - RNA, 19 nt, Human
cccauucccugggaucugg

SEQ ID NO: 3436113 - RNA, 16 nt, Human
cccauucucaucugca

SEQ ID NO: 3436114 - RNA, 18 nt, Human
cccauucugcccuguggg

SEQ ID NO: 3436115 - RNA, 13 nt, Human
cccauucugccug

SEQ ID NO: 3436116 - RNA, 14 nt, Human
cccauucugccugc

SEQ ID NO: 3436117 - RNA, 20 nt, Human
cccauucugccugcccaggc

SEQ ID NO: 3436118 - RNA, 11 nt, Human
cccauucuuug

SEQ ID NO: 3436119 - RNA, 21 nt, Human
cccauugcaucaccucuguaa

SEQ ID NO: 3436120 - RNA, 12 nt, Human
cccauugcuguu

SEQ ID NO: 3436121 - RNA, 15 nt, Human
cccauugucccucug

SEQ ID NO: 3436122 - RNA, 15 nt, Human
cccauuguggcuccu

SEQ ID NO: 3436123 - RNA, 20 nt, Human
cccauuuaaauuuuuuuccu

SEQ ID NO: 3436124 - RNA, 15 nt, Human
cccauuuauccaccu

SEQ ID NO: 3436125 - RNA, 18 nt, Human
cccauuuauccaccucca

SEQ ID NO: 3436126 - RNA, 20 nt, Human
cccauuucgugagccccauc

SEQ ID NO: 3436127 - RNA, 21 nt, Human
cccauuucuaaaggccucuuc

SEQ ID NO: 3436128 - RNA, 15 nt, Human
cccauuucucacuga

SEQ ID NO: 3436129 - RNA, 14 nt, Human
cccauuucuccaga

SEQ ID NO: 3436130 - RNA, 15 nt, Human
cccauuucuccagaa

SEQ ID NO: 3436131 - RNA, 14 nt, Human
cccauuuggagggc

SEQ ID NO: 3436132 - RNA, 13 nt, Human
cccauuugggcag

SEQ ID NO: 3436133 - RNA, 20 nt, Human
cccauuugggcagagaggcu

SEQ ID NO: 3436134 - RNA, 18 nt, Human
cccauuuugagugacucg

SEQ ID NO: 3436135 - RNA, 19 nt, Human
cccauuuugcaaaauuucc

SEQ ID NO: 3436136 - RNA, 20 nt, Human
cccauuuuuauaucgaucuc

SEQ ID NO: 3436137 - RNA, 12 nt, Human
cccauuuuuccc

SEQ ID NO: 3436138 - RNA, 12 nt, Human
cccauuuuuccu

SEQ ID NO: 3436139 - RNA, 19 nt, Human
ccccaaaacaaagucuuug

SEQ ID NO: 3436140 - RNA, 22 nt, Human
ccccaaaacucuccucugcugc

SEQ ID NO: 3436141 - RNA, 18 nt, Human
ccccaaacaccuuccagc

SEQ ID NO: 3436142 - RNA, 17 nt, Human
ccaugugccugcaccag

SEQ ID NO: 3436143 - RNA, 20 nt, Human
ccaugugccugcaccaggag

SEQ ID NO: 3436144 - RNA, 20 nt, Human
ccauguggaaggcaagccag

SEQ ID NO: 3436145 - RNA, 21 nt, Human
ccauguggaaggcaagccagg

SEQ ID NO: 3436146 - RNA, 12 nt, Human
ccauguggacuu

SEQ ID NO: 3436147 - RNA, 18 nt, Human
ccauguggugaugaugug

SEQ ID NO: 3436148 - RNA, 17 nt, Human
ccaugugguggcacagg

SEQ ID NO: 3436149 - RNA, 17 nt, Human
ccauguguccugguucc

SEQ ID NO: 3436150 - RNA, 11 nt, Human
ccaugugugag

SEQ ID NO: 3436151 - RNA, 18 nt, Human
ccaugugugagugugugc

SEQ ID NO: 3436152 - RNA, 21 nt, Human
ccauguuaaguccucccugac

SEQ ID NO: 3436153 - RNA, 22 nt, Human
ccauguuaauuucaugugucaa

SEQ ID NO: 3436154 - RNA, 18 nt, Human
ccauguuagccaggcugg

SEQ ID NO: 3436155 - RNA, 17 nt, Human
ccauguuccaauaaaca

SEQ ID NO: 3436156 - RNA, 17 nt, Human
ccauguucugcccccag

SEQ ID NO: 3436157 - RNA, 20 nt, Human
ccauguucugcccccagccc

SEQ ID NO: 3436158 - RNA, 22 nt, Human
ccauguucugucccuugccccc

SEQ ID NO: 3436159 - RNA, 17 nt, Human
ccauguugccugucuuu

SEQ ID NO: 3436160 - RNA, 18 nt, Human
ccauguuggccaggcugc

SEQ ID NO: 3436161 - RNA, 20 nt, Human
ccauguuggccaggcugcuc

SEQ ID NO: 3436162 - RNA, 19 nt, Human
ccauguuggccaggcuggu

SEQ ID NO: 3436163 - RNA, 13 nt, Human
ccauguuggcuag

SEQ ID NO: 3436164 - RNA, 18 nt, Human
ccauguuggucaggcugg

SEQ ID NO: 3436165 - RNA, 19 nt, Human
ccauguuggucaggcuggu

SEQ ID NO: 3436166 - RNA, 16 nt, Human
ccauguuguaaugcug

SEQ ID NO: 3436167 - RNA, 17 nt, Human
ccauguuguaaugcugc

SEQ ID NO: 3436168 - RNA, 15 nt, Human
ccauguuuaagauuu

SEQ ID NO: 3436169 - RNA, 16 nt, Human
ccauguuuaagauuua

SEQ ID NO: 3436170 - RNA, 13 nt, Human
ccauguuuauuac

SEQ ID NO: 3436171 - RNA, 20 nt, Human
ccauguuuauuacaguauaa

SEQ ID NO: 3436172 - RNA, 12 nt, Human
ccauguuucugu

SEQ ID NO: 3436173 - RNA, 21 nt, Human
ccauguuugagcucagacccc

SEQ ID NO: 3436174 - RNA, 14 nt, Human
ccauguuuguaaaa

SEQ ID NO: 3436175 - RNA, 15 nt, Human
ccauguuuguaaaac

SEQ ID NO: 3436176 - RNA, 20 nt, Human
ccauuaaaacugaagucuga

SEQ ID NO: 3436177 - RNA, 23 nt, Human
ccauuaaacgauuuuuaaaaugu

SEQ ID NO: 3436178 - RNA, 20 nt, Human
ccauuaaagaauaugaaaca

SEQ ID NO: 3436179 - RNA, 22 nt, Human
ccauuaaagucgagcuuuucua

SEQ ID NO: 3436180 - RNA, 14 nt, Human
ccauuaaagucuga

SEQ ID NO: 3436181 - RNA, 15 nt, Human
ccauuaaagucugaa

SEQ ID NO: 3436182 - RNA, 16 nt, Human
ccauuaaagucugaau

SEQ ID NO: 3436183 - RNA, 15 nt, Human
ccauuaaaugaauau

SEQ ID NO: 3436184 - RNA, 16 nt, Human
ccauuaaaugaauauu

SEQ ID NO: 3436185 - RNA, 17 nt, Human
ccauuaaaugaauauuu

SEQ ID NO: 3436186 - RNA, 23 nt, Human
ccauuaaccagggcaccaagccc

SEQ ID NO: 3436187 - RNA, 16 nt, Human
ccauuaaucauuuccc

SEQ ID NO: 3436188 - RNA, 18 nt, Human
ccauuaaucauuucccca

SEQ ID NO: 3436189 - RNA, 12 nt, Human
ccauuaauuuaa

SEQ ID NO: 3436190 - RNA, 22 nt, Human
ccauuacagagguauuaaaacu

SEQ ID NO: 3436191 - RNA, 16 nt, Human
ccauuaccauguaaug

SEQ ID NO: 3436192 - RNA, 13 nt, Human
ccauuaucaugug

SEQ ID NO: 3436193 - RNA, 15 nt, Human
ccauuaucaugugua

SEQ ID NO: 3436194 - RNA, 16 nt, Human
ccauuaucauguguaa

SEQ ID NO: 3436195 - RNA, 14 nt, Human
ccauuaucccugaa

SEQ ID NO: 3436196 - RNA, 22 nt, Human
ccauuauucaaaguugccuaaa

SEQ ID NO: 3436197 - RNA, 12 nt, Human
ccauuauuuucu

SEQ ID NO: 3436198 - RNA, 13 nt, Human
ccauuauuuucug

SEQ ID NO: 3436199 - RNA, 19 nt, Human
ccauucacaauaaaagcuu

SEQ ID NO: 3436200 - RNA, 14 nt, Human
ccauucauuccauu

SEQ ID NO: 3436201 - RNA, 16 nt, Human
ccauuccagaauaucu

SEQ ID NO: 3436202 - RNA, 16 nt, Human
ccauucccccagugcg

SEQ ID NO: 3436203 - RNA, 20 nt, Human
ccauucccugccuggggcgg

SEQ ID NO: 3436204 - RNA, 13 nt, Human
ccauuccugaaga

SEQ ID NO: 3436205 - RNA, 24 nt, Human
ccauuccuggagcccgaggcacca

SEQ ID NO: 3436206 - RNA, 22 nt, Human
ccauuccugggaaauauucccu

SEQ ID NO: 3436207 - RNA, 20 nt, Human
ccauuccugguacccagcca

SEQ ID NO: 3436208 - RNA, 21 nt, Human
ccauuccugguacccagccau

SEQ ID NO: 3436209 - RNA, 18 nt, Human
ccauucgcgcucugcuca

SEQ ID NO: 3436210 - RNA, 20 nt, Human
ccauucguacauaauacuga

SEQ ID NO: 3436211 - RNA, 13 nt, Human
ccauucuacuugc

SEQ ID NO: 3436212 - RNA, 18 nt, Human
ccauucuacuugcucugg

SEQ ID NO: 3436213 - RNA, 19 nt, Human
ccauucuacuugcucugga

SEQ ID NO: 3436214 - RNA, 22 nt, Human
ccauucuacuugcucuggaccu

SEQ ID NO: 3436215 - RNA, 12 nt, Human
ccauucuaugug

SEQ ID NO: 3436216 - RNA, 15 nt, Human
ccauucuccacagca

SEQ ID NO: 3436217 - RNA, 15 nt, Human
ccauucuccaccugc

SEQ ID NO: 3436218 - RNA, 18 nt, Human
ccauucuccaccugccag

SEQ ID NO: 3436219 - RNA, 11 nt, Human
ccauucuccca

SEQ ID NO: 3436220 - RNA, 22 nt, Human
ccauucucccagguaccagcug

SEQ ID NO: 3436221 - RNA, 23 nt, Human
ccauucucccagguaccagcugc

SEQ ID NO: 3436222 - RNA, 18 nt, Human
ccauucucccucuuguuu

SEQ ID NO: 3436223 - RNA, 20 nt, Human
ccauucucucuccuguccaa

SEQ ID NO: 3436224 - RNA, 17 nt, Human
ccauucugaccauuuca

SEQ ID NO: 3436225 - RNA, 20 nt, Human
ccauucugacucgguuucuc

SEQ ID NO: 3436226 - RNA, 20 nt, Human
ccauucugccuccauucuga

SEQ ID NO: 3436227 - RNA, 16 nt, Human
ccauucugccugccca

SEQ ID NO: 3436228 - RNA, 18 nt, Human
ccauucugccugcccagg

SEQ ID NO: 3436229 - RNA, 14 nt, Human
ccauucugcuccuu

SEQ ID NO: 3436230 - RNA, 16 nt, Human
ccauucugcuccuucc

SEQ ID NO: 3436231 - RNA, 19 nt, Human
ccauucuguccuaccuuua

SEQ ID NO: 3436232 - RNA, 12 nt, Human
ccauucuuuccc

SEQ ID NO: 3436233 - RNA, 13 nt, Human
ccauucuuugcuu

SEQ ID NO: 3436234 - RNA, 20 nt, Human
ccauucuuugcuugaacaca

SEQ ID NO: 3436235 - RNA, 15 nt, Human
ccauucuuuuguaau

SEQ ID NO: 3436236 - RNA, 19 nt, Human
ccauucuuuuuuucuuggc

SEQ ID NO: 3436237 - RNA, 19 nt, Human
ccauugaagccgacucugg

SEQ ID NO: 3436238 - RNA, 12 nt, Human
ccauugaaggcu

SEQ ID NO: 3436239 - RNA, 22 nt, Human
ccauugagaccgugaagauacu

SEQ ID NO: 3436240 - RNA, 20 nt, Human
ccauugcaucaccucuguaa

SEQ ID NO: 3436241 - RNA, 13 nt, Human
ccauugccuccuc

SEQ ID NO: 3436242 - RNA, 12 nt, Human
cccaaccccuga

SEQ ID NO: 3436243 - RNA, 14 nt, Human
cccaaccccugagg

SEQ ID NO: 3436244 - RNA, 23 nt, Human
cccaaccccuuaagcccuggccc

SEQ ID NO: 3436245 - RNA, 22 nt, Human
cccaacccguggaggcugcucg

SEQ ID NO: 3436246 - RNA, 23 nt, Human
cccaacccguggaggcugcucgg

SEQ ID NO: 3436247 - RNA, 14 nt, Human
cccaacccugcccc

SEQ ID NO: 3436248 - RNA, 15 nt, Human
cccaacccuucccca

SEQ ID NO: 3436249 - RNA, 13 nt, Human
cccaacccuucuu

SEQ ID NO: 3436250 - RNA, 15 nt, Human
cccaacccuucuuca

SEQ ID NO: 3436251 - RNA, 13 nt, Human
cccaaccucagca

SEQ ID NO: 3436252 - RNA, 14 nt, Human
cccaaccucuuccu

SEQ ID NO: 3436253 - RNA, 21 nt, Human
cccaaccucuuccuccugaca

SEQ ID NO: 3436254 - RNA, 19 nt, Human
cccaaccugcucuccucuu

SEQ ID NO: 3436255 - RNA, 15 nt, Human
cccaaccuuucccuc

SEQ ID NO: 3436256 - RNA, 16 nt, Human
cccaaccuuucccuca

SEQ ID NO: 3436257 - RNA, 15 nt, Human
cccaacgcacaggaa

SEQ ID NO: 3436258 - RNA, 20 nt, Human
cccaacuacuaucucagaga

SEQ ID NO: 3436259 - RNA, 17 nt, Human
cccaacucaccccagcc

SEQ ID NO: 3436260 - RNA, 13 nt, Human
cccaacuccagaa

SEQ ID NO: 3436261 - RNA, 12 nt, Human
cccaacuccugg

SEQ ID NO: 3436262 - RNA, 15 nt, Human
cccaacuccuuccag

SEQ ID NO: 3436263 - RNA, 18 nt, Human
cccaacuccuuccagcua

SEQ ID NO: 3436264 - RNA, 15 nt, Human
cccaacucuccccug

SEQ ID NO: 3436265 - RNA, 15 nt, Human
cccaacucuccugga

SEQ ID NO: 3436266 - RNA, 12 nt, Human
cccaacugacca

SEQ ID NO: 3436267 - RNA, 21 nt, Human
cccaacugcaagucacaaagg

SEQ ID NO: 3436268 - RNA, 20 nt, Human
cccaacuucucuugcuuucu

SEQ ID NO: 3436269 - RNA, 18 nt, Human
cccaacuugccuuugaag

SEQ ID NO: 3436270 - RNA, 20 nt, Human
cccaagaauagaugcugacu

SEQ ID NO: 3436271 - RNA, 14 nt, Human
cccaagaaugcaag

SEQ ID NO: 3436272 - RNA, 20 nt, Human
cccaagacagaugccccaga

SEQ ID NO: 3436273 - RNA, 17 nt, Human
cccaagaccuaaggguu

SEQ ID NO: 3436274 - RNA, 20 nt, Human
cccaagacucccaugaggga

SEQ ID NO: 3436275 - RNA, 22 nt, Human
cccaagacuugguguccuuucc

SEQ ID NO: 3436276 - RNA, 14 nt, Human
cccaagagaacucg

SEQ ID NO: 3436277 - RNA, 17 nt, Human
cccaagagaugaagagu

SEQ ID NO: 3436278 - RNA, 18 nt, Human
cccaagagcaucaugccu

SEQ ID NO: 3436279 - RNA, 23 nt, Human
cccaagaggucaaggcugcagug

SEQ ID NO: 3436280 - RNA, 20 nt, Human
cccaagaugggcaucuuuug

SEQ ID NO: 3436281 - RNA, 22 nt, Human
cccaagaugggcaucuuuugua

SEQ ID NO: 3436282 - RNA, 21 nt, Human
cccaagauugagcucucugcc

SEQ ID NO: 3436283 - RNA, 20 nt, Human
cccaagcaccugggauuaca

SEQ ID NO: 3436284 - RNA, 16 nt, Human
cccaagccaaaaaccu

SEQ ID NO: 3436285 - RNA, 23 nt, Human
cccaagcccgacuugcuguuuug

SEQ ID NO: 3436286 - RNA, 23 nt, Human
cccaagccuacuuuugccauuga

SEQ ID NO: 3436287 - RNA, 16 nt, Human
cccaagccuggcaagg

SEQ ID NO: 3436288 - RNA, 17 nt, Human
cccaagcggugucucuc

SEQ ID NO: 3436289 - RNA, 12 nt, Human
cccaagcucugc

SEQ ID NO: 3436290 - RNA, 13 nt, Human
cccaagcucugcu

SEQ ID NO: 3436291 - RNA, 22 nt, Human
cccaagcuggagugcaguggug

SEQ ID NO: 3436292 - RNA, 22 nt, Human
cccaagcugggccccagcccac

SEQ ID NO: 3436293 - RNA, 19 nt, Human
cccaagcuguuuucuucua

SEQ ID NO: 3436294 - RNA, 14 nt, Human
cccaagcuuagaac

SEQ ID NO: 3436295 - RNA, 22 nt, Human
cccaaggaaagccccagcacua

SEQ ID NO: 3436296 - RNA, 15 nt, Human
cccaaggacugaggg

SEQ ID NO: 3436297 - RNA, 19 nt, Human
cccaaggcccccugccugc

SEQ ID NO: 3436298 - RNA, 22 nt, Human
cccaaggcccccugccugcccu

SEQ ID NO: 3436299 - RNA, 19 nt, Human
cccaaggcucccggaauuc

SEQ ID NO: 3436300 - RNA, 15 nt, Human
cccaaggcugcgucu

SEQ ID NO: 3436301 - RNA, 18 nt, Human
cccaagggaggcugcugc

SEQ ID NO: 3436302 - RNA, 14 nt, Human
cccaagggccuggc

SEQ ID NO: 3436303 - RNA, 19 nt, Human
cccaagggccuggccugag

SEQ ID NO: 3436304 - RNA, 12 nt, Human
cccaaggggcag

SEQ ID NO: 3436305 - RNA, 15 nt, Human
cccaagguuggagcc

SEQ ID NO: 3436306 - RNA, 13 nt, Human
ccccagccccggg

SEQ ID NO: 3436307 - RNA, 23 nt, Human
ccccagccccgguggcugggcag

SEQ ID NO: 3436308 - RNA, 23 nt, Human
ccccagccccucccccaucuccc

SEQ ID NO: 3436309 - RNA, 13 nt, Human
ccccagcccugcu

SEQ ID NO: 3436310 - RNA, 16 nt, Human
ccccagcccugcuggg

SEQ ID NO: 3436311 - RNA, 13 nt, Human
ccccagcccuggc

SEQ ID NO: 3436312 - RNA, 23 nt, Human
ccccagccuaugagcauccugag

SEQ ID NO: 3436313 - RNA, 19 nt, Human
ccccagccugcgccugcug

SEQ ID NO: 3436314 - RNA, 13 nt, Human
ccccagccugcua

SEQ ID NO: 3436315 - RNA, 22 nt, Human
ccccagccuggcccagcucccc

SEQ ID NO: 3436316 - RNA, 20 nt, Human
ccccagcgcugacgugucag

SEQ ID NO: 3436317 - RNA, 21 nt, Human
ccccagcuaagaaccuggaac

SEQ ID NO: 3436318 - RNA, 22 nt, Human
ccccagcuacccuuuuucucca

SEQ ID NO: 3436319 - RNA, 16 nt, Human
ccccagcucaggggca

SEQ ID NO: 3436320 - RNA, 11 nt, Human
ccccagcuccc

SEQ ID NO: 3436321 - RNA, 14 nt, Human
ccccagcucccacc

SEQ ID NO: 3436322 - RNA, 13 nt, Human
ccccagcucccag

SEQ ID NO: 3436323 - RNA, 13 nt, Human
ccccagcucugcu

SEQ ID NO: 3436324 - RNA, 14 nt, Human
ccccagcucugcuu

SEQ ID NO: 3436325 - RNA, 17 nt, Human
ccccagcucuggcuucc

SEQ ID NO: 3436326 - RNA, 14 nt, Human
ccccagcucuggug

SEQ ID NO: 3436327 - RNA, 22 nt, Human
ccccagcucuggugagucuugg

SEQ ID NO: 3436328 - RNA, 12 nt, Human
ccccagcuggcc

SEQ ID NO: 3436329 - RNA, 13 nt, Human
ccccagcugggag

SEQ ID NO: 3436330 - RNA, 14 nt, Human
ccccagcugggagg

SEQ ID NO: 3436331 - RNA, 15 nt, Human
ccccagcugggaggc

SEQ ID NO: 3436332 - RNA, 22 nt, Human
ccccagcugggaggcaagaggg

SEQ ID NO: 3436333 - RNA, 21 nt, Human
ccccagcugugagccuuggcu

SEQ ID NO: 3436334 - RNA, 14 nt, Human
ccccagcuuccagc

SEQ ID NO: 3436335 - RNA, 19 nt, Human
ccccagcuuccagcaggag

SEQ ID NO: 3436336 - RNA, 12 nt, Human
ccccaggaagcc

SEQ ID NO: 3436337 - RNA, 18 nt, Human
ccccaggaagcccaggag

SEQ ID NO: 3436338 - RNA, 13 nt, Human
ccccaggacaggc

SEQ ID NO: 3436339 - RNA, 13 nt, Human
ccccaggaccaga

SEQ ID NO: 3436340 - RNA, 16 nt, Human
ccccaggaccagcuca

SEQ ID NO: 3436341 - RNA, 18 nt, Human
ccccaggaccagcucagg

SEQ ID NO: 3436342 - RNA, 20 nt, Human
ccccaggaccuggcugccau

SEQ ID NO: 3436343 - RNA, 12 nt, Human
ccccaggacgcc

SEQ ID NO: 3436344 - RNA, 23 nt, Human
ccccaggacgccacucauuucau

SEQ ID NO: 3436345 - RNA, 14 nt, Human
ccccaggaggccag

SEQ ID NO: 3436346 - RNA, 22 nt, Human
ccccaggaggccagccuugacc

SEQ ID NO: 3436347 - RNA, 21 nt, Human
ccccaggcccacucagggguc

SEQ ID NO: 3436348 - RNA, 19 nt, Human
ccccaggccccaggaagcc

SEQ ID NO: 3436349 - RNA, 20 nt, Human
ccccaggccccgaggaccca

SEQ ID NO: 3436350 - RNA, 18 nt, Human
ccccaggcucguggacug

SEQ ID NO: 3436351 - RNA, 16 nt, Human
ccccagggaagcagca

SEQ ID NO: 3436352 - RNA, 20 nt, Human
ccccagggaagcagcagccu

SEQ ID NO: 3436353 - RNA, 12 nt, Human
ccccagggcaca

SEQ ID NO: 3436354 - RNA, 16 nt, Human
ccccagggcacaggag

SEQ ID NO: 3436355 - RNA, 18 nt, Human
ccccagggcacaggagcu

SEQ ID NO: 3436356 - RNA, 19 nt, Human
ccccagggcacaggagcua

SEQ ID NO: 3436357 - RNA, 23 nt, Human
ccccagggcacaggagcuaccug

SEQ ID NO: 3436358 - RNA, 22 nt, Human
ccccagggcacuucacagagug

SEQ ID NO: 3436359 - RNA, 15 nt, Human
ccccagggcagccag

SEQ ID NO: 3436360 - RNA, 16 nt, Human
ccccagggcagccagg

SEQ ID NO: 3436361 - RNA, 22 nt, Human
ccccagggcuguaacugccagg

SEQ ID NO: 3436362 - RNA, 16 nt, Human
ccccaggggaaaauga

SEQ ID NO: 3436363 - RNA, 19 nt, Human
ccccaggggaaagaugagc

SEQ ID NO: 3436364 - RNA, 23 nt, Human
ccccagguaggggccccucucag

SEQ ID NO: 3436365 - RNA, 21 nt, Human
ccccagguccagcucuggagg

SEQ ID NO: 3436366 - RNA, 13 nt, Human
ccccaguaaaauu

SEQ ID NO: 3436367 - RNA, 18 nt, Human
ccccaguaagccacugcc

SEQ ID NO: 3436368 - RNA, 14 nt, Human
ccccaguacacagg

SEQ ID NO: 3436369 - RNA, 17 nt, Human
ccccagucagccucucu

SEQ ID NO: 3436370 - RNA, 15 nt, Human
ccccagugacagcua

SEQ ID NO: 3436371 - RNA, 21 nt, Human
ccccaguuccuguggcucccu

SEQ ID NO: 3436372 - RNA, 22 nt, Human
ccccaguuccuguggcucccuc

SEQ ID NO: 3436373 - RNA, 15 nt, Human
ccccaguucgccugg

SEQ ID NO: 3436374 - RNA, 17 nt, Human
ccccaguucugcuccuc

SEQ ID NO: 3436375 - RNA, 19 nt, Human
ccccaguucugcuccucuc

SEQ ID NO: 3436376 - RNA, 20 nt, Human
ccccaguucugcuccucucc

SEQ ID NO: 3436377 - RNA, 15 nt, Human
ccccauacuccuaug

SEQ ID NO: 3436378 - RNA, 20 nt, Human
ccccaucagugcucccucac

SEQ ID NO: 3436379 - RNA, 16 nt, Human
ccccauccuccagcuu

SEQ ID NO: 3436380 - RNA, 17 nt, Human
ccccauccuccagcuuc

SEQ ID NO: 3436381 - RNA, 18 nt, Human
ccccauccuccccuuccc

SEQ ID NO: 3436382 - RNA, 14 nt, Human
ccccauccucugua

SEQ ID NO: 3436383 - RNA, 14 nt, Human
ccccauccuggccc

SEQ ID NO: 3436384 - RNA, 23 nt, Human
ccccaucgccagcugaugacuca

SEQ ID NO: 3436385 - RNA, 17 nt, Human
ccccaucucaggccaga

SEQ ID NO: 3436386 - RNA, 19 nt, Human
ccccaucuccccucagcuc

SEQ ID NO: 3436387 - RNA, 18 nt, Human
cccaggaaaggcuccagg

SEQ ID NO: 3436388 - RNA, 18 nt, Human
cccaggaauggagccugc

SEQ ID NO: 3436389 - RNA, 20 nt, Human
cccaggaauggagccugcac

SEQ ID NO: 3436390 - RNA, 16 nt, Human
cccaggacaagcaugg

SEQ ID NO: 3436391 - RNA, 19 nt, Human
cccaggacaccacacccag

SEQ ID NO: 3436392 - RNA, 22 nt, Human
cccaggacaccacacccagccu

SEQ ID NO: 3436393 - RNA, 10 nt, Human
cccaggacag

SEQ ID NO: 3436394 - RNA, 15 nt, Human
cccaggaccaagcca

SEQ ID NO: 3436395 - RNA, 16 nt, Human
cccaggaccacaggcu

SEQ ID NO: 3436396 - RNA, 12 nt, Human
cccaggaccagc

SEQ ID NO: 3436397 - RNA, 15 nt, Human
cccaggaccagcugg

SEQ ID NO: 3436398 - RNA, 18 nt, Human
cccaggaccagcuggggc

SEQ ID NO: 3436399 - RNA, 22 nt, Human
cccaggaccagcuggggcgugg

SEQ ID NO: 3436400 - RNA, 12 nt, Human
cccaggacccca

SEQ ID NO: 3436401 - RNA, 12 nt, Human
cccaggacccug

SEQ ID NO: 3436402 - RNA, 13 nt, Human
cccaggacccuga

SEQ ID NO: 3436403 - RNA, 23 nt, Human
cccaggacccugaaggggccaug

SEQ ID NO: 3436404 - RNA, 23 nt, Human
cccaggacgccacucauuucauc

SEQ ID NO: 3436405 - RNA, 18 nt, Human
cccaggacgcuucugaau

SEQ ID NO: 3436406 - RNA, 20 nt, Human
cccaggacgcuucugaaugc

SEQ ID NO: 3436407 - RNA, 17 nt, Human
cccaggacggggccggc

SEQ ID NO: 3436408 - RNA, 15 nt, Human
cccaggacucugacc

SEQ ID NO: 3436409 - RNA, 17 nt, Human
cccaggagacaguucaa

SEQ ID NO: 3436410 - RNA, 13 nt, Human
cccaggagagaga

SEQ ID NO: 3436411 - RNA, 20 nt, Human
cccaggagagagaaagccag

SEQ ID NO: 3436412 - RNA, 19 nt, Human
cccaggagagccagcccuc

SEQ ID NO: 3436413 - RNA, 21 nt, Human
cccaggagagccagcccuccc

SEQ ID NO: 3436414 - RNA, 22 nt, Human
cccaggagagccagcccucccu

SEQ ID NO: 3436415 - RNA, 14 nt, Human
cccaggagccucac

SEQ ID NO: 3436416 - RNA, 17 nt, Human
cccaggagcugcccaga

SEQ ID NO: 3436417 - RNA, 15 nt, Human
cccaggaggcaggga

SEQ ID NO: 3436418 - RNA, 13 nt, Human
cccaggaggccag

SEQ ID NO: 3436419 - RNA, 13 nt, Human
cccaggaggcuga

SEQ ID NO: 3436420 - RNA, 18 nt, Human
cccaggagggagggggcu

SEQ ID NO: 3436421 - RNA, 20 nt, Human
cccaggaggggaacacugcc

SEQ ID NO: 3436422 - RNA, 23 nt, Human
cccaggagguggagguugcagug

SEQ ID NO: 3436423 - RNA, 22 nt, Human
cccaggaguggaggaggccugg

SEQ ID NO: 3436424 - RNA, 14 nt, Human
cccaggaguucugc

SEQ ID NO: 3436425 - RNA, 23 nt, Human
cccaggaguucugcucauucuaa

SEQ ID NO: 3436426 - RNA, 17 nt, Human
cccaggaguuuggccag

SEQ ID NO: 3436427 - RNA, 19 nt, Human
cccaggaguuuggccagaa

SEQ ID NO: 3436428 - RNA, 15 nt, Human
cccaggauauauuuu

SEQ ID NO: 3436429 - RNA, 23 nt, Human
cccaggaucagauugcaugugac

SEQ ID NO: 3436430 - RNA, 13 nt, Human
cccaggcaaggcu

SEQ ID NO: 3436431 - RNA, 12 nt, Human
cccaggcacugc

SEQ ID NO: 3436432 - RNA, 13 nt, Human
cccaggcaggcug

SEQ ID NO: 3436433 - RNA, 17 nt, Human
cccaggcagggagacgg

SEQ ID NO: 3436434 - RNA, 23 nt, Human
cccaggcagggccaacccuucuc

SEQ ID NO: 3436435 - RNA, 11 nt, Human
cccaggcaggu

SEQ ID NO: 3436436 - RNA, 13 nt, Human
cccaggcaggucu

SEQ ID NO: 3436437 - RNA, 23 nt, Human
cccaggcaggucuugaacuccug

SEQ ID NO: 3436438 - RNA, 15 nt, Human
cccaggcauucccca

SEQ ID NO: 3436439 - RNA, 20 nt, Human
cccaggcauuccccaggagg

SEQ ID NO: 3436440 - RNA, 23 nt, Human
cccaggcauuccccaggaggcca

SEQ ID NO: 3436441 - RNA, 17 nt, Human
cccaggccaggacucug

SEQ ID NO: 3436442 - RNA, 19 nt, Human
cccaggccaggacucugca

SEQ ID NO: 3436443 - RNA, 20 nt, Human
cccaggccaggacucugcag

SEQ ID NO: 3436444 - RNA, 13 nt, Human
cccaggccaggcc

SEQ ID NO: 3436445 - RNA, 22 nt, Human
cccaggccaggccaccaggaug

SEQ ID NO: 3436446 - RNA, 19 nt, Human
cccaggccaggcuccuucc

SEQ ID NO: 3436447 - RNA, 21 nt, Human
cccaggccaggcuccuuccug

SEQ ID NO: 3436448 - RNA, 13 nt, Human
cccaggcccacuc

SEQ ID NO: 3436449 - RNA, 22 nt, Human
cccaggccccugccacccuggg

SEQ ID NO: 3436450 - RNA, 23 nt, Human
cccaggccccuggaggcugccuc

SEQ ID NO: 3436451 - RNA, 18 nt, Human
cccaggccgagaagccag

SEQ ID NO: 3436452 - RNA, 14 nt, Human
cccaggccgcagcu

SEQ ID NO: 3436453 - RNA, 17 nt, Human
cccaggccggccagccu

SEQ ID NO: 3436454 - RNA, 23 nt, Human
cccaggccggccagccucacccu

SEQ ID NO: 3436455 - RNA, 15 nt, Human
cccaggccguggcug

SEQ ID NO: 3436456 - RNA, 15 nt, Human
cccaggccugccugu

SEQ ID NO: 3436457 - RNA, 23 nt, Human
cccaggcgggagcgguggcccug

SEQ ID NO: 3436458 - RNA, 17 nt, Human
cccaggcucggccugcc

SEQ ID NO: 3436459 - RNA, 19 nt, Human
cccaggcucggccugcccc

SEQ ID NO: 3436460 - RNA, 12 nt, Human
cccaggcugccg

SEQ ID NO: 3436461 - RNA, 18 nt, Human
cccaggcuggagugcagu

SEQ ID NO: 3436462 - RNA, 19 nt, Human
cccaggcuggagugcagug

SEQ ID NO: 3436463 - RNA, 13 nt, Human
cccaggcuggcca

SEQ ID NO: 3436464 - RNA, 22 nt, Human
cccaggcuggccagccccacag

SEQ ID NO: 3436465 - RNA, 21 nt, Human
cccaggcuggcgugcaguggu

SEQ ID NO: 3436466 - RNA, 13 nt, Human
cccaggcugggaa

SEQ ID NO: 3436467 - RNA, 20 nt, Human
cccagggaagcagcagccuc

SEQ ID NO: 3436468 - RNA, 15 nt, Human
cccagggaaguuuug

SEQ ID NO: 3436469 - RNA, 19 nt, Human
cccagggacaccagccagg

SEQ ID NO: 3436470 - RNA, 21 nt, Human
cccagggacaccagccaggcu

SEQ ID NO: 3436471 - RNA, 17 nt, Human
cccagggaccgaaaagu

SEQ ID NO: 3436472 - RNA, 21 nt, Human
cccagggagcggaaagcagcu

SEQ ID NO: 3436473 - RNA, 15 nt, Human
cccagggcaagcucc

SEQ ID NO: 3436474 - RNA, 20 nt, Human
cccagggcaagcuccgcagg

SEQ ID NO: 3436475 - RNA, 23 nt, Human
cccagggcaaggguuaaggccug

SEQ ID NO: 3436476 - RNA, 14 nt, Human
cccagggcacagga

SEQ ID NO: 3436477 - RNA, 18 nt, Human
cccagggcacaggagcua

SEQ ID NO: 3436478 - RNA, 13 nt, Human
cccagggcacccu

SEQ ID NO: 3436479 - RNA, 18 nt, Human
cccagggcacuucacaga

SEQ ID NO: 3436480 - RNA, 20 nt, Human
cccagggcacuucacagagu

SEQ ID NO: 3436481 - RNA, 22 nt, Human
cccagggcacuucacagagugu

SEQ ID NO: 3436482 - RNA, 13 nt, Human
cccagggcagcca

SEQ ID NO: 3436483 - RNA, 17 nt, Human
cccagggcaucugggag

SEQ ID NO: 3436484 - RNA, 17 nt, Human
cccagggcaucuugcug

SEQ ID NO: 3436485 - RNA, 18 nt, Human
cccagggccacucugccu

SEQ ID NO: 3436486 - RNA, 15 nt, Human
cccagggccagggcc

SEQ ID NO: 3436487 - RNA, 22 nt, Human
cccagggccagggcccugcaga

SEQ ID NO: 3436488 - RNA, 22 nt, Human
cccagggcccagagcccagcuc

SEQ ID NO: 3436489 - RNA, 15 nt, Human
cccagggccugagcc

SEQ ID NO: 3436490 - RNA, 14 nt, Human
cccagggccugcag

SEQ ID NO: 3436491 - RNA, 19 nt, Human
cccagggccugcaggaccu

SEQ ID NO: 3436492 - RNA, 15 nt, Human
cccagggcuacccuc

SEQ ID NO: 3436493 - RNA, 14 nt, Human
cccagggcuccugc

SEQ ID NO: 3436494 - RNA, 16 nt, Human
cccagggcugggagga

SEQ ID NO: 3436495 - RNA, 21 nt, Human
cccagggcugggaggaaggac

SEQ ID NO: 3436496 - RNA, 23 nt, Human
cccagggcuguaacugccaggcu

SEQ ID NO: 3436497 - RNA, 18 nt, Human
cccaggggacaagggauu

SEQ ID NO: 3436498 - RNA, 17 nt, Human
cccaggggaccacaccu

SEQ ID NO: 3436499 - RNA, 24 nt, Human
cccaggggagagggucuggagaag

SEQ ID NO: 3436500 - RNA, 22 nt, Human
cccaggggcauguauuggccug

SEQ ID NO: 3436501 - RNA, 12 nt, Human
cccaggggccgg

SEQ ID NO: 3436502 - RNA, 22 nt, Human
cccagggggcuuccugagggga

SEQ ID NO: 3436503 - RNA, 18 nt, Human
cccaggggucccagccac

SEQ ID NO: 3436504 - RNA, 19 nt, Human
cccaggggucccagccacc

SEQ ID NO: 3436505 - RNA, 20 nt, Human
cccaggggucccagccaccc

SEQ ID NO: 3436506 - RNA, 14 nt, Human
cccaggggucuccc

SEQ ID NO: 3436507 - RNA, 17 nt, Human
cccaggggucucccugg

SEQ ID NO: 3436508 - RNA, 20 nt, Human
cccaggggucucccuggcuc

SEQ ID NO: 3436509 - RNA, 18 nt, Human
cagccucccgaguagcug

SEQ ID NO: 3436510 - RNA, 21 nt, Human
cagccucccuauuuuuuuucu

SEQ ID NO: 3436511 - RNA, 23 nt, Human
cagccucccucugaccugcaggc

SEQ ID NO: 3436512 - RNA, 18 nt, Human
cagccucccugaagccuu

SEQ ID NO: 3436513 - RNA, 21 nt, Human
cagccucccugucggccuggu

SEQ ID NO: 3436514 - RNA, 19 nt, Human
cagccuccgagagggagag

SEQ ID NO: 3436515 - RNA, 20 nt, Human
cagccuccgagagggagaga

SEQ ID NO: 3436516 - RNA, 21 nt, Human
cagccuccgcuucccugguuc

SEQ ID NO: 3436517 - RNA, 17 nt, Human
cagccuccucaucuggg

SEQ ID NO: 3436518 - RNA, 12 nt, Human
cagccuccucug

SEQ ID NO: 3436519 - RNA, 14 nt, Human
cagccuccucugga

SEQ ID NO: 3436520 - RNA, 21 nt, Human
cagccuccucuggacggcagg

SEQ ID NO: 3436521 - RNA, 17 nt, Human
cagccuccucugucugc

SEQ ID NO: 3436522 - RNA, 15 nt, Human
cagccuccugaguag

SEQ ID NO: 3436523 - RNA, 21 nt, Human
cagccucgaacuccugggcuc

SEQ ID NO: 3436524 - RNA, 23 nt, Human
cagccucgaacuccugggcucaa

SEQ ID NO: 3436525 - RNA, 21 nt, Human
cagccucgcaggccucccugc

SEQ ID NO: 3436526 - RNA, 20 nt, Human
cagccucgccccuggcagag

SEQ ID NO: 3436527 - RNA, 20 nt, Human
cagccucuagggaccccucc

SEQ ID NO: 3436528 - RNA, 21 nt, Human
cagccucuagggaccccuccu

SEQ ID NO: 3436529 - RNA, 15 nt, Human
cagccucucagugcc

SEQ ID NO: 3436530 - RNA, 18 nt, Human
cccaugcaagcagaggac

SEQ ID NO: 3436531 - RNA, 12 nt, Human
cccaugcacugu

SEQ ID NO: 3436532 - RNA, 19 nt, Human
cccaugcacugugaaggac

SEQ ID NO: 3436533 - RNA, 20 nt, Human
cccaugcacugugaaggacc

SEQ ID NO: 3436534 - RNA, 14 nt, Human
cccaugcaggcccu

SEQ ID NO: 3436535 - RNA, 19 nt, Human
cccaugcaggcccuuugaa

SEQ ID NO: 3436536 - RNA, 14 nt, Human
cccaugcccaccug

SEQ ID NO: 3436537 - RNA, 18 nt, Human
cccaugcccaccugccca

SEQ ID NO: 3436538 - RNA, 14 nt, Human
cccaugccugucca

SEQ ID NO: 3436539 - RNA, 19 nt, Human
cccaugccuguccagccug

SEQ ID NO: 3436540 - RNA, 14 nt, Human
cccaugccuguggc

SEQ ID NO: 3436541 - RNA, 18 nt, Human
cccaugccuguggcugcg

SEQ ID NO: 3436542 - RNA, 12 nt, Human
cccaugcugccc

SEQ ID NO: 3436543 - RNA, 13 nt, Human
cccaugcuggagc

SEQ ID NO: 3436544 - RNA, 18 nt, Human
cccaugcuguccauccau

SEQ ID NO: 3436545 - RNA, 20 nt, Human
cccauggacacuccagugcc

SEQ ID NO: 3436546 - RNA, 15 nt, Human
cccauggacaggcug

SEQ ID NO: 3436547 - RNA, 14 nt, Human
cccauggagcccca

SEQ ID NO: 3436548 - RNA, 16 nt, Human
cccauggagccccagc

SEQ ID NO: 3436549 - RNA, 14 nt, Human
cccauggcccugag

SEQ ID NO: 3436550 - RNA, 22 nt, Human
cccaugggaagacgaggcccuc

SEQ ID NO: 3436551 - RNA, 21 nt, Human
cccaugggagggagcugagaa

SEQ ID NO: 3436552 - RNA, 15 nt, Human
cccaugggcacugcu

SEQ ID NO: 3436553 - RNA, 21 nt, Human
cccaugggcacugcugggugg

SEQ ID NO: 3436554 - RNA, 17 nt, Human
cccaugggcucugacag

SEQ ID NO: 3436555 - RNA, 19 nt, Human
cccauggggagggauucug

SEQ ID NO: 3436556 - RNA, 22 nt, Human
cccauggguuguguguuuauuu

SEQ ID NO: 3436557 - RNA, 17 nt, Human
cccauggugcuaggaag

SEQ ID NO: 3436558 - RNA, 17 nt, Human
cccauguaacagaaagg

SEQ ID NO: 3436559 - RNA, 14 nt, Human
cccauguagccccc

SEQ ID NO: 3436560 - RNA, 15 nt, Human
cccauguagcccccu

SEQ ID NO: 3436561 - RNA, 23 nt, Human
cccauguagcccccuggccucug

SEQ ID NO: 3436562 - RNA, 17 nt, Human
cccaugucuacacagau

SEQ ID NO: 3436563 - RNA, 14 nt, Human
cccaugugagcugc

SEQ ID NO: 3436564 - RNA, 18 nt, Human
cccauguucugcccccag

SEQ ID NO: 3436565 - RNA, 19 nt, Human
cccauguucugcccccagc

SEQ ID NO: 3436566 - RNA, 21 nt, Human
cccauguucugucccuugccc

SEQ ID NO: 3436567 - RNA, 14 nt, Human
cccauguuguaaug

SEQ ID NO: 3436568 - RNA, 18 nt, Human
cccauguuguaaugcugc

SEQ ID NO: 3436569 - RNA, 19 nt, Human
cccauguuguaaugcugca

SEQ ID NO: 3436570 - RNA, 20 nt, Human
cccauguuguaaugcugcac

SEQ ID NO: 3436571 - RNA, 13 nt, Human
cccauguuucaaa

SEQ ID NO: 3436572 - RNA, 15 nt, Human
cccauguuucucugg

SEQ ID NO: 3436573 - RNA, 18 nt, Human
cccauuagaccaagcuug

SEQ ID NO: 3436574 - RNA, 15 nt, Human
cccauucaagauucc

SEQ ID NO: 3436575 - RNA, 12 nt, Human
cccauuccaggc

SEQ ID NO: 3436576 - RNA, 20 nt, Human
cccauuccaggcagccucug

SEQ ID NO: 3436577 - RNA, 14 nt, Human
cccauuccccagcc

SEQ ID NO: 3436578 - RNA, 12 nt, Human
cccauucccgca

SEQ ID NO: 3436579 - RNA, 16 nt, Human
cccauucccgcagugg

SEQ ID NO: 3436580 - RNA, 12 nt, Human
cccauuccugaa

SEQ ID NO: 3436581 - RNA, 18 nt, Human
cccauucuacuugcucug

SEQ ID NO: 3436582 - RNA, 22 nt, Human
cccauucuacuugcucuggacc

SEQ ID NO: 3436583 - RNA, 24 nt, Human
cccauucuacuugcucuggaccug

SEQ ID NO: 3436584 - RNA, 21 nt, Human
cccauucugccuccauucuga

SEQ ID NO: 3436585 - RNA, 21 nt, Human
cccauucugccugcccaggcc

SEQ ID NO: 3436586 - RNA, 22 nt, Human
cccauucugccugcccaggccc

SEQ ID NO: 3436587 - RNA, 12 nt, Human
cccauucugucc

SEQ ID NO: 3436588 - RNA, 17 nt, Human
cccauucuuuuguaauu

SEQ ID NO: 3436589 - RNA, 22 nt, Human
cccauucuuuuguaauuuaaau

SEQ ID NO: 3436590 - RNA, 17 nt, Human
cccauugguguugucau

SEQ ID NO: 3436591 - RNA, 20 nt, Human
cccauugucccucugcccca

SEQ ID NO: 3436592 - RNA, 22 nt, Human
cccauuguggucacaggaagua

SEQ ID NO: 3436593 - RNA, 12 nt, Human
cccauuuagaau

SEQ ID NO: 3436594 - RNA, 22 nt, Human
cccauuuagaauggugauuuua

SEQ ID NO: 3436595 - RNA, 18 nt, Human
cccauuucacaccugaaa

SEQ ID NO: 3436596 - RNA, 19 nt, Human
cccauuucgugagccccau

SEQ ID NO: 3436597 - RNA, 12 nt, Human
cccauuucuacu

SEQ ID NO: 3436598 - RNA, 16 nt, Human
cccauuucuauuuauu

SEQ ID NO: 3436599 - RNA, 20 nt, Human
cccauuucuauuuauuuacu

SEQ ID NO: 3436600 - RNA, 17 nt, Human
cccauuucuccagaacc

SEQ ID NO: 3436601 - RNA, 18 nt, Human
cccauuucuccagaaccc

SEQ ID NO: 3436602 - RNA, 18 nt, Human
cccauuugugccagagga

SEQ ID NO: 3436603 - RNA, 20 nt, Human
cccauuuuagucacuuuuuu

SEQ ID NO: 3436604 - RNA, 17 nt, Human
cccauuuugaaucacau

SEQ ID NO: 3436605 - RNA, 12 nt, Human
cccauuuugcaa

SEQ ID NO: 3436606 - RNA, 13 nt, Human
cccauuuuuccuu

SEQ ID NO: 3436607 - RNA, 18 nt, Human
ccccaaaacaaagucuuu

SEQ ID NO: 3436608 - RNA, 16 nt, Human
ccccaaaaccacagcc

SEQ ID NO: 3436609 - RNA, 19 nt, Human
ccccaaaaccacagcccug

SEQ ID NO: 3436610 - RNA, 22 nt, Human
ccccaaaaccacagcccuguca

SEQ ID NO: 3436611 - RNA, 18 nt, Human
ccccaaaacucuccucug

SEQ ID NO: 3436612 - RNA, 20 nt, Human
ccccaaaacucuccucugcu

SEQ ID NO: 3436613 - RNA, 13 nt, Human
ccccaaaauuagc

SEQ ID NO: 3436614 - RNA, 19 nt, Human
ccccaaacgggcugcccug

SEQ ID NO: 3436615 - RNA, 23 nt, Human
ccccaaaggaagcuuucucugcu

SEQ ID NO: 3436616 - RNA, 18 nt, Human
ccccaaauaagaagggau

SEQ ID NO: 3436617 - RNA, 11 nt, Human
ccccaaauccg

SEQ ID NO: 3436618 - RNA, 19 nt, Human
ccccaaauccgaaccuccu

SEQ ID NO: 3436619 - RNA, 17 nt, Human
ccccaacacugugcccu

SEQ ID NO: 3436620 - RNA, 16 nt, Human
ccccaacaugcacuga

SEQ ID NO: 3436621 - RNA, 13 nt, Human
ccccaaccccagc

SEQ ID NO: 3436622 - RNA, 13 nt, Human
ccccaacccccac

SEQ ID NO: 3436623 - RNA, 23 nt, Human
ccccaacccccagcacccgggcu

SEQ ID NO: 3436624 - RNA, 14 nt, Human
ccccaaccccugag

SEQ ID NO: 3436625 - RNA, 17 nt, Human
ccccaaccccugaggaa

SEQ ID NO: 3436626 - RNA, 20 nt, Human
ccccaacccguggaggcugc

SEQ ID NO: 3436627 - RNA, 15 nt, Human
ccccaacccugcccc

SEQ ID NO: 3436628 - RNA, 14 nt, Human
ccccaaccucaggg

SEQ ID NO: 3436629 - RNA, 20 nt, Human
ccccaaccucagggcuccca

SEQ ID NO: 3436630 - RNA, 16 nt, Human
ccccaaccugcucucc

SEQ ID NO: 3436631 - RNA, 21 nt, Human
ccccaaccugcucuccucuuc

SEQ ID NO: 3436632 - RNA, 15 nt, Human
ccccaaccuuucccu

SEQ ID NO: 3436633 - RNA, 20 nt, Human
ccccaacuacccccagcugu

SEQ ID NO: 3436634 - RNA, 13 nt, Human
ccccaacuccugg

SEQ ID NO: 3436635 - RNA, 16 nt, Human
ccccaacuccuuccag

SEQ ID NO: 3436636 - RNA, 17 nt, Human
ccccaacuccuuccagc

SEQ ID NO: 3436637 - RNA, 17 nt, Human
ccccaacucugagccca

SEQ ID NO: 3436638 - RNA, 17 nt, Human
ccccaagacucccauga

SEQ ID NO: 3436639 - RNA, 13 nt, Human
ccccaagcgcccu

SEQ ID NO: 3436640 - RNA, 15 nt, Human
ccccaaggggcaguc

SEQ ID NO: 3436641 - RNA, 15 nt, Human
ccccaauaauugcag

SEQ ID NO: 3436642 - RNA, 12 nt, Human
ccccacaacuuu

SEQ ID NO: 3436643 - RNA, 12 nt, Human
ccccacacacac

SEQ ID NO: 3436644 - RNA, 16 nt, Human
ccccacaccucaguuc

SEQ ID NO: 3436645 - RNA, 14 nt, Human
ccccacaccuggcc

SEQ ID NO: 3436646 - RNA, 12 nt, Human
ccccacacuccu

SEQ ID NO: 3436647 - RNA, 14 nt, Human
ccccacacuucccu

SEQ ID NO: 3436648 - RNA, 12 nt, Human
ccccacagcccc

SEQ ID NO: 3436649 - RNA, 17 nt, Human
ccccacagcgucccugg

SEQ ID NO: 3436650 - RNA, 18 nt, Human
ccccacagcgucccuggc

SEQ ID NO: 3436651 - RNA, 13 nt, Human
ccccaccacacau

SEQ ID NO: 3436652 - RNA, 14 nt, Human
ccccaccacacauc

SEQ ID NO: 3436653 - RNA, 12 nt, Human
ccccaccaccua

SEQ ID NO: 3436654 - RNA, 17 nt, Human
ccccaccacuucuuuua

SEQ ID NO: 3436655 - RNA, 18 nt, Human
ccccaccagccucaccag

SEQ ID NO: 3436656 - RNA, 15 nt, Human
ccccaccaucugcug

SEQ ID NO: 3436657 - RNA, 18 nt, Human
ccccaccaucugcugucu

SEQ ID NO: 3436658 - RNA, 19 nt, Human
ccccaccaucugcugucuu

SEQ ID NO: 3436659 - RNA, 20 nt, Human
ccccacccaagggccuggcc

SEQ ID NO: 3436660 - RNA, 21 nt, Human
ccccacccaagggccuggccu

SEQ ID NO: 3436661 - RNA, 12 nt, Human
ccccacccagga

SEQ ID NO: 3436662 - RNA, 13 nt, Human
ccccacccaggag

SEQ ID NO: 3436663 - RNA, 20 nt, Human
ccccaccccagggcagccag

SEQ ID NO: 3436664 - RNA, 13 nt, Human
ccccaccccauuu

SEQ ID NO: 3436665 - RNA, 14 nt, Human
ccccacccccaagg

SEQ ID NO: 3436666 - RNA, 13 nt, Human
ccccacccccagc

SEQ ID NO: 3436667 - RNA, 16 nt, Human
ccccacccccagcuca

SEQ ID NO: 3436668 - RNA, 17 nt, Human
ccccacccccagcucaa

SEQ ID NO: 3436669 - RNA, 17 nt, Human
ccccaccccccaggccu

SEQ ID NO: 3436670 - RNA, 12 nt, Human
ccccacccccuu

SEQ ID NO: 3436671 - RNA, 17 nt, Human
ccccacccccuucagug

SEQ ID NO: 3436672 - RNA, 21 nt, Human
ccccacccccuucagugccca

SEQ ID NO: 3436673 - RNA, 13 nt, Human
ccccaccccuacc

SEQ ID NO: 3436674 - RNA, 13 nt, Human
ccccaccccugcc

SEQ ID NO: 3436675 - RNA, 19 nt, Human
cagcggccccucccacaca

SEQ ID NO: 3436676 - RNA, 22 nt, Human
cccggccggccacccaggaggc

SEQ ID NO: 3436677 - RNA, 18 nt, Human
cccggccugcucccagca

SEQ ID NO: 3436678 - RNA, 23 nt, Human
cccggcgccccgcaccuguacag

SEQ ID NO: 3436679 - RNA, 16 nt, Human
cccggcgccuggccuc

SEQ ID NO: 3436680 - RNA, 20 nt, Human
cccggcgccuggccuccagg

SEQ ID NO: 3436681 - RNA, 21 nt, Human
cccggcgccuggccuccaggc

SEQ ID NO: 3436682 - RNA, 21 nt, Human
cccggcuaugggggcacugag

SEQ ID NO: 3436683 - RNA, 18 nt, Human
cccggcuccuggucaccu

SEQ ID NO: 3436684 - RNA, 22 nt, Human
cccggcuccuggucaccuagga

SEQ ID NO: 3436685 - RNA, 22 nt, Human
cccggcucgagcaguccugccu

SEQ ID NO: 3436686 - RNA, 16 nt, Human
cccggcucugugggug

SEQ ID NO: 3436687 - RNA, 21 nt, Human
cccggcugcagaggccagagg

SEQ ID NO: 3436688 - RNA, 12 nt, Human
cccggcugcccu

SEQ ID NO: 3436689 - RNA, 13 nt, Human
cccggcugcccuu

SEQ ID NO: 3436690 - RNA, 22 nt, Human
cccgggaaccuccccagccugc

SEQ ID NO: 3436691 - RNA, 23 nt, Human
cccgggaaccuccccagccugcg

SEQ ID NO: 3436692 - RNA, 18 nt, Human
cccgggaagggggcuggg

SEQ ID NO: 3436693 - RNA, 22 nt, Human
cccgggaagggggcugggacau

SEQ ID NO: 3436694 - RNA, 23 nt, Human
cccgggacgcagggguugcagug

SEQ ID NO: 3436695 - RNA, 23 nt, Human
cccgggacucacuggcagcccca

SEQ ID NO: 3436696 - RNA, 13 nt, Human
cccgggacucugc

SEQ ID NO: 3436697 - RNA, 13 nt, Human
cccgggagccuag

SEQ ID NO: 3436698 - RNA, 19 nt, Human
cccgggagcugcugcccug

SEQ ID NO: 3436699 - RNA, 13 nt, Human
cccgggaggggcc

SEQ ID NO: 3436700 - RNA, 15 nt, Human
cccgggaggggcccg

SEQ ID NO: 3436701 - RNA, 22 nt, Human
cccgggaggggcccgcuugccu

SEQ ID NO: 3436702 - RNA, 23 nt, Human
cccgggaggggcccgcuugccuc

SEQ ID NO: 3436703 - RNA, 12 nt, Human
cccgggcagggc

SEQ ID NO: 3436704 - RNA, 13 nt, Human
cccgggcagggcu

SEQ ID NO: 3436705 - RNA, 12 nt, Human
cccgggcccaga

SEQ ID NO: 3436706 - RNA, 11 nt, Human
cccgggcccca

SEQ ID NO: 3436707 - RNA, 17 nt, Human
cccgggcccucccuugg

SEQ ID NO: 3436708 - RNA, 18 nt, Human
cccgggcccucccuugga

SEQ ID NO: 3436709 - RNA, 20 nt, Human
cccgggcucagggaccacag

SEQ ID NO: 3436710 - RNA, 16 nt, Human
cccgggcucucugcug

SEQ ID NO: 3436711 - RNA, 14 nt, Human
cccgggcucugccu

SEQ ID NO: 3436712 - RNA, 13 nt, Human
cccgggcugccug

SEQ ID NO: 3436713 - RNA, 15 nt, Human
cccgggcugccuggg

SEQ ID NO: 3436714 - RNA, 15 nt, Human
cccggggacccugug

SEQ ID NO: 3436715 - RNA, 16 nt, Human
cccggggacccuguga

SEQ ID NO: 3436716 - RNA, 20 nt, Human
cccggggcagcugccagaga

SEQ ID NO: 3436717 - RNA, 18 nt, Human
cccggggcagggcagccg

SEQ ID NO: 3436718 - RNA, 14 nt, Human
cccggggccagcac

SEQ ID NO: 3436719 - RNA, 15 nt, Human
cccggggcccagggc

SEQ ID NO: 3436720 - RNA, 18 nt, Human
cccgggguccuguggcag

SEQ ID NO: 3436721 - RNA, 22 nt, Human
cccgggguccuguggcaggcag

SEQ ID NO: 3436722 - RNA, 23 nt, Human
cccggggugagggggggcucccu

SEQ ID NO: 3436723 - RNA, 16 nt, Human
cccgggguggccacag

SEQ ID NO: 3436724 - RNA, 22 nt, Human
cccggguuuggcgggccaagga

SEQ ID NO: 3436725 - RNA, 20 nt, Human
cccggugggacccccguggg

SEQ ID NO: 3436726 - RNA, 19 nt, Human
cccgucaggacguugagga

SEQ ID NO: 3436727 - RNA, 18 nt, Human
cccgucauguuccucaaa

SEQ ID NO: 3436728 - RNA, 16 nt, Human
cccgucccauauccug

SEQ ID NO: 3436729 - RNA, 17 nt, Human
cccgucgacguagaacc

SEQ ID NO: 3436730 - RNA, 12 nt, Human
cccgucucagug

SEQ ID NO: 3436731 - RNA, 15 nt, Human
cccugugauggggcc

SEQ ID NO: 3436732 - RNA, 17 nt, Human
cccugugauggggcccu

SEQ ID NO: 3436733 - RNA, 22 nt, Human
cccugugcaaccucuuggccug

SEQ ID NO: 3436734 - RNA, 12 nt, Human
cccugugccccc

SEQ ID NO: 3436735 - RNA, 22 nt, Human
cccugugccuaacaccagcguu

SEQ ID NO: 3436736 - RNA, 17 nt, Human
cccugugccuccucccu

SEQ ID NO: 3436737 - RNA, 24 nt, Human
cccugugccuuggugugcuguauc

SEQ ID NO: 3436738 - RNA, 20 nt, Human
cccugugccuugucacgcca

SEQ ID NO: 3436739 - RNA, 14 nt, Human
cccugugcuggugu

SEQ ID NO: 3436740 - RNA, 15 nt, Human
cccugugcugguguc

SEQ ID NO: 3436741 - RNA, 22 nt, Human
cccugugcugguguccugacca

SEQ ID NO: 3436742 - RNA, 19 nt, Human
cccuguggaugcugcugcc

SEQ ID NO: 3436743 - RNA, 14 nt, Human
cccuguggcccugg

SEQ ID NO: 3436744 - RNA, 12 nt, Human
cccugugggacc

SEQ ID NO: 3436745 - RNA, 14 nt, Human
cccuguggggaucu

SEQ ID NO: 3436746 - RNA, 15 nt, Human
cccuguggggaucuc

SEQ ID NO: 3436747 - RNA, 13 nt, Human
cccugugugaaug

SEQ ID NO: 3436748 - RNA, 17 nt, Human
cccuguguugucucuag

SEQ ID NO: 3436749 - RNA, 18 nt, Human
cccuguguugucucuaga

SEQ ID NO: 3436750 - RNA, 23 nt, Human
cccuguguugucucuagagcagg

SEQ ID NO: 3436751 - RNA, 16 nt, Human
cccuguuacaaagcug

SEQ ID NO: 3436752 - RNA, 21 nt, Human
cccuguuauuuucaaguagcu

SEQ ID NO: 3436753 - RNA, 13 nt, Human
cccuguucacucu

SEQ ID NO: 3436754 - RNA, 14 nt, Human
cccuguuccugcug

SEQ ID NO: 3436755 - RNA, 15 nt, Human
cccuguuccugcugc

SEQ ID NO: 3436756 - RNA, 16 nt, Human
cccuguuccugcugcu

SEQ ID NO: 3436757 - RNA, 15 nt, Human
cccuguuccuggagg

SEQ ID NO: 3436758 - RNA, 11 nt, Human
cccuguucuaa

SEQ ID NO: 3436759 - RNA, 12 nt, Human
cccuguucuaag

SEQ ID NO: 3436760 - RNA, 23 nt, Human
cccuguucuaagggggaggggaa

SEQ ID NO: 3436761 - RNA, 20 nt, Human
cccuguucuuccuccagcug

SEQ ID NO: 3436762 - RNA, 20 nt, Human
cccuguugacgaagucucuu

SEQ ID NO: 3436763 - RNA, 16 nt, Human
cccuguuuaauauuua

SEQ ID NO: 3436764 - RNA, 17 nt, Human
cccuguuuaauauuuaa

SEQ ID NO: 3436765 - RNA, 18 nt, Human
cccuguuuaauauuuaaa

SEQ ID NO: 3436766 - RNA, 19 nt, Human
cccuguuucaaucacuguc

SEQ ID NO: 3436767 - RNA, 14 nt, Human
cccuguuuccugag

SEQ ID NO: 3436768 - RNA, 19 nt, Human
cccuguuuguuucugaaag

SEQ ID NO: 3436769 - RNA, 22 nt, Human
cccuguuuucccacgaggaauc

SEQ ID NO: 3436770 - RNA, 14 nt, Human
cccuguuuucugag

SEQ ID NO: 3436771 - RNA, 16 nt, Human
cccuguuuucugagcc

SEQ ID NO: 3436772 - RNA, 17 nt, Human
cccuguuuucugagccc

SEQ ID NO: 3436773 - RNA, 20 nt, Human
cccuguuuucugagcccggg

SEQ ID NO: 3436774 - RNA, 13 nt, Human
cccuuaaaauuua

SEQ ID NO: 3436775 - RNA, 22 nt, Human
cccuuaaacaguugcacagcau

SEQ ID NO: 3436776 - RNA, 15 nt, Human
cccuuaacccaagga

SEQ ID NO: 3436777 - RNA, 17 nt, Human
cccuuaacccaaggagc

SEQ ID NO: 3436778 - RNA, 22 nt, Human
cccuuaacccaaggagcacagg

SEQ ID NO: 3436779 - RNA, 18 nt, Human
cccuuaauuacuuaaaaa

SEQ ID NO: 3436780 - RNA, 20 nt, Human
cccuuaauuacuuaaaaaaa

SEQ ID NO: 3436781 - RNA, 16 nt, Human
cccuuacacguaccuc

SEQ ID NO: 3436782 - RNA, 15 nt, Human
cccuuacagccucug

SEQ ID NO: 3436783 - RNA, 18 nt, Human
cccuuacagccucugacu

SEQ ID NO: 3436784 - RNA, 19 nt, Human
cccuuacagccucugacuu

SEQ ID NO: 3436785 - RNA, 17 nt, Human
cccuuaccccuuagccu

SEQ ID NO: 3436786 - RNA, 21 nt, Human
cccuuacccuuuccuccuuua

SEQ ID NO: 3436787 - RNA, 19 nt, Human
cccuuaccucggugccuuc

SEQ ID NO: 3436788 - RNA, 17 nt, Human
cccuuaccugccaggaa

SEQ ID NO: 3436789 - RNA, 20 nt, Human
cccuuaccugccaggaagcc

SEQ ID NO: 3436790 - RNA, 15 nt, Human
cccuuacgugagucc

SEQ ID NO: 3436791 - RNA, 21 nt, Human
cccuuacuggcuuaccuccuc

SEQ ID NO: 3436792 - RNA, 16 nt, Human
cccuuagaaaaugugu

SEQ ID NO: 3436793 - RNA, 15 nt, Human
cccuuagacagaggc

SEQ ID NO: 3436794 - RNA, 16 nt, Human
cccuuagacagaggcc

SEQ ID NO: 3436795 - RNA, 21 nt, Human
cccuuagacagaggcccucaa

SEQ ID NO: 3436796 - RNA, 14 nt, Human
cccuuagcagggaa

SEQ ID NO: 3436797 - RNA, 23 nt, Human
cccuuagcagggaaacagcuaau

SEQ ID NO: 3436798 - RNA, 14 nt, Human
cccuuagccucccu

SEQ ID NO: 3436799 - RNA, 23 nt, Human
cccuuagucccccaacucugagc

SEQ ID NO: 3436800 - RNA, 19 nt, Human
cccuuaugcgguuaauuuu

SEQ ID NO: 3436801 - RNA, 16 nt, Human
cccuuauuacacggaa

SEQ ID NO: 3436802 - RNA, 18 nt, Human
cccuucaaccauucccca

SEQ ID NO: 3436803 - RNA, 19 nt, Human
cccuucacaccauaacuag

SEQ ID NO: 3436804 - RNA, 12 nt, Human
cccuucagcccc

SEQ ID NO: 3436805 - RNA, 21 nt, Human
cccuucaguacccucucagcu

SEQ ID NO: 3436806 - RNA, 13 nt, Human
cccuucagugccc

SEQ ID NO: 3436807 - RNA, 17 nt, Human
cccuucagugcccacca

SEQ ID NO: 3436808 - RNA, 14 nt, Human
cccuucaucuggaa

SEQ ID NO: 3436809 - RNA, 15 nt, Human
cccuucaucuuccug

SEQ ID NO: 3436810 - RNA, 17 nt, Human
cccuucaucuuccugug

SEQ ID NO: 3436811 - RNA, 20 nt, Human
cccuucaucuuccugugucc

SEQ ID NO: 3436812 - RNA, 19 nt, Human
cccuucauugauuuccugu

SEQ ID NO: 3436813 - RNA, 11 nt, Human
cccuucauuug

SEQ ID NO: 3436814 - RNA, 20 nt, Human
cccuuccaaauaauaaaguc

SEQ ID NO: 3436815 - RNA, 19 nt, Human
cccuuccaccugcucugcu

SEQ ID NO: 3436816 - RNA, 13 nt, Human
cccuuccacugag

SEQ ID NO: 3436817 - RNA, 16 nt, Human
cccuuccacugagggc

SEQ ID NO: 3436818 - RNA, 14 nt, Human
cccuuccacugccu

SEQ ID NO: 3436819 - RNA, 16 nt, Human
cccuuccacugccucu

SEQ ID NO: 3436820 - RNA, 18 nt, Human
cccuuccacugccucugc

SEQ ID NO: 3436821 - RNA, 24 nt, Human
caggaucagauugcaugugacucu

SEQ ID NO: 3436822 - RNA, 14 nt, Human
caggaucagucuga

SEQ ID NO: 3436823 - RNA, 15 nt, Human
caggaucauggugua

SEQ ID NO: 3436824 - RNA, 16 nt, Human
caggaucaugguguaa

SEQ ID NO: 3436825 - RNA, 23 nt, Human
caggaucaugguguaauaagaca

SEQ ID NO: 3436826 - RNA, 15 nt, Human
caggauccagccuca

SEQ ID NO: 3436827 - RNA, 13 nt, Human
caggauccaggcc

SEQ ID NO: 3436828 - RNA, 22 nt, Human
caggauccccaaggcacuugag

SEQ ID NO: 3436829 - RNA, 23 nt, Human
caggaucgcaagagccauguaga

SEQ ID NO: 3436830 - RNA, 18 nt, Human
caggaucucuuagcauuu

SEQ ID NO: 3436831 - RNA, 18 nt, Human
caggaugaugacuaugga

SEQ ID NO: 3436832 - RNA, 19 nt, Human
caggaugcccacggcugga

SEQ ID NO: 3436833 - RNA, 19 nt, Human
caggaugcccagggccacu

SEQ ID NO: 3436834 - RNA, 13 nt, Human
caggaugcugggu

SEQ ID NO: 3436835 - RNA, 15 nt, Human
caggaugcugggugg

SEQ ID NO: 3436836 - RNA, 15 nt, Human
caggauggaggggug

SEQ ID NO: 3436837 - RNA, 22 nt, Human
caggauggaggggugguccuga

SEQ ID NO: 3436838 - RNA, 21 nt, Human
caggauggcaaccagaccauu

SEQ ID NO: 3436839 - RNA, 16 nt, Human
caggauggccuggcca

SEQ ID NO: 3436840 - RNA, 19 nt, Human
caggaugggggcuggccuc

SEQ ID NO: 3436841 - RNA, 15 nt, Human
caggaugguguuacu

SEQ ID NO: 3436842 - RNA, 21 nt, Human
caggaugguguuacugcaguu

SEQ ID NO: 3436843 - RNA, 22 nt, Human
caggaugguguuacugcaguug

SEQ ID NO: 3436844 - RNA, 21 nt, Human
caggaugguucccuugaugaa

SEQ ID NO: 3436845 - RNA, 19 nt, Human
caggauguacaaggacagc

SEQ ID NO: 3436846 - RNA, 18 nt, Human
caggauguguuugcuuuc

SEQ ID NO: 3436847 - RNA, 17 nt, Human
caggauucagccggagg

SEQ ID NO: 3436848 - RNA, 22 nt, Human
caggauuccucuuuucucugcc

SEQ ID NO: 3436849 - RNA, 18 nt, Human
caggauucuuccucccuc

SEQ ID NO: 3436850 - RNA, 15 nt, Human
caggauugaagagca

SEQ ID NO: 3436851 - RNA, 16 nt, Human
caggauugcgagagau

SEQ ID NO: 3436852 - RNA, 19 nt, Human
caggauugcgagagaugug

SEQ ID NO: 3436853 - RNA, 20 nt, Human
caggauuggggaagagagcc

SEQ ID NO: 3436854 - RNA, 24 nt, Human
caggauuggggaagagagccugca

SEQ ID NO: 3436855 - RNA, 19 nt, Human
caggauuuaaaaacuggaa

SEQ ID NO: 3436856 - RNA, 20 nt, Human
caggauuuaaaaacuggaac

SEQ ID NO: 3436857 - RNA, 21 nt, Human
caggauuucgugggucuguuu

SEQ ID NO: 3436858 - RNA, 12 nt, Human
caggauuucuaa

SEQ ID NO: 3436859 - RNA, 21 nt, Human
caggauuugaacucagaucug

SEQ ID NO: 3436860 - RNA, 14 nt, Human
caggauuugcacag

SEQ ID NO: 3436861 - RNA, 22 nt, Human
caggauuuuaacaaaagcaaga

SEQ ID NO: 3436862 - RNA, 23 nt, Human
caggcaaacauuuucucuuagaa

SEQ ID NO: 3436863 - RNA, 17 nt, Human
caggcaaagaaaaugaa

SEQ ID NO: 3436864 - RNA, 13 nt, Human
caggcaaaucagu

SEQ ID NO: 3436865 - RNA, 16 nt, Human
caggcaacugaggcag

SEQ ID NO: 3436866 - RNA, 17 nt, Human
caggcaacugaggcaga

SEQ ID NO: 3436867 - RNA, 19 nt, Human
caggcaacugaggcagaca

SEQ ID NO: 3436868 - RNA, 20 nt, Human
caggcaacuucaguccuggg

SEQ ID NO: 3436869 - RNA, 21 nt, Human
caggcaacuucaguccuggga

SEQ ID NO: 3436870 - RNA, 15 nt, Human
caggcaagcaccucc

SEQ ID NO: 3436871 - RNA, 21 nt, Human
caggcaaggggaaucuggagg

SEQ ID NO: 3436872 - RNA, 17 nt, Human
caggcaaggucuggccu

SEQ ID NO: 3436873 - RNA, 12 nt, Human
caggcaauuccg

SEQ ID NO: 3436874 - RNA, 24 nt, Human
caggcaauucuccugccuuugccu

SEQ ID NO: 3436875 - RNA, 19 nt, Human
caggcacacaaggggcccu

SEQ ID NO: 3436876 - RNA, 16 nt, Human
caggcacagcugaguu

SEQ ID NO: 3436877 - RNA, 12 nt, Human
caggcacaggau

SEQ ID NO: 3436878 - RNA, 13 nt, Human
caggcacaggcag

SEQ ID NO: 3436879 - RNA, 12 nt, Human
caggcacagguc

SEQ ID NO: 3436880 - RNA, 13 nt, Human
caggcacagguca

SEQ ID NO: 3436881 - RNA, 20 nt, Human
caggcaccaggacuagggcu

SEQ ID NO: 3436882 - RNA, 16 nt, Human
caggcaccagucccug

SEQ ID NO: 3436883 - RNA, 13 nt, Human
caggcaccgagaa

SEQ ID NO: 3436884 - RNA, 16 nt, Human
caggcaccucacagaa

SEQ ID NO: 3436885 - RNA, 20 nt, Human
caggcaccucacagaaauga

SEQ ID NO: 3436886 - RNA, 14 nt, Human
caggcaccucuucc

SEQ ID NO: 3436887 - RNA, 19 nt, Human
caggcaccuguagucccag

SEQ ID NO: 3436888 - RNA, 17 nt, Human
caggcacgggugguccc

SEQ ID NO: 3436889 - RNA, 22 nt, Human
caggcacuagccuuuggcucug

SEQ ID NO: 3436890 - RNA, 15 nt, Human
caggcacugcccugg

SEQ ID NO: 3436891 - RNA, 22 nt, Human
cccuucuugcugcccugcccca

SEQ ID NO: 3436892 - RNA, 21 nt, Human
cccuucuuggugcuuacacau

SEQ ID NO: 3436893 - RNA, 17 nt, Human
cccuucuuuccacagaa

SEQ ID NO: 3436894 - RNA, 14 nt, Human
cccuucuuuccucu

SEQ ID NO: 3436895 - RNA, 15 nt, Human
cccuucuuuuaugag

SEQ ID NO: 3436896 - RNA, 22 nt, Human
cccuucuuuuaugagcagaagg

SEQ ID NO: 3436897 - RNA, 17 nt, Human
cccuugacaacuggcag

SEQ ID NO: 3436898 - RNA, 18 nt, Human
cccuugacaacuggcagg

SEQ ID NO: 3436899 - RNA, 15 nt, Human
cccuugacaccgggg

SEQ ID NO: 3436900 - RNA, 12 nt, Human
cccuugaccugc

SEQ ID NO: 3436901 - RNA, 15 nt, Human
cccuugaccugcuga

SEQ ID NO: 3436902 - RNA, 17 nt, Human
cccuugacuuugcuccu

SEQ ID NO: 3436903 - RNA, 13 nt, Human
cccuugagaccuc

SEQ ID NO: 3436904 - RNA, 14 nt, Human
cccuugagaccuca

SEQ ID NO: 3436905 - RNA, 14 nt, Human
cccuugagcccucc

SEQ ID NO: 3436906 - RNA, 17 nt, Human
cccuugagcccucuaug

SEQ ID NO: 3436907 - RNA, 18 nt, Human
cccuugagcuccccaaaa

SEQ ID NO: 3436908 - RNA, 20 nt, Human
cccuugagcuccccaaaaac

SEQ ID NO: 3436909 - RNA, 22 nt, Human
cccuugaggaaacaacagcuuu

SEQ ID NO: 3436910 - RNA, 15 nt, Human
cccuugaggucucag

SEQ ID NO: 3436911 - RNA, 16 nt, Human
cccuugaugcacagag

SEQ ID NO: 3436912 - RNA, 19 nt, Human
cccuugaugcacagagaag

SEQ ID NO: 3436913 - RNA, 22 nt, Human
cccuugcacuaaaguauguaaa

SEQ ID NO: 3436914 - RNA, 21 nt, Human
cccuugcaguucagcaccacc

SEQ ID NO: 3436915 - RNA, 18 nt, Human
cccuugccagcugcugag

SEQ ID NO: 3436916 - RNA, 21 nt, Human
cccuugccagcugcugagccg

SEQ ID NO: 3436917 - RNA, 14 nt, Human
cccuugcccagggc

SEQ ID NO: 3436918 - RNA, 21 nt, Human
cccuugcccagggcucagccu

SEQ ID NO: 3436919 - RNA, 15 nt, Human
cccuugccccccugg

SEQ ID NO: 3436920 - RNA, 22 nt, Human
cccuugccccccuggccucccc

SEQ ID NO: 3436921 - RNA, 12 nt, Human
cccuugcccuga

SEQ ID NO: 3436922 - RNA, 21 nt, Human
cccuugcccugaccucccagc

SEQ ID NO: 3436923 - RNA, 17 nt, Human
cccuugcccuugcccug

SEQ ID NO: 3436924 - RNA, 21 nt, Human
cccuugcccuugcccugaccu

SEQ ID NO: 3436925 - RNA, 18 nt, Human
cccuugccgucuaccuga

SEQ ID NO: 3436926 - RNA, 23 nt, Human
cccuugccuccccauuucccauc

SEQ ID NO: 3436927 - RNA, 15 nt, Human
cccuugccugugcca

SEQ ID NO: 3436928 - RNA, 18 nt, Human
cccuugcucuccccugcc

SEQ ID NO: 3436929 - RNA, 13 nt, Human
cccuugcuggccc

SEQ ID NO: 3436930 - RNA, 16 nt, Human
cccuugcuggccccag

SEQ ID NO: 3436931 - RNA, 15 nt, Human
cccuugcugugaauu

SEQ ID NO: 3436932 - RNA, 22 nt, Human
cccuugcuugccugcagggcca

SEQ ID NO: 3436933 - RNA, 18 nt, Human
cccuugcuuuucccucuu

SEQ ID NO: 3436934 - RNA, 21 nt, Human
cccuugcuuuucccucuuuuc

SEQ ID NO: 3436935 - RNA, 13 nt, Human
cccuuggaaaccu

SEQ ID NO: 3436936 - RNA, 17 nt, Human
cccuuggaaaccugccc

SEQ ID NO: 3436937 - RNA, 18 nt, Human
cccuuggaaaccugcccu

SEQ ID NO: 3436938 - RNA, 12 nt, Human
cccuuggaagag

SEQ ID NO: 3436939 - RNA, 14 nt, Human
cccuuggacacgcu

SEQ ID NO: 3436940 - RNA, 16 nt, Human
cccuuggacacgcuca

SEQ ID NO: 3436941 - RNA, 14 nt, Human
cccuuggacauuuu

SEQ ID NO: 3436942 - RNA, 13 nt, Human
cccuuggaggcca

SEQ ID NO: 3436943 - RNA, 17 nt, Human
cccuuggaggcugucuu

SEQ ID NO: 3436944 - RNA, 11 nt, Human
cccuuggccag

SEQ ID NO: 3436945 - RNA, 16 nt, Human
cccuuggccugucuca

SEQ ID NO: 3436946 - RNA, 12 nt, Human
cccuuggcucuc

SEQ ID NO: 3436947 - RNA, 14 nt, Human
cccuuggcugggac

SEQ ID NO: 3436948 - RNA, 18 nt, Human
cccuugggcggcugagag

SEQ ID NO: 3436949 - RNA, 15 nt, Human
cccuugggcucugau

SEQ ID NO: 3436950 - RNA, 16 nt, Human
cccuuggugcccuccu

SEQ ID NO: 3436951 - RNA, 23 nt, Human
cccuugguuaggcauugugggaa

SEQ ID NO: 3436952 - RNA, 18 nt, Human
cccuuguauccccugcag

SEQ ID NO: 3436953 - RNA, 22 nt, Human
cccuugucggccccaccagugc

SEQ ID NO: 3436954 - RNA, 23 nt, Human
cccuugucugagaugcugguaau

SEQ ID NO: 3436955 - RNA, 17 nt, Human
cccuugugcguggguga

SEQ ID NO: 3436956 - RNA, 23 nt, Human
cccuugugcgugggugaagccgc

SEQ ID NO: 3436957 - RNA, 16 nt, Human
cccuuguggucccacc

SEQ ID NO: 3436958 - RNA, 18 nt, Human
cccuuguggucccacccc

SEQ ID NO: 3436959 - RNA, 12 nt, Human
cccuugugugug

SEQ ID NO: 3436960 - RNA, 13 nt, Human
cccuuguucucua

SEQ ID NO: 3436961 - RNA, 20 nt, Human
cccuuguuuggggcaggagu

SEQ ID NO: 3436962 - RNA, 20 nt, Human
cccuuucacaggcagccagu

SEQ ID NO: 3436963 - RNA, 12 nt, Human
cccuuucccacc

SEQ ID NO: 3436964 - RNA, 14 nt, Human
cccuuucccacccc

SEQ ID NO: 3436965 - RNA, 17 nt, Human
caggccaagaaacgucu

SEQ ID NO: 3436966 - RNA, 18 nt, Human
caggccaagagcagaggc

SEQ ID NO: 3436967 - RNA, 23 nt, Human
caggccaagagcagaggcagcga

SEQ ID NO: 3436968 - RNA, 20 nt, Human
caggccaaggucugagccac

SEQ ID NO: 3436969 - RNA, 17 nt, Human
caggccacaagacccuu

SEQ ID NO: 3436970 - RNA, 15 nt, Human
caggccaccaggaug

SEQ ID NO: 3436971 - RNA, 15 nt, Human
caggccacccugugc

SEQ ID NO: 3436972 - RNA, 17 nt, Human
caggccacccugugcag

SEQ ID NO: 3436973 - RNA, 16 nt, Human
caggccaccugccccc

SEQ ID NO: 3436974 - RNA, 19 nt, Human
caggccaccugcccccuuc

SEQ ID NO: 3436975 - RNA, 22 nt, Human
caggccaccugcccccuucucc

SEQ ID NO: 3436976 - RNA, 13 nt, Human
caggccagagcca

SEQ ID NO: 3436977 - RNA, 15 nt, Human
caggccagccuccga

SEQ ID NO: 3436978 - RNA, 16 nt, Human
caggccagccuccgag

SEQ ID NO: 3436979 - RNA, 12 nt, Human
caggccagcugu

SEQ ID NO: 3436980 - RNA, 20 nt, Human
caggccaggacucugcagcc

SEQ ID NO: 3436981 - RNA, 21 nt, Human
caggccaggacucugcagccu

SEQ ID NO: 3436982 - RNA, 23 nt, Human
caggccaggacucugcagccuca

SEQ ID NO: 3436983 - RNA, 12 nt, Human
caggccaggcau

SEQ ID NO: 3436984 - RNA, 11 nt, Human
caggccaggcc

SEQ ID NO: 3436985 - RNA, 16 nt, Human
caggccaggccaccag

SEQ ID NO: 3436986 - RNA, 17 nt, Human
caggccaggcccucugc

SEQ ID NO: 3436987 - RNA, 19 nt, Human
caggccaggcccucugccc

SEQ ID NO: 3436988 - RNA, 17 nt, Human
caggccagggggccagu

SEQ ID NO: 3436989 - RNA, 23 nt, Human
caggccaguaagggaaauagaaa

SEQ ID NO: 3436990 - RNA, 14 nt, Human
caggccaucuucca

SEQ ID NO: 3436991 - RNA, 19 nt, Human
caggccaucuuccaggugg

SEQ ID NO: 3436992 - RNA, 15 nt, Human
caggccauugugaac

SEQ ID NO: 3436993 - RNA, 23 nt, Human
caggcccaaauuaucaagcuaau

SEQ ID NO: 3436994 - RNA, 16 nt, Human
caggcccaaggcuccc

SEQ ID NO: 3436995 - RNA, 23 nt, Human
caggcccacccugcuuggcccag

SEQ ID NO: 3436996 - RNA, 23 nt, Human
caggcccaccuaccuucaaagcu

SEQ ID NO: 3436997 - RNA, 13 nt, Human
caggcccacucag

SEQ ID NO: 3436998 - RNA, 20 nt, Human
caggcccagcauugcugguu

SEQ ID NO: 3436999 - RNA, 22 nt, Human
caggcccagcauugcugguucu

SEQ ID NO: 3437000 - RNA, 19 nt, Human
caggcccagccgacccccu

SEQ ID NO: 3437001 - RNA, 21 nt, Human
caggcccagccgacccccucu

SEQ ID NO: 3437002 - RNA, 22 nt, Human
caggcccagccgacccccucuc

SEQ ID NO: 3437003 - RNA, 21 nt, Human
caggcccaugggaggcuggag

SEQ ID NO: 3437004 - RNA, 14 nt, Human
caggccccaggaag

SEQ ID NO: 3437005 - RNA, 15 nt, Human
caggccccaggaagc

SEQ ID NO: 3437006 - RNA, 17 nt, Human
caggccccaugaccucc

SEQ ID NO: 3437007 - RNA, 20 nt, Human
caggccccaugaccuccagc

SEQ ID NO: 3437008 - RNA, 19 nt, Human
caggcccccaagccugcag

SEQ ID NO: 3437009 - RNA, 17 nt, Human
caggcccccaccuggcu

SEQ ID NO: 3437010 - RNA, 21 nt, Human
caggcccccagaaccccuggc

SEQ ID NO: 3437011 - RNA, 20 nt, Human
caggcccccaggugccaguu

SEQ ID NO: 3437012 - RNA, 18 nt, Human
caggccccgaggacccag

SEQ ID NO: 3437013 - RNA, 20 nt, Human
caggccccgaggacccagac

SEQ ID NO: 3437014 - RNA, 22 nt, Human
caggccccgaggacccagaccc

SEQ ID NO: 3437015 - RNA, 17 nt, Human
caggccccgcuugucca

SEQ ID NO: 3437016 - RNA, 21 nt, Human
caggccccgugaggcaauggg

SEQ ID NO: 3437017 - RNA, 15 nt, Human
caggccccugccacc

SEQ ID NO: 3437018 - RNA, 17 nt, Human
caggccccugccacccu

SEQ ID NO: 3437019 - RNA, 13 nt, Human
caggccccuggag

SEQ ID NO: 3437020 - RNA, 14 nt, Human
caggccccuggagg

SEQ ID NO: 3437021 - RNA, 19 nt, Human
caggccccuggaggcugcc

SEQ ID NO: 3437022 - RNA, 22 nt, Human
caggccccuuuucacucccucc

SEQ ID NO: 3437023 - RNA, 19 nt, Human
caggcccggcuccaggcuc

SEQ ID NO: 3437024 - RNA, 16 nt, Human
caggcccggggcuggc

SEQ ID NO: 3437025 - RNA, 11 nt, Human
caggcccuccu

SEQ ID NO: 3437026 - RNA, 18 nt, Human
caggcccuccucccuccc

SEQ ID NO: 3437027 - RNA, 14 nt, Human
caggcccuccucuc

SEQ ID NO: 3437028 - RNA, 12 nt, Human
caggcccugcac

SEQ ID NO: 3437029 - RNA, 14 nt, Human
caggcccugcacug

SEQ ID NO: 3437030 - RNA, 16 nt, Human
caggcccugcacuguc

SEQ ID NO: 3437031 - RNA, 20 nt, Human
caggcccugcacuguccugc

SEQ ID NO: 3437032 - RNA, 22 nt, Human
caggcccugcacuguccugcuc

SEQ ID NO: 3437033 - RNA, 17 nt, Human
caggcccugcaguguuc

SEQ ID NO: 3437034 - RNA, 13 nt, Human
caggcccugcucc

SEQ ID NO: 3437035 - RNA, 14 nt, Human
caggcccugcuccu

SEQ ID NO: 3437036 - RNA, 10 nt, Human
caggcccugg

SEQ ID NO: 3437037 - RNA, 11 nt, Human
caggcccuggc

SEQ ID NO: 3437038 - RNA, 21 nt, Human
caggcccuuauuuucaagaaa

SEQ ID NO: 3437039 - RNA, 19 nt, Human
caggcccuuccucuccacu

SEQ ID NO: 3437040 - RNA, 23 nt, Human
caggcccuuccucuccacugccu

SEQ ID NO: 3437041 - RNA, 16 nt, Human
caggcccuuuccucag

SEQ ID NO: 3437042 - RNA, 19 nt, Human
caggcccuuugaagccuca

SEQ ID NO: 3437043 - RNA, 13 nt, Human
caggccgcagcuc

SEQ ID NO: 3437044 - RNA, 21 nt, Human
caggccggcagccccagccug

SEQ ID NO: 3437045 - RNA, 23 nt, Human
caggccggcagccccagccugcu

SEQ ID NO: 3437046 - RNA, 22 nt, Human
caggccggugugggcugugucg

SEQ ID NO: 3437047 - RNA, 15 nt, Human
caggccguggcugcc

SEQ ID NO: 3437048 - RNA, 17 nt, Human
caggccguggcugccca

SEQ ID NO: 3437049 - RNA, 15 nt, Human
caggccuacuccugu

SEQ ID NO: 3437050 - RNA, 16 nt, Human
caggccuacuccuguc

SEQ ID NO: 3437051 - RNA, 19 nt, Human
caggccuacuccugucuuc

SEQ ID NO: 3437052 - RNA, 19 nt, Human
caggccucaccucuaccca

SEQ ID NO: 3437053 - RNA, 21 nt, Human
caggccucaccucuacccaaa

SEQ ID NO: 3437054 - RNA, 14 nt, Human
caggccucagggcu

SEQ ID NO: 3437055 - RNA, 14 nt, Human
caggccuccagcuc

SEQ ID NO: 3437056 - RNA, 18 nt, Human
cccucugguuugccggug

SEQ ID NO: 3437057 - RNA, 17 nt, Human
cccucuguccaccagcc

SEQ ID NO: 3437058 - RNA, 20 nt, Human
cccucuguccaggcacugag

SEQ ID NO: 3437059 - RNA, 20 nt, Human
cccucuguguauuugcuuuu

SEQ ID NO: 3437060 - RNA, 17 nt, Human
cccucuguucaguaaca

SEQ ID NO: 3437061 - RNA, 22 nt, Human
cccucuucccugguaagaaaaa

SEQ ID NO: 3437062 - RNA, 14 nt, Human
cccucuuccuacug

SEQ ID NO: 3437063 - RNA, 23 nt, Human
cccucuuccucuugacccugcac

SEQ ID NO: 3437064 - RNA, 11 nt, Human
cccucuuccug

SEQ ID NO: 3437065 - RNA, 12 nt, Human
cccucuuccuga

SEQ ID NO: 3437066 - RNA, 13 nt, Human
cccucuuccuucc

SEQ ID NO: 3437067 - RNA, 20 nt, Human
cccucuucuuucagacuugc

SEQ ID NO: 3437068 - RNA, 24 nt, Human
cccucuucuuucagacuugccaug

SEQ ID NO: 3437069 - RNA, 16 nt, Human
cccucuugcccauccu

SEQ ID NO: 3437070 - RNA, 17 nt, Human
cccucuugcccauccug

SEQ ID NO: 3437071 - RNA, 13 nt, Human
cccucuugcccca

SEQ ID NO: 3437072 - RNA, 23 nt, Human
cccucuuggagaagucucagcua

SEQ ID NO: 3437073 - RNA, 17 nt, Human
cccucuugucuccccug

SEQ ID NO: 3437074 - RNA, 13 nt, Human
cccucuuucucuu

SEQ ID NO: 3437075 - RNA, 15 nt, Human
cccucuuucucuuuc

SEQ ID NO: 3437076 - RNA, 18 nt, Human
cccucuuucucuuucuuc

SEQ ID NO: 3437077 - RNA, 14 nt, Human
cccucuuugcugca

SEQ ID NO: 3437078 - RNA, 17 nt, Human
cccucuuuggcuccccu

SEQ ID NO: 3437079 - RNA, 21 nt, Human
cccucuuuucuuacuccuccu

SEQ ID NO: 3437080 - RNA, 22 nt, Human
cccucuuuucuuacuccuccuc

SEQ ID NO: 3437081 - RNA, 15 nt, Human
cccugaaagcccuga

SEQ ID NO: 3437082 - RNA, 18 nt, Human
cccugaaagcccugagcu

SEQ ID NO: 3437083 - RNA, 11 nt, Human
cccugaaaugu

SEQ ID NO: 3437084 - RNA, 14 nt, Human
cccugaacaagaau

SEQ ID NO: 3437085 - RNA, 17 nt, Human
cccugaagccagccuuc

SEQ ID NO: 3437086 - RNA, 19 nt, Human
cccugaagcugugcggagc

SEQ ID NO: 3437087 - RNA, 12 nt, Human
cccugaaggccc

SEQ ID NO: 3437088 - RNA, 14 nt, Human
cccugaaggccccg

SEQ ID NO: 3437089 - RNA, 16 nt, Human
cccugaaggccccgcc

SEQ ID NO: 3437090 - RNA, 15 nt, Human
cccugaaucccccuu

SEQ ID NO: 3437091 - RNA, 22 nt, Human
cccugacaacacucauugaccu

SEQ ID NO: 3437092 - RNA, 15 nt, Human
cccugacccugcaga

SEQ ID NO: 3437093 - RNA, 12 nt, Human
cccugacccugu

SEQ ID NO: 3437094 - RNA, 16 nt, Human
cccugacccuguauau

SEQ ID NO: 3437095 - RNA, 11 nt, Human
cccugaccucc

SEQ ID NO: 3437096 - RNA, 18 nt, Human
cccugaccucccagcccu

SEQ ID NO: 3437097 - RNA, 19 nt, Human
cccugaccucccagcccua

SEQ ID NO: 3437098 - RNA, 20 nt, Human
cccugaccucccagcccuau

SEQ ID NO: 3437099 - RNA, 17 nt, Human
cccugaccucccucuaa

SEQ ID NO: 3437100 - RNA, 13 nt, Human
cccugacucucug

SEQ ID NO: 3437101 - RNA, 17 nt, Human
cccugacucucugugac

SEQ ID NO: 3437102 - RNA, 18 nt, Human
cccugacucucugugacc

SEQ ID NO: 3437103 - RNA, 9 nt, Human
cccugacug

SEQ ID NO: 3437104 - RNA, 20 nt, Human
cccugacugggggcagacau

SEQ ID NO: 3437105 - RNA, 16 nt, Human
cccugagaagcugcuc

SEQ ID NO: 3437106 - RNA, 20 nt, Human
cccugagacaaauggaggcc

SEQ ID NO: 3437107 - RNA, 23 nt, Human
cccugagacaaauggaggccugu

SEQ ID NO: 3437108 - RNA, 18 nt, Human
cccugagaucagaguccu

SEQ ID NO: 3437109 - RNA, 16 nt, Human
cccugagauccccuga

SEQ ID NO: 3437110 - RNA, 22 nt, Human
cagggucccugguggcagcuca

SEQ ID NO: 3437111 - RNA, 23 nt, Human
ccuauaccccuuacuuagcaugc

SEQ ID NO: 3437112 - RNA, 22 nt, Human
ccuauacugcuuggagcugagc

SEQ ID NO: 3437113 - RNA, 19 nt, Human
ccuauacuguaguauucuu

SEQ ID NO: 3437114 - RNA, 15 nt, Human
ccuauauauuucuau

SEQ ID NO: 3437115 - RNA, 22 nt, Human
ccuauaugagaagaauagccua

SEQ ID NO: 3437116 - RNA, 13 nt, Human
ccuauauuuacag

SEQ ID NO: 3437117 - RNA, 16 nt, Human
ccuaucaccuauuucc

SEQ ID NO: 3437118 - RNA, 15 nt, Human
ccuaucaccuccccu

SEQ ID NO: 3437119 - RNA, 17 nt, Human
ccuaucaccuccccucc

SEQ ID NO: 3437120 - RNA, 17 nt, Human
ccuaucagaaguuucuc

SEQ ID NO: 3437121 - RNA, 20 nt, Human
ccuaucagugugccccccau

SEQ ID NO: 3437122 - RNA, 13 nt, Human
ccuaucauuuauu

SEQ ID NO: 3437123 - RNA, 15 nt, Human
ccuaucccucuccua

SEQ ID NO: 3437124 - RNA, 13 nt, Human
ccuauccuuggca

SEQ ID NO: 3437125 - RNA, 14 nt, Human
ccuauccuuggcac

SEQ ID NO: 3437126 - RNA, 13 nt, Human
ccuaucuccugac

SEQ ID NO: 3437127 - RNA, 18 nt, Human
ccuaucucgugggagagc

SEQ ID NO: 3437128 - RNA, 12 nt, Human
ccuaucugggcu

SEQ ID NO: 3437129 - RNA, 19 nt, Human
ccuaucugggcuuccugga

SEQ ID NO: 3437130 - RNA, 12 nt, Human
ccuaucuucaua

SEQ ID NO: 3437131 - RNA, 18 nt, Human
ccuaucuuuuaguuuuag

SEQ ID NO: 3437132 - RNA, 15 nt, Human
ccuaugaucccagca

SEQ ID NO: 3437133 - RNA, 14 nt, Human
ccuaugauguauac

SEQ ID NO: 3437134 - RNA, 14 nt, Human
ccuaugcaauaaaa

SEQ ID NO: 3437135 - RNA, 14 nt, Human
ccuaugcaauauau

SEQ ID NO: 3437136 - RNA, 22 nt, Human
ccuaugcaauauaucuaaauug

SEQ ID NO: 3437137 - RNA, 20 nt, Human
ccuaugcacauauggacucu

SEQ ID NO: 3437138 - RNA, 21 nt, Human
ccuaugcaugguguagaugcc

SEQ ID NO: 3437139 - RNA, 22 nt, Human
ccuaugcaugguuucagcacua

SEQ ID NO: 3437140 - RNA, 20 nt, Human
ccuaugcugccuaggcugac

SEQ ID NO: 3437141 - RNA, 12 nt, Human
ccuaugcuuuga

SEQ ID NO: 3437142 - RNA, 11 nt, Human
ccuauggaaac

SEQ ID NO: 3437143 - RNA, 14 nt, Human
ccuauggagagccc

SEQ ID NO: 3437144 - RNA, 15 nt, Human
ccuauggagagcccu

SEQ ID NO: 3437145 - RNA, 18 nt, Human
ccuauggcuggccacugc

SEQ ID NO: 3437146 - RNA, 21 nt, Human
ccuauggcuggccacugcaca

SEQ ID NO: 3437147 - RNA, 18 nt, Human
ccuaugggagucaagugu

SEQ ID NO: 3437148 - RNA, 22 nt, Human
ccuauguccuaaggacacacua

SEQ ID NO: 3437149 - RNA, 22 nt, Human
ccuaugugauuuuaacucuguc

SEQ ID NO: 3437150 - RNA, 22 nt, Human
ccuauguugauccauccagcuu

SEQ ID NO: 3437151 - RNA, 16 nt, Human
ccuauuaucccagcug

SEQ ID NO: 3437152 - RNA, 18 nt, Human
ccuauuaucccagcugcc

SEQ ID NO: 3437153 - RNA, 21 nt, Human
ccuauucaguucccagaauca

SEQ ID NO: 3437154 - RNA, 21 nt, Human
ccuauucccacaccuccacag

SEQ ID NO: 3437155 - RNA, 13 nt, Human
ccuauucucacca

SEQ ID NO: 3437156 - RNA, 22 nt, Human
ccuauugcuagagcuccucccu

SEQ ID NO: 3437157 - RNA, 15 nt, Human
ccuauugugauuuga

SEQ ID NO: 3437158 - RNA, 17 nt, Human
ccuauugugauuugacu

SEQ ID NO: 3437159 - RNA, 18 nt, Human
ccuauugugauuugacug

SEQ ID NO: 3437160 - RNA, 19 nt, Human
ccuauugugcaauguaaau

SEQ ID NO: 3437161 - RNA, 22 nt, Human
ccuauuucaaaaauuuggaauu

SEQ ID NO: 3437162 - RNA, 23 nt, Human
ccuauuucaguguuaccugugug

SEQ ID NO: 3437163 - RNA, 15 nt, Human
ccuauuuccccaccc

SEQ ID NO: 3437164 - RNA, 16 nt, Human
ccuauuucucuuucuu

SEQ ID NO: 3437165 - RNA, 12 nt, Human
ccuauuugugug

SEQ ID NO: 3437166 - RNA, 15 nt, Human
ccuauuuuaauaaac

SEQ ID NO: 3437167 - RNA, 23 nt, Human
ccucaaaauuuaacaguuaccug

SEQ ID NO: 3437168 - RNA, 15 nt, Human
ccucaaacacugcag

SEQ ID NO: 3437169 - RNA, 17 nt, Human
ccucaaacacugcaggc

SEQ ID NO: 3437170 - RNA, 22 nt, Human
ccucaaacaguagguuggcagu

SEQ ID NO: 3437171 - RNA, 14 nt, Human
ccucaaagaggcag

SEQ ID NO: 3437172 - RNA, 18 nt, Human
ccucaaagcuuccauucc

SEQ ID NO: 3437173 - RNA, 17 nt, Human
ccucaaauccaggaccc

SEQ ID NO: 3437174 - RNA, 23 nt, Human
ccucaaauccaggacccugccag

SEQ ID NO: 3437175 - RNA, 19 nt, Human
ccucaaaugaugugccugc

SEQ ID NO: 3437176 - RNA, 17 nt, Human
ccucaaauuacuuugug

SEQ ID NO: 3437177 - RNA, 16 nt, Human
ccucaaauuuuuugac

SEQ ID NO: 3437178 - RNA, 22 nt, Human
ccucaacaagggagagaccuca

SEQ ID NO: 3437179 - RNA, 23 nt, Human
ccucaaccccuccccuccauccc

SEQ ID NO: 3437180 - RNA, 16 nt, Human
ccucaacccucccuca

SEQ ID NO: 3437181 - RNA, 18 nt, Human
ccucaacccucccucagc

SEQ ID NO: 3437182 - RNA, 20 nt, Human
ccucaaccucuucuggcuca

SEQ ID NO: 3437183 - RNA, 20 nt, Human
ccucaaccuguaaauuauuu

SEQ ID NO: 3437184 - RNA, 23 nt, Human
ccucaaccuguaaauuauuuuaa

SEQ ID NO: 3437185 - RNA, 19 nt, Human
ccucaacguugcuccccau

SEQ ID NO: 3437186 - RNA, 16 nt, Human
ccucaacuccucccau

SEQ ID NO: 3437187 - RNA, 16 nt, Human
ccucaacucugcugag

SEQ ID NO: 3437188 - RNA, 18 nt, Human
ccucaacucugcugaggg

SEQ ID NO: 3437189 - RNA, 18 nt, Human
ccucaagccaauccccuc

SEQ ID NO: 3437190 - RNA, 22 nt, Human
ccucaaggacaaagucuccagc

SEQ ID NO: 3437191 - RNA, 12 nt, Human
ccucaaggacuu

SEQ ID NO: 3437192 - RNA, 19 nt, Human
ccucaaggacuugaaagca

SEQ ID NO: 3437193 - RNA, 15 nt, Human
ccucaaggccuccca

SEQ ID NO: 3437194 - RNA, 16 nt, Human
ccucaaggccucccac

SEQ ID NO: 3437195 - RNA, 19 nt, Human
ccucaaggccucccacagu

SEQ ID NO: 3437196 - RNA, 16 nt, Human
ccucaaguaaacuccc

SEQ ID NO: 3437197 - RNA, 20 nt, Human
ccucaagucacucccaagcc

SEQ ID NO: 3437198 - RNA, 18 nt, Human
ccucaagugauccuccca

SEQ ID NO: 3437199 - RNA, 19 nt, Human
ccucaagugauccucccac

SEQ ID NO: 3437200 - RNA, 18 nt, Human
ccucaauagaucuccagc

SEQ ID NO: 3437201 - RNA, 23 nt, Human
ccucaaugccaguaacgcgucuu

SEQ ID NO: 3437202 - RNA, 22 nt, Human
ccucaaugugaaucagacccua

SEQ ID NO: 3437203 - RNA, 22 nt, Human
ccucacaaguggguacccccag

SEQ ID NO: 3437204 - RNA, 12 nt, Human
ccucacacuggg

SEQ ID NO: 3437205 - RNA, 13 nt, Human
ccucacagccucu

SEQ ID NO: 3437206 - RNA, 18 nt, Human
ccucacagccucugaccc

SEQ ID NO: 3437207 - RNA, 21 nt, Human
ccucacagccucugaccccuc

SEQ ID NO: 3437208 - RNA, 15 nt, Human
ccucacaggccccag

SEQ ID NO: 3437209 - RNA, 19 nt, Human
ccucacagucccacugugc

SEQ ID NO: 3437210 - RNA, 20 nt, Human
ccucacaguccuuaccagca

SEQ ID NO: 3437211 - RNA, 23 nt, Human
ccucacaguccuuaccagcagag

SEQ ID NO: 3437212 - RNA, 15 nt, Human
ccucaccacccacuu

SEQ ID NO: 3437213 - RNA, 14 nt, Human
ccucaccaggggca

SEQ ID NO: 3437214 - RNA, 20 nt, Human
ccucaccaggggcaggcaca

SEQ ID NO: 3437215 - RNA, 19 nt, Human
ccucacccaccccugcaca

SEQ ID NO: 3437216 - RNA, 15 nt, Human
ccucaccccacugug

SEQ ID NO: 3437217 - RNA, 24 nt, Human
ccucaccccacuuaucccucucca

SEQ ID NO: 3437218 - RNA, 16 nt, Human
ccucacccccucccac

SEQ ID NO: 3437219 - RNA, 17 nt, Human
ccucacccccucccacc

SEQ ID NO: 3437220 - RNA, 20 nt, Human
ccucacccccucccaccccc

SEQ ID NO: 3437221 - RNA, 17 nt, Human
ccucacccccuccuuca

SEQ ID NO: 3437222 - RNA, 20 nt, Human
ccucaccccgaggcccugca

SEQ ID NO: 3437223 - RNA, 21 nt, Human
ccucaccccgaggcccugcau

SEQ ID NO: 3437224 - RNA, 22 nt, Human
ccucaccccgaggcccugcaug

SEQ ID NO: 3437225 - RNA, 17 nt, Human
ccucaccccgucugggg

SEQ ID NO: 3437226 - RNA, 19 nt, Human
ccucaccccguuacagcuc

SEQ ID NO: 3437227 - RNA, 16 nt, Human
ccucaccccugcccug

SEQ ID NO: 3437228 - RNA, 19 nt, Human
ccucaccccuguccucacu

SEQ ID NO: 3437229 - RNA, 22 nt, Human
ccucaccccuguccucacugcu

SEQ ID NO: 3437230 - RNA, 21 nt, Human
ccucacccgaggcugcccacu

SEQ ID NO: 3437231 - RNA, 23 nt, Human
ccucacccugagccccuuccuug

SEQ ID NO: 3437232 - RNA, 14 nt, Human
ccucacccuggggc

SEQ ID NO: 3437233 - RNA, 22 nt, Human
ccucaccuaauaggcugggaga

SEQ ID NO: 3437234 - RNA, 19 nt, Human
ccucaccucaugcccaccc

SEQ ID NO: 3437235 - RNA, 14 nt, Human
ccucaccucuaccc

SEQ ID NO: 3437236 - RNA, 18 nt, Human
ccucaccucuggacuggc

SEQ ID NO: 3437237 - RNA, 16 nt, Human
ccucaccugagagcca

SEQ ID NO: 3437238 - RNA, 18 nt, Human
ccucaccugggcaccugg

SEQ ID NO: 3437239 - RNA, 19 nt, Human
ccucaccuugcaacacaca

SEQ ID NO: 3437240 - RNA, 21 nt, Human
ccucaccuuggcaccagacac

SEQ ID NO: 3437241 - RNA, 17 nt, Human
ccucaccuuucccaucu

SEQ ID NO: 3437242 - RNA, 14 nt, Human
ccucacgcaccucc

SEQ ID NO: 3437243 - RNA, 17 nt, Human
ccucacucagcaccacu

SEQ ID NO: 3437244 - RNA, 18 nt, Human
ccucacucagcaccacuc

SEQ ID NO: 3437245 - RNA, 14 nt, Human
ccucacucccuucu

SEQ ID NO: 3437246 - RNA, 23 nt, Human
ccucacucggguuucucuguggc

SEQ ID NO: 3437247 - RNA, 13 nt, Human
ccucacucucagg

SEQ ID NO: 3437248 - RNA, 14 nt, Human
ccucacucucagga

SEQ ID NO: 3437249 - RNA, 19 nt, Human
ccucacucugccagggcag

SEQ ID NO: 3437250 - RNA, 19 nt, Human
ccucacugcucccugaagc

SEQ ID NO: 3437251 - RNA, 15 nt, Human
ccucacuggccaucc

SEQ ID NO: 3437252 - RNA, 22 nt, Human
ccucacuggccaucccucgugg

SEQ ID NO: 3437253 - RNA, 16 nt, Human
ccggcagggcgggcag

SEQ ID NO: 3437254 - RNA, 23 nt, Human
ccggcagggcgggcagagggcug

SEQ ID NO: 3437255 - RNA, 18 nt, Human
ccggcaggguccuagaaa

SEQ ID NO: 3437256 - RNA, 20 nt, Human
ccggcaugagacucagugca

SEQ ID NO: 3437257 - RNA, 21 nt, Human
ccggcaugagacucagugcag

SEQ ID NO: 3437258 - RNA, 22 nt, Human
ccggcaugagacucagugcaga

SEQ ID NO: 3437259 - RNA, 18 nt, Human
ccggcauggacaauggac

SEQ ID NO: 3437260 - RNA, 16 nt, Human
ccggccaauggaaacc

SEQ ID NO: 3437261 - RNA, 13 nt, Human
ccggccaccucug

SEQ ID NO: 3437262 - RNA, 14 nt, Human
ccggccaccucugc

SEQ ID NO: 3437263 - RNA, 17 nt, Human
ccggccaccugcggugc

SEQ ID NO: 3437264 - RNA, 18 nt, Human
ccggccaccugcggugcu

SEQ ID NO: 3437265 - RNA, 18 nt, Human
ccggccaggugccuccug

SEQ ID NO: 3437266 - RNA, 20 nt, Human
ccggccaguggcggaaguga

SEQ ID NO: 3437267 - RNA, 14 nt, Human
ccggcccaguuuug

SEQ ID NO: 3437268 - RNA, 13 nt, Human
ccggccccagcca

SEQ ID NO: 3437269 - RNA, 14 nt, Human
ccggccccagccag

SEQ ID NO: 3437270 - RNA, 16 nt, Human
ccggccccagccagag

SEQ ID NO: 3437271 - RNA, 18 nt, Human
ccggccccaguacacagg

SEQ ID NO: 3437272 - RNA, 19 nt, Human
ccggccccggccccagcca

SEQ ID NO: 3437273 - RNA, 18 nt, Human
ccggcccgcgccacagga

SEQ ID NO: 3437274 - RNA, 13 nt, Human
ccggccucuccag

SEQ ID NO: 3437275 - RNA, 23 nt, Human
cagggucccugguggcagcucac

SEQ ID NO: 3437276 - RNA, 14 nt, Human
caggguccugcuau

SEQ ID NO: 3437277 - RNA, 23 nt, Human
caggguccuuuugacacugcucu

SEQ ID NO: 3437278 - RNA, 17 nt, Human
cagggucucacucuguc

SEQ ID NO: 3437279 - RNA, 18 nt, Human
cagggucucacucugucg

SEQ ID NO: 3437280 - RNA, 19 nt, Human
cagggucuccagaaagccc

SEQ ID NO: 3437281 - RNA, 22 nt, Human
cagggucucuagugcugugaaa

SEQ ID NO: 3437282 - RNA, 18 nt, Human
cagggucucugcugccgc

SEQ ID NO: 3437283 - RNA, 17 nt, Human
cagggucugcucuuucu

SEQ ID NO: 3437284 - RNA, 23 nt, Human
cagggucugcucuuucucugcca

SEQ ID NO: 3437285 - RNA, 14 nt, Human
cagggucugggcag

SEQ ID NO: 3437286 - RNA, 15 nt, Human
cagggucugugugaa

SEQ ID NO: 3437287 - RNA, 23 nt, Human
cagggucugugugaaugugggca

SEQ ID NO: 3437288 - RNA, 21 nt, Human
cagggucuuuucaucugggaa

SEQ ID NO: 3437289 - RNA, 19 nt, Human
cagggugacggugacaaag

SEQ ID NO: 3437290 - RNA, 15 nt, Human
cagggugaugccagg

SEQ ID NO: 3437291 - RNA, 18 nt, Human
cagggugaugccagguuc

SEQ ID NO: 3437292 - RNA, 17 nt, Human
caggguggacuuagaaa

SEQ ID NO: 3437293 - RNA, 22 nt, Human
caggguggacuuagaaagcagg

SEQ ID NO: 3437294 - RNA, 20 nt, Human
cagggugggccucggccccu

SEQ ID NO: 3437295 - RNA, 16 nt, Human
cagggugggcuugugg

SEQ ID NO: 3437296 - RNA, 22 nt, Human
caggguggucucuucuuggggc

SEQ ID NO: 3437297 - RNA, 17 nt, Human
caggguggugcugggac

SEQ ID NO: 3437298 - RNA, 17 nt, Human
cagggugucuccugaag

SEQ ID NO: 3437299 - RNA, 19 nt, Human
caggguguggcccugccau

SEQ ID NO: 3437300 - RNA, 16 nt, Human
caggguguggggccau

SEQ ID NO: 3437301 - RNA, 17 nt, Human
caggguguggggccaug

SEQ ID NO: 3437302 - RNA, 22 nt, Human
caggguguggggccaugccucc

SEQ ID NO: 3437303 - RNA, 17 nt, Human
caggguucuccucuccc

SEQ ID NO: 3437304 - RNA, 21 nt, Human
caggguugaucacacucuggg

SEQ ID NO: 3437305 - RNA, 13 nt, Human
caggguuggcacc

SEQ ID NO: 3437306 - RNA, 20 nt, Human
caggguuggcaccuuccccc

SEQ ID NO: 3437307 - RNA, 14 nt, Human
caggguuggccccu

SEQ ID NO: 3437308 - RNA, 17 nt, Human
caggguuggccccugcc

SEQ ID NO: 3437309 - RNA, 15 nt, Human
caggguugggcccag

SEQ ID NO: 3437310 - RNA, 15 nt, Human
caggguuggugugcu

SEQ ID NO: 3437311 - RNA, 19 nt, Human
caggguuucaccauguugc

SEQ ID NO: 3437312 - RNA, 20 nt, Human
caggguuucaccauguuggc

SEQ ID NO: 3437313 - RNA, 19 nt, Human
caggguuucgagaagcugc

SEQ ID NO: 3437314 - RNA, 22 nt, Human
caggguuuggcugugucuaaac

SEQ ID NO: 3437315 - RNA, 15 nt, Human
caggguuuuaacuuu

SEQ ID NO: 3437316 - RNA, 14 nt, Human
cagguaaaacaggg

SEQ ID NO: 3437317 - RNA, 17 nt, Human
cagguaaauuaagacau

SEQ ID NO: 3437318 - RNA, 15 nt, Human
cagguaacaggcaga

SEQ ID NO: 3437319 - RNA, 17 nt, Human
cagguaacaggcagaua

SEQ ID NO: 3437320 - RNA, 18 nt, Human
cagguaaucgaccugccu

SEQ ID NO: 3437321 - RNA, 19 nt, Human
cagguaaucgaccugccuc

SEQ ID NO: 3437322 - RNA, 20 nt, Human
cagguaaucgaccugccucg

SEQ ID NO: 3437323 - RNA, 23 nt, Human
cagguaaugagggacuggaacca

SEQ ID NO: 3437324 - RNA, 13 nt, Human
cagguaaugugaa

SEQ ID NO: 3437325 - RNA, 15 nt, Human
cagguaccagcugcg

SEQ ID NO: 3437326 - RNA, 15 nt, Human
cagguaccaguucuu

SEQ ID NO: 3437327 - RNA, 15 nt, Human
cagguaccccagcuc

SEQ ID NO: 3437328 - RNA, 17 nt, Human
cagguacgcacagacag

SEQ ID NO: 3437329 - RNA, 18 nt, Human
cagguacgcacagacagg

SEQ ID NO: 3437330 - RNA, 21 nt, Human
cagguacuuguaaauuauuaa

SEQ ID NO: 3437331 - RNA, 23 nt, Human
cagguacuuugucuaagaaacau

SEQ ID NO: 3437332 - RNA, 22 nt, Human
cagguagaauuaucuaauuuau

SEQ ID NO: 3437333 - RNA, 18 nt, Human
cagguagaggugcaugcc

SEQ ID NO: 3437334 - RNA, 12 nt, Human
cagguagccagg

SEQ ID NO: 3437335 - RNA, 14 nt, Human
cagguagcugcccc

SEQ ID NO: 3437336 - RNA, 23 nt, Human
cagguagcugccccuggcucuga

SEQ ID NO: 3437337 - RNA, 13 nt, Human
cagguaggaauau

SEQ ID NO: 3437338 - RNA, 20 nt, Human
cagguaggaauauuauauuu

SEQ ID NO: 3437339 - RNA, 23 nt, Human
cagguaggaggcaaauaucuuga

SEQ ID NO: 3437340 - RNA, 22 nt, Human
cagguaggccaagguguccuac

SEQ ID NO: 3437341 - RNA, 22 nt, Human
cagguaguacuaagaguaugug

SEQ ID NO: 3437342 - RNA, 18 nt, Human
cagguaguugcaauugaa

SEQ ID NO: 3437343 - RNA, 15 nt, Human
cagguauccaaaaau

SEQ ID NO: 3437344 - RNA, 16 nt, Human
cagguaucuccaggau

SEQ ID NO: 3437345 - RNA, 16 nt, Human
cagguauggcucugca

SEQ ID NO: 3437346 - RNA, 17 nt, Human
cagguauuaaucuugga

SEQ ID NO: 3437347 - RNA, 18 nt, Human
cagguauuauuaucuuua

SEQ ID NO: 3437348 - RNA, 13 nt, Human
caggucaacagaa

SEQ ID NO: 3437349 - RNA, 15 nt, Human
caggucaacagaaug

SEQ ID NO: 3437350 - RNA, 19 nt, Human
caggucaacagaaugaaaa

SEQ ID NO: 3437351 - RNA, 23 nt, Human
caggucaauacaguacaggcagc

SEQ ID NO: 3437352 - RNA, 17 nt, Human
caggucacacgaggggc

SEQ ID NO: 3437353 - RNA, 15 nt, Human
caggucagccacugu

SEQ ID NO: 3437354 - RNA, 21 nt, Human
caggucaggggugacacagac

SEQ ID NO: 3437355 - RNA, 23 nt, Human
caggucaggggugacacagacuc

SEQ ID NO: 3437356 - RNA, 21 nt, Human
caggucauauuaauauauuuc

SEQ ID NO: 3437357 - RNA, 14 nt, Human
cagguccaaugagc

SEQ ID NO: 3437358 - RNA, 22 nt, Human
cagguccaaugagcuuucugaa

SEQ ID NO: 3437359 - RNA, 22 nt, Human
cagguccacggucuguucuuga

SEQ ID NO: 3437360 - RNA, 16 nt, Human
cagguccagagagacc

SEQ ID NO: 3437361 - RNA, 19 nt, Human
cagguccagcucuggaggg

SEQ ID NO: 3437362 - RNA, 12 nt, Human
cagguccccaga

SEQ ID NO: 3437363 - RNA, 13 nt, Human
caggucccuaaua

SEQ ID NO: 3437364 - RNA, 20 nt, Human
cagguccucaguguccucag

SEQ ID NO: 3437365 - RNA, 15 nt, Human
cagguccugcucagc

SEQ ID NO: 3437366 - RNA, 17 nt, Human
cagguccugcucagcag

SEQ ID NO: 3437367 - RNA, 13 nt, Human
cagguccuggugg

SEQ ID NO: 3437368 - RNA, 16 nt, Human
caggucgggcgcagga

SEQ ID NO: 3437369 - RNA, 22 nt, Human
caggucgggcucagcucuggcu

SEQ ID NO: 3437370 - RNA, 12 nt, Human
caggucuagacu

SEQ ID NO: 3437371 - RNA, 22 nt, Human
caggucucccacgugggagaca

SEQ ID NO: 3437372 - RNA, 14 nt, Human
caggucuccucuua

SEQ ID NO: 3437373 - RNA, 17 nt, Human
caggucuccucuuaaaa

SEQ ID NO: 3437374 - RNA, 22 nt, Human
caggucuccucuuaaaaaauaa

SEQ ID NO: 3437375 - RNA, 22 nt, Human
caggucuugaacuccuggccuc

SEQ ID NO: 3437376 - RNA, 19 nt, Human
caggucuuggagcugagcc

SEQ ID NO: 3437377 - RNA, 21 nt, Human
caggucuuggagcugagccuc

SEQ ID NO: 3437378 - RNA, 23 nt, Human
caggucuuggagcugagccucuc

SEQ ID NO: 3437379 - RNA, 21 nt, Human
caggucuuuccuaaggcugca

SEQ ID NO: 3437380 - RNA, 14 nt, Human
caggugaaggaggc

SEQ ID NO: 3437381 - RNA, 14 nt, Human
caggugacauguga

SEQ ID NO: 3437382 - RNA, 16 nt, Human
caggugacaugugaaa

SEQ ID NO: 3437383 - RNA, 23 nt, Human
caggugaccaaaauccccuucuc

SEQ ID NO: 3437384 - RNA, 18 nt, Human
caggugaccuucugggaa

SEQ ID NO: 3437385 - RNA, 21 nt, Human
caggugaggucuguuccuuuu

SEQ ID NO: 3437386 - RNA, 22 nt, Human
caggugaguccuagagcuacag

SEQ ID NO: 3437387 - RNA, 16 nt, Human
caggugauccacccac

SEQ ID NO: 3437388 - RNA, 17 nt, Human
caggugauccacccacc

SEQ ID NO: 3437389 - RNA, 22 nt, Human
caggugauccacccaccucagc

SEQ ID NO: 3437390 - RNA, 15 nt, Human
caggugcaaccaggg

SEQ ID NO: 3437391 - RNA, 15 nt, Human
caggugcacagacgu

SEQ ID NO: 3437392 - RNA, 23 nt, Human
caggugcacagacgucccuccac

SEQ ID NO: 3437393 - RNA, 15 nt, Human
caggugcagaggaag

SEQ ID NO: 3437394 - RNA, 23 nt, Human
caggugcagagguacccugggug

SEQ ID NO: 3437395 - RNA, 17 nt, Human
caggugcagccagaggc

SEQ ID NO: 3437396 - RNA, 17 nt, Human
cagugaaaaacuauuaa

SEQ ID NO: 3437397 - RNA, 16 nt, Human
cagugaaaacaagugc

SEQ ID NO: 3437398 - RNA, 15 nt, Human
cagugaaaauguaag

SEQ ID NO: 3437399 - RNA, 16 nt, Human
cagugaaagaaaauaa

SEQ ID NO: 3437400 - RNA, 13 nt, Human
cagugaagacaga

SEQ ID NO: 3437401 - RNA, 15 nt, Human
cagugaaguugcugc

SEQ ID NO: 3437402 - RNA, 16 nt, Human
cagugaaguugcugcu

SEQ ID NO: 3437403 - RNA, 19 nt, Human
cagugaaguugcugcuucu

SEQ ID NO: 3437404 - RNA, 17 nt, Human
cagugaaugauucagug

SEQ ID NO: 3437405 - RNA, 18 nt, Human
cagugaaugauucagugu

SEQ ID NO: 3437406 - RNA, 12 nt, Human
cagugaauucuu

SEQ ID NO: 3437407 - RNA, 16 nt, Human
cagugacagacaggcu

SEQ ID NO: 3437408 - RNA, 17 nt, Human
cagugacagacaggcuc

SEQ ID NO: 3437409 - RNA, 18 nt, Human
cagugacagaguucacua

SEQ ID NO: 3437410 - RNA, 20 nt, Human
cagugacagaguucacuaua

SEQ ID NO: 3437411 - RNA, 12 nt, Human
cagugacagcua

SEQ ID NO: 3437412 - RNA, 15 nt, Human
cagugacagcuagga

SEQ ID NO: 3437413 - RNA, 15 nt, Human
cagugacaugagacu

SEQ ID NO: 3437414 - RNA, 16 nt, Human
cagugacccuggcucc

SEQ ID NO: 3437415 - RNA, 17 nt, Human
cagugacccuggcuccu

SEQ ID NO: 3437416 - RNA, 24 nt, Human
cagugacccuucccaaucagcacu

SEQ ID NO: 3437417 - RNA, 18 nt, Human
cagugaccucucucucug

SEQ ID NO: 3437418 - RNA, 17 nt, Human
cagugaccugaggaagc

SEQ ID NO: 3437419 - RNA, 19 nt, Human
cagugaccugcuggguaaa

SEQ ID NO: 3437420 - RNA, 17 nt, Human
cagugacgugcaccugu

SEQ ID NO: 3437421 - RNA, 16 nt, Human
cagugacuccaggaga

SEQ ID NO: 3437422 - RNA, 16 nt, Human
cagugacucgggcucc

SEQ ID NO: 3437423 - RNA, 17 nt, Human
cagugacucgggcuccu

SEQ ID NO: 3437424 - RNA, 22 nt, Human
cagugacucgggcuccugugcc

SEQ ID NO: 3437425 - RNA, 19 nt, Human
cagugagaaaaagcuccug

SEQ ID NO: 3437426 - RNA, 21 nt, Human
cagugagaaaaagcuccuguc

SEQ ID NO: 3437427 - RNA, 22 nt, Human
cagugagagaguggcuggggca

SEQ ID NO: 3437428 - RNA, 14 nt, Human
cagugagaugaggg

SEQ ID NO: 3437429 - RNA, 18 nt, Human
cagugagauuacagagga

SEQ ID NO: 3437430 - RNA, 17 nt, Human
cagugagcagagaucac

SEQ ID NO: 3437431 - RNA, 17 nt, Human
cagugaggcccagggag

SEQ ID NO: 3437432 - RNA, 21 nt, Human
cagugaggcccagggagaggc

SEQ ID NO: 3437433 - RNA, 15 nt, Human
cagugaggcucugcc

SEQ ID NO: 3437434 - RNA, 16 nt, Human
cagugaggcugcaccc

SEQ ID NO: 3437435 - RNA, 23 nt, Human
cagugagggguauaucugggcug

SEQ ID NO: 3437436 - RNA, 23 nt, Human
cagugaggguaaguauuuuccug

SEQ ID NO: 3437437 - RNA, 17 nt, Human
cagugagucgaggacag

SEQ ID NO: 3437438 - RNA, 18 nt, Human
cagugagucgaggacagg

SEQ ID NO: 3437439 - RNA, 15 nt, Human
cagugagugagccug

SEQ ID NO: 3437440 - RNA, 16 nt, Human
cagugagugagccugg

SEQ ID NO: 3437441 - RNA, 21 nt, Human
cagugagugagccuggcucuu

SEQ ID NO: 3437442 - RNA, 22 nt, Human
cagugaguuacagcgagaggca

SEQ ID NO: 3437443 - RNA, 23 nt, Human
cagugaguuacagcgagaggcag

SEQ ID NO: 3437444 - RNA, 21 nt, Human
cagugauauggcagaagacac

SEQ ID NO: 3437445 - RNA, 22 nt, Human
cagugauauggcagaagacacc

SEQ ID NO: 3437446 - RNA, 14 nt, Human
cagugauauucuuu

SEQ ID NO: 3437447 - RNA, 16 nt, Human
cagugaucuccauaug

SEQ ID NO: 3437448 - RNA, 21 nt, Human
cagugaucuccauauguuaca

SEQ ID NO: 3437449 - RNA, 23 nt, Human
cagugauguaccaugaaacaaag

SEQ ID NO: 3437450 - RNA, 20 nt, Human
cagugauucgagcuauauuu

SEQ ID NO: 3437451 - RNA, 13 nt, Human
cagugauuuuuau

SEQ ID NO: 3437452 - RNA, 20 nt, Human
cagugcaaaugcaugcuucu

SEQ ID NO: 3437453 - RNA, 15 nt, Human
cagugcaacacuggu

SEQ ID NO: 3437454 - RNA, 11 nt, Human
cagugcaagag

SEQ ID NO: 3437455 - RNA, 23 nt, Human
cagugcaagagacucuggccucc

SEQ ID NO: 3437456 - RNA, 14 nt, Human
cagugcacaugaac

SEQ ID NO: 3437457 - RNA, 17 nt, Human
cagugcaccugucauau

SEQ ID NO: 3437458 - RNA, 15 nt, Human
cagugcagaauguaa

SEQ ID NO: 3437459 - RNA, 20 nt, Human
cagugcagagccuucucaga

SEQ ID NO: 3437460 - RNA, 12 nt, Human
cagugcaggcac

SEQ ID NO: 3437461 - RNA, 22 nt, Human
cagugcaggcuggccagccgcu

SEQ ID NO: 3437462 - RNA, 20 nt, Human
cagugcagggcaaaauauuc

SEQ ID NO: 3437463 - RNA, 23 nt, Human
cagugcauaguuguagacaaagu

SEQ ID NO: 3437464 - RNA, 17 nt, Human
cagugcaucucagccca

SEQ ID NO: 3437465 - RNA, 16 nt, Human
cagugcaugcuguccc

SEQ ID NO: 3437466 - RNA, 23 nt, Human
cagugcaugcugucccuuacgug

SEQ ID NO: 3437467 - RNA, 18 nt, Human
cagugcaugguggccaga

SEQ ID NO: 3437468 - RNA, 15 nt, Human
cagugccaaaaacaa

SEQ ID NO: 3437469 - RNA, 17 nt, Human
cagugccaacuguggcu

SEQ ID NO: 3437470 - RNA, 18 nt, Human
ccuagucucccucacagc

SEQ ID NO: 3437471 - RNA, 14 nt, Human
ccuagucucuauca

SEQ ID NO: 3437472 - RNA, 15 nt, Human
ccuagucucuaucau

SEQ ID NO: 3437473 - RNA, 21 nt, Human
ccuagucucuaucauuaaagu

SEQ ID NO: 3437474 - RNA, 12 nt, Human
ccuagugaaccu

SEQ ID NO: 3437475 - RNA, 18 nt, Human
ccuagugaaccucacccc

SEQ ID NO: 3437476 - RNA, 18 nt, Human
ccuaguggcuguccagug

SEQ ID NO: 3437477 - RNA, 13 nt, Human
ccuaguggcuugu

SEQ ID NO: 3437478 - RNA, 15 nt, Human
ccuaguggcuugucc

SEQ ID NO: 3437479 - RNA, 16 nt, Human
ccuaguggcuuguccu

SEQ ID NO: 3437480 - RNA, 19 nt, Human
ccuaguggggucucccucu

SEQ ID NO: 3437481 - RNA, 21 nt, Human
ccuaguggggucucccucucc

SEQ ID NO: 3437482 - RNA, 22 nt, Human
ccuaguucccucugcucagcca

SEQ ID NO: 3437483 - RNA, 17 nt, Human
ccuaguucuagaaaaac

SEQ ID NO: 3437484 - RNA, 22 nt, Human
ccuaguuggugagaaaccugua

SEQ ID NO: 3437485 - RNA, 15 nt, Human
ccuaguuuccucucc

SEQ ID NO: 3437486 - RNA, 17 nt, Human
ccuaguuuccucuccuu

SEQ ID NO: 3437487 - RNA, 15 nt, Human
ccuaguuugaccuca

SEQ ID NO: 3437488 - RNA, 16 nt, Human
ccuaguuugugagaaa

SEQ ID NO: 3437489 - RNA, 15 nt, Human
ccuaguuuuccuacu

SEQ ID NO: 3437490 - RNA, 19 nt, Human
ccuaguuuucuccucccag

SEQ ID NO: 3437491 - RNA, 20 nt, Human
ccuaguuuucuccucccagg

SEQ ID NO: 3437492 - RNA, 20 nt, Human
ccuaguuuucuuuccuccuu

SEQ ID NO: 3437493 - RNA, 23 nt, Human
ccuauaaaacaggucaauacagu

SEQ ID NO: 3437494 - RNA, 19 nt, Human
ccuauaacuugaugcaugu

SEQ ID NO: 3437495 - RNA, 15 nt, Human
ccuauaaucugucaa

SEQ ID NO: 3437496 - RNA, 13 nt, Human
ccuauaaugcugg

SEQ ID NO: 3437497 - RNA, 18 nt, Human
ccuauaccuguguuucuu

SEQ ID NO: 3437498 - RNA, 23 nt, Human
ccuauacugcuuggagcugagca

SEQ ID NO: 3437499 - RNA, 14 nt, Human
ccuauagucccagc

SEQ ID NO: 3437500 - RNA, 15 nt, Human
ccuauagucccagcu

SEQ ID NO: 3437501 - RNA, 18 nt, Human
ccuauagucccagcuacu

SEQ ID NO: 3437502 - RNA, 16 nt, Human
ccuauauaguuuauug

SEQ ID NO: 3437503 - RNA, 16 nt, Human
ccuauauccugugacu

SEQ ID NO: 3437504 - RNA, 18 nt, Human
ccuauaugauuuauaguu

SEQ ID NO: 3437505 - RNA, 24 nt, Human
ccuauauuuacagugaaaauguaa

SEQ ID NO: 3437506 - RNA, 20 nt, Human
ccuaucacccaacgcuccaa

SEQ ID NO: 3437507 - RNA, 17 nt, Human
ccuaucaccuauuucca

SEQ ID NO: 3437508 - RNA, 20 nt, Human
ccuaucagaguugcugcaaa

SEQ ID NO: 3437509 - RNA, 18 nt, Human
ccuaucagugugcccccc

SEQ ID NO: 3437510 - RNA, 14 nt, Human
ccuaucauguuaac

SEQ ID NO: 3437511 - RNA, 12 nt, Human
ccuauccaccca

SEQ ID NO: 3437512 - RNA, 16 nt, Human
ccuauccacccagccc

SEQ ID NO: 3437513 - RNA, 18 nt, Human
ccuauccacccagcccau

SEQ ID NO: 3437514 - RNA, 21 nt, Human
ccuauccacccagcccauucu

SEQ ID NO: 3437515 - RNA, 14 nt, Human
ccuaucccauccca

SEQ ID NO: 3437516 - RNA, 14 nt, Human
ccuaucccucuccu

SEQ ID NO: 3437517 - RNA, 15 nt, Human
ccuauccgcugccag

SEQ ID NO: 3437518 - RNA, 13 nt, Human
ccuauccugcugu

SEQ ID NO: 3437519 - RNA, 19 nt, Human
ccuauccuuggcaccaaag

SEQ ID NO: 3437520 - RNA, 22 nt, Human
ccuaucgcccccuacgcgccuu

SEQ ID NO: 3437521 - RNA, 18 nt, Human
ccuaucuaacccucccau

SEQ ID NO: 3437522 - RNA, 20 nt, Human
ccuaucuccagcggcccugu

SEQ ID NO: 3437523 - RNA, 15 nt, Human
ccuaucuccugacag

SEQ ID NO: 3437524 - RNA, 16 nt, Human
ccuaucucgugggaga

SEQ ID NO: 3437525 - RNA, 20 nt, Human
ccuaucucgugggagagcca

SEQ ID NO: 3437526 - RNA, 22 nt, Human
ccuaucuguuuacaguguuccg

SEQ ID NO: 3437527 - RNA, 12 nt, Human
ccuaucuuugcc

SEQ ID NO: 3437528 - RNA, 15 nt, Human
ccuaucuuugccacc

SEQ ID NO: 3437529 - RNA, 17 nt, Human
ccuaugacuugggcacc

SEQ ID NO: 3437530 - RNA, 22 nt, Human
ccuaugacuugggcacccccag

SEQ ID NO: 3437531 - RNA, 21 nt, Human
ccuaugagcauccugagcccc

SEQ ID NO: 3437532 - RNA, 17 nt, Human
ccuaugauauuuucugu

SEQ ID NO: 3437533 - RNA, 13 nt, Human
ccuaugaucccag

SEQ ID NO: 3437534 - RNA, 22 nt, Human
ccuaugauguauacugccacua

SEQ ID NO: 3437535 - RNA, 21 nt, Human
ccuaugcacauauggacucug

SEQ ID NO: 3437536 - RNA, 18 nt, Human
ccuaugcaugguuucagc

SEQ ID NO: 3437537 - RNA, 23 nt, Human
ccuaugcaugguuucagcacuag

SEQ ID NO: 3437538 - RNA, 12 nt, Human
ccuauggaaacc

SEQ ID NO: 3437539 - RNA, 14 nt, Human
ccuauggaauuuau

SEQ ID NO: 3437540 - RNA, 17 nt, Human
ccucacuauucaaguau

SEQ ID NO: 3437541 - RNA, 19 nt, Human
ccucacucccuucuaccug

SEQ ID NO: 3437542 - RNA, 12 nt, Human
ccucacuccugu

SEQ ID NO: 3437543 - RNA, 22 nt, Human
ccucacucggguuucucugugg

SEQ ID NO: 3437544 - RNA, 19 nt, Human
ccucacucgucucccccaa

SEQ ID NO: 3437545 - RNA, 12 nt, Human
ccucacucugcc

SEQ ID NO: 3437546 - RNA, 23 nt, Human
ccucacucugcuaccuugcccca

SEQ ID NO: 3437547 - RNA, 17 nt, Human
ccucacucuggccucag

SEQ ID NO: 3437548 - RNA, 15 nt, Human
ccucacucuugccaa

SEQ ID NO: 3437549 - RNA, 16 nt, Human
ccucacucuugccaac

SEQ ID NO: 3437550 - RNA, 17 nt, Human
ccucacugaaugccuca

SEQ ID NO: 3437551 - RNA, 18 nt, Human
ccucacugcccgcacacc

SEQ ID NO: 3437552 - RNA, 22 nt, Human
ccucacugcccgcacacccuca

SEQ ID NO: 3437553 - RNA, 21 nt, Human
ccucacugcucccugaagcca

SEQ ID NO: 3437554 - RNA, 17 nt, Human
ccucacuggccaucccu

SEQ ID NO: 3437555 - RNA, 13 nt, Human
ccucacuggcucu

SEQ ID NO: 3437556 - RNA, 18 nt, Human
ccucacuggcucuccugg

SEQ ID NO: 3437557 - RNA, 20 nt, Human
ccucacugggguccuggggc

SEQ ID NO: 3437558 - RNA, 14 nt, Human
ccucacuggguggg

SEQ ID NO: 3437559 - RNA, 21 nt, Human
ccucacuggguggggugagga

SEQ ID NO: 3437560 - RNA, 20 nt, Human
ccucacuguauccagguucc

SEQ ID NO: 3437561 - RNA, 16 nt, Human
ccucacuguugaauuu

SEQ ID NO: 3437562 - RNA, 19 nt, Human
ccucacuuccauacagcuc

SEQ ID NO: 3437563 - RNA, 22 nt, Human
ccucacuuggucugccaggccc

SEQ ID NO: 3437564 - RNA, 19 nt, Human
ccucagaaacacuggggcu

SEQ ID NO: 3437565 - RNA, 22 nt, Human
ccucagaacccuuggcuugccc

SEQ ID NO: 3437566 - RNA, 15 nt, Human
ccucagacucuaaga

SEQ ID NO: 3437567 - RNA, 19 nt, Human
ccucagacucuaagaaaga

SEQ ID NO: 3437568 - RNA, 21 nt, Human
ccucagacucuaagaaagaac

SEQ ID NO: 3437569 - RNA, 12 nt, Human
ccucagacugca

SEQ ID NO: 3437570 - RNA, 20 nt, Human
ccucagacugcacccaggag

SEQ ID NO: 3437571 - RNA, 17 nt, Human
ccucagacuuaccagga

SEQ ID NO: 3437572 - RNA, 19 nt, Human
ccucagagaccagggcucc

SEQ ID NO: 3437573 - RNA, 17 nt, Human
ccucagaguccaggccc

SEQ ID NO: 3437574 - RNA, 14 nt, Human
ccucagagugcaag

SEQ ID NO: 3437575 - RNA, 21 nt, Human
ccucagauggcagcuuuuaaa

SEQ ID NO: 3437576 - RNA, 16 nt, Human
ccucagaugucccuug

SEQ ID NO: 3437577 - RNA, 16 nt, Human
ccucagauuccuuccc

SEQ ID NO: 3437578 - RNA, 17 nt, Human
ccucagauuccuuccca

SEQ ID NO: 3437579 - RNA, 22 nt, Human
ccucagauuccuucccauggag

SEQ ID NO: 3437580 - RNA, 13 nt, Human
ccucagcaccccu

SEQ ID NO: 3437581 - RNA, 18 nt, Human
ccucagcaccccuuccau

SEQ ID NO: 3437582 - RNA, 22 nt, Human
ccucagcaccccuuccaugugg

SEQ ID NO: 3437583 - RNA, 14 nt, Human
ccucagcauccugg

SEQ ID NO: 3437584 - RNA, 16 nt, Human
ccucagccacacccag

SEQ ID NO: 3437585 - RNA, 19 nt, Human
ccucagccacacccaggca

SEQ ID NO: 3437586 - RNA, 15 nt, Human
ccucagccagagaag

SEQ ID NO: 3437587 - RNA, 17 nt, Human
ccucagccagagaagcu

SEQ ID NO: 3437588 - RNA, 23 nt, Human
ccucagccauucacugcccccag

SEQ ID NO: 3437589 - RNA, 18 nt, Human
ccucagccccgcguggaa

SEQ ID NO: 3437590 - RNA, 16 nt, Human
ccucagccccucuugc

SEQ ID NO: 3437591 - RNA, 13 nt, Human
ccucagcccugac

SEQ ID NO: 3437592 - RNA, 23 nt, Human
ccucagccgacugcacagcggcc

SEQ ID NO: 3437593 - RNA, 19 nt, Human
ccucagccucccaaagugc

SEQ ID NO: 3437594 - RNA, 14 nt, Human
ccucagccuccuga

SEQ ID NO: 3437595 - RNA, 18 nt, Human
ccucagccuccugaguag

SEQ ID NO: 3437596 - RNA, 19 nt, Human
ccucagccugaaccccagg

SEQ ID NO: 3437597 - RNA, 12 nt, Human
ccucagccuggc

SEQ ID NO: 3437598 - RNA, 16 nt, Human
ccucagccuggccaga

SEQ ID NO: 3437599 - RNA, 17 nt, Human
ccucagccuggccagac

SEQ ID NO: 3437600 - RNA, 16 nt, Human
ccucagccugugcugc

SEQ ID NO: 3437601 - RNA, 12 nt, Human
ccucagccuuaa

SEQ ID NO: 3437602 - RNA, 19 nt, Human
ccucagccuugccagagau

SEQ ID NO: 3437603 - RNA, 21 nt, Human
ccucagccuugccagagaucc

SEQ ID NO: 3437604 - RNA, 20 nt, Human
ccucagcucccacaagccuc

SEQ ID NO: 3437605 - RNA, 19 nt, Human
ccucagcucggcucagcuc

SEQ ID NO: 3437606 - RNA, 14 nt, Human
ccucagcucuggga

SEQ ID NO: 3437607 - RNA, 14 nt, Human
ccucagcugaaugc

SEQ ID NO: 3437608 - RNA, 16 nt, Human
ccucagcugccucacu

SEQ ID NO: 3437609 - RNA, 16 nt, Human
ccucaggaaagaauag

SEQ ID NO: 3437610 - RNA, 18 nt, Human
ccucaggaaagaauagaa

SEQ ID NO: 3437611 - RNA, 16 nt, Human
ccucaggaaugggcug

SEQ ID NO: 3437612 - RNA, 13 nt, Human
ccucaggaccagg

SEQ ID NO: 3437613 - RNA, 17 nt, Human
ccucaggacccucgcug

SEQ ID NO: 3437614 - RNA, 18 nt, Human
ccucaggacccucgcugg

SEQ ID NO: 3437615 - RNA, 21 nt, Human
ccucaggacccucgcuggccc

SEQ ID NO: 3437616 - RNA, 22 nt, Human
ccucaggacccucgcuggcccc

SEQ ID NO: 3437617 - RNA, 22 nt, Human
ccucaggcaaucugcccgccug

SEQ ID NO: 3437618 - RNA, 15 nt, Human
ccucaggcacacagc

SEQ ID NO: 3437619 - RNA, 16 nt, Human
ccucaggcacacagcu

SEQ ID NO: 3437620 - RNA, 17 nt, Human
ccucaggcacacagcua

SEQ ID NO: 3437621 - RNA, 20 nt, Human
ccucaggcacacagcuacuc

SEQ ID NO: 3437622 - RNA, 18 nt, Human
ccucaggcacuagccuuu

SEQ ID NO: 3437623 - RNA, 22 nt, Human
ccucaggcacuagccuuuggcu

SEQ ID NO: 3437624 - RNA, 13 nt, Human
ccucaggcagcuc

SEQ ID NO: 3437625 - RNA, 15 nt, Human
ccucaggcagcucaa

SEQ ID NO: 3437626 - RNA, 15 nt, Human
ccucaggcaggaagg

SEQ ID NO: 3437627 - RNA, 18 nt, Human
ccucaggcauaggccugg

SEQ ID NO: 3437628 - RNA, 12 nt, Human
ccucaggcugcu

SEQ ID NO: 3437629 - RNA, 17 nt, Human
ccucaggcuuccuuggc

SEQ ID NO: 3437630 - RNA, 22 nt, Human
ccucagggacagagacaccugc

SEQ ID NO: 3437631 - RNA, 16 nt, Human
ccucagggacucaggu

SEQ ID NO: 3437632 - RNA, 23 nt, Human
ccucagggagcagggaaggccug

SEQ ID NO: 3437633 - RNA, 14 nt, Human
ccucagggcaaagc

SEQ ID NO: 3437634 - RNA, 22 nt, Human
ccucagggcaaagccagguccc

SEQ ID NO: 3437635 - RNA, 19 nt, Human
ccucagggcagccugccug

SEQ ID NO: 3437636 - RNA, 14 nt, Human
ccucugcuaaauug

SEQ ID NO: 3437637 - RNA, 22 nt, Human
ccucugcuaaauugauguugau

SEQ ID NO: 3437638 - RNA, 21 nt, Human
ccucugcuacguuccuauugu

SEQ ID NO: 3437639 - RNA, 23 nt, Human
ccucugcucaccgcccaucaggg

SEQ ID NO: 3437640 - RNA, 13 nt, Human
ccucugcucccca

SEQ ID NO: 3437641 - RNA, 13 nt, Human
ccucugcuccugg

SEQ ID NO: 3437642 - RNA, 22 nt, Human
ccucugcuccuggagccuuuga

SEQ ID NO: 3437643 - RNA, 21 nt, Human
ccucugcucugaggcuuccag

SEQ ID NO: 3437644 - RNA, 17 nt, Human
ccucugcugaccugcug

SEQ ID NO: 3437645 - RNA, 18 nt, Human
ccucugcugauccuccca

SEQ ID NO: 3437646 - RNA, 14 nt, Human
ccucugcugccaug

SEQ ID NO: 3437647 - RNA, 15 nt, Human
ccucugcugccaugg

SEQ ID NO: 3437648 - RNA, 15 nt, Human
ccucugcugcuggcu

SEQ ID NO: 3437649 - RNA, 16 nt, Human
ccucuggaaagcaaag

SEQ ID NO: 3437650 - RNA, 16 nt, Human
ccucuggaauugcuca

SEQ ID NO: 3437651 - RNA, 23 nt, Human
ccucuggacggcaggcucacugc

SEQ ID NO: 3437652 - RNA, 17 nt, Human
ccucuggacuggcuaga

SEQ ID NO: 3437653 - RNA, 19 nt, Human
ccucuggaggccucugggc

SEQ ID NO: 3437654 - RNA, 20 nt, Human
ccucuggaggccucugggcc

SEQ ID NO: 3437655 - RNA, 21 nt, Human
ccucuggauuaggucucuguu

SEQ ID NO: 3437656 - RNA, 12 nt, Human
ccucuggccagg

SEQ ID NO: 3437657 - RNA, 15 nt, Human
ccucuggccaggaug

SEQ ID NO: 3437658 - RNA, 15 nt, Human
ccucuggcccugccu

SEQ ID NO: 3437659 - RNA, 16 nt, Human
ccucuggcucuacaca

SEQ ID NO: 3437660 - RNA, 23 nt, Human
ccucugggaaaugagaaggcagc

SEQ ID NO: 3437661 - RNA, 13 nt, Human
ccucugggaaccu

SEQ ID NO: 3437662 - RNA, 15 nt, Human
ccucugggaaccucc

SEQ ID NO: 3437663 - RNA, 21 nt, Human
ccucugggaaccucccagagg

SEQ ID NO: 3437664 - RNA, 14 nt, Human
ccucugggcacugg

SEQ ID NO: 3437665 - RNA, 17 nt, Human
ccucuggggcucuaggg

SEQ ID NO: 3437666 - RNA, 20 nt, Human
ccucugggggguggccaggc

SEQ ID NO: 3437667 - RNA, 20 nt, Human
ccucugggucagugguccac

SEQ ID NO: 3437668 - RNA, 18 nt, Human
ccucuguacagagcccac

SEQ ID NO: 3437669 - RNA, 14 nt, Human
ccucugucaggccu

SEQ ID NO: 3437670 - RNA, 15 nt, Human
ccucugucagucaca

SEQ ID NO: 3437671 - RNA, 19 nt, Human
ccucugucagucacagcca

SEQ ID NO: 3437672 - RNA, 16 nt, Human
ccucugucauaucuuc

SEQ ID NO: 3437673 - RNA, 19 nt, Human
ccucugucauaucuucaca

SEQ ID NO: 3437674 - RNA, 14 nt, Human
ccucuguccagggc

SEQ ID NO: 3437675 - RNA, 23 nt, Human
ccucuguccagggcccugagcuc

SEQ ID NO: 3437676 - RNA, 15 nt, Human
ccucugucuagcaug

SEQ ID NO: 3437677 - RNA, 20 nt, Human
ccucugucuagcaugccaac

SEQ ID NO: 3437678 - RNA, 21 nt, Human
ccucugucuagcaugccaaca

SEQ ID NO: 3437679 - RNA, 11 nt, Human
ccucugucuca

SEQ ID NO: 3437680 - RNA, 20 nt, Human
ccucugucucauccuccugg

SEQ ID NO: 3437681 - RNA, 18 nt, Human
ccucugucucgagcgccc

SEQ ID NO: 3437682 - RNA, 21 nt, Human
ccucugucucgagcgcccugc

SEQ ID NO: 3437683 - RNA, 22 nt, Human
ccucugucucgagcgcccugca

SEQ ID NO: 3437684 - RNA, 17 nt, Human
ccucucuaaccuccuuu

SEQ ID NO: 3437685 - RNA, 20 nt, Human
ccucucuaaccuccuuuacc

SEQ ID NO: 3437686 - RNA, 15 nt, Human
ccucucuacagucuc

SEQ ID NO: 3437687 - RNA, 12 nt, Human
ccucucucacuc

SEQ ID NO: 3437688 - RNA, 14 nt, Human
ccucucucccaguc

SEQ ID NO: 3437689 - RNA, 12 nt, Human
ccucucucccuc

SEQ ID NO: 3437690 - RNA, 16 nt, Human
ccucucucccucuccc

SEQ ID NO: 3437691 - RNA, 18 nt, Human
cauagauaaaacaucuuu

SEQ ID NO: 3437692 - RNA, 23 nt, Human
cauagaucagcaaaccggggccu

SEQ ID NO: 3437693 - RNA, 18 nt, Human
cauagauguuuugguaga

SEQ ID NO: 3437694 - RNA, 17 nt, Human
cauagauuaauggcacu

SEQ ID NO: 3437695 - RNA, 15 nt, Human
cauagauucaccugu

SEQ ID NO: 3437696 - RNA, 16 nt, Human
cauagauucaccugua

SEQ ID NO: 3437697 - RNA, 22 nt, Human
cauagauucaccuguaaaacuu

SEQ ID NO: 3437698 - RNA, 22 nt, Human
cauagauuuauuuuucaguucc

SEQ ID NO: 3437699 - RNA, 15 nt, Human
cauagauuucugauu

SEQ ID NO: 3437700 - RNA, 14 nt, Human
cauagcacuucccc

SEQ ID NO: 3437701 - RNA, 19 nt, Human
cauagcagagaaugaaagg

SEQ ID NO: 3437702 - RNA, 14 nt, Human
cauagcauaggaca

SEQ ID NO: 3437703 - RNA, 15 nt, Human
cauagcauuaacuaa

SEQ ID NO: 3437704 - RNA, 23 nt, Human
cauagcauuaacuaaucuauugg

SEQ ID NO: 3437705 - RNA, 17 nt, Human
cauagccauaaaugaug

SEQ ID NO: 3437706 - RNA, 16 nt, Human
cauagcccagacacag

SEQ ID NO: 3437707 - RNA, 18 nt, Human
cauagcccagacacagaa

SEQ ID NO: 3437708 - RNA, 19 nt, Human
cauagcccauguuaagucc

SEQ ID NO: 3437709 - RNA, 15 nt, Human
cauagcccucacccu

SEQ ID NO: 3437710 - RNA, 19 nt, Human
cauagccuaaucccugggc

SEQ ID NO: 3437711 - RNA, 12 nt, Human
cauagccuauau

SEQ ID NO: 3437712 - RNA, 13 nt, Human
cauagccuauauu

SEQ ID NO: 3437713 - RNA, 23 nt, Human
cauagcggacuccuccuuucucc

SEQ ID NO: 3437714 - RNA, 22 nt, Human
cauagcuaagaaauaaaacugu

SEQ ID NO: 3437715 - RNA, 20 nt, Human
cauagcuccugcuccacagc

SEQ ID NO: 3437716 - RNA, 12 nt, Human
cauagcucuggg

SEQ ID NO: 3437717 - RNA, 18 nt, Human
cauagcuuauuauugaag

SEQ ID NO: 3437718 - RNA, 13 nt, Human
cauagcuuccaug

SEQ ID NO: 3437719 - RNA, 23 nt, Human
cauaggacucaaaguuucagaga

SEQ ID NO: 3437720 - RNA, 19 nt, Human
cauaggaguuuggaggaag

SEQ ID NO: 3437721 - RNA, 14 nt, Human
cauaggcccacaca

SEQ ID NO: 3437722 - RNA, 17 nt, Human
cauaggcccacacacag

SEQ ID NO: 3437723 - RNA, 15 nt, Human
cauaggccugggugc

SEQ ID NO: 3437724 - RNA, 17 nt, Human
cauaggccugggugcug

SEQ ID NO: 3437725 - RNA, 18 nt, Human
cauaggccugggugcugg

SEQ ID NO: 3437726 - RNA, 19 nt, Human
cauaggucacuggcucucc

SEQ ID NO: 3437727 - RNA, 21 nt, Human
cauaggucacuggcucuccaa

SEQ ID NO: 3437728 - RNA, 20 nt, Human
cauaggugauccauguaacu

SEQ ID NO: 3437729 - RNA, 23 nt, Human
cauagguuaaaaaaaaaagucac

SEQ ID NO: 3437730 - RNA, 15 nt, Human
cauaguaaauguagu

SEQ ID NO: 3437731 - RNA, 15 nt, Human
cauaguaacugacau

SEQ ID NO: 3437732 - RNA, 23 nt, Human
cauaguaacuucuuauggaauug

SEQ ID NO: 3437733 - RNA, 16 nt, Human
cauaguagaacgcuau

SEQ ID NO: 3437734 - RNA, 19 nt, Human
cauaguauauuaaaaaugg

SEQ ID NO: 3437735 - RNA, 19 nt, Human
cauaguauccauauuuuau

SEQ ID NO: 3437736 - RNA, 20 nt, Human
cauaguauccauauuuuauu

SEQ ID NO: 3437737 - RNA, 19 nt, Human
cauaguaugguggcugggu

SEQ ID NO: 3437738 - RNA, 20 nt, Human
cauaguaugguggcuggguu

SEQ ID NO: 3437739 - RNA, 13 nt, Human
cauagucacaugg

SEQ ID NO: 3437740 - RNA, 13 nt, Human
cauagucccugcc

SEQ ID NO: 3437741 - RNA, 22 nt, Human
cauagugaugguuccccuguuc

SEQ ID NO: 3437742 - RNA, 11 nt, Human
cauagugcugg

SEQ ID NO: 3437743 - RNA, 13 nt, Human
cauaguguaaugu

SEQ ID NO: 3437744 - RNA, 20 nt, Human
cauaguuaaagaagacauuu

SEQ ID NO: 3437745 - RNA, 13 nt, Human
cauaguuacugua

SEQ ID NO: 3437746 - RNA, 17 nt, Human
cauaguuacuguaaaau

SEQ ID NO: 3437747 - RNA, 19 nt, Human
cauaguuacuguguaaacu

SEQ ID NO: 3437748 - RNA, 13 nt, Human
cauaguucagaau

SEQ ID NO: 3437749 - RNA, 20 nt, Human
cauaguucugagcugccagu

SEQ ID NO: 3437750 - RNA, 20 nt, Human
cauaguuguagacaaaguac

SEQ ID NO: 3437751 - RNA, 15 nt, Human
cauaguuucuuuauu

SEQ ID NO: 3437752 - RNA, 17 nt, Human
cauaguuucuuuauuuu

SEQ ID NO: 3437753 - RNA, 16 nt, Human
cauaguuuggcauuug

SEQ ID NO: 3437754 - RNA, 16 nt, Human
cauaguuuuauuuaua

SEQ ID NO: 3437755 - RNA, 17 nt, Human
cauaguuuuuacugaac

SEQ ID NO: 3437756 - RNA, 19 nt, Human
cauauaaacuuuuuaaaga

SEQ ID NO: 3437757 - RNA, 12 nt, Human
cauauaaaguau

SEQ ID NO: 3437758 - RNA, 13 nt, Human
cauauaaauagaa

SEQ ID NO: 3437759 - RNA, 17 nt, Human
cauauaaauagaaugua

SEQ ID NO: 3437760 - RNA, 22 nt, Human
cauauaaauagaauguaaaugu

SEQ ID NO: 3437761 - RNA, 22 nt, Human
cauauaacuuauauuguaagaa

SEQ ID NO: 3437762 - RNA, 14 nt, Human
cauauaaguuugaa

SEQ ID NO: 3437763 - RNA, 24 nt, Human
cauauaaguuugaaggaaacaguu

SEQ ID NO: 3437764 - RNA, 20 nt, Human
cauauaauauauguuuuaaa

SEQ ID NO: 3437765 - RNA, 22 nt, Human
cauauaauauauguuuuaaaua

SEQ ID NO: 3437766 - RNA, 17 nt, Human
cauauaauguuguuauu

SEQ ID NO: 3437767 - RNA, 20 nt, Human
cauauacaacaccaaaaaau

SEQ ID NO: 3437768 - RNA, 17 nt, Human
cauauaccagcaauaua

SEQ ID NO: 3437769 - RNA, 19 nt, Human
cauauaccuauaaugugug

SEQ ID NO: 3437770 - RNA, 23 nt, Human
cauauaccuauaauguguguaug

SEQ ID NO: 3437771 - RNA, 16 nt, Human
cauauagacacauaca

SEQ ID NO: 3437772 - RNA, 22 nt, Human
cauauagcaaaacuuuuaaacu

SEQ ID NO: 3437773 - RNA, 22 nt, Human
cauauaguauguaaccuguuuu

SEQ ID NO: 3437774 - RNA, 20 nt, Human
cauauauaacagauacauuu

SEQ ID NO: 3437775 - RNA, 18 nt, Human
cauauauaacuagcuaga

SEQ ID NO: 3437776 - RNA, 22 nt, Human
cauauauacacacacaaagaga

SEQ ID NO: 3437777 - RNA, 16 nt, Human
cauauauacaggcaua

SEQ ID NO: 3437778 - RNA, 20 nt, Human
cauauauagacagcuuugac

SEQ ID NO: 3437779 - RNA, 16 nt, Human
cauauauauauauaac

SEQ ID NO: 3437780 - RNA, 14 nt, Human
cauauauauaugug

SEQ ID NO: 3437781 - RNA, 15 nt, Human
cauauauauaugugu

SEQ ID NO: 3437782 - RNA, 23 nt, Human
cauauauauguuuuaagaggcag

SEQ ID NO: 3437783 - RNA, 20 nt, Human
cauauauccuuuucuucuau

SEQ ID NO: 3437784 - RNA, 23 nt, Human
cauauauccuuuucuucuaugua

SEQ ID NO: 3437785 - RNA, 22 nt, Human
cauauauggggggccaacacca

SEQ ID NO: 3437786 - RNA, 22 nt, Human
cauauauuuuuaaaaaaugaaa

SEQ ID NO: 3437787 - RNA, 20 nt, Human
cauauauuuuuauauuuacu

SEQ ID NO: 3437788 - RNA, 16 nt, Human
cauaucagucucugag

SEQ ID NO: 3437789 - RNA, 18 nt, Human
cauaucauccacacauga

SEQ ID NO: 3437790 - RNA, 15 nt, Human
cauaucauuucuuaa

SEQ ID NO: 3437791 - RNA, 16 nt, Human
cauauccaaguuugaa

SEQ ID NO: 3437792 - RNA, 16 nt, Human
cauauccaccaccucc

SEQ ID NO: 3437793 - RNA, 18 nt, Human
cauauccccuauuuaaca

SEQ ID NO: 3437794 - RNA, 23 nt, Human
cauauccugagccaucggugaaa

SEQ ID NO: 3437795 - RNA, 17 nt, Human
cauaucgcugacuucau

SEQ ID NO: 3437796 - RNA, 14 nt, Human
cauaucuacagaua

SEQ ID NO: 3437797 - RNA, 18 nt, Human
cauaucuaguaugaaauu

SEQ ID NO: 3437798 - RNA, 17 nt, Human
cauaucuaucagaguau

SEQ ID NO: 3437799 - RNA, 11 nt, Human
cauaucugccu

SEQ ID NO: 3437800 - RNA, 13 nt, Human
cauaucugccuuu

SEQ ID NO: 3437801 - RNA, 21 nt, Human
cauaucuugcgaauccaagcu

SEQ ID NO: 3437802 - RNA, 16 nt, Human
cauaucuuuauuaauc

SEQ ID NO: 3437803 - RNA, 17 nt, Human
cauaucuuuauuaauca

SEQ ID NO: 3437804 - RNA, 15 nt, Human
cauaugaaaggagag

SEQ ID NO: 3437805 - RNA, 20 nt, Human
cauaugaaaggugccaugga

SEQ ID NO: 3437806 - RNA, 17 nt, Human
cauaugaaauuuaauau

SEQ ID NO: 3437807 - RNA, 15 nt, Human
cauaugaauuguaca

SEQ ID NO: 3437808 - RNA, 16 nt, Human
cauaugaauuguacag

SEQ ID NO: 3437809 - RNA, 17 nt, Human
cauaugacaaauguuuc

SEQ ID NO: 3437810 - RNA, 22 nt, Human
cauaugacauucaugccuggcu

SEQ ID NO: 3437811 - RNA, 16 nt, Human
cauaugaccucaugca

SEQ ID NO: 3437812 - RNA, 20 nt, Human
cauaugacucacaugaugca

SEQ ID NO: 3437813 - RNA, 19 nt, Human
cauaugaguguggaagccg

SEQ ID NO: 3437814 - RNA, 13 nt, Human
cauaugaucuguu

SEQ ID NO: 3437815 - RNA, 17 nt, Human
cauaugauguacaugua

SEQ ID NO: 3437816 - RNA, 14 nt, Human
cauaugauucugcu

SEQ ID NO: 3437817 - RNA, 15 nt, Human
cauaugauucugcuu

SEQ ID NO: 3437818 - RNA, 14 nt, Human
cauaugauuuacau

SEQ ID NO: 3437819 - RNA, 17 nt, Human
cauaugcaccuuguguc

SEQ ID NO: 3437820 - RNA, 18 nt, Human
cauaugcaguguucuaca

SEQ ID NO: 3437821 - RNA, 20 nt, Human
cauaugcccacauuuagucu

SEQ ID NO: 3437822 - RNA, 13 nt, Human
cauaugccugggc

SEQ ID NO: 3437823 - RNA, 21 nt, Human
cauaugcuaccaccagcugug

SEQ ID NO: 3437824 - RNA, 14 nt, Human
cauauggauaaaua

SEQ ID NO: 3437825 - RNA, 12 nt, Human
cauauggauguu

SEQ ID NO: 3437826 - RNA, 15 nt, Human
cauauggauguuacu

SEQ ID NO: 3437827 - RNA, 20 nt, Human
cauauggcccagugucaagu

SEQ ID NO: 3437828 - RNA, 17 nt, Human
ccucuggucgcuccugc

SEQ ID NO: 3437829 - RNA, 19 nt, Human
ccucuggucgcuccugccc

SEQ ID NO: 3437830 - RNA, 16 nt, Human
ccucugguuuggggcg

SEQ ID NO: 3437831 - RNA, 21 nt, Human
ccucugguuuggggcgaggca

SEQ ID NO: 3437832 - RNA, 23 nt, Human
ccucugguuuggggcgaggcaga

SEQ ID NO: 3437833 - RNA, 14 nt, Human
ccucuguacagagc

SEQ ID NO: 3437834 - RNA, 15 nt, Human
ccucuguacagagcc

SEQ ID NO: 3437835 - RNA, 18 nt, Human
ccucugucagucacagcc

SEQ ID NO: 3437836 - RNA, 17 nt, Human
ccucuguccaggcacug

SEQ ID NO: 3437837 - RNA, 19 nt, Human
ccucuguccccuucucuca

SEQ ID NO: 3437838 - RNA, 21 nt, Human
ccucuguccccuucucucauc

SEQ ID NO: 3437839 - RNA, 11 nt, Human
ccucuguccug

SEQ ID NO: 3437840 - RNA, 17 nt, Human
ccucuguccugcuucug

SEQ ID NO: 3437841 - RNA, 15 nt, Human
ccucugucucauccu

SEQ ID NO: 3437842 - RNA, 23 nt, Human
ccucugucucauccuccuggaac

SEQ ID NO: 3437843 - RNA, 15 nt, Human
ccucugucucgagcg

SEQ ID NO: 3437844 - RNA, 19 nt, Human
ccucugucucgagcgcccu

SEQ ID NO: 3437845 - RNA, 20 nt, Human
ccucugucucgagcgcccug

SEQ ID NO: 3437846 - RNA, 22 nt, Human
ccucugucugcccuucacccca

SEQ ID NO: 3437847 - RNA, 16 nt, Human
ccucugucuucuggac

SEQ ID NO: 3437848 - RNA, 19 nt, Human
ccucugugaccaaugucuu

SEQ ID NO: 3437849 - RNA, 15 nt, Human
ccucugugcugugug

SEQ ID NO: 3437850 - RNA, 19 nt, Human
ccucugugucacuggcugc

SEQ ID NO: 3437851 - RNA, 18 nt, Human
ccucuguuguccuccccu

SEQ ID NO: 3437852 - RNA, 21 nt, Human
ccucuguuucucuuuccuugg

SEQ ID NO: 3437853 - RNA, 21 nt, Human
ccucuguuugacaaaccucua

SEQ ID NO: 3437854 - RNA, 17 nt, Human
ccucuuaaagcugccug

SEQ ID NO: 3437855 - RNA, 23 nt, Human
ccugcccaugucgcgcucagcau

SEQ ID NO: 3437856 - RNA, 21 nt, Human
ccugcccauucugcccugugg

SEQ ID NO: 3437857 - RNA, 20 nt, Human
ccugccccaaucccuuuauu

SEQ ID NO: 3437858 - RNA, 12 nt, Human
ccugccccagcc

SEQ ID NO: 3437859 - RNA, 13 nt, Human
ccugccccagccc

SEQ ID NO: 3437860 - RNA, 18 nt, Human
ccugccccagcccaaguc

SEQ ID NO: 3437861 - RNA, 18 nt, Human
ccugccccaggccugaaa

SEQ ID NO: 3437862 - RNA, 15 nt, Human
ccugcccccaaucca

SEQ ID NO: 3437863 - RNA, 15 nt, Human
ccugcccccacaccu

SEQ ID NO: 3437864 - RNA, 18 nt, Human
ccugcccccacaccuggc

SEQ ID NO: 3437865 - RNA, 19 nt, Human
ccugcccccacaccuggcc

SEQ ID NO: 3437866 - RNA, 22 nt, Human
ccugcccccagaccuuuuaucc

SEQ ID NO: 3437867 - RNA, 13 nt, Human
ccugcccccagcc

SEQ ID NO: 3437868 - RNA, 15 nt, Human
ccugcccccagcccc

SEQ ID NO: 3437869 - RNA, 17 nt, Human
ccugcccccagccccgg

SEQ ID NO: 3437870 - RNA, 12 nt, Human
ccugcccccagg

SEQ ID NO: 3437871 - RNA, 15 nt, Human
ccugcccccaggacu

SEQ ID NO: 3437872 - RNA, 17 nt, Human
ccugcccccaggacugg

SEQ ID NO: 3437873 - RNA, 19 nt, Human
ccugcccccaggacugggc

SEQ ID NO: 3437874 - RNA, 20 nt, Human
ccugcccccaggacugggcc

SEQ ID NO: 3437875 - RNA, 14 nt, Human
ccugccccccagcc

SEQ ID NO: 3437876 - RNA, 18 nt, Human
ccugccccccagccucug

SEQ ID NO: 3437877 - RNA, 22 nt, Human
ccugccccccagccucuggcau

SEQ ID NO: 3437878 - RNA, 20 nt, Human
ccugcccccgcauccccugc

SEQ ID NO: 3437879 - RNA, 22 nt, Human
ccugcccccgcauccccugccu

SEQ ID NO: 3437880 - RNA, 20 nt, Human
ccugcccccugcaggaagga

SEQ ID NO: 3437881 - RNA, 12 nt, Human
ccugcccccugg

SEQ ID NO: 3437882 - RNA, 16 nt, Human
ccugcccccuggugga

SEQ ID NO: 3437883 - RNA, 12 nt, Human
ccugcccccuuc

SEQ ID NO: 3437884 - RNA, 13 nt, Human
ccugcccccuucu

SEQ ID NO: 3437885 - RNA, 17 nt, Human
ccugcccccuucuccca

SEQ ID NO: 3437886 - RNA, 20 nt, Human
ccugcccccuucucccacac

SEQ ID NO: 3437887 - RNA, 21 nt, Human
ccugcccccuucucccacacu

SEQ ID NO: 3437888 - RNA, 16 nt, Human
ccugccccucagagac

SEQ ID NO: 3437889 - RNA, 15 nt, Human
ccugccccucccuuc

SEQ ID NO: 3437890 - RNA, 18 nt, Human
ccugccccucccuucaac

SEQ ID NO: 3437891 - RNA, 18 nt, Human
ccugccccuccucucugc

SEQ ID NO: 3437892 - RNA, 21 nt, Human
ccugccccuccucucugcccu

SEQ ID NO: 3437893 - RNA, 16 nt, Human
ccugccccucucccgc

SEQ ID NO: 3437894 - RNA, 18 nt, Human
ccugccccucuuucucuu

SEQ ID NO: 3437895 - RNA, 20 nt, Human
ccugccccucuuucucuuuc

SEQ ID NO: 3437896 - RNA, 14 nt, Human
ccugccccuguucu

SEQ ID NO: 3437897 - RNA, 16 nt, Human
ccugccccuuccuuua

SEQ ID NO: 3437898 - RNA, 19 nt, Human
ccugccccuucuacacucu

SEQ ID NO: 3437899 - RNA, 20 nt, Human
ccugccccuucuacacucuc

SEQ ID NO: 3437900 - RNA, 22 nt, Human
ccugccccuucuacacucuccu

SEQ ID NO: 3437901 - RNA, 15 nt, Human
ccugcccgcacagca

SEQ ID NO: 3437902 - RNA, 16 nt, Human
ccugcccgcacagcag

SEQ ID NO: 3437903 - RNA, 20 nt, Human
ccugcccgcacagcagccug

SEQ ID NO: 3437904 - RNA, 18 nt, Human
ccugcccgcagaccucug

SEQ ID NO: 3437905 - RNA, 15 nt, Human
ccugcccguaaacac

SEQ ID NO: 3437906 - RNA, 23 nt, Human
ccugcccguaaacacgccugcaa

SEQ ID NO: 3437907 - RNA, 20 nt, Human
ccugcccgucucucucccau

SEQ ID NO: 3437908 - RNA, 20 nt, Human
ccugcccuacagaggucucu

SEQ ID NO: 3437909 - RNA, 18 nt, Human
ccugcccuagagcacacu

SEQ ID NO: 3437910 - RNA, 22 nt, Human
ccugcccuagagcacacuguag

SEQ ID NO: 3437911 - RNA, 13 nt, Human
ccugcccucaagg

SEQ ID NO: 3437912 - RNA, 18 nt, Human
ccugcccucaagggugug

SEQ ID NO: 3437913 - RNA, 15 nt, Human
ccugcccucagggau

SEQ ID NO: 3437914 - RNA, 19 nt, Human
ccugcccucaucucucucc

SEQ ID NO: 3437915 - RNA, 21 nt, Human
ccugcccucauggccccucug

SEQ ID NO: 3437916 - RNA, 15 nt, Human
ccugcccuccccaga

SEQ ID NO: 3437917 - RNA, 12 nt, Human
ccugcccucgug

SEQ ID NO: 3437918 - RNA, 14 nt, Human
ccugcccucguggc

SEQ ID NO: 3437919 - RNA, 23 nt, Human
ccugcccucguggccagcccggc

SEQ ID NO: 3437920 - RNA, 13 nt, Human
ccugcccugagga

SEQ ID NO: 3437921 - RNA, 11 nt, Human
ccugcccugca

SEQ ID NO: 3437922 - RNA, 12 nt, Human
ccugcccugcca

SEQ ID NO: 3437923 - RNA, 15 nt, Human
ccugcccugccccca

SEQ ID NO: 3437924 - RNA, 14 nt, Human
ccugcccugccuga

SEQ ID NO: 3437925 - RNA, 20 nt, Human
ccugcccugcugccgccucc

SEQ ID NO: 3437926 - RNA, 12 nt, Human
ccugcccuggaa

SEQ ID NO: 3437927 - RNA, 14 nt, Human
ccugcccugggagg

SEQ ID NO: 3437928 - RNA, 22 nt, Human
ccugcccugguuuccugcccug

SEQ ID NO: 3437929 - RNA, 21 nt, Human
ccugcccuuaccugccaggaa

SEQ ID NO: 3437930 - RNA, 17 nt, Human
ccugcccuucagcaucc

SEQ ID NO: 3437931 - RNA, 17 nt, Human
ccugcccuugucugaga

SEQ ID NO: 3437932 - RNA, 20 nt, Human
ccugcccuuuuuucugccuc

SEQ ID NO: 3437933 - RNA, 16 nt, Human
ccugccgacacgcucc

SEQ ID NO: 3437934 - RNA, 14 nt, Human
ccugccgagagucc

SEQ ID NO: 3437935 - RNA, 23 nt, Human
ccugccgagaguccaucagccuc

SEQ ID NO: 3437936 - RNA, 15 nt, Human
ccugccgcagagcug

SEQ ID NO: 3437937 - RNA, 14 nt, Human
ccugccgccucaau

SEQ ID NO: 3437938 - RNA, 13 nt, Human
ccugccggcuccu

SEQ ID NO: 3437939 - RNA, 20 nt, Human
ccugccgguaaacacgccug

SEQ ID NO: 3437940 - RNA, 22 nt, Human
ccugccgguaaacacgccugca

SEQ ID NO: 3437941 - RNA, 23 nt, Human
ccugccgucaccaccaccccuac

SEQ ID NO: 3437942 - RNA, 15 nt, Human
ccugccuagcacuca

SEQ ID NO: 3437943 - RNA, 19 nt, Human
ccugccuauuaucugucag

SEQ ID NO: 3437944 - RNA, 22 nt, Human
ccugccucaccagcccuggcaa

SEQ ID NO: 3437945 - RNA, 15 nt, Human
ccugccucagccucc

SEQ ID NO: 3437946 - RNA, 17 nt, Human
ccugccucagccucccg

SEQ ID NO: 3437947 - RNA, 19 nt, Human
ccugccucagccucccgag

SEQ ID NO: 3437948 - RNA, 18 nt, Human
ccugccuccacccucuga

SEQ ID NO: 3437949 - RNA, 15 nt, Human
ccugccuccaggaac

SEQ ID NO: 3437950 - RNA, 20 nt, Human
ccugccuccaggaaccacac

SEQ ID NO: 3437951 - RNA, 15 nt, Human
ccugccuccagggcu

SEQ ID NO: 3437952 - RNA, 17 nt, Human
ccugccuccagggcugg

SEQ ID NO: 3437953 - RNA, 16 nt, Human
ccugccuccccugccu

SEQ ID NO: 3437954 - RNA, 15 nt, Human
ccugccuccccugug

SEQ ID NO: 3437955 - RNA, 17 nt, Human
ccugccuccccugugca

SEQ ID NO: 3437956 - RNA, 22 nt, Human
ccugccucccgcccccuuggcu

SEQ ID NO: 3437957 - RNA, 13 nt, Human
ccugccuccugcc

SEQ ID NO: 3437958 - RNA, 20 nt, Human
ccugccuccugccugccccu

SEQ ID NO: 3437959 - RNA, 22 nt, Human
ccugccuccuuugugaggaagc

SEQ ID NO: 3437960 - RNA, 23 nt, Human
ccugccucucaucaacugaauga

SEQ ID NO: 3437961 - RNA, 17 nt, Human
ccugccucuccgccccu

SEQ ID NO: 3437962 - RNA, 22 nt, Human
ccugccucuccgccccugagcc

SEQ ID NO: 3437963 - RNA, 14 nt, Human
ccugccucucugca

SEQ ID NO: 3437964 - RNA, 14 nt, Human
ccugccucuuaaau

SEQ ID NO: 3437965 - RNA, 21 nt, Human
ccugccucuuaaauaaaccuu

SEQ ID NO: 3437966 - RNA, 20 nt, Human
ccugccugagggccccucug

SEQ ID NO: 3437967 - RNA, 22 nt, Human
ccugccugagggccccucugcc

SEQ ID NO: 3437968 - RNA, 12 nt, Human
ccugccugccau

SEQ ID NO: 3437969 - RNA, 13 nt, Human
ccugccugccaug

SEQ ID NO: 3437970 - RNA, 14 nt, Human
ccugccugcccugu

SEQ ID NO: 3437971 - RNA, 12 nt, Human
ccugccugcugg

SEQ ID NO: 3437972 - RNA, 22 nt, Human
cauccccaaaacaaagucuuug

SEQ ID NO: 3437973 - RNA, 22 nt, Human
cauccccacguggacaagaaag

SEQ ID NO: 3437974 - RNA, 15 nt, Human
cauccccauccucca

SEQ ID NO: 3437975 - RNA, 18 nt, Human
cauccccccucaccaggg

SEQ ID NO: 3437976 - RNA, 12 nt, Human
caucccccugcc

SEQ ID NO: 3437977 - RNA, 14 nt, Human
cauccccucccauc

SEQ ID NO: 3437978 - RNA, 22 nt, Human
cauccccuugaggucucagccc

SEQ ID NO: 3437979 - RNA, 18 nt, Human
caucccgcucuuuuccua

SEQ ID NO: 3437980 - RNA, 17 nt, Human
caucccggaggaaaucu

SEQ ID NO: 3437981 - RNA, 20 nt, Human
caucccgugcaaaacaugcu

SEQ ID NO: 3437982 - RNA, 21 nt, Human
caucccgugcaaaacaugcua

SEQ ID NO: 3437983 - RNA, 17 nt, Human
caucccguguucuccuu

SEQ ID NO: 3437984 - RNA, 21 nt, Human
caucccguguucuccuuuucc

SEQ ID NO: 3437985 - RNA, 19 nt, Human
caucccuaccgacccaggg

SEQ ID NO: 3437986 - RNA, 13 nt, Human
caucccucccucc

SEQ ID NO: 3437987 - RNA, 23 nt, Human
caucccucccuccaccucccugc

SEQ ID NO: 3437988 - RNA, 14 nt, Human
caucccuccuuaag

SEQ ID NO: 3437989 - RNA, 17 nt, Human
caucccugaaggccccg

SEQ ID NO: 3437990 - RNA, 18 nt, Human
caucccugaggagccagg

SEQ ID NO: 3437991 - RNA, 22 nt, Human
caucccugaggcuggacuccag

SEQ ID NO: 3437992 - RNA, 15 nt, Human
caucccugccagcuc

SEQ ID NO: 3437993 - RNA, 21 nt, Human
caucccugccagcucuucugc

SEQ ID NO: 3437994 - RNA, 13 nt, Human
caucccugccugg

SEQ ID NO: 3437995 - RNA, 14 nt, Human
caucccugccuggu

SEQ ID NO: 3437996 - RNA, 14 nt, Human
caucccugggccug

SEQ ID NO: 3437997 - RNA, 15 nt, Human
caucccugggccugc

SEQ ID NO: 3437998 - RNA, 19 nt, Human
caucccugggccugcugcu

SEQ ID NO: 3437999 - RNA, 17 nt, Human
caucccugggccuuggg

SEQ ID NO: 3438000 - RNA, 21 nt, Human
caucccugggccuugggcucc

SEQ ID NO: 3438001 - RNA, 13 nt, Human
caucccugugagg

SEQ ID NO: 3438002 - RNA, 18 nt, Human
caucccuucucuuccagg

SEQ ID NO: 3438003 - RNA, 23 nt, Human
caucccuucucuuccaggcagcc

SEQ ID NO: 3438004 - RNA, 19 nt, Human
caucccuugaccaggccug

SEQ ID NO: 3438005 - RNA, 20 nt, Human
caucccuugaccaggccugg

SEQ ID NO: 3438006 - RNA, 19 nt, Human
caucccuuugaaacaagau

SEQ ID NO: 3438007 - RNA, 15 nt, Human
caucccuuuuucaau

SEQ ID NO: 3438008 - RNA, 18 nt, Human
caucccuuuuugaagugu

SEQ ID NO: 3438009 - RNA, 20 nt, Human
caucccuuuuugaaguguag

SEQ ID NO: 3438010 - RNA, 19 nt, Human
ccucuuaaagcugccugua

SEQ ID NO: 3438011 - RNA, 22 nt, Human
ccucuuaaagcugccuguaguu

SEQ ID NO: 3438012 - RNA, 23 nt, Human
ccucuuaaagcugccuguaguua

SEQ ID NO: 3438013 - RNA, 21 nt, Human
ccucuuaauguaugauuacau

SEQ ID NO: 3438014 - RNA, 20 nt, Human
ccucuuagacuucugcuuuc

SEQ ID NO: 3438015 - RNA, 22 nt, Human
ccucuuagacuucugcuuucca

SEQ ID NO: 3438016 - RNA, 15 nt, Human
ccucuuaugggcugg

SEQ ID NO: 3438017 - RNA, 20 nt, Human
ccucuuauguaccucuuuua

SEQ ID NO: 3438018 - RNA, 13 nt, Human
ccucuucaaauua

SEQ ID NO: 3438019 - RNA, 13 nt, Human
ccucuucaccccc

SEQ ID NO: 3438020 - RNA, 17 nt, Human
ccucuucaccccggcag

SEQ ID NO: 3438021 - RNA, 20 nt, Human
ccucuucaccccggcaggcc

SEQ ID NO: 3438022 - RNA, 21 nt, Human
ccucuucaccccggcaggccc

SEQ ID NO: 3438023 - RNA, 12 nt, Human
ccucuuccaguc

SEQ ID NO: 3438024 - RNA, 14 nt, Human
ccucuuccagucuu

SEQ ID NO: 3438025 - RNA, 18 nt, Human
ccucuuccaucauguccc

SEQ ID NO: 3438026 - RNA, 12 nt, Human
ccucuuccccac

SEQ ID NO: 3438027 - RNA, 16 nt, Human
ccucuucccccaagau

SEQ ID NO: 3438028 - RNA, 21 nt, Human
ccucuucccugguaagaaaaa

SEQ ID NO: 3438029 - RNA, 14 nt, Human
ccucuuccuacccu

SEQ ID NO: 3438030 - RNA, 10 nt, Human
ccucuuccuc

SEQ ID NO: 3438031 - RNA, 15 nt, Human
ccucuuccucccuca

SEQ ID NO: 3438032 - RNA, 11 nt, Human
ccucuuccucu

SEQ ID NO: 3438033 - RNA, 20 nt, Human
ccucuuccucuugacccugc

SEQ ID NO: 3438034 - RNA, 20 nt, Human
ccucuuccugacgaaacugg

SEQ ID NO: 3438035 - RNA, 15 nt, Human
ccucuuccugccuag

SEQ ID NO: 3438036 - RNA, 16 nt, Human
ccucuuccuugcugug

SEQ ID NO: 3438037 - RNA, 13 nt, Human
ccucuucggcccu

SEQ ID NO: 3438038 - RNA, 16 nt, Human
ccucuucggcccucag

SEQ ID NO: 3438039 - RNA, 21 nt, Human
ccucuucuacucacuuuuccc

SEQ ID NO: 3438040 - RNA, 23 nt, Human
ccucuucuacucacuuuucccac

SEQ ID NO: 3438041 - RNA, 19 nt, Human
ccucuucucgugccucccc

SEQ ID NO: 3438042 - RNA, 14 nt, Human
ccucuucucuuccu

SEQ ID NO: 3438043 - RNA, 16 nt, Human
ccucuucucuuccugu

SEQ ID NO: 3438044 - RNA, 17 nt, Human
ccucuucucuuccugua

SEQ ID NO: 3438045 - RNA, 15 nt, Human
ccucuucuggcucaa

SEQ ID NO: 3438046 - RNA, 20 nt, Human
ccucuucugucccuguuaga

SEQ ID NO: 3438047 - RNA, 12 nt, Human
ccucuucuuacu

SEQ ID NO: 3438048 - RNA, 14 nt, Human
ccucuucuuacuug

SEQ ID NO: 3438049 - RNA, 22 nt, Human
ccucuucuuucagacuugccau

SEQ ID NO: 3438050 - RNA, 15 nt, Human
ccucuugaccaggcu

SEQ ID NO: 3438051 - RNA, 15 nt, Human
ccucuugagcagugg

SEQ ID NO: 3438052 - RNA, 13 nt, Human
ccucuugagccuu

SEQ ID NO: 3438053 - RNA, 12 nt, Human
ccucuugccccc

SEQ ID NO: 3438054 - RNA, 18 nt, Human
ccucuugcggucccuucu

SEQ ID NO: 3438055 - RNA, 12 nt, Human
ccucuugcucaa

SEQ ID NO: 3438056 - RNA, 15 nt, Human
ccucuuggaccucug

SEQ ID NO: 3438057 - RNA, 20 nt, Human
ccucuuggagaagucucagc

SEQ ID NO: 3438058 - RNA, 22 nt, Human
ccucuuggggaguuuagggugg

SEQ ID NO: 3438059 - RNA, 17 nt, Human
ccucuuguaaauaaagc

SEQ ID NO: 3438060 - RNA, 18 nt, Human
ccucuuguaaauaaagcc

SEQ ID NO: 3438061 - RNA, 15 nt, Human
ccucuuguuuuguuu

SEQ ID NO: 3438062 - RNA, 11 nt, Human
ccucuuuaaaa

SEQ ID NO: 3438063 - RNA, 15 nt, Human
ccucuuuaaaacaaa

SEQ ID NO: 3438064 - RNA, 12 nt, Human
ccucuuuaagag

SEQ ID NO: 3438065 - RNA, 19 nt, Human
ccucuuuagaguuagacug

SEQ ID NO: 3438066 - RNA, 16 nt, Human
ccucuuucagaaaaca

SEQ ID NO: 3438067 - RNA, 17 nt, Human
ccucuuucagaaaacag

SEQ ID NO: 3438068 - RNA, 16 nt, Human
ccucuuucagcuccug

SEQ ID NO: 3438069 - RNA, 16 nt, Human
ccucuuucccucccuu

SEQ ID NO: 3438070 - RNA, 15 nt, Human
ccucuuuccucucuu

SEQ ID NO: 3438071 - RNA, 12 nt, Human
ccucuuucucuu

SEQ ID NO: 3438072 - RNA, 15 nt, Human
ccucuuugagugaag

SEQ ID NO: 3438073 - RNA, 14 nt, Human
ccucuuugcuuugc

SEQ ID NO: 3438074 - RNA, 19 nt, Human
ccucuuuggucuacacugu

SEQ ID NO: 3438075 - RNA, 22 nt, Human
ccucuuuggucuacacugugcu

SEQ ID NO: 3438076 - RNA, 14 nt, Human
ccucuuugucuaaa

SEQ ID NO: 3438077 - RNA, 19 nt, Human
ccucuuugucuaaaacaau

SEQ ID NO: 3438078 - RNA, 22 nt, Human
ccucuuugucugcgugggucag

SEQ ID NO: 3438079 - RNA, 18 nt, Human
ccucuuuuaccugcugcu

SEQ ID NO: 3438080 - RNA, 17 nt, Human
ccucuuuuagucauuuu

SEQ ID NO: 3438081 - RNA, 14 nt, Human
ccucuuuucucugc

SEQ ID NO: 3438082 - RNA, 11 nt, Human
ccucuuuucuu

SEQ ID NO: 3438083 - RNA, 12 nt, Human
ccucuuuugugc

SEQ ID NO: 3438084 - RNA, 20 nt, Human
ccucuuuuuccaucauaauu

SEQ ID NO: 3438085 - RNA, 17 nt, Human
ccugaaaacacugugca

SEQ ID NO: 3438086 - RNA, 13 nt, Human
ccugaaaacccag

SEQ ID NO: 3438087 - RNA, 21 nt, Human
ccugaaaagauguugugucuu

SEQ ID NO: 3438088 - RNA, 22 nt, Human
ccugaaaagguuuaugaaaaag

SEQ ID NO: 3438089 - RNA, 20 nt, Human
ccugaaacgcuccuuugugu

SEQ ID NO: 3438090 - RNA, 15 nt, Human
ccugaaacuuauuuu

SEQ ID NO: 3438091 - RNA, 16 nt, Human
ccugaaacuuauuuuu

SEQ ID NO: 3438092 - RNA, 13 nt, Human
ccugaaagaggaa

SEQ ID NO: 3438093 - RNA, 19 nt, Human
ccugaaagaggcugaggcc

SEQ ID NO: 3438094 - RNA, 22 nt, Human
ccugaaagaggcugaggccugg

SEQ ID NO: 3438095 - RNA, 13 nt, Human
ccugaaagcccug

SEQ ID NO: 3438096 - RNA, 18 nt, Human
ccugaaagcccugagcuu

SEQ ID NO: 3438097 - RNA, 18 nt, Human
ccugaaauagugguucuu

SEQ ID NO: 3438098 - RNA, 12 nt, Human
ccugaaaugugu

SEQ ID NO: 3438099 - RNA, 14 nt, Human
ccugaaauuucacc

SEQ ID NO: 3438100 - RNA, 13 nt, Human
ccugaacaagaau

SEQ ID NO: 3438101 - RNA, 16 nt, Human
ccugaacaagaauugg

SEQ ID NO: 3438102 - RNA, 19 nt, Human
ccugaacacuuauugcuuu

SEQ ID NO: 3438103 - RNA, 23 nt, Human
ccugaacagcauggcacucccuc

SEQ ID NO: 3438104 - RNA, 18 nt, Human
ccugaacauccuuccuuc

SEQ ID NO: 3438105 - RNA, 14 nt, Human
ccugaaccaugugg

SEQ ID NO: 3438106 - RNA, 22 nt, Human
ccugaaccgcacagcucaggag

SEQ ID NO: 3438107 - RNA, 17 nt, Human
ccugaacugaacaccau

SEQ ID NO: 3438108 - RNA, 14 nt, Human
ccugaagaacagua

SEQ ID NO: 3438109 - RNA, 18 nt, Human
ccugaagaauuaagauac

SEQ ID NO: 3438110 - RNA, 15 nt, Human
ccugaagacugagga

SEQ ID NO: 3438111 - RNA, 18 nt, Human
ccugaagaggcgggccag

SEQ ID NO: 3438112 - RNA, 20 nt, Human
ccugaagaggcgggccagcc

SEQ ID NO: 3438113 - RNA, 22 nt, Human
ccugaagaggcgggccagccag

SEQ ID NO: 3438114 - RNA, 23 nt, Human
ccugaagaggcgggccagccagg

SEQ ID NO: 3438115 - RNA, 17 nt, Human
ccugaagaugggagccu

SEQ ID NO: 3438116 - RNA, 17 nt, Human
ccugaagccagccuucu

SEQ ID NO: 3438117 - RNA, 18 nt, Human
ccugcgucuuccgccccu

SEQ ID NO: 3438118 - RNA, 16 nt, Human
ccugcguggcugaccc

SEQ ID NO: 3438119 - RNA, 19 nt, Human
ccugcguggcugacccccc

SEQ ID NO: 3438120 - RNA, 23 nt, Human
ccugcguggcugaccccccucag

SEQ ID NO: 3438121 - RNA, 13 nt, Human
ccugcguggggac

SEQ ID NO: 3438122 - RNA, 19 nt, Human
ccugcguugguccagagcg

SEQ ID NO: 3438123 - RNA, 18 nt, Human
ccugcuaacggugcucag

SEQ ID NO: 3438124 - RNA, 19 nt, Human
ccugcuaacggugcucagg

SEQ ID NO: 3438125 - RNA, 19 nt, Human
ccugcuacaacuucagcag

SEQ ID NO: 3438126 - RNA, 20 nt, Human
ccugcuacaacuucagcagu

SEQ ID NO: 3438127 - RNA, 20 nt, Human
ccugcuacaccuauuauccc

SEQ ID NO: 3438128 - RNA, 15 nt, Human
ccugcuacugccaac

SEQ ID NO: 3438129 - RNA, 15 nt, Human
ccugcuaggccagag

SEQ ID NO: 3438130 - RNA, 16 nt, Human
ccugcuaggccagagc

SEQ ID NO: 3438131 - RNA, 17 nt, Human
ccugcuaggccagagcc

SEQ ID NO: 3438132 - RNA, 18 nt, Human
ccugcuauuucccaagcu

SEQ ID NO: 3438133 - RNA, 20 nt, Human
ccugcuauuucccaagcugg

SEQ ID NO: 3438134 - RNA, 21 nt, Human
ccugcuauuucccaagcugga

SEQ ID NO: 3438135 - RNA, 22 nt, Human
ccugcucagcagugagagcaga

SEQ ID NO: 3438136 - RNA, 16 nt, Human
ccugcucagcccugca

SEQ ID NO: 3438137 - RNA, 13 nt, Human
ccugcucauccac

SEQ ID NO: 3438138 - RNA, 23 nt, Human
ccugcucauuaugccacuuccuu

SEQ ID NO: 3438139 - RNA, 14 nt, Human
ccugcuccagaccu

SEQ ID NO: 3438140 - RNA, 15 nt, Human
ccugcuccagaccug

SEQ ID NO: 3438141 - RNA, 12 nt, Human
ccugcucccagc

SEQ ID NO: 3438142 - RNA, 14 nt, Human
ccugcucccagcag

SEQ ID NO: 3438143 - RNA, 15 nt, Human
ccugcucccauccug

SEQ ID NO: 3438144 - RNA, 14 nt, Human
ccugcucccccacc

SEQ ID NO: 3438145 - RNA, 23 nt, Human
ccugcucccccacccccucccca

SEQ ID NO: 3438146 - RNA, 22 nt, Human
ccugcucccuccgggucuuccu

SEQ ID NO: 3438147 - RNA, 18 nt, Human
ccugcucccucucccccu

SEQ ID NO: 3438148 - RNA, 14 nt, Human
ccugcuccgcugcu

SEQ ID NO: 3438149 - RNA, 21 nt, Human
ccugcuccgcugcuccuuggc

SEQ ID NO: 3438150 - RNA, 18 nt, Human
ccugcuccucccuggcug

SEQ ID NO: 3438151 - RNA, 19 nt, Human
ccugcuccucccuggcugc

SEQ ID NO: 3438152 - RNA, 22 nt, Human
ccugcuccucccuggcugcccu

SEQ ID NO: 3438153 - RNA, 17 nt, Human
ccugcuccugcagcaug

SEQ ID NO: 3438154 - RNA, 18 nt, Human
ccugcuccuucccaggag

SEQ ID NO: 3438155 - RNA, 15 nt, Human
ccugcucgcucccug

SEQ ID NO: 3438156 - RNA, 18 nt, Human
ccugcucguccccaagug

SEQ ID NO: 3438157 - RNA, 17 nt, Human
ccugcucuagugggaca

SEQ ID NO: 3438158 - RNA, 19 nt, Human
ccugcucuagugggacagc

SEQ ID NO: 3438159 - RNA, 23 nt, Human
ccugcucuccaagucucaguggc

SEQ ID NO: 3438160 - RNA, 21 nt, Human
ccugcucuccgaccagacacc

SEQ ID NO: 3438161 - RNA, 15 nt, Human
ccugcucuccucuuc

SEQ ID NO: 3438162 - RNA, 21 nt, Human
ccugcucuccucuugccacug

SEQ ID NO: 3438163 - RNA, 22 nt, Human
ccugcucuccucuugccacugc

SEQ ID NO: 3438164 - RNA, 14 nt, Human
ccugcucucuaccc

SEQ ID NO: 3438165 - RNA, 16 nt, Human
ccugcucucuacccag

SEQ ID NO: 3438166 - RNA, 17 nt, Human
ccugcucucuacccagc

SEQ ID NO: 3438167 - RNA, 12 nt, Human
ccugcucugcuc

SEQ ID NO: 3438168 - RNA, 21 nt, Human
ccugcugaagguggggauugc

SEQ ID NO: 3438169 - RNA, 13 nt, Human
ccugcugaccugu

SEQ ID NO: 3438170 - RNA, 18 nt, Human
ccugcugagcucugagag

SEQ ID NO: 3438171 - RNA, 24 nt, Human
ccugcugagcucugagaggcccug

SEQ ID NO: 3438172 - RNA, 21 nt, Human
ccugcugagggaccagccaag

SEQ ID NO: 3438173 - RNA, 20 nt, Human
ccugcugagucccaggcuga

SEQ ID NO: 3438174 - RNA, 17 nt, Human
ccugcugauguggcaac

SEQ ID NO: 3438175 - RNA, 21 nt, Human
ccugcugauguggcaacugcu

SEQ ID NO: 3438176 - RNA, 12 nt, Human
ccugcugcacca

SEQ ID NO: 3438177 - RNA, 18 nt, Human
ccugcugcaccaacccag

SEQ ID NO: 3438178 - RNA, 20 nt, Human
ccugcugcaccaacccagcc

SEQ ID NO: 3438179 - RNA, 21 nt, Human
ccugcugcaccaacccagccg

SEQ ID NO: 3438180 - RNA, 14 nt, Human
ccugcugcagaggg

SEQ ID NO: 3438181 - RNA, 16 nt, Human
ccugcugcagaggggc

SEQ ID NO: 3438182 - RNA, 15 nt, Human
ccugcugcaggggcu

SEQ ID NO: 3438183 - RNA, 17 nt, Human
ccugcugcaggggcucu

SEQ ID NO: 3438184 - RNA, 21 nt, Human
ccugcugcaguugccagucac

SEQ ID NO: 3438185 - RNA, 16 nt, Human
ccugcugcaugcccuc

SEQ ID NO: 3438186 - RNA, 23 nt, Human
ccugcugcaugcccucucaggcc

SEQ ID NO: 3438187 - RNA, 20 nt, Human
ccugcugccuccccaacccu

SEQ ID NO: 3438188 - RNA, 23 nt, Human
ccugcugccuccccaacccugcc

SEQ ID NO: 3438189 - RNA, 22 nt, Human
ccugcugccuucugacggcccu

SEQ ID NO: 3438190 - RNA, 17 nt, Human
ccugcugcucccucaga

SEQ ID NO: 3438191 - RNA, 13 nt, Human
ccugcugcuccua

SEQ ID NO: 3438192 - RNA, 15 nt, Human
ccugcugcuccuagg

SEQ ID NO: 3438193 - RNA, 20 nt, Human
ccugcugcugacccagccug

SEQ ID NO: 3438194 - RNA, 15 nt, Human
ccugcugcugagaac

SEQ ID NO: 3438195 - RNA, 22 nt, Human
ccugcugcugagaaccuggccu

SEQ ID NO: 3438196 - RNA, 15 nt, Human
ccugcugcuggugca

SEQ ID NO: 3438197 - RNA, 22 nt, Human
ccugcugcugucaccucuccca

SEQ ID NO: 3438198 - RNA, 19 nt, Human
ccugcugcugucugggugc

SEQ ID NO: 3438199 - RNA, 12 nt, Human
ccugcugcuucu

SEQ ID NO: 3438200 - RNA, 12 nt, Human
ccugcuggaagc

SEQ ID NO: 3438201 - RNA, 13 nt, Human
ccugcuggaagcc

SEQ ID NO: 3438202 - RNA, 14 nt, Human
ccugcuggaagccc

SEQ ID NO: 3438203 - RNA, 16 nt, Human
ccugcuggaagcccag

SEQ ID NO: 3438204 - RNA, 12 nt, Human
ccugcuggaggc

SEQ ID NO: 3438205 - RNA, 13 nt, Human
ccugcuggaggcc

SEQ ID NO: 3438206 - RNA, 15 nt, Human
ccugcuggaggccuc

SEQ ID NO: 3438207 - RNA, 17 nt, Human
ccugcuggaggccucag

SEQ ID NO: 3438208 - RNA, 21 nt, Human
ccugcuggaggccucaggugc

SEQ ID NO: 3438209 - RNA, 13 nt, Human
ccugcuggaucuc

SEQ ID NO: 3438210 - RNA, 15 nt, Human
ccugcuggaucuccc

SEQ ID NO: 3438211 - RNA, 22 nt, Human
ccugcuggaucucccagggcua

SEQ ID NO: 3438212 - RNA, 15 nt, Human
ccugcuggccccuca

SEQ ID NO: 3438213 - RNA, 17 nt, Human
ccugcuggcucuucugc

SEQ ID NO: 3438214 - RNA, 19 nt, Human
ccugcuggcucuucugccc

SEQ ID NO: 3438215 - RNA, 12 nt, Human
ccugcugggcuc

SEQ ID NO: 3438216 - RNA, 23 nt, Human
ccuguagagugggagcugagugg

SEQ ID NO: 3438217 - RNA, 13 nt, Human
ccuguagcaguga

SEQ ID NO: 3438218 - RNA, 13 nt, Human
ccuguagcaucuu

SEQ ID NO: 3438219 - RNA, 15 nt, Human
ccuguagcaucuucu

SEQ ID NO: 3438220 - RNA, 23 nt, Human
ccuguagcccacucugcucgccu

SEQ ID NO: 3438221 - RNA, 24 nt, Human
ccuguagcccacucugcucgccuu

SEQ ID NO: 3438222 - RNA, 22 nt, Human
ccuguagccccagugacagcua

SEQ ID NO: 3438223 - RNA, 19 nt, Human
ccuguagccuucuguagga

SEQ ID NO: 3438224 - RNA, 14 nt, Human
ccuguagucccagc

SEQ ID NO: 3438225 - RNA, 18 nt, Human
ccuguagucccagccacu

SEQ ID NO: 3438226 - RNA, 13 nt, Human
ccuguaguccuag

SEQ ID NO: 3438227 - RNA, 15 nt, Human
ccuguaguuaggaaa

SEQ ID NO: 3438228 - RNA, 22 nt, Human
ccuguaguuaggaaauaaaacc

SEQ ID NO: 3438229 - RNA, 23 nt, Human
ccuguaguuaggaaauaaaaccu

SEQ ID NO: 3438230 - RNA, 20 nt, Human
ccuguaguugcguggacucu

SEQ ID NO: 3438231 - RNA, 17 nt, Human
ccuguaguuuuauuuua

SEQ ID NO: 3438232 - RNA, 13 nt, Human
ccuguauaagcac

SEQ ID NO: 3438233 - RNA, 23 nt, Human
ccuguauaaguggaggcacuuua

SEQ ID NO: 3438234 - RNA, 14 nt, Human
ccuguauacagugc

SEQ ID NO: 3438235 - RNA, 12 nt, Human
ccuguauacuuu

SEQ ID NO: 3438236 - RNA, 13 nt, Human
ccuguauacuuua

SEQ ID NO: 3438237 - RNA, 23 nt, Human
ccuguauauagcccagccaggcc

SEQ ID NO: 3438238 - RNA, 20 nt, Human
ccuguauauuuguaaagcua

SEQ ID NO: 3438239 - RNA, 22 nt, Human
ccuguaugucaauaaacaacag

SEQ ID NO: 3438240 - RNA, 16 nt, Human
ccuguaugucugucau

SEQ ID NO: 3438241 - RNA, 19 nt, Human
ccuguaugucugucauugu

SEQ ID NO: 3438242 - RNA, 16 nt, Human
ccuguauucagacaga

SEQ ID NO: 3438243 - RNA, 22 nt, Human
ccuguauucucaaacacaguua

SEQ ID NO: 3438244 - RNA, 18 nt, Human
ccuguauuuaaaaauaga

SEQ ID NO: 3438245 - RNA, 14 nt, Human
ccuguauuuaagca

SEQ ID NO: 3438246 - RNA, 19 nt, Human
ccuguauuuaagcaaauac

SEQ ID NO: 3438247 - RNA, 19 nt, Human
ccuguauuuguucccaaga

SEQ ID NO: 3438248 - RNA, 22 nt, Human
ccuguauuuguucccaagagca

SEQ ID NO: 3438249 - RNA, 17 nt, Human
ccuguauuuucuuucuc

SEQ ID NO: 3438250 - RNA, 18 nt, Human
ccugucaaacaaagccag

SEQ ID NO: 3438251 - RNA, 19 nt, Human
ccugucaaacaaagccaga

SEQ ID NO: 3438252 - RNA, 22 nt, Human
ccugucaaacaaagccagaagc

SEQ ID NO: 3438253 - RNA, 23 nt, Human
ccugucaaacaaagccagaagcu

SEQ ID NO: 3438254 - RNA, 21 nt, Human
ccugucacauugcauucuauu

SEQ ID NO: 3438255 - RNA, 14 nt, Human
ccugucaccaagcu

SEQ ID NO: 3438256 - RNA, 12 nt, Human
ccugucaccucu

SEQ ID NO: 3438257 - RNA, 12 nt, Human
ccugucagcaug

SEQ ID NO: 3438258 - RNA, 13 nt, Human
ccugucagcauga

SEQ ID NO: 3438259 - RNA, 17 nt, Human
ccugucagcaugaauuu

SEQ ID NO: 3438260 - RNA, 14 nt, Human
ccugucagugcagc

SEQ ID NO: 3438261 - RNA, 20 nt, Human
caugauggcaacagaucugg

SEQ ID NO: 3438262 - RNA, 23 nt, Human
caugaugguuauuuucuuuucuu

SEQ ID NO: 3438263 - RNA, 17 nt, Human
caugauguuucuuccac

SEQ ID NO: 3438264 - RNA, 17 nt, Human
caugauguuugcccaaa

SEQ ID NO: 3438265 - RNA, 20 nt, Human
caugauguuuuuaaaaucuu

SEQ ID NO: 3438266 - RNA, 21 nt, Human
caugauuagcagaagaaagga

SEQ ID NO: 3438267 - RNA, 22 nt, Human
caugauuagcagaagaaaggaa

SEQ ID NO: 3438268 - RNA, 13 nt, Human
caugauucauuuu

SEQ ID NO: 3438269 - RNA, 14 nt, Human
caugauuccuuccu

SEQ ID NO: 3438270 - RNA, 21 nt, Human
caugauucgcccaaagccaga

SEQ ID NO: 3438271 - RNA, 14 nt, Human
caugauucuauuua

SEQ ID NO: 3438272 - RNA, 20 nt, Human
caugauugcagaauuguuua

SEQ ID NO: 3438273 - RNA, 15 nt, Human
caugauuucacaaau

SEQ ID NO: 3438274 - RNA, 22 nt, Human
caugauuuuaaguuucucugca

SEQ ID NO: 3438275 - RNA, 16 nt, Human
caugcaaaauauguuu

SEQ ID NO: 3438276 - RNA, 17 nt, Human
caugcaaaauauguuua

SEQ ID NO: 3438277 - RNA, 22 nt, Human
caugcaaaugagcucugaaauc

SEQ ID NO: 3438278 - RNA, 14 nt, Human
caugcaaaugcugu

SEQ ID NO: 3438279 - RNA, 22 nt, Human
caugcaaaugcuguauucuucu

SEQ ID NO: 3438280 - RNA, 20 nt, Human
caugcaagaacucaucacug

SEQ ID NO: 3438281 - RNA, 14 nt, Human
caugcaagcagagg

SEQ ID NO: 3438282 - RNA, 17 nt, Human
caugcaagcagaggacc

SEQ ID NO: 3438283 - RNA, 23 nt, Human
caugcaagggaugaauuguaaaa

SEQ ID NO: 3438284 - RNA, 14 nt, Human
caugcaaggggaaa

SEQ ID NO: 3438285 - RNA, 16 nt, Human
caugcaauacauacca

SEQ ID NO: 3438286 - RNA, 17 nt, Human
caugcaauucaucccag

SEQ ID NO: 3438287 - RNA, 12 nt, Human
caugcacaaauu

SEQ ID NO: 3438288 - RNA, 14 nt, Human
caugcacacucaug

SEQ ID NO: 3438289 - RNA, 19 nt, Human
caugcacacucaugugcaa

SEQ ID NO: 3438290 - RNA, 14 nt, Human
caugcacagcugua

SEQ ID NO: 3438291 - RNA, 14 nt, Human
caugcacaguauuu

SEQ ID NO: 3438292 - RNA, 19 nt, Human
caugcaccugcaaucccag

SEQ ID NO: 3438293 - RNA, 20 nt, Human
caugcaccugcaaucccagc

SEQ ID NO: 3438294 - RNA, 16 nt, Human
caugcacucagcucuu

SEQ ID NO: 3438295 - RNA, 12 nt, Human
caugcacugacc

SEQ ID NO: 3438296 - RNA, 19 nt, Human
caugcacugacccuuccag

SEQ ID NO: 3438297 - RNA, 22 nt, Human
caugcacugacccuuccagaca

SEQ ID NO: 3438298 - RNA, 14 nt, Human
caugcacugauguu

SEQ ID NO: 3438299 - RNA, 13 nt, Human
caugcacugugaa

SEQ ID NO: 3438300 - RNA, 14 nt, Human
caugcacugugaag

SEQ ID NO: 3438301 - RNA, 16 nt, Human
caugcacugugaagga

SEQ ID NO: 3438302 - RNA, 20 nt, Human
caugcacugugaaggacccu

SEQ ID NO: 3438303 - RNA, 16 nt, Human
caugcacuuaaagaag

SEQ ID NO: 3438304 - RNA, 20 nt, Human
caugcagaacaaaugaagac

SEQ ID NO: 3438305 - RNA, 19 nt, Human
caugcagacaugagugcgu

SEQ ID NO: 3438306 - RNA, 13 nt, Human
caugcagagcgcc

SEQ ID NO: 3438307 - RNA, 13 nt, Human
caugcagcagcuu

SEQ ID NO: 3438308 - RNA, 16 nt, Human
caugcagcagcuugcu

SEQ ID NO: 3438309 - RNA, 17 nt, Human
caugcagcagcuugcug

SEQ ID NO: 3438310 - RNA, 14 nt, Human
caugcagcaucuaa

SEQ ID NO: 3438311 - RNA, 20 nt, Human
caugcagcccaugcccaccu

SEQ ID NO: 3438312 - RNA, 23 nt, Human
caugcagcccaugcccaccugcc

SEQ ID NO: 3438313 - RNA, 15 nt, Human
caugcagccgugauc

SEQ ID NO: 3438314 - RNA, 21 nt, Human
caugcagccgugaucaaggga

SEQ ID NO: 3438315 - RNA, 20 nt, Human
caugcagcugcacccucccu

SEQ ID NO: 3438316 - RNA, 18 nt, Human
caugcagggggcuccugg

SEQ ID NO: 3438317 - RNA, 19 nt, Human
caugcagggggcuccuggg

SEQ ID NO: 3438318 - RNA, 12 nt, Human
caugcaguuuga

SEQ ID NO: 3438319 - RNA, 20 nt, Human
caugcaguuugaaauucuga

SEQ ID NO: 3438320 - RNA, 12 nt, Human
caugcauaaaua

SEQ ID NO: 3438321 - RNA, 16 nt, Human
caugcauacacacaca

SEQ ID NO: 3438322 - RNA, 15 nt, Human
caugcauacuucaaa

SEQ ID NO: 3438323 - RNA, 16 nt, Human
caugcauacuucaaaa

SEQ ID NO: 3438324 - RNA, 14 nt, Human
caugcauauaauga

SEQ ID NO: 3438325 - RNA, 18 nt, Human
caugcauauaaugaauaa

SEQ ID NO: 3438326 - RNA, 20 nt, Human
caugcauauaaugaauaaau

SEQ ID NO: 3438327 - RNA, 22 nt, Human
caugcauauaaugaauaaauca

SEQ ID NO: 3438328 - RNA, 22 nt, Human
caugcaucuguuuauucuauag

SEQ ID NO: 3438329 - RNA, 14 nt, Human
caugcaucuuacug

SEQ ID NO: 3438330 - RNA, 15 nt, Human
caugcaugacagccu

SEQ ID NO: 3438331 - RNA, 19 nt, Human
caugcaugcaaaugagcuc

SEQ ID NO: 3438332 - RNA, 16 nt, Human
caugcauguccuguaa

SEQ ID NO: 3438333 - RNA, 20 nt, Human
caugcauuacugcaugcacu

SEQ ID NO: 3438334 - RNA, 22 nt, Human
caugcauuguugagguggucug

SEQ ID NO: 3438335 - RNA, 20 nt, Human
caugcauuuugcagcaguga

SEQ ID NO: 3438336 - RNA, 22 nt, Human
caugccaacaagaaugcauuga

SEQ ID NO: 3438337 - RNA, 21 nt, Human
caugccagcuacuuccuccuc

SEQ ID NO: 3438338 - RNA, 13 nt, Human
caugccagcuggc

SEQ ID NO: 3438339 - RNA, 16 nt, Human
caugccagcuggccuu

SEQ ID NO: 3438340 - RNA, 18 nt, Human
caugccaggcuaauuuuu

SEQ ID NO: 3438341 - RNA, 14 nt, Human
caugccaggggccu

SEQ ID NO: 3438342 - RNA, 19 nt, Human
caugccaguaacaggcuca

SEQ ID NO: 3438343 - RNA, 17 nt, Human
caugccauuuguacuga

SEQ ID NO: 3438344 - RNA, 16 nt, Human
caugcccacccccugc

SEQ ID NO: 3438345 - RNA, 17 nt, Human
caugcccacccccugcc

SEQ ID NO: 3438346 - RNA, 19 nt, Human
caugcccacccccugcccu

SEQ ID NO: 3438347 - RNA, 13 nt, Human
caugcccaccugc

SEQ ID NO: 3438348 - RNA, 16 nt, Human
caugcccaccugccca

SEQ ID NO: 3438349 - RNA, 17 nt, Human
caugcccaccugcccau

SEQ ID NO: 3438350 - RNA, 16 nt, Human
caugcccagagaccca

SEQ ID NO: 3438351 - RNA, 19 nt, Human
caugcccagagacccagcg

SEQ ID NO: 3438352 - RNA, 17 nt, Human
caugcccauauuuuacu

SEQ ID NO: 3438353 - RNA, 18 nt, Human
caugccccggccaccucu

SEQ ID NO: 3438354 - RNA, 20 nt, Human
caugccccggccaccucugc

SEQ ID NO: 3438355 - RNA, 21 nt, Human
caugccccggccaccucugcg

SEQ ID NO: 3438356 - RNA, 16 nt, Human
caugccccuggcuggg

SEQ ID NO: 3438357 - RNA, 21 nt, Human
caugcccggcuaauuuuugua

SEQ ID NO: 3438358 - RNA, 20 nt, Human
caugcccggucccaccccuc

SEQ ID NO: 3438359 - RNA, 20 nt, Human
caugcccucccuucucccug

SEQ ID NO: 3438360 - RNA, 23 nt, Human
caugcccucccuucucccuggau

SEQ ID NO: 3438361 - RNA, 13 nt, Human
caugcccuccucu

SEQ ID NO: 3438362 - RNA, 20 nt, Human
caugcccuccucucccauug

SEQ ID NO: 3438363 - RNA, 15 nt, Human
caugcccucucaggc

SEQ ID NO: 3438364 - RNA, 19 nt, Human
caugcccugugcaaccucu

SEQ ID NO: 3438365 - RNA, 15 nt, Human
caugccgggugcagc

SEQ ID NO: 3438366 - RNA, 16 nt, Human
caugccucagaagugc

SEQ ID NO: 3438367 - RNA, 11 nt, Human
caugccucagc

SEQ ID NO: 3438368 - RNA, 16 nt, Human
caugccucagcccuga

SEQ ID NO: 3438369 - RNA, 15 nt, Human
caugccuccucagga

SEQ ID NO: 3438370 - RNA, 19 nt, Human
caugccucucucaggccaa

SEQ ID NO: 3438371 - RNA, 21 nt, Human
caugccugagagacauggcuu

SEQ ID NO: 3438372 - RNA, 21 nt, Human
caugccuggauggggcugcac

SEQ ID NO: 3438373 - RNA, 13 nt, Human
caugccuggcuuc

SEQ ID NO: 3438374 - RNA, 14 nt, Human
caugccuguggcug

SEQ ID NO: 3438375 - RNA, 23 nt, Human
caugccugugugacaucaguggc

SEQ ID NO: 3438376 - RNA, 19 nt, Human
caugccuuccagcacccug

SEQ ID NO: 3438377 - RNA, 20 nt, Human
caugccuugugcuguuaaua

SEQ ID NO: 3438378 - RNA, 13 nt, Human
caugccuuuguaa

SEQ ID NO: 3438379 - RNA, 23 nt, Human
caugcgcccccuccgcccugcca

SEQ ID NO: 3438380 - RNA, 23 nt, Human
ccuggcacagugucugggcugac

SEQ ID NO: 3438381 - RNA, 21 nt, Human
ccuggcacccggccccugcug

SEQ ID NO: 3438382 - RNA, 23 nt, Human
ccuggcacccggccccugcuggu

SEQ ID NO: 3438383 - RNA, 22 nt, Human
ccuggcacgguggcucaggccu

SEQ ID NO: 3438384 - RNA, 22 nt, Human
ccuggcacuauaauguaagcuc

SEQ ID NO: 3438385 - RNA, 13 nt, Human
ccuggcacugcuu

SEQ ID NO: 3438386 - RNA, 16 nt, Human
ccuggcacugcuucca

SEQ ID NO: 3438387 - RNA, 20 nt, Human
ccuggcacugcuuccaguga

SEQ ID NO: 3438388 - RNA, 12 nt, Human
ccuggcacugga

SEQ ID NO: 3438389 - RNA, 16 nt, Human
ccuggcacuggacccc

SEQ ID NO: 3438390 - RNA, 14 nt, Human
ccuggcagcccaga

SEQ ID NO: 3438391 - RNA, 12 nt, Human
ccuggcagccgu

SEQ ID NO: 3438392 - RNA, 22 nt, Human
ccuggcagccgugccuucagcu

SEQ ID NO: 3438393 - RNA, 14 nt, Human
ccuggcagcucagc

SEQ ID NO: 3438394 - RNA, 21 nt, Human
ccuggcagcucuggacagccc

SEQ ID NO: 3438395 - RNA, 22 nt, Human
ccuggcaggaugacccugcgaa

SEQ ID NO: 3438396 - RNA, 12 nt, Human
ccuggcaggcag

SEQ ID NO: 3438397 - RNA, 14 nt, Human
ccuggcaggcaggg

SEQ ID NO: 3438398 - RNA, 21 nt, Human
ccuggcaggcugucuggccag

SEQ ID NO: 3438399 - RNA, 20 nt, Human
ccuggcagggaggucaggcc

SEQ ID NO: 3438400 - RNA, 22 nt, Human
ccuggcagggaggucaggcccu

SEQ ID NO: 3438401 - RNA, 21 nt, Human
ccuggcagguuagaaccuaga

SEQ ID NO: 3438402 - RNA, 21 nt, Human
ccuggcagguuguuagaaaaa

SEQ ID NO: 3438403 - RNA, 23 nt, Human
ccuggcaucgcaccauucugacu

SEQ ID NO: 3438404 - RNA, 14 nt, Human
ccuggcaugggaau

SEQ ID NO: 3438405 - RNA, 11 nt, Human
ccuuuccuguc

SEQ ID NO: 3438406 - RNA, 14 nt, Human
ccuuuccuguccca

SEQ ID NO: 3438407 - RNA, 24 nt, Human
ccuuuccuguguguacucugucca

SEQ ID NO: 3438408 - RNA, 11 nt, Human
ccuuuccuguu

SEQ ID NO: 3438409 - RNA, 15 nt, Human
ccuuuccuguucagc

SEQ ID NO: 3438410 - RNA, 12 nt, Human
ccuuuccuuccu

SEQ ID NO: 3438411 - RNA, 13 nt, Human
ccuuuccuuccua

SEQ ID NO: 3438412 - RNA, 21 nt, Human
ccuuuccuuccuucccuggcu

SEQ ID NO: 3438413 - RNA, 14 nt, Human
ccuuucgaggccug

SEQ ID NO: 3438414 - RNA, 15 nt, Human
ccuuucgaggccuga

SEQ ID NO: 3438415 - RNA, 17 nt, Human
ccuuucggauccaggga

SEQ ID NO: 3438416 - RNA, 21 nt, Human
ccuuucggauccagggaggcu

SEQ ID NO: 3438417 - RNA, 18 nt, Human
ccuuucuaucguucucuc

SEQ ID NO: 3438418 - RNA, 18 nt, Human
ccuuucuccagccagcaa

SEQ ID NO: 3438419 - RNA, 17 nt, Human
ccuuucucccaggccag

SEQ ID NO: 3438420 - RNA, 18 nt, Human
ccuuucuccccugccccc

SEQ ID NO: 3438421 - RNA, 14 nt, Human
ccuuucuccuuugu

SEQ ID NO: 3438422 - RNA, 15 nt, Human
ccuuucuccuuugua

SEQ ID NO: 3438423 - RNA, 17 nt, Human
ccuuucucgauuuuauc

SEQ ID NO: 3438424 - RNA, 16 nt, Human
ccuuucucuuucucuc

SEQ ID NO: 3438425 - RNA, 18 nt, Human
ccuuucucuuucucucuu

SEQ ID NO: 3438426 - RNA, 22 nt, Human
ccuuucucuuucucucuucccu

SEQ ID NO: 3438427 - RNA, 16 nt, Human
ccuuucugaucuucac

SEQ ID NO: 3438428 - RNA, 15 nt, Human
ccuuucugccgaccc

SEQ ID NO: 3438429 - RNA, 17 nt, Human
ccuuucugccgaccccu

SEQ ID NO: 3438430 - RNA, 19 nt, Human
ccuuucuggcagguccucc

SEQ ID NO: 3438431 - RNA, 16 nt, Human
ccuuucuguaccauuu

SEQ ID NO: 3438432 - RNA, 14 nt, Human
ccuuucugugcccu

SEQ ID NO: 3438433 - RNA, 11 nt, Human
ccuuucuuccu

SEQ ID NO: 3438434 - RNA, 12 nt, Human
ccuuucuuccuc

SEQ ID NO: 3438435 - RNA, 13 nt, Human
ccuguguggagag

SEQ ID NO: 3438436 - RNA, 16 nt, Human
ccuguguggagaggga

SEQ ID NO: 3438437 - RNA, 19 nt, Human
ccuguguggagagggaaug

SEQ ID NO: 3438438 - RNA, 20 nt, Human
ccugugugguuuaguguaaa

SEQ ID NO: 3438439 - RNA, 21 nt, Human
ccugugugugaaaggaagcuc

SEQ ID NO: 3438440 - RNA, 19 nt, Human
ccuguguuucuugccucau

SEQ ID NO: 3438441 - RNA, 20 nt, Human
ccuguuaaaagaugaaaaua

SEQ ID NO: 3438442 - RNA, 22 nt, Human
ccuguuaccuaauuagagcaga

SEQ ID NO: 3438443 - RNA, 14 nt, Human
ccuguuacuuaccu

SEQ ID NO: 3438444 - RNA, 22 nt, Human
ccuguuagcuccucacuguggu

SEQ ID NO: 3438445 - RNA, 13 nt, Human
ccuguuauuuuca

SEQ ID NO: 3438446 - RNA, 14 nt, Human
ccuguucacaccag

SEQ ID NO: 3438447 - RNA, 16 nt, Human
ccuguucagcuccagc

SEQ ID NO: 3438448 - RNA, 19 nt, Human
ccuguucagcuccagcuca

SEQ ID NO: 3438449 - RNA, 19 nt, Human
ccuguucagugucccgggc

SEQ ID NO: 3438450 - RNA, 11 nt, Human
ccuguucaguu

SEQ ID NO: 3438451 - RNA, 19 nt, Human
ccuguucaguuacagaaag

SEQ ID NO: 3438452 - RNA, 22 nt, Human
ccuguucaugccgacgcuugca

SEQ ID NO: 3438453 - RNA, 12 nt, Human
ccuguuccccuc

SEQ ID NO: 3438454 - RNA, 17 nt, Human
ccuguuccccucacugg

SEQ ID NO: 3438455 - RNA, 13 nt, Human
ccuguuccccucu

SEQ ID NO: 3438456 - RNA, 16 nt, Human
ccuguuccccucuccc

SEQ ID NO: 3438457 - RNA, 17 nt, Human
ccuguuccccucucccu

SEQ ID NO: 3438458 - RNA, 14 nt, Human
ccuguucugaacug

SEQ ID NO: 3438459 - RNA, 17 nt, Human
ccuguucuggcagaguu

SEQ ID NO: 3438460 - RNA, 22 nt, Human
ccuguugaaaagccauguuuaa

SEQ ID NO: 3438461 - RNA, 20 nt, Human
ccuguugacgaagucucuuu

SEQ ID NO: 3438462 - RNA, 22 nt, Human
ccuguugauuaauuucugccau

SEQ ID NO: 3438463 - RNA, 13 nt, Human
ccuguugcuaagc

SEQ ID NO: 3438464 - RNA, 12 nt, Human
ccuguugcuuuu

SEQ ID NO: 3438465 - RNA, 23 nt, Human
ccuguuggacccgcucuggacca

SEQ ID NO: 3438466 - RNA, 20 nt, Human
ccuguugggccaggagccuc

SEQ ID NO: 3438467 - RNA, 16 nt, Human
ccuguuuaaaaaacca

SEQ ID NO: 3438468 - RNA, 15 nt, Human
ccuguuuaagagaca

SEQ ID NO: 3438469 - RNA, 16 nt, Human
ccuguuuaauauuuaa

SEQ ID NO: 3438470 - RNA, 21 nt, Human
ccuguuuauucauaugcauau

SEQ ID NO: 3438471 - RNA, 23 nt, Human
ccuguuucaaguucacaccugca

SEQ ID NO: 3438472 - RNA, 15 nt, Human
ccuguuucccaggcc

SEQ ID NO: 3438473 - RNA, 13 nt, Human
ccuguuucugaaa

SEQ ID NO: 3438474 - RNA, 19 nt, Human
ccuguuucugaaaagaaau

SEQ ID NO: 3438475 - RNA, 12 nt, Human
ccuguuucuucc

SEQ ID NO: 3438476 - RNA, 13 nt, Human
ccuguuuggauuu

SEQ ID NO: 3438477 - RNA, 22 nt, Human
ccuguuugggaagagcuuagaa

SEQ ID NO: 3438478 - RNA, 21 nt, Human
ccuguuugggccccucuccca

SEQ ID NO: 3438479 - RNA, 13 nt, Human
ccuguuuucugag

SEQ ID NO: 3438480 - RNA, 17 nt, Human
ccuguuuucugagcccg

SEQ ID NO: 3438481 - RNA, 16 nt, Human
ccuguuuugagcccug

SEQ ID NO: 3438482 - RNA, 18 nt, Human
ccuguuuuuaagcuguuu

SEQ ID NO: 3438483 - RNA, 19 nt, Human
ccuguuuuuaagcuguuuc

SEQ ID NO: 3438484 - RNA, 20 nt, Human
ccuguuuuucacauuuuccu

SEQ ID NO: 3438485 - RNA, 16 nt, Human
ccuguuuuucugggug

SEQ ID NO: 3438486 - RNA, 13 nt, Human
ccuuaaaaaucac

SEQ ID NO: 3438487 - RNA, 13 nt, Human
ccuuaaaacuagg

SEQ ID NO: 3438488 - RNA, 23 nt, Human
ccuuaaaacuaggcauuuguaaa

SEQ ID NO: 3438489 - RNA, 19 nt, Human
ccuuaaaagccaucaugua

SEQ ID NO: 3438490 - RNA, 18 nt, Human
ccuuaaaauuugaaacau

SEQ ID NO: 3438491 - RNA, 23 nt, Human
ccuuaaacagggcaucuccagga

SEQ ID NO: 3438492 - RNA, 19 nt, Human
ccuuaaacaguugcacagc

SEQ ID NO: 3438493 - RNA, 16 nt, Human
ccuuaacaguuguauu

SEQ ID NO: 3438494 - RNA, 15 nt, Human
ccuuaacccaaggag

SEQ ID NO: 3438495 - RNA, 20 nt, Human
ccuuaacccaaggagcacag

SEQ ID NO: 3438496 - RNA, 23 nt, Human
ccuuaacuggagccccaucagcu

SEQ ID NO: 3438497 - RNA, 19 nt, Human
ccuuaagaacacaaagcgg

SEQ ID NO: 3438498 - RNA, 14 nt, Human
ccuuaagcccuggc

SEQ ID NO: 3438499 - RNA, 13 nt, Human
ccuuaaggcucuu

SEQ ID NO: 3438500 - RNA, 16 nt, Human
ccuuaaggcucuuuug

SEQ ID NO: 3438501 - RNA, 18 nt, Human
ccuuaaggcucuuuugua

SEQ ID NO: 3438502 - RNA, 19 nt, Human
ccuuaagugaggaaaucaa

SEQ ID NO: 3438503 - RNA, 20 nt, Human
ccuuaagugaggaaaucaaa

SEQ ID NO: 3438504 - RNA, 19 nt, Human
ccuuaauauuucuucaaau

SEQ ID NO: 3438505 - RNA, 23 nt, Human
ccuuaaucagguccucagagaau

SEQ ID NO: 3438506 - RNA, 13 nt, Human
ccuuaauuacuua

SEQ ID NO: 3438507 - RNA, 17 nt, Human
ccuuaauucacucccac

SEQ ID NO: 3438508 - RNA, 23 nt, Human
ccuuaauuuccuuuuugacacug

SEQ ID NO: 3438509 - RNA, 17 nt, Human
ccuuacaaaugauugcu

SEQ ID NO: 3438510 - RNA, 21 nt, Human
ccuuacaaaugauugcuuuua

SEQ ID NO: 3438511 - RNA, 14 nt, Human
ccuuacacaauggu

SEQ ID NO: 3438512 - RNA, 22 nt, Human
ccuuacaccucguuagggaaga

SEQ ID NO: 3438513 - RNA, 22 nt, Human
ccuuacacguaccucucaucag

SEQ ID NO: 3438514 - RNA, 13 nt, Human
ccuuacacuuacu

SEQ ID NO: 3438515 - RNA, 16 nt, Human
ccuuacacuuacuguu

SEQ ID NO: 3438516 - RNA, 18 nt, Human
ccuuacagccucugacuu

SEQ ID NO: 3438517 - RNA, 21 nt, Human
ccuuacaguaggagcccagcu

SEQ ID NO: 3438518 - RNA, 15 nt, Human
ccuuaccaacuuucu

SEQ ID NO: 3438519 - RNA, 13 nt, Human
ccuuaccagcaga

SEQ ID NO: 3438520 - RNA, 16 nt, Human
ccuuaccagcagagca

SEQ ID NO: 3438521 - RNA, 15 nt, Human
ccuuaccaugugccu

SEQ ID NO: 3438522 - RNA, 21 nt, Human
ccuuaccaugugccugaucca

SEQ ID NO: 3438523 - RNA, 23 nt, Human
ccuuaccccacaacgugcaacug

SEQ ID NO: 3438524 - RNA, 19 nt, Human
ccuuaccccaguuuuuuga

SEQ ID NO: 3438525 - RNA, 13 nt, Human
ccuuaccccugcc

SEQ ID NO: 3438526 - RNA, 15 nt, Human
ccuuacccucauguu

SEQ ID NO: 3438527 - RNA, 21 nt, Human
ccuuacccugccccagcuggg

SEQ ID NO: 3438528 - RNA, 13 nt, Human
ccuuacccuggga

SEQ ID NO: 3438529 - RNA, 20 nt, Human
ccuuaccuccugcccaggag

SEQ ID NO: 3438530 - RNA, 20 nt, Human
ccuuaccucggugccuuccu

SEQ ID NO: 3438531 - RNA, 14 nt, Human
ccuuaccugccagg

SEQ ID NO: 3438532 - RNA, 18 nt, Human
ccuuacgaucaggcacag

SEQ ID NO: 3438533 - RNA, 14 nt, Human
ccuuacuaauuaua

SEQ ID NO: 3438534 - RNA, 14 nt, Human
ccuuacuccugugg

SEQ ID NO: 3438535 - RNA, 19 nt, Human
ccuuacuccugugggagcc

SEQ ID NO: 3438536 - RNA, 20 nt, Human
ccuuacuccugugggagccu

SEQ ID NO: 3438537 - RNA, 17 nt, Human
ccuuacucuucuugaaa

SEQ ID NO: 3438538 - RNA, 16 nt, Human
ccuuacuucuugcccu

SEQ ID NO: 3438539 - RNA, 17 nt, Human
ccuuacuuuuuauauau

SEQ ID NO: 3438540 - RNA, 19 nt, Human
ccuuagaaauguaaacugc

SEQ ID NO: 3438541 - RNA, 21 nt, Human
ccuuagaaauguaaacugcca

SEQ ID NO: 3438542 - RNA, 23 nt, Human
ccuuagaaauguaaacugccaua

SEQ ID NO: 3438543 - RNA, 18 nt, Human
ccuuagaaccuuucuuac

SEQ ID NO: 3438544 - RNA, 21 nt, Human
ccuuagaagguauuaagauua

SEQ ID NO: 3438545 - RNA, 17 nt, Human
ccuuagaagucacacag

SEQ ID NO: 3438546 - RNA, 14 nt, Human
ccuuagaaguggaa

SEQ ID NO: 3438547 - RNA, 18 nt, Human
ccuuagacagucccugcc

SEQ ID NO: 3438548 - RNA, 21 nt, Human
ccuuagacagucccugccaau

SEQ ID NO: 3438549 - RNA, 17 nt, Human
ccuuagagccaggcaca

SEQ ID NO: 3438550 - RNA, 18 nt, Human
ccuuuuuuaagauuuuuc

SEQ ID NO: 3438551 - RNA, 19 nt, Human
ccuuuuuuaagauuuuucu

SEQ ID NO: 3438552 - RNA, 20 nt, Human
ccuuuuuuaagauuuuucuc

SEQ ID NO: 3438553 - RNA, 21 nt, Human
ccuuuuuuagaguugauacua

SEQ ID NO: 3438554 - RNA, 12 nt, Human
ccuuuuuuauac

SEQ ID NO: 3438555 - RNA, 17 nt, Human
ccuuuuuuauacauaaa

SEQ ID NO: 3438556 - RNA, 22 nt, Human
ccuuuuuuauaucuuggcaggu

SEQ ID NO: 3438557 - RNA, 12 nt, Human
ccuuuuuucaaa

SEQ ID NO: 3438558 - RNA, 18 nt, Human
ccuuuuuuccuuuccacc

SEQ ID NO: 3438559 - RNA, 13 nt, Human
ccuuuuuugauca

SEQ ID NO: 3438560 - RNA, 14 nt, Human
ccuuuuuuguaguu

SEQ ID NO: 3438561 - RNA, 23 nt, Human
ccuuuuuuguuuuuucaaaauag

SEQ ID NO: 3438562 - RNA, 14 nt, Human
ccuuuuuuuccuuu

SEQ ID NO: 3438563 - RNA, 16 nt, Human
ccuuuuuuuccuuuuu

SEQ ID NO: 3438564 - RNA, 20 nt, Human
ccuuuuuuugauauaugaaa

SEQ ID NO: 3438565 - RNA, 17 nt, Human
ccuuuuuuuuuuuucca

SEQ ID NO: 3438566 - RNA, 18 nt, Human
cgaaaacguggcugcuuc

SEQ ID NO: 3438567 - RNA, 22 nt, Human
cgaaaaguuggugucaaugaau

SEQ ID NO: 3438568 - RNA, 17 nt, Human
cgaaacacagaaaccuu

SEQ ID NO: 3438569 - RNA, 22 nt, Human
cgaaacucuaaguguuugcugc

SEQ ID NO: 3438570 - RNA, 13 nt, Human
cgaaacugcucua

SEQ ID NO: 3438571 - RNA, 13 nt, Human
cgaaacuggaagu

SEQ ID NO: 3438572 - RNA, 12 nt, Human
cgaaagagagag

SEQ ID NO: 3438573 - RNA, 20 nt, Human
cgaaaggaugaaagugacca

SEQ ID NO: 3438574 - RNA, 23 nt, Human
cgaaaggauguaaacagugccug

SEQ ID NO: 3438575 - RNA, 22 nt, Human
cgaaagggacuuggaagcuccg

SEQ ID NO: 3438576 - RNA, 16 nt, Human
cgaaaguuaguaggau

SEQ ID NO: 3438577 - RNA, 11 nt, Human
cgaaauaacaa

SEQ ID NO: 3438578 - RNA, 15 nt, Human
cgaaauaucaaaguc

SEQ ID NO: 3438579 - RNA, 13 nt, Human
cgaaauguuauuu

SEQ ID NO: 3438580 - RNA, 18 nt, Human
cgaacacccucgaagcgc

SEQ ID NO: 3438581 - RNA, 22 nt, Human
cgaacauggaacucauuccugc

SEQ ID NO: 3438582 - RNA, 21 nt, Human
cgaacauguuuuucuucuccc

SEQ ID NO: 3438583 - RNA, 18 nt, Human
cgaacccacacugcaaca

SEQ ID NO: 3438584 - RNA, 14 nt, Human
cgaacccaccugcu

SEQ ID NO: 3438585 - RNA, 14 nt, Human
cgaacuccugaccu

SEQ ID NO: 3438586 - RNA, 15 nt, Human
cgaacuccuugauuu

SEQ ID NO: 3438587 - RNA, 13 nt, Human
cgaacuggcgccu

SEQ ID NO: 3438588 - RNA, 21 nt, Human
cgaacugggcauauuucuaau

SEQ ID NO: 3438589 - RNA, 14 nt, Human
cgaacuucacaacu

SEQ ID NO: 3438590 - RNA, 20 nt, Human
cauguuucuuugaucaugaa

SEQ ID NO: 3438591 - RNA, 20 nt, Human
cauguuucuuuguaaugaaa

SEQ ID NO: 3438592 - RNA, 19 nt, Human
cauguuugagcucagaccc

SEQ ID NO: 3438593 - RNA, 20 nt, Human
cauguuugagcucagacccc

SEQ ID NO: 3438594 - RNA, 23 nt, Human
cauguuugagcucagacccccac

SEQ ID NO: 3438595 - RNA, 21 nt, Human
cauguuugcaccuuucuaguu

SEQ ID NO: 3438596 - RNA, 18 nt, Human
cauguuugccuagacagc

SEQ ID NO: 3438597 - RNA, 22 nt, Human
cauguuuggaaggggucuguag

SEQ ID NO: 3438598 - RNA, 22 nt, Human
cauguuuggugcauagaacugg

SEQ ID NO: 3438599 - RNA, 15 nt, Human
cauguuuuaaaugua

SEQ ID NO: 3438600 - RNA, 23 nt, Human
cauguuuuaaauguacaguuugg

SEQ ID NO: 3438601 - RNA, 14 nt, Human
cauguuuuaacaaa

SEQ ID NO: 3438602 - RNA, 15 nt, Human
cauguuuuaacaaaa

SEQ ID NO: 3438603 - RNA, 17 nt, Human
cauguuuuaacaaaaac

SEQ ID NO: 3438604 - RNA, 20 nt, Human
cauguuuucaaauggaguug

SEQ ID NO: 3438605 - RNA, 15 nt, Human
cauguuuucaacugc

SEQ ID NO: 3438606 - RNA, 16 nt, Human
cauguuuugcauguaa

SEQ ID NO: 3438607 - RNA, 11 nt, Human
cauguuuuggu

SEQ ID NO: 3438608 - RNA, 17 nt, Human
cauguuuuguauacaaa

SEQ ID NO: 3438609 - RNA, 19 nt, Human
cauguuuuguauacaaaua

SEQ ID NO: 3438610 - RNA, 20 nt, Human
cauguuuuguauacaaauau

SEQ ID NO: 3438611 - RNA, 14 nt, Human
cauguuuugugacu

SEQ ID NO: 3438612 - RNA, 20 nt, Human
cauguuuuucuucucccuca

SEQ ID NO: 3438613 - RNA, 23 nt, Human
cauguuuuuguuuucuuugaaug

SEQ ID NO: 3438614 - RNA, 21 nt, Human
cauuaaaaaaucaguuguaca

SEQ ID NO: 3438615 - RNA, 12 nt, Human
cauuaaaacaau

SEQ ID NO: 3438616 - RNA, 21 nt, Human
cauuaaaacugaagucugaaa

SEQ ID NO: 3438617 - RNA, 22 nt, Human
cauuaaaacugaagucugaaau

SEQ ID NO: 3438618 - RNA, 14 nt, Human
cauuaaaagaaaau

SEQ ID NO: 3438619 - RNA, 20 nt, Human
cauuaaaagaaaauaaaaaa

SEQ ID NO: 3438620 - RNA, 11 nt, Human
cauuaaaauau

SEQ ID NO: 3438621 - RNA, 16 nt, Human
cauuaaaauaugcacu

SEQ ID NO: 3438622 - RNA, 18 nt, Human
cauuaaaauaugcacuaa

SEQ ID NO: 3438623 - RNA, 10 nt, Human
cauuaaacug

SEQ ID NO: 3438624 - RNA, 11 nt, Human
cauuaaacuuu

SEQ ID NO: 3438625 - RNA, 19 nt, Human
cauuaaacuuuuuuaacca

SEQ ID NO: 3438626 - RNA, 14 nt, Human
cauuaaagaagacc

SEQ ID NO: 3438627 - RNA, 13 nt, Human
cauuaaagcaguc

SEQ ID NO: 3438628 - RNA, 12 nt, Human
cauuaaagccau

SEQ ID NO: 3438629 - RNA, 17 nt, Human
cauuaaagguacuuugc

SEQ ID NO: 3438630 - RNA, 13 nt, Human
cauuaaagucaga

SEQ ID NO: 3438631 - RNA, 14 nt, Human
cauuaaaugaauau

SEQ ID NO: 3438632 - RNA, 15 nt, Human
cauuaaaugaauauu

SEQ ID NO: 3438633 - RNA, 22 nt, Human
cauuaaaugaauauuuugauaa

SEQ ID NO: 3438634 - RNA, 12 nt, Human
cauuaaauguuu

SEQ ID NO: 3438635 - RNA, 13 nt, Human
cauuaaauguuug

SEQ ID NO: 3438636 - RNA, 21 nt, Human
cauuaaauucacaaacuuuua

SEQ ID NO: 3438637 - RNA, 15 nt, Human
cauuaacaaauaaaa

SEQ ID NO: 3438638 - RNA, 16 nt, Human
cauuaacaaauaaaaa

SEQ ID NO: 3438639 - RNA, 13 nt, Human
cauuaacaguuuu

SEQ ID NO: 3438640 - RNA, 17 nt, Human
cauuaaccgaugcuuua

SEQ ID NO: 3438641 - RNA, 20 nt, Human
cauuaaccgaugcuuuacca

SEQ ID NO: 3438642 - RNA, 17 nt, Human
cauuaacuuagcaugug

SEQ ID NO: 3438643 - RNA, 11 nt, Human
cauuaagaaaa

SEQ ID NO: 3438644 - RNA, 12 nt, Human
cauuaagaaaau

SEQ ID NO: 3438645 - RNA, 13 nt, Human
cauuaagaaaauc

SEQ ID NO: 3438646 - RNA, 19 nt, Human
cauuaaggggaagaaugaa

SEQ ID NO: 3438647 - RNA, 21 nt, Human
cauuaaguaaucaauaaagaa

SEQ ID NO: 3438648 - RNA, 15 nt, Human
cauuaauagcagccu

SEQ ID NO: 3438649 - RNA, 16 nt, Human
cauuaauauuugcuga

SEQ ID NO: 3438650 - RNA, 18 nt, Human
cauuaaucaaucaucugu

SEQ ID NO: 3438651 - RNA, 23 nt, Human
cauuaaucaaucaucugugugaa

SEQ ID NO: 3438652 - RNA, 19 nt, Human
cauuaaugccugcuuuuug

SEQ ID NO: 3438653 - RNA, 13 nt, Human
cauuaauguuaau

SEQ ID NO: 3438654 - RNA, 16 nt, Human
cauuaauguugauuuc

SEQ ID NO: 3438655 - RNA, 12 nt, Human
cauuaauguuuc

SEQ ID NO: 3438656 - RNA, 16 nt, Human
cauuacaaauugcuua

SEQ ID NO: 3438657 - RNA, 22 nt, Human
cauuacaacugaccaaguuucu

SEQ ID NO: 3438658 - RNA, 20 nt, Human
cauuacaagccuggaaaaaa

SEQ ID NO: 3438659 - RNA, 22 nt, Human
cauuacagggcacaggccaugg

SEQ ID NO: 3438660 - RNA, 20 nt, Human
cauuacauuccuugauaaug

SEQ ID NO: 3438661 - RNA, 23 nt, Human
cauuaccagacgguucaccagcc

SEQ ID NO: 3438662 - RNA, 13 nt, Human
cauuacccuuccc

SEQ ID NO: 3438663 - RNA, 15 nt, Human
cauuacccuucccug

SEQ ID NO: 3438664 - RNA, 22 nt, Human
cauuaccucagugagaagccag

SEQ ID NO: 3438665 - RNA, 13 nt, Human
cauuaccuuacug

SEQ ID NO: 3438666 - RNA, 16 nt, Human
cauuacggcuccucuc

SEQ ID NO: 3438667 - RNA, 16 nt, Human
cauuacgugagccagg

SEQ ID NO: 3438668 - RNA, 23 nt, Human
cauuacucuuguaagauuuugaa

SEQ ID NO: 3438669 - RNA, 17 nt, Human
cauuacugaaaacuuca

SEQ ID NO: 3438670 - RNA, 13 nt, Human
cauuacugcaugc

SEQ ID NO: 3438671 - RNA, 13 nt, Human
cauuacugggccu

SEQ ID NO: 3438672 - RNA, 20 nt, Human
cauuacuguuuaagacacuu

SEQ ID NO: 3438673 - RNA, 23 nt, Human
cauuacuugauuaagauuuuaca

SEQ ID NO: 3438674 - RNA, 21 nt, Human
cauuacuuuaccacccccaca

SEQ ID NO: 3438675 - RNA, 14 nt, Human
cauuagaaaaagag

SEQ ID NO: 3438676 - RNA, 19 nt, Human
cauuagaaaaauagcaacu

SEQ ID NO: 3438677 - RNA, 17 nt, Human
cauuagaaauagacagu

SEQ ID NO: 3438678 - RNA, 18 nt, Human
cauuagaaauuagcugug

SEQ ID NO: 3438679 - RNA, 15 nt, Human
cauuagacuccuccu

SEQ ID NO: 3438680 - RNA, 12 nt, Human
cauuagagcagg

SEQ ID NO: 3438681 - RNA, 13 nt, Human
cauuagagcaggc

SEQ ID NO: 3438682 - RNA, 16 nt, Human
cauuagcaaaaaaagu

SEQ ID NO: 3438683 - RNA, 23 nt, Human
cauuagcacagauuuuaauuguc

SEQ ID NO: 3438684 - RNA, 12 nt, Human
cauuagccaagg

SEQ ID NO: 3438685 - RNA, 17 nt, Human
cauuagccugaguagaa

SEQ ID NO: 3438686 - RNA, 18 nt, Human
cauuagccugaguagaaa

SEQ ID NO: 3438687 - RNA, 22 nt, Human
cauuaggacaaucaguccccuc

SEQ ID NO: 3438688 - RNA, 15 nt, Human
cauuaggauggcuag

SEQ ID NO: 3438689 - RNA, 23 nt, Human
cauuaguaaaugucuuuguaagu

SEQ ID NO: 3438690 - RNA, 20 nt, Human
cauuaguacuuuauagaaga

SEQ ID NO: 3438691 - RNA, 22 nt, Human
cauuaguacuuuauagaagaau

SEQ ID NO: 3438692 - RNA, 21 nt, Human
cauuagucauguuuaucugcu

SEQ ID NO: 3438693 - RNA, 22 nt, Human
cauuagucauguuuaucugcuu

SEQ ID NO: 3438694 - RNA, 21 nt, Human
cauuagugagacauauuuaca

SEQ ID NO: 3438695 - RNA, 15 nt, Human
cgcuaccucucuguc

SEQ ID NO: 3438696 - RNA, 17 nt, Human
cgcuaccucucuguccc

SEQ ID NO: 3438697 - RNA, 17 nt, Human
cgcuacuauaaagagaa

SEQ ID NO: 3438698 - RNA, 15 nt, Human
cgcuagcaguggcag

SEQ ID NO: 3438699 - RNA, 23 nt, Human
cgcuaggcucgccuucccuccug

SEQ ID NO: 3438700 - RNA, 21 nt, Human
cgcuagguagagucugagggc

SEQ ID NO: 3438701 - RNA, 21 nt, Human
cgcuaucucccugccuccugc

SEQ ID NO: 3438702 - RNA, 17 nt, Human
cgcuauugucaccaggg

SEQ ID NO: 3438703 - RNA, 22 nt, Human
cgcucaccuuuguuuagaacac

SEQ ID NO: 3438704 - RNA, 18 nt, Human
cgcucagcaugcauccuu

SEQ ID NO: 3438705 - RNA, 12 nt, Human
cgcucagcccuc

SEQ ID NO: 3438706 - RNA, 19 nt, Human
cgcucagggccaugcugag

SEQ ID NO: 3438707 - RNA, 18 nt, Human
cgcucaugggccccucug

SEQ ID NO: 3438708 - RNA, 18 nt, Human
cgcucauucagcaucuga

SEQ ID NO: 3438709 - RNA, 23 nt, Human
cgcuccaccagcaucaccugccu

SEQ ID NO: 3438710 - RNA, 16 nt, Human
cgcuccagcugccccg

SEQ ID NO: 3438711 - RNA, 10 nt, Human
cgcuccaggu

SEQ ID NO: 3438712 - RNA, 14 nt, Human
cgcucccagugucu

SEQ ID NO: 3438713 - RNA, 17 nt, Human
cgcuccccacucugcuc

SEQ ID NO: 3438714 - RNA, 13 nt, Human
cgcucccucccag

SEQ ID NO: 3438715 - RNA, 20 nt, Human
cgcucccucccaggacucug

SEQ ID NO: 3438716 - RNA, 23 nt, Human
cgcuccgggcuuucacggaaacu

SEQ ID NO: 3438717 - RNA, 22 nt, Human
cgcuccucccucugaggcugua

SEQ ID NO: 3438718 - RNA, 14 nt, Human
cgcuccugcagccc

SEQ ID NO: 3438719 - RNA, 14 nt, Human
cgcuccugucugcc

SEQ ID NO: 3438720 - RNA, 16 nt, Human
cgcuccugucugccag

SEQ ID NO: 3438721 - RNA, 20 nt, Human
cgcuccugucugccagccag

SEQ ID NO: 3438722 - RNA, 13 nt, Human
cgcuccugugucu

SEQ ID NO: 3438723 - RNA, 21 nt, Human
cgcucgccccaccggcgcgcu

SEQ ID NO: 3438724 - RNA, 16 nt, Human
cgcucggaggccccaa

SEQ ID NO: 3438725 - RNA, 19 nt, Human
cgcucggaggccccaaagg

SEQ ID NO: 3438726 - RNA, 14 nt, Human
cgcucucuccaggc

SEQ ID NO: 3438727 - RNA, 14 nt, Human
cgcucucuggccuu

SEQ ID NO: 3438728 - RNA, 15 nt, Human
cgcucucuggccuuc

SEQ ID NO: 3438729 - RNA, 12 nt, Human
cgcucucuuccu

SEQ ID NO: 3438730 - RNA, 16 nt, Human
cgcucucuuccugccc

SEQ ID NO: 3438731 - RNA, 19 nt, Human
cgcucucuuuucuguacuu

SEQ ID NO: 3438732 - RNA, 15 nt, Human
cgcucugcucagugg

SEQ ID NO: 3438733 - RNA, 15 nt, Human
cgcucugcuggccug

SEQ ID NO: 3438734 - RNA, 20 nt, Human
cgcucugucgcccaggcugg

SEQ ID NO: 3438735 - RNA, 24 nt, Human
cgcucuucgcgcccgccccugcag

SEQ ID NO: 3438736 - RNA, 15 nt, Human
cgcugacuacagggc

SEQ ID NO: 3438737 - RNA, 14 nt, Human
cgcugagccaccug

SEQ ID NO: 3438738 - RNA, 20 nt, Human
cgcugauacauaacuaaauu

SEQ ID NO: 3438739 - RNA, 12 nt, Human
cgcugaugcugg

SEQ ID NO: 3438740 - RNA, 17 nt, Human
cgcugaugcugggcugg

SEQ ID NO: 3438741 - RNA, 19 nt, Human
cgcugaugcugggcugggu

SEQ ID NO: 3438742 - RNA, 16 nt, Human
cgcugauucucagggu

SEQ ID NO: 3438743 - RNA, 23 nt, Human
cgcugauucucagggucucugcu

SEQ ID NO: 3438744 - RNA, 16 nt, Human
cgcugccacccaccuc

SEQ ID NO: 3438745 - RNA, 15 nt, Human
cgcugccagcucugu

SEQ ID NO: 3438746 - RNA, 14 nt, Human
cgcugccccaucuc

SEQ ID NO: 3438747 - RNA, 21 nt, Human
cgcugccccaucuccccucag

SEQ ID NO: 3438748 - RNA, 16 nt, Human
cgcugccccuggcagc

SEQ ID NO: 3438749 - RNA, 18 nt, Human
cgcugccccuggcagccc

SEQ ID NO: 3438750 - RNA, 20 nt, Human
cgcugccccuggcagccccu

SEQ ID NO: 3438751 - RNA, 20 nt, Human
cgcugcccggcgcccucugu

SEQ ID NO: 3438752 - RNA, 13 nt, Human
cgcugccugugug

SEQ ID NO: 3438753 - RNA, 21 nt, Human
cgcugcuccacgcgcuucgac

SEQ ID NO: 3438754 - RNA, 12 nt, Human
cgcugcuccuug

SEQ ID NO: 3438755 - RNA, 20 nt, Human
cgcugcucuuaugccauuug

SEQ ID NO: 3438756 - RNA, 20 nt, Human
cgcugcugcgcccugggcuc

SEQ ID NO: 3438757 - RNA, 18 nt, Human
cgcuggagguggggccug

SEQ ID NO: 3438758 - RNA, 12 nt, Human
cgcuggccccca

SEQ ID NO: 3438759 - RNA, 13 nt, Human
cgcuggcccccac

SEQ ID NO: 3438760 - RNA, 18 nt, Human
cgcuggcccccacuggcu

SEQ ID NO: 3438761 - RNA, 19 nt, Human
cgcuggcccccacuggcug

SEQ ID NO: 3438762 - RNA, 22 nt, Human
cgcuggccccuuugggcccugc

SEQ ID NO: 3438763 - RNA, 18 nt, Human
cgcuggccgggaccccga

SEQ ID NO: 3438764 - RNA, 23 nt, Human
cgcuggccgggaccccgagccug

SEQ ID NO: 3438765 - RNA, 20 nt, Human
cgcuggcugggggccucacu

SEQ ID NO: 3438766 - RNA, 14 nt, Human
cgcugggcacuucc

SEQ ID NO: 3438767 - RNA, 15 nt, Human
cgcugggcacuuccc

SEQ ID NO: 3438768 - RNA, 20 nt, Human
cgcugggcacuucccugcug

SEQ ID NO: 3438769 - RNA, 21 nt, Human
cgcugggcacuucccugcugc

SEQ ID NO: 3438770 - RNA, 17 nt, Human
cgcuggggccaguuggu

SEQ ID NO: 3438771 - RNA, 19 nt, Human
cgcugggugguacccucug

SEQ ID NO: 3438772 - RNA, 13 nt, Human
cgcuggugcugag

SEQ ID NO: 3438773 - RNA, 22 nt, Human
cgcuguaugaaaggagagagca

SEQ ID NO: 3438774 - RNA, 16 nt, Human
cgcuguccuuucuaga

SEQ ID NO: 3438775 - RNA, 17 nt, Human
cgcuguccuuucuagag

SEQ ID NO: 3438776 - RNA, 14 nt, Human
cgcugucuccagac

SEQ ID NO: 3438777 - RNA, 20 nt, Human
cgcugugcuaucaugaugga

SEQ ID NO: 3438778 - RNA, 13 nt, Human
cgcugugcugccc

SEQ ID NO: 3438779 - RNA, 13 nt, Human
cgcuguugcugaa

SEQ ID NO: 3438780 - RNA, 14 nt, Human
cgcuguugcugaau

SEQ ID NO: 3438781 - RNA, 20 nt, Human
cgcuguuggggcugcucaug

SEQ ID NO: 3438782 - RNA, 21 nt, Human
cgcuguuuuuguugugugugc

SEQ ID NO: 3438783 - RNA, 17 nt, Human
cgcuuaaaggugucuuc

SEQ ID NO: 3438784 - RNA, 18 nt, Human
cgcuucccuccugcccgc

SEQ ID NO: 3438785 - RNA, 22 nt, Human
cgcuucccugguucaagcgauu

SEQ ID NO: 3438786 - RNA, 17 nt, Human
cgcuuccggcuccugug

SEQ ID NO: 3438787 - RNA, 12 nt, Human
cgcuucucugug

SEQ ID NO: 3438788 - RNA, 12 nt, Human
cgcuucugacug

SEQ ID NO: 3438789 - RNA, 15 nt, Human
cgcuucuugccucug

SEQ ID NO: 3438790 - RNA, 18 nt, Human
cgcuucuugccucugugc

SEQ ID NO: 3438791 - RNA, 19 nt, Human
cgcuucuugccucugugcu

SEQ ID NO: 3438792 - RNA, 22 nt, Human
cgcuucuugccucugugcugug

SEQ ID NO: 3438793 - RNA, 18 nt, Human
cgcuugccucggcuccug

SEQ ID NO: 3438794 - RNA, 16 nt, Human
cauuucuugggcccuc

SEQ ID NO: 3438795 - RNA, 19 nt, Human
cauuucuuuucuuuuuaca

SEQ ID NO: 3438796 - RNA, 22 nt, Human
cauuugaaaauuuugauguuuu

SEQ ID NO: 3438797 - RNA, 14 nt, Human
cauuugaaagaaag

SEQ ID NO: 3438798 - RNA, 18 nt, Human
cauuugaaagaaaggacu

SEQ ID NO: 3438799 - RNA, 18 nt, Human
cauuugaaguguaccugu

SEQ ID NO: 3438800 - RNA, 21 nt, Human
cauuugaauaaagccugcuuu

SEQ ID NO: 3438801 - RNA, 11 nt, Human
cauuugaaugc

SEQ ID NO: 3438802 - RNA, 13 nt, Human
cauuugaaugcau

SEQ ID NO: 3438803 - RNA, 18 nt, Human
cauuugaaugcauuuugu

SEQ ID NO: 3438804 - RNA, 12 nt, Human
cauuugagaaau

SEQ ID NO: 3438805 - RNA, 18 nt, Human
cauuugagaaaugcauau

SEQ ID NO: 3438806 - RNA, 23 nt, Human
cauuugagaaaugcauauuguau

SEQ ID NO: 3438807 - RNA, 20 nt, Human
cauuugagcagggcucagcg

SEQ ID NO: 3438808 - RNA, 23 nt, Human
cauuugaggauuuagaaguguca

SEQ ID NO: 3438809 - RNA, 17 nt, Human
cauuugauaaugauaaa

SEQ ID NO: 3438810 - RNA, 11 nt, Human
cauuugauacc

SEQ ID NO: 3438811 - RNA, 17 nt, Human
cauuugauaccccuggg

SEQ ID NO: 3438812 - RNA, 17 nt, Human
cauuugaucuguugcaa

SEQ ID NO: 3438813 - RNA, 15 nt, Human
cauuugaugcuaaau

SEQ ID NO: 3438814 - RNA, 16 nt, Human
cauuugaugcuaaaua

SEQ ID NO: 3438815 - RNA, 16 nt, Human
cauuugauuuuucuaa

SEQ ID NO: 3438816 - RNA, 22 nt, Human
cauuugcaagggaaaagucucu

SEQ ID NO: 3438817 - RNA, 16 nt, Human
cauuugcaauaacagc

SEQ ID NO: 3438818 - RNA, 20 nt, Human
cauuugcaauaacagcugca

SEQ ID NO: 3438819 - RNA, 20 nt, Human
cauuugcacuggaguucuau

SEQ ID NO: 3438820 - RNA, 20 nt, Human
cauuugcaggguccucuucu

SEQ ID NO: 3438821 - RNA, 22 nt, Human
cauuugcaggguccucuucugg

SEQ ID NO: 3438822 - RNA, 14 nt, Human
cauuugcauuuguu

SEQ ID NO: 3438823 - RNA, 12 nt, Human
cauuugccuugc

SEQ ID NO: 3438824 - RNA, 15 nt, Human
cauuugccuugcaga

SEQ ID NO: 3438825 - RNA, 23 nt, Human
cauuugcgcacaacuuaaaaagu

SEQ ID NO: 3438826 - RNA, 15 nt, Human
cauuugcuacuguug

SEQ ID NO: 3438827 - RNA, 22 nt, Human
cauuugcuacuguuguaagaau

SEQ ID NO: 3438828 - RNA, 13 nt, Human
cauuugcucaugg

SEQ ID NO: 3438829 - RNA, 18 nt, Human
cauuugcucauggaauug

SEQ ID NO: 3438830 - RNA, 13 nt, Human
cauuugcuccuuu

SEQ ID NO: 3438831 - RNA, 12 nt, Human
cauuugcucuuc

SEQ ID NO: 3438832 - RNA, 14 nt, Human
cauuugcuggagcu

SEQ ID NO: 3438833 - RNA, 16 nt, Human
cauuugcuguuuuaaa

SEQ ID NO: 3438834 - RNA, 17 nt, Human
cauuugcuguuuuaaac

SEQ ID NO: 3438835 - RNA, 14 nt, Human
cauuugcuuuggaa

SEQ ID NO: 3438836 - RNA, 13 nt, Human
cauuugcuuuuug

SEQ ID NO: 3438837 - RNA, 11 nt, Human
cauuuggaaau

SEQ ID NO: 3438838 - RNA, 18 nt, Human
cauuuggaaaucuuuaaa

SEQ ID NO: 3438839 - RNA, 15 nt, Human
cauuuggaauacuuu

SEQ ID NO: 3438840 - RNA, 16 nt, Human
cauuuuuuucuaccua

SEQ ID NO: 3438841 - RNA, 23 nt, Human
cauuuuuuucuaccuauaacacu

SEQ ID NO: 3438842 - RNA, 14 nt, Human
cauuuuuuugcaug

SEQ ID NO: 3438843 - RNA, 21 nt, Human
cauuuuuuuucagcagacuau

SEQ ID NO: 3438844 - RNA, 17 nt, Human
cauuuuuuuuuuaaauc

SEQ ID NO: 3438845 - RNA, 17 nt, Human
cauuuuuuuuuuuaauu

SEQ ID NO: 3438846 - RNA, 21 nt, Human
cauuuuuuuuuuuguuucuga

SEQ ID NO: 3438847 - RNA, 13 nt, Human
ccaaaaaaauaag

SEQ ID NO: 3438848 - RNA, 18 nt, Human
ccaaaaaaauaaggugua

SEQ ID NO: 3438849 - RNA, 23 nt, Human
ccaaaaaauaucuaguaauauau

SEQ ID NO: 3438850 - RNA, 23 nt, Human
ccaaaaagaaucugcauuuagca

SEQ ID NO: 3438851 - RNA, 17 nt, Human
ccaaaaagaccagacua

SEQ ID NO: 3438852 - RNA, 19 nt, Human
ccaaaaagauuuucagaaa

SEQ ID NO: 3438853 - RNA, 13 nt, Human
ccaaaaagcacau

SEQ ID NO: 3438854 - RNA, 23 nt, Human
ccaaaaagguugcuguuucacaa

SEQ ID NO: 3438855 - RNA, 16 nt, Human
ccaaaaagugaaauaa

SEQ ID NO: 3438856 - RNA, 16 nt, Human
ccaaaaauaaauauau

SEQ ID NO: 3438857 - RNA, 18 nt, Human
ccaaaacaaacaaacaga

SEQ ID NO: 3438858 - RNA, 16 nt, Human
ccaaaacaagccuggu

SEQ ID NO: 3438859 - RNA, 11 nt, Human
ccaaaacugcu

SEQ ID NO: 3438860 - RNA, 19 nt, Human
ccaaaagauugcugaaauu

SEQ ID NO: 3438861 - RNA, 23 nt, Human
ccaaaagauugcugaaauuuuau

SEQ ID NO: 3438862 - RNA, 14 nt, Human
ccaaaagcacuuac

SEQ ID NO: 3438863 - RNA, 15 nt, Human
ccaaaagcaguaaau

SEQ ID NO: 3438864 - RNA, 15 nt, Human
ccaaaaggaaaaagc

SEQ ID NO: 3438865 - RNA, 21 nt, Human
ccaaaagucaaaaggugccug

SEQ ID NO: 3438866 - RNA, 15 nt, Human
ccaaaaguggccucu

SEQ ID NO: 3438867 - RNA, 17 nt, Human
ccaaaauaagaaaagau

SEQ ID NO: 3438868 - RNA, 20 nt, Human
ccaaaaucauaagauauuuu

SEQ ID NO: 3438869 - RNA, 21 nt, Human
ccaaaauguuggucauuuuau

SEQ ID NO: 3438870 - RNA, 23 nt, Human
ccaaaauuagccaguaauccugu

SEQ ID NO: 3438871 - RNA, 13 nt, Human
ccaaacaauuauu

SEQ ID NO: 3438872 - RNA, 15 nt, Human
ccaaacacacagaag

SEQ ID NO: 3438873 - RNA, 13 nt, Human
ccaaacacaggca

SEQ ID NO: 3438874 - RNA, 19 nt, Human
ccaaacaccuuccagcucc

SEQ ID NO: 3438875 - RNA, 12 nt, Human
ccaaacagcaaa

SEQ ID NO: 3438876 - RNA, 22 nt, Human
ccaaacagcaaaccaagagauu

SEQ ID NO: 3438877 - RNA, 16 nt, Human
ccaaacagccacacug

SEQ ID NO: 3438878 - RNA, 18 nt, Human
ccaaacaggcccuccucc

SEQ ID NO: 3438879 - RNA, 13 nt, Human
ccaaacagugaca

SEQ ID NO: 3438880 - RNA, 20 nt, Human
ccaaacauccuacaagacac

SEQ ID NO: 3438881 - RNA, 15 nt, Human
ccaaacauguauuua

SEQ ID NO: 3438882 - RNA, 18 nt, Human
ccaaacauuaauguugau

SEQ ID NO: 3438883 - RNA, 14 nt, Human
ccaaaccaccuucc

SEQ ID NO: 3438884 - RNA, 11 nt, Human
ccaaaccacuu

SEQ ID NO: 3438885 - RNA, 15 nt, Human
ccaaaccccggggcu

SEQ ID NO: 3438886 - RNA, 12 nt, Human
ccaaacccuagg

SEQ ID NO: 3438887 - RNA, 17 nt, Human
ccaaaccgccagcgaac

SEQ ID NO: 3438888 - RNA, 13 nt, Human
ccaaaccggcagg

SEQ ID NO: 3438889 - RNA, 16 nt, Human
ccaaaccggcaggugc

SEQ ID NO: 3438890 - RNA, 13 nt, Human
ccaaaccucacca

SEQ ID NO: 3438891 - RNA, 19 nt, Human
ccaaaccuccaaaacuccu

SEQ ID NO: 3438892 - RNA, 17 nt, Human
ccaaaccucuguucagu

SEQ ID NO: 3438893 - RNA, 20 nt, Human
ccaaaccucuguucagugua

SEQ ID NO: 3438894 - RNA, 15 nt, Human
ccaaaccugacagau

SEQ ID NO: 3438895 - RNA, 14 nt, Human
ccaaaccuggagau

SEQ ID NO: 3438896 - RNA, 21 nt, Human
ccaaaccuucacacacagacu

SEQ ID NO: 3438897 - RNA, 15 nt, Human
ccaaacgcugagcca

SEQ ID NO: 3438898 - RNA, 20 nt, Human
ccaaacgcugagccaccugc

SEQ ID NO: 3438899 - RNA, 16 nt, Human
ccaaacuacugaauga

SEQ ID NO: 3438900 - RNA, 14 nt, Human
ccaaacugccuaag

SEQ ID NO: 3438901 - RNA, 24 nt, Human
ccaaacugcuggacgucuuucuuu

SEQ ID NO: 3438902 - RNA, 20 nt, Human
ccaaagaaaugaacauucca

SEQ ID NO: 3438903 - RNA, 19 nt, Human
ccaaagaaccaaagaagaa

SEQ ID NO: 3438904 - RNA, 14 nt, Human
ccaaagaaugaauu

SEQ ID NO: 3438905 - RNA, 18 nt, Human
ccaaagaauguuagagca

SEQ ID NO: 3438906 - RNA, 14 nt, Human
ccaaagacaaauag

SEQ ID NO: 3438907 - RNA, 15 nt, Human
ccaaagacaaauagu

SEQ ID NO: 3438908 - RNA, 20 nt, Human
ccaaagagacuggagcaucu

SEQ ID NO: 3438909 - RNA, 15 nt, Human
ccaaagagccuggag

SEQ ID NO: 3438910 - RNA, 22 nt, Human
ccaaagagccuggagaagcuga

SEQ ID NO: 3438911 - RNA, 12 nt, Human
ccaaagaggcug

SEQ ID NO: 3438912 - RNA, 14 nt, Human
ccaaagaggcugcc

SEQ ID NO: 3438913 - RNA, 17 nt, Human
ccaaagaggcugccccu

SEQ ID NO: 3438914 - RNA, 20 nt, Human
ccaaagaggcugccccucuc

SEQ ID NO: 3438915 - RNA, 19 nt, Human
ccaaagagggcuuccucua

SEQ ID NO: 3438916 - RNA, 9 nt, Human
ccaaagagu

SEQ ID NO: 3438917 - RNA, 14 nt, Human
ccaaagaugcagcc

SEQ ID NO: 3438918 - RNA, 16 nt, Human
ccaaagcaagcaagag

SEQ ID NO: 3438919 - RNA, 13 nt, Human
ccaaagcacauuu

SEQ ID NO: 3438920 - RNA, 13 nt, Human
ccaaagcagacag

SEQ ID NO: 3438921 - RNA, 16 nt, Human
ccaaagcagggucugg

SEQ ID NO: 3438922 - RNA, 13 nt, Human
ccaaagcauggac

SEQ ID NO: 3438923 - RNA, 14 nt, Human
ccaaagccaaugug

SEQ ID NO: 3438924 - RNA, 20 nt, Human
ccaaagccaccucugucauu

SEQ ID NO: 3438925 - RNA, 15 nt, Human
ccaaagccagaacca

SEQ ID NO: 3438926 - RNA, 15 nt, Human
ccaaagcuaggccug

SEQ ID NO: 3438927 - RNA, 20 nt, Human
ccaaagcugagccugcaggg

SEQ ID NO: 3438928 - RNA, 20 nt, Human
ccaaagcugcccacuguuuc

SEQ ID NO: 3438929 - RNA, 21 nt, Human
ccaaagcuguuggucuguccc

SEQ ID NO: 3438930 - RNA, 15 nt, Human
ccaaagcuuuccugc

SEQ ID NO: 3438931 - RNA, 16 nt, Human
ccaaagcuuuccugcc

SEQ ID NO: 3438932 - RNA, 19 nt, Human
ccaaagcuuuccugcccca

SEQ ID NO: 3438933 - RNA, 17 nt, Human
ccaaaggaaaaagcaca

SEQ ID NO: 3438934 - RNA, 20 nt, Human
ccaaaggaaaaugucuguaa

SEQ ID NO: 3438935 - RNA, 18 nt, Human
ccaaaggaagucuaggag

SEQ ID NO: 3438936 - RNA, 21 nt, Human
ccaaaggacgcacugagcaac

SEQ ID NO: 3438937 - RNA, 21 nt, Human
ccaaaggacuccacccauccu

SEQ ID NO: 3438938 - RNA, 16 nt, Human
ccaaaggaugugauau

SEQ ID NO: 3438939 - RNA, 22 nt, Human
ccaaaggcauuuuauugcuuga

SEQ ID NO: 3438940 - RNA, 14 nt, Human
ccaaaggcccccua

SEQ ID NO: 3438941 - RNA, 12 nt, Human
ccaaaggcuggu

SEQ ID NO: 3438942 - RNA, 18 nt, Human
ccaaaggggaccuggaag

SEQ ID NO: 3438943 - RNA, 21 nt, Human
ccaaagggugaagcuauuuau

SEQ ID NO: 3438944 - RNA, 14 nt, Human
ccaaaguauuguac

SEQ ID NO: 3438945 - RNA, 17 nt, Human
ccaaagucauaauugca

SEQ ID NO: 3438946 - RNA, 19 nt, Human
ccaaagucauaauugcauu

SEQ ID NO: 3438947 - RNA, 21 nt, Human
ccaaagugccggugagaccca

SEQ ID NO: 3438948 - RNA, 14 nt, Human
ccaaagugcuggga

SEQ ID NO: 3438949 - RNA, 18 nt, Human
ccaaagugcugggauuaa

SEQ ID NO: 3438950 - RNA, 22 nt, Human
ccaaagugcugggauuacaggg

SEQ ID NO: 3438951 - RNA, 16 nt, Human
ccaaaguucaacuugg

SEQ ID NO: 3438952 - RNA, 12 nt, Human
ccaaaguucuaa

SEQ ID NO: 3438953 - RNA, 15 nt, Human
ccaaaguuguuguaa

SEQ ID NO: 3438954 - RNA, 18 nt, Human
ccaaauaaaguuaaaagu

SEQ ID NO: 3438955 - RNA, 16 nt, Human
ccaaauaacuucaguc

SEQ ID NO: 3438956 - RNA, 18 nt, Human
ccaaauaacuucaguccu

SEQ ID NO: 3438957 - RNA, 13 nt, Human
ccaaauaauaaag

SEQ ID NO: 3438958 - RNA, 21 nt, Human
ccaaauaauauguuuccuucc

SEQ ID NO: 3438959 - RNA, 15 nt, Human
ccaaauaaugucucu

SEQ ID NO: 3438960 - RNA, 17 nt, Human
ccaaauaaugucucugu

SEQ ID NO: 3438961 - RNA, 23 nt, Human
cgaagcccagagggucugggggc

SEQ ID NO: 3438962 - RNA, 15 nt, Human
cgaagcucagcccac

SEQ ID NO: 3438963 - RNA, 16 nt, Human
cgaagcucagcccacc

SEQ ID NO: 3438964 - RNA, 12 nt, Human
cgaagcucuggc

SEQ ID NO: 3438965 - RNA, 20 nt, Human
cgaagcucuggcugaacccu

SEQ ID NO: 3438966 - RNA, 23 nt, Human
cgaaggcagugcaagagacucug

SEQ ID NO: 3438967 - RNA, 12 nt, Human
cgaaggccucug

SEQ ID NO: 3438968 - RNA, 13 nt, Human
cgaaggugcugga

SEQ ID NO: 3438969 - RNA, 22 nt, Human
cgaaguggacuggccccugggu

SEQ ID NO: 3438970 - RNA, 14 nt, Human
cgaaguugaugcaa

SEQ ID NO: 3438971 - RNA, 17 nt, Human
cgaauagacaucaaacu

SEQ ID NO: 3438972 - RNA, 13 nt, Human
cgaauagcuggga

SEQ ID NO: 3438973 - RNA, 17 nt, Human
cgaauauugagcaauau

SEQ ID NO: 3438974 - RNA, 21 nt, Human
cgaaucacgaggucaggaguu

SEQ ID NO: 3438975 - RNA, 18 nt, Human
cgaauccccucccuguca

SEQ ID NO: 3438976 - RNA, 16 nt, Human
cgaaucucugugccuu

SEQ ID NO: 3438977 - RNA, 15 nt, Human
cgaaugaaaagacaa

SEQ ID NO: 3438978 - RNA, 22 nt, Human
cgaaugaaaauaacugaauuug

SEQ ID NO: 3438979 - RNA, 12 nt, Human
cgaauggacuuu

SEQ ID NO: 3438980 - RNA, 13 nt, Human
cgaaugugcaggu

SEQ ID NO: 3438981 - RNA, 15 nt, Human
cgaauguguacaacu

SEQ ID NO: 3438982 - RNA, 19 nt, Human
cgaaugugucuuuagauag

SEQ ID NO: 3438983 - RNA, 14 nt, Human
cgaauugagcacaa

SEQ ID NO: 3438984 - RNA, 20 nt, Human
cgaauuucugugcccuccug

SEQ ID NO: 3438985 - RNA, 17 nt, Human
cgaauuuuucagaugau

SEQ ID NO: 3438986 - RNA, 15 nt, Human
cguuuaaaguucugu

SEQ ID NO: 3438987 - RNA, 17 nt, Human
cguuuaagccaaaacaa

SEQ ID NO: 3438988 - RNA, 18 nt, Human
cguuuaagccaaaacaau

SEQ ID NO: 3438989 - RNA, 22 nt, Human
cguuuaagccaaaacaauguuu

SEQ ID NO: 3438990 - RNA, 20 nt, Human
cguuuacuuaucuuaugcca

SEQ ID NO: 3438991 - RNA, 18 nt, Human
cguuuagaccaaggaaca

SEQ ID NO: 3438992 - RNA, 18 nt, Human
cguuuauaaacagaaaug

SEQ ID NO: 3438993 - RNA, 15 nt, Human
cguuuauuuucaaga

SEQ ID NO: 3438994 - RNA, 13 nt, Human
cguuucaaaaaca

SEQ ID NO: 3438995 - RNA, 15 nt, Human
cguuucaaaaacaca

SEQ ID NO: 3438996 - RNA, 12 nt, Human
cguuuccuaccg

SEQ ID NO: 3438997 - RNA, 18 nt, Human
cguuucuccaccuagacu

SEQ ID NO: 3438998 - RNA, 12 nt, Human
cguuucuucccu

SEQ ID NO: 3438999 - RNA, 13 nt, Human
cguuucuucccug

SEQ ID NO: 3439000 - RNA, 22 nt, Human
cguuucuuuaaccuuguauaaa

SEQ ID NO: 3439001 - RNA, 19 nt, Human
cguuuggaagauccuguga

SEQ ID NO: 3439002 - RNA, 15 nt, Human
cguuuguaugugugu

SEQ ID NO: 3439003 - RNA, 15 nt, Human
cguuuguuuguuuug

SEQ ID NO: 3439004 - RNA, 17 nt, Human
cguuuguuuguuuuguu

SEQ ID NO: 3439005 - RNA, 14 nt, Human
cguuuuauuguguu

SEQ ID NO: 3439006 - RNA, 14 nt, Human
cguuuuccccauga

SEQ ID NO: 3439007 - RNA, 16 nt, Human
cguuuuccccaugaca

SEQ ID NO: 3439008 - RNA, 15 nt, Human
cguuuucuaauugcu

SEQ ID NO: 3439009 - RNA, 13 nt, Human
cguuuugaagcua

SEQ ID NO: 3439010 - RNA, 20 nt, Human
cguuuugaagcuacugugug

SEQ ID NO: 3439011 - RNA, 15 nt, Human
cguuuuggaagcucu

SEQ ID NO: 3439012 - RNA, 23 nt, Human
cguuuugugugguggcaccuccu

SEQ ID NO: 3439013 - RNA, 15 nt, Human
cguuuuuguauuuuc

SEQ ID NO: 3439014 - RNA, 17 nt, Human
cuaaaaaacagaggcca

SEQ ID NO: 3439015 - RNA, 22 nt, Human
cuaaaaaacauaaauuucuuua

SEQ ID NO: 3439016 - RNA, 22 nt, Human
cuaaaaaagauauauuaaaaau

SEQ ID NO: 3439017 - RNA, 11 nt, Human
cuaaaaacaua

SEQ ID NO: 3439018 - RNA, 15 nt, Human
cuaaaaaguauaaaa

SEQ ID NO: 3439019 - RNA, 18 nt, Human
cuaaaaagucagauguuu

SEQ ID NO: 3439020 - RNA, 14 nt, Human
cuaaaaauaaagca

SEQ ID NO: 3439021 - RNA, 15 nt, Human
cuaaaaauaaagcac

SEQ ID NO: 3439022 - RNA, 22 nt, Human
cuaaaaauaacuguaauuauuu

SEQ ID NO: 3439023 - RNA, 23 nt, Human
cuaaaaauaacuguaauuauuug

SEQ ID NO: 3439024 - RNA, 13 nt, Human
cuaaaaauacaaa

SEQ ID NO: 3439025 - RNA, 21 nt, Human
cuaaaaauauacauguuuaug

SEQ ID NO: 3439026 - RNA, 22 nt, Human
cuaaaaauauuauaacuuaaaa

SEQ ID NO: 3439027 - RNA, 23 nt, Human
cuaaaaaugagcuugauuaaauc

SEQ ID NO: 3439028 - RNA, 22 nt, Human
cuaaaaaugggacuucuuuuca

SEQ ID NO: 3439029 - RNA, 17 nt, Human
cuaaaaccauuccauuu

SEQ ID NO: 3439030 - RNA, 22 nt, Human
cuaaaacuaaauagcauguauu

SEQ ID NO: 3439031 - RNA, 22 nt, Human
cuaaaacuguacuuugauucac

SEQ ID NO: 3439032 - RNA, 13 nt, Human
cuaaaagaaacuu

SEQ ID NO: 3439033 - RNA, 14 nt, Human
cuaaaagacauuug

SEQ ID NO: 3439034 - RNA, 17 nt, Human
cuaaaagacauuuguua

SEQ ID NO: 3439035 - RNA, 16 nt, Human
cuaaaagauauaagug

SEQ ID NO: 3439036 - RNA, 13 nt, Human
cuaaaagauccuu

SEQ ID NO: 3439037 - RNA, 12 nt, Human
cuaaaagcaaaa

SEQ ID NO: 3439038 - RNA, 13 nt, Human
cuaaaaguaaaca

SEQ ID NO: 3439039 - RNA, 13 nt, Human
cuaaaagucuucg

SEQ ID NO: 3439040 - RNA, 20 nt, Human
cuaaaagugggcuugauucu

SEQ ID NO: 3439041 - RNA, 12 nt, Human
cuaaaaguguca

SEQ ID NO: 3439042 - RNA, 13 nt, Human
cuaaaagugucac

SEQ ID NO: 3439043 - RNA, 23 nt, Human
cuaaaaguucauaacagugccau

SEQ ID NO: 3439044 - RNA, 14 nt, Human
cuaaaauaaagaaa

SEQ ID NO: 3439045 - RNA, 22 nt, Human
cuaaaauaaagaaauagaacaa

SEQ ID NO: 3439046 - RNA, 22 nt, Human
cuaaaauaagggcagagucaca

SEQ ID NO: 3439047 - RNA, 15 nt, Human
cuaaaauaauuuugu

SEQ ID NO: 3439048 - RNA, 13 nt, Human
cuaaaauagccac

SEQ ID NO: 3439049 - RNA, 21 nt, Human
cuaaaauauuuaugaagaaaa

SEQ ID NO: 3439050 - RNA, 22 nt, Human
cuaaaauauuuaugaagaaaau

SEQ ID NO: 3439051 - RNA, 13 nt, Human
cuaaaaucaugaa

SEQ ID NO: 3439052 - RNA, 17 nt, Human
cuaaaaucuuauaguuc

SEQ ID NO: 3439053 - RNA, 22 nt, Human
cuaaaaugugauguucuaaggc

SEQ ID NO: 3439054 - RNA, 23 nt, Human
cuaaaaugugauguucuaaggcu

SEQ ID NO: 3439055 - RNA, 21 nt, Human
cuaaaauuguuuuuuguugua

SEQ ID NO: 3439056 - RNA, 21 nt, Human
cuaaaauuugcccucccaucc

SEQ ID NO: 3439057 - RNA, 15 nt, Human
cuaaaauuuuuuccu

SEQ ID NO: 3439058 - RNA, 21 nt, Human
cuaaacaagaaucagucuauc

SEQ ID NO: 3439059 - RNA, 22 nt, Human
cuaaacaagauuuuaaagacau

SEQ ID NO: 3439060 - RNA, 23 nt, Human
cuaaacaagauuuuaaagacaug

SEQ ID NO: 3439061 - RNA, 17 nt, Human
cuaaacacgugacacaa

SEQ ID NO: 3439062 - RNA, 18 nt, Human
cuaaacacugcgcuuuau

SEQ ID NO: 3439063 - RNA, 14 nt, Human
cuaaacagacucau

SEQ ID NO: 3439064 - RNA, 12 nt, Human
cuaaacagauau

SEQ ID NO: 3439065 - RNA, 13 nt, Human
cuaaacagauaua

SEQ ID NO: 3439066 - RNA, 13 nt, Human
cuaaacaucauuc

SEQ ID NO: 3439067 - RNA, 23 nt, Human
cuaaacaucauucauuuuuguug

SEQ ID NO: 3439068 - RNA, 12 nt, Human
cuaaacauccau

SEQ ID NO: 3439069 - RNA, 16 nt, Human
cuaaaccaaggacuga

SEQ ID NO: 3439070 - RNA, 17 nt, Human
cuaaaccaaggacugag

SEQ ID NO: 3439071 - RNA, 19 nt, Human
cuaaaccaaggacugagca

SEQ ID NO: 3439072 - RNA, 23 nt, Human
cuaaaccaaggacugagcacccu

SEQ ID NO: 3439073 - RNA, 13 nt, Human
cuaaaccucaguu

SEQ ID NO: 3439074 - RNA, 18 nt, Human
cuaaaccuuaguacugag

SEQ ID NO: 3439075 - RNA, 20 nt, Human
cuaaacgagucaauccccuc

SEQ ID NO: 3439076 - RNA, 14 nt, Human
cuaaacguguaugu

SEQ ID NO: 3439077 - RNA, 19 nt, Human
cuaaacguguauguuuuuc

SEQ ID NO: 3439078 - RNA, 15 nt, Human
cuaaacuaggcuccu

SEQ ID NO: 3439079 - RNA, 15 nt, Human
cuaaacuccuuccug

SEQ ID NO: 3439080 - RNA, 13 nt, Human
cuaaacugccccc

SEQ ID NO: 3439081 - RNA, 20 nt, Human
cuaaacuuggugcuuauuga

SEQ ID NO: 3439082 - RNA, 13 nt, Human
cuaaacuuucaca

SEQ ID NO: 3439083 - RNA, 13 nt, Human
cuaaagaaaaaca

SEQ ID NO: 3439084 - RNA, 20 nt, Human
cuaaagaaaaacaaacucgu

SEQ ID NO: 3439085 - RNA, 16 nt, Human
cuaaagaagaucugua

SEQ ID NO: 3439086 - RNA, 20 nt, Human
cuaaagagcccuugccuccc

SEQ ID NO: 3439087 - RNA, 22 nt, Human
cuaaagagcccuugccucccca

SEQ ID NO: 3439088 - RNA, 23 nt, Human
cuaaagagcccuugccuccccau

SEQ ID NO: 3439089 - RNA, 19 nt, Human
cuaaagaguuuauuuuaag

SEQ ID NO: 3439090 - RNA, 15 nt, Human
cuaaagauaauauua

SEQ ID NO: 3439091 - RNA, 17 nt, Human
cuaaagauggaguuucu

SEQ ID NO: 3439092 - RNA, 14 nt, Human
cuaaagauucuaua

SEQ ID NO: 3439093 - RNA, 17 nt, Human
cuaaagauucuauaguu

SEQ ID NO: 3439094 - RNA, 22 nt, Human
cuaaagauucuauaguucuaga

SEQ ID NO: 3439095 - RNA, 23 nt, Human
cuaaagauucuauaguucuagac

SEQ ID NO: 3439096 - RNA, 20 nt, Human
cuaaagcaauaaugguccca

SEQ ID NO: 3439097 - RNA, 14 nt, Human
cuaaagcaauagaa

SEQ ID NO: 3439098 - RNA, 22 nt, Human
cuaaagcaugaaaugugaauuu

SEQ ID NO: 3439099 - RNA, 16 nt, Human
cuaaagccucaaaaca

SEQ ID NO: 3439100 - RNA, 11 nt, Human
cuaaagcugcc

SEQ ID NO: 3439101 - RNA, 14 nt, Human
cuaaaggaaaaaac

SEQ ID NO: 3439102 - RNA, 19 nt, Human
cuaaaggaaaucaaaugaa

SEQ ID NO: 3439103 - RNA, 16 nt, Human
cuaaaggaguuuaugu

SEQ ID NO: 3439104 - RNA, 17 nt, Human
cuaaaggauagaucaaa

SEQ ID NO: 3439105 - RNA, 19 nt, Human
cuaaaggauagaucaaagu

SEQ ID NO: 3439106 - RNA, 19 nt, Human
cuaaagguccacaggucua

SEQ ID NO: 3439107 - RNA, 20 nt, Human
cuaaaggucccaaggcaagg

SEQ ID NO: 3439108 - RNA, 23 nt, Human
cuaaagguggccacaaauucuuu

SEQ ID NO: 3439109 - RNA, 23 nt, Human
cuaaaguaaaaacaaagaaauua

SEQ ID NO: 3439110 - RNA, 21 nt, Human
cuaaaguaaaaagggaauuau

SEQ ID NO: 3439111 - RNA, 20 nt, Human
cuaaaguauguaaaguaugu

SEQ ID NO: 3439112 - RNA, 14 nt, Human
cuaaagugcuggga

SEQ ID NO: 3439113 - RNA, 16 nt, Human
cuaaagugcugggauu

SEQ ID NO: 3439114 - RNA, 20 nt, Human
cuaaagugcugggauuacag

SEQ ID NO: 3439115 - RNA, 20 nt, Human
cuaaaguguauuuucagagc

SEQ ID NO: 3439116 - RNA, 10 nt, Human
cuaaaguuau

SEQ ID NO: 3439117 - RNA, 13 nt, Human
cuaaaguuauauu

SEQ ID NO: 3439118 - RNA, 15 nt, Human
cuaaaguuauauuuc

SEQ ID NO: 3439119 - RNA, 17 nt, Human
cuaaaguucuaagauuc

SEQ ID NO: 3439120 - RNA, 19 nt, Human
cuaaaguucuaagauucug

SEQ ID NO: 3439121 - RNA, 20 nt, Human
cuaaaguucuaagauucuga

SEQ ID NO: 3439122 - RNA, 20 nt, Human
cuaaaguuguacuuuaaaaa

SEQ ID NO: 3439123 - RNA, 21 nt, Human
cuaaaguuuacaguaaauaaa

SEQ ID NO: 3439124 - RNA, 24 nt, Human
cuaaaguuuacaguaaauaaauug

SEQ ID NO: 3439125 - RNA, 22 nt, Human
cuaaauaaaaguuuuacaaagg

SEQ ID NO: 3439126 - RNA, 21 nt, Human
cuaaauaaaaugcuagguucu

SEQ ID NO: 3439127 - RNA, 23 nt, Human
cuaaauaaagcuugcaacaaaau

SEQ ID NO: 3439128 - RNA, 18 nt, Human
cuaaauaaguuauaaaga

SEQ ID NO: 3439129 - RNA, 21 nt, Human
cuaaauaaucuuacucuagau

SEQ ID NO: 3439130 - RNA, 18 nt, Human
cuaagaagcuucuaauaa

SEQ ID NO: 3439131 - RNA, 16 nt, Human
cuaagaauaaacauuu

SEQ ID NO: 3439132 - RNA, 20 nt, Human
cuaagaauaaacauuuguua

SEQ ID NO: 3439133 - RNA, 15 nt, Human
cuaagaauaauaaaa

SEQ ID NO: 3439134 - RNA, 17 nt, Human
cuaagaauacagcuuuc

SEQ ID NO: 3439135 - RNA, 22 nt, Human
cuaagacacaaaugcaugaaca

SEQ ID NO: 3439136 - RNA, 23 nt, Human
cuaagacacaaaugcaugaacaa

SEQ ID NO: 3439137 - RNA, 14 nt, Human
cuaagacuacagca

SEQ ID NO: 3439138 - RNA, 13 nt, Human
cuaagacuauaua

SEQ ID NO: 3439139 - RNA, 22 nt, Human
cuaagacuccucggccuggcuc

SEQ ID NO: 3439140 - RNA, 17 nt, Human
cuaagagaaguagaaau

SEQ ID NO: 3439141 - RNA, 16 nt, Human
cuaagagaaguuauuu

SEQ ID NO: 3439142 - RNA, 22 nt, Human
cuaagagaaguuauuuucuaca

SEQ ID NO: 3439143 - RNA, 16 nt, Human
cuaagagagcaccugg

SEQ ID NO: 3439144 - RNA, 20 nt, Human
cuaagagccauuuaggggcc

SEQ ID NO: 3439145 - RNA, 18 nt, Human
cuaagaggaaaguacauu

SEQ ID NO: 3439146 - RNA, 23 nt, Human
cuaagaggcugcccuccugugcu

SEQ ID NO: 3439147 - RNA, 14 nt, Human
cuaagaggcugcug

SEQ ID NO: 3439148 - RNA, 18 nt, Human
cuaagaguguccuaggag

SEQ ID NO: 3439149 - RNA, 16 nt, Human
cuaagauaguaacaau

SEQ ID NO: 3439150 - RNA, 20 nt, Human
cuaagaucgguuaacaaaua

SEQ ID NO: 3439151 - RNA, 17 nt, Human
cuaagaucuuagauucu

SEQ ID NO: 3439152 - RNA, 18 nt, Human
cuaagaugacauugcuaa

SEQ ID NO: 3439153 - RNA, 23 nt, Human
cuaagaugugauauucuaagacu

SEQ ID NO: 3439154 - RNA, 18 nt, Human
cuaagauguguucuuauu

SEQ ID NO: 3439155 - RNA, 20 nt, Human
cuaagauguuauauuuuucu

SEQ ID NO: 3439156 - RNA, 15 nt, Human
cuaagauuaauagca

SEQ ID NO: 3439157 - RNA, 21 nt, Human
cuaagauuacaaaucagaagu

SEQ ID NO: 3439158 - RNA, 13 nt, Human
cuaagauucuaaa

SEQ ID NO: 3439159 - RNA, 13 nt, Human
cuaagauucuaga

SEQ ID NO: 3439160 - RNA, 16 nt, Human
cuaagauucuagauca

SEQ ID NO: 3439161 - RNA, 11 nt, Human
cuaagauucug

SEQ ID NO: 3439162 - RNA, 14 nt, Human
cuaagauucuuuua

SEQ ID NO: 3439163 - RNA, 13 nt, Human
cuaagcagaaagu

SEQ ID NO: 3439164 - RNA, 14 nt, Human
cuaagcagaaagug

SEQ ID NO: 3439165 - RNA, 16 nt, Human
cuaagcagaaagugcc

SEQ ID NO: 3439166 - RNA, 22 nt, Human
cuaagcagaaagugccuuucag

SEQ ID NO: 3439167 - RNA, 20 nt, Human
cuaagcagaggaggggccgc

SEQ ID NO: 3439168 - RNA, 19 nt, Human
cuaagcagcauuucugaag

SEQ ID NO: 3439169 - RNA, 21 nt, Human
cuaagcauaaaagaugaaaga

SEQ ID NO: 3439170 - RNA, 21 nt, Human
cuaagcauagcaaacagagga

SEQ ID NO: 3439171 - RNA, 15 nt, Human
cuaagcauugccugg

SEQ ID NO: 3439172 - RNA, 20 nt, Human
cuaagccacucuuccaaagg

SEQ ID NO: 3439173 - RNA, 16 nt, Human
cuaagccagcugcccc

SEQ ID NO: 3439174 - RNA, 16 nt, Human
cuaagcccaugggaca

SEQ ID NO: 3439175 - RNA, 15 nt, Human
cuaagccccagcaag

SEQ ID NO: 3439176 - RNA, 16 nt, Human
cuaagccccagcaagc

SEQ ID NO: 3439177 - RNA, 14 nt, Human
cuaagcccccgcug

SEQ ID NO: 3439178 - RNA, 18 nt, Human
cuaagcccccgcuguaau

SEQ ID NO: 3439179 - RNA, 22 nt, Human
cuaagcccccgcuguaaugaaa

SEQ ID NO: 3439180 - RNA, 12 nt, Human
cuaagcccuguc

SEQ ID NO: 3439181 - RNA, 14 nt, Human
cuaagccuccuuuu

SEQ ID NO: 3439182 - RNA, 22 nt, Human
cggcaggcucacugccaggcca

SEQ ID NO: 3439183 - RNA, 15 nt, Human
cggcaggggccugga

SEQ ID NO: 3439184 - RNA, 18 nt, Human
cggcaggggccuggagau

SEQ ID NO: 3439185 - RNA, 19 nt, Human
cggcaggggccuggagauc

SEQ ID NO: 3439186 - RNA, 16 nt, Human
cggcaguucugggugc

SEQ ID NO: 3439187 - RNA, 22 nt, Human
cggcaugggaaagccaccucuc

SEQ ID NO: 3439188 - RNA, 12 nt, Human
cggccaagaaug

SEQ ID NO: 3439189 - RNA, 13 nt, Human
cggccaagaaugu

SEQ ID NO: 3439190 - RNA, 15 nt, Human
cggccaauggaaacc

SEQ ID NO: 3439191 - RNA, 15 nt, Human
cggccacacagcugc

SEQ ID NO: 3439192 - RNA, 17 nt, Human
cggccacacagcugccg

SEQ ID NO: 3439193 - RNA, 16 nt, Human
cggccacuggccaucu

SEQ ID NO: 3439194 - RNA, 22 nt, Human
cggccagccccggcccugggcu

SEQ ID NO: 3439195 - RNA, 22 nt, Human
cggccagccccuggccccagga

SEQ ID NO: 3439196 - RNA, 20 nt, Human
cggccaggccagagggagug

SEQ ID NO: 3439197 - RNA, 17 nt, Human
cggccagggagaagcuc

SEQ ID NO: 3439198 - RNA, 13 nt, Human
cggccaggugggc

SEQ ID NO: 3439199 - RNA, 16 nt, Human
cggcccaagcccgacu

SEQ ID NO: 3439200 - RNA, 17 nt, Human
cggcccaauccaaggug

SEQ ID NO: 3439201 - RNA, 17 nt, Human
cggcccagcccggcucc

SEQ ID NO: 3439202 - RNA, 17 nt, Human
cggcccaggauggcuuu

SEQ ID NO: 3439203 - RNA, 17 nt, Human
cggccccaccagugccu

SEQ ID NO: 3439204 - RNA, 22 nt, Human
cggccccagcaccucagccugc

SEQ ID NO: 3439205 - RNA, 12 nt, Human
cggccccagcca

SEQ ID NO: 3439206 - RNA, 14 nt, Human
cggccccagcuucu

SEQ ID NO: 3439207 - RNA, 21 nt, Human
cggcccccagagcgccccucc

SEQ ID NO: 3439208 - RNA, 17 nt, Human
cggcccccaugcaaggu

SEQ ID NO: 3439209 - RNA, 14 nt, Human
cggccccucccccu

SEQ ID NO: 3439210 - RNA, 15 nt, Human
cggccccucccgccc

SEQ ID NO: 3439211 - RNA, 22 nt, Human
cggccccugcauccccuuggcu

SEQ ID NO: 3439212 - RNA, 13 nt, Human
cggccccugcugg

SEQ ID NO: 3439213 - RNA, 17 nt, Human
cggcccgccucuccucg

SEQ ID NO: 3439214 - RNA, 17 nt, Human
cggcccgcgccacagga

SEQ ID NO: 3439215 - RNA, 18 nt, Human
cggcccuaccagcgcccg

SEQ ID NO: 3439216 - RNA, 14 nt, Human
cggcccuagcccag

SEQ ID NO: 3439217 - RNA, 18 nt, Human
cggcccucaucuaugagg

SEQ ID NO: 3439218 - RNA, 13 nt, Human
cggcccuccagag

SEQ ID NO: 3439219 - RNA, 20 nt, Human
cggcccuccagagccccaca

SEQ ID NO: 3439220 - RNA, 17 nt, Human
cggcccugcagccagcu

SEQ ID NO: 3439221 - RNA, 19 nt, Human
cggcccugcagccagcuca

SEQ ID NO: 3439222 - RNA, 22 nt, Human
cggcccugggcucggaggcugc

SEQ ID NO: 3439223 - RNA, 11 nt, Human
cggcccugggg

SEQ ID NO: 3439224 - RNA, 15 nt, Human
cggccgcauucccug

SEQ ID NO: 3439225 - RNA, 18 nt, Human
cggccgcauucccugagu

SEQ ID NO: 3439226 - RNA, 15 nt, Human
cggccgcuccagggg

SEQ ID NO: 3439227 - RNA, 14 nt, Human
cggccggccagccc

SEQ ID NO: 3439228 - RNA, 19 nt, Human
cggccgucuucacucgccc

SEQ ID NO: 3439229 - RNA, 20 nt, Human
cggccuagggcccccacagu

SEQ ID NO: 3439230 - RNA, 19 nt, Human
cggccuaugacuugggcac

SEQ ID NO: 3439231 - RNA, 12 nt, Human
cggccucagagu

SEQ ID NO: 3439232 - RNA, 14 nt, Human
cggccuccauccug

SEQ ID NO: 3439233 - RNA, 18 nt, Human
cggccucuaaccccaggc

SEQ ID NO: 3439234 - RNA, 17 nt, Human
cggccucuucucucaga

SEQ ID NO: 3439235 - RNA, 18 nt, Human
cggccucuucucucagac

SEQ ID NO: 3439236 - RNA, 19 nt, Human
cggccucuucucucagacc

SEQ ID NO: 3439237 - RNA, 14 nt, Human
cggccugccaggag

SEQ ID NO: 3439238 - RNA, 22 nt, Human
cggccugccaggaggacccagg

SEQ ID NO: 3439239 - RNA, 15 nt, Human
cggccugguguucug

SEQ ID NO: 3439240 - RNA, 21 nt, Human
cggccuguccuccaacaccaa

SEQ ID NO: 3439241 - RNA, 16 nt, Human
cggccuugcugggggc

SEQ ID NO: 3439242 - RNA, 13 nt, Human
cggcgccaccauc

SEQ ID NO: 3439243 - RNA, 15 nt, Human
cggcggaaagccugu

SEQ ID NO: 3439244 - RNA, 13 nt, Human
cggcggagcuggc

SEQ ID NO: 3439245 - RNA, 21 nt, Human
cggcggagcuggccccgccgc

SEQ ID NO: 3439246 - RNA, 15 nt, Human
cggcggucccagcuc

SEQ ID NO: 3439247 - RNA, 16 nt, Human
cggcguacaggcuggc

SEQ ID NO: 3439248 - RNA, 15 nt, Human
cggcucacugcagcc

SEQ ID NO: 3439249 - RNA, 16 nt, Human
cggcucacugcagccu

SEQ ID NO: 3439250 - RNA, 19 nt, Human
cggcucacugcagccucaa

SEQ ID NO: 3439251 - RNA, 21 nt, Human
cggcucacugcauccuccgcc

SEQ ID NO: 3439252 - RNA, 19 nt, Human
cggcucagugcaaccucug

SEQ ID NO: 3439253 - RNA, 15 nt, Human
cggcuccacuaggac

SEQ ID NO: 3439254 - RNA, 14 nt, Human
cggcuccaggcucc

SEQ ID NO: 3439255 - RNA, 13 nt, Human
cggcucccagccu

SEQ ID NO: 3439256 - RNA, 20 nt, Human
cggcuccccauguguccugg

SEQ ID NO: 3439257 - RNA, 12 nt, Human
cggcuccuggac

SEQ ID NO: 3439258 - RNA, 13 nt, Human
cggcuccugugcu

SEQ ID NO: 3439259 - RNA, 14 nt, Human
cggcuccugugcuu

SEQ ID NO: 3439260 - RNA, 20 nt, Human
cggcucggaggaagccccca

SEQ ID NO: 3439261 - RNA, 16 nt, Human
cggcucuuuccuugcu

SEQ ID NO: 3439262 - RNA, 22 nt, Human
cggcugaccaugcucaucugcu

SEQ ID NO: 3439263 - RNA, 11 nt, Human
cggcugagagc

SEQ ID NO: 3439264 - RNA, 14 nt, Human
cggcugagagcccc

SEQ ID NO: 3439265 - RNA, 17 nt, Human
cggcugagagccccagc

SEQ ID NO: 3439266 - RNA, 18 nt, Human
cggcugagagccccagcu

SEQ ID NO: 3439267 - RNA, 19 nt, Human
cggcugagagccccagcug

SEQ ID NO: 3439268 - RNA, 20 nt, Human
cggcugagagccccagcuga

SEQ ID NO: 3439269 - RNA, 12 nt, Human
cggcugcagagg

SEQ ID NO: 3439270 - RNA, 15 nt, Human
cggcugcagaggcca

SEQ ID NO: 3439271 - RNA, 18 nt, Human
cggcugcagcucacccag

SEQ ID NO: 3439272 - RNA, 15 nt, Human
cggcuggacuuggag

SEQ ID NO: 3439273 - RNA, 17 nt, Human
cggcuggagaccaugca

SEQ ID NO: 3439274 - RNA, 14 nt, Human
cggcuggcagccca

SEQ ID NO: 3439275 - RNA, 13 nt, Human
cggcuggccaugg

SEQ ID NO: 3439276 - RNA, 19 nt, Human
ccaccgccuugcccagccu

SEQ ID NO: 3439277 - RNA, 15 nt, Human
ccaccgcuccccagc

SEQ ID NO: 3439278 - RNA, 17 nt, Human
ccaccgcuccccagccc

SEQ ID NO: 3439279 - RNA, 21 nt, Human
ccaccgcuccccagcccaggg

SEQ ID NO: 3439280 - RNA, 13 nt, Human
ccaccgcugccua

SEQ ID NO: 3439281 - RNA, 14 nt, Human
ccaccgcugccuaa

SEQ ID NO: 3439282 - RNA, 14 nt, Human
ccaccgggccacuc

SEQ ID NO: 3439283 - RNA, 21 nt, Human
ccaccgggccacuccuuccug

SEQ ID NO: 3439284 - RNA, 22 nt, Human
ccaccgggccacuccuuccugc

SEQ ID NO: 3439285 - RNA, 15 nt, Human
ccaccguccgcccug

SEQ ID NO: 3439286 - RNA, 16 nt, Human
ccaccguccgcccugc

SEQ ID NO: 3439287 - RNA, 19 nt, Human
ccaccguccgcccugcucc

SEQ ID NO: 3439288 - RNA, 13 nt, Human
ccaccguggagga

SEQ ID NO: 3439289 - RNA, 14 nt, Human
ccaccuagaacacu

SEQ ID NO: 3439290 - RNA, 21 nt, Human
ccaccuagacuguaaaccucu

SEQ ID NO: 3439291 - RNA, 15 nt, Human
ccaccuaguggcugu

SEQ ID NO: 3439292 - RNA, 18 nt, Human
ccaccuaucucgugggag

SEQ ID NO: 3439293 - RNA, 21 nt, Human
ccaccuaucucgugggagagc

SEQ ID NO: 3439294 - RNA, 18 nt, Human
ccaccucacuccuguuac

SEQ ID NO: 3439295 - RNA, 18 nt, Human
ccaccucagaccccgggg

SEQ ID NO: 3439296 - RNA, 12 nt, Human
ccaccucagccu

SEQ ID NO: 3439297 - RNA, 16 nt, Human
ccaccucagccuccug

SEQ ID NO: 3439298 - RNA, 22 nt, Human
ccaccuccagcccgggagccua

SEQ ID NO: 3439299 - RNA, 14 nt, Human
ccaccuccaguccc

SEQ ID NO: 3439300 - RNA, 24 nt, Human
ccaccuccagucccccuauccuug

SEQ ID NO: 3439301 - RNA, 17 nt, Human
ccaccuccccacgcccu

SEQ ID NO: 3439302 - RNA, 18 nt, Human
ccaccuccccacgcccuc

SEQ ID NO: 3439303 - RNA, 13 nt, Human
ccaccuccccagg

SEQ ID NO: 3439304 - RNA, 16 nt, Human
ccaccuccccccacaa

SEQ ID NO: 3439305 - RNA, 17 nt, Human
ccaccuccccuauccac

SEQ ID NO: 3439306 - RNA, 19 nt, Human
ccaccuccccuauccaccc

SEQ ID NO: 3439307 - RNA, 18 nt, Human
ccaccuccccuugccagc

SEQ ID NO: 3439308 - RNA, 19 nt, Human
ccaccuccccuugccagcu

SEQ ID NO: 3439309 - RNA, 20 nt, Human
ccaccucccucaaccucauc

SEQ ID NO: 3439310 - RNA, 15 nt, Human
ccaccucccugccca

SEQ ID NO: 3439311 - RNA, 17 nt, Human
ccaccucccugcccagg

SEQ ID NO: 3439312 - RNA, 14 nt, Human
ccaccucccugccu

SEQ ID NO: 3439313 - RNA, 18 nt, Human
ccaccucccugccuccag

SEQ ID NO: 3439314 - RNA, 23 nt, Human
ccaccuccuaaaaggcccagaga

SEQ ID NO: 3439315 - RNA, 20 nt, Human
ccaccucgcagguucaagca

SEQ ID NO: 3439316 - RNA, 15 nt, Human
ccaccucuaacagca

SEQ ID NO: 3439317 - RNA, 21 nt, Human
ccaccucuaacagcaccaaau

SEQ ID NO: 3439318 - RNA, 14 nt, Human
ccaccucucaauau

SEQ ID NO: 3439319 - RNA, 12 nt, Human
ccaccucucccu

SEQ ID NO: 3439320 - RNA, 16 nt, Human
ccaccucucccugacc

SEQ ID NO: 3439321 - RNA, 17 nt, Human
ccaccucucccugaccc

SEQ ID NO: 3439322 - RNA, 18 nt, Human
ccaccucucccugacccu

SEQ ID NO: 3439323 - RNA, 20 nt, Human
ccaccucucucacuccuuga

SEQ ID NO: 3439324 - RNA, 15 nt, Human
ccaccucucuuuuuc

SEQ ID NO: 3439325 - RNA, 13 nt, Human
ccaccucugcgga

SEQ ID NO: 3439326 - RNA, 22 nt, Human
ccaccucugcggaccccagcug

SEQ ID NO: 3439327 - RNA, 17 nt, Human
ccaccucuuccuggccg

SEQ ID NO: 3439328 - RNA, 18 nt, Human
ccaccucuucucuuccug

SEQ ID NO: 3439329 - RNA, 20 nt, Human
ccaccucuucucuuccugua

SEQ ID NO: 3439330 - RNA, 23 nt, Human
ccaccugacacaccaggcgcuaa

SEQ ID NO: 3439331 - RNA, 20 nt, Human
ccaccugagcuuuggacaca

SEQ ID NO: 3439332 - RNA, 14 nt, Human
ccaccugagguggg

SEQ ID NO: 3439333 - RNA, 20 nt, Human
ccaccugaggugggcccagg

SEQ ID NO: 3439334 - RNA, 21 nt, Human
ccaccugaggugggcccagga

SEQ ID NO: 3439335 - RNA, 15 nt, Human
ccaccugcagcuccc

SEQ ID NO: 3439336 - RNA, 17 nt, Human
ccaccugcagcucccuc

SEQ ID NO: 3439337 - RNA, 17 nt, Human
ccaccugcagggcugcc

SEQ ID NO: 3439338 - RNA, 11 nt, Human
cuaagccugug

SEQ ID NO: 3439339 - RNA, 15 nt, Human
cuaagccuguggcug

SEQ ID NO: 3439340 - RNA, 22 nt, Human
cuaagcggaccagccucccugu

SEQ ID NO: 3439341 - RNA, 15 nt, Human
cuaagcuaacccccu

SEQ ID NO: 3439342 - RNA, 22 nt, Human
cuaagcuaggaaugaaauccug

SEQ ID NO: 3439343 - RNA, 19 nt, Human
cuaagcuauucaguaauaa

SEQ ID NO: 3439344 - RNA, 14 nt, Human
cuaagcugcagcuu

SEQ ID NO: 3439345 - RNA, 17 nt, Human
cuaagcugcagcuuccu

SEQ ID NO: 3439346 - RNA, 15 nt, Human
cuaagcuuaaaaaaa

SEQ ID NO: 3439347 - RNA, 17 nt, Human
cuaagcuuaaaaaaaac

SEQ ID NO: 3439348 - RNA, 19 nt, Human
cuaagcuuugccagcugcu

SEQ ID NO: 3439349 - RNA, 20 nt, Human
cuaagcuuugccagcugcug

SEQ ID NO: 3439350 - RNA, 21 nt, Human
cuaaggacaagguaaggaggg

SEQ ID NO: 3439351 - RNA, 12 nt, Human
cuaaggacacac

SEQ ID NO: 3439352 - RNA, 13 nt, Human
cuaaggacacacu

SEQ ID NO: 3439353 - RNA, 19 nt, Human
cuaaggaccugaaauucca

SEQ ID NO: 3439354 - RNA, 22 nt, Human
cuaaggaccugaaauuccaaag

SEQ ID NO: 3439355 - RNA, 11 nt, Human
cuaaggaccuu

SEQ ID NO: 3439356 - RNA, 14 nt, Human
cuaaggacuucuuu

SEQ ID NO: 3439357 - RNA, 16 nt, Human
cuaaggacuucuuuaa

SEQ ID NO: 3439358 - RNA, 22 nt, Human
cuaaggacuucuuuaauuuugg

SEQ ID NO: 3439359 - RNA, 16 nt, Human
cuaaggacuuguuaga

SEQ ID NO: 3439360 - RNA, 20 nt, Human
cuaaggauagcaccgcuuuu

SEQ ID NO: 3439361 - RNA, 12 nt, Human
cuaaggaucucu

SEQ ID NO: 3439362 - RNA, 17 nt, Human
cuaaggaucucucagga

SEQ ID NO: 3439363 - RNA, 23 nt, Human
cuaaggaucucucaggagcacag

SEQ ID NO: 3439364 - RNA, 20 nt, Human
cuaaggcaucuaucugugcu

SEQ ID NO: 3439365 - RNA, 21 nt, Human
cuaaggccuaggauucuaaaa

SEQ ID NO: 3439366 - RNA, 22 nt, Human
cuaaggcguggagcugccugau

SEQ ID NO: 3439367 - RNA, 16 nt, Human
cuaaggcuccuguuuu

SEQ ID NO: 3439368 - RNA, 19 nt, Human
cuaaggcucuaugagucua

SEQ ID NO: 3439369 - RNA, 20 nt, Human
cuaaggcucuaugagucuag

SEQ ID NO: 3439370 - RNA, 23 nt, Human
cuaaggcucuaugagucuagaug

SEQ ID NO: 3439371 - RNA, 13 nt, Human
cuaaggcucugag

SEQ ID NO: 3439372 - RNA, 23 nt, Human
cuaaggcucugagagucuagauu

SEQ ID NO: 3439373 - RNA, 14 nt, Human
cuaaggcugaacuu

SEQ ID NO: 3439374 - RNA, 15 nt, Human
cuaaggcuguuugcu

SEQ ID NO: 3439375 - RNA, 17 nt, Human
cuaaggcuguuugcuuc

SEQ ID NO: 3439376 - RNA, 18 nt, Human
cuaagggaagacauuucu

SEQ ID NO: 3439377 - RNA, 17 nt, Human
cuaagggagagugguau

SEQ ID NO: 3439378 - RNA, 13 nt, Human
cuaaggggcccgg

SEQ ID NO: 3439379 - RNA, 18 nt, Human
cuaaggggcccggccagc

SEQ ID NO: 3439380 - RNA, 18 nt, Human
cuaagggggaggggaagu

SEQ ID NO: 3439381 - RNA, 19 nt, Human
cuaagggggaggggaaguc

SEQ ID NO: 3439382 - RNA, 23 nt, Human
cuaagggucgaaagcucuagaau

SEQ ID NO: 3439383 - RNA, 19 nt, Human
cuaagggugggugcucaga

SEQ ID NO: 3439384 - RNA, 21 nt, Human
cuaagggugggugcucagaau

SEQ ID NO: 3439385 - RNA, 22 nt, Human
cuaagggugggugcucagaaua

SEQ ID NO: 3439386 - RNA, 18 nt, Human
cuaaggguguaaguaauu

SEQ ID NO: 3439387 - RNA, 21 nt, Human
cuaagguccgguguucuaaga

SEQ ID NO: 3439388 - RNA, 23 nt, Human
cuaaggucuuggaacuugccugc

SEQ ID NO: 3439389 - RNA, 11 nt, Human
cuaagguucua

SEQ ID NO: 3439390 - RNA, 14 nt, Human
cuaagguucuaagg

SEQ ID NO: 3439391 - RNA, 15 nt, Human
cuaagguucuaaggc

SEQ ID NO: 3439392 - RNA, 14 nt, Human
cuaaguaaaaccac

SEQ ID NO: 3439393 - RNA, 19 nt, Human
cuaaguaaaaccacagcag

SEQ ID NO: 3439394 - RNA, 20 nt, Human
cuaaguaaaaccacagcagu

SEQ ID NO: 3439395 - RNA, 19 nt, Human
cuaaguaaauacaauuuuu

SEQ ID NO: 3439396 - RNA, 18 nt, Human
cuaaguaaaucucuucug

SEQ ID NO: 3439397 - RNA, 13 nt, Human
cuaaguacuguaa

SEQ ID NO: 3439398 - RNA, 22 nt, Human
cuaaguacuguaauaauaccuc

SEQ ID NO: 3439399 - RNA, 18 nt, Human
cuaaguaucaaguauaga

SEQ ID NO: 3439400 - RNA, 12 nt, Human
cuaaguauuaaa

SEQ ID NO: 3439401 - RNA, 17 nt, Human
cuaaguauuucccagca

SEQ ID NO: 3439402 - RNA, 17 nt, Human
cuaagucaacuuagcau

SEQ ID NO: 3439403 - RNA, 12 nt, Human
cuaagucaguac

SEQ ID NO: 3439404 - RNA, 14 nt, Human
cuaagucauucaua

SEQ ID NO: 3439405 - RNA, 16 nt, Human
cuaagucccugccccc

SEQ ID NO: 3439406 - RNA, 15 nt, Human
cuaaguccuuuaugu

SEQ ID NO: 3439407 - RNA, 12 nt, Human
cuaagucucugu

SEQ ID NO: 3439408 - RNA, 20 nt, Human
cuaagugaaauaagccagac

SEQ ID NO: 3439409 - RNA, 16 nt, Human
cuaagugauauaaauc

SEQ ID NO: 3439410 - RNA, 20 nt, Human
cuaagugauccucccaccuc

SEQ ID NO: 3439411 - RNA, 17 nt, Human
cuaagugcuaagugcuu

SEQ ID NO: 3439412 - RNA, 20 nt, Human
cuaagugggcauugccaugu

SEQ ID NO: 3439413 - RNA, 15 nt, Human
cuaaguuaauuuaaa

SEQ ID NO: 3439414 - RNA, 20 nt, Human
cuaaguuauaguauaucugg

SEQ ID NO: 3439415 - RNA, 18 nt, Human
cuaaguucacauuagaau

SEQ ID NO: 3439416 - RNA, 18 nt, Human
cuaaguuccacugagcuc

SEQ ID NO: 3439417 - RNA, 15 nt, Human
cuaaguucuuagaua

SEQ ID NO: 3439418 - RNA, 19 nt, Human
cuaaguugaguauauuaua

SEQ ID NO: 3439419 - RNA, 22 nt, Human
cuaaguugaguauauuauaaua

SEQ ID NO: 3439420 - RNA, 23 nt, Human
cuaaaguacugagcagugauauu

SEQ ID NO: 3439421 - RNA, 19 nt, Human
cuaaaguauuuuuauaaau

SEQ ID NO: 3439422 - RNA, 19 nt, Human
cuaaaguguauuuuuuuac

SEQ ID NO: 3439423 - RNA, 19 nt, Human
cuaaaguguguuguugcuu

SEQ ID NO: 3439424 - RNA, 16 nt, Human
cuaaaguuauauuuca

SEQ ID NO: 3439425 - RNA, 13 nt, Human
cuaaaguucuaag

SEQ ID NO: 3439426 - RNA, 15 nt, Human
cuaaaguuguacuuu

SEQ ID NO: 3439427 - RNA, 19 nt, Human
cuaaaguuguacuuuaaaa

SEQ ID NO: 3439428 - RNA, 13 nt, Human
cuaaaguuuacag

SEQ ID NO: 3439429 - RNA, 14 nt, Human
cuaaaguuuacagu

SEQ ID NO: 3439430 - RNA, 18 nt, Human
cuaaaguuuacaguaaau

SEQ ID NO: 3439431 - RNA, 15 nt, Human
cuaaauaaaauauaa

SEQ ID NO: 3439432 - RNA, 19 nt, Human
cuaaauaaaauauaauugu

SEQ ID NO: 3439433 - RNA, 13 nt, Human
cuaaauaaaaugc

SEQ ID NO: 3439434 - RNA, 22 nt, Human
cuaaauaaacacauagauucac

SEQ ID NO: 3439435 - RNA, 16 nt, Human
cuaaauaaagauauug

SEQ ID NO: 3439436 - RNA, 19 nt, Human
cuaaauaccucaaucaguc

SEQ ID NO: 3439437 - RNA, 17 nt, Human
cuaaauacuugcuccau

SEQ ID NO: 3439438 - RNA, 14 nt, Human
cuaaauagcaugua

SEQ ID NO: 3439439 - RNA, 17 nt, Human
cuaaauagcauguauug

SEQ ID NO: 3439440 - RNA, 22 nt, Human
cuaaauagcauguauugugucu

SEQ ID NO: 3439441 - RNA, 17 nt, Human
cuaaauauauuuuaaga

SEQ ID NO: 3439442 - RNA, 15 nt, Human
cuaaauauuuccuua

SEQ ID NO: 3439443 - RNA, 15 nt, Human
cuaaaucagagacaa

SEQ ID NO: 3439444 - RNA, 19 nt, Human
cuaaauccauuuggaaauc

SEQ ID NO: 3439445 - RNA, 20 nt, Human
cuaaauccauuuggaaaucu

SEQ ID NO: 3439446 - RNA, 16 nt, Human
cuaaaucuauuuauua

SEQ ID NO: 3439447 - RNA, 18 nt, Human
cuaaaucuguaagcucuu

SEQ ID NO: 3439448 - RNA, 14 nt, Human
cuaaaugaauguuu

SEQ ID NO: 3439449 - RNA, 19 nt, Human
cuaaaugccuaauaaacaa

SEQ ID NO: 3439450 - RNA, 20 nt, Human
cuaaaugccuaguuuuuagu

SEQ ID NO: 3439451 - RNA, 15 nt, Human
cuaaauggaaccacu

SEQ ID NO: 3439452 - RNA, 19 nt, Human
cuaaauggucgcccaggag

SEQ ID NO: 3439453 - RNA, 21 nt, Human
cuaaauggucgcccaggagac

SEQ ID NO: 3439454 - RNA, 14 nt, Human
cuaaauguaacagu

SEQ ID NO: 3439455 - RNA, 18 nt, Human
cuaaaugugcaauagaag

SEQ ID NO: 3439456 - RNA, 21 nt, Human
cuaaauguggagaaacuguag

SEQ ID NO: 3439457 - RNA, 17 nt, Human
cuaaauguuaaagaugu

SEQ ID NO: 3439458 - RNA, 15 nt, Human
cuaaauuaacuuuuu

SEQ ID NO: 3439459 - RNA, 15 nt, Human
cuaaauuauuuacug

SEQ ID NO: 3439460 - RNA, 23 nt, Human
cuaaauuauuuacugcaaaaaga

SEQ ID NO: 3439461 - RNA, 15 nt, Human
cuaaauucuuuauuu

SEQ ID NO: 3439462 - RNA, 19 nt, Human
cuaaauucuuuauuucugu

SEQ ID NO: 3439463 - RNA, 12 nt, Human
cuaaauugaaua

SEQ ID NO: 3439464 - RNA, 14 nt, Human
cuaaauugauguug

SEQ ID NO: 3439465 - RNA, 18 nt, Human
cuaaauuguaaacuccug

SEQ ID NO: 3439466 - RNA, 23 nt, Human
cuaaauuugaauguuaagcagau

SEQ ID NO: 3439467 - RNA, 15 nt, Human
cuaaauuugauacuu

SEQ ID NO: 3439468 - RNA, 16 nt, Human
cuaaauuugauacuua

SEQ ID NO: 3439469 - RNA, 18 nt, Human
cuaaauuugauacuuaua

SEQ ID NO: 3439470 - RNA, 21 nt, Human
cuaaauuugauacuuauauuu

SEQ ID NO: 3439471 - RNA, 14 nt, Human
cuaaauuuuaaagc

SEQ ID NO: 3439472 - RNA, 20 nt, Human
cuaaauuuuauaucuuguag

SEQ ID NO: 3439473 - RNA, 17 nt, Human
cuaaauuuuccuguccu

SEQ ID NO: 3439474 - RNA, 19 nt, Human
cuaaauuuuccuguccucu

SEQ ID NO: 3439475 - RNA, 13 nt, Human
cuaaauuuucuga

SEQ ID NO: 3439476 - RNA, 16 nt, Human
cuaacacacagcuccc

SEQ ID NO: 3439477 - RNA, 14 nt, Human
cuaacacagcaugu

SEQ ID NO: 3439478 - RNA, 17 nt, Human
cuaacacauuaucggga

SEQ ID NO: 3439479 - RNA, 13 nt, Human
cuaacaccagcgu

SEQ ID NO: 3439480 - RNA, 21 nt, Human
cuaacaccagcguuugagggg

SEQ ID NO: 3439481 - RNA, 20 nt, Human
cuaacacucagaagccuggg

SEQ ID NO: 3439482 - RNA, 20 nt, Human
cuaacacuggcauguucaaa

SEQ ID NO: 3439483 - RNA, 14 nt, Human
cuaacacuggcccc

SEQ ID NO: 3439484 - RNA, 14 nt, Human
cuaacacuuacccc

SEQ ID NO: 3439485 - RNA, 23 nt, Human
cuaacacuuaccccauggcugca

SEQ ID NO: 3439486 - RNA, 12 nt, Human
cuaacagcccuc

SEQ ID NO: 3439487 - RNA, 15 nt, Human
cuaacaggggcuggu

SEQ ID NO: 3439488 - RNA, 19 nt, Human
cuaacauaccguuuauaau

SEQ ID NO: 3439489 - RNA, 12 nt, Human
cuaacauauaau

SEQ ID NO: 3439490 - RNA, 15 nt, Human
cuaacaugaagaccu

SEQ ID NO: 3439491 - RNA, 15 nt, Human
cuaacauuauauugc

SEQ ID NO: 3439492 - RNA, 17 nt, Human
cuaacauuauuacuuuu

SEQ ID NO: 3439493 - RNA, 18 nt, Human
cuaacauuuuaaauaaaa

SEQ ID NO: 3439494 - RNA, 22 nt, Human
cuaaccaaaucucucaaaucug

SEQ ID NO: 3439495 - RNA, 10 nt, Human
cuaaccaagu

SEQ ID NO: 3439496 - RNA, 15 nt, Human
cuaaccacacagccu

SEQ ID NO: 3439497 - RNA, 13 nt, Human
cuaaccacaucaa

SEQ ID NO: 3439498 - RNA, 16 nt, Human
cuaaccagcagaaaug

SEQ ID NO: 3439499 - RNA, 12 nt, Human
cuaaccagggcc

SEQ ID NO: 3439500 - RNA, 19 nt, Human
cuaaccccaacgcacagga

SEQ ID NO: 3439501 - RNA, 13 nt, Human
cuaaccccuucca

SEQ ID NO: 3439502 - RNA, 14 nt, Human
cuaaccccuuccag

SEQ ID NO: 3439503 - RNA, 13 nt, Human
cuaaccccuuucc

SEQ ID NO: 3439504 - RNA, 20 nt, Human
cuaacccucccauggcaccu

SEQ ID NO: 3439505 - RNA, 13 nt, Human
cuaaccucgcccu

SEQ ID NO: 3439506 - RNA, 17 nt, Human
cuaaccucgcccucucc

SEQ ID NO: 3439507 - RNA, 21 nt, Human
cuaaccugccgagaguccauc

SEQ ID NO: 3439508 - RNA, 12 nt, Human
cuaaccuguguc

SEQ ID NO: 3439509 - RNA, 22 nt, Human
cuaaccuuauccugcauuguua

SEQ ID NO: 3439510 - RNA, 12 nt, Human
cuaaccuugaau

SEQ ID NO: 3439511 - RNA, 13 nt, Human
cuaaccuuuacau

SEQ ID NO: 3439512 - RNA, 13 nt, Human
cuaacgccugagc

SEQ ID NO: 3439513 - RNA, 20 nt, Human
cuaacgccugagcccaggga

SEQ ID NO: 3439514 - RNA, 16 nt, Human
cuaacggugcucaggg

SEQ ID NO: 3439515 - RNA, 17 nt, Human
cuaacggugcucagggg

SEQ ID NO: 3439516 - RNA, 23 nt, Human
cuaacuacaaagguuuaaaugaa

SEQ ID NO: 3439517 - RNA, 23 nt, Human
cuaacuagacaccaaaguucuaa

SEQ ID NO: 3439518 - RNA, 15 nt, Human
cuaacucaccuaacu

SEQ ID NO: 3439519 - RNA, 17 nt, Human
cuaacucauacugugcu

SEQ ID NO: 3439520 - RNA, 14 nt, Human
cuaacuccagugaa

SEQ ID NO: 3439521 - RNA, 14 nt, Human
cuaacuccugagaa

SEQ ID NO: 3439522 - RNA, 14 nt, Human
cuaacucugaugua

SEQ ID NO: 3439523 - RNA, 15 nt, Human
cuaacucugauguaa

SEQ ID NO: 3439524 - RNA, 21 nt, Human
cuaacucugauguaaaugaag

SEQ ID NO: 3439525 - RNA, 14 nt, Human
cuaacuggacuggu

SEQ ID NO: 3439526 - RNA, 15 nt, Human
cuaacuguacauuuc

SEQ ID NO: 3439527 - RNA, 13 nt, Human
cuaacuguaucuu

SEQ ID NO: 3439528 - RNA, 21 nt, Human
cuaacuuacaaagauucucua

SEQ ID NO: 3439529 - RNA, 15 nt, Human
cuaacuucaccauau

SEQ ID NO: 3439530 - RNA, 18 nt, Human
cuaacuucuaaaacugua

SEQ ID NO: 3439531 - RNA, 18 nt, Human
cuaacuugcuuaaaugug

SEQ ID NO: 3439532 - RNA, 20 nt, Human
cuaacuuggagccccagugc

SEQ ID NO: 3439533 - RNA, 20 nt, Human
cuaacuuuagaagugcauuu

SEQ ID NO: 3439534 - RNA, 23 nt, Human
cuaacuuuagaagugcauuucug

SEQ ID NO: 3439535 - RNA, 15 nt, Human
cuaagaaaagauuuu

SEQ ID NO: 3439536 - RNA, 20 nt, Human
cuaagaaaagauuuuaauca

SEQ ID NO: 3439537 - RNA, 13 nt, Human
cuaagaaacauug

SEQ ID NO: 3439538 - RNA, 19 nt, Human
cuaagaaacauuggaagca

SEQ ID NO: 3439539 - RNA, 22 nt, Human
cuaagaaacauuggaagcaggu

SEQ ID NO: 3439540 - RNA, 14 nt, Human
cuaagaaacuuuug

SEQ ID NO: 3439541 - RNA, 15 nt, Human
cuaagaaagaacacg

SEQ ID NO: 3439542 - RNA, 16 nt, Human
cuaagaaagaggagug

SEQ ID NO: 3439543 - RNA, 19 nt, Human
cuaagaaagaggagugcuu

SEQ ID NO: 3439544 - RNA, 21 nt, Human
cuaagaaagaggagugcuugu

SEQ ID NO: 3439545 - RNA, 20 nt, Human
cuaagaaauaugcacaauag

SEQ ID NO: 3439546 - RNA, 21 nt, Human
cuaagaaaucaaguaaugaau

SEQ ID NO: 3439547 - RNA, 21 nt, Human
cuaagaaauugaauacuuuga

SEQ ID NO: 3439548 - RNA, 17 nt, Human
cuagcacaauuugcacu

SEQ ID NO: 3439549 - RNA, 16 nt, Human
cuagcacagcucccuu

SEQ ID NO: 3439550 - RNA, 14 nt, Human
cuagcacaugcuuc

SEQ ID NO: 3439551 - RNA, 18 nt, Human
cuagcaccugccagggag

SEQ ID NO: 3439552 - RNA, 17 nt, Human
cuagcacucacaugcug

SEQ ID NO: 3439553 - RNA, 18 nt, Human
cuagcacucauuuucuau

SEQ ID NO: 3439554 - RNA, 15 nt, Human
cuagcacuggccugc

SEQ ID NO: 3439555 - RNA, 16 nt, Human
cuagcacuggccugca

SEQ ID NO: 3439556 - RNA, 19 nt, Human
cuagcagagcaggggcagg

SEQ ID NO: 3439557 - RNA, 12 nt, Human
cuagcagcaccg

SEQ ID NO: 3439558 - RNA, 20 nt, Human
cuagcagcaccguucugugc

SEQ ID NO: 3439559 - RNA, 12 nt, Human
cuagcagcaggg

SEQ ID NO: 3439560 - RNA, 20 nt, Human
cuagcagcccacccugcugc

SEQ ID NO: 3439561 - RNA, 17 nt, Human
cuagcagugaacuauuu

SEQ ID NO: 3439562 - RNA, 13 nt, Human
cuagcaguggcag

SEQ ID NO: 3439563 - RNA, 17 nt, Human
cuagcauaucugccuuu

SEQ ID NO: 3439564 - RNA, 18 nt, Human
cuagcauaucugccuuua

SEQ ID NO: 3439565 - RNA, 16 nt, Human
cuagcaucucaugagu

SEQ ID NO: 3439566 - RNA, 20 nt, Human
cuaagacucaaauguucuaa

SEQ ID NO: 3439567 - RNA, 18 nt, Human
cuaagacuuacucuaaga

SEQ ID NO: 3439568 - RNA, 19 nt, Human
cuaagacuuacucuaagau

SEQ ID NO: 3439569 - RNA, 22 nt, Human
cuaagacuuacucuaagaucuu

SEQ ID NO: 3439570 - RNA, 23 nt, Human
cuaagacuuacucuaagaucuua

SEQ ID NO: 3439571 - RNA, 13 nt, Human
cuaagacuuccua

SEQ ID NO: 3439572 - RNA, 11 nt, Human
cuaagagaagu

SEQ ID NO: 3439573 - RNA, 15 nt, Human
cuaagagaaguagaa

SEQ ID NO: 3439574 - RNA, 21 nt, Human
cuaagagaaguuguaaaguau

SEQ ID NO: 3439575 - RNA, 15 nt, Human
cuaagagaaugaauu

SEQ ID NO: 3439576 - RNA, 15 nt, Human
cuaagagagaaugag

SEQ ID NO: 3439577 - RNA, 16 nt, Human
cuaagagauucugauu

SEQ ID NO: 3439578 - RNA, 11 nt, Human
cuaagagccau

SEQ ID NO: 3439579 - RNA, 18 nt, Human
cuaagagcuagcgcugcc

SEQ ID NO: 3439580 - RNA, 19 nt, Human
cuaagagcuagcgcugccg

SEQ ID NO: 3439581 - RNA, 20 nt, Human
cuaagagcuagcgcugccgc

SEQ ID NO: 3439582 - RNA, 18 nt, Human
cuaagaggcugcccuccu

SEQ ID NO: 3439583 - RNA, 13 nt, Human
cuaagagggaggg

SEQ ID NO: 3439584 - RNA, 15 nt, Human
cuaagagggagggag

SEQ ID NO: 3439585 - RNA, 23 nt, Human
cuaagagggagggagggcuccag

SEQ ID NO: 3439586 - RNA, 23 nt, Human
cuaagauauacuuguuuuuguaa

SEQ ID NO: 3439587 - RNA, 12 nt, Human
cuaagaucuuag

SEQ ID NO: 3439588 - RNA, 14 nt, Human
cuaagaucuuagau

SEQ ID NO: 3439589 - RNA, 16 nt, Human
cuaagaucuuagauuc

SEQ ID NO: 3439590 - RNA, 18 nt, Human
cuaagaugugauauucua

SEQ ID NO: 3439591 - RNA, 21 nt, Human
cuaagaugugauauucuaaga

SEQ ID NO: 3439592 - RNA, 14 nt, Human
cuaagauguuauau

SEQ ID NO: 3439593 - RNA, 18 nt, Human
cuaagauguuauauuuuu

SEQ ID NO: 3439594 - RNA, 17 nt, Human
cuaagauguucacugug

SEQ ID NO: 3439595 - RNA, 23 nt, Human
cuaagauuacaaaucagaaguca

SEQ ID NO: 3439596 - RNA, 15 nt, Human
cuaagauucuaaagg

SEQ ID NO: 3439597 - RNA, 16 nt, Human
cuaagauucuaaaggu

SEQ ID NO: 3439598 - RNA, 18 nt, Human
cuaagauucuaaaggucc

SEQ ID NO: 3439599 - RNA, 13 nt, Human
cuaagauucuaau

SEQ ID NO: 3439600 - RNA, 12 nt, Human
cuaagauucuag

SEQ ID NO: 3439601 - RNA, 14 nt, Human
cuaagauucuagau

SEQ ID NO: 3439602 - RNA, 15 nt, Human
cuaagauucuagauc

SEQ ID NO: 3439603 - RNA, 12 nt, Human
cuaagauucuuu

SEQ ID NO: 3439604 - RNA, 23 nt, Human
cuaagauucuuuuaaauuagaaa

SEQ ID NO: 3439605 - RNA, 18 nt, Human
cuaagcaaaaugugauau

SEQ ID NO: 3439606 - RNA, 15 nt, Human
cuaagcaagcuaacc

SEQ ID NO: 3439607 - RNA, 13 nt, Human
cuaagcaauuucu

SEQ ID NO: 3439608 - RNA, 15 nt, Human
cuaagcaauuucuug

SEQ ID NO: 3439609 - RNA, 20 nt, Human
cuaagcacgggccauaugaa

SEQ ID NO: 3439610 - RNA, 17 nt, Human
cuaagcagaaagugccu

SEQ ID NO: 3439611 - RNA, 23 nt, Human
cuaagcagaaagugccuuucagg

SEQ ID NO: 3439612 - RNA, 14 nt, Human
cuaagcagaggagg

SEQ ID NO: 3439613 - RNA, 19 nt, Human
cuaagcagaggaggggccg

SEQ ID NO: 3439614 - RNA, 17 nt, Human
cuaagcagcauuucuga

SEQ ID NO: 3439615 - RNA, 14 nt, Human
cuaagcaucuaagu

SEQ ID NO: 3439616 - RNA, 11 nt, Human
cuaagccaagg

SEQ ID NO: 3439617 - RNA, 14 nt, Human
cuaagccaagggcc

SEQ ID NO: 3439618 - RNA, 18 nt, Human
cuaagccaagggccucuu

SEQ ID NO: 3439619 - RNA, 19 nt, Human
cuaagccagcaccggacca

SEQ ID NO: 3439620 - RNA, 14 nt, Human
cuaagccagccugg

SEQ ID NO: 3439621 - RNA, 22 nt, Human
cuaagccagcugcccccagagc

SEQ ID NO: 3439622 - RNA, 20 nt, Human
cuaagccugaaggggcgucu

SEQ ID NO: 3439623 - RNA, 13 nt, Human
cuaagccuguggc

SEQ ID NO: 3439624 - RNA, 16 nt, Human
cuaagccuuuccauaa

SEQ ID NO: 3439625 - RNA, 14 nt, Human
cuaagcuaggaaug

SEQ ID NO: 3439626 - RNA, 13 nt, Human
cuaagcugcagcu

SEQ ID NO: 3439627 - RNA, 16 nt, Human
cuaagcugcagcuucc

SEQ ID NO: 3439628 - RNA, 22 nt, Human
cuaagcuuugccagcugcugcu

SEQ ID NO: 3439629 - RNA, 15 nt, Human
cuaaggaaccuuccu

SEQ ID NO: 3439630 - RNA, 23 nt, Human
cuaaggaagaucacuuugcucug

SEQ ID NO: 3439631 - RNA, 19 nt, Human
cuaaggacauuucccaggg

SEQ ID NO: 3439632 - RNA, 20 nt, Human
cuaaggaccugaaauuccaa

SEQ ID NO: 3439633 - RNA, 17 nt, Human
cuaaggacuuguuagau

SEQ ID NO: 3439634 - RNA, 20 nt, Human
cuaaggaggggaaaaaaaug

SEQ ID NO: 3439635 - RNA, 18 nt, Human
cuaaggaucucucaggag

SEQ ID NO: 3439636 - RNA, 20 nt, Human
cuaaggaucucucaggagca

SEQ ID NO: 3439637 - RNA, 17 nt, Human
cuaaggaugcuaaaccu

SEQ ID NO: 3439638 - RNA, 18 nt, Human
cuaaggaugcuaaaccuu

SEQ ID NO: 3439639 - RNA, 18 nt, Human
cuaaggaugucacagggc

SEQ ID NO: 3439640 - RNA, 23 nt, Human
cuaaggccauggcaucccuuuuu

SEQ ID NO: 3439641 - RNA, 19 nt, Human
cuaaggccgaagaaggguc

SEQ ID NO: 3439642 - RNA, 14 nt, Human
cuaaggccuaggau

SEQ ID NO: 3439643 - RNA, 20 nt, Human
cuaaggccuaggauucuaaa

SEQ ID NO: 3439644 - RNA, 22 nt, Human
cuaaggccuaggauucuaaaau

SEQ ID NO: 3439645 - RNA, 20 nt, Human
cuaaggcguggagcugccug

SEQ ID NO: 3439646 - RNA, 22 nt, Human
cuaaggcucuaugagucuagau

SEQ ID NO: 3439647 - RNA, 15 nt, Human
cuaaggcucugagag

SEQ ID NO: 3439648 - RNA, 20 nt, Human
cuaaggcucugagagucuag

SEQ ID NO: 3439649 - RNA, 15 nt, Human
cuaagggaagacauu

SEQ ID NO: 3439650 - RNA, 22 nt, Human
cuaagggagagugguauuugca

SEQ ID NO: 3439651 - RNA, 11 nt, Human
cuaagggggag

SEQ ID NO: 3439652 - RNA, 18 nt, Human
cuaagggucgaaagcucu

SEQ ID NO: 3439653 - RNA, 22 nt, Human
cuaagggucgaaagcucuagaa

SEQ ID NO: 3439654 - RNA, 14 nt, Human
cuaagggugggugc

SEQ ID NO: 3439655 - RNA, 19 nt, Human
cuaagguccgguguucuaa

SEQ ID NO: 3439656 - RNA, 13 nt, Human
cuaagguccuaag

SEQ ID NO: 3439657 - RNA, 21 nt, Human
cuaaggucuuggaacuugccu

SEQ ID NO: 3439658 - RNA, 15 nt, Human
cuaaggugcuaaauc

SEQ ID NO: 3439659 - RNA, 15 nt, Human
cuaaggugugcucug

SEQ ID NO: 3439660 - RNA, 23 nt, Human
cuaaguaaaaccacagcaguuga

SEQ ID NO: 3439661 - RNA, 14 nt, Human
cuaaguaaauacaa

SEQ ID NO: 3439662 - RNA, 17 nt, Human
cuaaguaaauacaauuu

SEQ ID NO: 3439663 - RNA, 18 nt, Human
cuaaguaaauacaauuuu

SEQ ID NO: 3439664 - RNA, 17 nt, Human
cuaaguaaauaggaauu

SEQ ID NO: 3439665 - RNA, 17 nt, Human
cuaaguaaaucucuucu

SEQ ID NO: 3439666 - RNA, 14 nt, Human
cuaaguauuuccca

SEQ ID NO: 3439667 - RNA, 15 nt, Human
cuaagucaguaccca

SEQ ID NO: 3439668 - RNA, 15 nt, Human
cuaagucauguaugu

SEQ ID NO: 3439669 - RNA, 23 nt, Human
cuaaguccaguccaguccuaucu

SEQ ID NO: 3439670 - RNA, 17 nt, Human
cuaagucucuuuuuuac

SEQ ID NO: 3439671 - RNA, 14 nt, Human
cuaagucuuuccau

SEQ ID NO: 3439672 - RNA, 14 nt, Human
cuaagugaaaaggu

SEQ ID NO: 3439673 - RNA, 23 nt, Human
cuaagugaaauaagccagacauc

SEQ ID NO: 3439674 - RNA, 19 nt, Human
cuaagugaaauuucuagcc

SEQ ID NO: 3439675 - RNA, 18 nt, Human
cuaagugaggaugaaaaa

SEQ ID NO: 3439676 - RNA, 17 nt, Human
cuaagugcuuauuacau

SEQ ID NO: 3439677 - RNA, 14 nt, Human
cuaagugugaacug

SEQ ID NO: 3439678 - RNA, 17 nt, Human
cuaaguguuucauaaau

SEQ ID NO: 3439679 - RNA, 18 nt, Human
cuaaguucuuagauaucu

SEQ ID NO: 3439680 - RNA, 21 nt, Human
cuaaguugaguauauuauaau

SEQ ID NO: 3439681 - RNA, 15 nt, Human
cuaaguuucuaagau

SEQ ID NO: 3439682 - RNA, 18 nt, Human
cuaaguuucuaagauucu

SEQ ID NO: 3439683 - RNA, 19 nt, Human
cuaaguuucuaagauucua

SEQ ID NO: 3439684 - RNA, 21 nt, Human
cuaaguuucuaagauucuaaa

SEQ ID NO: 3439685 - RNA, 23 nt, Human
cuaaguuucuaagauucuaaagg

SEQ ID NO: 3439686 - RNA, 21 nt, Human
cuaaguuuuaggguacaugug

SEQ ID NO: 3439687 - RNA, 20 nt, Human
cuaaguuuuuauggcuuuug

SEQ ID NO: 3439688 - RNA, 23 nt, Human
cuaaguuuuuauggcuuuugugc

SEQ ID NO: 3439689 - RNA, 20 nt, Human
cuaauaaaaagcuuuugucu

SEQ ID NO: 3439690 - RNA, 22 nt, Human
cuaauaaaaagcuuuugucuac

SEQ ID NO: 3439691 - RNA, 13 nt, Human
cuaauaaaaaggu

SEQ ID NO: 3439692 - RNA, 19 nt, Human
cuaauaaaaaggugaccau

SEQ ID NO: 3439693 - RNA, 11 nt, Human
cuaauaaaacu

SEQ ID NO: 3439694 - RNA, 11 nt, Human
cuaauaaaaua

SEQ ID NO: 3439695 - RNA, 16 nt, Human
cuaauaaaauaucauu

SEQ ID NO: 3439696 - RNA, 17 nt, Human
cuaauaaaauaucauuc

SEQ ID NO: 3439697 - RNA, 18 nt, Human
cuaauaaaauaucauuca

SEQ ID NO: 3439698 - RNA, 21 nt, Human
cuaauaaaauaucauucagca

SEQ ID NO: 3439699 - RNA, 13 nt, Human
cuaauaaaauauu

SEQ ID NO: 3439700 - RNA, 15 nt, Human
cuaauaaaauauuuu

SEQ ID NO: 3439701 - RNA, 16 nt, Human
cuaauaaaauauuuuc

SEQ ID NO: 3439702 - RNA, 19 nt, Human
cuaauaaaauauuuucugu

SEQ ID NO: 3439703 - RNA, 23 nt, Human
cuaauaaaauauuuucugugugu

SEQ ID NO: 3439704 - RNA, 15 nt, Human
cuaauaaacuaauaa

SEQ ID NO: 3439705 - RNA, 21 nt, Human
cuaauaaacuaauaauugcag

SEQ ID NO: 3439706 - RNA, 11 nt, Human
cuaauaaauac

SEQ ID NO: 3439707 - RNA, 12 nt, Human
cuaauaaauuau

SEQ ID NO: 3439708 - RNA, 17 nt, Human
cuaggcugggugcccac

SEQ ID NO: 3439709 - RNA, 18 nt, Human
cuaggcugggugcccaca

SEQ ID NO: 3439710 - RNA, 20 nt, Human
cuaggcugggugcccacagc

SEQ ID NO: 3439711 - RNA, 13 nt, Human
cuagcacaugccc

SEQ ID NO: 3439712 - RNA, 16 nt, Human
cuagcacaugcuucaa

SEQ ID NO: 3439713 - RNA, 22 nt, Human
cuagcaccauuuuaagucccug

SEQ ID NO: 3439714 - RNA, 15 nt, Human
cuagcacucacaugc

SEQ ID NO: 3439715 - RNA, 13 nt, Human
cuagcacuggccu

SEQ ID NO: 3439716 - RNA, 17 nt, Human
cuagcacuuugggaggc

SEQ ID NO: 3439717 - RNA, 21 nt, Human
cuagcagcaccguucugugca

SEQ ID NO: 3439718 - RNA, 22 nt, Human
cuagcagcaccguucugugcac

SEQ ID NO: 3439719 - RNA, 22 nt, Human
cuagcagcagggagggcuucug

SEQ ID NO: 3439720 - RNA, 23 nt, Human
cuagcagcccacccugcugcugg

SEQ ID NO: 3439721 - RNA, 16 nt, Human
cuagcaguaaaagaug

SEQ ID NO: 3439722 - RNA, 22 nt, Human
cuagcagugaugaaaaugaauc

SEQ ID NO: 3439723 - RNA, 18 nt, Human
cuagcaguggcaggcaga

SEQ ID NO: 3439724 - RNA, 18 nt, Human
cuagcauacguacacauu

SEQ ID NO: 3439725 - RNA, 23 nt, Human
cuagcauacguacacauuuuauu

SEQ ID NO: 3439726 - RNA, 16 nt, Human
cuagcaugaagacaga

SEQ ID NO: 3439727 - RNA, 13 nt, Human
cuagcaugccaac

SEQ ID NO: 3439728 - RNA, 23 nt, Human
cuagcauuguaaaauuauuucau

SEQ ID NO: 3439729 - RNA, 19 nt, Human
cuagcauuucccaacacaa

SEQ ID NO: 3439730 - RNA, 18 nt, Human
cuagccaaaccucaccaa

SEQ ID NO: 3439731 - RNA, 20 nt, Human
cuagccaaaccucaccaacu

SEQ ID NO: 3439732 - RNA, 23 nt, Human
cuagccaaaugguuuaacuucug

SEQ ID NO: 3439733 - RNA, 21 nt, Human
cuagccaccaacucuugcagg

SEQ ID NO: 3439734 - RNA, 18 nt, Human
cuagccaccgccuccuac

SEQ ID NO: 3439735 - RNA, 18 nt, Human
cuagccagccccucuucc

SEQ ID NO: 3439736 - RNA, 22 nt, Human
cuagccaggaaguacuuccacc

SEQ ID NO: 3439737 - RNA, 15 nt, Human
cuagccauuccuggu

SEQ ID NO: 3439738 - RNA, 12 nt, Human
cuagcccacccu

SEQ ID NO: 3439739 - RNA, 15 nt, Human
cuagcccacccugcu

SEQ ID NO: 3439740 - RNA, 18 nt, Human
cuagcccacccugcugcc

SEQ ID NO: 3439741 - RNA, 21 nt, Human
cuagcccacccugcugccuuc

SEQ ID NO: 3439742 - RNA, 19 nt, Human
cuagcccagcgcucugccu

SEQ ID NO: 3439743 - RNA, 18 nt, Human
cuagcccaggagagagaa

SEQ ID NO: 3439744 - RNA, 19 nt, Human
cuagcccaggagagagaaa

SEQ ID NO: 3439745 - RNA, 14 nt, Human
cuagcccauggacu

SEQ ID NO: 3439746 - RNA, 19 nt, Human
cuagcccauggacuucaca

SEQ ID NO: 3439747 - RNA, 16 nt, Human
cuagcccgaauacaaa

SEQ ID NO: 3439748 - RNA, 19 nt, Human
cuagcccuccuuuuuccaa

SEQ ID NO: 3439749 - RNA, 16 nt, Human
cuagcccucucccucu

SEQ ID NO: 3439750 - RNA, 16 nt, Human
cuagccgaccucagcc

SEQ ID NO: 3439751 - RNA, 18 nt, Human
cuagccgaccucagccuu

SEQ ID NO: 3439752 - RNA, 19 nt, Human
cuagccgaccucagccuuc

SEQ ID NO: 3439753 - RNA, 20 nt, Human
cuagccgaccucagccuucc

SEQ ID NO: 3439754 - RNA, 19 nt, Human
cuagccgguuccugucccu

SEQ ID NO: 3439755 - RNA, 16 nt, Human
cuagccuauguggauu

SEQ ID NO: 3439756 - RNA, 18 nt, Human
cuagccuauuuaccugca

SEQ ID NO: 3439757 - RNA, 13 nt, Human
cuagccucagggg

SEQ ID NO: 3439758 - RNA, 22 nt, Human
cuagccuuagaagucacacagu

SEQ ID NO: 3439759 - RNA, 19 nt, Human
cuagccuuauccucugauc

SEQ ID NO: 3439760 - RNA, 15 nt, Human
cuagccuuuggcucu

SEQ ID NO: 3439761 - RNA, 20 nt, Human
cuagccuuuggcucuggaga

SEQ ID NO: 3439762 - RNA, 17 nt, Human
ccaggacugggccacuu

SEQ ID NO: 3439763 - RNA, 21 nt, Human
ccaggacuuauuuaaacucug

SEQ ID NO: 3439764 - RNA, 11 nt, Human
ccaggagaagc

SEQ ID NO: 3439765 - RNA, 17 nt, Human
ccaggagaagcucagcu

SEQ ID NO: 3439766 - RNA, 20 nt, Human
ccaggagaaggccaauuccu

SEQ ID NO: 3439767 - RNA, 16 nt, Human
ccaggagacagacaga

SEQ ID NO: 3439768 - RNA, 14 nt, Human
ccaggagagagaaa

SEQ ID NO: 3439769 - RNA, 22 nt, Human
ccaggagagcuuagggucucag

SEQ ID NO: 3439770 - RNA, 23 nt, Human
ccaggagagcuuagggucucagg

SEQ ID NO: 3439771 - RNA, 19 nt, Human
ccaggagcaaauguuucug

SEQ ID NO: 3439772 - RNA, 17 nt, Human
ccaggagcacggcucug

SEQ ID NO: 3439773 - RNA, 22 nt, Human
ccaggagcacggcucugucccc

SEQ ID NO: 3439774 - RNA, 20 nt, Human
ccaggagcauccaccuccuu

SEQ ID NO: 3439775 - RNA, 23 nt, Human
ccaggagcauccaccuccuucuc

SEQ ID NO: 3439776 - RNA, 12 nt, Human
ccaggagcccau

SEQ ID NO: 3439777 - RNA, 15 nt, Human
ccaggagccccgagg

SEQ ID NO: 3439778 - RNA, 14 nt, Human
ccaggagccuccug

SEQ ID NO: 3439779 - RNA, 18 nt, Human
ccaggagccuccugcccu

SEQ ID NO: 3439780 - RNA, 19 nt, Human
ccaggagccuccugcccuu

SEQ ID NO: 3439781 - RNA, 12 nt, Human
ccaggagcucca

SEQ ID NO: 3439782 - RNA, 13 nt, Human
ccaggagcuccag

SEQ ID NO: 3439783 - RNA, 21 nt, Human
ccaggagcuccaguguccuga

SEQ ID NO: 3439784 - RNA, 14 nt, Human
ccaggagcuccccu

SEQ ID NO: 3439785 - RNA, 13 nt, Human
ccaggagcucuuc

SEQ ID NO: 3439786 - RNA, 23 nt, Human
ccaggagcugggcagaaggccaa

SEQ ID NO: 3439787 - RNA, 15 nt, Human
ccaggagcugucacc

SEQ ID NO: 3439788 - RNA, 14 nt, Human
ccaggaggacccag

SEQ ID NO: 3439789 - RNA, 12 nt, Human
ccaggaggccag

SEQ ID NO: 3439790 - RNA, 13 nt, Human
ccaggaggccagc

SEQ ID NO: 3439791 - RNA, 14 nt, Human
ccaggaggccagcc

SEQ ID NO: 3439792 - RNA, 18 nt, Human
ccaggaggccagccuuga

SEQ ID NO: 3439793 - RNA, 15 nt, Human
ccaggaggcugaggu

SEQ ID NO: 3439794 - RNA, 16 nt, Human
ccaggagggacaaagg

SEQ ID NO: 3439795 - RNA, 21 nt, Human
ccaggagggacaaaggagccu

SEQ ID NO: 3439796 - RNA, 17 nt, Human
ccaggagggagcagagg

SEQ ID NO: 3439797 - RNA, 15 nt, Human
ccaggagggcacugg

SEQ ID NO: 3439798 - RNA, 17 nt, Human
ccaggagggcacuggag

SEQ ID NO: 3439799 - RNA, 19 nt, Human
ccaggagggcacuggagcu

SEQ ID NO: 3439800 - RNA, 17 nt, Human
ccaggagggcauccaua

SEQ ID NO: 3439801 - RNA, 20 nt, Human
ccaggagggcauccauacca

SEQ ID NO: 3439802 - RNA, 17 nt, Human
ccaggaggggaacacug

SEQ ID NO: 3439803 - RNA, 21 nt, Human
ccaggagguuuuuuugucaac

SEQ ID NO: 3439804 - RNA, 19 nt, Human
ccaggaguggguggggagu

SEQ ID NO: 3439805 - RNA, 17 nt, Human
ccaggaguuugagacca

SEQ ID NO: 3439806 - RNA, 20 nt, Human
ccaggaguuugaggcugcag

SEQ ID NO: 3439807 - RNA, 21 nt, Human
ccaggaguuugaggcugcagc

SEQ ID NO: 3439808 - RNA, 15 nt, Human
ccaggaguuuggcca

SEQ ID NO: 3439809 - RNA, 18 nt, Human
ccaggaguuuggccagaa

SEQ ID NO: 3439810 - RNA, 21 nt, Human
ccaggauacuggcacagaggu

SEQ ID NO: 3439811 - RNA, 18 nt, Human
ccaggauagagacuggaa

SEQ ID NO: 3439812 - RNA, 21 nt, Human
ccaggaucagauugcauguga

SEQ ID NO: 3439813 - RNA, 14 nt, Human
ccaggaucauggug

SEQ ID NO: 3439814 - RNA, 20 nt, Human
ccaggaucaugguguaauaa

SEQ ID NO: 3439815 - RNA, 17 nt, Human
ccaggauccagaagggg

SEQ ID NO: 3439816 - RNA, 18 nt, Human
ccaggaucguuuuuuccc

SEQ ID NO: 3439817 - RNA, 20 nt, Human
ccaggaugagcaucccagga

SEQ ID NO: 3439818 - RNA, 22 nt, Human
ccaggauggaggggugguccug

SEQ ID NO: 3439819 - RNA, 17 nt, Human
ccaggauggcgcaggaa

SEQ ID NO: 3439820 - RNA, 20 nt, Human
ccaggauuauugucaaagaa

SEQ ID NO: 3439821 - RNA, 21 nt, Human
ccaggcaacuucaguccuggg

SEQ ID NO: 3439822 - RNA, 17 nt, Human
ccaggcaacuugggaac

SEQ ID NO: 3439823 - RNA, 12 nt, Human
ccaggcaaggcu

SEQ ID NO: 3439824 - RNA, 16 nt, Human
ccaggcaaggcugugg

SEQ ID NO: 3439825 - RNA, 14 nt, Human
ccaggcacagcuga

SEQ ID NO: 3439826 - RNA, 15 nt, Human
ccaggcacagcugag

SEQ ID NO: 3439827 - RNA, 23 nt, Human
ccaggcacagcugaguuaugaug

SEQ ID NO: 3439828 - RNA, 13 nt, Human
ccaggcacaggau

SEQ ID NO: 3439829 - RNA, 14 nt, Human
ccaggcacaggcag

SEQ ID NO: 3439830 - RNA, 15 nt, Human
ccaggcacaggcagg

SEQ ID NO: 3439831 - RNA, 20 nt, Human
ccaggcacaggcagggcagg

SEQ ID NO: 3439832 - RNA, 17 nt, Human
ccaggcaccaaaagaag

SEQ ID NO: 3439833 - RNA, 19 nt, Human
ccaggcacccagcuuuguc

SEQ ID NO: 3439834 - RNA, 17 nt, Human
ccaggcacccccuggag

SEQ ID NO: 3439835 - RNA, 19 nt, Human
ccaggcacccccuggagag

SEQ ID NO: 3439836 - RNA, 14 nt, Human
ccaggcacccuucu

SEQ ID NO: 3439837 - RNA, 16 nt, Human
ccaggcaccucuuccu

SEQ ID NO: 3439838 - RNA, 20 nt, Human
ccaggcacgaacccaccugc

SEQ ID NO: 3439839 - RNA, 22 nt, Human
ccaggcacgaacccaccugcug

SEQ ID NO: 3439840 - RNA, 23 nt, Human
ccaggcagaucugugccccaugc

SEQ ID NO: 3439841 - RNA, 12 nt, Human
ccaggcagccuc

SEQ ID NO: 3439842 - RNA, 17 nt, Human
ccaggcagccucugggg

SEQ ID NO: 3439843 - RNA, 23 nt, Human
ccaggcagccucugucaggccuu

SEQ ID NO: 3439844 - RNA, 21 nt, Human
ccaggcaggcuaaggcgugga

SEQ ID NO: 3439845 - RNA, 10 nt, Human
ccaggcaggg

SEQ ID NO: 3439846 - RNA, 23 nt, Human
ccaggcagggccaacccuucucc

SEQ ID NO: 3439847 - RNA, 14 nt, Human
ccaggcagguagcc

SEQ ID NO: 3439848 - RNA, 17 nt, Human
ccaggcaggugccugga

SEQ ID NO: 3439849 - RNA, 17 nt, Human
ccaggcagucgggggcu

SEQ ID NO: 3439850 - RNA, 20 nt, Human
ccaggcagucgggggcuggc

SEQ ID NO: 3439851 - RNA, 22 nt, Human
ccaggcagucgggggcuggccu

SEQ ID NO: 3439852 - RNA, 23 nt, Human
ccaggcagucgggggcuggccua

SEQ ID NO: 3439853 - RNA, 18 nt, Human
ccaggcauuccccaggag

SEQ ID NO: 3439854 - RNA, 15 nt, Human
cucacucccuuccca

SEQ ID NO: 3439855 - RNA, 23 nt, Human
cucacucccuucuaccugccacu

SEQ ID NO: 3439856 - RNA, 15 nt, Human
cucacuccuaccugg

SEQ ID NO: 3439857 - RNA, 16 nt, Human
cucacuccuaccuggu

SEQ ID NO: 3439858 - RNA, 17 nt, Human
cucacuccuaccuggua

SEQ ID NO: 3439859 - RNA, 20 nt, Human
cucacuccuguuacuuaccu

SEQ ID NO: 3439860 - RNA, 13 nt, Human
cucacuccuugaa

SEQ ID NO: 3439861 - RNA, 13 nt, Human
cucacuccuuuua

SEQ ID NO: 3439862 - RNA, 19 nt, Human
cucacuccuuuuaaagaaa

SEQ ID NO: 3439863 - RNA, 12 nt, Human
cucacucucagg

SEQ ID NO: 3439864 - RNA, 13 nt, Human
cucacucucagga

SEQ ID NO: 3439865 - RNA, 17 nt, Human
cucacucugcuaccuug

SEQ ID NO: 3439866 - RNA, 11 nt, Human
cucacucuggg

SEQ ID NO: 3439867 - RNA, 14 nt, Human
cucacucugggcug

SEQ ID NO: 3439868 - RNA, 11 nt, Human
cucacucuguc

SEQ ID NO: 3439869 - RNA, 12 nt, Human
cucacucugucg

SEQ ID NO: 3439870 - RNA, 15 nt, Human
cucacucuguuuccu

SEQ ID NO: 3439871 - RNA, 14 nt, Human
cucacucuugccaa

SEQ ID NO: 3439872 - RNA, 16 nt, Human
cucacucuugccaacc

SEQ ID NO: 3439873 - RNA, 17 nt, Human
cucacugaaaacaucug

SEQ ID NO: 3439874 - RNA, 19 nt, Human
cucacugaaaacaucugga

SEQ ID NO: 3439875 - RNA, 23 nt, Human
cucacugaaacauggcuguguuu

SEQ ID NO: 3439876 - RNA, 12 nt, Human
cucacugaagcc

SEQ ID NO: 3439877 - RNA, 15 nt, Human
cucacugagcacugu

SEQ ID NO: 3439878 - RNA, 16 nt, Human
cucacugagcacuguu

SEQ ID NO: 3439879 - RNA, 17 nt, Human
cucacugagcacuguuu

SEQ ID NO: 3439880 - RNA, 18 nt, Human
cucacugagcacuguuuu

SEQ ID NO: 3439881 - RNA, 15 nt, Human
cucacugcagccuca

SEQ ID NO: 3439882 - RNA, 16 nt, Human
cucacugcagccucga

SEQ ID NO: 3439883 - RNA, 20 nt, Human
cucacugcauccuccgccuc

SEQ ID NO: 3439884 - RNA, 19 nt, Human
cucacugccaggccagccu

SEQ ID NO: 3439885 - RNA, 20 nt, Human
cucacugccaggccagccuc

SEQ ID NO: 3439886 - RNA, 21 nt, Human
cucacugccaggccagccucc

SEQ ID NO: 3439887 - RNA, 19 nt, Human
cucacugccaugccagcuu

SEQ ID NO: 3439888 - RNA, 18 nt, Human
cucacugcccgcacaccc

SEQ ID NO: 3439889 - RNA, 14 nt, Human
cucacugcucaaga

SEQ ID NO: 3439890 - RNA, 16 nt, Human
cucacugcucaagaag

SEQ ID NO: 3439891 - RNA, 19 nt, Human
cucacugcucaagaagaca

SEQ ID NO: 3439892 - RNA, 15 nt, Human
cucacugcucccuga

SEQ ID NO: 3439893 - RNA, 17 nt, Human
cucacugcucccugaag

SEQ ID NO: 3439894 - RNA, 13 nt, Human
cucacuggcagcc

SEQ ID NO: 3439895 - RNA, 18 nt, Human
cucacuggcagccccagc

SEQ ID NO: 3439896 - RNA, 21 nt, Human
cucacuggccaucccucgugg

SEQ ID NO: 3439897 - RNA, 15 nt, Human
cucacuggcucuccu

SEQ ID NO: 3439898 - RNA, 17 nt, Human
cucacuggcucuccugg

SEQ ID NO: 3439899 - RNA, 18 nt, Human
cucacuggcucuccuggc

SEQ ID NO: 3439900 - RNA, 21 nt, Human
cucacuggcucuccuggcccu

SEQ ID NO: 3439901 - RNA, 12 nt, Human
cucacugggugg

SEQ ID NO: 3439902 - RNA, 13 nt, Human
cucacuggguggg

SEQ ID NO: 3439903 - RNA, 12 nt, Human
cucacugucuga

SEQ ID NO: 3439904 - RNA, 13 nt, Human
cucacugucugag

SEQ ID NO: 3439905 - RNA, 20 nt, Human
cucacugugguaaaugccac

SEQ ID NO: 3439906 - RNA, 22 nt, Human
cucacugugguaaaugccacac

SEQ ID NO: 3439907 - RNA, 19 nt, Human
cucacugugucacccaggc

SEQ ID NO: 3439908 - RNA, 21 nt, Human
cucacuguucuauucaucuca

SEQ ID NO: 3439909 - RNA, 14 nt, Human
cucacuguugccca

SEQ ID NO: 3439910 - RNA, 15 nt, Human
cucacuguugcccag

SEQ ID NO: 3439911 - RNA, 21 nt, Human
cucacuuaucccaagagaaug

SEQ ID NO: 3439912 - RNA, 14 nt, Human
cucacuucacccug

SEQ ID NO: 3439913 - RNA, 12 nt, Human
cucacuucaggu

SEQ ID NO: 3439914 - RNA, 20 nt, Human
cucacuucugggcuucaucu

SEQ ID NO: 3439915 - RNA, 21 nt, Human
cucacuuggugauauguccua

SEQ ID NO: 3439916 - RNA, 22 nt, Human
cucacuuuuaaugaacaaaugg

SEQ ID NO: 3439917 - RNA, 18 nt, Human
cucacuuuucccacucca

SEQ ID NO: 3439918 - RNA, 21 nt, Human
cucacuuuucccacuccaagc

SEQ ID NO: 3439919 - RNA, 14 nt, Human
cucacuuuucucca

SEQ ID NO: 3439920 - RNA, 13 nt, Human
cucacuuuuucau

SEQ ID NO: 3439921 - RNA, 19 nt, Human
cucagaaaacaaggaugaa

SEQ ID NO: 3439922 - RNA, 17 nt, Human
cucagaaagccaacaug

SEQ ID NO: 3439923 - RNA, 15 nt, Human
cucagaaagugccug

SEQ ID NO: 3439924 - RNA, 16 nt, Human
cucagaaagugccuga

SEQ ID NO: 3439925 - RNA, 17 nt, Human
cucagaacacauucuuu

SEQ ID NO: 3439926 - RNA, 14 nt, Human
cucagaaccacagc

SEQ ID NO: 3439927 - RNA, 14 nt, Human
cuaggugacagagu

SEQ ID NO: 3439928 - RNA, 18 nt, Human
cuaggugacagagugaga

SEQ ID NO: 3439929 - RNA, 15 nt, Human
cuaggugacauauac

SEQ ID NO: 3439930 - RNA, 16 nt, Human
cuaggugacauauaca

SEQ ID NO: 3439931 - RNA, 22 nt, Human
cuaggugcccuuggaggccagc

SEQ ID NO: 3439932 - RNA, 15 nt, Human
cuaggugggccagcc

SEQ ID NO: 3439933 - RNA, 18 nt, Human
cuaggugggccagccccu

SEQ ID NO: 3439934 - RNA, 19 nt, Human
cuaggugggccagccccuc

SEQ ID NO: 3439935 - RNA, 21 nt, Human
cuaggugggccagccccuccc

SEQ ID NO: 3439936 - RNA, 19 nt, Human
cuagguggguugaaagcca

SEQ ID NO: 3439937 - RNA, 17 nt, Human
cuagguguuuuguucac

SEQ ID NO: 3439938 - RNA, 13 nt, Human
cuagguucuaaaa

SEQ ID NO: 3439939 - RNA, 19 nt, Human
cuagguuuaacucagauca

SEQ ID NO: 3439940 - RNA, 22 nt, Human
cuagguuuaacucagaucacua

SEQ ID NO: 3439941 - RNA, 14 nt, Human
cuagguuuuuuccu

SEQ ID NO: 3439942 - RNA, 21 nt, Human
cuaguaaguaauuaugcacua

SEQ ID NO: 3439943 - RNA, 15 nt, Human
cuaguaagugccuuc

SEQ ID NO: 3439944 - RNA, 17 nt, Human
cuaguaagugccuucca

SEQ ID NO: 3439945 - RNA, 19 nt, Human
cuaguacacuuuuaugagc

SEQ ID NO: 3439946 - RNA, 16 nt, Human
cuaguacuaacuccua

SEQ ID NO: 3439947 - RNA, 20 nt, Human
cuaguacuguguacuguaua

SEQ ID NO: 3439948 - RNA, 16 nt, Human
cuaguacuugaaaaag

SEQ ID NO: 3439949 - RNA, 14 nt, Human
cuaguaguuaaaaa

SEQ ID NO: 3439950 - RNA, 15 nt, Human
cuaguaguucucuug

SEQ ID NO: 3439951 - RNA, 15 nt, Human
cuaguaucaaaagaa

SEQ ID NO: 3439952 - RNA, 17 nt, Human
cuaguauugacaaaaug

SEQ ID NO: 3439953 - RNA, 20 nt, Human
cuaguauuucuaugaaauau

SEQ ID NO: 3439954 - RNA, 20 nt, Human
cuaguauuugaauuaaaacu

SEQ ID NO: 3439955 - RNA, 21 nt, Human
cuaguauuugaauuaaaacuu

SEQ ID NO: 3439956 - RNA, 20 nt, Human
cuagucaacaguacccuggu

SEQ ID NO: 3439957 - RNA, 14 nt, Human
cuagucaccagaga

SEQ ID NO: 3439958 - RNA, 17 nt, Human
cuagucacgcaugcagu

SEQ ID NO: 3439959 - RNA, 16 nt, Human
cuagucagagagagug

SEQ ID NO: 3439960 - RNA, 14 nt, Human
cuaguccagugacc

SEQ ID NO: 3439961 - RNA, 17 nt, Human
cuagucccuuccccucc

SEQ ID NO: 3439962 - RNA, 22 nt, Human
cuagucccuuccccucccuggc

SEQ ID NO: 3439963 - RNA, 23 nt, Human
cuagucccuuccccucccuggcu

SEQ ID NO: 3439964 - RNA, 17 nt, Human
cuaguccuagugaaccu

SEQ ID NO: 3439965 - RNA, 20 nt, Human
cuagucguggagaugucuuc

SEQ ID NO: 3439966 - RNA, 15 nt, Human
cuagucuccuuugca

SEQ ID NO: 3439967 - RNA, 20 nt, Human
cuagucucuaucauuaaagu

SEQ ID NO: 3439968 - RNA, 22 nt, Human
cuagucucuaucauuaaaguuc

SEQ ID NO: 3439969 - RNA, 16 nt, Human
cuagucucuccuguaa

SEQ ID NO: 3439970 - RNA, 16 nt, Human
cuagucucucuggggc

SEQ ID NO: 3439971 - RNA, 13 nt, Human
cuagucugugugc

SEQ ID NO: 3439972 - RNA, 17 nt, Human
cuagucuuuugcuuuug

SEQ ID NO: 3439973 - RNA, 18 nt, Human
cuagugaaagaggcagcu

SEQ ID NO: 3439974 - RNA, 14 nt, Human
cuagugaaugaauc

SEQ ID NO: 3439975 - RNA, 18 nt, Human
cuagugacccacaugcca

SEQ ID NO: 3439976 - RNA, 14 nt, Human
cuagugacccggag

SEQ ID NO: 3439977 - RNA, 19 nt, Human
cuagugacuugugucccau

SEQ ID NO: 3439978 - RNA, 20 nt, Human
cuagugacuugugucccaug

SEQ ID NO: 3439979 - RNA, 16 nt, Human
cuagugagcugggcau

SEQ ID NO: 3439980 - RNA, 19 nt, Human
cuagugauguuuuuaugau

SEQ ID NO: 3439981 - RNA, 23 nt, Human
cuagugcagcugauuuuaacaau

SEQ ID NO: 3439982 - RNA, 21 nt, Human
cuagugcugaagcuuauuaau

SEQ ID NO: 3439983 - RNA, 22 nt, Human
cuagugcugaagcuuauuaaug

SEQ ID NO: 3439984 - RNA, 13 nt, Human
cuagugcugugaa

SEQ ID NO: 3439985 - RNA, 21 nt, Human
cuaguggcucucaguuaaaau

SEQ ID NO: 3439986 - RNA, 14 nt, Human
cuaguggcugucca

SEQ ID NO: 3439987 - RNA, 15 nt, Human
cuaguggcuguccag

SEQ ID NO: 3439988 - RNA, 17 nt, Human
cuaguggcuguccagug

SEQ ID NO: 3439989 - RNA, 18 nt, Human
cuaguggcuguccagugc

SEQ ID NO: 3439990 - RNA, 22 nt, Human
cuaguggcuguccagugcccau

SEQ ID NO: 3439991 - RNA, 15 nt, Human
cuaguggcuuguccu

SEQ ID NO: 3439992 - RNA, 17 nt, Human
cuagugggacagcccag

SEQ ID NO: 3439993 - RNA, 17 nt, Human
cuaguggggucucccuc

SEQ ID NO: 3439994 - RNA, 19 nt, Human
cuaguggggucucccucuc

SEQ ID NO: 3439995 - RNA, 20 nt, Human
cuaguggggucucccucucc

SEQ ID NO: 3439996 - RNA, 21 nt, Human
cuaguggggucucccucuccu

SEQ ID NO: 3439997 - RNA, 23 nt, Human
cuaguggggucucccucuccugc

SEQ ID NO: 3439998 - RNA, 15 nt, Human
cuagugggguuuccu

SEQ ID NO: 3439999 - RNA, 18 nt, Human
cucaaggccucccacagu

SEQ ID NO: 3440000 - RNA, 15 nt, Human
cucaagggacaagga

SEQ ID NO: 3440001 - RNA, 22 nt, Human
cucaaggggccauccuguccca

SEQ ID NO: 3440002 - RNA, 22 nt, Human
cucaagguuuuagguucuaaag

SEQ ID NO: 3440003 - RNA, 20 nt, Human
cucaaguagcauuuacugug

SEQ ID NO: 3440004 - RNA, 19 nt, Human
cucaagucacucccaagcc

SEQ ID NO: 3440005 - RNA, 17 nt, Human
cucaagucuucccugau

SEQ ID NO: 3440006 - RNA, 21 nt, Human
cucaagugauucuccugccuc

SEQ ID NO: 3440007 - RNA, 9 nt, Human
cucaagugc

SEQ ID NO: 3440008 - RNA, 15 nt, Human
cucaagugcccucuc

SEQ ID NO: 3440009 - RNA, 22 nt, Human
cucaagugcccucuccgagcug

SEQ ID NO: 3440010 - RNA, 20 nt, Human
cucaaguguucacaaccugg

SEQ ID NO: 3440011 - RNA, 18 nt, Human
cucaaguucaaggaccaa

SEQ ID NO: 3440012 - RNA, 15 nt, Human
cucaaguucuaagau

SEQ ID NO: 3440013 - RNA, 20 nt, Human
cucaaguucuaagauucuaa

SEQ ID NO: 3440014 - RNA, 22 nt, Human
cucaaguugauuagaaagacca

SEQ ID NO: 3440015 - RNA, 15 nt, Human
cucaauaaaauuaua

SEQ ID NO: 3440016 - RNA, 20 nt, Human
cucaauaaagugcuuuaaaa

SEQ ID NO: 3440017 - RNA, 15 nt, Human
cucaauaagccuugu

SEQ ID NO: 3440018 - RNA, 15 nt, Human
cucaauaugcuuaca

SEQ ID NO: 3440019 - RNA, 17 nt, Human
cucaauauucaauaaag

SEQ ID NO: 3440020 - RNA, 18 nt, Human
cucaauauucaauaaagc

SEQ ID NO: 3440021 - RNA, 19 nt, Human
cucaauauuuuccaugaaa

SEQ ID NO: 3440022 - RNA, 15 nt, Human
cucaauccauguucu

SEQ ID NO: 3440023 - RNA, 18 nt, Human
cucaaucccagcuacuca

SEQ ID NO: 3440024 - RNA, 14 nt, Human
cucaauccuaauuu

SEQ ID NO: 3440025 - RNA, 20 nt, Human
cucaauccuaauuucuccuc

SEQ ID NO: 3440026 - RNA, 12 nt, Human
cucaaugaaaaa

SEQ ID NO: 3440027 - RNA, 16 nt, Human
cucaaugaagccagcu

SEQ ID NO: 3440028 - RNA, 13 nt, Human
cucaaugagcaug

SEQ ID NO: 3440029 - RNA, 16 nt, Human
cucaaugcagccagac

SEQ ID NO: 3440030 - RNA, 14 nt, Human
cucaaugcuguuug

SEQ ID NO: 3440031 - RNA, 15 nt, Human
cucaaugcuuuauuu

SEQ ID NO: 3440032 - RNA, 19 nt, Human
cucaaugcuuuauuuguaa

SEQ ID NO: 3440033 - RNA, 17 nt, Human
cucaauggacuggaagg

SEQ ID NO: 3440034 - RNA, 20 nt, Human
cucaauggacuggaagggga

SEQ ID NO: 3440035 - RNA, 20 nt, Human
cucaauggaguaugucugau

SEQ ID NO: 3440036 - RNA, 22 nt, Human
cucaauggccuaaaacuggccu

SEQ ID NO: 3440037 - RNA, 20 nt, Human
cucaaugugaaucagacccu

SEQ ID NO: 3440038 - RNA, 21 nt, Human
cucaaugugaaucagacccua

SEQ ID NO: 3440039 - RNA, 14 nt, Human
cucaaugugaccag

SEQ ID NO: 3440040 - RNA, 15 nt, Human
cucaaugugaccagg

SEQ ID NO: 3440041 - RNA, 23 nt, Human
cucaauuauuuugcauuuuuucu

SEQ ID NO: 3440042 - RNA, 18 nt, Human
cucaauucccccuggcca

SEQ ID NO: 3440043 - RNA, 15 nt, Human
cucaauuucucccca

SEQ ID NO: 3440044 - RNA, 15 nt, Human
cucaauuuucacugu

SEQ ID NO: 3440045 - RNA, 12 nt, Human
cucaauuuuugg

SEQ ID NO: 3440046 - RNA, 14 nt, Human
cucacaaaggaugc

SEQ ID NO: 3440047 - RNA, 23 nt, Human
cucacaacuuaguguaauauacc

SEQ ID NO: 3440048 - RNA, 15 nt, Human
cucacaagccagcca

SEQ ID NO: 3440049 - RNA, 13 nt, Human
cucacaaggcagc

SEQ ID NO: 3440050 - RNA, 15 nt, Human
cucacaaggcagcaa

SEQ ID NO: 3440051 - RNA, 17 nt, Human
cucacaaggcagcaagg

SEQ ID NO: 3440052 - RNA, 20 nt, Human
cucacaaguggguaccccca

SEQ ID NO: 3440053 - RNA, 15 nt, Human
cucacacacccugag

SEQ ID NO: 3440054 - RNA, 12 nt, Human
cucacacaggca

SEQ ID NO: 3440055 - RNA, 21 nt, Human
cucacacaugagcaucaggcc

SEQ ID NO: 3440056 - RNA, 24 nt, Human
cucacacaugagcaucaggccagg

SEQ ID NO: 3440057 - RNA, 13 nt, Human
cucacaccaaauu

SEQ ID NO: 3440058 - RNA, 15 nt, Human
cucacaccugaacug

SEQ ID NO: 3440059 - RNA, 23 nt, Human
cucacacggacacucaaaagcug

SEQ ID NO: 3440060 - RNA, 22 nt, Human
cucacacucaugcauuguccuc

SEQ ID NO: 3440061 - RNA, 10 nt, Human
cucacacucc

SEQ ID NO: 3440062 - RNA, 21 nt, Human
cucacacugguucucaaugaa

SEQ ID NO: 3440063 - RNA, 20 nt, Human
cucacacuuacuguaagaca

SEQ ID NO: 3440064 - RNA, 13 nt, Human
cucacagaaauga

SEQ ID NO: 3440065 - RNA, 15 nt, Human
cucacagacaggacc

SEQ ID NO: 3440066 - RNA, 16 nt, Human
cucacagacaggaccc

SEQ ID NO: 3440067 - RNA, 20 nt, Human
cucacagacaggaccccugc

SEQ ID NO: 3440068 - RNA, 16 nt, Human
cucacagagacacagg

SEQ ID NO: 3440069 - RNA, 13 nt, Human
cucacagagucaa

SEQ ID NO: 3440070 - RNA, 13 nt, Human
cucacagcacaga

SEQ ID NO: 3440071 - RNA, 15 nt, Human
cucacagcacagaga

SEQ ID NO: 3440072 - RNA, 15 nt, Human
cucacagcacaugcu

SEQ ID NO: 3440073 - RNA, 13 nt, Human
cucacagccucug

SEQ ID NO: 3440074 - RNA, 15 nt, Human
cucacagcugaguug

SEQ ID NO: 3440075 - RNA, 16 nt, Human
cucacagcuguaauaa

SEQ ID NO: 3440076 - RNA, 15 nt, Human
cucacaggucccaaa

SEQ ID NO: 3440077 - RNA, 16 nt, Human
cucacaggucccaaau

SEQ ID NO: 3440078 - RNA, 20 nt, Human
cucacaguaacccaaaccuc

SEQ ID NO: 3440079 - RNA, 13 nt, Human
cucacaguacagc

SEQ ID NO: 3440080 - RNA, 22 nt, Human
cucacaguauugcucacccagu

SEQ ID NO: 3440081 - RNA, 17 nt, Human
cucacagucccacugug

SEQ ID NO: 3440082 - RNA, 18 nt, Human
cucacagucccacugugc

SEQ ID NO: 3440083 - RNA, 20 nt, Human
cucacagucucuuuaaucuu

SEQ ID NO: 3440084 - RNA, 19 nt, Human
cucacagugggagccaggg

SEQ ID NO: 3440085 - RNA, 17 nt, Human
cucacaguguugcccag

SEQ ID NO: 3440086 - RNA, 21 nt, Human
cucacaguguugcccaggcug

SEQ ID NO: 3440087 - RNA, 16 nt, Human
cucacaguuauuacau

SEQ ID NO: 3440088 - RNA, 16 nt, Human
cucacaucagagugac

SEQ ID NO: 3440089 - RNA, 17 nt, Human
cucacaucuuuuucacu

SEQ ID NO: 3440090 - RNA, 18 nt, Human
cucacaugauuccagcca

SEQ ID NO: 3440091 - RNA, 13 nt, Human
cucacaugcugga

SEQ ID NO: 3440092 - RNA, 19 nt, Human
cucacauggaaugaggguu

SEQ ID NO: 3440093 - RNA, 16 nt, Human
cucacaugguuuacau

SEQ ID NO: 3440094 - RNA, 13 nt, Human
cucacauuuauau

SEQ ID NO: 3440095 - RNA, 12 nt, Human
cucacauuuaug

SEQ ID NO: 3440096 - RNA, 19 nt, Human
cucacauuuauucugcuca

SEQ ID NO: 3440097 - RNA, 13 nt, Human
cucaccaacuccu

SEQ ID NO: 3440098 - RNA, 16 nt, Human
cucaccacggaccaaa

SEQ ID NO: 3440099 - RNA, 20 nt, Human
cucaccacuacaucacuuga

SEQ ID NO: 3440100 - RNA, 14 nt, Human
cucaccagaauuau

SEQ ID NO: 3440101 - RNA, 20 nt, Human
cucaccagaauugugcaaau

SEQ ID NO: 3440102 - RNA, 13 nt, Human
cucaccagcccca

SEQ ID NO: 3440103 - RNA, 16 nt, Human
cucaccagccccacug

SEQ ID NO: 3440104 - RNA, 17 nt, Human
cucaccagccccacugc

SEQ ID NO: 3440105 - RNA, 18 nt, Human
cucaccagccccacugcc

SEQ ID NO: 3440106 - RNA, 19 nt, Human
cucaccagccccacugcca

SEQ ID NO: 3440107 - RNA, 21 nt, Human
cucaccagccccacugccagc

SEQ ID NO: 3440108 - RNA, 14 nt, Human
cucaccagccccag

SEQ ID NO: 3440109 - RNA, 15 nt, Human
cucaccagccccagu

SEQ ID NO: 3440110 - RNA, 21 nt, Human
cucaccagccccagugcccac

SEQ ID NO: 3440111 - RNA, 11 nt, Human
cucaccagcug

SEQ ID NO: 3440112 - RNA, 12 nt, Human
cucaccagcugc

SEQ ID NO: 3440113 - RNA, 14 nt, Human
cucaccagcugcaa

SEQ ID NO: 3440114 - RNA, 13 nt, Human
cucaccaggaagg

SEQ ID NO: 3440115 - RNA, 21 nt, Human
cucaccaggcagccucugggg

SEQ ID NO: 3440116 - RNA, 13 nt, Human
cucaccaggggca

SEQ ID NO: 3440117 - RNA, 14 nt, Human
cucaccauguaaaa

SEQ ID NO: 3440118 - RNA, 20 nt, Human
cucaccauuccaagucucca

SEQ ID NO: 3440119 - RNA, 16 nt, Human
cucaccauuuccccag

SEQ ID NO: 3440120 - RNA, 19 nt, Human
cucaccauuuccccagggc

SEQ ID NO: 3440121 - RNA, 13 nt, Human
cucacccacacca

SEQ ID NO: 3440122 - RNA, 15 nt, Human
cucacccaguccugc

SEQ ID NO: 3440123 - RNA, 14 nt, Human
cucacccagugccc

SEQ ID NO: 3440124 - RNA, 17 nt, Human
cucacccauccuagagg

SEQ ID NO: 3440125 - RNA, 22 nt, Human
cucacccaugcaagcagaggac

SEQ ID NO: 3440126 - RNA, 13 nt, Human
cucaccccauccc

SEQ ID NO: 3440127 - RNA, 15 nt, Human
cucauucaguauuaa

SEQ ID NO: 3440128 - RNA, 19 nt, Human
cucauucaguauuaaaggg

SEQ ID NO: 3440129 - RNA, 13 nt, Human
cucauucauuacu

SEQ ID NO: 3440130 - RNA, 17 nt, Human
cucauucauuacuaaaa

SEQ ID NO: 3440131 - RNA, 18 nt, Human
cucauuccaccuucccau

SEQ ID NO: 3440132 - RNA, 12 nt, Human
cucauuccagau

SEQ ID NO: 3440133 - RNA, 14 nt, Human
cucauuccagaucc

SEQ ID NO: 3440134 - RNA, 23 nt, Human
cucauuccccggggcguuucuuu

SEQ ID NO: 3440135 - RNA, 20 nt, Human
cucauucccucgucuuuccc

SEQ ID NO: 3440136 - RNA, 12 nt, Human
cucauuccugcc

SEQ ID NO: 3440137 - RNA, 13 nt, Human
cucauuccugccu

SEQ ID NO: 3440138 - RNA, 20 nt, Human
cucauucuaaugauggccca

SEQ ID NO: 3440139 - RNA, 18 nt, Human
cucauucugaauuaauua

SEQ ID NO: 3440140 - RNA, 14 nt, Human
cucauucuuguuuu

SEQ ID NO: 3440141 - RNA, 12 nt, Human
cucauugaaaug

SEQ ID NO: 3440142 - RNA, 14 nt, Human
cucauugaaauguc

SEQ ID NO: 3440143 - RNA, 16 nt, Human
cucauugaaaugucac

SEQ ID NO: 3440144 - RNA, 21 nt, Human
cucauugaccugaggcccuuc

SEQ ID NO: 3440145 - RNA, 15 nt, Human
cucaccccgaggccc

SEQ ID NO: 3440146 - RNA, 13 nt, Human
cucaccccggcag

SEQ ID NO: 3440147 - RNA, 16 nt, Human
cucaccccgucugggg

SEQ ID NO: 3440148 - RNA, 20 nt, Human
cucaccccugguucucaucu

SEQ ID NO: 3440149 - RNA, 19 nt, Human
cucaccccuguccucacug

SEQ ID NO: 3440150 - RNA, 22 nt, Human
cucaccccuguccucacugcuc

SEQ ID NO: 3440151 - RNA, 17 nt, Human
cucaccccuugccauaa

SEQ ID NO: 3440152 - RNA, 14 nt, Human
cucacccgaggcug

SEQ ID NO: 3440153 - RNA, 13 nt, Human
cucaccgcccauc

SEQ ID NO: 3440154 - RNA, 17 nt, Human
cucaccgcccaucaggg

SEQ ID NO: 3440155 - RNA, 12 nt, Human
cucaccgcuucc

SEQ ID NO: 3440156 - RNA, 19 nt, Human
cucaccuagagccagacca

SEQ ID NO: 3440157 - RNA, 23 nt, Human
cucaccucaugcccacccccugc

SEQ ID NO: 3440158 - RNA, 23 nt, Human
cucaccucuagguccccauacuc

SEQ ID NO: 3440159 - RNA, 16 nt, Human
cucaccucucccuugg

SEQ ID NO: 3440160 - RNA, 17 nt, Human
cucaccucucccuugga

SEQ ID NO: 3440161 - RNA, 13 nt, Human
cucaccucugccu

SEQ ID NO: 3440162 - RNA, 19 nt, Human
cucaccugagucacccuac

SEQ ID NO: 3440163 - RNA, 20 nt, Human
cucaccugcacuaacagagu

SEQ ID NO: 3440164 - RNA, 18 nt, Human
cucaccugccccucaacu

SEQ ID NO: 3440165 - RNA, 16 nt, Human
cucaccugcuggcccc

SEQ ID NO: 3440166 - RNA, 18 nt, Human
cucaccugcuggccccuc

SEQ ID NO: 3440167 - RNA, 13 nt, Human
cucaccuggacuu

SEQ ID NO: 3440168 - RNA, 17 nt, Human
cucaccuggcccugcuu

SEQ ID NO: 3440169 - RNA, 20 nt, Human
cucaccugggcaccugggga

SEQ ID NO: 3440170 - RNA, 21 nt, Human
cucaccugggcaccuggggag

SEQ ID NO: 3440171 - RNA, 11 nt, Human
cucaccugggg

SEQ ID NO: 3440172 - RNA, 12 nt, Human
cucaccuggggu

SEQ ID NO: 3440173 - RNA, 13 nt, Human
cucaccuguugcu

SEQ ID NO: 3440174 - RNA, 14 nt, Human
cucaccuucugagu

SEQ ID NO: 3440175 - RNA, 20 nt, Human
cucaccuugcaacacacaga

SEQ ID NO: 3440176 - RNA, 21 nt, Human
cucaccuugcaacacacagac

SEQ ID NO: 3440177 - RNA, 16 nt, Human
cucaccuugguuccug

SEQ ID NO: 3440178 - RNA, 16 nt, Human
cucaccuuuucccggg

SEQ ID NO: 3440179 - RNA, 18 nt, Human
cucacgagucauccagaa

SEQ ID NO: 3440180 - RNA, 13 nt, Human
cucacgccuguaa

SEQ ID NO: 3440181 - RNA, 18 nt, Human
cucacgccuguaauccca

SEQ ID NO: 3440182 - RNA, 20 nt, Human
cucacgccuguaaucccagc

SEQ ID NO: 3440183 - RNA, 23 nt, Human
cucacgccuguaaucccagcacu

SEQ ID NO: 3440184 - RNA, 23 nt, Human
cucacgccuguaaucccagcagu

SEQ ID NO: 3440185 - RNA, 23 nt, Human
cucacgcuuaccucaaccauccu

SEQ ID NO: 3440186 - RNA, 18 nt, Human
cucacggccacacagcug

SEQ ID NO: 3440187 - RNA, 19 nt, Human
cucacggccacacagcugc

SEQ ID NO: 3440188 - RNA, 14 nt, Human
cucacgucaaaugc

SEQ ID NO: 3440189 - RNA, 14 nt, Human
cucacuaaagcaug

SEQ ID NO: 3440190 - RNA, 19 nt, Human
cucacuaaagcaugaaaug

SEQ ID NO: 3440191 - RNA, 15 nt, Human
cucacuaauuuuugu

SEQ ID NO: 3440192 - RNA, 15 nt, Human
cucacuaccuccuca

SEQ ID NO: 3440193 - RNA, 23 nt, Human
cucacuaggcccccacuugccuc

SEQ ID NO: 3440194 - RNA, 16 nt, Human
cucacuaggcuucugg

SEQ ID NO: 3440195 - RNA, 20 nt, Human
cucacuaggcuucugguuga

SEQ ID NO: 3440196 - RNA, 20 nt, Human
cucacuaucccggcugcccu

SEQ ID NO: 3440197 - RNA, 22 nt, Human
cucacuaugaaucuauuauacu

SEQ ID NO: 3440198 - RNA, 18 nt, Human
cucacuauguugcccagg

SEQ ID NO: 3440199 - RNA, 17 nt, Human
cucacucaaguucaagg

SEQ ID NO: 3440200 - RNA, 13 nt, Human
cucacucagcacc

SEQ ID NO: 3440201 - RNA, 18 nt, Human
cucacucagcaccacuca

SEQ ID NO: 3440202 - RNA, 12 nt, Human
cucacuccacca

SEQ ID NO: 3440203 - RNA, 21 nt, Human
cucacuccaggaaggggcugg

SEQ ID NO: 3440204 - RNA, 14 nt, Human
cucacucccaccug

SEQ ID NO: 3440205 - RNA, 15 nt, Human
cucacucccagucca

SEQ ID NO: 3440206 - RNA, 19 nt, Human
cucacuccccaugccacgu

SEQ ID NO: 3440207 - RNA, 12 nt, Human
cucacuccccuc

SEQ ID NO: 3440208 - RNA, 22 nt, Human
cucacucccuucuaccugccac

SEQ ID NO: 3440209 - RNA, 17 nt, Human
cucacucccuucuccuu

SEQ ID NO: 3440210 - RNA, 12 nt, Human
cucacuccuguu

SEQ ID NO: 3440211 - RNA, 14 nt, Human
cucacuccuuuuaa

SEQ ID NO: 3440212 - RNA, 22 nt, Human
cucacucggguuucucuguggc

SEQ ID NO: 3440213 - RNA, 14 nt, Human
cucacucgucuccc

SEQ ID NO: 3440214 - RNA, 14 nt, Human
cucacucugccagg

SEQ ID NO: 3440215 - RNA, 15 nt, Human
cucacucugccaggg

SEQ ID NO: 3440216 - RNA, 11 nt, Human
cucacucugcu

SEQ ID NO: 3440217 - RNA, 14 nt, Human
cucacucuggccuc

SEQ ID NO: 3440218 - RNA, 12 nt, Human
cucacucugggc

SEQ ID NO: 3440219 - RNA, 21 nt, Human
cucacucugucgcccagucug

SEQ ID NO: 3440220 - RNA, 18 nt, Human
cucacugaaaacaucugg

SEQ ID NO: 3440221 - RNA, 15 nt, Human
cucacugauauauuu

SEQ ID NO: 3440222 - RNA, 17 nt, Human
cucacugcaaccuccgc

SEQ ID NO: 3440223 - RNA, 18 nt, Human
cucacugcaaccuucacc

SEQ ID NO: 3440224 - RNA, 14 nt, Human
cucacugcagccuc

SEQ ID NO: 3440225 - RNA, 15 nt, Human
cucacugcagccucg

SEQ ID NO: 3440226 - RNA, 11 nt, Human
cucacugccag

SEQ ID NO: 3440227 - RNA, 12 nt, Human
cucacugccagg

SEQ ID NO: 3440228 - RNA, 13 nt, Human
cucacugccaggc

SEQ ID NO: 3440229 - RNA, 14 nt, Human
cucacugccaggcc

SEQ ID NO: 3440230 - RNA, 22 nt, Human
cucacugcggagaaccuugugc

SEQ ID NO: 3440231 - RNA, 21 nt, Human
cucacugcucaagaagacaug

SEQ ID NO: 3440232 - RNA, 18 nt, Human
cucacugcuugaacuagg

SEQ ID NO: 3440233 - RNA, 14 nt, Human
cucacuggccaucc

SEQ ID NO: 3440234 - RNA, 17 nt, Human
cucacugggguccuggg

SEQ ID NO: 3440235 - RNA, 10 nt, Human
cucacuguga

SEQ ID NO: 3440236 - RNA, 20 nt, Human
cucacuguggugucuguguu

SEQ ID NO: 3440237 - RNA, 18 nt, Human
cucacuguucccucugcu

SEQ ID NO: 3440238 - RNA, 15 nt, Human
cucacuguugaauuu

SEQ ID NO: 3440239 - RNA, 21 nt, Human
cucacuguugaauuuucucua

SEQ ID NO: 3440240 - RNA, 18 nt, Human
cucacuguugcccaggcu

SEQ ID NO: 3440241 - RNA, 19 nt, Human
cucacuguugcccaggcug

SEQ ID NO: 3440242 - RNA, 21 nt, Human
cucacuguugcccaggcuggc

SEQ ID NO: 3440243 - RNA, 22 nt, Human
cucacuguugcccaggcuggcg

SEQ ID NO: 3440244 - RNA, 15 nt, Human
cucacuugcccacac

SEQ ID NO: 3440245 - RNA, 18 nt, Human
cucacuuggucugccagg

SEQ ID NO: 3440246 - RNA, 19 nt, Human
cucacuuggucugccaggc

SEQ ID NO: 3440247 - RNA, 18 nt, Human
cucacuuguuuuauuuaa

SEQ ID NO: 3440248 - RNA, 15 nt, Human
cucacuuuucccacu

SEQ ID NO: 3440249 - RNA, 15 nt, Human
cucacuuuucuccau

SEQ ID NO: 3440250 - RNA, 16 nt, Human
cucacuuuuucauuuc

SEQ ID NO: 3440251 - RNA, 20 nt, Human
cucagaaaauaucccuccug

SEQ ID NO: 3440252 - RNA, 19 nt, Human
cucagaaacacuggggcug

SEQ ID NO: 3440253 - RNA, 18 nt, Human
cucagaaacuccaugaug

SEQ ID NO: 3440254 - RNA, 22 nt, Human
cucagaaagugccugacacacu

SEQ ID NO: 3440255 - RNA, 23 nt, Human
cucagaaaguguauaauaagaaa

SEQ ID NO: 3440256 - RNA, 21 nt, Human
cucagaaauuuuuauuuuucu

SEQ ID NO: 3440257 - RNA, 16 nt, Human
cucagaacccagggcu

SEQ ID NO: 3440258 - RNA, 23 nt, Human
cucagaacccagggcucugcccc

SEQ ID NO: 3440259 - RNA, 15 nt, Human
cucagaagacacuga

SEQ ID NO: 3440260 - RNA, 23 nt, Human
cucagaagacacugaugggcaac

SEQ ID NO: 3440261 - RNA, 13 nt, Human
cucagaagcacag

SEQ ID NO: 3440262 - RNA, 22 nt, Human
cucagaagccugggggccuggc

SEQ ID NO: 3440263 - RNA, 23 nt, Human
cucagaagccugggggccuggcu

SEQ ID NO: 3440264 - RNA, 14 nt, Human
cucagaaggcucuu

SEQ ID NO: 3440265 - RNA, 15 nt, Human
cucagaaggcucuuc

SEQ ID NO: 3440266 - RNA, 20 nt, Human
cucagaaggcucuucugacu

SEQ ID NO: 3440267 - RNA, 22 nt, Human
cucagaagggagcuagccagag

SEQ ID NO: 3440268 - RNA, 13 nt, Human
cucagaagguauu

SEQ ID NO: 3440269 - RNA, 16 nt, Human
cucagaagguauuccu

SEQ ID NO: 3440270 - RNA, 13 nt, Human
cucagaaguaaag

SEQ ID NO: 3440271 - RNA, 16 nt, Human
cucagaagucuuucag

SEQ ID NO: 3440272 - RNA, 21 nt, Human
cucagaagugcaucuggagag

SEQ ID NO: 3440273 - RNA, 11 nt, Human
cucagaaucua

SEQ ID NO: 3440274 - RNA, 14 nt, Human
cucagaauuauuuu

SEQ ID NO: 3440275 - RNA, 17 nt, Human
cucagacauuggcaccu

SEQ ID NO: 3440276 - RNA, 14 nt, Human
cucagaccagagaa

SEQ ID NO: 3440277 - RNA, 15 nt, Human
cucagaccagagaag

SEQ ID NO: 3440278 - RNA, 14 nt, Human
cucagaccagcucu

SEQ ID NO: 3440279 - RNA, 15 nt, Human
cucagaccagcucuu

SEQ ID NO: 3440280 - RNA, 14 nt, Human
cucagacccuuucu

SEQ ID NO: 3440281 - RNA, 17 nt, Human
cucagaccgucuuccuc

SEQ ID NO: 3440282 - RNA, 21 nt, Human
cucagaccgucuuccuccaac

SEQ ID NO: 3440283 - RNA, 19 nt, Human
cucagacucuaagaaagaa

SEQ ID NO: 3440284 - RNA, 22 nt, Human
cucagacucuuuuuguaccugg

SEQ ID NO: 3440285 - RNA, 18 nt, Human
cucagacugcacccagga

SEQ ID NO: 3440286 - RNA, 20 nt, Human
cucagacugcacccaggagg

SEQ ID NO: 3440287 - RNA, 17 nt, Human
cucagacuuuggaaaau

SEQ ID NO: 3440288 - RNA, 16 nt, Human
ccaucugauaucuaua

SEQ ID NO: 3440289 - RNA, 23 nt, Human
ccaucugcaccccuucucuccuc

SEQ ID NO: 3440290 - RNA, 12 nt, Human
cucaucugucac

SEQ ID NO: 3440291 - RNA, 14 nt, Human
cucaucugucacca

SEQ ID NO: 3440292 - RNA, 17 nt, Human
cucaucugucccuccgg

SEQ ID NO: 3440293 - RNA, 13 nt, Human
cucaucugucugg

SEQ ID NO: 3440294 - RNA, 18 nt, Human
cucaucuuagugccugag

SEQ ID NO: 3440295 - RNA, 19 nt, Human
cucaucuugaagggcccag

SEQ ID NO: 3440296 - RNA, 21 nt, Human
cucaucuugacagagccugcc

SEQ ID NO: 3440297 - RNA, 14 nt, Human
cucaucuugugaaa

SEQ ID NO: 3440298 - RNA, 19 nt, Human
cucaucuuucccuccuugg

SEQ ID NO: 3440299 - RNA, 12 nt, Human
cucaucuuucuu

SEQ ID NO: 3440300 - RNA, 16 nt, Human
cucaucuuucuuccaa

SEQ ID NO: 3440301 - RNA, 15 nt, Human
cucaucuuucuugau

SEQ ID NO: 3440302 - RNA, 14 nt, Human
cucaucuuuuuacu

SEQ ID NO: 3440303 - RNA, 13 nt, Human
cucaugaauguaa

SEQ ID NO: 3440304 - RNA, 14 nt, Human
cucaugaauguaaa

SEQ ID NO: 3440305 - RNA, 15 nt, Human
cucaugaauguaaau

SEQ ID NO: 3440306 - RNA, 14 nt, Human
cucaugaggggaga

SEQ ID NO: 3440307 - RNA, 19 nt, Human
cucaugaucuugugacaua

SEQ ID NO: 3440308 - RNA, 16 nt, Human
cucaugcaaaucaauu

SEQ ID NO: 3440309 - RNA, 20 nt, Human
cucaugcaaaucaauuacug

SEQ ID NO: 3440310 - RNA, 14 nt, Human
cucaugcagccgug

SEQ ID NO: 3440311 - RNA, 18 nt, Human
cucaugcauagucccagc

SEQ ID NO: 3440312 - RNA, 19 nt, Human
cucaugcauagucccagcu

SEQ ID NO: 3440313 - RNA, 12 nt, Human
cucaugcaucuc

SEQ ID NO: 3440314 - RNA, 21 nt, Human
cucaugccaaccccgcccuag

SEQ ID NO: 3440315 - RNA, 16 nt, Human
cucaugcccacccccu

SEQ ID NO: 3440316 - RNA, 19 nt, Human
cucaugcccacccccugcc

SEQ ID NO: 3440317 - RNA, 23 nt, Human
cucaugcccacccccugcccugc

SEQ ID NO: 3440318 - RNA, 12 nt, Human
cucaugccucag

SEQ ID NO: 3440319 - RNA, 18 nt, Human
cucaugccucagccuccu

SEQ ID NO: 3440320 - RNA, 21 nt, Human
cucaugccuguaaucccagca

SEQ ID NO: 3440321 - RNA, 12 nt, Human
cucaugcugaaa

SEQ ID NO: 3440322 - RNA, 14 nt, Human
cucaugcugccaau

SEQ ID NO: 3440323 - RNA, 12 nt, Human
cucaugcugccc

SEQ ID NO: 3440324 - RNA, 18 nt, Human
cucaugcugccccugccu

SEQ ID NO: 3440325 - RNA, 20 nt, Human
cucauggagaagcagaaaua

SEQ ID NO: 3440326 - RNA, 21 nt, Human
cucauggagaagcagaaauac

SEQ ID NO: 3440327 - RNA, 14 nt, Human
cucauggccccucu

SEQ ID NO: 3440328 - RNA, 16 nt, Human
cucaugggguccaagu

SEQ ID NO: 3440329 - RNA, 23 nt, Human
cucauggguggcacucagucucu

SEQ ID NO: 3440330 - RNA, 23 nt, Human
cucauggugaggcuuaacaaugu

SEQ ID NO: 3440331 - RNA, 15 nt, Human
cucaugguggguuca

SEQ ID NO: 3440332 - RNA, 17 nt, Human
cucauguaucaucugga

SEQ ID NO: 3440333 - RNA, 19 nt, Human
cucauguaucaucuggaua

SEQ ID NO: 3440334 - RNA, 13 nt, Human
cucauguggcugg

SEQ ID NO: 3440335 - RNA, 14 nt, Human
cucauguggcugga

SEQ ID NO: 3440336 - RNA, 16 nt, Human
cucaugugugcaacag

SEQ ID NO: 3440337 - RNA, 18 nt, Human
cucaugugugcucuucuu

SEQ ID NO: 3440338 - RNA, 15 nt, Human
cucauguucugcuuu

SEQ ID NO: 3440339 - RNA, 18 nt, Human
cucauguucuuaauucuu

SEQ ID NO: 3440340 - RNA, 19 nt, Human
cucauguucuuaauucuua

SEQ ID NO: 3440341 - RNA, 15 nt, Human
cucauguuuaugaaa

SEQ ID NO: 3440342 - RNA, 17 nt, Human
cucauguuuaugaaaau

SEQ ID NO: 3440343 - RNA, 18 nt, Human
cucauguuuucaacugcc

SEQ ID NO: 3440344 - RNA, 18 nt, Human
cucccuuuuuccuugucc

SEQ ID NO: 3440345 - RNA, 21 nt, Human
cucccuuuuuccuugucccca

SEQ ID NO: 3440346 - RNA, 23 nt, Human
cucccuuuuuccuuguccccaca

SEQ ID NO: 3440347 - RNA, 16 nt, Human
cuccgaaaugcugucu

SEQ ID NO: 3440348 - RNA, 17 nt, Human
cuccgaaaugcugucuu

SEQ ID NO: 3440349 - RNA, 15 nt, Human
cuccgaccagacacc

SEQ ID NO: 3440350 - RNA, 16 nt, Human
cuccgacugcuaggga

SEQ ID NO: 3440351 - RNA, 14 nt, Human
cuccgagagggaga

SEQ ID NO: 3440352 - RNA, 13 nt, Human
cuccgagaggugg

SEQ ID NO: 3440353 - RNA, 22 nt, Human
cuccgagaggugggccagucug

SEQ ID NO: 3440354 - RNA, 18 nt, Human
cuccgaggugguuuuaaa

SEQ ID NO: 3440355 - RNA, 12 nt, Human
cuccgcaggacu

SEQ ID NO: 3440356 - RNA, 20 nt, Human
cuccgccagccuccucugga

SEQ ID NO: 3440357 - RNA, 16 nt, Human
cuccgcccccagguag

SEQ ID NO: 3440358 - RNA, 19 nt, Human
cuccgccccugagcccacu

SEQ ID NO: 3440359 - RNA, 13 nt, Human
cuccgcccugcca

SEQ ID NO: 3440360 - RNA, 16 nt, Human
cuccgcccugccacuc

SEQ ID NO: 3440361 - RNA, 15 nt, Human
cuccgccucugcugg

SEQ ID NO: 3440362 - RNA, 18 nt, Human
cuccgccuucacuccggu

SEQ ID NO: 3440363 - RNA, 22 nt, Human
cuccgcuuucuacccagcgagc

SEQ ID NO: 3440364 - RNA, 17 nt, Human
cuccggaggacucacca

SEQ ID NO: 3440365 - RNA, 23 nt, Human
cuccggaggacucaccacugccc

SEQ ID NO: 3440366 - RNA, 16 nt, Human
cuccggaucgaggccu

SEQ ID NO: 3440367 - RNA, 18 nt, Human
cuccggccaggugccucc

SEQ ID NO: 3440368 - RNA, 19 nt, Human
cuccggcccuccagagccc

SEQ ID NO: 3440369 - RNA, 15 nt, Human
cuccggccuccccuc

SEQ ID NO: 3440370 - RNA, 19 nt, Human
cuccggccucugccuuugc

SEQ ID NO: 3440371 - RNA, 17 nt, Human
cuccggcgucagccucc

SEQ ID NO: 3440372 - RNA, 22 nt, Human
cuccggcgucagccuccagccu

SEQ ID NO: 3440373 - RNA, 23 nt, Human
cuccggcgucagccuccagccuc

SEQ ID NO: 3440374 - RNA, 16 nt, Human
cuccggcucccagccu

SEQ ID NO: 3440375 - RNA, 16 nt, Human
cuccgggacccccagg

SEQ ID NO: 3440376 - RNA, 18 nt, Human
cuccggugugccugcagc

SEQ ID NO: 3440377 - RNA, 19 nt, Human
cuccggugugccugcagcc

SEQ ID NO: 3440378 - RNA, 23 nt, Human
cuccggugugccugcagccccgc

SEQ ID NO: 3440379 - RNA, 14 nt, Human
cuccgucacuaccu

SEQ ID NO: 3440380 - RNA, 15 nt, Human
cuccguccagccgcc

SEQ ID NO: 3440381 - RNA, 18 nt, Human
cuccguccaggagccugg

SEQ ID NO: 3440382 - RNA, 13 nt, Human
cuccguccauauc

SEQ ID NO: 3440383 - RNA, 13 nt, Human
cuccgugccucca

SEQ ID NO: 3440384 - RNA, 22 nt, Human
cuccgugccuccaccaccacug

SEQ ID NO: 3440385 - RNA, 12 nt, Human
cuccguggagga

SEQ ID NO: 3440386 - RNA, 18 nt, Human
cuccguggaggagguugg

SEQ ID NO: 3440387 - RNA, 22 nt, Human
cuccguggaggagguugggagg

SEQ ID NO: 3440388 - RNA, 15 nt, Human
cuccguuagcuccug

SEQ ID NO: 3440389 - RNA, 21 nt, Human
cuccguuagcuccuguggccc

SEQ ID NO: 3440390 - RNA, 12 nt, Human
cuccguuggcca

SEQ ID NO: 3440391 - RNA, 22 nt, Human
cuccguuuauuauaaacuguau

SEQ ID NO: 3440392 - RNA, 19 nt, Human
cuccuaaaaggcccagaga

SEQ ID NO: 3440393 - RNA, 17 nt, Human
cuccuaaaguacuggga

SEQ ID NO: 3440394 - RNA, 19 nt, Human
cuccuaaccucaagugauc

SEQ ID NO: 3440395 - RNA, 22 nt, Human
cuccuaagcaccuguaaugugc

SEQ ID NO: 3440396 - RNA, 19 nt, Human
cuccuacauaucccuucca

SEQ ID NO: 3440397 - RNA, 21 nt, Human
cuccuacauaucccuuccaga

SEQ ID NO: 3440398 - RNA, 20 nt, Human
cuccuacccaccgcccuugc

SEQ ID NO: 3440399 - RNA, 16 nt, Human
cuccuaccccucccag

SEQ ID NO: 3440400 - RNA, 17 nt, Human
cuccuaccccucccagc

SEQ ID NO: 3440401 - RNA, 18 nt, Human
cuccuacccugcgcccag

SEQ ID NO: 3440402 - RNA, 21 nt, Human
cuccuaccgaaaccuugccuu

SEQ ID NO: 3440403 - RNA, 16 nt, Human
cuccuaccucagccua

SEQ ID NO: 3440404 - RNA, 17 nt, Human
cuccuaccugcccugga

SEQ ID NO: 3440405 - RNA, 18 nt, Human
cuccuagagacagaagca

SEQ ID NO: 3440406 - RNA, 18 nt, Human
cuccuagagggaggggcc

SEQ ID NO: 3440407 - RNA, 19 nt, Human
cuccuagagggaggggccu

SEQ ID NO: 3440408 - RNA, 22 nt, Human
cuccuagccugugccucuggga

SEQ ID NO: 3440409 - RNA, 21 nt, Human
cuccuagcuguccuuuuuccu

SEQ ID NO: 3440410 - RNA, 20 nt, Human
cuccuaggacccgucuccag

SEQ ID NO: 3440411 - RNA, 22 nt, Human
cuccuaggacccgucuccagcu

SEQ ID NO: 3440412 - RNA, 15 nt, Human
cuccuaggcauucug

SEQ ID NO: 3440413 - RNA, 22 nt, Human
cuccuaguacuaacuccuagga

SEQ ID NO: 3440414 - RNA, 17 nt, Human
cuccuaguucuagaaaa

SEQ ID NO: 3440415 - RNA, 21 nt, Human
cuccuaguucuucaucccacu

SEQ ID NO: 3440416 - RNA, 16 nt, Human
cuccuauaaucuguca

SEQ ID NO: 3440417 - RNA, 23 nt, Human
cuccuauaaucugucaaaacacu

SEQ ID NO: 3440418 - RNA, 17 nt, Human
cuccuaucaccuccccu

SEQ ID NO: 3440419 - RNA, 18 nt, Human
cuccuaucaccuccccuc

SEQ ID NO: 3440420 - RNA, 14 nt, Human
cuccuauccugguu

SEQ ID NO: 3440421 - RNA, 19 nt, Human
cuccuaugaucugagucag

SEQ ID NO: 3440422 - RNA, 13 nt, Human
cuccuaugcuuua

SEQ ID NO: 3440423 - RNA, 18 nt, Human
cuccuaugcuuuagcuua

SEQ ID NO: 3440424 - RNA, 22 nt, Human
cuccuauucaguucccagaauc

SEQ ID NO: 3440425 - RNA, 22 nt, Human
cuccuauucucuuaauuuuucu

SEQ ID NO: 3440426 - RNA, 21 nt, Human
cuccucaauuuuugucucaga

SEQ ID NO: 3440427 - RNA, 21 nt, Human
cuccucacaacauggugucug

SEQ ID NO: 3440428 - RNA, 14 nt, Human
cuccucacccccag

SEQ ID NO: 3440429 - RNA, 15 nt, Human
cuccucacccccagc

SEQ ID NO: 3440430 - RNA, 17 nt, Human
cuccucacccccagcuu

SEQ ID NO: 3440431 - RNA, 20 nt, Human
cuccucacccccagcuuugc

SEQ ID NO: 3440432 - RNA, 21 nt, Human
cuccucacccccagcuuugcu

SEQ ID NO: 3440433 - RNA, 15 nt, Human
cuccucaccccgucu

SEQ ID NO: 3440434 - RNA, 15 nt, Human
cccacuguccugggc

SEQ ID NO: 3440435 - RNA, 16 nt, Human
cccacuguccugggcc

SEQ ID NO: 3440436 - RNA, 22 nt, Human
cccacuguccugggccugcaga

SEQ ID NO: 3440437 - RNA, 17 nt, Human
cccacuguccugggcgc

SEQ ID NO: 3440438 - RNA, 22 nt, Human
cccacuguuucucuugagcugg

SEQ ID NO: 3440439 - RNA, 15 nt, Human
cccacuuccccuccu

SEQ ID NO: 3440440 - RNA, 19 nt, Human
cccacuuccccuccuaccc

SEQ ID NO: 3440441 - RNA, 23 nt, Human
cccacuuccccuccuaccccucc

SEQ ID NO: 3440442 - RNA, 16 nt, Human
cccacuucccugacac

SEQ ID NO: 3440443 - RNA, 20 nt, Human
cccacuucccugacacugcg

SEQ ID NO: 3440444 - RNA, 14 nt, Human
cccacuucugcacu

SEQ ID NO: 3440445 - RNA, 14 nt, Human
cccacuugccucuu

SEQ ID NO: 3440446 - RNA, 15 nt, Human
cccacuugccucuuc

SEQ ID NO: 3440447 - RNA, 18 nt, Human
cccacuuguccuuagccu

SEQ ID NO: 3440448 - RNA, 18 nt, Human
cccagaacacacuccauc

SEQ ID NO: 3440449 - RNA, 19 nt, Human
cccagaaccuguccuugca

SEQ ID NO: 3440450 - RNA, 19 nt, Human
cccagaacuggacucagga

SEQ ID NO: 3440451 - RNA, 16 nt, Human
cccagaaugaggcugc

SEQ ID NO: 3440452 - RNA, 17 nt, Human
cccagaaugaggcugcu

SEQ ID NO: 3440453 - RNA, 18 nt, Human
cccagaaugccuccugca

SEQ ID NO: 3440454 - RNA, 11 nt, Human
cccagaauuca

SEQ ID NO: 3440455 - RNA, 17 nt, Human
cccagaauucccagcug

SEQ ID NO: 3440456 - RNA, 21 nt, Human
cccagaauucccagcugucug

SEQ ID NO: 3440457 - RNA, 11 nt, Human
cccagacacau

SEQ ID NO: 3440458 - RNA, 16 nt, Human
cccagacacugguuug

SEQ ID NO: 3440459 - RNA, 23 nt, Human
cccagacagacaucucugcaccc

SEQ ID NO: 3440460 - RNA, 15 nt, Human
cccagacgaugucuu

SEQ ID NO: 3440461 - RNA, 22 nt, Human
cccagacuacuauuuucuuuuu

SEQ ID NO: 3440462 - RNA, 13 nt, Human
cccagagaagcca

SEQ ID NO: 3440463 - RNA, 15 nt, Human
cccagagaagccccu

SEQ ID NO: 3440464 - RNA, 14 nt, Human
cccagagacaggaa

SEQ ID NO: 3440465 - RNA, 18 nt, Human
cccagagacauacuugaa

SEQ ID NO: 3440466 - RNA, 20 nt, Human
cccagagaccaggcuguguc

SEQ ID NO: 3440467 - RNA, 14 nt, Human
cccagagacccagc

SEQ ID NO: 3440468 - RNA, 15 nt, Human
cccagagacccagcg

SEQ ID NO: 3440469 - RNA, 11 nt, Human
cccagagacuu

SEQ ID NO: 3440470 - RNA, 22 nt, Human
cccagagagaagagccccacuc

SEQ ID NO: 3440471 - RNA, 15 nt, Human
cccagagagcccgag

SEQ ID NO: 3440472 - RNA, 19 nt, Human
cccagagaggaaucagacu

SEQ ID NO: 3440473 - RNA, 13 nt, Human
cccagagauguca

SEQ ID NO: 3440474 - RNA, 22 nt, Human
cccagagauugcuucucauccc

SEQ ID NO: 3440475 - RNA, 14 nt, Human
cccagagcaccugc

SEQ ID NO: 3440476 - RNA, 16 nt, Human
cccagagcaggaggcc

SEQ ID NO: 3440477 - RNA, 14 nt, Human
cccagagcagggug

SEQ ID NO: 3440478 - RNA, 22 nt, Human
cccagagcauuacgugagccag

SEQ ID NO: 3440479 - RNA, 19 nt, Human
cccagagccacacaugggc

SEQ ID NO: 3440480 - RNA, 16 nt, Human
cccagagcccagcucc

SEQ ID NO: 3440481 - RNA, 20 nt, Human
cccagagcugguggacccag

SEQ ID NO: 3440482 - RNA, 24 nt, Human
cccagaggaaggggccagaggcuc

SEQ ID NO: 3440483 - RNA, 20 nt, Human
cccagaggacagcacagacu

SEQ ID NO: 3440484 - RNA, 20 nt, Human
cccagaggagcugggagccg

SEQ ID NO: 3440485 - RNA, 16 nt, Human
cccagaggauugcugc

SEQ ID NO: 3440486 - RNA, 18 nt, Human
cccagaggcacagccggg

SEQ ID NO: 3440487 - RNA, 14 nt, Human
cccagaggccucuc

SEQ ID NO: 3440488 - RNA, 16 nt, Human
cccagaggcugcccca

SEQ ID NO: 3440489 - RNA, 15 nt, Human
cccagagggcccagg

SEQ ID NO: 3440490 - RNA, 23 nt, Human
cccagagggcccaggcaggccac

SEQ ID NO: 3440491 - RNA, 18 nt, Human
cccagagggccugcaagg

SEQ ID NO: 3440492 - RNA, 13 nt, Human
cccagaggggccu

SEQ ID NO: 3440493 - RNA, 15 nt, Human
cccagaggggccugc

SEQ ID NO: 3440494 - RNA, 17 nt, Human
cccagaggggccugcca

SEQ ID NO: 3440495 - RNA, 18 nt, Human
cccagaggggccugccac

SEQ ID NO: 3440496 - RNA, 13 nt, Human
cccagagguaaca

SEQ ID NO: 3440497 - RNA, 18 nt, Human
cccagagguaacagaaca

SEQ ID NO: 3440498 - RNA, 15 nt, Human
cccagagguccagcc

SEQ ID NO: 3440499 - RNA, 17 nt, Human
cccagagguccagccca

SEQ ID NO: 3440500 - RNA, 14 nt, Human
cccagaguuuuuau

SEQ ID NO: 3440501 - RNA, 16 nt, Human
cccagaucagcuccua

SEQ ID NO: 3440502 - RNA, 19 nt, Human
cccagaucagucagagccc

SEQ ID NO: 3440503 - RNA, 14 nt, Human
cccagaucccagaa

SEQ ID NO: 3440504 - RNA, 16 nt, Human
cccagaucccagaagg

SEQ ID NO: 3440505 - RNA, 18 nt, Human
cccagaucuggucccuug

SEQ ID NO: 3440506 - RNA, 19 nt, Human
cccagaucuggucccuugc

SEQ ID NO: 3440507 - RNA, 17 nt, Human
cccagauuccccugugu

SEQ ID NO: 3440508 - RNA, 15 nt, Human
cccagauuucagucu

SEQ ID NO: 3440509 - RNA, 21 nt, Human
cuccucggcuggcuguccacc

SEQ ID NO: 3440510 - RNA, 22 nt, Human
cuccucggcuggcuguccaccc

SEQ ID NO: 3440511 - RNA, 17 nt, Human
cuccucuaacaggggcu

SEQ ID NO: 3440512 - RNA, 22 nt, Human
cuccucuauccugggcuuuugu

SEQ ID NO: 3440513 - RNA, 15 nt, Human
cuccucucacucccc

SEQ ID NO: 3440514 - RNA, 14 nt, Human
cuccucucaguguu

SEQ ID NO: 3440515 - RNA, 14 nt, Human
cuccucuccaccau

SEQ ID NO: 3440516 - RNA, 15 nt, Human
cuccucuccaccauc

SEQ ID NO: 3440517 - RNA, 11 nt, Human
cuccucuccag

SEQ ID NO: 3440518 - RNA, 12 nt, Human
cuccucuccagg

SEQ ID NO: 3440519 - RNA, 18 nt, Human
cuccucuccccuaccacu

SEQ ID NO: 3440520 - RNA, 16 nt, Human
cuccucuccuggagga

SEQ ID NO: 3440521 - RNA, 19 nt, Human
cuccucucuaaccuccuuu

SEQ ID NO: 3440522 - RNA, 19 nt, Human
cuccucucugcccuaaugc

SEQ ID NO: 3440523 - RNA, 11 nt, Human
cuccucugaaa

SEQ ID NO: 3440524 - RNA, 12 nt, Human
cuccucugaaac

SEQ ID NO: 3440525 - RNA, 14 nt, Human
cuccucugaaacag

SEQ ID NO: 3440526 - RNA, 16 nt, Human
cuccucugaaacagcu

SEQ ID NO: 3440527 - RNA, 18 nt, Human
cuccucugaaacagcugc

SEQ ID NO: 3440528 - RNA, 12 nt, Human
cuccucugcacu

SEQ ID NO: 3440529 - RNA, 17 nt, Human
cuccucugcagugccuu

SEQ ID NO: 3440530 - RNA, 14 nt, Human
cuccucugccaccu

SEQ ID NO: 3440531 - RNA, 15 nt, Human
cuccucugccaccuc

SEQ ID NO: 3440532 - RNA, 16 nt, Human
cuccucugccaccucc

SEQ ID NO: 3440533 - RNA, 17 nt, Human
cuccucugccaccuccc

SEQ ID NO: 3440534 - RNA, 11 nt, Human
cuccucugcug

SEQ ID NO: 3440535 - RNA, 14 nt, Human
cuccucugcugacc

SEQ ID NO: 3440536 - RNA, 16 nt, Human
cuccucugcugaccug

SEQ ID NO: 3440537 - RNA, 19 nt, Human
cuccucugcugaccugcug

SEQ ID NO: 3440538 - RNA, 16 nt, Human
cuccucugcuugccau

SEQ ID NO: 3440539 - RNA, 17 nt, Human
cuccucugcuugccauc

SEQ ID NO: 3440540 - RNA, 21 nt, Human
cuccucugcuugccaucccuc

SEQ ID NO: 3440541 - RNA, 13 nt, Human
cuccucugggcag

SEQ ID NO: 3440542 - RNA, 23 nt, Human
cuccucugggcaggaccucagag

SEQ ID NO: 3440543 - RNA, 14 nt, Human
cuccucuguccagg

SEQ ID NO: 3440544 - RNA, 18 nt, Human
cuccucuguccugcuucu

SEQ ID NO: 3440545 - RNA, 20 nt, Human
cuccucuguccugcuucuga

SEQ ID NO: 3440546 - RNA, 13 nt, Human
cuccucugugacc

SEQ ID NO: 3440547 - RNA, 13 nt, Human
cuccucuguggug

SEQ ID NO: 3440548 - RNA, 19 nt, Human
cuccucuuaaaaaauaaaa

SEQ ID NO: 3440549 - RNA, 21 nt, Human
cuccucuuaaaaaauaaaaac

SEQ ID NO: 3440550 - RNA, 18 nt, Human
cuccucuucaccccggca

SEQ ID NO: 3440551 - RNA, 14 nt, Human
cuccucuuccaggc

SEQ ID NO: 3440552 - RNA, 16 nt, Human
cuccucuuccaugcug

SEQ ID NO: 3440553 - RNA, 15 nt, Human
cuccucuuccccaga

SEQ ID NO: 3440554 - RNA, 17 nt, Human
cuccucuucuacucacu

SEQ ID NO: 3440555 - RNA, 23 nt, Human
cuccucuucuuuuuuuucauuau

SEQ ID NO: 3440556 - RNA, 13 nt, Human
cuccucuuuaaaa

SEQ ID NO: 3440557 - RNA, 18 nt, Human
cuccucuuuaaaacaaaa

SEQ ID NO: 3440558 - RNA, 13 nt, Human
cuccucuuucucu

SEQ ID NO: 3440559 - RNA, 16 nt, Human
cuccucuuuguuuugu

SEQ ID NO: 3440560 - RNA, 19 nt, Human
cuccugacacaccugcagc

SEQ ID NO: 3440561 - RNA, 19 nt, Human
cuccugacaccccacuuag

SEQ ID NO: 3440562 - RNA, 20 nt, Human
cuccugacaccccacuuagc

SEQ ID NO: 3440563 - RNA, 16 nt, Human
cuccugaccaguugca

SEQ ID NO: 3440564 - RNA, 23 nt, Human
cuccugaccaguugcagucacuc

SEQ ID NO: 3440565 - RNA, 14 nt, Human
cuccugaccucagg

SEQ ID NO: 3440566 - RNA, 15 nt, Human
cuccugaccugaggc

SEQ ID NO: 3440567 - RNA, 14 nt, Human
cuccugaccuuagg

SEQ ID NO: 3440568 - RNA, 18 nt, Human
cuccugagaccccuggcc

SEQ ID NO: 3440569 - RNA, 19 nt, Human
cuccugagcccccagcuuc

SEQ ID NO: 3440570 - RNA, 23 nt, Human
cuccugagcccccagcuuccagc

SEQ ID NO: 3440571 - RNA, 13 nt, Human
cuccugagcuagg

SEQ ID NO: 3440572 - RNA, 19 nt, Human
cuccugaggacagcugucc

SEQ ID NO: 3440573 - RNA, 23 nt, Human
cuccugaggaucagaaaguaauu

SEQ ID NO: 3440574 - RNA, 17 nt, Human
cuccugaggcuuuggau

SEQ ID NO: 3440575 - RNA, 19 nt, Human
cuccugagggaggaccugg

SEQ ID NO: 3440576 - RNA, 23 nt, Human
cuccugagggaggaccuggggca

SEQ ID NO: 3440577 - RNA, 19 nt, Human
cuccugaggggcaucugcc

SEQ ID NO: 3440578 - RNA, 21 nt, Human
cuccugaguagcuggauuaca

SEQ ID NO: 3440579 - RNA, 17 nt, Human
cuccugaguagcuggga

SEQ ID NO: 3440580 - RNA, 16 nt, Human
cucucccugccagagg

SEQ ID NO: 3440581 - RNA, 14 nt, Human
cucucccugcugcu

SEQ ID NO: 3440582 - RNA, 12 nt, Human
cucucccuguug

SEQ ID NO: 3440583 - RNA, 15 nt, Human
cucucccuucccucc

SEQ ID NO: 3440584 - RNA, 14 nt, Human
cucucccuugggcu

SEQ ID NO: 3440585 - RNA, 21 nt, Human
cucucccuugggcucugauga

SEQ ID NO: 3440586 - RNA, 16 nt, Human
cucuccgaccagacac

SEQ ID NO: 3440587 - RNA, 19 nt, Human
cucuccuacucggcucugc

SEQ ID NO: 3440588 - RNA, 14 nt, Human
cucuccuagagaca

SEQ ID NO: 3440589 - RNA, 15 nt, Human
cucuccuagccccug

SEQ ID NO: 3440590 - RNA, 21 nt, Human
cucuccuaggcauucuggacc

SEQ ID NO: 3440591 - RNA, 13 nt, Human
cucuccucagacu

SEQ ID NO: 3440592 - RNA, 18 nt, Human
cucuccucagacugcuca

SEQ ID NO: 3440593 - RNA, 23 nt, Human
cucuccucaucucuaacagcuca

SEQ ID NO: 3440594 - RNA, 16 nt, Human
cucuccuccaagacac

SEQ ID NO: 3440595 - RNA, 13 nt, Human
cucuccuccagag

SEQ ID NO: 3440596 - RNA, 16 nt, Human
cucuccuccagaguca

SEQ ID NO: 3440597 - RNA, 11 nt, Human
cucuccucccc

SEQ ID NO: 3440598 - RNA, 15 nt, Human
cucuccuccccaaau

SEQ ID NO: 3440599 - RNA, 15 nt, Human
cucuccuccugccca

SEQ ID NO: 3440600 - RNA, 17 nt, Human
cucuccucuugccacug

SEQ ID NO: 3440601 - RNA, 12 nt, Human
cucuccuggccu

SEQ ID NO: 3440602 - RNA, 13 nt, Human
cucuccuggccua

SEQ ID NO: 3440603 - RNA, 21 nt, Human
cucuccuggccuauccgcugc

SEQ ID NO: 3440604 - RNA, 12 nt, Human
cucuccuggcuu

SEQ ID NO: 3440605 - RNA, 12 nt, Human
cucuccugggca

SEQ ID NO: 3440606 - RNA, 19 nt, Human
cucuccugggcagcugccu

SEQ ID NO: 3440607 - RNA, 19 nt, Human
cucuccugggccccucccu

SEQ ID NO: 3440608 - RNA, 20 nt, Human
cucuccugggccccucccua

SEQ ID NO: 3440609 - RNA, 21 nt, Human
cucuccugggccccucccuac

SEQ ID NO: 3440610 - RNA, 22 nt, Human
cucuccugggccccucccuacc

SEQ ID NO: 3440611 - RNA, 14 nt, Human
cucuccuguaccuc

SEQ ID NO: 3440612 - RNA, 17 nt, Human
cucuccuguaccucuug

SEQ ID NO: 3440613 - RNA, 18 nt, Human
cucuccuguacuuuuucc

SEQ ID NO: 3440614 - RNA, 20 nt, Human
cucuccuguuucccuucccu

SEQ ID NO: 3440615 - RNA, 12 nt, Human
cucuccuuccuu

SEQ ID NO: 3440616 - RNA, 13 nt, Human
cucucgcacaccu

SEQ ID NO: 3440617 - RNA, 17 nt, Human
cucucgcaccuuuccaa

SEQ ID NO: 3440618 - RNA, 23 nt, Human
cucucgcggccucuucucucaga

SEQ ID NO: 3440619 - RNA, 20 nt, Human
cucucggaacugcaugcugc

SEQ ID NO: 3440620 - RNA, 23 nt, Human
cucucggaacugcaugcugcugg

SEQ ID NO: 3440621 - RNA, 16 nt, Human
cucucggaaggcuggc

SEQ ID NO: 3440622 - RNA, 15 nt, Human
cucucggcuccccau

SEQ ID NO: 3440623 - RNA, 18 nt, Human
cucucggcuccccaugug

SEQ ID NO: 3440624 - RNA, 22 nt, Human
cucucuaagugggcauugccau

SEQ ID NO: 3440625 - RNA, 18 nt, Human
cucucuacagagaggaaa

SEQ ID NO: 3440626 - RNA, 13 nt, Human
cucucuacagugc

SEQ ID NO: 3440627 - RNA, 18 nt, Human
cucucuacccagcccauc

SEQ ID NO: 3440628 - RNA, 22 nt, Human
cucucuacuaaaacuacaaaaa

SEQ ID NO: 3440629 - RNA, 22 nt, Human
cucucuaggguacauggugcug

SEQ ID NO: 3440630 - RNA, 14 nt, Human
cucucuaugccucu

SEQ ID NO: 3440631 - RNA, 14 nt, Human
cucucucaaaagag

SEQ ID NO: 3440632 - RNA, 21 nt, Human
cucucucaauuuuugguugaa

SEQ ID NO: 3440633 - RNA, 12 nt, Human
cucucucacucc

SEQ ID NO: 3440634 - RNA, 16 nt, Human
cucucucacuccuuga

SEQ ID NO: 3440635 - RNA, 14 nt, Human
cucucuccagaugu

SEQ ID NO: 3440636 - RNA, 17 nt, Human
cucucuccagauguuuc

SEQ ID NO: 3440637 - RNA, 20 nt, Human
cucucuccagucuuccaccu

SEQ ID NO: 3440638 - RNA, 12 nt, Human
cucucuccauca

SEQ ID NO: 3440639 - RNA, 21 nt, Human
cucucuccaucagaggacacc

SEQ ID NO: 3440640 - RNA, 13 nt, Human
cucucucccaguc

SEQ ID NO: 3440641 - RNA, 14 nt, Human
cucucuccccucaa

SEQ ID NO: 3440642 - RNA, 13 nt, Human
cucucuccucccu

SEQ ID NO: 3440643 - RNA, 14 nt, Human
cucucuccugucca

SEQ ID NO: 3440644 - RNA, 15 nt, Human
cucucuccuguccaa

SEQ ID NO: 3440645 - RNA, 13 nt, Human
cucucucuguugu

SEQ ID NO: 3440646 - RNA, 21 nt, Human
cucucucuucugcuccacccu

SEQ ID NO: 3440647 - RNA, 20 nt, Human
cucucugaguccuggcccaa

SEQ ID NO: 3440648 - RNA, 16 nt, Human
cucucugcagccagcc

SEQ ID NO: 3440649 - RNA, 17 nt, Human
cucucugcaggucccua

SEQ ID NO: 3440650 - RNA, 12 nt, Human
cucucugccacu

SEQ ID NO: 3440651 - RNA, 11 nt, Human
cucucugcccu

SEQ ID NO: 3440652 - RNA, 21 nt, Human
cucucugcccuaaugcgcagg

SEQ ID NO: 3440653 - RNA, 18 nt, Human
cucucugccugugagcca

SEQ ID NO: 3440654 - RNA, 14 nt, Human
cucucugcucugac

SEQ ID NO: 3440655 - RNA, 20 nt, Human
cucucuggaagccccugggc

SEQ ID NO: 3440656 - RNA, 20 nt, Human
cucucuggaagcccuggaga

SEQ ID NO: 3440657 - RNA, 13 nt, Human
cucucuggccucc

SEQ ID NO: 3440658 - RNA, 17 nt, Human
cucucuggccucccacc

SEQ ID NO: 3440659 - RNA, 20 nt, Human
cucucuggccucccacccga

SEQ ID NO: 3440660 - RNA, 16 nt, Human
cucucuggccuucggc

SEQ ID NO: 3440661 - RNA, 19 nt, Human
cucucuggccuucggccuc

SEQ ID NO: 3440662 - RNA, 20 nt, Human
cucucugggccucagaggcc

SEQ ID NO: 3440663 - RNA, 18 nt, Human
cucucuguauaaacauua

SEQ ID NO: 3440664 - RNA, 18 nt, Human
cucucugucccuugcugu

SEQ ID NO: 3440665 - RNA, 18 nt, Human
cucucuuauagaauauuu

SEQ ID NO: 3440666 - RNA, 23 nt, Human
cucucuuauagaauauuuauuac

SEQ ID NO: 3440667 - RNA, 22 nt, Human
cucucuucagacucucagccca

SEQ ID NO: 3440668 - RNA, 13 nt, Human
cucucuucccuca

SEQ ID NO: 3440669 - RNA, 19 nt, Human
cucucuuccuaucccaucc

SEQ ID NO: 3440670 - RNA, 18 nt, Human
cucucuuccugccccucu

SEQ ID NO: 3440671 - RNA, 19 nt, Human
cucucuuccugccccucuu

SEQ ID NO: 3440672 - RNA, 20 nt, Human
cucucuuccugccccucuuu

SEQ ID NO: 3440673 - RNA, 15 nt, Human
cucucuucugcucca

SEQ ID NO: 3440674 - RNA, 16 nt, Human
cucucuucugcuccac

SEQ ID NO: 3440675 - RNA, 18 nt, Human
cucucuucugcuccaccc

SEQ ID NO: 3440676 - RNA, 13 nt, Human
cucucuugcaccc

SEQ ID NO: 3440677 - RNA, 15 nt, Human
cucucuugguuuccu

SEQ ID NO: 3440678 - RNA, 17 nt, Human
cucucuuuauacagcug

SEQ ID NO: 3440679 - RNA, 16 nt, Human
cucucuuugcauggau

SEQ ID NO: 3440680 - RNA, 18 nt, Human
cucucuuugcauggauuu

SEQ ID NO: 3440681 - RNA, 15 nt, Human
cucucuuugcccagu

SEQ ID NO: 3440682 - RNA, 23 nt, Human
cucucuuugcccaguuggagacu

SEQ ID NO: 3440683 - RNA, 15 nt, Human
cucucuuugggaaug

SEQ ID NO: 3440684 - RNA, 17 nt, Human
cucucuuugggaauguu

SEQ ID NO: 3440685 - RNA, 17 nt, Human
cucucuuuucuguacuu

SEQ ID NO: 3440686 - RNA, 18 nt, Human
cucucuuuucuguacuuc

SEQ ID NO: 3440687 - RNA, 20 nt, Human
cucucuuuuuggaggugcuu

SEQ ID NO: 3440688 - RNA, 17 nt, Human
cucugaaacagcugccu

SEQ ID NO: 3440689 - RNA, 20 nt, Human
cucugaaacagcugccuuag

SEQ ID NO: 3440690 - RNA, 15 nt, Human
cucugaaacccugga

SEQ ID NO: 3440691 - RNA, 21 nt, Human
cucugaaagagaaacacguau

SEQ ID NO: 3440692 - RNA, 19 nt, Human
cucugaaaguuguacauga

SEQ ID NO: 3440693 - RNA, 14 nt, Human
cucugaacacaggc

SEQ ID NO: 3440694 - RNA, 18 nt, Human
cucugaacacaggcagcu

SEQ ID NO: 3440695 - RNA, 13 nt, Human
cucugaacuuugg

SEQ ID NO: 3440696 - RNA, 21 nt, Human
cucugaagaguggguuucaca

SEQ ID NO: 3440697 - RNA, 23 nt, Human
cucugaagaguggguuucacaag

SEQ ID NO: 3440698 - RNA, 23 nt, Human
cucugaagcaaggcgguggacuu

SEQ ID NO: 3440699 - RNA, 14 nt, Human
cucugaagcauguu

SEQ ID NO: 3440700 - RNA, 17 nt, Human
cucugaagccacaaaua

SEQ ID NO: 3440701 - RNA, 15 nt, Human
cucugaagccucugg

SEQ ID NO: 3440702 - RNA, 17 nt, Human
cucugaagccucuggga

SEQ ID NO: 3440703 - RNA, 21 nt, Human
cucugaaggaggccaccuccu

SEQ ID NO: 3440704 - RNA, 14 nt, Human
cucugaagggaggu

SEQ ID NO: 3440705 - RNA, 17 nt, Human
cucugaagggcaucaug

SEQ ID NO: 3440706 - RNA, 19 nt, Human
cucugaagugaaacugcuu

SEQ ID NO: 3440707 - RNA, 23 nt, Human
cucugaagugaaacugcuuguuu

SEQ ID NO: 3440708 - RNA, 19 nt, Human
cucugaauaagcacuuuuu

SEQ ID NO: 3440709 - RNA, 21 nt, Human
cucugaauaagcacuuuuuaa

SEQ ID NO: 3440710 - RNA, 20 nt, Human
cucugaauuaguccuugcuu

SEQ ID NO: 3440711 - RNA, 18 nt, Human
cucugaauuccaaguaga

SEQ ID NO: 3440712 - RNA, 21 nt, Human
cucugaauuuacuuccuugca

SEQ ID NO: 3440713 - RNA, 14 nt, Human
cucugacaagggcu

SEQ ID NO: 3440714 - RNA, 16 nt, Human
cucugacaagggcuga

SEQ ID NO: 3440715 - RNA, 18 nt, Human
cucugacaagggcugacc

SEQ ID NO: 3440716 - RNA, 23 nt, Human
cuccggccaggugccuccugaca

SEQ ID NO: 3440717 - RNA, 20 nt, Human
cuccggccugaugacagagc

SEQ ID NO: 3440718 - RNA, 14 nt, Human
cuccggcgucagcc

SEQ ID NO: 3440719 - RNA, 16 nt, Human
cuccggcgucagccuc

SEQ ID NO: 3440720 - RNA, 18 nt, Human
cuccggcgucagccucca

SEQ ID NO: 3440721 - RNA, 21 nt, Human
cuccggcgucagccuccagcc

SEQ ID NO: 3440722 - RNA, 17 nt, Human
cuccggcugugcuggga

SEQ ID NO: 3440723 - RNA, 18 nt, Human
cuccggcuugaccuguuu

SEQ ID NO: 3440724 - RNA, 17 nt, Human
cuccgggacccccagga

SEQ ID NO: 3440725 - RNA, 15 nt, Human
cucugcgucuauccu

SEQ ID NO: 3440726 - RNA, 21 nt, Human
cucugcgucuauccuguguag

SEQ ID NO: 3440727 - RNA, 20 nt, Human
cucugcuaaauugauguuga

SEQ ID NO: 3440728 - RNA, 23 nt, Human
cucugcuauauauaaaacggugc

SEQ ID NO: 3440729 - RNA, 18 nt, Human
cucugcuauuaggccagc

SEQ ID NO: 3440730 - RNA, 16 nt, Human
cucugcucagccaagc

SEQ ID NO: 3440731 - RNA, 23 nt, Human
aaauaucaaauuaauugugugaa

SEQ ID NO: 3440732 - RNA, 14 nt, Human
aaauaucaaucauu

SEQ ID NO: 3440733 - RNA, 20 nt, Human
aaauaucaaucauuuuccuu

SEQ ID NO: 3440734 - RNA, 22 nt, Human
aaauaucacuugucaauaaaau

SEQ ID NO: 3440735 - RNA, 18 nt, Human
aaauaucaguuacucagc

SEQ ID NO: 3440736 - RNA, 15 nt, Human
aaauaucauucagca

SEQ ID NO: 3440737 - RNA, 17 nt, Human
aaauaucauucagcaac

SEQ ID NO: 3440738 - RNA, 20 nt, Human
aaauaucccuccuguuggga

SEQ ID NO: 3440739 - RNA, 14 nt, Human
aaauaucccuuccg

SEQ ID NO: 3440740 - RNA, 19 nt, Human
aaauaucuaguaauauauu

SEQ ID NO: 3440741 - RNA, 21 nt, Human
aaauaucuaguaauauauuua

SEQ ID NO: 3440742 - RNA, 17 nt, Human
aaauaucuauguuuuac

SEQ ID NO: 3440743 - RNA, 21 nt, Human
aaauaucugaaaauguaugug

SEQ ID NO: 3440744 - RNA, 12 nt, Human
aaauaucuguau

SEQ ID NO: 3440745 - RNA, 21 nt, Human
aaauaucugugaaauaucauc

SEQ ID NO: 3440746 - RNA, 20 nt, Human
aaauaucuuguguuguccuu

SEQ ID NO: 3440747 - RNA, 15 nt, Human
aaauaucuuuuaugu

SEQ ID NO: 3440748 - RNA, 21 nt, Human
aaauaucuuuuauguuugaau

SEQ ID NO: 3440749 - RNA, 21 nt, Human
aaauaugaacccuuuguuucu

SEQ ID NO: 3440750 - RNA, 12 nt, Human
aaauaugaagcu

SEQ ID NO: 3440751 - RNA, 15 nt, Human
aaauaugauguuaaa

SEQ ID NO: 3440752 - RNA, 15 nt, Human
aaauaugcaaagcac

SEQ ID NO: 3440753 - RNA, 17 nt, Human
aaauaugcaaagcacug

SEQ ID NO: 3440754 - RNA, 13 nt, Human
aaauaugcacuaa

SEQ ID NO: 3440755 - RNA, 18 nt, Human
aaauaugcagugauaugg

SEQ ID NO: 3440756 - RNA, 13 nt, Human
aaauaugcucuuu

SEQ ID NO: 3440757 - RNA, 18 nt, Human
aaauaugcucuuuuguuu

SEQ ID NO: 3440758 - RNA, 13 nt, Human
aaauauguauuua

SEQ ID NO: 3440759 - RNA, 19 nt, Human
aaauauguccauaucuaac

SEQ ID NO: 3440760 - RNA, 23 nt, Human
aaauaugugagauuuuuuauugc

SEQ ID NO: 3440761 - RNA, 16 nt, Human
aaauauguugaugaaa

SEQ ID NO: 3440762 - RNA, 13 nt, Human
aaauauguuuuua

SEQ ID NO: 3440763 - RNA, 22 nt, Human
aaauauuagaugugauuuaaua

SEQ ID NO: 3440764 - RNA, 19 nt, Human
aaauauuaguuaauggauu

SEQ ID NO: 3440765 - RNA, 15 nt, Human
aaauauuauaacuca

SEQ ID NO: 3440766 - RNA, 15 nt, Human
aaauauuauguguuu

SEQ ID NO: 3440767 - RNA, 21 nt, Human
aaauauuauuuguguuuccua

SEQ ID NO: 3440768 - RNA, 16 nt, Human
aaauauucacaucuuc

SEQ ID NO: 3440769 - RNA, 23 nt, Human
aaauauuccauccauauacuuug

SEQ ID NO: 3440770 - RNA, 13 nt, Human
aaauauucuauau

SEQ ID NO: 3440771 - RNA, 18 nt, Human
aaauauucuauuuucauu

SEQ ID NO: 3440772 - RNA, 15 nt, Human
aaauauugaggcuuu

SEQ ID NO: 3440773 - RNA, 23 nt, Human
aaauauugaggcuuuguguugua

SEQ ID NO: 3440774 - RNA, 15 nt, Human
aaauauugaugaaaa

SEQ ID NO: 3440775 - RNA, 21 nt, Human
aaauauugguugggaugacuu

SEQ ID NO: 3440776 - RNA, 21 nt, Human
aaauauuuaauguugaacaaa

SEQ ID NO: 3440777 - RNA, 15 nt, Human
aaauauuuacauaug

SEQ ID NO: 3440778 - RNA, 17 nt, Human
aaauauuuacauaugaa

SEQ ID NO: 3440779 - RNA, 21 nt, Human
aaauauuuacauaugaaauuu

SEQ ID NO: 3440780 - RNA, 22 nt, Human
aaauauuuagauguaauuuugu

SEQ ID NO: 3440781 - RNA, 10 nt, Human
aaauauuuau

SEQ ID NO: 3440782 - RNA, 19 nt, Human
aaauauuuauaaaacuucu

SEQ ID NO: 3440783 - RNA, 15 nt, Human
aaauauuuaugaaga

SEQ ID NO: 3440784 - RNA, 15 nt, Human
aaauauuuauguaaa

SEQ ID NO: 3440785 - RNA, 16 nt, Human
aaauauuucagugaau

SEQ ID NO: 3440786 - RNA, 12 nt, Human
aaauauuuccuu

SEQ ID NO: 3440787 - RNA, 16 nt, Human
aaauauuuuaaagaau

SEQ ID NO: 3440788 - RNA, 18 nt, Human
aaauauuuuaaagaauug

SEQ ID NO: 3440789 - RNA, 23 nt, Human
aaauauuuuaaagaauuguguca

SEQ ID NO: 3440790 - RNA, 14 nt, Human
aaauauuuuaugau

SEQ ID NO: 3440791 - RNA, 12 nt, Human
aaauauuuucua

SEQ ID NO: 3440792 - RNA, 13 nt, Human
aaauauuuucuau

SEQ ID NO: 3440793 - RNA, 17 nt, Human
aaauauuuucugugugu

SEQ ID NO: 3440794 - RNA, 22 nt, Human
aaauauuuucuguguguuccug

SEQ ID NO: 3440795 - RNA, 15 nt, Human
aaauauuuugaauca

SEQ ID NO: 3440796 - RNA, 20 nt, Human
aaauauuuugauaauaaauu

SEQ ID NO: 3440797 - RNA, 22 nt, Human
aaauauuuugaucuucaacaaa

SEQ ID NO: 3440798 - RNA, 23 nt, Human
aaauauuuugaucuucaacaaau

SEQ ID NO: 3440799 - RNA, 12 nt, Human
aaauauuuuguc

SEQ ID NO: 3440800 - RNA, 14 nt, Human
aaauauuuugucua

SEQ ID NO: 3440801 - RNA, 17 nt, Human
aaauauuuugucuaaaa

SEQ ID NO: 3440802 - RNA, 17 nt, Human
aaauauuuuuaaaagau

SEQ ID NO: 3440803 - RNA, 21 nt, Human
aaaucaaaacucacaagugcu

SEQ ID NO: 3440804 - RNA, 14 nt, Human
aaaucaaaaucucu

SEQ ID NO: 3440805 - RNA, 16 nt, Human
aaaucaaaaucucucc

SEQ ID NO: 3440806 - RNA, 20 nt, Human
aaaucaaaaucucuccacuu

SEQ ID NO: 3440807 - RNA, 19 nt, Human
aaaucaaauaugcaaagca

SEQ ID NO: 3440808 - RNA, 16 nt, Human
aaaucaaauguaaagu

SEQ ID NO: 3440809 - RNA, 21 nt, Human
aaaucaacaccuuaauaugcu

SEQ ID NO: 3440810 - RNA, 17 nt, Human
aaaucaacagaagcauu

SEQ ID NO: 3440811 - RNA, 19 nt, Human
aaaucaacagaagcauuug

SEQ ID NO: 3440812 - RNA, 18 nt, Human
aaaucaacuugcuuauca

SEQ ID NO: 3440813 - RNA, 17 nt, Human
aaaucaagcaagccucu

SEQ ID NO: 3440814 - RNA, 23 nt, Human
aaaucaaguauuauaaacaagaa

SEQ ID NO: 3440815 - RNA, 18 nt, Human
aaaucaaguauuugggaa

SEQ ID NO: 3440816 - RNA, 16 nt, Human
aaaucaaguauuuugu

SEQ ID NO: 3440817 - RNA, 16 nt, Human
aaaucaaguccuuuaa

SEQ ID NO: 3440818 - RNA, 14 nt, Human
aaaucaaguuucca

SEQ ID NO: 3440819 - RNA, 16 nt, Human
aaaucaaguuuccaag

SEQ ID NO: 3440820 - RNA, 20 nt, Human
aaaucaaguuuccaagcaaa

SEQ ID NO: 3440821 - RNA, 12 nt, Human
aaaucaaguuuu

SEQ ID NO: 3440822 - RNA, 17 nt, Human
aaaucaauaguugaauu

SEQ ID NO: 3440823 - RNA, 17 nt, Human
aaaucaauaugcagaau

SEQ ID NO: 3440824 - RNA, 19 nt, Human
aaaucaauuacugguccaa

SEQ ID NO: 3440825 - RNA, 17 nt, Human
aaaucaauuuuuaggaa

SEQ ID NO: 3440826 - RNA, 22 nt, Human
aaaucacaaaaauuugaacacu

SEQ ID NO: 3440827 - RNA, 14 nt, Human
aaaucacauccuua

SEQ ID NO: 3440828 - RNA, 18 nt, Human
aaaucacauccuuauccu

SEQ ID NO: 3440829 - RNA, 18 nt, Human
aaaucacuaacauuauau

SEQ ID NO: 3440830 - RNA, 15 nt, Human
aaaucacuuccauag

SEQ ID NO: 3440831 - RNA, 14 nt, Human
aaaucacuuucaua

SEQ ID NO: 3440832 - RNA, 21 nt, Human
aaaucagaagucaucuugcua

SEQ ID NO: 3440833 - RNA, 22 nt, Human
aaaucagauguugaauucuuuu

SEQ ID NO: 3440834 - RNA, 21 nt, Human
aaaucagccaaguuuuauaau

SEQ ID NO: 3440835 - RNA, 17 nt, Human
aaaucagccaauuaugu

SEQ ID NO: 3440836 - RNA, 18 nt, Human
aaaucagccaauuauguu

SEQ ID NO: 3440837 - RNA, 21 nt, Human
aaaucagccugcuccagcugu

SEQ ID NO: 3440838 - RNA, 23 nt, Human
aaaucagccugcuccagcuguuc

SEQ ID NO: 3440839 - RNA, 19 nt, Human
aaaucagcuauuuugugaa

SEQ ID NO: 3440840 - RNA, 16 nt, Human
aaaucagcugcuacua

SEQ ID NO: 3440841 - RNA, 22 nt, Human
aaaucaggcuuuuguuuccuuu

SEQ ID NO: 3440842 - RNA, 23 nt, Human
aaaucaggcuuuuguuuccuuuu

SEQ ID NO: 3440843 - RNA, 14 nt, Human
aaaucagguuuucu

SEQ ID NO: 3440844 - RNA, 22 nt, Human
aaaucagguuuucuuuuaagaa

SEQ ID NO: 3440845 - RNA, 15 nt, Human
aaaucaguaaacacu

SEQ ID NO: 3440846 - RNA, 11 nt, Human
aaaucaguaag

SEQ ID NO: 3440847 - RNA, 22 nt, Human
aaaucagucagugcaaauguca

SEQ ID NO: 3440848 - RNA, 22 nt, Human
aaaucauacuccuaugcuuuag

SEQ ID NO: 3440849 - RNA, 19 nt, Human
aaaucauaguuaaauguua

SEQ ID NO: 3440850 - RNA, 13 nt, Human
aaaucauauugau

SEQ ID NO: 3440851 - RNA, 13 nt, Human
aaaucaucaagaa

SEQ ID NO: 3440852 - RNA, 23 nt, Human
aaaucaucaagaagggcugcaug

SEQ ID NO: 3440853 - RNA, 15 nt, Human
aaaucaucagaaagg

SEQ ID NO: 3440854 - RNA, 22 nt, Human
aaaucaucagaaaggaaaaaca

SEQ ID NO: 3440855 - RNA, 17 nt, Human
aaaucaucgaaaauuca

SEQ ID NO: 3440856 - RNA, 21 nt, Human
aaaucaugaagauauuuuucc

SEQ ID NO: 3440857 - RNA, 18 nt, Human
aaaucaugccaguauuuu

SEQ ID NO: 3440858 - RNA, 16 nt, Human
aaaucauucauuuucu

SEQ ID NO: 3440859 - RNA, 19 nt, Human
aaaucauucuuacuaaaaa

SEQ ID NO: 3440860 - RNA, 21 nt, Human
aaaucauuucugcaucagcug

SEQ ID NO: 3440861 - RNA, 22 nt, Human
aaaucauuucugcaucagcugc

SEQ ID NO: 3440862 - RNA, 23 nt, Human
aaaucauuuggguuaauauggcu

SEQ ID NO: 3440863 - RNA, 19 nt, Human
aaaucauuuuaggaaagga

SEQ ID NO: 3440864 - RNA, 16 nt, Human
aaaucauuuuauaugu

SEQ ID NO: 3440865 - RNA, 14 nt, Human
aaaucauuuuaugu

SEQ ID NO: 3440866 - RNA, 15 nt, Human
aaaucauuuuauguc

SEQ ID NO: 3440867 - RNA, 14 nt, Human
aaaucauuuugcaa

SEQ ID NO: 3440868 - RNA, 15 nt, Human
aaauccaaauauugu

SEQ ID NO: 3440869 - RNA, 14 nt, Human
cucucaucugaggc

SEQ ID NO: 3440870 - RNA, 13 nt, Human
cucucaugaaccu

SEQ ID NO: 3440871 - RNA, 19 nt, Human
cucucaugcugccccugcc

SEQ ID NO: 3440872 - RNA, 14 nt, Human
cucucauuccccag

SEQ ID NO: 3440873 - RNA, 15 nt, Human
cucucauuccccagg

SEQ ID NO: 3440874 - RNA, 18 nt, Human
cucucauuuagccugucc

SEQ ID NO: 3440875 - RNA, 15 nt, Human
cucuccaaaaaugca

SEQ ID NO: 3440876 - RNA, 15 nt, Human
cucuccaaaccacuu

SEQ ID NO: 3440877 - RNA, 12 nt, Human
cucuccaagggc

SEQ ID NO: 3440878 - RNA, 22 nt, Human
cucuccaagggcuucugcaccc

SEQ ID NO: 3440879 - RNA, 15 nt, Human
cucuccaagugccag

SEQ ID NO: 3440880 - RNA, 16 nt, Human
cucuccaagugccaga

SEQ ID NO: 3440881 - RNA, 23 nt, Human
cucuccacacagugcucaaggcc

SEQ ID NO: 3440882 - RNA, 17 nt, Human
cucuccaccuaguggcu

SEQ ID NO: 3440883 - RNA, 20 nt, Human
cucuccaccuaguggcuguc

SEQ ID NO: 3440884 - RNA, 14 nt, Human
cucuccaccucagc

SEQ ID NO: 3440885 - RNA, 15 nt, Human
cucuccaccucagcc

SEQ ID NO: 3440886 - RNA, 16 nt, Human
cucuccaccucagccu

SEQ ID NO: 3440887 - RNA, 22 nt, Human
cucuccacucaugugacucuuu

SEQ ID NO: 3440888 - RNA, 13 nt, Human
cucuccacugugc

SEQ ID NO: 3440889 - RNA, 19 nt, Human
cucuccacugugcuuucag

SEQ ID NO: 3440890 - RNA, 14 nt, Human
cucuccacuuucag

SEQ ID NO: 3440891 - RNA, 21 nt, Human
cucuccacuuucagcugucuu

SEQ ID NO: 3440892 - RNA, 16 nt, Human
cucuccagcaggccca

SEQ ID NO: 3440893 - RNA, 13 nt, Human
cucuccagccuca

SEQ ID NO: 3440894 - RNA, 16 nt, Human
cucuccagccucagcc

SEQ ID NO: 3440895 - RNA, 14 nt, Human
cucuccagccugac

SEQ ID NO: 3440896 - RNA, 13 nt, Human
cucuccagcuaua

SEQ ID NO: 3440897 - RNA, 14 nt, Human
cucuccagcuccaa

SEQ ID NO: 3440898 - RNA, 14 nt, Human
cucuccagcugacu

SEQ ID NO: 3440899 - RNA, 16 nt, Human
cucuccagcugacuaa

SEQ ID NO: 3440900 - RNA, 18 nt, Human
cucuccagcugacuaaac

SEQ ID NO: 3440901 - RNA, 14 nt, Human
cucuccaggcacca

SEQ ID NO: 3440902 - RNA, 18 nt, Human
cucuccaggcacccuucu

SEQ ID NO: 3440903 - RNA, 16 nt, Human
cucuccagucuuccac

SEQ ID NO: 3440904 - RNA, 22 nt, Human
cucuccagucuuccaccuggaa

SEQ ID NO: 3440905 - RNA, 23 nt, Human
cucuccaguuugcaccugucccc

SEQ ID NO: 3440906 - RNA, 18 nt, Human
cucuccauaaccccaccc

SEQ ID NO: 3440907 - RNA, 17 nt, Human
cucuccauucugcuccu

SEQ ID NO: 3440908 - RNA, 19 nt, Human
cucuccauucugcuccuuc

SEQ ID NO: 3440909 - RNA, 13 nt, Human
cucuccauuuaau

SEQ ID NO: 3440910 - RNA, 22 nt, Human
cucuccauuuuggugucuuucu

SEQ ID NO: 3440911 - RNA, 15 nt, Human
cucucccaaguccac

SEQ ID NO: 3440912 - RNA, 21 nt, Human
cucucccacccucuuccuacu

SEQ ID NO: 3440913 - RNA, 21 nt, Human
cucucccacgggaccuggggc

SEQ ID NO: 3440914 - RNA, 12 nt, Human
cucucccaggcc

SEQ ID NO: 3440915 - RNA, 13 nt, Human
cucucccaggccc

SEQ ID NO: 3440916 - RNA, 22 nt, Human
cucucccagucuacccagagaa

SEQ ID NO: 3440917 - RNA, 12 nt, Human
cucucccauccc

SEQ ID NO: 3440918 - RNA, 13 nt, Human
cucucccaucccc

SEQ ID NO: 3440919 - RNA, 18 nt, Human
cucucccauggagcccca

SEQ ID NO: 3440920 - RNA, 21 nt, Human
cucucccauggagccccagcc

SEQ ID NO: 3440921 - RNA, 23 nt, Human
cucucccauggagccccagcccc

SEQ ID NO: 3440922 - RNA, 21 nt, Human
cucucccauugucccucugcc

SEQ ID NO: 3440923 - RNA, 20 nt, Human
cucuccccaacccccauucu

SEQ ID NO: 3440924 - RNA, 19 nt, Human
cucuccccacgagggcugg

SEQ ID NO: 3440925 - RNA, 22 nt, Human
cucuccccagcaagugagagcu

SEQ ID NO: 3440926 - RNA, 24 nt, Human
cucuccccagcaagugagagcugg

SEQ ID NO: 3440927 - RNA, 13 nt, Human
cucuccccagccc

SEQ ID NO: 3440928 - RNA, 17 nt, Human
cucuccccagcccagag

SEQ ID NO: 3440929 - RNA, 18 nt, Human
cucuccccagguccagcu

SEQ ID NO: 3440930 - RNA, 17 nt, Human
cucuccccccccccucc

SEQ ID NO: 3440931 - RNA, 18 nt, Human
ccccucugucuacaaaua

SEQ ID NO: 3440932 - RNA, 15 nt, Human
ccccucuuccucuug

SEQ ID NO: 3440933 - RNA, 14 nt, Human
ccccucuucugagc

SEQ ID NO: 3440934 - RNA, 14 nt, Human
ccccucuuggagaa

SEQ ID NO: 3440935 - RNA, 18 nt, Human
ccccucuugucuccccug

SEQ ID NO: 3440936 - RNA, 17 nt, Human
ccccucuuucucuuucu

SEQ ID NO: 3440937 - RNA, 13 nt, Human
ccccugaaacuua

SEQ ID NO: 3440938 - RNA, 15 nt, Human
ccccugacaacacuc

SEQ ID NO: 3440939 - RNA, 15 nt, Human
ccccugaccugugag

SEQ ID NO: 3440940 - RNA, 14 nt, Human
ccccugacucauca

SEQ ID NO: 3440941 - RNA, 19 nt, Human
ccccugagauccccugagc

SEQ ID NO: 3440942 - RNA, 19 nt, Human
ccccugagcaaugucugug

SEQ ID NO: 3440943 - RNA, 11 nt, Human
ccccugagccc

SEQ ID NO: 3440944 - RNA, 13 nt, Human
ccccugagcccac

SEQ ID NO: 3440945 - RNA, 20 nt, Human
ccccugcaaagcccagcuug

SEQ ID NO: 3440946 - RNA, 23 nt, Human
ccccugcacagcaggcugccagu

SEQ ID NO: 3440947 - RNA, 14 nt, Human
ccccugcacuguaa

SEQ ID NO: 3440948 - RNA, 16 nt, Human
ccccugcacuguaaaa

SEQ ID NO: 3440949 - RNA, 13 nt, Human
ccccugcagcacg

SEQ ID NO: 3440950 - RNA, 20 nt, Human
ccccugcagcacggacaaua

SEQ ID NO: 3440951 - RNA, 11 nt, Human
ccccugcagcu

SEQ ID NO: 3440952 - RNA, 22 nt, Human
ccccugcagcuuguagccagcc

SEQ ID NO: 3440953 - RNA, 23 nt, Human
ccccugcaggaaggagcugccug

SEQ ID NO: 3440954 - RNA, 15 nt, Human
ccccugccaccuccu

SEQ ID NO: 3440955 - RNA, 14 nt, Human
ccccugccagggca

SEQ ID NO: 3440956 - RNA, 23 nt, Human
ccccugcccagaucagccagaag

SEQ ID NO: 3440957 - RNA, 13 nt, Human
ccccugccccagc

SEQ ID NO: 3440958 - RNA, 14 nt, Human
ccccugccccagcc

SEQ ID NO: 3440959 - RNA, 17 nt, Human
ccccugcccccugcagg

SEQ ID NO: 3440960 - RNA, 13 nt, Human
ccccugccccucc

SEQ ID NO: 3440961 - RNA, 18 nt, Human
ccccugccccugcuacug

SEQ ID NO: 3440962 - RNA, 19 nt, Human
ccccugcccggcugcggaa

SEQ ID NO: 3440963 - RNA, 15 nt, Human
ccccugcccucgugg

SEQ ID NO: 3440964 - RNA, 21 nt, Human
ccccugcccucguggccagcc

SEQ ID NO: 3440965 - RNA, 22 nt, Human
ccccugcccucguggccagccc

SEQ ID NO: 3440966 - RNA, 17 nt, Human
ccccugccggccggggc

SEQ ID NO: 3440967 - RNA, 15 nt, Human
ccccugccuccaccc

SEQ ID NO: 3440968 - RNA, 15 nt, Human
ccccugccucucugc

SEQ ID NO: 3440969 - RNA, 11 nt, Human
ccccugccugc

SEQ ID NO: 3440970 - RNA, 15 nt, Human
ccccugccugccaug

SEQ ID NO: 3440971 - RNA, 13 nt, Human
ccccugccugccc

SEQ ID NO: 3440972 - RNA, 15 nt, Human
ccccugcuacugcca

SEQ ID NO: 3440973 - RNA, 12 nt, Human
ccccugcugccu

SEQ ID NO: 3440974 - RNA, 13 nt, Human
ccccugcugccuc

SEQ ID NO: 3440975 - RNA, 14 nt, Human
ccccugcugggugu

SEQ ID NO: 3440976 - RNA, 11 nt, Human
ccccugcuggu

SEQ ID NO: 3440977 - RNA, 20 nt, Human
ccccugcugguucaggguug

SEQ ID NO: 3440978 - RNA, 13 nt, Human
ccccugcuucagu

SEQ ID NO: 3440979 - RNA, 13 nt, Human
ccccugcuucucc

SEQ ID NO: 3440980 - RNA, 15 nt, Human
ccccugcuucuccag

SEQ ID NO: 3440981 - RNA, 18 nt, Human
ccccugcuucuccagccu

SEQ ID NO: 3440982 - RNA, 20 nt, Human
ccccuggaagagcccagucu

SEQ ID NO: 3440983 - RNA, 17 nt, Human
ccccuggaagcagugcc

SEQ ID NO: 3440984 - RNA, 11 nt, Human
ccccuggaccc

SEQ ID NO: 3440985 - RNA, 20 nt, Human
ccccuggaggcacugaagug

SEQ ID NO: 3440986 - RNA, 17 nt, Human
ccccuggaggcugccuc

SEQ ID NO: 3440987 - RNA, 20 nt, Human
ccccuggaggcugccuccca

SEQ ID NO: 3440988 - RNA, 14 nt, Human
ccccuggaugaagu

SEQ ID NO: 3440989 - RNA, 15 nt, Human
ccccuggaugcagcc

SEQ ID NO: 3440990 - RNA, 12 nt, Human
ccccuggcagag

SEQ ID NO: 3440991 - RNA, 11 nt, Human
ccccuggccca

SEQ ID NO: 3440992 - RNA, 14 nt, Human
ccccuggcccagcg

SEQ ID NO: 3440993 - RNA, 22 nt, Human
ccccuggcccagcggccccucc

SEQ ID NO: 3440994 - RNA, 19 nt, Human
ccccuggccucccccacuu

SEQ ID NO: 3440995 - RNA, 13 nt, Human
ccccuggccuccg

SEQ ID NO: 3440996 - RNA, 11 nt, Human
ccccuggccuu

SEQ ID NO: 3440997 - RNA, 20 nt, Human
ccccuggcuccaggccaggg

SEQ ID NO: 3440998 - RNA, 23 nt, Human
ccccuggcuuuucacugcuggcu

SEQ ID NO: 3440999 - RNA, 20 nt, Human
ccccugggcuuggccugcug

SEQ ID NO: 3441000 - RNA, 22 nt, Human
ccccugggcuuggccugcugug

SEQ ID NO: 3441001 - RNA, 12 nt, Human
ccccuggggccu

SEQ ID NO: 3441002 - RNA, 18 nt, Human
ccccuggggcuucuccug

SEQ ID NO: 3441003 - RNA, 22 nt, Human
ccccuggggucucugcugcauu

SEQ ID NO: 3441004 - RNA, 19 nt, Human
ccccugggguggccaccag

SEQ ID NO: 3441005 - RNA, 23 nt, Human
ccccugggugggugguggggagg

SEQ ID NO: 3441006 - RNA, 21 nt, Human
ccccugguccccuccuuccca

SEQ ID NO: 3441007 - RNA, 22 nt, Human
ccccugguggacaguccuggga

SEQ ID NO: 3441008 - RNA, 23 nt, Human
ccccugguggacaguccugggag

SEQ ID NO: 3441009 - RNA, 11 nt, Human
ccccuguacac

SEQ ID NO: 3441010 - RNA, 14 nt, Human
ccccuguacuccag

SEQ ID NO: 3441011 - RNA, 22 nt, Human
ccccugucccaugcaggcccuu

SEQ ID NO: 3441012 - RNA, 14 nt, Human
ccccuguccucacu

SEQ ID NO: 3441013 - RNA, 12 nt, Human
ccccuguccuga

SEQ ID NO: 3441014 - RNA, 23 nt, Human
ccccugucucucagggccaggcc

SEQ ID NO: 3441015 - RNA, 16 nt, Human
cugaauacagaggcaa

SEQ ID NO: 3441016 - RNA, 15 nt, Human
cugaauaccacucug

SEQ ID NO: 3441017 - RNA, 17 nt, Human
cugaauaccacucugua

SEQ ID NO: 3441018 - RNA, 22 nt, Human
cugaauaccacucuguaauugc

SEQ ID NO: 3441019 - RNA, 18 nt, Human
cugaauaccucuuugaaa

SEQ ID NO: 3441020 - RNA, 15 nt, Human
cugaauagauaugaa

SEQ ID NO: 3441021 - RNA, 11 nt, Human
cugaauagauu

SEQ ID NO: 3441022 - RNA, 21 nt, Human
cugaauaggcgaucacaacgu

SEQ ID NO: 3441023 - RNA, 19 nt, Human
cugaauaugaggcauuugg

SEQ ID NO: 3441024 - RNA, 21 nt, Human
cugaauauugccauuaugcuu

SEQ ID NO: 3441025 - RNA, 16 nt, Human
cugaauauuuauauuu

SEQ ID NO: 3441026 - RNA, 18 nt, Human
cugaaucaugagccugcu

SEQ ID NO: 3441027 - RNA, 22 nt, Human
cugaaucauucucgauuuaacu

SEQ ID NO: 3441028 - RNA, 19 nt, Human
cugaauccaaacuaaucca

SEQ ID NO: 3441029 - RNA, 19 nt, Human
cugaaucgagugagacaaa

SEQ ID NO: 3441030 - RNA, 18 nt, Human
cugaaugaaacccccaca

SEQ ID NO: 3441031 - RNA, 20 nt, Human
cugaaugaacaaccucggcu

SEQ ID NO: 3441032 - RNA, 14 nt, Human
cugaaugaagcagu

SEQ ID NO: 3441033 - RNA, 17 nt, Human
cugaaugcucugugcga

SEQ ID NO: 3441034 - RNA, 16 nt, Human
cugaaugcugcuacuu

SEQ ID NO: 3441035 - RNA, 19 nt, Human
cugaaugcuuauagguggc

SEQ ID NO: 3441036 - RNA, 21 nt, Human
cugaaugcuuauagguggccu

SEQ ID NO: 3441037 - RNA, 18 nt, Human
cugaaugcuucuaaguaa

SEQ ID NO: 3441038 - RNA, 23 nt, Human
cugaauggcuugcaguuguuccu

SEQ ID NO: 3441039 - RNA, 19 nt, Human
cugaaugggaucaugaaag

SEQ ID NO: 3441040 - RNA, 14 nt, Human
cugaaugguccagg

SEQ ID NO: 3441041 - RNA, 22 nt, Human
cugaaugguuccaugccugagg

SEQ ID NO: 3441042 - RNA, 16 nt, Human
cugaauguauguaaau

SEQ ID NO: 3441043 - RNA, 11 nt, Human
cugaauguauu

SEQ ID NO: 3441044 - RNA, 22 nt, Human
cugaaugucauugaaaaacuaa

SEQ ID NO: 3441045 - RNA, 23 nt, Human
cugaaugugguuucaaucuaauu

SEQ ID NO: 3441046 - RNA, 11 nt, Human
cugaauguucu

SEQ ID NO: 3441047 - RNA, 13 nt, Human
cugaauguucuga

SEQ ID NO: 3441048 - RNA, 18 nt, Human
cugaauguuuauuccuug

SEQ ID NO: 3441049 - RNA, 19 nt, Human
cugaauguuuauuccuuga

SEQ ID NO: 3441050 - RNA, 16 nt, Human
cugaauguuuuucuaa

SEQ ID NO: 3441051 - RNA, 20 nt, Human
cugaauuaaugacagagcca

SEQ ID NO: 3441052 - RNA, 21 nt, Human
cugaauuaaugacagagccag

SEQ ID NO: 3441053 - RNA, 24 nt, Human
cugaauuauaagaggcugauaauu

SEQ ID NO: 3441054 - RNA, 14 nt, Human
cugaauuaugaaac

SEQ ID NO: 3441055 - RNA, 20 nt, Human
cugaauucaccacagacuuu

SEQ ID NO: 3441056 - RNA, 23 nt, Human
cugaauugagccuaaaaauaaag

SEQ ID NO: 3441057 - RNA, 16 nt, Human
cugaauuguccccagu

SEQ ID NO: 3441058 - RNA, 14 nt, Human
cugaauuuaaauag

SEQ ID NO: 3441059 - RNA, 18 nt, Human
cugaauuuaucuuugaua

SEQ ID NO: 3441060 - RNA, 13 nt, Human
cugaauuucccuc

SEQ ID NO: 3441061 - RNA, 12 nt, Human
cugaauuugcaa

SEQ ID NO: 3441062 - RNA, 15 nt, Human
cugaauuugcaaagu

SEQ ID NO: 3441063 - RNA, 18 nt, Human
cugaauuugcaaaguacu

SEQ ID NO: 3441064 - RNA, 21 nt, Human
cugaauuugcaaaguacugua

SEQ ID NO: 3441065 - RNA, 22 nt, Human
cugaauuugcaaaguacuguaa

SEQ ID NO: 3441066 - RNA, 16 nt, Human
cugaauuugcccuggg

SEQ ID NO: 3441067 - RNA, 14 nt, Human
cugaauuuucacau

SEQ ID NO: 3441068 - RNA, 20 nt, Human
cugaauuuucacaugaacau

SEQ ID NO: 3441069 - RNA, 16 nt, Human
cugaauuuuggaggca

SEQ ID NO: 3441070 - RNA, 16 nt, Human
cugaauuuuuaugugu

SEQ ID NO: 3441071 - RNA, 20 nt, Human
cugaauuuuuaugugugauu

SEQ ID NO: 3441072 - RNA, 14 nt, Human
cugaauuuuuuugu

SEQ ID NO: 3441073 - RNA, 15 nt, Human
cugacaacagacuuc

SEQ ID NO: 3441074 - RNA, 18 nt, Human
cugacaacagacuucuga

SEQ ID NO: 3441075 - RNA, 20 nt, Human
cugacaaccaccgcucccca

SEQ ID NO: 3441076 - RNA, 21 nt, Human
cugacaaccaccgcuccccag

SEQ ID NO: 3441077 - RNA, 20 nt, Human
cugacaaccacuggucugua

SEQ ID NO: 3441078 - RNA, 19 nt, Human
cugacaaccauuaaaguca

SEQ ID NO: 3441079 - RNA, 22 nt, Human
cugacaaccauuaaagucagaa

SEQ ID NO: 3441080 - RNA, 22 nt, Human
cugacaaggcacuucauguaaa

SEQ ID NO: 3441081 - RNA, 12 nt, Human
cugacaagggcu

SEQ ID NO: 3441082 - RNA, 13 nt, Human
cugacaagggcug

SEQ ID NO: 3441083 - RNA, 19 nt, Human
cugacaagggcugaccugc

SEQ ID NO: 3441084 - RNA, 20 nt, Human
cugacaagggcugaccugcc

SEQ ID NO: 3441085 - RNA, 17 nt, Human
cugacaauacuguaugu

SEQ ID NO: 3441086 - RNA, 16 nt, Human
cugacacacagcucug

SEQ ID NO: 3441087 - RNA, 21 nt, Human
cugacacacagcucuguccug

SEQ ID NO: 3441088 - RNA, 23 nt, Human
cugacacacagcucuguccuggg

SEQ ID NO: 3441089 - RNA, 10 nt, Human
cugacacagg

SEQ ID NO: 3441090 - RNA, 13 nt, Human
cugacacaggaaa

SEQ ID NO: 3441091 - RNA, 14 nt, Human
cugacacccauguu

SEQ ID NO: 3441092 - RNA, 21 nt, Human
cugacacccauguuucucugg

SEQ ID NO: 3441093 - RNA, 19 nt, Human
cugacaccuaacucuucuu

SEQ ID NO: 3441094 - RNA, 19 nt, Human
cugacaccuuugcaggcau

SEQ ID NO: 3441095 - RNA, 14 nt, Human
cugacacucccacc

SEQ ID NO: 3441096 - RNA, 19 nt, Human
cugacacucccacccaguc

SEQ ID NO: 3441097 - RNA, 13 nt, Human
cugacacugcggg

SEQ ID NO: 3441098 - RNA, 23 nt, Human
cugacacugcggggcuuggcuga

SEQ ID NO: 3441099 - RNA, 13 nt, Human
cugacacugcugg

SEQ ID NO: 3441100 - RNA, 19 nt, Human
cugacacuucaaggugaca

SEQ ID NO: 3441101 - RNA, 19 nt, Human
cugacacuuuaauuaccaa

SEQ ID NO: 3441102 - RNA, 15 nt, Human
cucugaacuucagcu

SEQ ID NO: 3441103 - RNA, 15 nt, Human
cucugaacuugccuu

SEQ ID NO: 3441104 - RNA, 13 nt, Human
cucugaagagugg

SEQ ID NO: 3441105 - RNA, 22 nt, Human
cucugaagaguggguuucacaa

SEQ ID NO: 3441106 - RNA, 11 nt, Human
cucugaagcau

SEQ ID NO: 3441107 - RNA, 19 nt, Human
cucugaagccacaaauagg

SEQ ID NO: 3441108 - RNA, 15 nt, Human
cucugaaggacauug

SEQ ID NO: 3441109 - RNA, 22 nt, Human
cucugaaggacauugcggacag

SEQ ID NO: 3441110 - RNA, 15 nt, Human
cucugaaggaggcca

SEQ ID NO: 3441111 - RNA, 18 nt, Human
cucugaaggaggccaccu

SEQ ID NO: 3441112 - RNA, 19 nt, Human
cucugaagggcaucaugca

SEQ ID NO: 3441113 - RNA, 22 nt, Human
cucugaagggcaucaugcaucu

SEQ ID NO: 3441114 - RNA, 19 nt, Human
cucugaaggguaauuauau

SEQ ID NO: 3441115 - RNA, 23 nt, Human
cucugaagucacaucacaggaca

SEQ ID NO: 3441116 - RNA, 16 nt, Human
cucugaaguuggacag

SEQ ID NO: 3441117 - RNA, 18 nt, Human
cucugaaguuggacagca

SEQ ID NO: 3441118 - RNA, 17 nt, Human
cucugaaugguccaggg

SEQ ID NO: 3441119 - RNA, 21 nt, Human
cucugaauuaguccuugcuug

SEQ ID NO: 3441120 - RNA, 12 nt, Human
cucugaauucca

SEQ ID NO: 3441121 - RNA, 15 nt, Human
cucugaauuuaucuu

SEQ ID NO: 3441122 - RNA, 14 nt, Human
cucugaauuuuaaa

SEQ ID NO: 3441123 - RNA, 13 nt, Human
cucugacaaagcu

SEQ ID NO: 3441124 - RNA, 21 nt, Human
cucugacaacagacuucugaa

SEQ ID NO: 3441125 - RNA, 22 nt, Human
cucugacaacagacuucugaaa

SEQ ID NO: 3441126 - RNA, 17 nt, Human
cucugacaagggcugac

SEQ ID NO: 3441127 - RNA, 14 nt, Human
cucugacagcagca

SEQ ID NO: 3441128 - RNA, 18 nt, Human
cucugacagcagcaucuc

SEQ ID NO: 3441129 - RNA, 16 nt, Human
cucugaccaacaggcu

SEQ ID NO: 3441130 - RNA, 16 nt, Human
cucugacccagugaga

SEQ ID NO: 3441131 - RNA, 15 nt, Human
cucugaccccugccu

SEQ ID NO: 3441132 - RNA, 17 nt, Human
cucugaccgaaacagcg

SEQ ID NO: 3441133 - RNA, 15 nt, Human
cucugacucagggcu

SEQ ID NO: 3441134 - RNA, 17 nt, Human
cucugacucagggcucc

SEQ ID NO: 3441135 - RNA, 20 nt, Human
cucugacuuaagcaaaagaa

SEQ ID NO: 3441136 - RNA, 17 nt, Human
cucugacuucugccugg

SEQ ID NO: 3441137 - RNA, 18 nt, Human
cucugacuucugccugga

SEQ ID NO: 3441138 - RNA, 14 nt, Human
cucugacuugggga

SEQ ID NO: 3441139 - RNA, 10 nt, Human
cucugagaac

SEQ ID NO: 3441140 - RNA, 23 nt, Human
cucugagaaggggaggaccucug

SEQ ID NO: 3441141 - RNA, 14 nt, Human
cucugagacuccag

SEQ ID NO: 3441142 - RNA, 20 nt, Human
cucugagacucgcgacaaug

SEQ ID NO: 3441143 - RNA, 21 nt, Human
cucugagacucgcgacaaugc

SEQ ID NO: 3441144 - RNA, 23 nt, Human
cucugagagcaucaggccuagag

SEQ ID NO: 3441145 - RNA, 15 nt, Human
cucugagaggcccug

SEQ ID NO: 3441146 - RNA, 21 nt, Human
cucugagaucuaaggauguca

SEQ ID NO: 3441147 - RNA, 12 nt, Human
cucugagcccau

SEQ ID NO: 3441148 - RNA, 15 nt, Human
cucugagcugugcag

SEQ ID NO: 3441149 - RNA, 16 nt, Human
cucugagcugugcagg

SEQ ID NO: 3441150 - RNA, 12 nt, Human
cucugaggacaa

SEQ ID NO: 3441151 - RNA, 17 nt, Human
cucugaggacugcacca

SEQ ID NO: 3441152 - RNA, 14 nt, Human
cucugaggccagcc

SEQ ID NO: 3441153 - RNA, 15 nt, Human
cucugaggccagccu

SEQ ID NO: 3441154 - RNA, 20 nt, Human
cucugaggccagccuggccu

SEQ ID NO: 3441155 - RNA, 22 nt, Human
cucugaggcgccccaacccgug

SEQ ID NO: 3441156 - RNA, 23 nt, Human
cucugaggcgccccaacccgugg

SEQ ID NO: 3441157 - RNA, 14 nt, Human
cucugaggcugaaa

SEQ ID NO: 3441158 - RNA, 15 nt, Human
cucugaggcuuccag

SEQ ID NO: 3441159 - RNA, 18 nt, Human
cugaagaggcgggccagc

SEQ ID NO: 3441160 - RNA, 22 nt, Human
cugaagaggcgggccagccagg

SEQ ID NO: 3441161 - RNA, 21 nt, Human
cugaagauagaagaaaaaaga

SEQ ID NO: 3441162 - RNA, 22 nt, Human
cugaagaugcagcucacuaccc

SEQ ID NO: 3441163 - RNA, 15 nt, Human
cugaagaugggagcc

SEQ ID NO: 3441164 - RNA, 14 nt, Human
cugaagcagaugca

SEQ ID NO: 3441165 - RNA, 22 nt, Human
cugaagcagaugcaaagaggca

SEQ ID NO: 3441166 - RNA, 19 nt, Human
cugaagcagguucccaagc

SEQ ID NO: 3441167 - RNA, 15 nt, Human
cugaagcauguuuca

SEQ ID NO: 3441168 - RNA, 16 nt, Human
cugaagccaaagccaa

SEQ ID NO: 3441169 - RNA, 13 nt, Human
cugaagccagccu

SEQ ID NO: 3441170 - RNA, 17 nt, Human
cugaagccagccuucuu

SEQ ID NO: 3441171 - RNA, 17 nt, Human
cugaagccagcugcccu

SEQ ID NO: 3441172 - RNA, 13 nt, Human
cugaagccucugg

SEQ ID NO: 3441173 - RNA, 23 nt, Human
cugaagccuuugcauuuuggaga

SEQ ID NO: 3441174 - RNA, 17 nt, Human
cugaagcuuauuaaugc

SEQ ID NO: 3441175 - RNA, 18 nt, Human
cugaagcuuauuaaugcu

SEQ ID NO: 3441176 - RNA, 21 nt, Human
cugaagcuucacucacuguca

SEQ ID NO: 3441177 - RNA, 11 nt, Human
cugaaggaaaa

SEQ ID NO: 3441178 - RNA, 17 nt, Human
cugaaggacacuuccug

SEQ ID NO: 3441179 - RNA, 18 nt, Human
cugaaggacacuuccugc

SEQ ID NO: 3441180 - RNA, 21 nt, Human
cugaaggacacuuccugccua

SEQ ID NO: 3441181 - RNA, 21 nt, Human
cugaaggacauugcggacagc

SEQ ID NO: 3441182 - RNA, 18 nt, Human
cugaaggacccuucagag

SEQ ID NO: 3441183 - RNA, 15 nt, Human
cugaaggacugugac

SEQ ID NO: 3441184 - RNA, 12 nt, Human
cugaaggagaag

SEQ ID NO: 3441185 - RNA, 18 nt, Human
cugaaggagauuuuccuu

SEQ ID NO: 3441186 - RNA, 13 nt, Human
cugaaggaggcca

SEQ ID NO: 3441187 - RNA, 16 nt, Human
cugaaggaggccaccu

SEQ ID NO: 3441188 - RNA, 14 nt, Human
cugaaggccccgcc

SEQ ID NO: 3441189 - RNA, 17 nt, Human
cugaaggccccgcccag

SEQ ID NO: 3441190 - RNA, 13 nt, Human
cugaaggccugag

SEQ ID NO: 3441191 - RNA, 15 nt, Human
cugaaggccugaggu

SEQ ID NO: 3441192 - RNA, 22 nt, Human
cugaaggcuaaaaagcaacagg

SEQ ID NO: 3441193 - RNA, 17 nt, Human
cugaaggcuggguucug

SEQ ID NO: 3441194 - RNA, 18 nt, Human
cugaaggcuuucagggcc

SEQ ID NO: 3441195 - RNA, 12 nt, Human
cugaagggaggu

SEQ ID NO: 3441196 - RNA, 21 nt, Human
cugaagggauaugugaaacaa

SEQ ID NO: 3441197 - RNA, 23 nt, Human
cugaaggggccaugauggcaaca

SEQ ID NO: 3441198 - RNA, 20 nt, Human
cugaaggggcgucuguuccc

SEQ ID NO: 3441199 - RNA, 16 nt, Human
cugaagggggcggccu

SEQ ID NO: 3441200 - RNA, 17 nt, Human
cugaagggguucucaca

SEQ ID NO: 3441201 - RNA, 21 nt, Human
cugaagggguucucacagugg

SEQ ID NO: 3441202 - RNA, 15 nt, Human
cugaagguaaaauug

SEQ ID NO: 3441203 - RNA, 17 nt, Human
cugaagguaaaauugaa

SEQ ID NO: 3441204 - RNA, 16 nt, Human
cugaagguuguggccu

SEQ ID NO: 3441205 - RNA, 17 nt, Human
cugaaguacuaacacaa

SEQ ID NO: 3441206 - RNA, 17 nt, Human
cugaaguagugugcagu

SEQ ID NO: 3441207 - RNA, 14 nt, Human
cugaagucacacag

SEQ ID NO: 3441208 - RNA, 16 nt, Human
cugaagucacacagug

SEQ ID NO: 3441209 - RNA, 14 nt, Human
cugaagucacugca

SEQ ID NO: 3441210 - RNA, 16 nt, Human
cugaagucacugcaca

SEQ ID NO: 3441211 - RNA, 15 nt, Human
cugaagucugaaauu

SEQ ID NO: 3441212 - RNA, 20 nt, Human
cugaagucuuacuacagaaa

SEQ ID NO: 3441213 - RNA, 19 nt, Human
cugaagugaaacugcuugu

SEQ ID NO: 3441214 - RNA, 16 nt, Human
cugaagugcuuagugu

SEQ ID NO: 3441215 - RNA, 19 nt, Human
cugaaguucugccucugau

SEQ ID NO: 3441216 - RNA, 15 nt, Human
cugaaguuggacagc

SEQ ID NO: 3441217 - RNA, 17 nt, Human
cugaaguuucauuuaug

SEQ ID NO: 3441218 - RNA, 14 nt, Human
cugaauaaagcaau

SEQ ID NO: 3441219 - RNA, 15 nt, Human
cugaauaaauaccuc

SEQ ID NO: 3441220 - RNA, 13 nt, Human
cugaauaaauguc

SEQ ID NO: 3441221 - RNA, 15 nt, Human
cugaauaaaugucuu

SEQ ID NO: 3441222 - RNA, 22 nt, Human
cugaauaaauuguacagccggc

SEQ ID NO: 3441223 - RNA, 15 nt, Human
cugaauaacauuugu

SEQ ID NO: 3441224 - RNA, 16 nt, Human
cugaauaagcacuuuu

SEQ ID NO: 3441225 - RNA, 19 nt, Human
cugaauaagcacuuuuuaa

SEQ ID NO: 3441226 - RNA, 19 nt, Human
cugaauaccacucuguaau

SEQ ID NO: 3441227 - RNA, 21 nt, Human
cugaauaccacucuguaauug

SEQ ID NO: 3441228 - RNA, 15 nt, Human
cugaauagcagaagg

SEQ ID NO: 3441229 - RNA, 16 nt, Human
cugaauagcucccaga

SEQ ID NO: 3441230 - RNA, 18 nt, Human
cugaauaggcgaucacaa

SEQ ID NO: 3441231 - RNA, 17 nt, Human
cugaauauacagcaggu

SEQ ID NO: 3441232 - RNA, 20 nt, Human
cugaauccauuaaaaauggg

SEQ ID NO: 3441233 - RNA, 19 nt, Human
cugaaucccccuugccacc

SEQ ID NO: 3441234 - RNA, 22 nt, Human
cugaaucccccuugccacccca

SEQ ID NO: 3441235 - RNA, 15 nt, Human
cugaaucugcuacca

SEQ ID NO: 3441236 - RNA, 14 nt, Human
cugaaucuguacag

SEQ ID NO: 3441237 - RNA, 15 nt, Human
cugaaucuucugaaa

SEQ ID NO: 3441238 - RNA, 17 nt, Human
cugaaugaaacccccac

SEQ ID NO: 3441239 - RNA, 21 nt, Human
cugaaugaaacccccacacac

SEQ ID NO: 3441240 - RNA, 15 nt, Human
cugaaugccuccugu

SEQ ID NO: 3441241 - RNA, 14 nt, Human
cugaaugcucugua

SEQ ID NO: 3441242 - RNA, 14 nt, Human
cugaaugcugccac

SEQ ID NO: 3441243 - RNA, 22 nt, Human
cugaauggaagguuuguauauu

SEQ ID NO: 3441244 - RNA, 18 nt, Human
cugaauggacuuugcaca

SEQ ID NO: 3441245 - RNA, 18 nt, Human
cugaaugguuccaugccu

SEQ ID NO: 3441246 - RNA, 20 nt, Human
cugaaugguuuucaaaauaa

SEQ ID NO: 3441247 - RNA, 16 nt, Human
cugaauguaauuugug

SEQ ID NO: 3441248 - RNA, 16 nt, Human
cugaauguucugacau

SEQ ID NO: 3441249 - RNA, 17 nt, Human
cugaauguucugacauu

SEQ ID NO: 3441250 - RNA, 22 nt, Human
cugaauguucugacauuaacag

SEQ ID NO: 3441251 - RNA, 23 nt, Human
cugaauguucugacauuaacagu

SEQ ID NO: 3441252 - RNA, 16 nt, Human
cugaauguugggacug

SEQ ID NO: 3441253 - RNA, 19 nt, Human
cugaauguugggacugcua

SEQ ID NO: 3441254 - RNA, 14 nt, Human
cugaauguuuuucu

SEQ ID NO: 3441255 - RNA, 17 nt, Human
cugaauguuuuucuaaa

SEQ ID NO: 3441256 - RNA, 17 nt, Human
cugaauuaaucaucuau

SEQ ID NO: 3441257 - RNA, 19 nt, Human
cugaauuaguccuugcuug

SEQ ID NO: 3441258 - RNA, 22 nt, Human
cugaauuaguccuugcuuggcu

SEQ ID NO: 3441259 - RNA, 23 nt, Human
cugaauuaucuauacauaucuuu

SEQ ID NO: 3441260 - RNA, 13 nt, Human
cugaauuaugaaa

SEQ ID NO: 3441261 - RNA, 12 nt, Human
cugaauuauuuu

SEQ ID NO: 3441262 - RNA, 21 nt, Human
cugaauuggaaugcacucaga

SEQ ID NO: 3441263 - RNA, 23 nt, Human
cugaauuuaaauagcuuuuuucu

SEQ ID NO: 3441264 - RNA, 12 nt, Human
cugaauuucuuu

SEQ ID NO: 3441265 - RNA, 13 nt, Human
cugaauuugcaaa

SEQ ID NO: 3441266 - RNA, 20 nt, Human
cugaauuugcaaaguacugu

SEQ ID NO: 3441267 - RNA, 15 nt, Human
cugaauuugcccugg

SEQ ID NO: 3441268 - RNA, 19 nt, Human
cugaauuugcccugggaaa

SEQ ID NO: 3441269 - RNA, 21 nt, Human
cugaauuuggccugcacuaau

SEQ ID NO: 3441270 - RNA, 21 nt, Human
cugaauuuuggggauuuucaa

SEQ ID NO: 3441271 - RNA, 22 nt, Human
cugaauuuuuaaacaaguauuu

SEQ ID NO: 3441272 - RNA, 18 nt, Human
cugaauuuuuauguguga

SEQ ID NO: 3441273 - RNA, 15 nt, Human
cugaauuuuuuugua

SEQ ID NO: 3441274 - RNA, 17 nt, Human
cugaauuuuuuuguaau

SEQ ID NO: 3441275 - RNA, 18 nt, Human
cugacaaaaaguuuccau

SEQ ID NO: 3441276 - RNA, 16 nt, Human
cugacaaaauacuugu

SEQ ID NO: 3441277 - RNA, 16 nt, Human
cugacaaaucaaguuu

SEQ ID NO: 3441278 - RNA, 22 nt, Human
cugacaacacucauugaccuga

SEQ ID NO: 3441279 - RNA, 23 nt, Human
cugacaacacucauugaccugag

SEQ ID NO: 3441280 - RNA, 14 nt, Human
cugacaacauuucu

SEQ ID NO: 3441281 - RNA, 18 nt, Human
cugacaaccacuggucug

SEQ ID NO: 3441282 - RNA, 20 nt, Human
cugacaaccauuaaagucag

SEQ ID NO: 3441283 - RNA, 18 nt, Human
cugacaagcuccauuuaa

SEQ ID NO: 3441284 - RNA, 23 nt, Human
cugacaaggcacuucauguaaag

SEQ ID NO: 3441285 - RNA, 13 nt, Human
cugacaaucaacu

SEQ ID NO: 3441286 - RNA, 22 nt, Human
cugacaaugguguuauuugaaa

SEQ ID NO: 3441287 - RNA, 16 nt, Human
cugacacaaaccugcc

SEQ ID NO: 3441288 - RNA, 18 nt, Human
cugacacaaaccugccug

SEQ ID NO: 3441289 - RNA, 13 nt, Human
cugacacaaagga

SEQ ID NO: 3441290 - RNA, 14 nt, Human
cugacacaaaggaa

SEQ ID NO: 3441291 - RNA, 15 nt, Human
cugacacaaaggaag

SEQ ID NO: 3441292 - RNA, 18 nt, Human
cugacacacagcucuguc

SEQ ID NO: 3441293 - RNA, 17 nt, Human
cugacacaccaggcgcu

SEQ ID NO: 3441294 - RNA, 15 nt, Human
cugacacaccugcag

SEQ ID NO: 3441295 - RNA, 16 nt, Human
cugacacaccugcagc

SEQ ID NO: 3441296 - RNA, 20 nt, Human
cugacacacuaaccaagcug

SEQ ID NO: 3441297 - RNA, 22 nt, Human
cugacacacuaaccaagcugag

SEQ ID NO: 3441298 - RNA, 23 nt, Human
cugacacacuaaccaagcugagu

SEQ ID NO: 3441299 - RNA, 21 nt, Human
cugacacaggaaaccaacacc

SEQ ID NO: 3441300 - RNA, 14 nt, Human
cugacaccccacuu

SEQ ID NO: 3441301 - RNA, 16 nt, Human
cugacacccuucuccc

SEQ ID NO: 3441302 - RNA, 17 nt, Human
cugacacccuucuccca

SEQ ID NO: 3441303 - RNA, 16 nt, Human
cccugccccucaugcc

SEQ ID NO: 3441304 - RNA, 18 nt, Human
cccugccccucccuucaa

SEQ ID NO: 3441305 - RNA, 19 nt, Human
cccugccccucccuucaac

SEQ ID NO: 3441306 - RNA, 19 nt, Human
cccugccccugccccguca

SEQ ID NO: 3441307 - RNA, 18 nt, Human
cccugccccuucuacacu

SEQ ID NO: 3441308 - RNA, 23 nt, Human
cccugccccuucuacacucuccu

SEQ ID NO: 3441309 - RNA, 14 nt, Human
cccugcccuagcuc

SEQ ID NO: 3441310 - RNA, 14 nt, Human
cccugcccuccccu

SEQ ID NO: 3441311 - RNA, 15 nt, Human
cccugcccuccccuc

SEQ ID NO: 3441312 - RNA, 14 nt, Human
cccugcccucgugg

SEQ ID NO: 3441313 - RNA, 17 nt, Human
cccugcccucguggcca

SEQ ID NO: 3441314 - RNA, 17 nt, Human
cccugcccucuccuucc

SEQ ID NO: 3441315 - RNA, 13 nt, Human
cccugcccugcac

SEQ ID NO: 3441316 - RNA, 17 nt, Human
cccugcccugccaccug

SEQ ID NO: 3441317 - RNA, 13 nt, Human
cccugcccuggga

SEQ ID NO: 3441318 - RNA, 18 nt, Human
cccugcccugguccaggg

SEQ ID NO: 3441319 - RNA, 13 nt, Human
cccugcccugugg

SEQ ID NO: 3441320 - RNA, 20 nt, Human
cccugcccugugggccccca

SEQ ID NO: 3441321 - RNA, 15 nt, Human
cccugcccugugggg

SEQ ID NO: 3441322 - RNA, 14 nt, Human
cccugccgccucaa

SEQ ID NO: 3441323 - RNA, 16 nt, Human
cccugccucaggccuc

SEQ ID NO: 3441324 - RNA, 21 nt, Human
cccugccucaggccucugugc

SEQ ID NO: 3441325 - RNA, 20 nt, Human
cugaugaacuuauucuguag

SEQ ID NO: 3441326 - RNA, 15 nt, Human
cugaugaaucacugu

SEQ ID NO: 3441327 - RNA, 17 nt, Human
cugaugacaauaaagcu

SEQ ID NO: 3441328 - RNA, 18 nt, Human
cugaugacaauaaagcuu

SEQ ID NO: 3441329 - RNA, 20 nt, Human
cugaugacaauaaagcuugu

SEQ ID NO: 3441330 - RNA, 17 nt, Human
cugaugaccaauuuuaa

SEQ ID NO: 3441331 - RNA, 19 nt, Human
cugaugacccaggcugccu

SEQ ID NO: 3441332 - RNA, 23 nt, Human
cugaugacccaggcugccugagc

SEQ ID NO: 3441333 - RNA, 22 nt, Human
cugaugacccccccagcuucac

SEQ ID NO: 3441334 - RNA, 20 nt, Human
cugaugacucaagauuccca

SEQ ID NO: 3441335 - RNA, 23 nt, Human
cugaugacucaagauucccagga

SEQ ID NO: 3441336 - RNA, 14 nt, Human
cugaugacuugcuu

SEQ ID NO: 3441337 - RNA, 20 nt, Human
cugaugauuuguuuuuguau

SEQ ID NO: 3441338 - RNA, 16 nt, Human
cugaugcagcuuauac

SEQ ID NO: 3441339 - RNA, 17 nt, Human
cugaugcaucagaaagg

SEQ ID NO: 3441340 - RNA, 19 nt, Human
cugaugccaauacuaguca

SEQ ID NO: 3441341 - RNA, 20 nt, Human
cugaugccgugauccugagc

SEQ ID NO: 3441342 - RNA, 17 nt, Human
cugaugcucccuccccu

SEQ ID NO: 3441343 - RNA, 24 nt, Human
cugaugcucccuccccugcccugg

SEQ ID NO: 3441344 - RNA, 12 nt, Human
cugaugcugaca

SEQ ID NO: 3441345 - RNA, 13 nt, Human
cugaugcugggcu

SEQ ID NO: 3441346 - RNA, 18 nt, Human
cugaugcugggcugggug

SEQ ID NO: 3441347 - RNA, 16 nt, Human
cugaugcuguucucuu

SEQ ID NO: 3441348 - RNA, 22 nt, Human
cugaugcuuugcuucaaaucca

SEQ ID NO: 3441349 - RNA, 18 nt, Human
cugaugcuuuuagcucaa

SEQ ID NO: 3441350 - RNA, 19 nt, Human
cugaugcuuuugucuaauu

SEQ ID NO: 3441351 - RNA, 16 nt, Human
cugauggagaaggaag

SEQ ID NO: 3441352 - RNA, 17 nt, Human
cugauggcaggauggcc

SEQ ID NO: 3441353 - RNA, 19 nt, Human
cugauggcaggauggccug

SEQ ID NO: 3441354 - RNA, 14 nt, Human
cugauggccuuaau

SEQ ID NO: 3441355 - RNA, 21 nt, Human
cugaugggcaacccccagccu

SEQ ID NO: 3441356 - RNA, 23 nt, Human
cugaugggcaacccccagccugc

SEQ ID NO: 3441357 - RNA, 21 nt, Human
cugaugggcguacgcuggugc

SEQ ID NO: 3441358 - RNA, 22 nt, Human
cugaugggcguacgcuggugcu

SEQ ID NO: 3441359 - RNA, 17 nt, Human
cugauggggcaaacuca

SEQ ID NO: 3441360 - RNA, 17 nt, Human
cugauggugcaaugacc

SEQ ID NO: 3441361 - RNA, 21 nt, Human
cugauggugcaaugaccuuuc

SEQ ID NO: 3441362 - RNA, 15 nt, Human
cugauguaaaugaag

SEQ ID NO: 3441363 - RNA, 15 nt, Human
cugauguacucuaaa

SEQ ID NO: 3441364 - RNA, 16 nt, Human
cugauguacucuaaau

SEQ ID NO: 3441365 - RNA, 17 nt, Human
cugauguauuuugugag

SEQ ID NO: 3441366 - RNA, 19 nt, Human
cugaugucaauuucugugu

SEQ ID NO: 3441367 - RNA, 13 nt, Human
cugaugucuccua

SEQ ID NO: 3441368 - RNA, 21 nt, Human
cugaugucuccuaagcaccug

SEQ ID NO: 3441369 - RNA, 18 nt, Human
cugaugucucuaaagcac

SEQ ID NO: 3441370 - RNA, 12 nt, Human
cugaugugaaac

SEQ ID NO: 3441371 - RNA, 13 nt, Human
cugaugugaaacu

SEQ ID NO: 3441372 - RNA, 20 nt, Human
cugauguuacaucacagugu

SEQ ID NO: 3441373 - RNA, 18 nt, Human
cugauguuaggcugggcc

SEQ ID NO: 3441374 - RNA, 21 nt, Human
cugauguuaggcugggcccag

SEQ ID NO: 3441375 - RNA, 22 nt, Human
cugauguuaggcugggcccaga

SEQ ID NO: 3441376 - RNA, 16 nt, Human
cugauguucaguguaa

SEQ ID NO: 3441377 - RNA, 13 nt, Human
cugauguuccuag

SEQ ID NO: 3441378 - RNA, 18 nt, Human
cugauguuccuagugaaa

SEQ ID NO: 3441379 - RNA, 22 nt, Human
cugauguugagggaacagacag

SEQ ID NO: 3441380 - RNA, 16 nt, Human
cugauuaaaugacacu

SEQ ID NO: 3441381 - RNA, 19 nt, Human
cugauuaaugcuaaaugua

SEQ ID NO: 3441382 - RNA, 20 nt, Human
cugauuacugucaauaaaca

SEQ ID NO: 3441383 - RNA, 23 nt, Human
cugauuacugucaauaaacagcu

SEQ ID NO: 3441384 - RNA, 11 nt, Human
cugauuagaaa

SEQ ID NO: 3441385 - RNA, 16 nt, Human
cugauuagcuuugugu

SEQ ID NO: 3441386 - RNA, 14 nt, Human
cugauuaugucuuu

SEQ ID NO: 3441387 - RNA, 20 nt, Human
cugauuauugaguuccaguu

SEQ ID NO: 3441388 - RNA, 17 nt, Human
cugauuauuuucuucau

SEQ ID NO: 3441389 - RNA, 18 nt, Human
cugauucaacuaaaaaaa

SEQ ID NO: 3441390 - RNA, 16 nt, Human
cugauucaauuugaug

SEQ ID NO: 3441391 - RNA, 20 nt, Human
cugauucacugcauggcucc

SEQ ID NO: 3441392 - RNA, 22 nt, Human
cugauucauaauaaauaucugu

SEQ ID NO: 3441393 - RNA, 22 nt, Human
cugauucccaagcucugcuccu

SEQ ID NO: 3441394 - RNA, 16 nt, Human
cugauucccugauuua

SEQ ID NO: 3441395 - RNA, 16 nt, Human
cugauucggcugucuc

SEQ ID NO: 3441396 - RNA, 22 nt, Human
cugauucuggcuuuaagccuuc

SEQ ID NO: 3441397 - RNA, 16 nt, Human
cugauucugggaugcu

SEQ ID NO: 3441398 - RNA, 17 nt, Human
cugauuggcuuguagaa

SEQ ID NO: 3441399 - RNA, 16 nt, Human
cugauugguuucucuu

SEQ ID NO: 3441400 - RNA, 16 nt, Human
cugauuguaaacuuca

SEQ ID NO: 3441401 - RNA, 14 nt, Human
cugauuguaacguu

SEQ ID NO: 3441402 - RNA, 20 nt, Human
cugauuguaacguugcugug

SEQ ID NO: 3441403 - RNA, 17 nt, Human
cugauuguugucaggcc

SEQ ID NO: 3441404 - RNA, 16 nt, Human
cugauuuaauaugcaa

SEQ ID NO: 3441405 - RNA, 18 nt, Human
cugauuuaggagaagcca

SEQ ID NO: 3441406 - RNA, 14 nt, Human
cugauuuauuuugu

SEQ ID NO: 3441407 - RNA, 17 nt, Human
cugauuuauuuuguaug

SEQ ID NO: 3441408 - RNA, 13 nt, Human
cugauuucacaac

SEQ ID NO: 3441409 - RNA, 15 nt, Human
cugauuuccccuuuu

SEQ ID NO: 3441410 - RNA, 22 nt, Human
cugauuugacauagucuggcug

SEQ ID NO: 3441411 - RNA, 23 nt, Human
cugauuugaugauacauuucauu

SEQ ID NO: 3441412 - RNA, 17 nt, Human
cugauuugccacugaua

SEQ ID NO: 3441413 - RNA, 22 nt, Human
cugauuugccacugauauucag

SEQ ID NO: 3441414 - RNA, 11 nt, Human
cugauuugcug

SEQ ID NO: 3441415 - RNA, 17 nt, Human
cugauuugcugcucuuc

SEQ ID NO: 3441416 - RNA, 14 nt, Human
cugauuugguacuu

SEQ ID NO: 3441417 - RNA, 19 nt, Human
cugauuuguaacccacuga

SEQ ID NO: 3441418 - RNA, 13 nt, Human
cugauuuuaacaa

SEQ ID NO: 3441419 - RNA, 14 nt, Human
cugauuuuaaugga

SEQ ID NO: 3441420 - RNA, 21 nt, Human
cugauuuuuaugaugaugaaa

SEQ ID NO: 3441421 - RNA, 19 nt, Human
cugauuuuuuuuccuuuua

SEQ ID NO: 3441422 - RNA, 20 nt, Human
cugauuuuuuuuccuuuuaa

SEQ ID NO: 3441423 - RNA, 13 nt, Human
cugcaaaaaugga

SEQ ID NO: 3441424 - RNA, 19 nt, Human
cugcaaaaggccucuugua

SEQ ID NO: 3441425 - RNA, 19 nt, Human
cugcaaaaugaggaaugua

SEQ ID NO: 3441426 - RNA, 13 nt, Human
cugcaaaauuuua

SEQ ID NO: 3441427 - RNA, 18 nt, Human
cugcaaacaaacaccuuc

SEQ ID NO: 3441428 - RNA, 15 nt, Human
cugcaaacagaacag

SEQ ID NO: 3441429 - RNA, 23 nt, Human
cugcaaacaugggguuggcuggg

SEQ ID NO: 3441430 - RNA, 18 nt, Human
cugcaaaccugaccccug

SEQ ID NO: 3441431 - RNA, 16 nt, Human
cugcaaacucacugcu

SEQ ID NO: 3441432 - RNA, 20 nt, Human
cugcaaacucacugcucaag

SEQ ID NO: 3441433 - RNA, 12 nt, Human
cugcaaacuggg

SEQ ID NO: 3441434 - RNA, 21 nt, Human
cugcaaacugggaaccccuuu

SEQ ID NO: 3441435 - RNA, 22 nt, Human
cugcaaagaucuguccucagcc

SEQ ID NO: 3441436 - RNA, 13 nt, Human
cugcaaaggacug

SEQ ID NO: 3441437 - RNA, 23 nt, Human
cugcaaagguaauaauacagcca

SEQ ID NO: 3441438 - RNA, 22 nt, Human
cugcaaaguacagguacuuugu

SEQ ID NO: 3441439 - RNA, 20 nt, Human
cugcaaaguguuuuguacca

SEQ ID NO: 3441440 - RNA, 19 nt, Human
cugcaaauacuguauauuc

SEQ ID NO: 3441441 - RNA, 19 nt, Human
cugcaaauagaaaacagga

SEQ ID NO: 3441442 - RNA, 20 nt, Human
cugcaaauagaaaacaggaa

SEQ ID NO: 3441443 - RNA, 18 nt, Human
cugcaaaucaggcuuuug

SEQ ID NO: 3441444 - RNA, 19 nt, Human
cugcaaauccuugugggaa

SEQ ID NO: 3441445 - RNA, 19 nt, Human
cugcaaaucugauggccuu

SEQ ID NO: 3441446 - RNA, 15 nt, Human
cugcaacaaaaugua

SEQ ID NO: 3441447 - RNA, 14 nt, Human
cugauuuuaacaau

SEQ ID NO: 3441448 - RNA, 17 nt, Human
cugauuuuaacaauaac

SEQ ID NO: 3441449 - RNA, 22 nt, Human
cugauuuuaacaauaacuacug

SEQ ID NO: 3441450 - RNA, 12 nt, Human
cugauuuuaaug

SEQ ID NO: 3441451 - RNA, 12 nt, Human
cugauuuuauuc

SEQ ID NO: 3441452 - RNA, 19 nt, Human
cugauuuuuuuuuccuuca

SEQ ID NO: 3441453 - RNA, 20 nt, Human
cugauuuuuuuuuccuucag

SEQ ID NO: 3441454 - RNA, 13 nt, Human
cugcaaaaaauac

SEQ ID NO: 3441455 - RNA, 17 nt, Human
cugcaaaaauauuuaua

SEQ ID NO: 3441456 - RNA, 21 nt, Human
cugcaaaaauggauauuauua

SEQ ID NO: 3441457 - RNA, 18 nt, Human
cugcaaaaggagagacuc

SEQ ID NO: 3441458 - RNA, 15 nt, Human
cugcaaaaggccucu

SEQ ID NO: 3441459 - RNA, 11 nt, Human
cugcaaaauuu

SEQ ID NO: 3441460 - RNA, 14 nt, Human
cugcaaacagaaca

SEQ ID NO: 3441461 - RNA, 20 nt, Human
cugcaaacgcugccugccca

SEQ ID NO: 3441462 - RNA, 14 nt, Human
cugcaaacugggaa

SEQ ID NO: 3441463 - RNA, 12 nt, Human
cugcaaagaaag

SEQ ID NO: 3441464 - RNA, 23 nt, Human
cugcaaagaucuguccucagccu

SEQ ID NO: 3441465 - RNA, 13 nt, Human
cugcaaagcaugu

SEQ ID NO: 3441466 - RNA, 13 nt, Human
cugcaaagcccag

SEQ ID NO: 3441467 - RNA, 15 nt, Human
cugcaaagcccagcu

SEQ ID NO: 3441468 - RNA, 16 nt, Human
cugcaaaggacagauc

SEQ ID NO: 3441469 - RNA, 22 nt, Human
cugcaaaggguaucaggugcug

SEQ ID NO: 3441470 - RNA, 15 nt, Human
cugcaaaucaggcuu

SEQ ID NO: 3441471 - RNA, 20 nt, Human
cugcaaaucaggcuuuuguu

SEQ ID NO: 3441472 - RNA, 16 nt, Human
cugcaaauccuugugg

SEQ ID NO: 3441473 - RNA, 17 nt, Human
cugcaaccuccaccucc

SEQ ID NO: 3441474 - RNA, 17 nt, Human
cugcaaccuucgccacc

SEQ ID NO: 3441475 - RNA, 19 nt, Human
cugcaaccuucgccaccug

SEQ ID NO: 3441476 - RNA, 22 nt, Human
cugcaaccuucgccaccugggu

SEQ ID NO: 3441477 - RNA, 21 nt, Human
cugcaagaaaaugauguguac

SEQ ID NO: 3441478 - RNA, 20 nt, Human
cugcaagaauugaagcagga

SEQ ID NO: 3441479 - RNA, 15 nt, Human
cugcaagagccuugg

SEQ ID NO: 3441480 - RNA, 17 nt, Human
cugcaagagccuuggug

SEQ ID NO: 3441481 - RNA, 18 nt, Human
cugcaagagccuuggugu

SEQ ID NO: 3441482 - RNA, 23 nt, Human
cugcaagagccuugguguccacc

SEQ ID NO: 3441483 - RNA, 15 nt, Human
cugcaagaggcuccu

SEQ ID NO: 3441484 - RNA, 17 nt, Human
cugcaagcacagcccuu

SEQ ID NO: 3441485 - RNA, 20 nt, Human
cugcaagcacaucugcauuu

SEQ ID NO: 3441486 - RNA, 14 nt, Human
cugcaagcagggcu

SEQ ID NO: 3441487 - RNA, 19 nt, Human
cugcaagcagggcucugcc

SEQ ID NO: 3441488 - RNA, 12 nt, Human
cugcaagccugc

SEQ ID NO: 3441489 - RNA, 14 nt, Human
cugcaaggacauuc

SEQ ID NO: 3441490 - RNA, 18 nt, Human
cugcaaggcccacaggag

SEQ ID NO: 3441491 - RNA, 16 nt, Human
cugcaaggccuuucug

SEQ ID NO: 3441492 - RNA, 22 nt, Human
cugcaagggcagaacacuaacc

SEQ ID NO: 3441493 - RNA, 18 nt, Human
cugcaagguacucuggug

SEQ ID NO: 3441494 - RNA, 19 nt, Human
cugcaagguacucugguga

SEQ ID NO: 3441495 - RNA, 18 nt, Human
cugcaagucacaaaggaa

SEQ ID NO: 3441496 - RNA, 12 nt, Human
cugcaagucaga

SEQ ID NO: 3441497 - RNA, 14 nt, Human
cugcaagucagagg

SEQ ID NO: 3441498 - RNA, 19 nt, Human
cugcaagucagaggauggc

SEQ ID NO: 3441499 - RNA, 18 nt, Human
cugcaaguccuuuuguaa

SEQ ID NO: 3441500 - RNA, 18 nt, Human
cugcaaguuaugaaauau

SEQ ID NO: 3441501 - RNA, 15 nt, Human
cugcaauaacuucug

SEQ ID NO: 3441502 - RNA, 18 nt, Human
cugcaauaaggggagagu

SEQ ID NO: 3441503 - RNA, 20 nt, Human
cugcaauagagacuguagau

SEQ ID NO: 3441504 - RNA, 21 nt, Human
cugcaauagagacuguagauu

SEQ ID NO: 3441505 - RNA, 16 nt, Human
cugcaaucauauguga

SEQ ID NO: 3441506 - RNA, 17 nt, Human
cugcaaucauaugugau

SEQ ID NO: 3441507 - RNA, 15 nt, Human
cugcaauccugucuu

SEQ ID NO: 3441508 - RNA, 18 nt, Human
cugcaaugaagucucuga

SEQ ID NO: 3441509 - RNA, 17 nt, Human
cugcaaugggcacuggg

SEQ ID NO: 3441510 - RNA, 21 nt, Human
cugcaaugggcacugggauga

SEQ ID NO: 3441511 - RNA, 24 nt, Human
cugcaauucaaaaguuccaagagu

SEQ ID NO: 3441512 - RNA, 20 nt, Human
cugcaauuccccucugcugc

SEQ ID NO: 3441513 - RNA, 14 nt, Human
cugcaauucccugg

SEQ ID NO: 3441514 - RNA, 22 nt, Human
cugcaauuggcaccgaagccca

SEQ ID NO: 3441515 - RNA, 12 nt, Human
cugcaauuucua

SEQ ID NO: 3441516 - RNA, 15 nt, Human
cugcaauuucuacua

SEQ ID NO: 3441517 - RNA, 15 nt, Human
cugcacaagccaggg

SEQ ID NO: 3441518 - RNA, 22 nt, Human
cugcacaagccagggugugucu

SEQ ID NO: 3441519 - RNA, 15 nt, Human
cugcacaauaacucc

SEQ ID NO: 3441520 - RNA, 20 nt, Human
cugcacaauaacuccuccca

SEQ ID NO: 3441521 - RNA, 22 nt, Human
cugcacaauaacuccucccagg

SEQ ID NO: 3441522 - RNA, 14 nt, Human
cugcacacaaauau

SEQ ID NO: 3441523 - RNA, 15 nt, Human
cugcacacaccucag

SEQ ID NO: 3441524 - RNA, 13 nt, Human
cugcacacagcac

SEQ ID NO: 3441525 - RNA, 14 nt, Human
cugcacacagcacg

SEQ ID NO: 3441526 - RNA, 20 nt, Human
cugcacacccuccagagaca

SEQ ID NO: 3441527 - RNA, 22 nt, Human
cugcacacgcuccuuccucuga

SEQ ID NO: 3441528 - RNA, 13 nt, Human
cugcacagagcuc

SEQ ID NO: 3441529 - RNA, 18 nt, Human
cugcacagagcucuccag

SEQ ID NO: 3441530 - RNA, 13 nt, Human
cugcacagaugga

SEQ ID NO: 3441531 - RNA, 20 nt, Human
cugcacagauggauuugccu

SEQ ID NO: 3441532 - RNA, 22 nt, Human
cugcacagcaggcugccagugc

SEQ ID NO: 3441533 - RNA, 23 nt, Human
cccuuuuugaaguguaggcagac

SEQ ID NO: 3441534 - RNA, 14 nt, Human
cccuuuuuucugcc

SEQ ID NO: 3441535 - RNA, 19 nt, Human
cccuuuuuucugccuccuu

SEQ ID NO: 3441536 - RNA, 18 nt, Human
cccuuuuuuggcugcuga

SEQ ID NO: 3441537 - RNA, 19 nt, Human
cccuuuuuuggcugcugaa

SEQ ID NO: 3441538 - RNA, 21 nt, Human
cccuuuuuuggcugcugaagg

SEQ ID NO: 3441539 - RNA, 23 nt, Human
cccuuuuuuggcugcugaaggcu

SEQ ID NO: 3441540 - RNA, 17 nt, Human
ccgaaaaauccucuucc

SEQ ID NO: 3441541 - RNA, 19 nt, Human
ccgaaagaggcacccuucc

SEQ ID NO: 3441542 - RNA, 18 nt, Human
ccgaaaggucaccucacu

SEQ ID NO: 3441543 - RNA, 15 nt, Human
ccgaaaugcugucuu

SEQ ID NO: 3441544 - RNA, 23 nt, Human
ccgaacaucaccgacgcgucucc

SEQ ID NO: 3441545 - RNA, 13 nt, Human
ccgaaccuccucu

SEQ ID NO: 3441546 - RNA, 20 nt, Human
ccgaagaaggguccuucccu

SEQ ID NO: 3441547 - RNA, 16 nt, Human
ccgaagcccaggggcc

SEQ ID NO: 3441548 - RNA, 23 nt, Human
ccgaagcuaacagggaaggcagg

SEQ ID NO: 3441549 - RNA, 17 nt, Human
ccgaagcucuggcugaa

SEQ ID NO: 3441550 - RNA, 23 nt, Human
ccgaaggugcuggaggugggagc

SEQ ID NO: 3441551 - RNA, 21 nt, Human
ccgaagguuauggucaauccc

SEQ ID NO: 3441552 - RNA, 16 nt, Human
ccgaauagcugggacu

SEQ ID NO: 3441553 - RNA, 20 nt, Human
ccgaauagcugggacuacag

SEQ ID NO: 3441554 - RNA, 22 nt, Human
ccgaauauugagcaauauguca

SEQ ID NO: 3441555 - RNA, 16 nt, Human
ccgaauccccucccug

SEQ ID NO: 3441556 - RNA, 18 nt, Human
ccgaauccccucccuguc

SEQ ID NO: 3441557 - RNA, 19 nt, Human
ccgaauccccucccuguca

SEQ ID NO: 3441558 - RNA, 23 nt, Human
ccgaaucucuuuuugcuuucgaa

SEQ ID NO: 3441559 - RNA, 13 nt, Human
ccgaaugugcagg

SEQ ID NO: 3441560 - RNA, 20 nt, Human
ccgaauguugagguggacuc

SEQ ID NO: 3441561 - RNA, 22 nt, Human
ccgaauucgcuguuaccgccug

SEQ ID NO: 3441562 - RNA, 15 nt, Human
ccgaauugagcacaa

SEQ ID NO: 3441563 - RNA, 18 nt, Human
ccgacaaccgaugcucca

SEQ ID NO: 3441564 - RNA, 12 nt, Human
ccgacacuguuc

SEQ ID NO: 3441565 - RNA, 14 nt, Human
ccgacacuguucuc

SEQ ID NO: 3441566 - RNA, 13 nt, Human
ccgacagagggaa

SEQ ID NO: 3441567 - RNA, 18 nt, Human
ccgacagcccccucugcc

SEQ ID NO: 3441568 - RNA, 13 nt, Human
ccgacagccuggc

SEQ ID NO: 3441569 - RNA, 18 nt, Human
ccgaccagacaccuugac

SEQ ID NO: 3441570 - RNA, 13 nt, Human
ccgaccagagccc

SEQ ID NO: 3441571 - RNA, 21 nt, Human
ccgacccaggguucccgcggg

SEQ ID NO: 3441572 - RNA, 19 nt, Human
ccgacccucugggaaccuc

SEQ ID NO: 3441573 - RNA, 19 nt, Human
ccgaccgaggcuggagcug

SEQ ID NO: 3441574 - RNA, 19 nt, Human
ccgaccucguccucccccu

SEQ ID NO: 3441575 - RNA, 18 nt, Human
ccgacgccacagcccagc

SEQ ID NO: 3441576 - RNA, 23 nt, Human
ccgacggugggcauuugugaggc

SEQ ID NO: 3441577 - RNA, 16 nt, Human
ccgacuagacacacaa

SEQ ID NO: 3441578 - RNA, 23 nt, Human
ccgacucacaccacuagccucag

SEQ ID NO: 3441579 - RNA, 10 nt, Human
ccgacuccag

SEQ ID NO: 3441580 - RNA, 11 nt, Human
ccgacuccagc

SEQ ID NO: 3441581 - RNA, 15 nt, Human
ccgacuccagccagc

SEQ ID NO: 3441582 - RNA, 20 nt, Human
ccgacuccuggguugagcug

SEQ ID NO: 3441583 - RNA, 13 nt, Human
ccgacucuggccc

SEQ ID NO: 3441584 - RNA, 21 nt, Human
ccgacucuuucugagugccuu

SEQ ID NO: 3441585 - RNA, 17 nt, Human
ccgacugcuuuggaccu

SEQ ID NO: 3441586 - RNA, 22 nt, Human
ccgacuugaauuuucccacugc

SEQ ID NO: 3441587 - RNA, 20 nt, Human
ccgacuugugcacaggcaga

SEQ ID NO: 3441588 - RNA, 13 nt, Human
ccgagaagaacag

SEQ ID NO: 3441589 - RNA, 19 nt, Human
ccgagaagcaagaaagaaa

SEQ ID NO: 3441590 - RNA, 23 nt, Human
ccgagagagcaccccucucugca

SEQ ID NO: 3441591 - RNA, 21 nt, Human
cugcaccuccccccacugcag

SEQ ID NO: 3441592 - RNA, 16 nt, Human
cugcaccugccagccu

SEQ ID NO: 3441593 - RNA, 19 nt, Human
cugcaccugccagccuggc

SEQ ID NO: 3441594 - RNA, 17 nt, Human
cugcacggugaauggcu

SEQ ID NO: 3441595 - RNA, 20 nt, Human
cugcacggugaauggcuuug

SEQ ID NO: 3441596 - RNA, 17 nt, Human
cugcacguggcuucuga

SEQ ID NO: 3441597 - RNA, 16 nt, Human
cugcacuacuccucug

SEQ ID NO: 3441598 - RNA, 16 nt, Human
cugcacuauagccuag

SEQ ID NO: 3441599 - RNA, 14 nt, Human
cugcacuauaugca

SEQ ID NO: 3441600 - RNA, 17 nt, Human
cugcacucaaccuuaag

SEQ ID NO: 3441601 - RNA, 20 nt, Human
cugcacuccaaucuggguga

SEQ ID NO: 3441602 - RNA, 13 nt, Human
cugcacuccagcc

SEQ ID NO: 3441603 - RNA, 19 nt, Human
cugcacuccagccugggcg

SEQ ID NO: 3441604 - RNA, 18 nt, Human
cugcacuccagccugggu

SEQ ID NO: 3441605 - RNA, 20 nt, Human
cugcacuccaggcuggguga

SEQ ID NO: 3441606 - RNA, 20 nt, Human
cugcacuccagucuggguga

SEQ ID NO: 3441607 - RNA, 15 nt, Human
cugcacuccaugagu

SEQ ID NO: 3441608 - RNA, 18 nt, Human
cugcacucccaccugaca

SEQ ID NO: 3441609 - RNA, 21 nt, Human
cugcacuccccugcugggugu

SEQ ID NO: 3441610 - RNA, 20 nt, Human
cugcacuccggccugaugac

SEQ ID NO: 3441611 - RNA, 14 nt, Human
cugcacuccucagg

SEQ ID NO: 3441612 - RNA, 17 nt, Human
cugcacucugugcccau

SEQ ID NO: 3441613 - RNA, 18 nt, Human
cugcacucugugcccaug

SEQ ID NO: 3441614 - RNA, 19 nt, Human
cugcacugacccacagccu

SEQ ID NO: 3441615 - RNA, 14 nt, Human
cugcacugacucug

SEQ ID NO: 3441616 - RNA, 15 nt, Human
cugcacugacucugg

SEQ ID NO: 3441617 - RNA, 18 nt, Human
cugcacugaugcugcccc

SEQ ID NO: 3441618 - RNA, 22 nt, Human
cugcacuggggagcccgucuca

SEQ ID NO: 3441619 - RNA, 11 nt, Human
cugcacuguaa

SEQ ID NO: 3441620 - RNA, 13 nt, Human
cugcacuguaaaa

SEQ ID NO: 3441621 - RNA, 16 nt, Human
cugcacuguaaaaugu

SEQ ID NO: 3441622 - RNA, 20 nt, Human
cugcacuguaaaauguggga

SEQ ID NO: 3441623 - RNA, 13 nt, Human
cugcacuguccug

SEQ ID NO: 3441624 - RNA, 14 nt, Human
cugcacuguccugc

SEQ ID NO: 3441625 - RNA, 18 nt, Human
cugcacuguccugcucca

SEQ ID NO: 3441626 - RNA, 23 nt, Human
cugcacuguccugcuccacagug

SEQ ID NO: 3441627 - RNA, 19 nt, Human
cugcacuuauacccaugaa

SEQ ID NO: 3441628 - RNA, 14 nt, Human
cugcacuugcagac

SEQ ID NO: 3441629 - RNA, 16 nt, Human
cugcacuugcagacuc

SEQ ID NO: 3441630 - RNA, 18 nt, Human
cugcacuugcagacucua

SEQ ID NO: 3441631 - RNA, 19 nt, Human
cugcacuugggggcucagc

SEQ ID NO: 3441632 - RNA, 20 nt, Human
cugcacuugggggcucagca

SEQ ID NO: 3441633 - RNA, 24 nt, Human
cugcacuugggggcucagcaaggc

SEQ ID NO: 3441634 - RNA, 17 nt, Human
cugcacuuugaugucau

SEQ ID NO: 3441635 - RNA, 16 nt, Human
cugcagaaccggagag

SEQ ID NO: 3441636 - RNA, 22 nt, Human
cugcagaaccggagagccagcu

SEQ ID NO: 3441637 - RNA, 15 nt, Human
cugcagaaggaaaaa

SEQ ID NO: 3441638 - RNA, 21 nt, Human
cugcagaaggaaaaaugugua

SEQ ID NO: 3441639 - RNA, 16 nt, Human
cugcagaaggccaaga

SEQ ID NO: 3441640 - RNA, 19 nt, Human
cugcagaaggccaagaauc

SEQ ID NO: 3441641 - RNA, 13 nt, Human
cugcagacccugc

SEQ ID NO: 3441642 - RNA, 22 nt, Human
cugcagaccuguccuccuggug

SEQ ID NO: 3441643 - RNA, 15 nt, Human
cugcagacucacugu

SEQ ID NO: 3441644 - RNA, 15 nt, Human
cugcagacuucccag

SEQ ID NO: 3441645 - RNA, 16 nt, Human
cugcagacuucccagc

SEQ ID NO: 3441646 - RNA, 20 nt, Human
cugcagagcaggaaacauga

SEQ ID NO: 3441647 - RNA, 18 nt, Human
cugcagagcagugggccu

SEQ ID NO: 3441648 - RNA, 21 nt, Human
cugcagagcagugggccuggc

SEQ ID NO: 3441649 - RNA, 20 nt, Human
cugcagaggccagaggcccc

SEQ ID NO: 3441650 - RNA, 21 nt, Human
cugcagaggggcaggcccugc

SEQ ID NO: 3441651 - RNA, 19 nt, Human
cugcagaggucugugcuga

SEQ ID NO: 3441652 - RNA, 22 nt, Human
cugcagaggucugugcugaggc

SEQ ID NO: 3441653 - RNA, 17 nt, Human
cugcagaguuuccaaaa

SEQ ID NO: 3441654 - RNA, 16 nt, Human
cugcagaugccacccu

SEQ ID NO: 3441655 - RNA, 19 nt, Human
cugcagauuugggcuggaa

SEQ ID NO: 3441656 - RNA, 20 nt, Human
cugcagauuugggcuggaac

SEQ ID NO: 3441657 - RNA, 18 nt, Human
cugcagcaaacacuccac

SEQ ID NO: 3441658 - RNA, 20 nt, Human
cugcagcaaacacuccaccc

SEQ ID NO: 3441659 - RNA, 16 nt, Human
cugcagcaauaaagca

SEQ ID NO: 3441660 - RNA, 16 nt, Human
cugcagcaccgagggg

SEQ ID NO: 3441661 - RNA, 18 nt, Human
cugcagcaccgaggggcc

SEQ ID NO: 3441662 - RNA, 22 nt, Human
cugcagcaccgaggggccuuug

SEQ ID NO: 3441663 - RNA, 18 nt, Human
cugcagcaccuccaggcc

SEQ ID NO: 3441664 - RNA, 19 nt, Human
cugcagcacggacaauaaa

SEQ ID NO: 3441665 - RNA, 14 nt, Human
cugcagcagagccu

SEQ ID NO: 3441666 - RNA, 15 nt, Human
cugcagcagagccug

SEQ ID NO: 3441667 - RNA, 14 nt, Human
cugcagcagaggca

SEQ ID NO: 3441668 - RNA, 22 nt, Human
cugcagcaugaccugugaccag

SEQ ID NO: 3441669 - RNA, 23 nt, Human
cugcagcauggucccugccuuag

SEQ ID NO: 3441670 - RNA, 18 nt, Human
cugcagcauguugcugag

SEQ ID NO: 3441671 - RNA, 20 nt, Human
cugcagcauguugcugagga

SEQ ID NO: 3441672 - RNA, 12 nt, Human
cugcagccagcc

SEQ ID NO: 3441673 - RNA, 17 nt, Human
cugcagccagcccagcc

SEQ ID NO: 3441674 - RNA, 17 nt, Human
cugcagccaggccacug

SEQ ID NO: 3441675 - RNA, 15 nt, Human
cugcagcccuggccc

SEQ ID NO: 3441676 - RNA, 11 nt, Human
cugcagccuca

SEQ ID NO: 3441677 - RNA, 24 nt, Human
cugcagccucaaccuccugggcua

SEQ ID NO: 3441678 - RNA, 14 nt, Human
cugcagccucagag

SEQ ID NO: 3441679 - RNA, 11 nt, Human
cugcagccucc

SEQ ID NO: 3441680 - RNA, 20 nt, Human
cugcagccuccgcuucccug

SEQ ID NO: 3441681 - RNA, 16 nt, Human
cugcagccuccuccug

SEQ ID NO: 3441682 - RNA, 17 nt, Human
cugcagccuccuccuga

SEQ ID NO: 3441683 - RNA, 18 nt, Human
cugcagccuccuccugac

SEQ ID NO: 3441684 - RNA, 19 nt, Human
cugcagccucgaacuccug

SEQ ID NO: 3441685 - RNA, 20 nt, Human
cugcagccucgaacuccugg

SEQ ID NO: 3441686 - RNA, 19 nt, Human
cugcagccugcaggaccuc

SEQ ID NO: 3441687 - RNA, 11 nt, Human
cugcagccugg

SEQ ID NO: 3441688 - RNA, 14 nt, Human
cugcagccuggagg

SEQ ID NO: 3441689 - RNA, 20 nt, Human
cugcagccuggaggccgggu

SEQ ID NO: 3441690 - RNA, 21 nt, Human
cugcagccuugaacucugggc

SEQ ID NO: 3441691 - RNA, 16 nt, Human
cugcagcucccuggcu

SEQ ID NO: 3441692 - RNA, 17 nt, Human
cugcagcucccuggcuu

SEQ ID NO: 3441693 - RNA, 12 nt, Human
cugcagcugacc

SEQ ID NO: 3441694 - RNA, 21 nt, Human
cugcagcugaccucuguuguc

SEQ ID NO: 3441695 - RNA, 12 nt, Human
cugcagcugccg

SEQ ID NO: 3441696 - RNA, 13 nt, Human
cugcagcuggaca

SEQ ID NO: 3441697 - RNA, 13 nt, Human
ccggcaggcccug

SEQ ID NO: 3441698 - RNA, 23 nt, Human
ccggcaugagacucagugcagau

SEQ ID NO: 3441699 - RNA, 17 nt, Human
ccggccaauggaaaccu

SEQ ID NO: 3441700 - RNA, 15 nt, Human
ccggccagccauguc

SEQ ID NO: 3441701 - RNA, 14 nt, Human
ccggccagcuggga

SEQ ID NO: 3441702 - RNA, 20 nt, Human
ccggccaggugccuccugac

SEQ ID NO: 3441703 - RNA, 13 nt, Human
ccggccagguggg

SEQ ID NO: 3441704 - RNA, 12 nt, Human
ccggccccagcc

SEQ ID NO: 3441705 - RNA, 18 nt, Human
ccggccccagccagaguu

SEQ ID NO: 3441706 - RNA, 17 nt, Human
ccggcccccagagcgcc

SEQ ID NO: 3441707 - RNA, 19 nt, Human
ccggcccccuggucucugg

SEQ ID NO: 3441708 - RNA, 16 nt, Human
ccggccccggccccag

SEQ ID NO: 3441709 - RNA, 13 nt, Human
ccggccccugcug

SEQ ID NO: 3441710 - RNA, 14 nt, Human
ccggccccugcugg

SEQ ID NO: 3441711 - RNA, 15 nt, Human
ccggccccugcuggu

SEQ ID NO: 3441712 - RNA, 14 nt, Human
ccggcccuagccca

SEQ ID NO: 3441713 - RNA, 13 nt, Human
ccggcccuccaga

SEQ ID NO: 3441714 - RNA, 16 nt, Human
ccggcccuccagagcc

SEQ ID NO: 3441715 - RNA, 17 nt, Human
ccggcccuccagagccc

SEQ ID NO: 3441716 - RNA, 21 nt, Human
ccggcccuccuacccugcgcc

SEQ ID NO: 3441717 - RNA, 22 nt, Human
ccggcccugggcucggaggcug

SEQ ID NO: 3441718 - RNA, 13 nt, Human
ccggcccugugug

SEQ ID NO: 3441719 - RNA, 14 nt, Human
ccggccgauggaga

SEQ ID NO: 3441720 - RNA, 15 nt, Human
ccggccgcuccacca

SEQ ID NO: 3441721 - RNA, 16 nt, Human
ccggccggccacccag

SEQ ID NO: 3441722 - RNA, 23 nt, Human
ccggccucagcaccccugucucu

SEQ ID NO: 3441723 - RNA, 12 nt, Human
ccggccucucca

SEQ ID NO: 3441724 - RNA, 14 nt, Human
ccggccucuccagc

SEQ ID NO: 3441725 - RNA, 18 nt, Human
ccggccucuccagccuca

SEQ ID NO: 3441726 - RNA, 15 nt, Human
ccggccucucuggcc

SEQ ID NO: 3441727 - RNA, 18 nt, Human
ccggccucucuggccucc

SEQ ID NO: 3441728 - RNA, 20 nt, Human
ccggccucucuggccuccca

SEQ ID NO: 3441729 - RNA, 14 nt, Human
ccggccugccagga

SEQ ID NO: 3441730 - RNA, 20 nt, Human
ccggccugcucccagcagcc

SEQ ID NO: 3441731 - RNA, 15 nt, Human
ccggcgcccucuguc

SEQ ID NO: 3441732 - RNA, 18 nt, Human
ccggcgcccucuguccug

SEQ ID NO: 3441733 - RNA, 20 nt, Human
ccggcgccuggccuccaggc

SEQ ID NO: 3441734 - RNA, 21 nt, Human
ccggcgcuugccacuagggcu

SEQ ID NO: 3441735 - RNA, 19 nt, Human
ccggcggcccaagcccgac

SEQ ID NO: 3441736 - RNA, 15 nt, Human
cugcugucagucugc

SEQ ID NO: 3441737 - RNA, 16 nt, Human
cugcugucagucugcu

SEQ ID NO: 3441738 - RNA, 15 nt, Human
cugcugucauaacau

SEQ ID NO: 3441739 - RNA, 20 nt, Human
cugcugucauugcuucuucu

SEQ ID NO: 3441740 - RNA, 19 nt, Human
cugcuguccagacagccug

SEQ ID NO: 3441741 - RNA, 14 nt, Human
cugcuguccccucu

SEQ ID NO: 3441742 - RNA, 18 nt, Human
cugcuguccccucuugcc

SEQ ID NO: 3441743 - RNA, 21 nt, Human
cugcuguccccucuugcccca

SEQ ID NO: 3441744 - RNA, 23 nt, Human
cugcuguccccucuugccccaac

SEQ ID NO: 3441745 - RNA, 14 nt, Human
cugcugucucagcc

SEQ ID NO: 3441746 - RNA, 12 nt, Human
cugcugucuggg

SEQ ID NO: 3441747 - RNA, 14 nt, Human
cugcugucugggug

SEQ ID NO: 3441748 - RNA, 15 nt, Human
cugcugucugggugc

SEQ ID NO: 3441749 - RNA, 15 nt, Human
cugcugugaaagaag

SEQ ID NO: 3441750 - RNA, 22 nt, Human
cugcugugaacaagugaacaca

SEQ ID NO: 3441751 - RNA, 17 nt, Human
cugcugugaacccuggg

SEQ ID NO: 3441752 - RNA, 16 nt, Human
ccuagcuggagaggag

SEQ ID NO: 3441753 - RNA, 15 nt, Human
ccuagcuggcucugu

SEQ ID NO: 3441754 - RNA, 22 nt, Human
ccuagcuguccuuuuuccucuc

SEQ ID NO: 3441755 - RNA, 22 nt, Human
ccuagcugugugaauaccugcu

SEQ ID NO: 3441756 - RNA, 13 nt, Human
ccuagcugugugc

SEQ ID NO: 3441757 - RNA, 17 nt, Human
ccuagcugugugcaguc

SEQ ID NO: 3441758 - RNA, 20 nt, Human
ccuagcuugggaggcuuccc

SEQ ID NO: 3441759 - RNA, 23 nt, Human
ccuagcuuuagacccuggguggg

SEQ ID NO: 3441760 - RNA, 22 nt, Human
ccuaggaaacucacacuccccu

SEQ ID NO: 3441761 - RNA, 15 nt, Human
ccuaggaagccucag

SEQ ID NO: 3441762 - RNA, 17 nt, Human
ccuaggaagccucagau

SEQ ID NO: 3441763 - RNA, 14 nt, Human
ccuaggaagugauu

SEQ ID NO: 3441764 - RNA, 16 nt, Human
ccuaggaauucccagc

SEQ ID NO: 3441765 - RNA, 20 nt, Human
ccuaggaccacucagccccu

SEQ ID NO: 3441766 - RNA, 21 nt, Human
ccuaggaguauauuuccgcac

SEQ ID NO: 3441767 - RNA, 21 nt, Human
ccuaggauaaaaagccagggc

SEQ ID NO: 3441768 - RNA, 16 nt, Human
ccuaggauugugccug

SEQ ID NO: 3441769 - RNA, 22 nt, Human
ccuaggcaggacaugcugaagc

SEQ ID NO: 3441770 - RNA, 19 nt, Human
ccuaggcaguaggccggug

SEQ ID NO: 3441771 - RNA, 18 nt, Human
ccuaggccacuccuccaa

SEQ ID NO: 3441772 - RNA, 20 nt, Human
ccuaggccucagccagagaa

SEQ ID NO: 3441773 - RNA, 13 nt, Human
ccuaggccuggca

SEQ ID NO: 3441774 - RNA, 17 nt, Human
ccuaggcuccaccccau

SEQ ID NO: 3441775 - RNA, 17 nt, Human
ccuaggcugaccuugaa

SEQ ID NO: 3441776 - RNA, 16 nt, Human
ccuaggcuggaaggag

SEQ ID NO: 3441777 - RNA, 22 nt, Human
ccuaggcuggaaggaggaagaa

SEQ ID NO: 3441778 - RNA, 23 nt, Human
ccuagggaagggugguggagcca

SEQ ID NO: 3441779 - RNA, 17 nt, Human
ccuagggccacugaaga

SEQ ID NO: 3441780 - RNA, 20 nt, Human
ccuagggcccccacaguugc

SEQ ID NO: 3441781 - RNA, 14 nt, Human
ccuagggccugguc

SEQ ID NO: 3441782 - RNA, 13 nt, Human
ccuagggcugggu

SEQ ID NO: 3441783 - RNA, 16 nt, Human
ccuaggggaaugaggg

SEQ ID NO: 3441784 - RNA, 22 nt, Human
ccuaggggaaugagggggcuca

SEQ ID NO: 3441785 - RNA, 17 nt, Human
ccuaggggacacuuccc

SEQ ID NO: 3441786 - RNA, 15 nt, Human
ccuaggggucaggga

SEQ ID NO: 3441787 - RNA, 21 nt, Human
ccuagguagcccccucuuccc

SEQ ID NO: 3441788 - RNA, 17 nt, Human
ccuagguguuuuguuca

SEQ ID NO: 3441789 - RNA, 18 nt, Human
ccuagguucccggucccg

SEQ ID NO: 3441790 - RNA, 15 nt, Human
ccuaguaagugccuu

SEQ ID NO: 3441791 - RNA, 14 nt, Human
ccuaguagucauuu

SEQ ID NO: 3441792 - RNA, 14 nt, Human
ccuagucccuuccc

SEQ ID NO: 3441793 - RNA, 19 nt, Human
ccuagucccuuccccuccc

SEQ ID NO: 3441794 - RNA, 16 nt, Human
ccuagucucuaucauu

SEQ ID NO: 3441795 - RNA, 14 nt, Human
ccuagugaaacuuu

SEQ ID NO: 3441796 - RNA, 18 nt, Human
ccuagugaaggcuucucu

SEQ ID NO: 3441797 - RNA, 23 nt, Human
ccuagugaaggcuucucucugug

SEQ ID NO: 3441798 - RNA, 19 nt, Human
ccuagugacccggaggcca

SEQ ID NO: 3441799 - RNA, 20 nt, Human
ccuagugacccggaggccac

SEQ ID NO: 3441800 - RNA, 15 nt, Human
ccuaguggcugucca

SEQ ID NO: 3441801 - RNA, 16 nt, Human
ccuaguggcuguccag

SEQ ID NO: 3441802 - RNA, 21 nt, Human
ccuaguggcuguccagugccc

SEQ ID NO: 3441803 - RNA, 18 nt, Human
ccuaguggggucucccuc

SEQ ID NO: 3441804 - RNA, 23 nt, Human
ccuaguggggucucccucuccug

SEQ ID NO: 3441805 - RNA, 24 nt, Human
ccuaguggggucucccucuccugc

SEQ ID NO: 3441806 - RNA, 15 nt, Human
ccuaguuaaagaaag

SEQ ID NO: 3441807 - RNA, 19 nt, Human
ccuaguuaaagaaaggaaa

SEQ ID NO: 3441808 - RNA, 21 nt, Human
ccuaguucauccaauccucac

SEQ ID NO: 3441809 - RNA, 18 nt, Human
ccuaguucccucugcuca

SEQ ID NO: 3441810 - RNA, 16 nt, Human
ccuaguuggugagaaa

SEQ ID NO: 3441811 - RNA, 17 nt, Human
ccuaguuugaccucaca

SEQ ID NO: 3441812 - RNA, 12 nt, Human
ccuaguuuucca

SEQ ID NO: 3441813 - RNA, 18 nt, Human
ccuaguuuucuccuccca

SEQ ID NO: 3441814 - RNA, 16 nt, Human
ccuaguuuucuuuccu

SEQ ID NO: 3441815 - RNA, 22 nt, Human
ccuaguuuucuuuccuccuuuc

SEQ ID NO: 3441816 - RNA, 12 nt, Human
ccuauaaaacag

SEQ ID NO: 3441817 - RNA, 14 nt, Human
ccuauaaaucuaau

SEQ ID NO: 3441818 - RNA, 18 nt, Human
ccuauaaaucuaaugaca

SEQ ID NO: 3441819 - RNA, 18 nt, Human
ccuauaacuugaugcaug

SEQ ID NO: 3441820 - RNA, 16 nt, Human
ccuauaauguguguau

SEQ ID NO: 3441821 - RNA, 19 nt, Human
ccuauaauguguguaugug

SEQ ID NO: 3441822 - RNA, 21 nt, Human
ccuauaauguguguaugugua

SEQ ID NO: 3441823 - RNA, 22 nt, Human
ccuauacgcagcgugcuuuaaa

SEQ ID NO: 3441824 - RNA, 13 nt, Human
ccuauacugcuug

SEQ ID NO: 3441825 - RNA, 18 nt, Human
ccuauauaauaaagcuac

SEQ ID NO: 3441826 - RNA, 15 nt, Human
ccuauaugagaagaa

SEQ ID NO: 3441827 - RNA, 14 nt, Human
ccuauauguaguau

SEQ ID NO: 3441828 - RNA, 15 nt, Human
ccuauauuggcuaaa

SEQ ID NO: 3441829 - RNA, 16 nt, Human
ccuaucaaaaagauau

SEQ ID NO: 3441830 - RNA, 19 nt, Human
ccuaucaaaaagauaucaa

SEQ ID NO: 3441831 - RNA, 18 nt, Human
ccuaucaccuccccuccu

SEQ ID NO: 3441832 - RNA, 17 nt, Human
ccuaucagugugccccc

SEQ ID NO: 3441833 - RNA, 22 nt, Human
ccuaucagugugccccccaucc

SEQ ID NO: 3441834 - RNA, 17 nt, Human
ccuauccacugggcaca

SEQ ID NO: 3441835 - RNA, 13 nt, Human
ccuaucccauccc

SEQ ID NO: 3441836 - RNA, 15 nt, Human
ccuaucccaucccau

SEQ ID NO: 3441837 - RNA, 15 nt, Human
ccuauccucacugcc

SEQ ID NO: 3441838 - RNA, 14 nt, Human
ccuaucuccugaca

SEQ ID NO: 3441839 - RNA, 17 nt, Human
ccuaucucgugggagag

SEQ ID NO: 3441840 - RNA, 17 nt, Human
ccuaucugggcuuccug

SEQ ID NO: 3441841 - RNA, 18 nt, Human
ccuaucugggcuuccugg

SEQ ID NO: 3441842 - RNA, 21 nt, Human
ccuaugaaguaaagaacugca

SEQ ID NO: 3441843 - RNA, 16 nt, Human
ccuaugaaugcuuugc

SEQ ID NO: 3441844 - RNA, 22 nt, Human
ccuaugagcauccugagccccg

SEQ ID NO: 3441845 - RNA, 14 nt, Human
ccuaugaucccagc

SEQ ID NO: 3441846 - RNA, 12 nt, Human
ccuaugcaauaa

SEQ ID NO: 3441847 - RNA, 14 nt, Human
ccuaugcaugguuu

SEQ ID NO: 3441848 - RNA, 20 nt, Human
ccuaugcaugguuucagcac

SEQ ID NO: 3441849 - RNA, 22 nt, Human
ccuaugcuauugacaauaaaau

SEQ ID NO: 3441850 - RNA, 23 nt, Human
ccuaugcuauugacaauaaaaua

SEQ ID NO: 3441851 - RNA, 13 nt, Human
ccuauggagagcc

SEQ ID NO: 3441852 - RNA, 16 nt, Human
ccuauggagagcccug

SEQ ID NO: 3441853 - RNA, 17 nt, Human
ccuauggagagcccugg

SEQ ID NO: 3441854 - RNA, 11 nt, Human
ccuauggaugu

SEQ ID NO: 3441855 - RNA, 17 nt, Human
ccuaugggccugccggg

SEQ ID NO: 3441856 - RNA, 22 nt, Human
ccuauguaagaauucagaagac

SEQ ID NO: 3441857 - RNA, 16 nt, Human
ccuauguaguccgugc

SEQ ID NO: 3441858 - RNA, 15 nt, Human
ccuauguccuaagga

SEQ ID NO: 3441859 - RNA, 21 nt, Human
ccuauguccuaaggacacacu

SEQ ID NO: 3441860 - RNA, 11 nt, Human
ccuauguuugc

SEQ ID NO: 3441861 - RNA, 16 nt, Human
ccuauuaaccuagaga

SEQ ID NO: 3441862 - RNA, 16 nt, Human
ccuauuagagaagaga

SEQ ID NO: 3441863 - RNA, 16 nt, Human
ccuauuaguguuauau

SEQ ID NO: 3441864 - RNA, 12 nt, Human
ccuauuauccca

SEQ ID NO: 3441865 - RNA, 17 nt, Human
ccuauuaucccagcugc

SEQ ID NO: 3441866 - RNA, 17 nt, Human
ccuauuaucugucagcu

SEQ ID NO: 3441867 - RNA, 23 nt, Human
ccuauucaacacacacaugcuuc

SEQ ID NO: 3441868 - RNA, 17 nt, Human
ccuauuccaagcuucca

SEQ ID NO: 3441869 - RNA, 15 nt, Human
ccuauuccuccuggg

SEQ ID NO: 3441870 - RNA, 15 nt, Human
ccuauucuccucauc

SEQ ID NO: 3441871 - RNA, 16 nt, Human
ccuauuguaaauacaa

SEQ ID NO: 3441872 - RNA, 13 nt, Human
ccuauugucauua

SEQ ID NO: 3441873 - RNA, 21 nt, Human
ccuauugugauuugacuguuu

SEQ ID NO: 3441874 - RNA, 16 nt, Human
ccuauuucaaaaauuu

SEQ ID NO: 3441875 - RNA, 11 nt, Human
ccuauuucaga

SEQ ID NO: 3441876 - RNA, 20 nt, Human
ccuauuucaguacuucagca

SEQ ID NO: 3441877 - RNA, 12 nt, Human
ccuauuucucuu

SEQ ID NO: 3441878 - RNA, 13 nt, Human
ccuauuuucauug

SEQ ID NO: 3441879 - RNA, 19 nt, Human
ccuauuuugaaaaauuccu

SEQ ID NO: 3441880 - RNA, 21 nt, Human
ccuauuuugaaaaauuccuau

SEQ ID NO: 3441881 - RNA, 20 nt, Human
ccucagccccucuugccccc

SEQ ID NO: 3441882 - RNA, 23 nt, Human
ccucagccccucuugccccccac

SEQ ID NO: 3441883 - RNA, 15 nt, Human
ccucagcccugaccc

SEQ ID NO: 3441884 - RNA, 18 nt, Human
ccucagcccugacccugu

SEQ ID NO: 3441885 - RNA, 19 nt, Human
ccucagccuagacccuccu

SEQ ID NO: 3441886 - RNA, 20 nt, Human
ccucagccuagacccuccuc

SEQ ID NO: 3441887 - RNA, 19 nt, Human
ccucagccuggccagacac

SEQ ID NO: 3441888 - RNA, 22 nt, Human
ccucagccuggccagacacagg

SEQ ID NO: 3441889 - RNA, 12 nt, Human
ccucagccuggg

SEQ ID NO: 3441890 - RNA, 13 nt, Human
ccucagccugggc

SEQ ID NO: 3441891 - RNA, 16 nt, Human
ccucagccugggcgcu

SEQ ID NO: 3441892 - RNA, 17 nt, Human
ccucagccugggcgcug

SEQ ID NO: 3441893 - RNA, 11 nt, Human
ccucagccugu

SEQ ID NO: 3441894 - RNA, 12 nt, Human
ccucagccugug

SEQ ID NO: 3441895 - RNA, 22 nt, Human
ccucagccuuccccuugcccag

SEQ ID NO: 3441896 - RNA, 20 nt, Human
ccucagccuugccagagauc

SEQ ID NO: 3441897 - RNA, 23 nt, Human
ccucagccuuggauaaugcuguu

SEQ ID NO: 3441898 - RNA, 14 nt, Human
ccucagcgcggccc

SEQ ID NO: 3441899 - RNA, 15 nt, Human
ccucagcucccacaa

SEQ ID NO: 3441900 - RNA, 17 nt, Human
ccucagcucggcucagc

SEQ ID NO: 3441901 - RNA, 17 nt, Human
ccucagcucucaguugc

SEQ ID NO: 3441902 - RNA, 15 nt, Human
ccucagcucugggag

SEQ ID NO: 3441903 - RNA, 13 nt, Human
ccucagcugccuc

SEQ ID NO: 3441904 - RNA, 18 nt, Human
ccucagcugccucacuuc

SEQ ID NO: 3441905 - RNA, 12 nt, Human
ccucaggaaaga

SEQ ID NO: 3441906 - RNA, 13 nt, Human
ccucaggaaagaa

SEQ ID NO: 3441907 - RNA, 17 nt, Human
ccucaggaaugggcugu

SEQ ID NO: 3441908 - RNA, 18 nt, Human
ccucaggacaaugucuga

SEQ ID NO: 3441909 - RNA, 11 nt, Human
ccucaggacca

SEQ ID NO: 3441910 - RNA, 13 nt, Human
ccucaggacccuc

SEQ ID NO: 3441911 - RNA, 19 nt, Human
ccucaggacccucgcuggc

SEQ ID NO: 3441912 - RNA, 13 nt, Human
ccucaggacuggg

SEQ ID NO: 3441913 - RNA, 17 nt, Human
ccucaggacugggagcc

SEQ ID NO: 3441914 - RNA, 19 nt, Human
ccucaggagccgaagccca

SEQ ID NO: 3441915 - RNA, 20 nt, Human
ccucaggcaaggucuggccu

SEQ ID NO: 3441916 - RNA, 15 nt, Human
ccucaggcacuagcc

SEQ ID NO: 3441917 - RNA, 16 nt, Human
ccucaggcacuagccu

SEQ ID NO: 3441918 - RNA, 20 nt, Human
cuggaagcugggaggucagg

SEQ ID NO: 3441919 - RNA, 16 nt, Human
cuggaaguuauuuauu

SEQ ID NO: 3441920 - RNA, 17 nt, Human
cuggaaguuuugcauuu

SEQ ID NO: 3441921 - RNA, 20 nt, Human
cuggaaguuuugcauuuaug

SEQ ID NO: 3441922 - RNA, 14 nt, Human
cuggaauaaguuca

SEQ ID NO: 3441923 - RNA, 23 nt, Human
cuggaauaauccuaaacauauga

SEQ ID NO: 3441924 - RNA, 15 nt, Human
cuggaauacaugaaa

SEQ ID NO: 3441925 - RNA, 18 nt, Human
cuggaauauauaaccagu

SEQ ID NO: 3441926 - RNA, 23 nt, Human
cuggaaucaagaugucagacugg

SEQ ID NO: 3441927 - RNA, 23 nt, Human
cuggaaucaggaauauuuuccaa

SEQ ID NO: 3441928 - RNA, 18 nt, Human
cuggaaucuggagaccag

SEQ ID NO: 3441929 - RNA, 20 nt, Human
cuggaaucuggagagcuaga

SEQ ID NO: 3441930 - RNA, 19 nt, Human
cuggaaugaguugaggcca

SEQ ID NO: 3441931 - RNA, 24 nt, Human
cuggaaugaguugaggccacugug

SEQ ID NO: 3441932 - RNA, 15 nt, Human
cuggaauguaaucaa

SEQ ID NO: 3441933 - RNA, 22 nt, Human
cuggaauuagcuuggggccagg

SEQ ID NO: 3441934 - RNA, 23 nt, Human
cuggaauuugcaagucauggcug

SEQ ID NO: 3441935 - RNA, 20 nt, Human
cuggaauuuuuauuaugcau

SEQ ID NO: 3441936 - RNA, 20 nt, Human
cuggaauuuuuuauucuugu

SEQ ID NO: 3441937 - RNA, 21 nt, Human
cuggaauuuuuuauucuugug

SEQ ID NO: 3441938 - RNA, 15 nt, Human
cuggacaaagaauuc

SEQ ID NO: 3441939 - RNA, 11 nt, Human
cuggacaagcc

SEQ ID NO: 3441940 - RNA, 15 nt, Human
cuggacaagccaacu

SEQ ID NO: 3441941 - RNA, 21 nt, Human
cuggacaagccaacuuguaaa

SEQ ID NO: 3441942 - RNA, 15 nt, Human
cuggacacaggccug

SEQ ID NO: 3441943 - RNA, 17 nt, Human
cuggacaccgggccagu

SEQ ID NO: 3441944 - RNA, 22 nt, Human
cuggacaccgggccaguaucua

SEQ ID NO: 3441945 - RNA, 15 nt, Human
cuggacacucagacc

SEQ ID NO: 3441946 - RNA, 20 nt, Human
cuggacacuucacgcccuug

SEQ ID NO: 3441947 - RNA, 22 nt, Human
cuggacacuucacgcccuuggc

SEQ ID NO: 3441948 - RNA, 19 nt, Human
cuggacagaggggacucug

SEQ ID NO: 3441949 - RNA, 15 nt, Human
cuggacagcugugcc

SEQ ID NO: 3441950 - RNA, 19 nt, Human
cuggacagcugugccucgc

SEQ ID NO: 3441951 - RNA, 13 nt, Human
cuggacaggucug

SEQ ID NO: 3441952 - RNA, 16 nt, Human
cuggacaggucuggga

SEQ ID NO: 3441953 - RNA, 20 nt, Human
cuggacaguaucacugucuu

SEQ ID NO: 3441954 - RNA, 17 nt, Human
cuggacagucacugcca

SEQ ID NO: 3441955 - RNA, 17 nt, Human
cuggacauaacauuuuc

SEQ ID NO: 3441956 - RNA, 18 nt, Human
cuggacauccucuucugc

SEQ ID NO: 3441957 - RNA, 13 nt, Human
cuggaccaaagcu

SEQ ID NO: 3441958 - RNA, 23 nt, Human
cuggaccaacccuguuuccugag

SEQ ID NO: 3441959 - RNA, 13 nt, Human
cuggaccagaugc

SEQ ID NO: 3441960 - RNA, 15 nt, Human
cuggaccagaugcug

SEQ ID NO: 3441961 - RNA, 17 nt, Human
cuggacccagccagaac

SEQ ID NO: 3441962 - RNA, 20 nt, Human
cuggacccagccaggcccag

SEQ ID NO: 3441963 - RNA, 18 nt, Human
cuggaccccaucugugaa

SEQ ID NO: 3441964 - RNA, 19 nt, Human
cuggaccccaucugugaau

SEQ ID NO: 3441965 - RNA, 22 nt, Human
cuggaccccccuuucacaggca

SEQ ID NO: 3441966 - RNA, 12 nt, Human
cuggacccugac

SEQ ID NO: 3441967 - RNA, 15 nt, Human
cuggacccuguggau

SEQ ID NO: 3441968 - RNA, 15 nt, Human
cuggacccuguugcu

SEQ ID NO: 3441969 - RNA, 19 nt, Human
cuggaccuauguccuaagg

SEQ ID NO: 3441970 - RNA, 17 nt, Human
cuggaccucugacagca

SEQ ID NO: 3441971 - RNA, 19 nt, Human
cuggaccucugacagcagc

SEQ ID NO: 3441972 - RNA, 21 nt, Human
cuggaccucugacagcagcau

SEQ ID NO: 3441973 - RNA, 12 nt, Human
cuggaccugccc

SEQ ID NO: 3441974 - RNA, 19 nt, Human
cuggaccugcccccgcauc

SEQ ID NO: 3441975 - RNA, 12 nt, Human
cuggaccugccu

SEQ ID NO: 3441976 - RNA, 20 nt, Human
cuggaccugccuccugccug

SEQ ID NO: 3441977 - RNA, 16 nt, Human
cuggaccuguauauuu

SEQ ID NO: 3441978 - RNA, 17 nt, Human
cuggaccuugaacuggg

SEQ ID NO: 3441979 - RNA, 17 nt, Human
cuggacggaaguggugg

SEQ ID NO: 3441980 - RNA, 13 nt, Human
cuggacggcaggc

SEQ ID NO: 3441981 - RNA, 15 nt, Human
cuggacggcauuccu

SEQ ID NO: 3441982 - RNA, 17 nt, Human
cuggacggcauuccugc

SEQ ID NO: 3441983 - RNA, 15 nt, Human
cuggacggggacugg

SEQ ID NO: 3441984 - RNA, 16 nt, Human
cuggacgucuuucuuu

SEQ ID NO: 3441985 - RNA, 21 nt, Human
cuggacuagagggaccucucc

SEQ ID NO: 3441986 - RNA, 23 nt, Human
cuggacuagagggaccucuccca

SEQ ID NO: 3441987 - RNA, 19 nt, Human
cuggacucaggaugcccag

SEQ ID NO: 3441988 - RNA, 23 nt, Human
cuggacuccucuguccaggcacu

SEQ ID NO: 3441989 - RNA, 14 nt, Human
cuggacucuaaaga

SEQ ID NO: 3441990 - RNA, 18 nt, Human
cuggacucuaaagaccaa

SEQ ID NO: 3441991 - RNA, 19 nt, Human
cuggacucuaaagaccaaa

SEQ ID NO: 3441992 - RNA, 21 nt, Human
cuggacucuaaagaccaaacu

SEQ ID NO: 3441993 - RNA, 14 nt, Human
cuggacucucaguc

SEQ ID NO: 3441994 - RNA, 19 nt, Human
cuggacucucagucucuga

SEQ ID NO: 3441995 - RNA, 20 nt, Human
cuggacucucagucucugag

SEQ ID NO: 3441996 - RNA, 23 nt, Human
cuggacucucagucucugagcag

SEQ ID NO: 3441997 - RNA, 21 nt, Human
cuggacucuggacuuucucua

SEQ ID NO: 3441998 - RNA, 16 nt, Human
cuggacugaagccugc

SEQ ID NO: 3441999 - RNA, 19 nt, Human
cuggacugaagccugcagg

SEQ ID NO: 3442000 - RNA, 12 nt, Human
cuggacugacag

SEQ ID NO: 3442001 - RNA, 12 nt, Human
cuggacugaggc

SEQ ID NO: 3442002 - RNA, 13 nt, Human
cuggacugaggcc

SEQ ID NO: 3442003 - RNA, 16 nt, Human
cuggacugaggccuga

SEQ ID NO: 3442004 - RNA, 18 nt, Human
cuggacugagggggccug

SEQ ID NO: 3442005 - RNA, 20 nt, Human
cuggacugagggggccugga

SEQ ID NO: 3442006 - RNA, 13 nt, Human
cuggacugggagg

SEQ ID NO: 3442007 - RNA, 14 nt, Human
cuggacugggaggu

SEQ ID NO: 3442008 - RNA, 16 nt, Human
cuggacugggagguag

SEQ ID NO: 3442009 - RNA, 18 nt, Human
cuggacugucauagaaau

SEQ ID NO: 3442010 - RNA, 19 nt, Human
cuggacugucauagaaauu

SEQ ID NO: 3442011 - RNA, 22 nt, Human
cuggacugugugcucaggagcc

SEQ ID NO: 3442012 - RNA, 18 nt, Human
cuggacuuaagcaucugg

SEQ ID NO: 3442013 - RNA, 18 nt, Human
cuggacuucuaccugccc

SEQ ID NO: 3442014 - RNA, 20 nt, Human
cuggacuucuaccugcccuc

SEQ ID NO: 3442015 - RNA, 18 nt, Human
cuggacuugagcuuggca

SEQ ID NO: 3442016 - RNA, 20 nt, Human
cuggacuugagcuuggcagc

SEQ ID NO: 3442017 - RNA, 18 nt, Human
cuggacuuuccuguuguc

SEQ ID NO: 3442018 - RNA, 18 nt, Human
cuggacuuucucuaauaa

SEQ ID NO: 3442019 - RNA, 19 nt, Human
cuggacuuucucuaauaau

SEQ ID NO: 3442020 - RNA, 13 nt, Human
cuggagaaaaaua

SEQ ID NO: 3442021 - RNA, 14 nt, Human
cuggagaaaaugga

SEQ ID NO: 3442022 - RNA, 21 nt, Human
cuggagaaaauggacguguua

SEQ ID NO: 3442023 - RNA, 13 nt, Human
cuggagaaagggc

SEQ ID NO: 3442024 - RNA, 23 nt, Human
cuggagaaagggcccugggccug

SEQ ID NO: 3442025 - RNA, 22 nt, Human
cuggacucuucaaaaacuguuu

SEQ ID NO: 3442026 - RNA, 22 nt, Human
cuggacugaagccugcaggagu

SEQ ID NO: 3442027 - RNA, 14 nt, Human
cuggacugaccugg

SEQ ID NO: 3442028 - RNA, 15 nt, Human
cuggacugaggccug

SEQ ID NO: 3442029 - RNA, 21 nt, Human
cuggacugagggggccuggau

SEQ ID NO: 3442030 - RNA, 23 nt, Human
cuggacugagggggccuggaugc

SEQ ID NO: 3442031 - RNA, 22 nt, Human
cuggacugccuugaauaucccc

SEQ ID NO: 3442032 - RNA, 19 nt, Human
cuggacuggaggccccugg

SEQ ID NO: 3442033 - RNA, 16 nt, Human
cuggacuggcuguccu

SEQ ID NO: 3442034 - RNA, 20 nt, Human
cuggacugucuucucccugc

SEQ ID NO: 3442035 - RNA, 13 nt, Human
cuggacugugugc

SEQ ID NO: 3442036 - RNA, 23 nt, Human
cuggacugugugcucaggagccc

SEQ ID NO: 3442037 - RNA, 23 nt, Human
cuggacuuaagcaucuggcucua

SEQ ID NO: 3442038 - RNA, 19 nt, Human
cuggacuucuaccugcccu

SEQ ID NO: 3442039 - RNA, 13 nt, Human
cuggacuugagcu

SEQ ID NO: 3442040 - RNA, 15 nt, Human
cuggacuugccucug

SEQ ID NO: 3442041 - RNA, 16 nt, Human
cuggacuugccucugc

SEQ ID NO: 3442042 - RNA, 18 nt, Human
cuggacuuggccccugcc

SEQ ID NO: 3442043 - RNA, 13 nt, Human
cuggacuuucucu

SEQ ID NO: 3442044 - RNA, 21 nt, Human
cuggacuuucucuaauaauaa

SEQ ID NO: 3442045 - RNA, 22 nt, Human
cuggacuuucucuaauaauaaa

SEQ ID NO: 3442046 - RNA, 20 nt, Human
cuggagaacaagaaagggcc

SEQ ID NO: 3442047 - RNA, 23 nt, Human
cuggagaacuagaaccuggaggg

SEQ ID NO: 3442048 - RNA, 15 nt, Human
cuggagaacuagaga

SEQ ID NO: 3442049 - RNA, 19 nt, Human
cuggagaagacccuccccg

SEQ ID NO: 3442050 - RNA, 15 nt, Human
cuggagaagagagga

SEQ ID NO: 3442051 - RNA, 14 nt, Human
cuggagaagcagug

SEQ ID NO: 3442052 - RNA, 20 nt, Human
cuggagacagccccagagca

SEQ ID NO: 3442053 - RNA, 22 nt, Human
cuggagaccaccagggcaucuc

SEQ ID NO: 3442054 - RNA, 19 nt, Human
cuggagaccagggagccuu

SEQ ID NO: 3442055 - RNA, 20 nt, Human
cuggagaccaugcagagcgc

SEQ ID NO: 3442056 - RNA, 21 nt, Human
cuggagaccaugcagagcgcc

SEQ ID NO: 3442057 - RNA, 18 nt, Human
cuggagacgggugggcgg

SEQ ID NO: 3442058 - RNA, 20 nt, Human
cuggagacugugugugcccu

SEQ ID NO: 3442059 - RNA, 23 nt, Human
cuggagacugugugugcccucug

SEQ ID NO: 3442060 - RNA, 21 nt, Human
cuggagacuuagggcaccagg

SEQ ID NO: 3442061 - RNA, 22 nt, Human
cuggagagaaacaauaaagaga

SEQ ID NO: 3442062 - RNA, 16 nt, Human
cuggagagaaguggaa

SEQ ID NO: 3442063 - RNA, 20 nt, Human
cuggagagcauagggucugg

SEQ ID NO: 3442064 - RNA, 16 nt, Human
cuggagagcccagagu

SEQ ID NO: 3442065 - RNA, 22 nt, Human
cuggagagcuagaaccuggagg

SEQ ID NO: 3442066 - RNA, 17 nt, Human
cuggagaggagcccugc

SEQ ID NO: 3442067 - RNA, 12 nt, Human
cuggagaggccc

SEQ ID NO: 3442068 - RNA, 22 nt, Human
cuggagaggcccucuggagugg

SEQ ID NO: 3442069 - RNA, 23 nt, Human
cuggagagucucacuccccuccu

SEQ ID NO: 3442070 - RNA, 20 nt, Human
cuggagaguucaauggcugc

SEQ ID NO: 3442071 - RNA, 15 nt, Human
cuggagaucaccagu

SEQ ID NO: 3442072 - RNA, 15 nt, Human
cuggagauccuccug

SEQ ID NO: 3442073 - RNA, 17 nt, Human
cuggagauccuccugca

SEQ ID NO: 3442074 - RNA, 18 nt, Human
cuggagauccuccugcag

SEQ ID NO: 3442075 - RNA, 23 nt, Human
cuggagauccuccugcagaccac

SEQ ID NO: 3442076 - RNA, 19 nt, Human
cuggagaugaggccagacc

SEQ ID NO: 3442077 - RNA, 15 nt, Human
cuggagauggggaga

SEQ ID NO: 3442078 - RNA, 13 nt, Human
cuggagcacaaag

SEQ ID NO: 3442079 - RNA, 13 nt, Human
cuggagcaccagg

SEQ ID NO: 3442080 - RNA, 21 nt, Human
cuggagcacugggcucccggg

SEQ ID NO: 3442081 - RNA, 23 nt, Human
cuggagcacugggcucccgggcc

SEQ ID NO: 3442082 - RNA, 18 nt, Human
cuggagcagaccaccccg

SEQ ID NO: 3442083 - RNA, 23 nt, Human
cuggagcagauggagaccccuug

SEQ ID NO: 3442084 - RNA, 13 nt, Human
cuggagcagccac

SEQ ID NO: 3442085 - RNA, 14 nt, Human
cuggagcagccacc

SEQ ID NO: 3442086 - RNA, 12 nt, Human
cuggagcaggcc

SEQ ID NO: 3442087 - RNA, 22 nt, Human
cuggagcaucugacucacaaga

SEQ ID NO: 3442088 - RNA, 19 nt, Human
cuggagccaaguccagauu

SEQ ID NO: 3442089 - RNA, 20 nt, Human
cuggagccaccugucccacc

SEQ ID NO: 3442090 - RNA, 21 nt, Human
cuggagccaccugucccaccu

SEQ ID NO: 3442091 - RNA, 23 nt, Human
cuggagccaccugucccaccuca

SEQ ID NO: 3442092 - RNA, 16 nt, Human
cuggagccacuaacua

SEQ ID NO: 3442093 - RNA, 22 nt, Human
cuggagccagccgagcaggagg

SEQ ID NO: 3442094 - RNA, 15 nt, Human
cuggagccaugggca

SEQ ID NO: 3442095 - RNA, 16 nt, Human
cuggagcccacuguac

SEQ ID NO: 3442096 - RNA, 21 nt, Human
cuggagcccagaggagggcag

SEQ ID NO: 3442097 - RNA, 13 nt, Human
cuggagcccagga

SEQ ID NO: 3442098 - RNA, 16 nt, Human
cuggagccccacugcc

SEQ ID NO: 3442099 - RNA, 15 nt, Human
cuggagccccugggu

SEQ ID NO: 3442100 - RNA, 17 nt, Human
cuggagccccugggugg

SEQ ID NO: 3442101 - RNA, 17 nt, Human
cuggagcccgaggcacc

SEQ ID NO: 3442102 - RNA, 20 nt, Human
cuggagcccgaggcaccagu

SEQ ID NO: 3442103 - RNA, 22 nt, Human
cuggagcccuaaccccuuccag

SEQ ID NO: 3442104 - RNA, 20 nt, Human
cuggagcccuccgccuucac

SEQ ID NO: 3442105 - RNA, 15 nt, Human
cuggagcccuggaga

SEQ ID NO: 3442106 - RNA, 15 nt, Human
cuggagcccuugggu

SEQ ID NO: 3442107 - RNA, 16 nt, Human
cuggagccugagucag

SEQ ID NO: 3442108 - RNA, 22 nt, Human
cuggagccugagucagggccca

SEQ ID NO: 3442109 - RNA, 23 nt, Human
cuggagccugagucagggcccag

SEQ ID NO: 3442110 - RNA, 15 nt, Human
cuggagccuggugcc

SEQ ID NO: 3442111 - RNA, 11 nt, Human
cuggagccugu

SEQ ID NO: 3442112 - RNA, 19 nt, Human
cuggagccuguguaacagc

SEQ ID NO: 3442113 - RNA, 23 nt, Human
cuggagccuguguaacagcuccu

SEQ ID NO: 3442114 - RNA, 23 nt, Human
cuggagcugccucucucauccac

SEQ ID NO: 3442115 - RNA, 19 nt, Human
cuggagcuggcgucugucu

SEQ ID NO: 3442116 - RNA, 13 nt, Human
cuggagcuucucu

SEQ ID NO: 3442117 - RNA, 14 nt, Human
cuggagcuucucuu

SEQ ID NO: 3442118 - RNA, 18 nt, Human
cuggaggaaagggaggag

SEQ ID NO: 3442119 - RNA, 22 nt, Human
cuggaggaagggggguugcagu

SEQ ID NO: 3442120 - RNA, 17 nt, Human
cuggaggaccugagccu

SEQ ID NO: 3442121 - RNA, 19 nt, Human
ccuccuuuaguaaaacucc

SEQ ID NO: 3442122 - RNA, 15 nt, Human
ccuccuuucucuucu

SEQ ID NO: 3442123 - RNA, 15 nt, Human
ccuccuuucuggcuu

SEQ ID NO: 3442124 - RNA, 13 nt, Human
ccuccuuucugug

SEQ ID NO: 3442125 - RNA, 16 nt, Human
ccuccuuucugugccc

SEQ ID NO: 3442126 - RNA, 18 nt, Human
ccuccuuuugcuugaaac

SEQ ID NO: 3442127 - RNA, 16 nt, Human
ccucgaacccacacug

SEQ ID NO: 3442128 - RNA, 15 nt, Human
ccucgaacuccuggg

SEQ ID NO: 3442129 - RNA, 18 nt, Human
ccucgaagcgcgccacuc

SEQ ID NO: 3442130 - RNA, 18 nt, Human
ccucgaauuuuguuuucu

SEQ ID NO: 3442131 - RNA, 14 nt, Human
ccucgagggcaggg

SEQ ID NO: 3442132 - RNA, 16 nt, Human
ccucgagggcagggac

SEQ ID NO: 3442133 - RNA, 16 nt, Human
ccucgagguuucucaa

SEQ ID NO: 3442134 - RNA, 19 nt, Human
ccucgaguacugugggcaa

SEQ ID NO: 3442135 - RNA, 21 nt, Human
ccucgcaacuguccacgcgug

SEQ ID NO: 3442136 - RNA, 22 nt, Human
ccucgcagccucucagugcccu

SEQ ID NO: 3442137 - RNA, 21 nt, Human
ccucgcaggccucccugccag

SEQ ID NO: 3442138 - RNA, 19 nt, Human
ccucgcccaccgcaugccc

SEQ ID NO: 3442139 - RNA, 15 nt, Human
ccucgcccaguccca

SEQ ID NO: 3442140 - RNA, 15 nt, Human
ccucgccccuggcag

SEQ ID NO: 3442141 - RNA, 18 nt, Human
ccucgcccucuccuuugu

SEQ ID NO: 3442142 - RNA, 18 nt, Human
ccucgccggaucugaggg

SEQ ID NO: 3442143 - RNA, 14 nt, Human
ccucgccucuccca

SEQ ID NO: 3442144 - RNA, 13 nt, Human
ccucgccuggccu

SEQ ID NO: 3442145 - RNA, 16 nt, Human
ccucgccuggccugag

SEQ ID NO: 3442146 - RNA, 13 nt, Human
ccucgccugugga

SEQ ID NO: 3442147 - RNA, 22 nt, Human
ccucgccuguggagcucagccc

SEQ ID NO: 3442148 - RNA, 19 nt, Human
ccucgcuccccacucugcu

SEQ ID NO: 3442149 - RNA, 12 nt, Human
ccucgcucuguu

SEQ ID NO: 3442150 - RNA, 16 nt, Human
ccucgcuggcccccac

SEQ ID NO: 3442151 - RNA, 21 nt, Human
ccucgcuggggcagugcccuc

SEQ ID NO: 3442152 - RNA, 22 nt, Human
ccucggaccccacuccggcccu

SEQ ID NO: 3442153 - RNA, 20 nt, Human
ccucggacuuagcugggaga

SEQ ID NO: 3442154 - RNA, 14 nt, Human
ccucggagaagagc

SEQ ID NO: 3442155 - RNA, 16 nt, Human
ccucggauccccuucc

SEQ ID NO: 3442156 - RNA, 18 nt, Human
ccucggccccucccacac

SEQ ID NO: 3442157 - RNA, 15 nt, Human
ccucggcuccugcug

SEQ ID NO: 3442158 - RNA, 19 nt, Human
ccucggcuccugcugcacc

SEQ ID NO: 3442159 - RNA, 16 nt, Human
ccucggcuggcucccc

SEQ ID NO: 3442160 - RNA, 19 nt, Human
ccucggcuggcuccccugc

SEQ ID NO: 3442161 - RNA, 21 nt, Human
ccucggcuggcuccccugcag

SEQ ID NO: 3442162 - RNA, 22 nt, Human
ccucggcuggcuccccugcagc

SEQ ID NO: 3442163 - RNA, 17 nt, Human
ccucggcuggcugucca

SEQ ID NO: 3442164 - RNA, 23 nt, Human
ccucgggaaccucacucuugcca

SEQ ID NO: 3442165 - RNA, 20 nt, Human
ccucgggcccaccuggccac

SEQ ID NO: 3442166 - RNA, 18 nt, Human
ccucgggcccagccccca

SEQ ID NO: 3442167 - RNA, 19 nt, Human
ccucgggcgagucacugcc

SEQ ID NO: 3442168 - RNA, 23 nt, Human
ccucucugcagacuucccagcua

SEQ ID NO: 3442169 - RNA, 15 nt, Human
ccucucugcaggucc

SEQ ID NO: 3442170 - RNA, 16 nt, Human
ccucucugcaucugac

SEQ ID NO: 3442171 - RNA, 12 nt, Human
ccucucugcccu

SEQ ID NO: 3442172 - RNA, 15 nt, Human
ccucucugcucugcg

SEQ ID NO: 3442173 - RNA, 16 nt, Human
ccucucugcucugcgu

SEQ ID NO: 3442174 - RNA, 13 nt, Human
ccucucuggagaa

SEQ ID NO: 3442175 - RNA, 22 nt, Human
ccucucuggagaaagggcccug

SEQ ID NO: 3442176 - RNA, 23 nt, Human
ccucucuggagaaagggcccugg

SEQ ID NO: 3442177 - RNA, 17 nt, Human
ccucucugucccuugcu

SEQ ID NO: 3442178 - RNA, 23 nt, Human
ccucucuuccuaucccaucccau

SEQ ID NO: 3442179 - RNA, 15 nt, Human
ccucucuuuguucuc

SEQ ID NO: 3442180 - RNA, 18 nt, Human
ccucucuuuguucucagc

SEQ ID NO: 3442181 - RNA, 20 nt, Human
ccucucuuuguucucagcuc

SEQ ID NO: 3442182 - RNA, 22 nt, Human
ccucucuuuguucucagcuccc

SEQ ID NO: 3442183 - RNA, 23 nt, Human
ccucucuuuguucucagcucccc

SEQ ID NO: 3442184 - RNA, 21 nt, Human
ccucugaaacagcugccuuag

SEQ ID NO: 3442185 - RNA, 16 nt, Human
ccucugaaacccugga

SEQ ID NO: 3442186 - RNA, 17 nt, Human
ccucugaaaguuguaca

SEQ ID NO: 3442187 - RNA, 20 nt, Human
ccucugaaugaaccuucugg

SEQ ID NO: 3442188 - RNA, 22 nt, Human
ccucugaauuuacuuccuugca

SEQ ID NO: 3442189 - RNA, 15 nt, Human
ccucugacacacagc

SEQ ID NO: 3442190 - RNA, 12 nt, Human
ccucugacagca

SEQ ID NO: 3442191 - RNA, 13 nt, Human
ccucugacagcag

SEQ ID NO: 3442192 - RNA, 15 nt, Human
ccucugaccccuccu

SEQ ID NO: 3442193 - RNA, 16 nt, Human
ccucugaccccuccuc

SEQ ID NO: 3442194 - RNA, 17 nt, Human
ccucugaccccuccuca

SEQ ID NO: 3442195 - RNA, 18 nt, Human
ccucugaccccuccucac

SEQ ID NO: 3442196 - RNA, 19 nt, Human
ccucugaccccuccucacu

SEQ ID NO: 3442197 - RNA, 20 nt, Human
ccucugaccccuccucacug

SEQ ID NO: 3442198 - RNA, 16 nt, Human
ccucugaccugcacug

SEQ ID NO: 3442199 - RNA, 17 nt, Human
ccucugaccugcaggcc

SEQ ID NO: 3442200 - RNA, 19 nt, Human
ccucugacucagggcuccu

SEQ ID NO: 3442201 - RNA, 19 nt, Human
ccucugagccccugggacu

SEQ ID NO: 3442202 - RNA, 11 nt, Human
ccucugagccu

SEQ ID NO: 3442203 - RNA, 15 nt, Human
ccucugagcuuugca

SEQ ID NO: 3442204 - RNA, 17 nt, Human
ccucugagcuuugcaug

SEQ ID NO: 3442205 - RNA, 15 nt, Human
ccucugaggccagcc

SEQ ID NO: 3442206 - RNA, 16 nt, Human
ccucugaggccagccu

SEQ ID NO: 3442207 - RNA, 17 nt, Human
ccucugaggccagccug

SEQ ID NO: 3442208 - RNA, 20 nt, Human
ccucugaggccagccuggcc

SEQ ID NO: 3442209 - RNA, 18 nt, Human
ccucugaggcuggauccu

SEQ ID NO: 3442210 - RNA, 20 nt, Human
ccucugagggaaagcccaga

SEQ ID NO: 3442211 - RNA, 18 nt, Human
ccucugauacccagagca

SEQ ID NO: 3442212 - RNA, 20 nt, Human
ccucugauacccagagcauu

SEQ ID NO: 3442213 - RNA, 14 nt, Human
ccucugauaccuca

SEQ ID NO: 3442214 - RNA, 16 nt, Human
ccucugaucuccaugg

SEQ ID NO: 3442215 - RNA, 20 nt, Human
ccucugcacuacugacaugu

SEQ ID NO: 3442216 - RNA, 15 nt, Human
ccucugcacuccccu

SEQ ID NO: 3442217 - RNA, 16 nt, Human
ccucugcacuccccug

SEQ ID NO: 3442218 - RNA, 19 nt, Human
ccucugcacuccccugcug

SEQ ID NO: 3442219 - RNA, 20 nt, Human
ccucugcacuccccugcugg

SEQ ID NO: 3442220 - RNA, 23 nt, Human
ccucugcacuccccugcugggug

SEQ ID NO: 3442221 - RNA, 14 nt, Human
ccucugcagcaaua

SEQ ID NO: 3442222 - RNA, 18 nt, Human
ccucugcagcaauaaagc

SEQ ID NO: 3442223 - RNA, 19 nt, Human
ccucugcagcaauaaagca

SEQ ID NO: 3442224 - RNA, 22 nt, Human
ccucugcagcugaccucuguug

SEQ ID NO: 3442225 - RNA, 17 nt, Human
ccucugcauccucugga

SEQ ID NO: 3442226 - RNA, 20 nt, Human
ccucugccaaaggaugugau

SEQ ID NO: 3442227 - RNA, 22 nt, Human
ccucugccaaaggaugugauau

SEQ ID NO: 3442228 - RNA, 18 nt, Human
ccucugccacacucugac

SEQ ID NO: 3442229 - RNA, 11 nt, Human
ccucugccacc

SEQ ID NO: 3442230 - RNA, 13 nt, Human
ccucugccaccag

SEQ ID NO: 3442231 - RNA, 17 nt, Human
ccucugccaccagagac

SEQ ID NO: 3442232 - RNA, 19 nt, Human
ccucugccaccagagaccg

SEQ ID NO: 3442233 - RNA, 24 nt, Human
ccucugccaccagagaccguccuc

SEQ ID NO: 3442234 - RNA, 14 nt, Human
ccucugccaccucc

SEQ ID NO: 3442235 - RNA, 16 nt, Human
ccucugcccagcuugg

SEQ ID NO: 3442236 - RNA, 21 nt, Human
ccucugcccgggagcucagga

SEQ ID NO: 3442237 - RNA, 23 nt, Human
ccucugcccucauuacugggccu

SEQ ID NO: 3442238 - RNA, 15 nt, Human
ccucugcccuuccug

SEQ ID NO: 3442239 - RNA, 20 nt, Human
ccucugccucugacacacag

SEQ ID NO: 3442240 - RNA, 23 nt, Human
ccucugccucugacacacagcuc

SEQ ID NO: 3442241 - RNA, 13 nt, Human
ccucugccugccc

SEQ ID NO: 3442242 - RNA, 16 nt, Human
ccucugccugccccgc

SEQ ID NO: 3442243 - RNA, 21 nt, Human
ccucugccugccccgccccca

SEQ ID NO: 3442244 - RNA, 14 nt, Human
ccucugccuguccc

SEQ ID NO: 3442245 - RNA, 18 nt, Human
ccucugccugucccucuc

SEQ ID NO: 3442246 - RNA, 15 nt, Human
ccucugccugucucc

SEQ ID NO: 3442247 - RNA, 23 nt, Human
ccucugccuuugcaccacgggac

SEQ ID NO: 3442248 - RNA, 12 nt, Human
ccucugcuaaau

SEQ ID NO: 3442249 - RNA, 11 nt, Human
ccucugcuacg

SEQ ID NO: 3442250 - RNA, 15 nt, Human
ccucugcucaccgcc

SEQ ID NO: 3442251 - RNA, 14 nt, Human
ccucugcucagcca

SEQ ID NO: 3442252 - RNA, 17 nt, Human
ccucugcucagccaagc

SEQ ID NO: 3442253 - RNA, 14 nt, Human
ccucugcuccccag

SEQ ID NO: 3442254 - RNA, 19 nt, Human
ccucugcucccccuuuucc

SEQ ID NO: 3442255 - RNA, 14 nt, Human
ccucugcucugagg

SEQ ID NO: 3442256 - RNA, 16 nt, Human
ccucugcugcuggcug

SEQ ID NO: 3442257 - RNA, 14 nt, Human
ccucugcugcuguc

SEQ ID NO: 3442258 - RNA, 21 nt, Human
ccucugcuggccgggcacagc

SEQ ID NO: 3442259 - RNA, 22 nt, Human
ccucugcuggccgggcacagcu

SEQ ID NO: 3442260 - RNA, 23 nt, Human
ccucugcuggccgggcacagcug

SEQ ID NO: 3442261 - RNA, 14 nt, Human
ccucugcuucccag

SEQ ID NO: 3442262 - RNA, 13 nt, Human
ccucugcuugcca

SEQ ID NO: 3442263 - RNA, 14 nt, Human
ccucugcuuugaaa

SEQ ID NO: 3442264 - RNA, 15 nt, Human
ccucugcuuuuaucu

SEQ ID NO: 3442265 - RNA, 15 nt, Human
ccucuggacggcagg

SEQ ID NO: 3442266 - RNA, 16 nt, Human
ccucuggacggcaggc

SEQ ID NO: 3442267 - RNA, 21 nt, Human
ccucuggacggcaggcucacu

SEQ ID NO: 3442268 - RNA, 22 nt, Human
ccucuggacggcaggcucacug

SEQ ID NO: 3442269 - RNA, 15 nt, Human
ccucuggacuggcua

SEQ ID NO: 3442270 - RNA, 21 nt, Human
ccucuggaggccucugggccu

SEQ ID NO: 3442271 - RNA, 22 nt, Human
ccucuggaggccucugggccuc

SEQ ID NO: 3442272 - RNA, 17 nt, Human
ccucuggaggggugugg

SEQ ID NO: 3442273 - RNA, 20 nt, Human
ccucuggagggguguggcuc

SEQ ID NO: 3442274 - RNA, 16 nt, Human
ccucuggaguggccac

SEQ ID NO: 3442275 - RNA, 21 nt, Human
ccucuggaguggccacuaagc

SEQ ID NO: 3442276 - RNA, 23 nt, Human
ccucuggcauuagaauuauuuaa

SEQ ID NO: 3442277 - RNA, 20 nt, Human
ccucuggccgccuaggcuca

SEQ ID NO: 3442278 - RNA, 12 nt, Human
ccucuggcuaga

SEQ ID NO: 3442279 - RNA, 13 nt, Human
ccucuggcuagag

SEQ ID NO: 3442280 - RNA, 22 nt, Human
ccucuggcuagaggccagcccc

SEQ ID NO: 3442281 - RNA, 24 nt, Human
ccucuggcuagaggccagccccac

SEQ ID NO: 3442282 - RNA, 20 nt, Human
ccucuggcuuggccacagcc

SEQ ID NO: 3442283 - RNA, 21 nt, Human
ccucuggcuuggccacagcca

SEQ ID NO: 3442284 - RNA, 23 nt, Human
cuggcagccccuguucuggcaga

SEQ ID NO: 3442285 - RNA, 13 nt, Human
cuggcagcccgca

SEQ ID NO: 3442286 - RNA, 18 nt, Human
cuggcagcccgcaucagc

SEQ ID NO: 3442287 - RNA, 19 nt, Human
cuggcagcccgcaucagcu

SEQ ID NO: 3442288 - RNA, 13 nt, Human
cuggcagccgugc

SEQ ID NO: 3442289 - RNA, 20 nt, Human
cuggcagccgugccuucagc

SEQ ID NO: 3442290 - RNA, 15 nt, Human
cuggcagccucccau

SEQ ID NO: 3442291 - RNA, 23 nt, Human
cuggcagccucccauccagggcc

SEQ ID NO: 3442292 - RNA, 15 nt, Human
cuggcagcucagaga

SEQ ID NO: 3442293 - RNA, 15 nt, Human
cuggcagcucuccag

SEQ ID NO: 3442294 - RNA, 18 nt, Human
cuggcagcucuccaguca

SEQ ID NO: 3442295 - RNA, 20 nt, Human
cuggcagcucuggacagccc

SEQ ID NO: 3442296 - RNA, 18 nt, Human
cuggcaggaugacccugc

SEQ ID NO: 3442297 - RNA, 12 nt, Human
cuggcaggcagg

SEQ ID NO: 3442298 - RNA, 23 nt, Human
cuggcaggcaggggcccugcagc

SEQ ID NO: 3442299 - RNA, 21 nt, Human
cuggcagggaggucaggcccu

SEQ ID NO: 3442300 - RNA, 13 nt, Human
cuggcagggcugg

SEQ ID NO: 3442301 - RNA, 15 nt, Human
cuggcagggggcaug

SEQ ID NO: 3442302 - RNA, 22 nt, Human
cuggcaguuuauauuuaacucu

SEQ ID NO: 3442303 - RNA, 15 nt, Human
cuggcaguuuuccau

SEQ ID NO: 3442304 - RNA, 22 nt, Human
cuggcaguuuugacaucagcca

SEQ ID NO: 3442305 - RNA, 19 nt, Human
cuggcauacuauguggaug

SEQ ID NO: 3442306 - RNA, 22 nt, Human
cuggcaucaagaggugggaggg

SEQ ID NO: 3442307 - RNA, 23 nt, Human
cuggcaucaagaggugggagggc

SEQ ID NO: 3442308 - RNA, 17 nt, Human
cuggcaucugacacaaa

SEQ ID NO: 3442309 - RNA, 15 nt, Human
cuggcauggcaccug

SEQ ID NO: 3442310 - RNA, 21 nt, Human
cuggcauggugguugggaccc

SEQ ID NO: 3442311 - RNA, 16 nt, Human
cuggcauuacagcugg

SEQ ID NO: 3442312 - RNA, 16 nt, Human
cuguaauuuaguuauu

SEQ ID NO: 3442313 - RNA, 19 nt, Human
cuguaauuuaguuauugau

SEQ ID NO: 3442314 - RNA, 14 nt, Human
cuguaauuugugau

SEQ ID NO: 3442315 - RNA, 15 nt, Human
cuguaauuugugaua

SEQ ID NO: 3442316 - RNA, 23 nt, Human
cuguaauuuuuauuuucacccuc

SEQ ID NO: 3442317 - RNA, 20 nt, Human
cuguacaaaagggacaugaa

SEQ ID NO: 3442318 - RNA, 15 nt, Human
cuguacaaauauaag

SEQ ID NO: 3442319 - RNA, 17 nt, Human
cuguacaaauauaagaa

SEQ ID NO: 3442320 - RNA, 18 nt, Human
cuguacacguguccugua

SEQ ID NO: 3442321 - RNA, 19 nt, Human
cuguacacugaauauuuau

SEQ ID NO: 3442322 - RNA, 15 nt, Human
cuguacacugacuug

SEQ ID NO: 3442323 - RNA, 15 nt, Human
cuguacacugcacga

SEQ ID NO: 3442324 - RNA, 11 nt, Human
cuguacagggg

SEQ ID NO: 3442325 - RNA, 13 nt, Human
cuguacagucugu

SEQ ID NO: 3442326 - RNA, 19 nt, Human
cuguacagucugucuucug

SEQ ID NO: 3442327 - RNA, 16 nt, Human
cuguacagugucuuuu

SEQ ID NO: 3442328 - RNA, 21 nt, Human
cuguacagugucuuuuuuugu

SEQ ID NO: 3442329 - RNA, 16 nt, Human
cuguacauauguaaac

SEQ ID NO: 3442330 - RNA, 13 nt, Human
cuguacauuuaaa

SEQ ID NO: 3442331 - RNA, 21 nt, Human
cuguacauuuuguuguaaaaa

SEQ ID NO: 3442332 - RNA, 14 nt, Human
cuguaccucugccu

SEQ ID NO: 3442333 - RNA, 17 nt, Human
cuguacgacacgggugg

SEQ ID NO: 3442334 - RNA, 14 nt, Human
cuguacgucugaca

SEQ ID NO: 3442335 - RNA, 15 nt, Human
cuguacgucugacag

SEQ ID NO: 3442336 - RNA, 19 nt, Human
cuguacgucugacaggcaa

SEQ ID NO: 3442337 - RNA, 20 nt, Human
cuguacgucugacaggcaau

SEQ ID NO: 3442338 - RNA, 17 nt, Human
cuguacuagagaucugg

SEQ ID NO: 3442339 - RNA, 21 nt, Human
cuguacuagagaucugguuuu

SEQ ID NO: 3442340 - RNA, 15 nt, Human
cuguacuccucccag

SEQ ID NO: 3442341 - RNA, 18 nt, Human
cuguacucuggggugcug

SEQ ID NO: 3442342 - RNA, 20 nt, Human
cuguacugaaguaaaacaaa

SEQ ID NO: 3442343 - RNA, 16 nt, Human
cuguacugacuugagg

SEQ ID NO: 3442344 - RNA, 13 nt, Human
cuguacugauuca

SEQ ID NO: 3442345 - RNA, 12 nt, Human
aaauucccugga

SEQ ID NO: 3442346 - RNA, 20 nt, Human
aaauucccuggaccagaugc

SEQ ID NO: 3442347 - RNA, 15 nt, Human
aaauucccuggccuu

SEQ ID NO: 3442348 - RNA, 16 nt, Human
aaauucccuucaucug

SEQ ID NO: 3442349 - RNA, 23 nt, Human
aaauuccuauugugauuugacug

SEQ ID NO: 3442350 - RNA, 19 nt, Human
aaauuccucuuugcuuugc

SEQ ID NO: 3442351 - RNA, 19 nt, Human
aaauucgcccgagcuguuu

SEQ ID NO: 3442352 - RNA, 15 nt, Human
aaauucguguguuuu

SEQ ID NO: 3442353 - RNA, 22 nt, Human
aaauucuaaauaaaauauaauu

SEQ ID NO: 3442354 - RNA, 14 nt, Human
aaauucuaaaugua

SEQ ID NO: 3442355 - RNA, 14 nt, Human
aaauucuagauuac

SEQ ID NO: 3442356 - RNA, 13 nt, Human
aaauucugaauuu

SEQ ID NO: 3442357 - RNA, 19 nt, Human
aaauucugaauuugcaaag

SEQ ID NO: 3442358 - RNA, 22 nt, Human
aaauucugaauuugcaaaguac

SEQ ID NO: 3442359 - RNA, 15 nt, Human
aaauucugaauuuug

SEQ ID NO: 3442360 - RNA, 20 nt, Human
aaauucugagacauguguca

SEQ ID NO: 3442361 - RNA, 12 nt, Human
aaauucugauuu

SEQ ID NO: 3442362 - RNA, 17 nt, Human
aaauucugauuucuuuu

SEQ ID NO: 3442363 - RNA, 22 nt, Human
aaauucugauuucuuuucacca

SEQ ID NO: 3442364 - RNA, 22 nt, Human
aaauucugugccuuguuuuuug

SEQ ID NO: 3442365 - RNA, 23 nt, Human
aaauugaaaggcauucucugaag

SEQ ID NO: 3442366 - RNA, 19 nt, Human
aaauugaauacuuugaaug

SEQ ID NO: 3442367 - RNA, 20 nt, Human
aaauugaauacuuugaaugu

SEQ ID NO: 3442368 - RNA, 16 nt, Human
aaauugaauuuaacaa

SEQ ID NO: 3442369 - RNA, 18 nt, Human
aaauugaauuuaacaaug

SEQ ID NO: 3442370 - RNA, 22 nt, Human
aaauugacacuuaaaaaugguu

SEQ ID NO: 3442371 - RNA, 15 nt, Human
aaauugacauugcuu

SEQ ID NO: 3442372 - RNA, 19 nt, Human
aaauugaguugcacuuauu

SEQ ID NO: 3442373 - RNA, 14 nt, Human
aaauugauguguuu

SEQ ID NO: 3442374 - RNA, 15 nt, Human
aaauugauguugaug

SEQ ID NO: 3442375 - RNA, 13 nt, Human
aaauugcaaaucu

SEQ ID NO: 3442376 - RNA, 12 nt, Human
aaauugcacaau

SEQ ID NO: 3442377 - RNA, 15 nt, Human
aaauugcauacuuug

SEQ ID NO: 3442378 - RNA, 15 nt, Human
aaauugccauauugc

SEQ ID NO: 3442379 - RNA, 18 nt, Human
aaauugccauauugcaca

SEQ ID NO: 3442380 - RNA, 21 nt, Human
aaauugccauauugcacaugu

SEQ ID NO: 3442381 - RNA, 21 nt, Human
aaauugccauuggacaguugu

SEQ ID NO: 3442382 - RNA, 20 nt, Human
aaauugccuauccugcuguu

SEQ ID NO: 3442383 - RNA, 16 nt, Human
aaauugccuuucugug

SEQ ID NO: 3442384 - RNA, 21 nt, Human
aaauugccuuucuguguuuau

SEQ ID NO: 3442385 - RNA, 23 nt, Human
aaauugcucacaguuauuacaua

SEQ ID NO: 3442386 - RNA, 19 nt, Human
aaauugcugacuguagcuu

SEQ ID NO: 3442387 - RNA, 22 nt, Human
aaauugcugugccucccaaaau

SEQ ID NO: 3442388 - RNA, 23 nt, Human
aaauugcugugcuuuauggauag

SEQ ID NO: 3442389 - RNA, 16 nt, Human
aaauugcuugaaagaa

SEQ ID NO: 3442390 - RNA, 20 nt, Human
aaauuggcauggaaauuuaa

SEQ ID NO: 3442391 - RNA, 17 nt, Human
aaauuggcauuaaaacu

SEQ ID NO: 3442392 - RNA, 15 nt, Human
aaauugggaaaggag

SEQ ID NO: 3442393 - RNA, 19 nt, Human
aaauuggggaggagggggc

SEQ ID NO: 3442394 - RNA, 18 nt, Human
aaauugguaccuugcaca

SEQ ID NO: 3442395 - RNA, 20 nt, Human
aaauugguaccuugcacaca

SEQ ID NO: 3442396 - RNA, 20 nt, Human
aaauugguaucaagaaaguc

SEQ ID NO: 3442397 - RNA, 16 nt, Human
aaauugguucuuuauu

SEQ ID NO: 3442398 - RNA, 15 nt, Human
aaauuguaauuauau

SEQ ID NO: 3442399 - RNA, 14 nt, Human
aaauuguacagccg

SEQ ID NO: 3442400 - RNA, 15 nt, Human
aaauuguacagccgg

SEQ ID NO: 3442401 - RNA, 16 nt, Human
aaauuguauauucacu

SEQ ID NO: 3442402 - RNA, 17 nt, Human
aaauuguauauucacuu

SEQ ID NO: 3442403 - RNA, 19 nt, Human
aaauuguauauuguaauuu

SEQ ID NO: 3442404 - RNA, 13 nt, Human
aaauugucagcaa

SEQ ID NO: 3442405 - RNA, 22 nt, Human
aaauugucuuuaaaaacuguuu

SEQ ID NO: 3442406 - RNA, 18 nt, Human
aaauugucuuuugucaug

SEQ ID NO: 3442407 - RNA, 21 nt, Human
aaauugucuuuugucaugugg

SEQ ID NO: 3442408 - RNA, 19 nt, Human
aaauugugaacucauugcu

SEQ ID NO: 3442409 - RNA, 12 nt, Human
aaauugugaugu

SEQ ID NO: 3442410 - RNA, 16 nt, Human
aaauuguuaucaaaau

SEQ ID NO: 3442411 - RNA, 22 nt, Human
aaauuguuguccgguuuacuuu

SEQ ID NO: 3442412 - RNA, 15 nt, Human
aaauuguuuagugau

SEQ ID NO: 3442413 - RNA, 23 nt, Human
aaauuguuuagugauauuacauu

SEQ ID NO: 3442414 - RNA, 20 nt, Human
aaauuguuuugagcuuucca

SEQ ID NO: 3442415 - RNA, 19 nt, Human
aaauuuaaaaaauaaauaa

SEQ ID NO: 3442416 - RNA, 18 nt, Human
aaauuuaaaacaaacaac

SEQ ID NO: 3442417 - RNA, 13 nt, Human
aaauuuaaacauu

SEQ ID NO: 3442418 - RNA, 14 nt, Human
aaauuuaaacauua

SEQ ID NO: 3442419 - RNA, 13 nt, Human
aaauuuaaagaua

SEQ ID NO: 3442420 - RNA, 13 nt, Human
aaauuuaaagcag

SEQ ID NO: 3442421 - RNA, 21 nt, Human
aaauuuaaagcagguucuugu

SEQ ID NO: 3442422 - RNA, 23 nt, Human
aaauuuaaaggguguacuuauau

SEQ ID NO: 3442423 - RNA, 12 nt, Human
aaauuuaagcau

SEQ ID NO: 3442424 - RNA, 13 nt, Human
aaauuuaagcauu

SEQ ID NO: 3442425 - RNA, 14 nt, Human
aaauuuaagcauug

SEQ ID NO: 3442426 - RNA, 16 nt, Human
aaauuuaagcauuguu

SEQ ID NO: 3442427 - RNA, 23 nt, Human
aaauuuaaguaucuuuuuucaaa

SEQ ID NO: 3442428 - RNA, 21 nt, Human
aaauuuaauaccagauaccuu

SEQ ID NO: 3442429 - RNA, 13 nt, Human
aaauuuacuauau

SEQ ID NO: 3442430 - RNA, 15 nt, Human
aaauuuacuauauau

SEQ ID NO: 3442431 - RNA, 21 nt, Human
aaauuuacugucuaagauuaa

SEQ ID NO: 3442432 - RNA, 20 nt, Human
aaauuuaguauuuuguuuca

SEQ ID NO: 3442433 - RNA, 10 nt, Human
aaauuuauaa

SEQ ID NO: 3442434 - RNA, 19 nt, Human
aaauuuauaauuuuaagau

SEQ ID NO: 3442435 - RNA, 20 nt, Human
aaauuuauauguauccagua

SEQ ID NO: 3442436 - RNA, 23 nt, Human
aaauuuaucaaagcauagauguu

SEQ ID NO: 3442437 - RNA, 23 nt, Human
aaauuuaugguuuugguauuuuu

SEQ ID NO: 3442438 - RNA, 15 nt, Human
aaauuuauugaggaa

SEQ ID NO: 3442439 - RNA, 20 nt, Human
aaauuuauugaggaaaaaua

SEQ ID NO: 3442440 - RNA, 19 nt, Human
aaauuuauuuccaauguuu

SEQ ID NO: 3442441 - RNA, 13 nt, Human
aaauuucaaaaga

SEQ ID NO: 3442442 - RNA, 16 nt, Human
aaauuucaaaagacau

SEQ ID NO: 3442443 - RNA, 12 nt, Human
aaauuucagauu

SEQ ID NO: 3442444 - RNA, 17 nt, Human
aaauuucagcagcugca

SEQ ID NO: 3442445 - RNA, 19 nt, Human
aaauuuccagugagcuuau

SEQ ID NO: 3442446 - RNA, 22 nt, Human
aaauuuccccaacagugugaag

SEQ ID NO: 3442447 - RNA, 13 nt, Human
aaauuucuaaauc

SEQ ID NO: 3442448 - RNA, 22 nt, Human
aaauuucuagccugcacuuuga

SEQ ID NO: 3442449 - RNA, 23 nt, Human
aaauuucucaucacagggauuua

SEQ ID NO: 3442450 - RNA, 17 nt, Human
aaauuucucuacugucu

SEQ ID NO: 3442451 - RNA, 14 nt, Human
aaauuucuggaccu

SEQ ID NO: 3442452 - RNA, 11 nt, Human
aaauuucuuau

SEQ ID NO: 3442453 - RNA, 17 nt, Human
aaauuucuuaugugaca

SEQ ID NO: 3442454 - RNA, 20 nt, Human
aaauuugaaacauugcuuuu

SEQ ID NO: 3442455 - RNA, 23 nt, Human
aaauuugaaacauugcuuuuaaa

SEQ ID NO: 3442456 - RNA, 15 nt, Human
cugucccucaaauga

SEQ ID NO: 3442457 - RNA, 23 nt, Human
cugucccucaaaugacccaaaga

SEQ ID NO: 3442458 - RNA, 12 nt, Human
cugucccucaca

SEQ ID NO: 3442459 - RNA, 21 nt, Human
cugucccuccgggaccuggug

SEQ ID NO: 3442460 - RNA, 13 nt, Human
cugucccuccugg

SEQ ID NO: 3442461 - RNA, 16 nt, Human
cugucccucucaggca

SEQ ID NO: 3442462 - RNA, 11 nt, Human
cugucccugcg

SEQ ID NO: 3442463 - RNA, 13 nt, Human
cugucccugcgcc

SEQ ID NO: 3442464 - RNA, 18 nt, Human
cugucccuggccaucucu

SEQ ID NO: 3442465 - RNA, 12 nt, Human
cugucccuguca

SEQ ID NO: 3442466 - RNA, 15 nt, Human
cugucccugucacca

SEQ ID NO: 3442467 - RNA, 17 nt, Human
cugucccugucaccaag

SEQ ID NO: 3442468 - RNA, 18 nt, Human
cugucccuucugucccuc

SEQ ID NO: 3442469 - RNA, 19 nt, Human
cugucccuucugucccuca

SEQ ID NO: 3442470 - RNA, 20 nt, Human
cugucccuugccccccuggc

SEQ ID NO: 3442471 - RNA, 15 nt, Human
cugucccuugccuca

SEQ ID NO: 3442472 - RNA, 18 nt, Human
cugucccuugcuguaugc

SEQ ID NO: 3442473 - RNA, 17 nt, Human
cugucccuugcuugccu

SEQ ID NO: 3442474 - RNA, 18 nt, Human
cugucccuugcuugccug

SEQ ID NO: 3442475 - RNA, 14 nt, Human
cuguccgagcuuug

SEQ ID NO: 3442476 - RNA, 18 nt, Human
cuguccgagugugccaca

SEQ ID NO: 3442477 - RNA, 21 nt, Human
cuguccggaaugccacccaca

SEQ ID NO: 3442478 - RNA, 17 nt, Human
cuguccuaaggaaccuu

SEQ ID NO: 3442479 - RNA, 12 nt, Human
cuguccuaccuu

SEQ ID NO: 3442480 - RNA, 21 nt, Human
cuguccuacucugugucaggu

SEQ ID NO: 3442481 - RNA, 15 nt, Human
cuguccuaggccaca

SEQ ID NO: 3442482 - RNA, 15 nt, Human
cuguccuauuauauu

SEQ ID NO: 3442483 - RNA, 13 nt, Human
cuguccucacugc

SEQ ID NO: 3442484 - RNA, 14 nt, Human
cuguccucacugcu

SEQ ID NO: 3442485 - RNA, 21 nt, Human
cuguccucagccuugccagag

SEQ ID NO: 3442486 - RNA, 22 nt, Human
cuguccucagccuugccagaga

SEQ ID NO: 3442487 - RNA, 12 nt, Human
cuguccucaggu

SEQ ID NO: 3442488 - RNA, 17 nt, Human
cuguccucagguggcca

SEQ ID NO: 3442489 - RNA, 12 nt, Human
cuguccuccaag

SEQ ID NO: 3442490 - RNA, 15 nt, Human
cuguccuccaagcca

SEQ ID NO: 3442491 - RNA, 17 nt, Human
cuguccuccaagccagc

SEQ ID NO: 3442492 - RNA, 16 nt, Human
cuguccucccaucccc

SEQ ID NO: 3442493 - RNA, 21 nt, Human
cuguccucccgagcuccucuu

SEQ ID NO: 3442494 - RNA, 14 nt, Human
cuguccuccuggug

SEQ ID NO: 3442495 - RNA, 19 nt, Human
cuguccuccuggugggucc

SEQ ID NO: 3442496 - RNA, 21 nt, Human
cuguccuccugguggguccag

SEQ ID NO: 3442497 - RNA, 17 nt, Human
cuguccucuccccucca

SEQ ID NO: 3442498 - RNA, 21 nt, Human
cuguccucuccccuccagccu

SEQ ID NO: 3442499 - RNA, 16 nt, Human
cuguccucuuucagaa

SEQ ID NO: 3442500 - RNA, 18 nt, Human
cuguccucuuucagcucc

SEQ ID NO: 3442501 - RNA, 21 nt, Human
cuguccucuuucagcuccuga

SEQ ID NO: 3442502 - RNA, 22 nt, Human
cuguccucuuucagcuccugac

SEQ ID NO: 3442503 - RNA, 20 nt, Human
cuguccugacuucaggggcu

SEQ ID NO: 3442504 - RNA, 13 nt, Human
cuguccugcagca

SEQ ID NO: 3442505 - RNA, 17 nt, Human
cuguccugccacccagc

SEQ ID NO: 3442506 - RNA, 20 nt, Human
cuguccugccaugcaagaac

SEQ ID NO: 3442507 - RNA, 19 nt, Human
cuguccugcuccacagugu

SEQ ID NO: 3442508 - RNA, 13 nt, Human
cuguccugcuggu

SEQ ID NO: 3442509 - RNA, 14 nt, Human
cuguccugggagug

SEQ ID NO: 3442510 - RNA, 11 nt, Human
cuguccugggc

SEQ ID NO: 3442511 - RNA, 18 nt, Human
cuguccugggcgcccugg

SEQ ID NO: 3442512 - RNA, 21 nt, Human
cuguccugggcgcccuggaag

SEQ ID NO: 3442513 - RNA, 23 nt, Human
cuguccugggcgcccuggaagcc

SEQ ID NO: 3442514 - RNA, 12 nt, Human
ccugcccuggga

SEQ ID NO: 3442515 - RNA, 20 nt, Human
ccugcccugggaggcaguga

SEQ ID NO: 3442516 - RNA, 12 nt, Human
ccugcccugguc

SEQ ID NO: 3442517 - RNA, 15 nt, Human
ccugcccugguccag

SEQ ID NO: 3442518 - RNA, 19 nt, Human
ccugcccugguuuccugcc

SEQ ID NO: 3442519 - RNA, 23 nt, Human
ccugcccugguuuccugcccugg

SEQ ID NO: 3442520 - RNA, 15 nt, Human
ccugcccugugggcc

SEQ ID NO: 3442521 - RNA, 21 nt, Human
ccugcccuguuguguauagau

SEQ ID NO: 3442522 - RNA, 16 nt, Human
ccugcccuucagcauc

SEQ ID NO: 3442523 - RNA, 16 nt, Human
ccugcccuugucugag

SEQ ID NO: 3442524 - RNA, 16 nt, Human
ccugccgacuccuggg

SEQ ID NO: 3442525 - RNA, 22 nt, Human
ccugccgagcaaccguggcccu

SEQ ID NO: 3442526 - RNA, 16 nt, Human
ccugccgcagagcugg

SEQ ID NO: 3442527 - RNA, 21 nt, Human
ccugccgcccgagguggcugc

SEQ ID NO: 3442528 - RNA, 16 nt, Human
ccugccggagaggaag

SEQ ID NO: 3442529 - RNA, 21 nt, Human
ccugccggagaggaagagaca

SEQ ID NO: 3442530 - RNA, 19 nt, Human
ccugccggccccggccgcc

SEQ ID NO: 3442531 - RNA, 16 nt, Human
ccugccgucaccacca

SEQ ID NO: 3442532 - RNA, 23 nt, Human
ccugccguggacuuggggucaga

SEQ ID NO: 3442533 - RNA, 20 nt, Human
ccugccuagcacucacaugc

SEQ ID NO: 3442534 - RNA, 16 nt, Human
ccugccucaccacgga

SEQ ID NO: 3442535 - RNA, 12 nt, Human
ccugccucagcc

SEQ ID NO: 3442536 - RNA, 14 nt, Human
ccugccuccacccu

SEQ ID NO: 3442537 - RNA, 19 nt, Human
ccugccuccacccucugag

SEQ ID NO: 3442538 - RNA, 20 nt, Human
ccugccuccacccucugagc

SEQ ID NO: 3442539 - RNA, 17 nt, Human
ccugccuccuugauauu

SEQ ID NO: 3442540 - RNA, 23 nt, Human
ccugccuccuuugugaggaagcc

SEQ ID NO: 3442541 - RNA, 23 nt, Human
ccugccucgaacuggcugcaaag

SEQ ID NO: 3442542 - RNA, 12 nt, Human
ccugccucuacu

SEQ ID NO: 3442543 - RNA, 17 nt, Human
ccugccucucacacaca

SEQ ID NO: 3442544 - RNA, 20 nt, Human
ccugccucucaucaacugaa

SEQ ID NO: 3442545 - RNA, 15 nt, Human
ccugccucucccagg

SEQ ID NO: 3442546 - RNA, 21 nt, Human
ccugccucuccgccccugagc

SEQ ID NO: 3442547 - RNA, 20 nt, Human
ccugccucucugcagguccc

SEQ ID NO: 3442548 - RNA, 15 nt, Human
ccugccucuguuuga

SEQ ID NO: 3442549 - RNA, 19 nt, Human
ccugccugagggccccucu

SEQ ID NO: 3442550 - RNA, 16 nt, Human
ccugccugcccuggug

SEQ ID NO: 3442551 - RNA, 19 nt, Human
ccugccugcccugucagga

SEQ ID NO: 3442552 - RNA, 18 nt, Human
ccugccugcgucuuccgc

SEQ ID NO: 3442553 - RNA, 23 nt, Human
ccugccuggacuuggccccugcc

SEQ ID NO: 3442554 - RNA, 12 nt, Human
ccugccuggagc

SEQ ID NO: 3442555 - RNA, 14 nt, Human
ccugccuggaggac

SEQ ID NO: 3442556 - RNA, 21 nt, Human
ccugccuggaggaccugagcc

SEQ ID NO: 3442557 - RNA, 22 nt, Human
ccugccuggaggaccugagccu

SEQ ID NO: 3442558 - RNA, 23 nt, Human
ccugccuggaggaccugagccug

SEQ ID NO: 3442559 - RNA, 18 nt, Human
ccugccuggccaggcaga

SEQ ID NO: 3442560 - RNA, 23 nt, Human
ccugccuggccaggcagaucugu

SEQ ID NO: 3442561 - RNA, 15 nt, Human
ccugccuggccccuc

SEQ ID NO: 3442562 - RNA, 23 nt, Human
ccugccuguggcgccgucuccag

SEQ ID NO: 3442563 - RNA, 14 nt, Human
ccugccuguugggc

SEQ ID NO: 3442564 - RNA, 20 nt, Human
ccugccuguugggccaggag

SEQ ID NO: 3442565 - RNA, 22 nt, Human
ccugccuguugggccaggagcc

SEQ ID NO: 3442566 - RNA, 23 nt, Human
ccugccuguugggccaggagccu

SEQ ID NO: 3442567 - RNA, 19 nt, Human
ccugccuuagagccaggca

SEQ ID NO: 3442568 - RNA, 14 nt, Human
ccugccuucaugga

SEQ ID NO: 3442569 - RNA, 14 nt, Human
ccugccuuccuccu

SEQ ID NO: 3442570 - RNA, 17 nt, Human
ccugccuuccuccuggg

SEQ ID NO: 3442571 - RNA, 21 nt, Human
ccugccuucuguccugguguc

SEQ ID NO: 3442572 - RNA, 22 nt, Human
ccugccuucuucuuuuugcugu

SEQ ID NO: 3442573 - RNA, 13 nt, Human
ccugccuugaagc

SEQ ID NO: 3442574 - RNA, 19 nt, Human
ccugccuugaagccacuga

SEQ ID NO: 3442575 - RNA, 23 nt, Human
ccugccuugaagccacugaagcu

SEQ ID NO: 3442576 - RNA, 21 nt, Human
ccugccuugcccacuccugcu

SEQ ID NO: 3442577 - RNA, 22 nt, Human
ccugccuuggggaaggucuccc

SEQ ID NO: 3442578 - RNA, 11 nt, Human
ccugccuuugc

SEQ ID NO: 3442579 - RNA, 14 nt, Human
ccugccuuugccuc

SEQ ID NO: 3442580 - RNA, 22 nt, Human
ccugccuuuuaguuccugugca

SEQ ID NO: 3442581 - RNA, 19 nt, Human
ccugcgaaggggcccuggu

SEQ ID NO: 3442582 - RNA, 21 nt, Human
ccugcgacccugggggcacag

SEQ ID NO: 3442583 - RNA, 19 nt, Human
ccugcgagggcagcgggag

SEQ ID NO: 3442584 - RNA, 20 nt, Human
ccugcgcccaccccgcucug

SEQ ID NO: 3442585 - RNA, 20 nt, Human
ccugcgcgcaugugcgcaca

SEQ ID NO: 3442586 - RNA, 21 nt, Human
ccugcgcgggaccaucuggaa

SEQ ID NO: 3442587 - RNA, 17 nt, Human
ccugcgcucucuuugca

SEQ ID NO: 3442588 - RNA, 20 nt, Human
ccugcggagugaagaggggc

SEQ ID NO: 3442589 - RNA, 22 nt, Human
ccugcggagugaagaggggcag

SEQ ID NO: 3442590 - RNA, 16 nt, Human
ccugcggcugcugugu

SEQ ID NO: 3442591 - RNA, 12 nt, Human
ccugcgggcugc

SEQ ID NO: 3442592 - RNA, 22 nt, Human
ccugcgggucacaggagggagg

SEQ ID NO: 3442593 - RNA, 23 nt, Human
ccugcgggugaacaaagcagcca

SEQ ID NO: 3442594 - RNA, 20 nt, Human
ccugcggguggggcuugggg

SEQ ID NO: 3442595 - RNA, 23 nt, Human
ccugcgguagaugggagggaggc

SEQ ID NO: 3442596 - RNA, 14 nt, Human
ccugcggucaaggc

SEQ ID NO: 3442597 - RNA, 17 nt, Human
ccugcggucaaggccag

SEQ ID NO: 3442598 - RNA, 14 nt, Human
ccugcgucuuccgc

SEQ ID NO: 3442599 - RNA, 17 nt, Human
ccugcgucuuccgcccc

SEQ ID NO: 3442600 - RNA, 16 nt, Human
ccuggugaauggccuu

SEQ ID NO: 3442601 - RNA, 20 nt, Human
ccuggugaauggccuuccuu

SEQ ID NO: 3442602 - RNA, 21 nt, Human
ccuggugagagggccgggcag

SEQ ID NO: 3442603 - RNA, 10 nt, Human
ccuggugccc

SEQ ID NO: 3442604 - RNA, 22 nt, Human
ccuggugccccccaccccugga

SEQ ID NO: 3442605 - RNA, 18 nt, Human
ccuggugcccuggaugcc

SEQ ID NO: 3442606 - RNA, 22 nt, Human
ccuggugcccuggaugcccagg

SEQ ID NO: 3442607 - RNA, 13 nt, Human
ccuggugcucucu

SEQ ID NO: 3442608 - RNA, 16 nt, Human
ccuggugcucucugcc

SEQ ID NO: 3442609 - RNA, 15 nt, Human
ccuggugcugccaca

SEQ ID NO: 3442610 - RNA, 18 nt, Human
ccuggugcugccacacuu

SEQ ID NO: 3442611 - RNA, 21 nt, Human
ccuggugcugccacacuucag

SEQ ID NO: 3442612 - RNA, 18 nt, Human
ccugguggacaguccugg

SEQ ID NO: 3442613 - RNA, 19 nt, Human
ccugguggacaguccuggg

SEQ ID NO: 3442614 - RNA, 20 nt, Human
ccugguggacaguccuggga

SEQ ID NO: 3442615 - RNA, 12 nt, Human
ccugguggagaa

SEQ ID NO: 3442616 - RNA, 17 nt, Human
ccugguggcagcucacc

SEQ ID NO: 3442617 - RNA, 18 nt, Human
ccugguggcagcucaccu

SEQ ID NO: 3442618 - RNA, 21 nt, Human
ccugguggcagcucaccucuc

SEQ ID NO: 3442619 - RNA, 22 nt, Human
ccugguggcagcucaccucucc

SEQ ID NO: 3442620 - RNA, 18 nt, Human
ccugguggcagcugcggu

SEQ ID NO: 3442621 - RNA, 19 nt, Human
ccugguggcagugggagcu

SEQ ID NO: 3442622 - RNA, 20 nt, Human
ccugguggccaugcuccucu

SEQ ID NO: 3442623 - RNA, 12 nt, Human
ccugguggcccu

SEQ ID NO: 3442624 - RNA, 22 nt, Human
ccugguggcccucuccccugcc

SEQ ID NO: 3442625 - RNA, 17 nt, Human
ccugguggccucugccc

SEQ ID NO: 3442626 - RNA, 20 nt, Human
ccuggugggccuccucuguc

SEQ ID NO: 3442627 - RNA, 15 nt, Human
ccugguggggcagcu

SEQ ID NO: 3442628 - RNA, 18 nt, Human
ccugguggggcagcuccu

SEQ ID NO: 3442629 - RNA, 19 nt, Human
ccugguggggcagcuccuc

SEQ ID NO: 3442630 - RNA, 19 nt, Human
ccugguggguccaggggcc

SEQ ID NO: 3442631 - RNA, 16 nt, Human
ccuggugguauuuuca

SEQ ID NO: 3442632 - RNA, 18 nt, Human
ccuggugguauuuucaau

SEQ ID NO: 3442633 - RNA, 18 nt, Human
ccuggugguggcucggga

SEQ ID NO: 3442634 - RNA, 15 nt, Human
ccuggugguuucugu

SEQ ID NO: 3442635 - RNA, 16 nt, Human
ccuggugucaccccag

SEQ ID NO: 3442636 - RNA, 17 nt, Human
ccuggugucaccccaga

SEQ ID NO: 3442637 - RNA, 18 nt, Human
ccuggugucaccccagag

SEQ ID NO: 3442638 - RNA, 19 nt, Human
ccuggugucaccccagagc

SEQ ID NO: 3442639 - RNA, 21 nt, Human
ccugguguuucuagcacuggc

SEQ ID NO: 3442640 - RNA, 23 nt, Human
ccugguguuucuagcacuggccu

SEQ ID NO: 3442641 - RNA, 15 nt, Human
ccugguucugaugau

SEQ ID NO: 3442642 - RNA, 15 nt, Human
ccugguuggguggca

SEQ ID NO: 3442643 - RNA, 18 nt, Human
ccugguuucacuggccca

SEQ ID NO: 3442644 - RNA, 18 nt, Human
ccugguuuccugcccugg

SEQ ID NO: 3442645 - RNA, 14 nt, Human
ccuguaaaacuuua

SEQ ID NO: 3442646 - RNA, 19 nt, Human
ccuguaaacacucagcugu

SEQ ID NO: 3442647 - RNA, 12 nt, Human
ccuguaaaccug

SEQ ID NO: 3442648 - RNA, 12 nt, Human
ccuguaaauuau

SEQ ID NO: 3442649 - RNA, 18 nt, Human
ccuguaaauuauuuuaaa

SEQ ID NO: 3442650 - RNA, 20 nt, Human
ccuguaacacaagccacaga

SEQ ID NO: 3442651 - RNA, 21 nt, Human
ccuguaacacaagccacagaa

SEQ ID NO: 3442652 - RNA, 23 nt, Human
ccuguaacacaagccacagaagc

SEQ ID NO: 3442653 - RNA, 15 nt, Human
ccuguaagccaaaga

SEQ ID NO: 3442654 - RNA, 16 nt, Human
ccuguaagccugcaag

SEQ ID NO: 3442655 - RNA, 15 nt, Human
ccuguaaucacagcu

SEQ ID NO: 3442656 - RNA, 13 nt, Human
ccuguaaucccag

SEQ ID NO: 3442657 - RNA, 15 nt, Human
ccuguaaucccagca

SEQ ID NO: 3442658 - RNA, 21 nt, Human
ccuguaaucccagcacuuugg

SEQ ID NO: 3442659 - RNA, 23 nt, Human
ccuguaaucccagcacuuuggga

SEQ ID NO: 3442660 - RNA, 23 nt, Human
ccuguaaucccagcuacucagga

SEQ ID NO: 3442661 - RNA, 20 nt, Human
ccuguaauccuagcacuuug

SEQ ID NO: 3442662 - RNA, 23 nt, Human
ccuguaauuccuaccucccugca

SEQ ID NO: 3442663 - RNA, 14 nt, Human
ccuguacaguagau

SEQ ID NO: 3442664 - RNA, 12 nt, Human
ccuguacagucu

SEQ ID NO: 3442665 - RNA, 19 nt, Human
ccuguacagucugucuucu

SEQ ID NO: 3442666 - RNA, 16 nt, Human
ccuguacauuguggga

SEQ ID NO: 3442667 - RNA, 14 nt, Human
ccuguaccccagca

SEQ ID NO: 3442668 - RNA, 10 nt, Human
ccuguaccuc

SEQ ID NO: 3442669 - RNA, 22 nt, Human
ccuguaccuuuugaggagcccc

SEQ ID NO: 3442670 - RNA, 15 nt, Human
ccuguacucaggagg

SEQ ID NO: 3442671 - RNA, 13 nt, Human
ccuguacugccug

SEQ ID NO: 3442672 - RNA, 17 nt, Human
ccuguacugccugcuug

SEQ ID NO: 3442673 - RNA, 18 nt, Human
ccuguacuguucuguguc

SEQ ID NO: 3442674 - RNA, 22 nt, Human
ccuguagaacucaaccucuaca

SEQ ID NO: 3442675 - RNA, 22 nt, Human
ccuguagaccuagggaggaccu

SEQ ID NO: 3442676 - RNA, 14 nt, Human
ccuguagagcuaga

SEQ ID NO: 3442677 - RNA, 16 nt, Human
ccuguagaguugcuga

SEQ ID NO: 3442678 - RNA, 21 nt, Human
ccuguagauucagguaauaca

SEQ ID NO: 3442679 - RNA, 18 nt, Human
ccuguagcaucuucugga

SEQ ID NO: 3442680 - RNA, 21 nt, Human
ccuguagcaucuucuggaguc

SEQ ID NO: 3442681 - RNA, 20 nt, Human
ccuguaggaagguacuguau

SEQ ID NO: 3442682 - RNA, 13 nt, Human
ccuguagucccag

SEQ ID NO: 3442683 - RNA, 15 nt, Human
ccuguagucccagcu

SEQ ID NO: 3442684 - RNA, 16 nt, Human
ccuguagucccagcua

SEQ ID NO: 3442685 - RNA, 14 nt, Human
ccuguaguuaggaa

SEQ ID NO: 3442686 - RNA, 16 nt, Human
ccuguaguuaggaaau

SEQ ID NO: 3442687 - RNA, 19 nt, Human
ccuguaguuaggaaauaaa

SEQ ID NO: 3442688 - RNA, 22 nt, Human
ccuguauaaguggaggcacuuu

SEQ ID NO: 3442689 - RNA, 15 nt, Human
ccuguauacagugca

SEQ ID NO: 3442690 - RNA, 19 nt, Human
ccuguauaccuccuccagc

SEQ ID NO: 3442691 - RNA, 16 nt, Human
ccuguauauagcccag

SEQ ID NO: 3442692 - RNA, 21 nt, Human
ccuguauauagcccagccagg

SEQ ID NO: 3442693 - RNA, 19 nt, Human
ccuguauauuuguaaagcu

SEQ ID NO: 3442694 - RNA, 14 nt, Human
ccuguaucuuucua

SEQ ID NO: 3442695 - RNA, 21 nt, Human
ccuguaucuuucuaugcugcu

SEQ ID NO: 3442696 - RNA, 19 nt, Human
ccuguaugcaacaggcacu

SEQ ID NO: 3442697 - RNA, 23 nt, Human
ccuguauuccugaccuccgccau

SEQ ID NO: 3442698 - RNA, 23 nt, Human
ccuguauuuaaaaauagaaacau

SEQ ID NO: 3442699 - RNA, 16 nt, Human
ccuguauuuaagcaaa

SEQ ID NO: 3442700 - RNA, 17 nt, Human
ccuguauuuaagcaaau

SEQ ID NO: 3442701 - RNA, 20 nt, Human
ccuguauuuaagcaaauacu

SEQ ID NO: 3442702 - RNA, 16 nt, Human
ccuguauuuguuccca

SEQ ID NO: 3442703 - RNA, 21 nt, Human
ccuguauuuguucccaagagc

SEQ ID NO: 3442704 - RNA, 16 nt, Human
ccugucaaacauuagu

SEQ ID NO: 3442705 - RNA, 14 nt, Human
ccugucaccucuuc

SEQ ID NO: 3442706 - RNA, 16 nt, Human
ccugucaccucuuccg

SEQ ID NO: 3442707 - RNA, 19 nt, Human
ccugucagauccaggagcu

SEQ ID NO: 3442708 - RNA, 13 nt, Human
ccugucaggaggc

SEQ ID NO: 3442709 - RNA, 16 nt, Human
ccugucaggaggcaga

SEQ ID NO: 3442710 - RNA, 16 nt, Human
ccugucagugcagccc

SEQ ID NO: 3442711 - RNA, 15 nt, Human
ccugucagugccgcc

SEQ ID NO: 3442712 - RNA, 20 nt, Human
ccugucauccagcucacuca

SEQ ID NO: 3442713 - RNA, 12 nt, Human
ccuguccaaccu

SEQ ID NO: 3442714 - RNA, 19 nt, Human
ccuguccaaccuaaccccu

SEQ ID NO: 3442715 - RNA, 16 nt, Human
ccuguccacacccagc

SEQ ID NO: 3442716 - RNA, 14 nt, Human
ccuguccacaggcu

SEQ ID NO: 3442717 - RNA, 18 nt, Human
ccuguccacaggcuucug

SEQ ID NO: 3442718 - RNA, 21 nt, Human
ccuguccacaggcuucugagc

SEQ ID NO: 3442719 - RNA, 22 nt, Human
ccuguccagccugggcagccag

SEQ ID NO: 3442720 - RNA, 16 nt, Human
ccugucccacccccuu

SEQ ID NO: 3442721 - RNA, 16 nt, Human
ccugucccaugcaggc

SEQ ID NO: 3442722 - RNA, 19 nt, Human
ccugucccaugcaggcccu

SEQ ID NO: 3442723 - RNA, 23 nt, Human
ccugucccauggacacuccagug

SEQ ID NO: 3442724 - RNA, 17 nt, Human
ccuguccccacccucca

SEQ ID NO: 3442725 - RNA, 17 nt, Human
cugugauggggcccugc

SEQ ID NO: 3442726 - RNA, 16 nt, Human
cugugauugugccuac

SEQ ID NO: 3442727 - RNA, 16 nt, Human
cugugcaaaaaaauua

SEQ ID NO: 3442728 - RNA, 21 nt, Human
cugugcaaccucuuggccuga

SEQ ID NO: 3442729 - RNA, 17 nt, Human
cugugcaacgccguggg

SEQ ID NO: 3442730 - RNA, 18 nt, Human
cugugcaacggucuccug

SEQ ID NO: 3442731 - RNA, 16 nt, Human
cugugcaaggccuggu

SEQ ID NO: 3442732 - RNA, 19 nt, Human
cugugcacaaaacccagac

SEQ ID NO: 3442733 - RNA, 20 nt, Human
cugugcacaaaacccagacc

SEQ ID NO: 3442734 - RNA, 20 nt, Human
cugugcacacacacacacau

SEQ ID NO: 3442735 - RNA, 21 nt, Human
cugugcacacacacacacaug

SEQ ID NO: 3442736 - RNA, 17 nt, Human
cugugcacacccaccuu

SEQ ID NO: 3442737 - RNA, 21 nt, Human
cugugcacaucugugucuugu

SEQ ID NO: 3442738 - RNA, 14 nt, Human
cugugcaccaagca

SEQ ID NO: 3442739 - RNA, 19 nt, Human
cugugcacccagaagaaga

SEQ ID NO: 3442740 - RNA, 17 nt, Human
cugugcacggccagcug

SEQ ID NO: 3442741 - RNA, 14 nt, Human
cugugcacugccca

SEQ ID NO: 3442742 - RNA, 16 nt, Human
cugugcagccgcugag

SEQ ID NO: 3442743 - RNA, 23 nt, Human
cugugcagccuguccugggcugg

SEQ ID NO: 3442744 - RNA, 14 nt, Human
cuuaugaaaagaau

SEQ ID NO: 3442745 - RNA, 21 nt, Human
cuuaugaaaagaauuguuggg

SEQ ID NO: 3442746 - RNA, 18 nt, Human
cuuaugaaugauuugcau

SEQ ID NO: 3442747 - RNA, 20 nt, Human
cuuaugaaugauuugcauau

SEQ ID NO: 3442748 - RNA, 15 nt, Human
cuuaugaauguuucc

SEQ ID NO: 3442749 - RNA, 21 nt, Human
cuuaugauuaaacuuccuucu

SEQ ID NO: 3442750 - RNA, 14 nt, Human
cuuaugcaaaaugg

SEQ ID NO: 3442751 - RNA, 15 nt, Human
cuuaugccauuuguu

SEQ ID NO: 3442752 - RNA, 17 nt, Human
cuuaugcgguuaauuuu

SEQ ID NO: 3442753 - RNA, 12 nt, Human
cuuaugcucuua

SEQ ID NO: 3442754 - RNA, 22 nt, Human
cuuaugcucuuaauugccaccu

SEQ ID NO: 3442755 - RNA, 12 nt, Human
cuuaugcuucca

SEQ ID NO: 3442756 - RNA, 20 nt, Human
cuuauggaacacucugagac

SEQ ID NO: 3442757 - RNA, 21 nt, Human
cuuauggaacacucugagacu

SEQ ID NO: 3442758 - RNA, 17 nt, Human
cuuauggaauugauuug

SEQ ID NO: 3442759 - RNA, 20 nt, Human
cuuauggaauugauuugcau

SEQ ID NO: 3442760 - RNA, 18 nt, Human
cuuauggauguccccagc

SEQ ID NO: 3442761 - RNA, 22 nt, Human
cuuaugggcuggguucuaccca

SEQ ID NO: 3442762 - RNA, 15 nt, Human
cuuauguaccucuuu

SEQ ID NO: 3442763 - RNA, 17 nt, Human
cuuauguagauauuugg

SEQ ID NO: 3442764 - RNA, 13 nt, Human
cuuaugugacauu

SEQ ID NO: 3442765 - RNA, 20 nt, Human
cuuauguggguugccuggug

SEQ ID NO: 3442766 - RNA, 16 nt, Human
cuuauguugaaaaaau

SEQ ID NO: 3442767 - RNA, 17 nt, Human
cuuauguugaaaaaauu

SEQ ID NO: 3442768 - RNA, 13 nt, Human
cuuauuaaaguuc

SEQ ID NO: 3442769 - RNA, 16 nt, Human
cuuauuaaaguuucaa

SEQ ID NO: 3442770 - RNA, 17 nt, Human
cuuauuaaaguuucaaa

SEQ ID NO: 3442771 - RNA, 22 nt, Human
cuuauuaaaguuucaaaaaucu

SEQ ID NO: 3442772 - RNA, 14 nt, Human
cuuauuaaugcuaa

SEQ ID NO: 3442773 - RNA, 16 nt, Human
cuuauuacauuuuauu

SEQ ID NO: 3442774 - RNA, 20 nt, Human
cuuauuagagugucuuucca

SEQ ID NO: 3442775 - RNA, 17 nt, Human
cuuauuagggagaaaau

SEQ ID NO: 3442776 - RNA, 19 nt, Human
cuuauucagcaccaagcau

SEQ ID NO: 3442777 - RNA, 21 nt, Human
cuuauucaggaaaagccucug

SEQ ID NO: 3442778 - RNA, 14 nt, Human
cuuauucauuuucu

SEQ ID NO: 3442779 - RNA, 19 nt, Human
cuuauucauuuucucuaau

SEQ ID NO: 3442780 - RNA, 24 nt, Human
ccuucaguacccucucagcuccag

SEQ ID NO: 3442781 - RNA, 21 nt, Human
ccuucagucuugaauuucuaa

SEQ ID NO: 3442782 - RNA, 11 nt, Human
ccuucagugcc

SEQ ID NO: 3442783 - RNA, 16 nt, Human
ccuucagugcccacca

SEQ ID NO: 3442784 - RNA, 18 nt, Human
ccuucagugcccaccaac

SEQ ID NO: 3442785 - RNA, 14 nt, Human
ccuucagugccuua

SEQ ID NO: 3442786 - RNA, 20 nt, Human
ccuucagugccuuauggaac

SEQ ID NO: 3442787 - RNA, 18 nt, Human
ccuucaguuaugauuuuu

SEQ ID NO: 3442788 - RNA, 15 nt, Human
ccuucauacuugaac

SEQ ID NO: 3442789 - RNA, 19 nt, Human
ccuucauaucauccacaca

SEQ ID NO: 3442790 - RNA, 17 nt, Human
ccuucaucaugaguucu

SEQ ID NO: 3442791 - RNA, 17 nt, Human
ccuucaucuccagggag

SEQ ID NO: 3442792 - RNA, 14 nt, Human
ccuucaucuggaac

SEQ ID NO: 3442793 - RNA, 19 nt, Human
ccuucaucuuccugugucc

SEQ ID NO: 3442794 - RNA, 20 nt, Human
ccuucaucuuccuguguccu

SEQ ID NO: 3442795 - RNA, 12 nt, Human
ccuucaugcaug

SEQ ID NO: 3442796 - RNA, 15 nt, Human
ccuucaugcauggaa

SEQ ID NO: 3442797 - RNA, 19 nt, Human
ccuucauucugagaccaaa

SEQ ID NO: 3442798 - RNA, 20 nt, Human
ccuucauugauuuccugugu

SEQ ID NO: 3442799 - RNA, 23 nt, Human
ccuucauugccuuaacuggagcc

SEQ ID NO: 3442800 - RNA, 11 nt, Human
ccuucauuuaa

SEQ ID NO: 3442801 - RNA, 18 nt, Human
ccuucauuucaggaggga

SEQ ID NO: 3442802 - RNA, 12 nt, Human
ccuucauuuccu

SEQ ID NO: 3442803 - RNA, 13 nt, Human
ccuucauuuccuc

SEQ ID NO: 3442804 - RNA, 15 nt, Human
ccuucauuucugaua

SEQ ID NO: 3442805 - RNA, 22 nt, Human
ccuucauuucugauauagaauu

SEQ ID NO: 3442806 - RNA, 18 nt, Human
ccuuccaaaaauuauuau

SEQ ID NO: 3442807 - RNA, 19 nt, Human
ccuuccaacugcugcccca

SEQ ID NO: 3442808 - RNA, 16 nt, Human
ccuuccaagagccuga

SEQ ID NO: 3442809 - RNA, 14 nt, Human
ccuuccacccaggg

SEQ ID NO: 3442810 - RNA, 13 nt, Human
ccuuccacccagu

SEQ ID NO: 3442811 - RNA, 17 nt, Human
ccuuccacggacucaag

SEQ ID NO: 3442812 - RNA, 15 nt, Human
ccuuccacugccucu

SEQ ID NO: 3442813 - RNA, 13 nt, Human
ccuuccagacaua

SEQ ID NO: 3442814 - RNA, 13 nt, Human
ccuuccagaucac

SEQ ID NO: 3442815 - RNA, 12 nt, Human
ccuuccagaucc

SEQ ID NO: 3442816 - RNA, 15 nt, Human
ccuuccagaugguca

SEQ ID NO: 3442817 - RNA, 17 nt, Human
ccuuccagcacccugca

SEQ ID NO: 3442818 - RNA, 13 nt, Human
ccuuccagcugcu

SEQ ID NO: 3442819 - RNA, 16 nt, Human
ccuuccagcugcuguc

SEQ ID NO: 3442820 - RNA, 15 nt, Human
ccuuccaggccauca

SEQ ID NO: 3442821 - RNA, 13 nt, Human
ccuuccaggggug

SEQ ID NO: 3442822 - RNA, 16 nt, Human
ccuuccagggguggga

SEQ ID NO: 3442823 - RNA, 22 nt, Human
ccuuccaggggugggacacccu

SEQ ID NO: 3442824 - RNA, 16 nt, Human
ccuuccagucaggaug

SEQ ID NO: 3442825 - RNA, 14 nt, Human
ccuuccauacauuu

SEQ ID NO: 3442826 - RNA, 12 nt, Human
ccuuccaucccu

SEQ ID NO: 3442827 - RNA, 17 nt, Human
ccuuccaucucgccacc

SEQ ID NO: 3442828 - RNA, 23 nt, Human
ccuuccauggugugaucgucuga

SEQ ID NO: 3442829 - RNA, 20 nt, Human
ccuuccaugucgccucugca

SEQ ID NO: 3442830 - RNA, 16 nt, Human
ccuuccauguggagaa

SEQ ID NO: 3442831 - RNA, 17 nt, Human
ccuuccauuucugccuu

SEQ ID NO: 3442832 - RNA, 16 nt, Human
ccuucccaaaggacuc

SEQ ID NO: 3442833 - RNA, 17 nt, Human
ccuucccaaucagcacu

SEQ ID NO: 3442834 - RNA, 21 nt, Human
ccuucccaaucagcacugaaa

SEQ ID NO: 3442835 - RNA, 12 nt, Human
ccuucccaccuc

SEQ ID NO: 3442836 - RNA, 19 nt, Human
ccuucccaccucucucacu

SEQ ID NO: 3442837 - RNA, 18 nt, Human
ccuucccacucaccccgg

SEQ ID NO: 3442838 - RNA, 12 nt, Human
ccuucccagagg

SEQ ID NO: 3442839 - RNA, 19 nt, Human
ccuucccagaggggccugc

SEQ ID NO: 3442840 - RNA, 24 nt, Human
ccuucccagaggggccugccaccu

SEQ ID NO: 3442841 - RNA, 14 nt, Human
ccuucccagcucuc

SEQ ID NO: 3442842 - RNA, 18 nt, Human
ccuucccagcucucccuc

SEQ ID NO: 3442843 - RNA, 21 nt, Human
ccuucccagcucucccucugg

SEQ ID NO: 3442844 - RNA, 22 nt, Human
ccuucccagcucucccucuggc

SEQ ID NO: 3442845 - RNA, 18 nt, Human
ccuucccagcugccccuc

SEQ ID NO: 3442846 - RNA, 19 nt, Human
ccuucccaggaguggagga

SEQ ID NO: 3442847 - RNA, 18 nt, Human
ccuucccaugacccaggc

SEQ ID NO: 3442848 - RNA, 12 nt, Human
ccuuccccagca

SEQ ID NO: 3442849 - RNA, 15 nt, Human
ccuuccccagcgucc

SEQ ID NO: 3442850 - RNA, 14 nt, Human
ccuucccccagccc

SEQ ID NO: 3442851 - RNA, 22 nt, Human
ccuucccccucccccagccacu

SEQ ID NO: 3442852 - RNA, 16 nt, Human
ccuuccccuccuucuc

SEQ ID NO: 3442853 - RNA, 16 nt, Human
ccuuccccuuccuucu

SEQ ID NO: 3442854 - RNA, 17 nt, Human
ccuuccccuuccuucuu

SEQ ID NO: 3442855 - RNA, 22 nt, Human
ccuuccccuugcccagggcuca

SEQ ID NO: 3442856 - RNA, 12 nt, Human
ccuucccuagcu

SEQ ID NO: 3442857 - RNA, 15 nt, Human
ccuucccuagcuuua

SEQ ID NO: 3442858 - RNA, 13 nt, Human
ccuucccugcugu

SEQ ID NO: 3442859 - RNA, 11 nt, Human
ccuucccuggc

SEQ ID NO: 3442860 - RNA, 17 nt, Human
ccuucccugucccucua

SEQ ID NO: 3442861 - RNA, 22 nt, Human
ccuucccuguuuuccccccaag

SEQ ID NO: 3442862 - RNA, 20 nt, Human
ccuucccuuccacugccucu

SEQ ID NO: 3442863 - RNA, 17 nt, Human
ccuucccuucuccaucu

SEQ ID NO: 3442864 - RNA, 16 nt, Human
ccuucccuugagcccu

SEQ ID NO: 3442865 - RNA, 14 nt, Human
ccuucccuugccac

SEQ ID NO: 3442866 - RNA, 20 nt, Human
ccuucccuugccacuuugca

SEQ ID NO: 3442867 - RNA, 22 nt, Human
ccuuccgacccucugggaaccu

SEQ ID NO: 3442868 - RNA, 22 nt, Human
ccuuccgcaguguggccaggcu

SEQ ID NO: 3442869 - RNA, 18 nt, Human
ccuuccuaauuccacagc

SEQ ID NO: 3442870 - RNA, 19 nt, Human
ccuuccuaauuccacagcu

SEQ ID NO: 3442871 - RNA, 16 nt, Human
ccuuccuacagauagu

SEQ ID NO: 3442872 - RNA, 14 nt, Human
ccuuccuaccaccc

SEQ ID NO: 3442873 - RNA, 18 nt, Human
ccuuccuacccuccugca

SEQ ID NO: 3442874 - RNA, 21 nt, Human
ccuuccuauaacuugaugcau

SEQ ID NO: 3442875 - RNA, 21 nt, Human
ccuuccuauuccaagcuucca

SEQ ID NO: 3442876 - RNA, 19 nt, Human
ccuuccucauccaccccau

SEQ ID NO: 3442877 - RNA, 15 nt, Human
ccuuccucgcagaga

SEQ ID NO: 3442878 - RNA, 17 nt, Human
ccuuccucgcagagagg

SEQ ID NO: 3442879 - RNA, 17 nt, Human
ccuuccucuccacugcc

SEQ ID NO: 3442880 - RNA, 21 nt, Human
ccuuccucuccacugccuucg

SEQ ID NO: 3442881 - RNA, 12 nt, Human
ccuuccucugca

SEQ ID NO: 3442882 - RNA, 13 nt, Human
ccuuccucugcuc

SEQ ID NO: 3442883 - RNA, 14 nt, Human
ccuuccucuggggc

SEQ ID NO: 3442884 - RNA, 22 nt, Human
ccuuccucuggggcucuagggu

SEQ ID NO: 3442885 - RNA, 12 nt, Human
ccuuccucuucg

SEQ ID NO: 3442886 - RNA, 14 nt, Human
ccuuccucuucggc

SEQ ID NO: 3442887 - RNA, 20 nt, Human
ccuuccucuuuuccuuccca

SEQ ID NO: 3442888 - RNA, 11 nt, Human
ccuuccugccc

SEQ ID NO: 3442889 - RNA, 11 nt, Human
ccuuccugcug

SEQ ID NO: 3442890 - RNA, 16 nt, Human
cuuagaauuauuugca

SEQ ID NO: 3442891 - RNA, 11 nt, Human
cuuagacaguc

SEQ ID NO: 3442892 - RNA, 14 nt, Human
cuuagacagucccu

SEQ ID NO: 3442893 - RNA, 18 nt, Human
cuuagacagucccugcca

SEQ ID NO: 3442894 - RNA, 20 nt, Human
cuuagaccaccaagccuuga

SEQ ID NO: 3442895 - RNA, 20 nt, Human
cuuagacccucaugcugcca

SEQ ID NO: 3442896 - RNA, 23 nt, Human
cuuagacccucaugcugccaaua

SEQ ID NO: 3442897 - RNA, 16 nt, Human
cuuagaccuuccauaa

SEQ ID NO: 3442898 - RNA, 18 nt, Human
cuuagaccuuccauaaug

SEQ ID NO: 3442899 - RNA, 20 nt, Human
cuuagacuucgacucaggau

SEQ ID NO: 3442900 - RNA, 14 nt, Human
cuuagacuucugcu

SEQ ID NO: 3442901 - RNA, 22 nt, Human
cuuagacuuuuccaauauguga

SEQ ID NO: 3442902 - RNA, 20 nt, Human
cuuagagaauguucuccuaa

SEQ ID NO: 3442903 - RNA, 11 nt, Human
cuuagagcagu

SEQ ID NO: 3442904 - RNA, 17 nt, Human
cuuagagccucccucaa

SEQ ID NO: 3442905 - RNA, 21 nt, Human
cuuagaggcaugggcuugcug

SEQ ID NO: 3442906 - RNA, 22 nt, Human
cuuagaguuucuguuugauucu

SEQ ID NO: 3442907 - RNA, 23 nt, Human
cuuagaguuucuguuugauucuu

SEQ ID NO: 3442908 - RNA, 13 nt, Human
cuuagauaucuuu

SEQ ID NO: 3442909 - RNA, 14 nt, Human
cuuagauaucuuuu

SEQ ID NO: 3442910 - RNA, 17 nt, Human
cuuagauaucuuuuuau

SEQ ID NO: 3442911 - RNA, 16 nt, Human
cuuagaucauaguuuu

SEQ ID NO: 3442912 - RNA, 17 nt, Human
cuuagaucauaguuuua

SEQ ID NO: 3442913 - RNA, 19 nt, Human
cuuagaucauaguuuuauu

SEQ ID NO: 3442914 - RNA, 21 nt, Human
cuuagaucauaguuuuauuua

SEQ ID NO: 3442915 - RNA, 21 nt, Human
cuuagaucuggcauguuagcc

SEQ ID NO: 3442916 - RNA, 20 nt, Human
cuuagaugcaguucugaaga

SEQ ID NO: 3442917 - RNA, 11 nt, Human
cuuagauucuc

SEQ ID NO: 3442918 - RNA, 22 nt, Human
cuuagauucucugugucuaaga

SEQ ID NO: 3442919 - RNA, 14 nt, Human
cuuagauucuuaau

SEQ ID NO: 3442920 - RNA, 17 nt, Human
cuuagauugaaguaaac

SEQ ID NO: 3442921 - RNA, 13 nt, Human
cuuagauuucaua

SEQ ID NO: 3442922 - RNA, 12 nt, Human
cuuagauuuuac

SEQ ID NO: 3442923 - RNA, 15 nt, Human
cuuagauuuuacaug

SEQ ID NO: 3442924 - RNA, 16 nt, Human
cuuagauuuuacauga

SEQ ID NO: 3442925 - RNA, 12 nt, Human
cuuagcaacagc

SEQ ID NO: 3442926 - RNA, 21 nt, Human
cuuagcaggagaggagagcca

SEQ ID NO: 3442927 - RNA, 12 nt, Human
cuuagcaguccc

SEQ ID NO: 3442928 - RNA, 17 nt, Human
cuuagcaguccccuucc

SEQ ID NO: 3442929 - RNA, 22 nt, Human
cuuagcagugauuuuuauccaa

SEQ ID NO: 3442930 - RNA, 20 nt, Human
cuuagcauccuaagaaauau

SEQ ID NO: 3442931 - RNA, 16 nt, Human
cuuagcauguuugcug

SEQ ID NO: 3442932 - RNA, 15 nt, Human
cuuagccucccugaa

SEQ ID NO: 3442933 - RNA, 17 nt, Human
cuuagccuccugaccug

SEQ ID NO: 3442934 - RNA, 21 nt, Human
cuuagccuccugaccugaggc

SEQ ID NO: 3442935 - RNA, 22 nt, Human
cuuagccuccugaccugaggcu

SEQ ID NO: 3442936 - RNA, 13 nt, Human
cuuagccuggacc

SEQ ID NO: 3442937 - RNA, 17 nt, Human
cuuagccuggaccucug

SEQ ID NO: 3442938 - RNA, 20 nt, Human
cuuagccuggaccucugaca

SEQ ID NO: 3442939 - RNA, 14 nt, Human
cuuagccuuucuuu

SEQ ID NO: 3442940 - RNA, 14 nt, Human
cuuagcuccccucc

SEQ ID NO: 3442941 - RNA, 13 nt, Human
cuuagcucccucc

SEQ ID NO: 3442942 - RNA, 21 nt, Human
cuuagcucccucccgcacccc

SEQ ID NO: 3442943 - RNA, 11 nt, Human
cuuagcugagu

SEQ ID NO: 3442944 - RNA, 14 nt, Human
cuuagcuggagaug

SEQ ID NO: 3442945 - RNA, 16 nt, Human
ccuucucccaccccug

SEQ ID NO: 3442946 - RNA, 13 nt, Human
ccuucucccacuc

SEQ ID NO: 3442947 - RNA, 23 nt, Human
ccuucucccccccggggcugggu

SEQ ID NO: 3442948 - RNA, 15 nt, Human
ccuucuccccugcac

SEQ ID NO: 3442949 - RNA, 22 nt, Human
ccuucucccuagcuccuccccu

SEQ ID NO: 3442950 - RNA, 13 nt, Human
ccuucucccugga

SEQ ID NO: 3442951 - RNA, 15 nt, Human
ccuucuccuucaccu

SEQ ID NO: 3442952 - RNA, 21 nt, Human
ccuucuccuugauaacagcua

SEQ ID NO: 3442953 - RNA, 16 nt, Human
ccuucucuauaucaug

SEQ ID NO: 3442954 - RNA, 18 nt, Human
ccuucucucaccuccuaa

SEQ ID NO: 3442955 - RNA, 19 nt, Human
ccuucucucaccuccuaaa

SEQ ID NO: 3442956 - RNA, 17 nt, Human
ccuucucucaucucuua

SEQ ID NO: 3442957 - RNA, 15 nt, Human
ccuucucuccagccc

SEQ ID NO: 3442958 - RNA, 17 nt, Human
ccuucucuccagccccu

SEQ ID NO: 3442959 - RNA, 20 nt, Human
ccuucucuccagccccugga

SEQ ID NO: 3442960 - RNA, 21 nt, Human
ccuucucuccagccccuggau

SEQ ID NO: 3442961 - RNA, 15 nt, Human
ccuucucucccugcc

SEQ ID NO: 3442962 - RNA, 17 nt, Human
ccuucucuccuccccaa

SEQ ID NO: 3442963 - RNA, 14 nt, Human
ccuucucugcccau

SEQ ID NO: 3442964 - RNA, 13 nt, Human
ccuucucugcucc

SEQ ID NO: 3442965 - RNA, 19 nt, Human
ccuucucugucucaugugu

SEQ ID NO: 3442966 - RNA, 11 nt, Human
ccuucucugug

SEQ ID NO: 3442967 - RNA, 12 nt, Human
ccuucucuguga

SEQ ID NO: 3442968 - RNA, 21 nt, Human
ccuucucuguucauuuccuca

SEQ ID NO: 3442969 - RNA, 18 nt, Human
ccuucucuuccaggcagc

SEQ ID NO: 3442970 - RNA, 21 nt, Human
ccuucugacccaugcugcccu

SEQ ID NO: 3442971 - RNA, 23 nt, Human
ccuucugacccaugcugcccugu

SEQ ID NO: 3442972 - RNA, 15 nt, Human
ccuucugacggcccu

SEQ ID NO: 3442973 - RNA, 21 nt, Human
ccuucugacggcccugcaaug

SEQ ID NO: 3442974 - RNA, 14 nt, Human
ccuucugagcuccu

SEQ ID NO: 3442975 - RNA, 18 nt, Human
ccuucugaggacauucca

SEQ ID NO: 3442976 - RNA, 21 nt, Human
ccuucugaggacauuccaaga

SEQ ID NO: 3442977 - RNA, 13 nt, Human
ccuucugcuacug

SEQ ID NO: 3442978 - RNA, 11 nt, Human
ccuucugcugc

SEQ ID NO: 3442979 - RNA, 16 nt, Human
ccuucuggaaacugug

SEQ ID NO: 3442980 - RNA, 17 nt, Human
ccuucuggauucuuggc

SEQ ID NO: 3442981 - RNA, 19 nt, Human
ccuucuggauucuuggccc

SEQ ID NO: 3442982 - RNA, 17 nt, Human
ccuucuggccucccaca

SEQ ID NO: 3442983 - RNA, 20 nt, Human
ccuucuggccucccacagac

SEQ ID NO: 3442984 - RNA, 16 nt, Human
ccuucuggccuuguaa

SEQ ID NO: 3442985 - RNA, 18 nt, Human
ccuucugggcaucuguuc

SEQ ID NO: 3442986 - RNA, 22 nt, Human
ccuucuguaaagguuuuuggaa

SEQ ID NO: 3442987 - RNA, 18 nt, Human
ccuucugucccucacagc

SEQ ID NO: 3442988 - RNA, 21 nt, Human
ccuucuguccuacucuguguc

SEQ ID NO: 3442989 - RNA, 22 nt, Human
ccuucuguccuggugucacuua

SEQ ID NO: 3442990 - RNA, 21 nt, Human
ccuucugugcccagcucaguc

SEQ ID NO: 3442991 - RNA, 17 nt, Human
ccuucuguugaugcugu

SEQ ID NO: 3442992 - RNA, 19 nt, Human
ccuucuucacccagcuaau

SEQ ID NO: 3442993 - RNA, 23 nt, Human
ccuucuucacccagcuaaucugu

SEQ ID NO: 3442994 - RNA, 13 nt, Human
ccuucuucagggc

SEQ ID NO: 3442995 - RNA, 17 nt, Human
ccuucuucagggccugg

SEQ ID NO: 3442996 - RNA, 18 nt, Human
ccuucuucagggccuggu

SEQ ID NO: 3442997 - RNA, 22 nt, Human
ccuucuuccaucccaggacacc

SEQ ID NO: 3442998 - RNA, 16 nt, Human
ccuucuuccccuuccc

SEQ ID NO: 3442999 - RNA, 21 nt, Human
ccuucuucggggaacuccugg

SEQ ID NO: 3443000 - RNA, 18 nt, Human
ccuucuucuuuuugcugu

SEQ ID NO: 3443001 - RNA, 14 nt, Human
ccuucuugcugccc

SEQ ID NO: 3443002 - RNA, 13 nt, Human
ccuucuuggugcu

SEQ ID NO: 3443003 - RNA, 19 nt, Human
ccuucuuuccauuucucuc

SEQ ID NO: 3443004 - RNA, 16 nt, Human
ccuucuuuccucuucc

SEQ ID NO: 3443005 - RNA, 13 nt, Human
ccuucuuucuacc

SEQ ID NO: 3443006 - RNA, 13 nt, Human
ccuucuuugaaga

SEQ ID NO: 3443007 - RNA, 14 nt, Human
ccuucuuugaagaa

SEQ ID NO: 3443008 - RNA, 13 nt, Human
ccuucuuugauaa

SEQ ID NO: 3443009 - RNA, 19 nt, Human
ccuucuuugauaauguuaa

SEQ ID NO: 3443010 - RNA, 12 nt, Human
ccuucuuuugua

SEQ ID NO: 3443011 - RNA, 16 nt, Human
ccuucuuuuucuggac

SEQ ID NO: 3443012 - RNA, 14 nt, Human
ccuucuuuuucuuc

SEQ ID NO: 3443013 - RNA, 16 nt, Human
ccuucuuuuucuucuu

SEQ ID NO: 3443014 - RNA, 21 nt, Human
ccuugaaaacacuguucucug

SEQ ID NO: 3443015 - RNA, 15 nt, Human
ccuugaaaauauuuu

SEQ ID NO: 3443016 - RNA, 13 nt, Human
ccuugaacacugg

SEQ ID NO: 3443017 - RNA, 16 nt, Human
ccuugaacucugggcu

SEQ ID NO: 3443018 - RNA, 16 nt, Human
ccuugaacuggguacu

SEQ ID NO: 3443019 - RNA, 21 nt, Human
ccuugaagaacugcaggcccu

SEQ ID NO: 3443020 - RNA, 23 nt, Human
ccuugaagaacugcaggcccugg

SEQ ID NO: 3443021 - RNA, 19 nt, Human
ccuugaagccacugaagcu

SEQ ID NO: 3443022 - RNA, 21 nt, Human
ccuugaaggguaaagaaguuu

SEQ ID NO: 3443023 - RNA, 14 nt, Human
ccuugaagguauau

SEQ ID NO: 3443024 - RNA, 13 nt, Human
ccuugaauaauaa

SEQ ID NO: 3443025 - RNA, 12 nt, Human
ccuugaaugcug

SEQ ID NO: 3443026 - RNA, 21 nt, Human
ccuugacaaagucaagccaca

SEQ ID NO: 3443027 - RNA, 13 nt, Human
ccuugacagggca

SEQ ID NO: 3443028 - RNA, 21 nt, Human
ccuugacagggcacaccgggc

SEQ ID NO: 3443029 - RNA, 15 nt, Human
ccuugacaucaguuc

SEQ ID NO: 3443030 - RNA, 20 nt, Human
ccuugaccagcagaucccag

SEQ ID NO: 3443031 - RNA, 23 nt, Human
ccuugaccagcagaucccagcuc

SEQ ID NO: 3443032 - RNA, 16 nt, Human
ccuugaccaggccugg

SEQ ID NO: 3443033 - RNA, 15 nt, Human
ccuugaccuuuguac

SEQ ID NO: 3443034 - RNA, 13 nt, Human
ccuugacucuuuc

SEQ ID NO: 3443035 - RNA, 14 nt, Human
cuucuggggcaggc

SEQ ID NO: 3443036 - RNA, 15 nt, Human
cuucuggggcaggcu

SEQ ID NO: 3443037 - RNA, 21 nt, Human
cuucuggggcaggcugggcca

SEQ ID NO: 3443038 - RNA, 22 nt, Human
cuucuggggcaggcugggccau

SEQ ID NO: 3443039 - RNA, 17 nt, Human
cuucugggguccccagg

SEQ ID NO: 3443040 - RNA, 15 nt, Human
cuucugguacuuucu

SEQ ID NO: 3443041 - RNA, 21 nt, Human
cuucuggugaccuuccaagag

SEQ ID NO: 3443042 - RNA, 14 nt, Human
cuucugguugaugc

SEQ ID NO: 3443043 - RNA, 14 nt, Human
cuucuguaauauuu

SEQ ID NO: 3443044 - RNA, 18 nt, Human
cuucuguacgucugacag

SEQ ID NO: 3443045 - RNA, 18 nt, Human
cuucuguaggaauucuuu

SEQ ID NO: 3443046 - RNA, 21 nt, Human
cuucuguaguacuccuuaaga

SEQ ID NO: 3443047 - RNA, 17 nt, Human
cuucuguaguuuuauca

SEQ ID NO: 3443048 - RNA, 18 nt, Human
cuucuguauauaaauggg

SEQ ID NO: 3443049 - RNA, 20 nt, Human
cuucuguauauaaaugggaa

SEQ ID NO: 3443050 - RNA, 15 nt, Human
cuucuguauucacuu

SEQ ID NO: 3443051 - RNA, 19 nt, Human
cuucuguauucacuuauau

SEQ ID NO: 3443052 - RNA, 20 nt, Human
cuucuguauuuuuuuuucua

SEQ ID NO: 3443053 - RNA, 22 nt, Human
cuucuguauuuuuuuuucuaag

SEQ ID NO: 3443054 - RNA, 15 nt, Human
cuucugucccucaca

SEQ ID NO: 3443055 - RNA, 17 nt, Human
cuucuguccuacucugu

SEQ ID NO: 3443056 - RNA, 18 nt, Human
cuucuguccuacucugug

SEQ ID NO: 3443057 - RNA, 10 nt, Human
cuucugucuc

SEQ ID NO: 3443058 - RNA, 21 nt, Human
cuucugucuucacaacagauu

SEQ ID NO: 3443059 - RNA, 19 nt, Human
cuucugugagacccccaca

SEQ ID NO: 3443060 - RNA, 13 nt, Human
cuucugugcccag

SEQ ID NO: 3443061 - RNA, 14 nt, Human
cuucugugcccaga

SEQ ID NO: 3443062 - RNA, 21 nt, Human
cuucugugggugacccagguc

SEQ ID NO: 3443063 - RNA, 22 nt, Human
cuucuguguaucucuuucacau

SEQ ID NO: 3443064 - RNA, 14 nt, Human
cuucuguguuuaua

SEQ ID NO: 3443065 - RNA, 17 nt, Human
cuucuguugcugccuca

SEQ ID NO: 3443066 - RNA, 19 nt, Human
cuucuguugucaccuucac

SEQ ID NO: 3443067 - RNA, 15 nt, Human
cuucuguuuucuguu

SEQ ID NO: 3443068 - RNA, 14 nt, Human
cuucuuaaaguauu

SEQ ID NO: 3443069 - RNA, 19 nt, Human
cuucuuaaaguauucuucu

SEQ ID NO: 3443070 - RNA, 19 nt, Human
cuucuuaaauaucuuuuau

SEQ ID NO: 3443071 - RNA, 21 nt, Human
cuucuuaaaugagaaggaauu

SEQ ID NO: 3443072 - RNA, 18 nt, Human
cuucuuaauauaacugcc

SEQ ID NO: 3443073 - RNA, 20 nt, Human
cuucuuaauauaacugccuu

SEQ ID NO: 3443074 - RNA, 17 nt, Human
cuucuuaaucuuuucac

SEQ ID NO: 3443075 - RNA, 20 nt, Human
cuucuuaauguacauagugc

SEQ ID NO: 3443076 - RNA, 16 nt, Human
cuucuuaauuaauuug

SEQ ID NO: 3443077 - RNA, 18 nt, Human
cuucuuaauuaauuugau

SEQ ID NO: 3443078 - RNA, 13 nt, Human
cuucuuacaugca

SEQ ID NO: 3443079 - RNA, 22 nt, Human
cuucuuacuuggaacugaaggg

SEQ ID NO: 3443080 - RNA, 13 nt, Human
cuucuuauacauu

SEQ ID NO: 3443081 - RNA, 19 nt, Human
cuucuuauggaauugauuu

SEQ ID NO: 3443082 - RNA, 19 nt, Human
cuucuuauuauauauauaa

SEQ ID NO: 3443083 - RNA, 14 nt, Human
cuucuuauucucac

SEQ ID NO: 3443084 - RNA, 22 nt, Human
cuucuuauucucacuccaccac

SEQ ID NO: 3443085 - RNA, 13 nt, Human
cuucuucaccauu

SEQ ID NO: 3443086 - RNA, 22 nt, Human
cuucuucacccagcuaaucugu

SEQ ID NO: 3443087 - RNA, 13 nt, Human
cuucuucagagac

SEQ ID NO: 3443088 - RNA, 23 nt, Human
cuucuucagagacuccugcaggc

SEQ ID NO: 3443089 - RNA, 16 nt, Human
cuucuucagagcugac

SEQ ID NO: 3443090 - RNA, 14 nt, Human
cuucuucagggccu

SEQ ID NO: 3443091 - RNA, 19 nt, Human
cuucuuccaggugcccagc

SEQ ID NO: 3443092 - RNA, 19 nt, Human
cuucuuccuuucucuuucu

SEQ ID NO: 3443093 - RNA, 21 nt, Human
cuucuucggggaacuccugga

SEQ ID NO: 3443094 - RNA, 13 nt, Human
cuucuucucaggc

SEQ ID NO: 3443095 - RNA, 12 nt, Human
cuucuucucccc

SEQ ID NO: 3443096 - RNA, 12 nt, Human
cuucuucuccua

SEQ ID NO: 3443097 - RNA, 18 nt, Human
cuucuucuccuaugugua

SEQ ID NO: 3443098 - RNA, 19 nt, Human
cuucuucuccuauguguaa

SEQ ID NO: 3443099 - RNA, 18 nt, Human
cuucuucuguaauauuua

SEQ ID NO: 3443100 - RNA, 18 nt, Human
cuucuucuuuuugcuguu

SEQ ID NO: 3443101 - RNA, 22 nt, Human
cuucuugaaauuuuaaccuaug

SEQ ID NO: 3443102 - RNA, 19 nt, Human
cuucuugaacacucaugcu

SEQ ID NO: 3443103 - RNA, 16 nt, Human
cuucuugaauauaaaa

SEQ ID NO: 3443104 - RNA, 18 nt, Human
cuucuugcauccuuccua

SEQ ID NO: 3443105 - RNA, 15 nt, Human
cuucuugccucugug

SEQ ID NO: 3443106 - RNA, 18 nt, Human
cuucuugccucugugcug

SEQ ID NO: 3443107 - RNA, 14 nt, Human
cuucuugcugcccu

SEQ ID NO: 3443108 - RNA, 20 nt, Human
cuucuugcuucuuucuagaa

SEQ ID NO: 3443109 - RNA, 14 nt, Human
cuucuuggcuuugu

SEQ ID NO: 3443110 - RNA, 21 nt, Human
cuucuuggggcccagugcaug

SEQ ID NO: 3443111 - RNA, 22 nt, Human
cuucuuggggcccagugcaugg

SEQ ID NO: 3443112 - RNA, 24 nt, Human
cuucuuggggcccagugcauggug

SEQ ID NO: 3443113 - RNA, 16 nt, Human
cuucuuggucuuauuu

SEQ ID NO: 3443114 - RNA, 12 nt, Human
cuucuugugaag

SEQ ID NO: 3443115 - RNA, 23 nt, Human
cuucuugugaucuugcucuaucu

SEQ ID NO: 3443116 - RNA, 16 nt, Human
cuucuuguguguaugc

SEQ ID NO: 3443117 - RNA, 16 nt, Human
cuucuuguuuccuugu

SEQ ID NO: 3443118 - RNA, 17 nt, Human
cuucuuguuuccuuguu

SEQ ID NO: 3443119 - RNA, 16 nt, Human
cuucuuuaauuuugga

SEQ ID NO: 3443120 - RNA, 18 nt, Human
cuucuuuaauuuuggaau

SEQ ID NO: 3443121 - RNA, 19 nt, Human
cuucuuuaauuuuggaauu

SEQ ID NO: 3443122 - RNA, 14 nt, Human
cuucuuuagaacag

SEQ ID NO: 3443123 - RNA, 14 nt, Human
cuucuuuauacugu

SEQ ID NO: 3443124 - RNA, 19 nt, Human
cuucuuuccacagaagcuc

SEQ ID NO: 3443125 - RNA, 17 nt, Human
cuucuuucugucuuuaa

SEQ ID NO: 3443126 - RNA, 14 nt, Human
cuucuuugaagaag

SEQ ID NO: 3443127 - RNA, 13 nt, Human
cuucuuugcuugc

SEQ ID NO: 3443128 - RNA, 13 nt, Human
cuucuuuuacuca

SEQ ID NO: 3443129 - RNA, 14 nt, Human
cuucuuuucacauu

SEQ ID NO: 3443130 - RNA, 15 nt, Human
cuucuuuucuuugua

SEQ ID NO: 3443131 - RNA, 12 nt, Human
cuucuuuugagc

SEQ ID NO: 3443132 - RNA, 13 nt, Human
cuucuuuugugaa

SEQ ID NO: 3443133 - RNA, 15 nt, Human
cuucuuuuuauuuuc

SEQ ID NO: 3443134 - RNA, 13 nt, Human
cuucuuuuucugg

SEQ ID NO: 3443135 - RNA, 15 nt, Human
cuucuuuuucuggac

SEQ ID NO: 3443136 - RNA, 19 nt, Human
cuucuuuuucuggacucug

SEQ ID NO: 3443137 - RNA, 16 nt, Human
cuucuuuuugcuguug

SEQ ID NO: 3443138 - RNA, 19 nt, Human
cuucuuuuuucaaaagaaa

SEQ ID NO: 3443139 - RNA, 15 nt, Human
cuugaaaaagacauu

SEQ ID NO: 3443140 - RNA, 14 nt, Human
cuugaaaacacugu

SEQ ID NO: 3443141 - RNA, 18 nt, Human
cuugaaaagagacaggca

SEQ ID NO: 3443142 - RNA, 22 nt, Human
cuugaaaauaagaauagaaaua

SEQ ID NO: 3443143 - RNA, 13 nt, Human
cuugaaaauuaac

SEQ ID NO: 3443144 - RNA, 18 nt, Human
cuugaaaauuaacaugaa

SEQ ID NO: 3443145 - RNA, 14 nt, Human
cuugaaagaauuuu

SEQ ID NO: 3443146 - RNA, 17 nt, Human
cuugaaagucaugaaca

SEQ ID NO: 3443147 - RNA, 22 nt, Human
cuugaaauaccagugaaccaaa

SEQ ID NO: 3443148 - RNA, 20 nt, Human
cuugaaauuauaucuguggu

SEQ ID NO: 3443149 - RNA, 21 nt, Human
cuugaaauuauaucugugguc

SEQ ID NO: 3443150 - RNA, 20 nt, Human
cuugaaauuugaauuuugug

SEQ ID NO: 3443151 - RNA, 13 nt, Human
cuugaaauuuuaa

SEQ ID NO: 3443152 - RNA, 19 nt, Human
cuugaaauuuuaaacuaua

SEQ ID NO: 3443153 - RNA, 15 nt, Human
cuugaacaaaagggu

SEQ ID NO: 3443154 - RNA, 16 nt, Human
cuugaacacaguauuu

SEQ ID NO: 3443155 - RNA, 17 nt, Human
cuugaacacaguauuuu

SEQ ID NO: 3443156 - RNA, 20 nt, Human
cuugaacacaguauuuuccc

SEQ ID NO: 3443157 - RNA, 16 nt, Human
cuuccuacccugccuc

SEQ ID NO: 3443158 - RNA, 16 nt, Human
cuuccuacucuucucu

SEQ ID NO: 3443159 - RNA, 19 nt, Human
cuuccuacucuucucucug

SEQ ID NO: 3443160 - RNA, 23 nt, Human
cuuccuacucuucucucugcucu

SEQ ID NO: 3443161 - RNA, 22 nt, Human
cuuccuagaaguuacugaaugc

SEQ ID NO: 3443162 - RNA, 17 nt, Human
cuuccuagccuugcacu

SEQ ID NO: 3443163 - RNA, 20 nt, Human
cuuccuagcuggagaggagc

SEQ ID NO: 3443164 - RNA, 17 nt, Human
cuuccuaguuuucuccu

SEQ ID NO: 3443165 - RNA, 18 nt, Human
cuuccuauaauuuugaua

SEQ ID NO: 3443166 - RNA, 21 nt, Human
cuuccuauaauuuugauagug

SEQ ID NO: 3443167 - RNA, 12 nt, Human
cuuccuauccca

SEQ ID NO: 3443168 - RNA, 16 nt, Human
cuuccuauuucuaggg

SEQ ID NO: 3443169 - RNA, 17 nt, Human
cuuccuauuucuagggc

SEQ ID NO: 3443170 - RNA, 18 nt, Human
cuuccuauuucuagggcu

SEQ ID NO: 3443171 - RNA, 22 nt, Human
cuuccucaaaauaaagaaguau

SEQ ID NO: 3443172 - RNA, 21 nt, Human
cuuccucacagucccacugug

SEQ ID NO: 3443173 - RNA, 14 nt, Human
cuuccucagccagc

SEQ ID NO: 3443174 - RNA, 15 nt, Human
cuuccucagccagcc

SEQ ID NO: 3443175 - RNA, 17 nt, Human
cuuccucagccagccuc

SEQ ID NO: 3443176 - RNA, 17 nt, Human
cuuccucaguuacacaa

SEQ ID NO: 3443177 - RNA, 18 nt, Human
cuuccucaguuuaauccu

SEQ ID NO: 3443178 - RNA, 23 nt, Human
cuuccucauccaccccaucccuc

SEQ ID NO: 3443179 - RNA, 23 nt, Human
cuuccucauucccucgucuuucc

SEQ ID NO: 3443180 - RNA, 22 nt, Human
cuugaagaacugcaggcccugg

SEQ ID NO: 3443181 - RNA, 15 nt, Human
cuugaagccaaagaa

SEQ ID NO: 3443182 - RNA, 16 nt, Human
cuugaagccacugaag

SEQ ID NO: 3443183 - RNA, 17 nt, Human
cuugaagccacugaagc

SEQ ID NO: 3443184 - RNA, 13 nt, Human
cuugaaggaaaaa

SEQ ID NO: 3443185 - RNA, 16 nt, Human
cuugaaggacuaauag

SEQ ID NO: 3443186 - RNA, 19 nt, Human
cuugaaggaucuguuuuua

SEQ ID NO: 3443187 - RNA, 16 nt, Human
cuugaagggccagagc

SEQ ID NO: 3443188 - RNA, 18 nt, Human
cuugaagggccagagcca

SEQ ID NO: 3443189 - RNA, 19 nt, Human
cuugaagggccagagccag

SEQ ID NO: 3443190 - RNA, 20 nt, Human
cuugaagggccagagccagg

SEQ ID NO: 3443191 - RNA, 22 nt, Human
cuugaaggugcugacggccagg

SEQ ID NO: 3443192 - RNA, 13 nt, Human
cuugaaguccugg

SEQ ID NO: 3443193 - RNA, 19 nt, Human
cuugaaguccuggcuucag

SEQ ID NO: 3443194 - RNA, 20 nt, Human
cuugaaguccuggcuucagg

SEQ ID NO: 3443195 - RNA, 22 nt, Human
cuugaaguuguuacuaacuaaa

SEQ ID NO: 3443196 - RNA, 23 nt, Human
cuugaauaaacaccacuggauua

SEQ ID NO: 3443197 - RNA, 14 nt, Human
cuugaauaauaagc

SEQ ID NO: 3443198 - RNA, 15 nt, Human
cuugaauauaaaaaa

SEQ ID NO: 3443199 - RNA, 16 nt, Human
cuugaauauggguggc

SEQ ID NO: 3443200 - RNA, 18 nt, Human
cuugaauccuagggccug

SEQ ID NO: 3443201 - RNA, 14 nt, Human
cuugaauccuucca

SEQ ID NO: 3443202 - RNA, 20 nt, Human
cuugaauccuuccauuccac

SEQ ID NO: 3443203 - RNA, 21 nt, Human
cuugaauccuuccauuccaca

SEQ ID NO: 3443204 - RNA, 12 nt, Human
cuugaaugaaaa

SEQ ID NO: 3443205 - RNA, 20 nt, Human
cuugaauguagcagccccgg

SEQ ID NO: 3443206 - RNA, 13 nt, Human
cuugaaugucuuu

SEQ ID NO: 3443207 - RNA, 17 nt, Human
cuugaauguggucucag

SEQ ID NO: 3443208 - RNA, 20 nt, Human
cuugaauugcauuuuuuaaa

SEQ ID NO: 3443209 - RNA, 17 nt, Human
cuugaauuguaacuguu

SEQ ID NO: 3443210 - RNA, 18 nt, Human
cuugaauuguaaggaaug

SEQ ID NO: 3443211 - RNA, 20 nt, Human
cuugaauuucuaaaaaacag

SEQ ID NO: 3443212 - RNA, 18 nt, Human
cuugaauuuucccacugc

SEQ ID NO: 3443213 - RNA, 19 nt, Human
cuugaauuuucccacugca

SEQ ID NO: 3443214 - RNA, 20 nt, Human
cuugaauuuucccacugcac

SEQ ID NO: 3443215 - RNA, 21 nt, Human
cuugaauuuucccacugcacc

SEQ ID NO: 3443216 - RNA, 14 nt, Human
cuugacaacuggca

SEQ ID NO: 3443217 - RNA, 17 nt, Human
cuugacaauagaacauu

SEQ ID NO: 3443218 - RNA, 22 nt, Human
cuugacaccugcugagaaaaca

SEQ ID NO: 3443219 - RNA, 14 nt, Human
cuugacagaacacu

SEQ ID NO: 3443220 - RNA, 16 nt, Human
cuugacagaacacugu

SEQ ID NO: 3443221 - RNA, 13 nt, Human
cuugacagggcac

SEQ ID NO: 3443222 - RNA, 14 nt, Human
cuugacagggcaca

SEQ ID NO: 3443223 - RNA, 12 nt, Human
cuugaccaagca

SEQ ID NO: 3443224 - RNA, 17 nt, Human
cuugaccaagcaggaag

SEQ ID NO: 3443225 - RNA, 23 nt, Human
cuugaccaagcaggaagcucaga

SEQ ID NO: 3443226 - RNA, 19 nt, Human
cuugaccagcagaucccag

SEQ ID NO: 3443227 - RNA, 21 nt, Human
cuugaccagcagaucccagcu

SEQ ID NO: 3443228 - RNA, 22 nt, Human
cuugaccagcagaucccagcuc

SEQ ID NO: 3443229 - RNA, 15 nt, Human
cuugaccaggccugg

SEQ ID NO: 3443230 - RNA, 17 nt, Human
cuugaccaggccugggc

SEQ ID NO: 3443231 - RNA, 21 nt, Human
cuugaccaggcugccucccuu

SEQ ID NO: 3443232 - RNA, 22 nt, Human
cuugaccauucuccaccugcca

SEQ ID NO: 3443233 - RNA, 13 nt, Human
cuugacccugcac

SEQ ID NO: 3443234 - RNA, 22 nt, Human
cuugacccugcacccuccuagg

SEQ ID NO: 3443235 - RNA, 21 nt, Human
cuugaccgugaggccagagac

SEQ ID NO: 3443236 - RNA, 14 nt, Human
cuugaccugaggcu

SEQ ID NO: 3443237 - RNA, 18 nt, Human
cuugaccuuccucugggg

SEQ ID NO: 3443238 - RNA, 22 nt, Human
cuugaccuuccucuggggcucu

SEQ ID NO: 3443239 - RNA, 14 nt, Human
cuugaccuuuguac

SEQ ID NO: 3443240 - RNA, 16 nt, Human
cuugacucaggauuua

SEQ ID NO: 3443241 - RNA, 19 nt, Human
cuugacucuacugaucuga

SEQ ID NO: 3443242 - RNA, 19 nt, Human
cuugacuucaguuauuggu

SEQ ID NO: 3443243 - RNA, 17 nt, Human
cuugacuugauuagugc

SEQ ID NO: 3443244 - RNA, 16 nt, Human
cuugagaaaaaaagaa

SEQ ID NO: 3443245 - RNA, 21 nt, Human
cuugagaagauucuucccauu

SEQ ID NO: 3443246 - RNA, 13 nt, Human
cuugagacagcuu

SEQ ID NO: 3443247 - RNA, 15 nt, Human
cuugagaccucagcc

SEQ ID NO: 3443248 - RNA, 16 nt, Human
cuugagagaccaggca

SEQ ID NO: 3443249 - RNA, 22 nt, Human
cuugagaguaucaggucuccca

SEQ ID NO: 3443250 - RNA, 21 nt, Human
cuugagauguaugaaggcuuu

SEQ ID NO: 3443251 - RNA, 15 nt, Human
cuugagaugucuucu

SEQ ID NO: 3443252 - RNA, 13 nt, Human
cuugagcaguggc

SEQ ID NO: 3443253 - RNA, 16 nt, Human
cuugagccaguaauug

SEQ ID NO: 3443254 - RNA, 17 nt, Human
cuugagcccuccccagg

SEQ ID NO: 3443255 - RNA, 13 nt, Human
cuugagcccuggc

SEQ ID NO: 3443256 - RNA, 15 nt, Human
cuugagccuugaacu

SEQ ID NO: 3443257 - RNA, 19 nt, Human
cuugagccuugaacuuuga

SEQ ID NO: 3443258 - RNA, 13 nt, Human
cuugagcuggccu

SEQ ID NO: 3443259 - RNA, 16 nt, Human
cuugagcuggccucuc

SEQ ID NO: 3443260 - RNA, 12 nt, Human
cuugagcuuggc

SEQ ID NO: 3443261 - RNA, 18 nt, Human
cuugaggaaacaacagcu

SEQ ID NO: 3443262 - RNA, 21 nt, Human
cuugaggaaacaacagcuuua

SEQ ID NO: 3443263 - RNA, 13 nt, Human
cuugaggacacau

SEQ ID NO: 3443264 - RNA, 14 nt, Human
cuugaggacacaug

SEQ ID NO: 3443265 - RNA, 22 nt, Human
cuugaggaggggcagguaaacu

SEQ ID NO: 3443266 - RNA, 15 nt, Human
cuugaggccugaucu

SEQ ID NO: 3443267 - RNA, 21 nt, Human
cuugaggccugaucugcccau

SEQ ID NO: 3443268 - RNA, 16 nt, Human
cuugagggagcuuagc

SEQ ID NO: 3443269 - RNA, 19 nt, Human
cuugagggcccagagcagg

SEQ ID NO: 3443270 - RNA, 14 nt, Human
cuugagggcugcag

SEQ ID NO: 3443271 - RNA, 23 nt, Human
cuugagggcugcaguucuacuca

SEQ ID NO: 3443272 - RNA, 19 nt, Human
cuugaggggaccaggagug

SEQ ID NO: 3443273 - RNA, 21 nt, Human
cuugaggggaccaggaguggg

SEQ ID NO: 3443274 - RNA, 16 nt, Human
cuugaggucucagccc

SEQ ID NO: 3443275 - RNA, 14 nt, Human
cuugaguaaaauaa

SEQ ID NO: 3443276 - RNA, 22 nt, Human
cuugagugggguuaucucugug

SEQ ID NO: 3443277 - RNA, 22 nt, Human
cuugagugucaagcugaccuug

SEQ ID NO: 3443278 - RNA, 19 nt, Human
cuugaguugauucagcucu

SEQ ID NO: 3443279 - RNA, 21 nt, Human
cuugaguugauucagcucugc

SEQ ID NO: 3443280 - RNA, 18 nt, Human
cuugaguuguuuuuguau

SEQ ID NO: 3443281 - RNA, 13 nt, Human
cuugaguuugucg

SEQ ID NO: 3443282 - RNA, 14 nt, Human
cuugauaaagaaga

SEQ ID NO: 3443283 - RNA, 22 nt, Human
cuugauaaauggcuuccuggca

SEQ ID NO: 3443284 - RNA, 14 nt, Human
cuugauaacagcua

SEQ ID NO: 3443285 - RNA, 16 nt, Human
cuugauaauuuuccuu

SEQ ID NO: 3443286 - RNA, 20 nt, Human
cuugauacauucaaauuugu

SEQ ID NO: 3443287 - RNA, 22 nt, Human
cuugauacauucaaauuugucu

SEQ ID NO: 3443288 - RNA, 18 nt, Human
cuugauaccccccucugu

SEQ ID NO: 3443289 - RNA, 21 nt, Human
cuugauaccccccucugucuu

SEQ ID NO: 3443290 - RNA, 22 nt, Human
cuugauacuaaaaguucuucuc

SEQ ID NO: 3443291 - RNA, 18 nt, Human
cuugauacuuguuuucaa

SEQ ID NO: 3443292 - RNA, 13 nt, Human
cuugauauuugua

SEQ ID NO: 3443293 - RNA, 22 nt, Human
cuugaucaguaguuugcauuuc

SEQ ID NO: 3443294 - RNA, 18 nt, Human
cuugaucaguuaagaaau

SEQ ID NO: 3443295 - RNA, 17 nt, Human
cuugauccauuucuaau

SEQ ID NO: 3443296 - RNA, 20 nt, Human
cuugaucugcucagcccugg

SEQ ID NO: 3443297 - RNA, 21 nt, Human
cuugaucugcucagcccugga

SEQ ID NO: 3443298 - RNA, 23 nt, Human
cuugaucugcucagcccuggagg

SEQ ID NO: 3443299 - RNA, 21 nt, Human
cuugaugaaauaacacagcag

SEQ ID NO: 3443300 - RNA, 22 nt, Human
cuugaugaaauaacacagcagu

SEQ ID NO: 3443301 - RNA, 23 nt, Human
cuugaugaguguaacaagaaagg

SEQ ID NO: 3443302 - RNA, 21 nt, Human
cuugaugcaugcacuguuccc

SEQ ID NO: 3443303 - RNA, 13 nt, Human
cuugaugcaugug

SEQ ID NO: 3443304 - RNA, 23 nt, Human
cuugaugccauaugccuugggga

SEQ ID NO: 3443305 - RNA, 12 nt, Human
cuugaugccugg

SEQ ID NO: 3443306 - RNA, 18 nt, Human
cuugaugggauucuggac

SEQ ID NO: 3443307 - RNA, 15 nt, Human
cuugauguaaaaucu

SEQ ID NO: 3443308 - RNA, 17 nt, Human
cuugauguaaaaucuug

SEQ ID NO: 3443309 - RNA, 20 nt, Human
cuugauguaaaaucuuguca

SEQ ID NO: 3443310 - RNA, 21 nt, Human
cuugauguaaggaugggcaug

SEQ ID NO: 3443311 - RNA, 22 nt, Human
cuugaugugccauuuuaaaaaa

SEQ ID NO: 3443312 - RNA, 22 nt, Human
cuugauguggugaggcaggcuu

SEQ ID NO: 3443313 - RNA, 15 nt, Human
cuugauguguuaucu

SEQ ID NO: 3443314 - RNA, 22 nt, Human
cuucuaaguaaaaccacagcag

SEQ ID NO: 3443315 - RNA, 18 nt, Human
cuucuaaguaaauacaau

SEQ ID NO: 3443316 - RNA, 14 nt, Human
cuucuaauauauuu

SEQ ID NO: 3443317 - RNA, 15 nt, Human
cuucuaauauauuuu

SEQ ID NO: 3443318 - RNA, 20 nt, Human
cuucuaauauauuuuuauau

SEQ ID NO: 3443319 - RNA, 21 nt, Human
cuucuaaucugcuaugcuuga

SEQ ID NO: 3443320 - RNA, 22 nt, Human
cuucuaaucugcuaugcuugaa

SEQ ID NO: 3443321 - RNA, 15 nt, Human
cuucuaauugccaug

SEQ ID NO: 3443322 - RNA, 12 nt, Human
cuucuaccugcc

SEQ ID NO: 3443323 - RNA, 12 nt, Human
cuugccuccugu

SEQ ID NO: 3443324 - RNA, 18 nt, Human
cuugccucggcuccugcu

SEQ ID NO: 3443325 - RNA, 19 nt, Human
cuugccucggcuccugcug

SEQ ID NO: 3443326 - RNA, 22 nt, Human
cuugccucggcuccugcugcac

SEQ ID NO: 3443327 - RNA, 15 nt, Human
cuugccucugcacac

SEQ ID NO: 3443328 - RNA, 17 nt, Human
cuugccucuguccccuu

SEQ ID NO: 3443329 - RNA, 14 nt, Human
cuugccucugugcu

SEQ ID NO: 3443330 - RNA, 12 nt, Human
cuugccucuucc

SEQ ID NO: 3443331 - RNA, 13 nt, Human
cuugccugcaggg

SEQ ID NO: 3443332 - RNA, 17 nt, Human
cuugccugcagggccau

SEQ ID NO: 3443333 - RNA, 16 nt, Human
cuugccugccuuucca

SEQ ID NO: 3443334 - RNA, 16 nt, Human
cuugccugguacagua

SEQ ID NO: 3443335 - RNA, 14 nt, Human
cuugccugugccag

SEQ ID NO: 3443336 - RNA, 15 nt, Human
cuugccuuacacaaa

SEQ ID NO: 3443337 - RNA, 21 nt, Human
cuugccuuauuagagugucuu

SEQ ID NO: 3443338 - RNA, 15 nt, Human
cuugccuuccuaagc

SEQ ID NO: 3443339 - RNA, 20 nt, Human
cuugccuuccuaagccugug

SEQ ID NO: 3443340 - RNA, 22 nt, Human
cuugccuuccuaagccuguggc

SEQ ID NO: 3443341 - RNA, 15 nt, Human
cuugccuucuggugu

SEQ ID NO: 3443342 - RNA, 19 nt, Human
cuugccuucuucacccagc

SEQ ID NO: 3443343 - RNA, 23 nt, Human
cuugccuuuagccccucccaagc

SEQ ID NO: 3443344 - RNA, 19 nt, Human
cuugccuuucgaggccuga

SEQ ID NO: 3443345 - RNA, 12 nt, Human
cuugccuuucuc

SEQ ID NO: 3443346 - RNA, 14 nt, Human
cuugccuuuuucau

SEQ ID NO: 3443347 - RNA, 15 nt, Human
cuugccuuuuucauu

SEQ ID NO: 3443348 - RNA, 23 nt, Human
cuugcgaacuagagaugugcaau

SEQ ID NO: 3443349 - RNA, 19 nt, Human
cuugcuaaucagugucuca

SEQ ID NO: 3443350 - RNA, 17 nt, Human
cuugcuaccaguauuua

SEQ ID NO: 3443351 - RNA, 20 nt, Human
cuugcuagcuaugugaccuu

SEQ ID NO: 3443352 - RNA, 23 nt, Human
cuugcuagcuaugugaccuugag

SEQ ID NO: 3443353 - RNA, 22 nt, Human
cuugcuauauugcccaggcugg

SEQ ID NO: 3443354 - RNA, 23 nt, Human
cuugcuauauugcccaggcuggu

SEQ ID NO: 3443355 - RNA, 21 nt, Human
cuugcuaucggggaagccaga

SEQ ID NO: 3443356 - RNA, 13 nt, Human
cuugcuaugauga

SEQ ID NO: 3443357 - RNA, 23 nt, Human
cuugcuauucugucccuaggugu

SEQ ID NO: 3443358 - RNA, 14 nt, Human
cuugcucauuaauu

SEQ ID NO: 3443359 - RNA, 13 nt, Human
cuugcucccuuca

SEQ ID NO: 3443360 - RNA, 15 nt, Human
cuugcuccuccuucu

SEQ ID NO: 3443361 - RNA, 19 nt, Human
cuugcucuaucucacagca

SEQ ID NO: 3443362 - RNA, 20 nt, Human
cuugcucuaucucacagcac

SEQ ID NO: 3443363 - RNA, 20 nt, Human
cuugcucuccccugcccugc

SEQ ID NO: 3443364 - RNA, 15 nt, Human
cuugcucucuggccu

SEQ ID NO: 3443365 - RNA, 22 nt, Human
cuugcucucuggccuuuuccua

SEQ ID NO: 3443366 - RNA, 18 nt, Human
cuugcucucuuuuauucu

SEQ ID NO: 3443367 - RNA, 13 nt, Human
cuugcucugcuga

SEQ ID NO: 3443368 - RNA, 16 nt, Human
cuugcucugcugacag

SEQ ID NO: 3443369 - RNA, 17 nt, Human
cuugcucugcugacaga

SEQ ID NO: 3443370 - RNA, 22 nt, Human
cuugcucugcugacagacacag

SEQ ID NO: 3443371 - RNA, 22 nt, Human
cuuguauagguuuuaaagaccu

SEQ ID NO: 3443372 - RNA, 17 nt, Human
cuuguauaguguaaaau

SEQ ID NO: 3443373 - RNA, 11 nt, Human
cuuguauauuu

SEQ ID NO: 3443374 - RNA, 12 nt, Human
cuuguauauuug

SEQ ID NO: 3443375 - RNA, 14 nt, Human
cuuguauauuugua

SEQ ID NO: 3443376 - RNA, 16 nt, Human
cuuguauauuuguaca

SEQ ID NO: 3443377 - RNA, 17 nt, Human
cuuguauauuuguacaa

SEQ ID NO: 3443378 - RNA, 21 nt, Human
cuuguaugaaagauggcugug

SEQ ID NO: 3443379 - RNA, 15 nt, Human
cuuguauuaagaaug

SEQ ID NO: 3443380 - RNA, 22 nt, Human
cuuguauuaaguuguuaauaaa

SEQ ID NO: 3443381 - RNA, 23 nt, Human
cuuguauuaaguuguuaauaaaa

SEQ ID NO: 3443382 - RNA, 13 nt, Human
cuuguauuaugug

SEQ ID NO: 3443383 - RNA, 18 nt, Human
cuuguauuauguguguuu

SEQ ID NO: 3443384 - RNA, 12 nt, Human
cuuguauuuaaa

SEQ ID NO: 3443385 - RNA, 18 nt, Human
cuuguauuuaaauauuaa

SEQ ID NO: 3443386 - RNA, 20 nt, Human
cuuguauuuaaauauuaaau

SEQ ID NO: 3443387 - RNA, 14 nt, Human
cuuguauuuuguga

SEQ ID NO: 3443388 - RNA, 13 nt, Human
cuugucaaagaag

SEQ ID NO: 3443389 - RNA, 15 nt, Human
cuugucaaagaaggu

SEQ ID NO: 3443390 - RNA, 16 nt, Human
cuugucacaauaaaug

SEQ ID NO: 3443391 - RNA, 16 nt, Human
cuugucacgccagacu

SEQ ID NO: 3443392 - RNA, 17 nt, Human
cuugucacugacacaaa

SEQ ID NO: 3443393 - RNA, 22 nt, Human
cuugucacugguagaccaaaau

SEQ ID NO: 3443394 - RNA, 13 nt, Human
cuugucagagcug

SEQ ID NO: 3443395 - RNA, 14 nt, Human
cuugucagagcugg

SEQ ID NO: 3443396 - RNA, 17 nt, Human
cuugucaggagugugug

SEQ ID NO: 3443397 - RNA, 14 nt, Human
cuugucauguguau

SEQ ID NO: 3443398 - RNA, 17 nt, Human
cuugucauguguauaaa

SEQ ID NO: 3443399 - RNA, 18 nt, Human
cuugucauguguauaaaa

SEQ ID NO: 3443400 - RNA, 19 nt, Human
cuugucauguguauaaaaa

SEQ ID NO: 3443401 - RNA, 15 nt, Human
cuuguccacccaccu

SEQ ID NO: 3443402 - RNA, 14 nt, Human
cuuguccagcgccu

SEQ ID NO: 3443403 - RNA, 12 nt, Human
cuuguccagcug

SEQ ID NO: 3443404 - RNA, 21 nt, Human
cuugucccacgugucuuccac

SEQ ID NO: 3443405 - RNA, 14 nt, Human
cuuguccccaaauc

SEQ ID NO: 3443406 - RNA, 12 nt, Human
cuuguccccaca

SEQ ID NO: 3443407 - RNA, 14 nt, Human
cuuguccccacacu

SEQ ID NO: 3443408 - RNA, 20 nt, Human
cuuguccccuccucacuccc

SEQ ID NO: 3443409 - RNA, 21 nt, Human
cuuguccccugccugugccug

SEQ ID NO: 3443410 - RNA, 20 nt, Human
cuuguccuagcacagauggc

SEQ ID NO: 3443411 - RNA, 16 nt, Human
cuuguccucagccagu

SEQ ID NO: 3443412 - RNA, 22 nt, Human
cuuguccucaguccauuuauau

SEQ ID NO: 3443413 - RNA, 16 nt, Human
cuuguccuuagccugg

SEQ ID NO: 3443414 - RNA, 17 nt, Human
cuuguccuuagccugga

SEQ ID NO: 3443415 - RNA, 19 nt, Human
cuuguccuuagccuggacc

SEQ ID NO: 3443416 - RNA, 15 nt, Human
cuugucggccccacc

SEQ ID NO: 3443417 - RNA, 16 nt, Human
cuugucggcuccaguc

SEQ ID NO: 3443418 - RNA, 17 nt, Human
cuugucuauaaagcauu

SEQ ID NO: 3443419 - RNA, 17 nt, Human
cuugucuauuuuugucu

SEQ ID NO: 3443420 - RNA, 14 nt, Human
cuugucucaaugcu

SEQ ID NO: 3443421 - RNA, 19 nt, Human
cuugucucaaugcucauaa

SEQ ID NO: 3443422 - RNA, 15 nt, Human
cuugucucauuuuaa

SEQ ID NO: 3443423 - RNA, 19 nt, Human
cuugucuccuacuccugac

SEQ ID NO: 3443424 - RNA, 14 nt, Human
cuugucugauuucu

SEQ ID NO: 3443425 - RNA, 11 nt, Human
cuugucuuaaa

SEQ ID NO: 3443426 - RNA, 21 nt, Human
cuugucuuccuauuucagaag

SEQ ID NO: 3443427 - RNA, 18 nt, Human
cuugucuucugguacuuu

SEQ ID NO: 3443428 - RNA, 15 nt, Human
cuugucuuucugggg

SEQ ID NO: 3443429 - RNA, 13 nt, Human
cuugucuuuggac

SEQ ID NO: 3443430 - RNA, 21 nt, Human
cuugucuuuggacccugaggc

SEQ ID NO: 3443431 - RNA, 17 nt, Human
cuugucuuuucaaaaua

SEQ ID NO: 3443432 - RNA, 18 nt, Human
cuugugaaaauaauugac

SEQ ID NO: 3443433 - RNA, 14 nt, Human
cuugugaaaaugug

SEQ ID NO: 3443434 - RNA, 17 nt, Human
cuugugaaacacagcug

SEQ ID NO: 3443435 - RNA, 12 nt, Human
cuugugaacaga

SEQ ID NO: 3443436 - RNA, 21 nt, Human
cuugugaaggccaugauauuu

SEQ ID NO: 3443437 - RNA, 22 nt, Human
cuugugaauaaagagggugggu

SEQ ID NO: 3443438 - RNA, 17 nt, Human
cuugugaauauguacau

SEQ ID NO: 3443439 - RNA, 20 nt, Human
cuugugaaucaagggucagg

SEQ ID NO: 3443440 - RNA, 22 nt, Human
cuugugaaucaagggucaggcc

SEQ ID NO: 3443441 - RNA, 22 nt, Human
cuugugacagcucuuuuuguga

SEQ ID NO: 3443442 - RNA, 13 nt, Human
cuugugacccagc

SEQ ID NO: 3443443 - RNA, 16 nt, Human
cuugugacuagugcug

SEQ ID NO: 3443444 - RNA, 22 nt, Human
cuugugacuagugcugaagcuu

SEQ ID NO: 3443445 - RNA, 17 nt, Human
cuugugacuuuugcuuu

SEQ ID NO: 3443446 - RNA, 19 nt, Human
cuugugacuuuugcuuuaa

SEQ ID NO: 3443447 - RNA, 21 nt, Human
cuugugacuuuugcuuuaauu

SEQ ID NO: 3443448 - RNA, 24 nt, Human
cuugugaugucauacagagaaguc

SEQ ID NO: 3443449 - RNA, 15 nt, Human
cuugugauuauuuau

SEQ ID NO: 3443450 - RNA, 22 nt, Human
cuugugcacaggcagagcccag

SEQ ID NO: 3443451 - RNA, 23 nt, Human
cuugugcacccucuaucccaaua

SEQ ID NO: 3443452 - RNA, 19 nt, Human
cuugugccauagucacaug

SEQ ID NO: 3443453 - RNA, 14 nt, Human
cuugugccuggcuc

SEQ ID NO: 3443454 - RNA, 21 nt, Human
cuugugcuggauggagcccag

SEQ ID NO: 3443455 - RNA, 16 nt, Human
cuugugcuuugcucuu

SEQ ID NO: 3443456 - RNA, 18 nt, Human
cuuguggaauugggagcu

SEQ ID NO: 3443457 - RNA, 18 nt, Human
cuuguggacacagcucuu

SEQ ID NO: 3443458 - RNA, 21 nt, Human
cuuguggacacagcucuucuc

SEQ ID NO: 3443459 - RNA, 12 nt, Human
cuuguggagccc

SEQ ID NO: 3443460 - RNA, 14 nt, Human
cuuguggagcccca

SEQ ID NO: 3443461 - RNA, 16 nt, Human
cuuguggagccccaca

SEQ ID NO: 3443462 - RNA, 19 nt, Human
cuuguggagccccacacug

SEQ ID NO: 3443463 - RNA, 13 nt, Human
cuuguggcacauu

SEQ ID NO: 3443464 - RNA, 12 nt, Human
cuugugggccug

SEQ ID NO: 3443465 - RNA, 16 nt, Human
cuugugggccugggcu

SEQ ID NO: 3443466 - RNA, 19 nt, Human
cuugugggccugggcuccu

SEQ ID NO: 3443467 - RNA, 16 nt, Human
cuuguggggacccagg

SEQ ID NO: 3443468 - RNA, 14 nt, Human
cuuuaauucuguau

SEQ ID NO: 3443469 - RNA, 14 nt, Human
cuuuaauugugaau

SEQ ID NO: 3443470 - RNA, 22 nt, Human
cuuuaauugugaauugauaaua

SEQ ID NO: 3443471 - RNA, 12 nt, Human
cuuuaauuuaug

SEQ ID NO: 3443472 - RNA, 16 nt, Human
cuuuaauuuauuuuug

SEQ ID NO: 3443473 - RNA, 19 nt, Human
cuuuaauuuauuuuugcau

SEQ ID NO: 3443474 - RNA, 13 nt, Human
cuuuaauuuuagc

SEQ ID NO: 3443475 - RNA, 15 nt, Human
cuuuaauuuuggaau

SEQ ID NO: 3443476 - RNA, 16 nt, Human
cuuuaauuuuggaauu

SEQ ID NO: 3443477 - RNA, 12 nt, Human
cuuuacaaaaag

SEQ ID NO: 3443478 - RNA, 16 nt, Human
cuuuacaaaacaaacu

SEQ ID NO: 3443479 - RNA, 20 nt, Human
cuuuacaaaagaaauaccuu

SEQ ID NO: 3443480 - RNA, 19 nt, Human
cuuuacaauguucauccca

SEQ ID NO: 3443481 - RNA, 21 nt, Human
cuuuacacauucggcucccug

SEQ ID NO: 3443482 - RNA, 23 nt, Human
cuuuacacauucggcucccugga

SEQ ID NO: 3443483 - RNA, 23 nt, Human
cuuuacacggagcggauugcaaa

SEQ ID NO: 3443484 - RNA, 18 nt, Human
cuuuacauacuuuaucaa

SEQ ID NO: 3443485 - RNA, 17 nt, Human
cuuuacaugaggacucu

SEQ ID NO: 3443486 - RNA, 16 nt, Human
cuuuaccaauugaagu

SEQ ID NO: 3443487 - RNA, 18 nt, Human
cuuuaccaauugaaguaa

SEQ ID NO: 3443488 - RNA, 19 nt, Human
cuuuaccaauugaaguaaa

SEQ ID NO: 3443489 - RNA, 17 nt, Human
cuuuaccacccccacac

SEQ ID NO: 3443490 - RNA, 16 nt, Human
cuuuacccauuugggu

SEQ ID NO: 3443491 - RNA, 17 nt, Human
cuuuaccccaucccugu

SEQ ID NO: 3443492 - RNA, 14 nt, Human
cuuuacccucaucu

SEQ ID NO: 3443493 - RNA, 17 nt, Human
cuuuacccucaucuguc

SEQ ID NO: 3443494 - RNA, 17 nt, Human
cuuuacccucuuugcug

SEQ ID NO: 3443495 - RNA, 19 nt, Human
cuuuacccucuuugcugca

SEQ ID NO: 3443496 - RNA, 18 nt, Human
cuuuacccuugagcccuc

SEQ ID NO: 3443497 - RNA, 13 nt, Human
cuuuaccugagac

SEQ ID NO: 3443498 - RNA, 17 nt, Human
cuuuaccuuuuuuauac

SEQ ID NO: 3443499 - RNA, 14 nt, Human
cuuuacuccucaca

SEQ ID NO: 3443500 - RNA, 14 nt, Human
cuuuacugacccug

SEQ ID NO: 3443501 - RNA, 19 nt, Human
cuuuacugacccuggggcu

SEQ ID NO: 3443502 - RNA, 18 nt, Human
cuuuacugccugaauaaa

SEQ ID NO: 3443503 - RNA, 19 nt, Human
cuuuacugccugaauaaag

SEQ ID NO: 3443504 - RNA, 15 nt, Human
cuuuacugucaaaau

SEQ ID NO: 3443505 - RNA, 12 nt, Human
cuuuacuguuug

SEQ ID NO: 3443506 - RNA, 16 nt, Human
cuuuacuuaaaaauau

SEQ ID NO: 3443507 - RNA, 18 nt, Human
cuuuacuuagcuuaucaa

SEQ ID NO: 3443508 - RNA, 18 nt, Human
cuuuacuuuagaagcaca

SEQ ID NO: 3443509 - RNA, 16 nt, Human
cuuuacuuucccuugc

SEQ ID NO: 3443510 - RNA, 18 nt, Human
cuuuacuuucccuugcuu

SEQ ID NO: 3443511 - RNA, 15 nt, Human
cuuuagaaaaaauga

SEQ ID NO: 3443512 - RNA, 14 nt, Human
cuuuagaaaaggca

SEQ ID NO: 3443513 - RNA, 18 nt, Human
cuuuagaaacacauaauu

SEQ ID NO: 3443514 - RNA, 14 nt, Human
cuuuagaaacagug

SEQ ID NO: 3443515 - RNA, 19 nt, Human
cuuuagaaagcugacauug

SEQ ID NO: 3443516 - RNA, 23 nt, Human
cuuuagaaauaaaccuuaauauu

SEQ ID NO: 3443517 - RNA, 19 nt, Human
cuuuagaagugcauuucug

SEQ ID NO: 3443518 - RNA, 20 nt, Human
cuuuagaagugcauuucuga

SEQ ID NO: 3443519 - RNA, 20 nt, Human
cuuuagaaucccagcccccu

SEQ ID NO: 3443520 - RNA, 23 nt, Human
cuuuagaaucccagcccccugac

SEQ ID NO: 3443521 - RNA, 23 nt, Human
cuuuagacccugggugggcucug

SEQ ID NO: 3443522 - RNA, 17 nt, Human
cuuuagacuugaaaaga

SEQ ID NO: 3443523 - RNA, 13 nt, Human
cuuuagagaacug

SEQ ID NO: 3443524 - RNA, 19 nt, Human
cuuuagagaacugaaaaga

SEQ ID NO: 3443525 - RNA, 18 nt, Human
cuuuagagcauugccauu

SEQ ID NO: 3443526 - RNA, 23 nt, Human
cuuuagagcauugccauucccug

SEQ ID NO: 3443527 - RNA, 15 nt, Human
cuuuagauagcccug

SEQ ID NO: 3443528 - RNA, 21 nt, Human
cuuuagauagcccuguccugg

SEQ ID NO: 3443529 - RNA, 23 nt, Human
cuuuagcaaaaaaaacccaugug

SEQ ID NO: 3443530 - RNA, 23 nt, Human
cuuuagcacguuuaaaguucugu

SEQ ID NO: 3443531 - RNA, 18 nt, Human
cuuuagcagaaucaaaau

SEQ ID NO: 3443532 - RNA, 16 nt, Human
cuuuagccaaacccuu

SEQ ID NO: 3443533 - RNA, 18 nt, Human
cuuuagccccucccaagc

SEQ ID NO: 3443534 - RNA, 23 nt, Human
cuuuagccccucccaagcuggcu

SEQ ID NO: 3443535 - RNA, 15 nt, Human
cuuuagcgcccaguu

SEQ ID NO: 3443536 - RNA, 18 nt, Human
cuuuaggcagcagcuuuu

SEQ ID NO: 3443537 - RNA, 16 nt, Human
cuugggcccagcuggg

SEQ ID NO: 3443538 - RNA, 21 nt, Human
cuugggcccagcugggcucug

SEQ ID NO: 3443539 - RNA, 22 nt, Human
cuugggcgccgugcugggcagc

SEQ ID NO: 3443540 - RNA, 14 nt, Human
cuugggcggcugag

SEQ ID NO: 3443541 - RNA, 15 nt, Human
cuugggcggcugaga

SEQ ID NO: 3443542 - RNA, 13 nt, Human
cuugggcucugau

SEQ ID NO: 3443543 - RNA, 16 nt, Human
cuugggcucugaugaa

SEQ ID NO: 3443544 - RNA, 13 nt, Human
cuugggcucugcu

SEQ ID NO: 3443545 - RNA, 14 nt, Human
cuugggcucugcug

SEQ ID NO: 3443546 - RNA, 18 nt, Human
cuuggggaauuuccucua

SEQ ID NO: 3443547 - RNA, 15 nt, Human
cuuggggacaucucu

SEQ ID NO: 3443548 - RNA, 19 nt, Human
cuuggggaccagagcugcc

SEQ ID NO: 3443549 - RNA, 20 nt, Human
cuuggggaguuaagaccugg

SEQ ID NO: 3443550 - RNA, 20 nt, Human
cuuggggaguuuaggguggg

SEQ ID NO: 3443551 - RNA, 23 nt, Human
cuuggggcaacauuguucaccuu

SEQ ID NO: 3443552 - RNA, 15 nt, Human
cuuggggcaggcagu

SEQ ID NO: 3443553 - RNA, 22 nt, Human
cuuggggccaccaaagcugccc

SEQ ID NO: 3443554 - RNA, 16 nt, Human
cuuggggcuggagagg

SEQ ID NO: 3443555 - RNA, 20 nt, Human
cuuggggcuugacuuuugua

SEQ ID NO: 3443556 - RNA, 21 nt, Human
cuuggggcuugacuuuuguau

SEQ ID NO: 3443557 - RNA, 18 nt, Human
cuugggggacagggcugg

SEQ ID NO: 3443558 - RNA, 24 nt, Human
cuugggggaugacuagaggcaggg

SEQ ID NO: 3443559 - RNA, 21 nt, Human
cuugggggcucagcaaggcca

SEQ ID NO: 3443560 - RNA, 23 nt, Human
cuuggggggcugaggugggagga

SEQ ID NO: 3443561 - RNA, 14 nt, Human
cuuggggggguggc

SEQ ID NO: 3443562 - RNA, 16 nt, Human
cuuggggggguggccg

SEQ ID NO: 3443563 - RNA, 19 nt, Human
cuuggggggguggccgcug

SEQ ID NO: 3443564 - RNA, 24 nt, Human
cuuggggggugaugagggcagcag

SEQ ID NO: 3443565 - RNA, 18 nt, Human
cuuggggguucaggcccg

SEQ ID NO: 3443566 - RNA, 22 nt, Human
cuuggggucagguugacaggag

SEQ ID NO: 3443567 - RNA, 19 nt, Human
cuuggguagaguuuacagc

SEQ ID NO: 3443568 - RNA, 19 nt, Human
cuuggguggagaagccauu

SEQ ID NO: 3443569 - RNA, 23 nt, Human
cuuggguggagaagccauugucu

SEQ ID NO: 3443570 - RNA, 22 nt, Human
cuugguaaaguccuuuucuugc

SEQ ID NO: 3443571 - RNA, 19 nt, Human
cuugguacuugcugcuauu

SEQ ID NO: 3443572 - RNA, 18 nt, Human
cuugguccaacugcaacu

SEQ ID NO: 3443573 - RNA, 15 nt, Human
cuugguccugcugca

SEQ ID NO: 3443574 - RNA, 14 nt, Human
cuuggucucagugu

SEQ ID NO: 3443575 - RNA, 13 nt, Human
cuuggucugccag

SEQ ID NO: 3443576 - RNA, 17 nt, Human
cuuggucugccaggccc

SEQ ID NO: 3443577 - RNA, 20 nt, Human
cuuggucugccaggccccca

SEQ ID NO: 3443578 - RNA, 15 nt, Human
cuuggucuuauuuau

SEQ ID NO: 3443579 - RNA, 20 nt, Human
cuuggugaauuuuuuuuucc

SEQ ID NO: 3443580 - RNA, 19 nt, Human
cuuggugauuccgcaguga

SEQ ID NO: 3443581 - RNA, 17 nt, Human
cuuggugccucugcagu

SEQ ID NO: 3443582 - RNA, 14 nt, Human
cuuggugcugggaa

SEQ ID NO: 3443583 - RNA, 15 nt, Human
cuuggugcugggaac

SEQ ID NO: 3443584 - RNA, 16 nt, Human
cuugguguaauuugaa

SEQ ID NO: 3443585 - RNA, 19 nt, Human
cuugguguccaccuggccc

SEQ ID NO: 3443586 - RNA, 19 nt, Human
cuuggugucgggcaugaca

SEQ ID NO: 3443587 - RNA, 16 nt, Human
cuugguguuaaaacac

SEQ ID NO: 3443588 - RNA, 17 nt, Human
cuugguuauacaugaca

SEQ ID NO: 3443589 - RNA, 19 nt, Human
cuugguuauacaugacacu

SEQ ID NO: 3443590 - RNA, 22 nt, Human
cuugguucauaaaugaauuuua

SEQ ID NO: 3443591 - RNA, 17 nt, Human
cuugguucaucaguguu

SEQ ID NO: 3443592 - RNA, 16 nt, Human
cuugguucccauuugc

SEQ ID NO: 3443593 - RNA, 16 nt, Human
cuugguucccccacug

SEQ ID NO: 3443594 - RNA, 17 nt, Human
cuugguucccuugugug

SEQ ID NO: 3443595 - RNA, 15 nt, Human
cuugguuccuggggc

SEQ ID NO: 3443596 - RNA, 17 nt, Human
cuugguuccuggggcau

SEQ ID NO: 3443597 - RNA, 23 nt, Human
cuugguucuugaggggaccagga

SEQ ID NO: 3443598 - RNA, 16 nt, Human
cuugguuggcuggccu

SEQ ID NO: 3443599 - RNA, 14 nt, Human
cuugguugucucca

SEQ ID NO: 3443600 - RNA, 22 nt, Human
cuugguuucuucaacaggagaa

SEQ ID NO: 3443601 - RNA, 14 nt, Human
cuugguuuguaaau

SEQ ID NO: 3443602 - RNA, 20 nt, Human
cuugguuuuuacugcucuga

SEQ ID NO: 3443603 - RNA, 21 nt, Human
cuugguuuuuacugcucugag

SEQ ID NO: 3443604 - RNA, 12 nt, Human
cuuguaaagacu

SEQ ID NO: 3443605 - RNA, 14 nt, Human
cuuguaaagacugg

SEQ ID NO: 3443606 - RNA, 18 nt, Human
cuuguaaagacuguagaa

SEQ ID NO: 3443607 - RNA, 12 nt, Human
cuuguaaauaaa

SEQ ID NO: 3443608 - RNA, 15 nt, Human
cuuguaaauaaagcc

SEQ ID NO: 3443609 - RNA, 16 nt, Human
cuuguaaauaaagccc

SEQ ID NO: 3443610 - RNA, 14 nt, Human
cuuguaaauaccag

SEQ ID NO: 3443611 - RNA, 17 nt, Human
cuuguaaauagcucagg

SEQ ID NO: 3443612 - RNA, 23 nt, Human
cuuuauuuuuuaaguauuuauau

SEQ ID NO: 3443613 - RNA, 16 nt, Human
cuuucaaaccagcuuc

SEQ ID NO: 3443614 - RNA, 21 nt, Human
cuuucaaagaaggaauucuag

SEQ ID NO: 3443615 - RNA, 13 nt, Human
cuuucaaaucggu

SEQ ID NO: 3443616 - RNA, 21 nt, Human
cuuucaaauugagagaaugga

SEQ ID NO: 3443617 - RNA, 21 nt, Human
cuuucaaauuuagaaacuaau

SEQ ID NO: 3443618 - RNA, 14 nt, Human
cuuucaaauuucac

SEQ ID NO: 3443619 - RNA, 15 nt, Human
cuuucaaauuucaca

SEQ ID NO: 3443620 - RNA, 13 nt, Human
cuuucaagaacuu

SEQ ID NO: 3443621 - RNA, 16 nt, Human
cuuucaagaacuuguu

SEQ ID NO: 3443622 - RNA, 16 nt, Human
cuuucaagaucuaaau

SEQ ID NO: 3443623 - RNA, 17 nt, Human
cuuucaagaucuaaauc

SEQ ID NO: 3443624 - RNA, 19 nt, Human
cuuucaagcagucgugccu

SEQ ID NO: 3443625 - RNA, 19 nt, Human
cuuucaagggcuuuccugu

SEQ ID NO: 3443626 - RNA, 16 nt, Human
cuuucaauaacgaagu

SEQ ID NO: 3443627 - RNA, 23 nt, Human
cuuucaauaggaaaaacugauuu

SEQ ID NO: 3443628 - RNA, 20 nt, Human
cuuucaauugucacuuuuua

SEQ ID NO: 3443629 - RNA, 17 nt, Human
cuuucacaaaauuuuau

SEQ ID NO: 3443630 - RNA, 20 nt, Human
cuuucacaaaauuuuauucc

SEQ ID NO: 3443631 - RNA, 15 nt, Human
cuuucacacuuccac

SEQ ID NO: 3443632 - RNA, 16 nt, Human
cuuucacacuuccacc

SEQ ID NO: 3443633 - RNA, 20 nt, Human
cuuucacacuuccaccagcc

SEQ ID NO: 3443634 - RNA, 14 nt, Human
cuuucacaggcagc

SEQ ID NO: 3443635 - RNA, 15 nt, Human
cuuucacaggcagcc

SEQ ID NO: 3443636 - RNA, 17 nt, Human
cuuucacauagagauca

SEQ ID NO: 3443637 - RNA, 17 nt, Human
cuuucacccacagaaag

SEQ ID NO: 3443638 - RNA, 19 nt, Human
cuuucacccacagaaagag

SEQ ID NO: 3443639 - RNA, 15 nt, Human
cuuucaccccagggc

SEQ ID NO: 3443640 - RNA, 21 nt, Human
cuuucaccccagggccugagc

SEQ ID NO: 3443641 - RNA, 20 nt, Human
cuuucacccuuuucuguuug

SEQ ID NO: 3443642 - RNA, 20 nt, Human
cuuucacuauaaugugaaau

SEQ ID NO: 3443643 - RNA, 12 nt, Human
cuuucacuucuu

SEQ ID NO: 3443644 - RNA, 10 nt, Human
cuuucagaaa

SEQ ID NO: 3443645 - RNA, 18 nt, Human
cuuucagaaaacagaaaa

SEQ ID NO: 3443646 - RNA, 23 nt, Human
cuuucagaaauauaacacauuuu

SEQ ID NO: 3443647 - RNA, 21 nt, Human
cuuucagaauaugucagugcu

SEQ ID NO: 3443648 - RNA, 19 nt, Human
cuuucagacucucucuggg

SEQ ID NO: 3443649 - RNA, 22 nt, Human
cuuucagacucucucugggagg

SEQ ID NO: 3443650 - RNA, 12 nt, Human
cuuucagagccu

SEQ ID NO: 3443651 - RNA, 19 nt, Human
cuuucagauacaugguugu

SEQ ID NO: 3443652 - RNA, 15 nt, Human
cuuucagaugucuuc

SEQ ID NO: 3443653 - RNA, 17 nt, Human
cuuucagaugucuucug

SEQ ID NO: 3443654 - RNA, 21 nt, Human
cuuucagcaagauaaacauua

SEQ ID NO: 3443655 - RNA, 16 nt, Human
cuuucagcaggcagcc

SEQ ID NO: 3443656 - RNA, 18 nt, Human
cuuucagcaggcagccuu

SEQ ID NO: 3443657 - RNA, 20 nt, Human
cuuucagccaagaauucuua

SEQ ID NO: 3443658 - RNA, 23 nt, Human
cuuucagccaagaauucuuaaau

SEQ ID NO: 3443659 - RNA, 12 nt, Human
cuuucagcuccu

SEQ ID NO: 3443660 - RNA, 14 nt, Human
cuuucagcuccuga

SEQ ID NO: 3443661 - RNA, 21 nt, Human
cuuucagcuccugaccaguug

SEQ ID NO: 3443662 - RNA, 13 nt, Human
cuuucagcugucu

SEQ ID NO: 3443663 - RNA, 19 nt, Human
cuuucaggagcuccauaca

SEQ ID NO: 3443664 - RNA, 15 nt, Human
cuuucaggaucuauu

SEQ ID NO: 3443665 - RNA, 16 nt, Human
cuuucaggaucuauuu

SEQ ID NO: 3443666 - RNA, 15 nt, Human
cuuucagggccucca

SEQ ID NO: 3443667 - RNA, 21 nt, Human
cuuucaguacuuuuuuaaaua

SEQ ID NO: 3443668 - RNA, 17 nt, Human
cuuucauaaucuuugcu

SEQ ID NO: 3443669 - RNA, 18 nt, Human
cuuucauaaucuuugcuu

SEQ ID NO: 3443670 - RNA, 17 nt, Human
cuuucauacugaagaug

SEQ ID NO: 3443671 - RNA, 19 nt, Human
cuuucauauuuuaaacaga

SEQ ID NO: 3443672 - RNA, 23 nt, Human
cuuucauauuuuaaacagaggau

SEQ ID NO: 3443673 - RNA, 19 nt, Human
cuuucauccugacucugcc

SEQ ID NO: 3443674 - RNA, 20 nt, Human
cuuucauccugacucugccc

SEQ ID NO: 3443675 - RNA, 21 nt, Human
cuuucauccugacucugcccc

SEQ ID NO: 3443676 - RNA, 18 nt, Human
cuuucaugaguuuuuccc

SEQ ID NO: 3443677 - RNA, 22 nt, Human
cuuucauggcugcuguugcuua

SEQ ID NO: 3443678 - RNA, 19 nt, Human
cuuucauggggugaugcug

SEQ ID NO: 3443679 - RNA, 17 nt, Human
cuuucauguaaacugug

SEQ ID NO: 3443680 - RNA, 19 nt, Human
cuuucauguaaacugugca

SEQ ID NO: 3443681 - RNA, 20 nt, Human
cuuucauuaaagcauuuacu

SEQ ID NO: 3443682 - RNA, 15 nt, Human
cuuucauugccagug

SEQ ID NO: 3443683 - RNA, 15 nt, Human
cuuucauuucuucua

SEQ ID NO: 3443684 - RNA, 14 nt, Human
cuuucauuugcuuu

SEQ ID NO: 3443685 - RNA, 18 nt, Human
cuuucauuugcuuuggaa

SEQ ID NO: 3443686 - RNA, 10 nt, Human
cuuucauuuu

SEQ ID NO: 3443687 - RNA, 21 nt, Human
cuuucauuuucucucagguga

SEQ ID NO: 3443688 - RNA, 14 nt, Human
cuuucauuuucugu

SEQ ID NO: 3443689 - RNA, 19 nt, Human
cuuucauuuuuuuccaggc

SEQ ID NO: 3443690 - RNA, 17 nt, Human
cuuuccaaaauuuuuca

SEQ ID NO: 3443691 - RNA, 14 nt, Human
cgggagcaucucuu

SEQ ID NO: 3443692 - RNA, 17 nt, Human
cgggagccgcuggcaga

SEQ ID NO: 3443693 - RNA, 17 nt, Human
cgggagccuaggaccac

SEQ ID NO: 3443694 - RNA, 15 nt, Human
cgggagccucccugc

SEQ ID NO: 3443695 - RNA, 22 nt, Human
cgggagccucccugccucaggc

SEQ ID NO: 3443696 - RNA, 20 nt, Human
cgggagcgguggcccugucc

SEQ ID NO: 3443697 - RNA, 20 nt, Human
cgggaggauguucugggaca

SEQ ID NO: 3443698 - RNA, 20 nt, Human
cgggaggcagagguugcagu

SEQ ID NO: 3443699 - RNA, 22 nt, Human
cgggaggcggagcuugcaguga

SEQ ID NO: 3443700 - RNA, 18 nt, Human
cgggaggcugagacagga

SEQ ID NO: 3443701 - RNA, 16 nt, Human
cgggagggcggcacag

SEQ ID NO: 3443702 - RNA, 14 nt, Human
cgggaggggcccgc

SEQ ID NO: 3443703 - RNA, 18 nt, Human
cgggaggucgaggcagga

SEQ ID NO: 3443704 - RNA, 14 nt, Human
cgggaguggacagg

SEQ ID NO: 3443705 - RNA, 16 nt, Human
cgggaugguccugggg

SEQ ID NO: 3443706 - RNA, 17 nt, Human
cgggauuaguacacacu

SEQ ID NO: 3443707 - RNA, 14 nt, Human
cgggcacaauaaau

SEQ ID NO: 3443708 - RNA, 18 nt, Human
cgggcacagcugugguga

SEQ ID NO: 3443709 - RNA, 14 nt, Human
cgggcaccagccag

SEQ ID NO: 3443710 - RNA, 19 nt, Human
cgggcaccuauagucccag

SEQ ID NO: 3443711 - RNA, 12 nt, Human
cgggcagagcac

SEQ ID NO: 3443712 - RNA, 23 nt, Human
cgggcagagggcuggaggcccag

SEQ ID NO: 3443713 - RNA, 14 nt, Human
cgggcagccuggcu

SEQ ID NO: 3443714 - RNA, 18 nt, Human
cgggcagccuggcuccca

SEQ ID NO: 3443715 - RNA, 11 nt, Human
cgggcagggcc

SEQ ID NO: 3443716 - RNA, 17 nt, Human
cgggcagggcucccaca

SEQ ID NO: 3443717 - RNA, 17 nt, Human
cgggcaugggcacuccc

SEQ ID NO: 3443718 - RNA, 12 nt, Human
cgggccacagag

SEQ ID NO: 3443719 - RNA, 17 nt, Human
cgggccacagagaaagu

SEQ ID NO: 3443720 - RNA, 20 nt, Human
cgggccacuccuuccugccc

SEQ ID NO: 3443721 - RNA, 13 nt, Human
cgggccagccagg

SEQ ID NO: 3443722 - RNA, 15 nt, Human
cgggccagccaggcg

SEQ ID NO: 3443723 - RNA, 16 nt, Human
cgggcccaccuggcca

SEQ ID NO: 3443724 - RNA, 14 nt, Human
cgggcccagcacuu

SEQ ID NO: 3443725 - RNA, 12 nt, Human
cgggcccagccc

SEQ ID NO: 3443726 - RNA, 15 nt, Human
cgggcccagccccca

SEQ ID NO: 3443727 - RNA, 15 nt, Human
cgggcccaggccauc

SEQ ID NO: 3443728 - RNA, 21 nt, Human
cgggccccaccugcagcuccc

SEQ ID NO: 3443729 - RNA, 15 nt, Human
cgggccccugggcuu

SEQ ID NO: 3443730 - RNA, 23 nt, Human
cgggccccugggcuuggccugcu

SEQ ID NO: 3443731 - RNA, 18 nt, Human
cgggcccguugaggauga

SEQ ID NO: 3443732 - RNA, 20 nt, Human
cgggccuguacagucugucu

SEQ ID NO: 3443733 - RNA, 22 nt, Human
cgggccuguccacaggcuucug

SEQ ID NO: 3443734 - RNA, 16 nt, Human
cgggcgcggccagccc

SEQ ID NO: 3443735 - RNA, 16 nt, Human
cgggcgcgguggcuca

SEQ ID NO: 3443736 - RNA, 21 nt, Human
cgggcggucagggguucgaga

SEQ ID NO: 3443737 - RNA, 11 nt, Human
cgggcucagca

SEQ ID NO: 3443738 - RNA, 18 nt, Human
cgggcuccagccaucuca

SEQ ID NO: 3443739 - RNA, 17 nt, Human
cgggcuccugugcccuu

SEQ ID NO: 3443740 - RNA, 12 nt, Human
cgggcucugccu

SEQ ID NO: 3443741 - RNA, 16 nt, Human
cgggcucugccuccca

SEQ ID NO: 3443742 - RNA, 16 nt, Human
cgggcugccugggcug

SEQ ID NO: 3443743 - RNA, 17 nt, Human
cgggcuggccugugccu

SEQ ID NO: 3443744 - RNA, 14 nt, Human
cgggcugggcagcu

SEQ ID NO: 3443745 - RNA, 17 nt, Human
cgggcugggcagcuguu

SEQ ID NO: 3443746 - RNA, 20 nt, Human
cgggcuuugugugaaggcag

SEQ ID NO: 3443747 - RNA, 15 nt, Human
cgggcuuuuccccgg

SEQ ID NO: 3443748 - RNA, 15 nt, Human
cggggaacuggccaa

SEQ ID NO: 3443749 - RNA, 17 nt, Human
cggggaacuggccaagc

SEQ ID NO: 3443750 - RNA, 16 nt, Human
cggggacagaggccug

SEQ ID NO: 3443751 - RNA, 17 nt, Human
cggggacagaggccugc

SEQ ID NO: 3443752 - RNA, 13 nt, Human
cggggacagcucc

SEQ ID NO: 3443753 - RNA, 14 nt, Human
cggggacucagccc

SEQ ID NO: 3443754 - RNA, 18 nt, Human
cggggagcgcccgcgccc

SEQ ID NO: 3443755 - RNA, 23 nt, Human
cggggagcggcggaaagccugua

SEQ ID NO: 3443756 - RNA, 13 nt, Human
cggggaggccaag

SEQ ID NO: 3443757 - RNA, 18 nt, Human
cguuggacuuuucguuaa

SEQ ID NO: 3443758 - RNA, 23 nt, Human
cguugggagggggagaaaaggaa

SEQ ID NO: 3443759 - RNA, 15 nt, Human
cguugguccagagcg

SEQ ID NO: 3443760 - RNA, 17 nt, Human
cguuuaaaguucugugu

SEQ ID NO: 3443761 - RNA, 20 nt, Human
cguuuacuaugccugugucu

SEQ ID NO: 3443762 - RNA, 15 nt, Human
cguuuacucacagcc

SEQ ID NO: 3443763 - RNA, 16 nt, Human
cguuuagaccaaggaa

SEQ ID NO: 3443764 - RNA, 21 nt, Human
cguuuagaccaaggaacaaaa

SEQ ID NO: 3443765 - RNA, 16 nt, Human
cguuuagcugacaaaa

SEQ ID NO: 3443766 - RNA, 22 nt, Human
cguuucagugucaaauaaacac

SEQ ID NO: 3443767 - RNA, 22 nt, Human
cguuuccaucagguuccauccc

SEQ ID NO: 3443768 - RNA, 20 nt, Human
cguuucuaugacacaugcaa

SEQ ID NO: 3443769 - RNA, 21 nt, Human
cguuucuuuaaccuuguauaa

SEQ ID NO: 3443770 - RNA, 20 nt, Human
cguuugaagacauugcacca

SEQ ID NO: 3443771 - RNA, 16 nt, Human
cguuugagaagaaaac

SEQ ID NO: 3443772 - RNA, 17 nt, Human
cguuuggaagauccugu

SEQ ID NO: 3443773 - RNA, 22 nt, Human
cguuuggaagauccugugagga

SEQ ID NO: 3443774 - RNA, 11 nt, Human
cguuuguguuc

SEQ ID NO: 3443775 - RNA, 20 nt, Human
cguuuguuccccaagacauu

SEQ ID NO: 3443776 - RNA, 13 nt, Human
cguuuguuuguuu

SEQ ID NO: 3443777 - RNA, 16 nt, Human
cguuuuaaggacugac

SEQ ID NO: 3443778 - RNA, 12 nt, Human
cguuuuauugug

SEQ ID NO: 3443779 - RNA, 13 nt, Human
cguuuucaaaauu

SEQ ID NO: 3443780 - RNA, 19 nt, Human
cguuuuccaaacugacuca

SEQ ID NO: 3443781 - RNA, 20 nt, Human
cguuuucuaauugcuuauuu

SEQ ID NO: 3443782 - RNA, 16 nt, Human
cguuuugcaagguaaa

SEQ ID NO: 3443783 - RNA, 11 nt, Human
cguuuugucac

SEQ ID NO: 3443784 - RNA, 14 nt, Human
cguuuuguuugaaa

SEQ ID NO: 3443785 - RNA, 16 nt, Human
cguuuuguuuugugcc

SEQ ID NO: 3443786 - RNA, 18 nt, Human
cuaaaaaaaaaaaaguau

SEQ ID NO: 3443787 - RNA, 20 nt, Human
cuaaaaaaaaaaaaguauua

SEQ ID NO: 3443788 - RNA, 11 nt, Human
cuaaaaaacag

SEQ ID NO: 3443789 - RNA, 15 nt, Human
cuaaaaaagauauau

SEQ ID NO: 3443790 - RNA, 17 nt, Human
cuaaaaacaaacccuuu

SEQ ID NO: 3443791 - RNA, 15 nt, Human
cuaaaaauaaaccaa

SEQ ID NO: 3443792 - RNA, 13 nt, Human
cuaaaaauaaagc

SEQ ID NO: 3443793 - RNA, 18 nt, Human
cuaaaaauaguggccaga

SEQ ID NO: 3443794 - RNA, 12 nt, Human
cuaaaacaauaa

SEQ ID NO: 3443795 - RNA, 15 nt, Human
cuaaaaccugagcua

SEQ ID NO: 3443796 - RNA, 23 nt, Human
cuaaaaccuuccaugucaagauu

SEQ ID NO: 3443797 - RNA, 18 nt, Human
cuaaaacuggccugacuu

SEQ ID NO: 3443798 - RNA, 18 nt, Human
cuaaaacuguacuuugau

SEQ ID NO: 3443799 - RNA, 20 nt, Human
cuaaaacuguacuuugauuc

SEQ ID NO: 3443800 - RNA, 14 nt, Human
cuaaaagaaacuuu

SEQ ID NO: 3443801 - RNA, 18 nt, Human
cuaaaagagauuucaaga

SEQ ID NO: 3443802 - RNA, 17 nt, Human
cuaaaagauauaagugc

SEQ ID NO: 3443803 - RNA, 20 nt, Human
cuaaaagauauaagugcugu

SEQ ID NO: 3443804 - RNA, 21 nt, Human
cuaaaagauauaagugcugua

SEQ ID NO: 3443805 - RNA, 20 nt, Human
cuaaaagcaaaauaaaaacu

SEQ ID NO: 3443806 - RNA, 12 nt, Human
cuaaaagcacac

SEQ ID NO: 3443807 - RNA, 12 nt, Human
cuaaaaggccca

SEQ ID NO: 3443808 - RNA, 18 nt, Human
cuaaaaggcccagagaga

SEQ ID NO: 3443809 - RNA, 23 nt, Human
cuaaaaggcccagagagaagagc

SEQ ID NO: 3443810 - RNA, 16 nt, Human
cuaaaagguucaggga

SEQ ID NO: 3443811 - RNA, 16 nt, Human
cuaaaauaaagaaaua

SEQ ID NO: 3443812 - RNA, 14 nt, Human
cuaaaauaagaaua

SEQ ID NO: 3443813 - RNA, 11 nt, Human
cuaaaauauau

SEQ ID NO: 3443814 - RNA, 10 nt, Human
cuaaaauauu

SEQ ID NO: 3443815 - RNA, 15 nt, Human
cuaaaauauuuauga

SEQ ID NO: 3443816 - RNA, 16 nt, Human
cuaaaauauuuaugaa

SEQ ID NO: 3443817 - RNA, 14 nt, Human
cuaaaauauuuauu

SEQ ID NO: 3443818 - RNA, 15 nt, Human
cuaaaaucugcuugu

SEQ ID NO: 3443819 - RNA, 19 nt, Human
cuaaaaucuuauaguucua

SEQ ID NO: 3443820 - RNA, 14 nt, Human
cuaaaaugauuuua

SEQ ID NO: 3443821 - RNA, 13 nt, Human
cuaaaauguaucu

SEQ ID NO: 3443822 - RNA, 19 nt, Human
cuaaaaugugauguucuaa

SEQ ID NO: 3443823 - RNA, 13 nt, Human
cuaaaauguuuuc

SEQ ID NO: 3443824 - RNA, 21 nt, Human
cuaaaauuuguggguuuuuuu

SEQ ID NO: 3443825 - RNA, 14 nt, Human
cuaaacaagauuuu

SEQ ID NO: 3443826 - RNA, 18 nt, Human
cuaaacacgugacacaaa

SEQ ID NO: 3443827 - RNA, 20 nt, Human
cuaaaccaaggacugagcac

SEQ ID NO: 3443828 - RNA, 15 nt, Human
cuaaaccauugugca

SEQ ID NO: 3443829 - RNA, 16 nt, Human
cuaaacccaauccaaa

SEQ ID NO: 3443830 - RNA, 15 nt, Human
cuaaaccccuguccc

SEQ ID NO: 3443831 - RNA, 16 nt, Human
cuaaaccccuguccca

SEQ ID NO: 3443832 - RNA, 12 nt, Human
cuaaaccucagu

SEQ ID NO: 3443833 - RNA, 17 nt, Human
cuaaaccucaguuauua

SEQ ID NO: 3443834 - RNA, 17 nt, Human
cuaaaccuuaguacuga

SEQ ID NO: 3443835 - RNA, 15 nt, Human
cuaaacggauuccaa

SEQ ID NO: 3443836 - RNA, 15 nt, Human
cuaaacgguucaguu

SEQ ID NO: 3443837 - RNA, 18 nt, Human
cuaaacguguauguuuuu

SEQ ID NO: 3443838 - RNA, 17 nt, Human
cuaaacuaggcuccuuc

SEQ ID NO: 3443839 - RNA, 22 nt, Human
cuaaacucauuuauaaagcuaa

SEQ ID NO: 3443840 - RNA, 14 nt, Human
cuaaacuccuuccu

SEQ ID NO: 3443841 - RNA, 16 nt, Human
cuaaacuccuuccugg

SEQ ID NO: 3443842 - RNA, 23 nt, Human
cuaaacugcccccucugcccugc

SEQ ID NO: 3443843 - RNA, 15 nt, Human
cuaaacuggagacug

SEQ ID NO: 3443844 - RNA, 19 nt, Human
cuaaacuggagacugugug

SEQ ID NO: 3443845 - RNA, 17 nt, Human
cuaaacuuuaauaugua

SEQ ID NO: 3443846 - RNA, 14 nt, Human
cuaaacuuucacac

SEQ ID NO: 3443847 - RNA, 18 nt, Human
cuaaacuuuuuuucugua

SEQ ID NO: 3443848 - RNA, 21 nt, Human
cuaaacuuuuuuucuguacca

SEQ ID NO: 3443849 - RNA, 17 nt, Human
cuaaagaaaaacaaacu

SEQ ID NO: 3443850 - RNA, 18 nt, Human
cuaaagaaaaagucaucc

SEQ ID NO: 3443851 - RNA, 23 nt, Human
cuaaagaccaaacuucacucugg

SEQ ID NO: 3443852 - RNA, 21 nt, Human
cuaaagacccuaaaucugagg

SEQ ID NO: 3443853 - RNA, 18 nt, Human
cuaaagaggcugaaagag

SEQ ID NO: 3443854 - RNA, 21 nt, Human
cuaaagauggaguuucuaagg

SEQ ID NO: 3443855 - RNA, 12 nt, Human
cuaaagauucua

SEQ ID NO: 3443856 - RNA, 13 nt, Human
cuaaagauuuuga

SEQ ID NO: 3443857 - RNA, 17 nt, Human
cuaaagauuuugaucuc

SEQ ID NO: 3443858 - RNA, 16 nt, Human
cuaaagcaauagaaac

SEQ ID NO: 3443859 - RNA, 17 nt, Human
cuaaagcaauagaaaca

SEQ ID NO: 3443860 - RNA, 11 nt, Human
cuaaagcagug

SEQ ID NO: 3443861 - RNA, 11 nt, Human
cuaaagccaaa

SEQ ID NO: 3443862 - RNA, 14 nt, Human
cuaaagccagccug

SEQ ID NO: 3443863 - RNA, 15 nt, Human
cuaaagccagccuga

SEQ ID NO: 3443864 - RNA, 12 nt, Human
cuaaagccuuua

SEQ ID NO: 3443865 - RNA, 12 nt, Human
cuaaagcucuga

SEQ ID NO: 3443866 - RNA, 15 nt, Human
cuaaagcugccagcc

SEQ ID NO: 3443867 - RNA, 18 nt, Human
cuaaagcugguuuaaugu

SEQ ID NO: 3443868 - RNA, 13 nt, Human
cuaaaggccucuu

SEQ ID NO: 3443869 - RNA, 17 nt, Human
cuaaaggcuaccuuugu

SEQ ID NO: 3443870 - RNA, 19 nt, Human
cuaaaggcuaccuuuguau

SEQ ID NO: 3443871 - RNA, 20 nt, Human
cuaaagguccacaggucuag

SEQ ID NO: 3443872 - RNA, 21 nt, Human
cuaaagguccacaggucuaga

SEQ ID NO: 3443873 - RNA, 23 nt, Human
cuaaagguccacaggucuagacu

SEQ ID NO: 3443874 - RNA, 17 nt, Human
cuaaagguguauuuaaa

SEQ ID NO: 3443875 - RNA, 20 nt, Human
cuaaaguacugagcagugau

SEQ ID NO: 3443876 - RNA, 17 nt, Human
cuaaaguagacuucauu

SEQ ID NO: 3443877 - RNA, 15 nt, Human
cuaaagugagcucua

SEQ ID NO: 3443878 - RNA, 14 nt, Human
cuaaaguuauauuu

SEQ ID NO: 3443879 - RNA, 22 nt, Human
cuaaaguuauauuucagaugua

SEQ ID NO: 3443880 - RNA, 11 nt, Human
cuaaaguucua

SEQ ID NO: 3443881 - RNA, 12 nt, Human
cuaaaguucuaa

SEQ ID NO: 3443882 - RNA, 18 nt, Human
cuaaaguucuaagauucu

SEQ ID NO: 3443883 - RNA, 19 nt, Human
cuaaaguuuacaguaaaua

SEQ ID NO: 3443884 - RNA, 17 nt, Human
cuaaauaaaauauaauu

SEQ ID NO: 3443885 - RNA, 18 nt, Human
cuaaauaaaauauaauug

SEQ ID NO: 3443886 - RNA, 22 nt, Human
cuaaauaaaaugcuagguucua

SEQ ID NO: 3443887 - RNA, 24 nt, Human
cuaaauaccugcccugacaugcac

SEQ ID NO: 3443888 - RNA, 21 nt, Human
cuaaauacugagaaaaccugu

SEQ ID NO: 3443889 - RNA, 20 nt, Human
cuaaauagcauguauugugu

SEQ ID NO: 3443890 - RNA, 18 nt, Human
cuaaauauauuuuaagac

SEQ ID NO: 3443891 - RNA, 14 nt, Human
cuaaauauuuccuu

SEQ ID NO: 3443892 - RNA, 19 nt, Human
cuaaaucagagacaaaaua

SEQ ID NO: 3443893 - RNA, 17 nt, Human
cuaaauccauuuggaaa

SEQ ID NO: 3443894 - RNA, 21 nt, Human
cuaaauccuuuacuguuaguc

SEQ ID NO: 3443895 - RNA, 21 nt, Human
cuaaaucuccaaaauaaaacu

SEQ ID NO: 3443896 - RNA, 11 nt, Human
cuuuugcuaaa

SEQ ID NO: 3443897 - RNA, 19 nt, Human
cuuuuggaaccaugccuuc

SEQ ID NO: 3443898 - RNA, 21 nt, Human
cuuuuggauuggacaaaauga

SEQ ID NO: 3443899 - RNA, 15 nt, Human
cuuuuggcuuccaug

SEQ ID NO: 3443900 - RNA, 15 nt, Human
cuuuugggaaaugcu

SEQ ID NO: 3443901 - RNA, 14 nt, Human
cuuuuggucucccu

SEQ ID NO: 3443902 - RNA, 19 nt, Human
cuuuugguguguuggacag

SEQ ID NO: 3443903 - RNA, 23 nt, Human
cuuugguuuuuuucuucuguauu

SEQ ID NO: 3443904 - RNA, 13 nt, Human
cuuuguaaaaauc

SEQ ID NO: 3443905 - RNA, 19 nt, Human
cuuuguaagaguguagaag

SEQ ID NO: 3443906 - RNA, 15 nt, Human
cuaaaucucuaauau

SEQ ID NO: 3443907 - RNA, 13 nt, Human
cuaaaugaagugc

SEQ ID NO: 3443908 - RNA, 12 nt, Human
cuaaaugaaugu

SEQ ID NO: 3443909 - RNA, 15 nt, Human
cuaaaugaauguuua

SEQ ID NO: 3443910 - RNA, 21 nt, Human
cuaaaugcauauccugagcca

SEQ ID NO: 3443911 - RNA, 22 nt, Human
cuaaaugcauauccugagccau

SEQ ID NO: 3443912 - RNA, 18 nt, Human
cuaaaugccuaauaaaca

SEQ ID NO: 3443913 - RNA, 12 nt, Human
cuaaauggccuc

SEQ ID NO: 3443914 - RNA, 13 nt, Human
cuaaauggccuca

SEQ ID NO: 3443915 - RNA, 16 nt, Human
cuaaauggccucaugu

SEQ ID NO: 3443916 - RNA, 17 nt, Human
cuaaauggccucaugug

SEQ ID NO: 3443917 - RNA, 19 nt, Human
cuaaauguaacagucugau

SEQ ID NO: 3443918 - RNA, 15 nt, Human
cuaaauguuaaagau

SEQ ID NO: 3443919 - RNA, 19 nt, Human
cuaaauguuaaagauguag

SEQ ID NO: 3443920 - RNA, 19 nt, Human
cuaaauuacaauugucauu

SEQ ID NO: 3443921 - RNA, 19 nt, Human
cuaaauugacacuuaaaaa

SEQ ID NO: 3443922 - RNA, 15 nt, Human
cuaaauugauguuga

SEQ ID NO: 3443923 - RNA, 16 nt, Human
cuaaauugauguugau

SEQ ID NO: 3443924 - RNA, 14 nt, Human
cuaaauuuaaauuu

SEQ ID NO: 3443925 - RNA, 13 nt, Human
cuaaauuucacua

SEQ ID NO: 3443926 - RNA, 16 nt, Human
cuaaauuugaauguua

SEQ ID NO: 3443927 - RNA, 14 nt, Human
cuaaauuugauacu

SEQ ID NO: 3443928 - RNA, 17 nt, Human
cuaaauuugauacuuau

SEQ ID NO: 3443929 - RNA, 20 nt, Human
cuaaauuugauacuuauauu

SEQ ID NO: 3443930 - RNA, 23 nt, Human
cuaaauuugauacuuauauuuuc

SEQ ID NO: 3443931 - RNA, 13 nt, Human
cuaaauuugggga

SEQ ID NO: 3443932 - RNA, 18 nt, Human
cuaaauuuggggacagau

SEQ ID NO: 3443933 - RNA, 16 nt, Human
cuaaauuuuaaagcca

SEQ ID NO: 3443934 - RNA, 17 nt, Human
cuaaauuuuaaagccau

SEQ ID NO: 3443935 - RNA, 16 nt, Human
cuaaauuuuauaucuu

SEQ ID NO: 3443936 - RNA, 20 nt, Human
cuaacaaaagaugaaagcag

SEQ ID NO: 3443937 - RNA, 23 nt, Human
cuaacaaacagauucuuuuaugu

SEQ ID NO: 3443938 - RNA, 20 nt, Human
cuaacaaaguuuucaugugc

SEQ ID NO: 3443939 - RNA, 13 nt, Human
cuaacaaugacau

SEQ ID NO: 3443940 - RNA, 16 nt, Human
cuaacacagcaugugu

SEQ ID NO: 3443941 - RNA, 19 nt, Human
cuaacacuagucugugugc

SEQ ID NO: 3443942 - RNA, 15 nt, Human
cuaacacuauuuuau

SEQ ID NO: 3443943 - RNA, 16 nt, Human
cuaacacucagaagcc

SEQ ID NO: 3443944 - RNA, 16 nt, Human
cuaacacuuaccccau

SEQ ID NO: 3443945 - RNA, 24 nt, Human
cuaacagcauccccaaaacaaagu

SEQ ID NO: 3443946 - RNA, 14 nt, Human
cuaacagggaaggc

SEQ ID NO: 3443947 - RNA, 16 nt, Human
cuaacagggaaggcag

SEQ ID NO: 3443948 - RNA, 18 nt, Human
cuaacagggaaggcaggc

SEQ ID NO: 3443949 - RNA, 19 nt, Human
cuaacaggggcuggugggc

SEQ ID NO: 3443950 - RNA, 20 nt, Human
cuaacaggggcuggugggca

SEQ ID NO: 3443951 - RNA, 17 nt, Human
cuaacaguucacuugca

SEQ ID NO: 3443952 - RNA, 15 nt, Human
cuaacaugauuuggg

SEQ ID NO: 3443953 - RNA, 17 nt, Human
cuaacaugcccuguuca

SEQ ID NO: 3443954 - RNA, 16 nt, Human
cuaacaugguuuaaaa

SEQ ID NO: 3443955 - RNA, 17 nt, Human
cuaacauguccugccua

SEQ ID NO: 3443956 - RNA, 18 nt, Human
cuaacauuauauugcaau

SEQ ID NO: 3443957 - RNA, 21 nt, Human
cuaaccaagcugaguuuccua

SEQ ID NO: 3443958 - RNA, 12 nt, Human
cuaaccacgcug

SEQ ID NO: 3443959 - RNA, 14 nt, Human
cuaaccacgcugga

SEQ ID NO: 3443960 - RNA, 17 nt, Human
cuaaccagcagaaaugc

SEQ ID NO: 3443961 - RNA, 21 nt, Human
cuaaccagggaagcugucccu

SEQ ID NO: 3443962 - RNA, 17 nt, Human
cuaaccccaacgcacag

SEQ ID NO: 3443963 - RNA, 15 nt, Human
cuaaccccaggcccc

SEQ ID NO: 3443964 - RNA, 16 nt, Human
cuaaccccuuuccugc

SEQ ID NO: 3443965 - RNA, 21 nt, Human
cuaacccucagaaacacuggg

SEQ ID NO: 3443966 - RNA, 11 nt, Human
cuaaccugacc

SEQ ID NO: 3443967 - RNA, 19 nt, Human
cuaaccugccgagagucca

SEQ ID NO: 3443968 - RNA, 12 nt, Human
cuaaccugugac

SEQ ID NO: 3443969 - RNA, 13 nt, Human
cuaaccugugucu

SEQ ID NO: 3443970 - RNA, 15 nt, Human
cuaaccuuauccugc

SEQ ID NO: 3443971 - RNA, 18 nt, Human
cuaaccuugaaugcugcc

SEQ ID NO: 3443972 - RNA, 13 nt, Human
cuaaccuugccug

SEQ ID NO: 3443973 - RNA, 21 nt, Human
cuaaccuugccugguacagua

SEQ ID NO: 3443974 - RNA, 20 nt, Human
cuaacgaaauaucaaaguca

SEQ ID NO: 3443975 - RNA, 20 nt, Human
cuaacgaaguauccuucagc

SEQ ID NO: 3443976 - RNA, 20 nt, Human
cuaacgacuucagggcaggg

SEQ ID NO: 3443977 - RNA, 12 nt, Human
cuaacgccugag

SEQ ID NO: 3443978 - RNA, 14 nt, Human
cuaacgccugagcc

SEQ ID NO: 3443979 - RNA, 15 nt, Human
cuaacgccugagccc

SEQ ID NO: 3443980 - RNA, 19 nt, Human
cuaacgccugagcccaggg

SEQ ID NO: 3443981 - RNA, 21 nt, Human
cuaacgccugagcccagggag

SEQ ID NO: 3443982 - RNA, 22 nt, Human
cuaacguugagccccuggaggc

SEQ ID NO: 3443983 - RNA, 13 nt, Human
cuaacuaaaacaa

SEQ ID NO: 3443984 - RNA, 20 nt, Human
cuaacuaaaacaaagccacu

SEQ ID NO: 3443985 - RNA, 12 nt, Human
cuaacuaaacuc

SEQ ID NO: 3443986 - RNA, 22 nt, Human
cuaacuagacaccaaaguucua

SEQ ID NO: 3443987 - RNA, 14 nt, Human
cuaacucaaauaca

SEQ ID NO: 3443988 - RNA, 14 nt, Human
cuaacucaccagcc

SEQ ID NO: 3443989 - RNA, 15 nt, Human
cuaacugaagagaca

SEQ ID NO: 3443990 - RNA, 15 nt, Human
cuaacugcauacacu

SEQ ID NO: 3443991 - RNA, 13 nt, Human
cuaacuggaagca

SEQ ID NO: 3443992 - RNA, 10 nt, Human
cuaacuguau

SEQ ID NO: 3443993 - RNA, 12 nt, Human
cuaacuguauau

SEQ ID NO: 3443994 - RNA, 15 nt, Human
cuaacuguauauuug

SEQ ID NO: 3443995 - RNA, 19 nt, Human
cuaacuguauauuuguaug

SEQ ID NO: 3443996 - RNA, 12 nt, Human
cuaacuguaucu

SEQ ID NO: 3443997 - RNA, 19 nt, Human
cuaacuuauuuuauuucca

SEQ ID NO: 3443998 - RNA, 22 nt, Human
cuaacuuauuuuauuuccauca

SEQ ID NO: 3443999 - RNA, 13 nt, Human
cuaacuucuaaaa

SEQ ID NO: 3444000 - RNA, 16 nt, Human
cuaacuugcuuaaaug

SEQ ID NO: 3444001 - RNA, 20 nt, Human
cuaacuugcuuaaaugugaa

SEQ ID NO: 3444002 - RNA, 17 nt, Human
cuaacuuggagccccag

SEQ ID NO: 3444003 - RNA, 14 nt, Human
cuaacuuggagccg

SEQ ID NO: 3444004 - RNA, 15 nt, Human
cuaacuuggcucaca

SEQ ID NO: 3444005 - RNA, 22 nt, Human
cuaacuuuagaagugcauuucu

SEQ ID NO: 3444006 - RNA, 13 nt, Human
cuaacuuuugugu

SEQ ID NO: 3444007 - RNA, 17 nt, Human
cuaacuuuugugugaaa

SEQ ID NO: 3444008 - RNA, 23 nt, Human
cuaagaaaagauacgacuuuauu

SEQ ID NO: 3444009 - RNA, 21 nt, Human
cuaagaaaagauuuuaaucaa

SEQ ID NO: 3444010 - RNA, 12 nt, Human
cuaagaaaauag

SEQ ID NO: 3444011 - RNA, 13 nt, Human
cuaagaaaauaga

SEQ ID NO: 3444012 - RNA, 12 nt, Human
cuaagaaacauu

SEQ ID NO: 3444013 - RNA, 22 nt, Human
cuaagaaacauuuauauugaua

SEQ ID NO: 3444014 - RNA, 17 nt, Human
cuaagaaacccucuguc

SEQ ID NO: 3444015 - RNA, 20 nt, Human
cuaagaaacuuuuguaaaga

SEQ ID NO: 3444016 - RNA, 22 nt, Human
cuaagaaagcccuuaggaagaa

SEQ ID NO: 3444017 - RNA, 20 nt, Human
cuaagaaauaucugugaaau

SEQ ID NO: 3444018 - RNA, 15 nt, Human
cuaagaaauauguga

SEQ ID NO: 3444019 - RNA, 17 nt, Human
cuaagaaauaugugaga

SEQ ID NO: 3444020 - RNA, 15 nt, Human
cuaagaaauauucca

SEQ ID NO: 3444021 - RNA, 17 nt, Human
cuaagaacccauggaaa

SEQ ID NO: 3444022 - RNA, 16 nt, Human
cuaagaagcuucuaau

SEQ ID NO: 3444023 - RNA, 22 nt, Human
cuaagaagcuucuaauaaauua

SEQ ID NO: 3444024 - RNA, 23 nt, Human
cuaagaagcuucuaauaaauuau

SEQ ID NO: 3444025 - RNA, 22 nt, Human
cuaagaaguacauuguuaccuc

SEQ ID NO: 3444026 - RNA, 17 nt, Human
cuaagaauaaacauuug

SEQ ID NO: 3444027 - RNA, 18 nt, Human
cuaagaauaaacauuugu

SEQ ID NO: 3444028 - RNA, 18 nt, Human
cuaagaauaauaaaauca

SEQ ID NO: 3444029 - RNA, 16 nt, Human
cuaagaauacagcuuu

SEQ ID NO: 3444030 - RNA, 17 nt, Human
cuaagaauucaaacugg

SEQ ID NO: 3444031 - RNA, 21 nt, Human
cuaagacaccugaacccucca

SEQ ID NO: 3444032 - RNA, 13 nt, Human
cuaagacauguaa

SEQ ID NO: 3444033 - RNA, 13 nt, Human
cuaagacucaaau

SEQ ID NO: 3444034 - RNA, 22 nt, Human
cuaagacucaaauguucuaagu

SEQ ID NO: 3444035 - RNA, 23 nt, Human
cuaagacuccucggccuggcucc

SEQ ID NO: 3444036 - RNA, 13 nt, Human
cuaagagaaguag

SEQ ID NO: 3444037 - RNA, 19 nt, Human
cuaagagaaguuauuuucu

SEQ ID NO: 3444038 - RNA, 14 nt, Human
cuaagagagagaga

SEQ ID NO: 3444039 - RNA, 13 nt, Human
cuaagagcucccg

SEQ ID NO: 3444040 - RNA, 16 nt, Human
cuaagaggcugcccuc

SEQ ID NO: 3444041 - RNA, 22 nt, Human
cuaagagggagggagggcucca

SEQ ID NO: 3444042 - RNA, 18 nt, Human
cuaagaguugagcucucg

SEQ ID NO: 3444043 - RNA, 21 nt, Human
cuaagaguugagcucucggaa

SEQ ID NO: 3444044 - RNA, 17 nt, Human
cuaagaucgguuaacaa

SEQ ID NO: 3444045 - RNA, 21 nt, Human
cuaagaucgguuaacaaauaa

SEQ ID NO: 3444046 - RNA, 20 nt, Human
cuaagaucuuagauucucug

SEQ ID NO: 3444047 - RNA, 12 nt, Human
cuaagaugacau

SEQ ID NO: 3444048 - RNA, 19 nt, Human
cuaagaugacauugcuaag

SEQ ID NO: 3444049 - RNA, 14 nt, Human
gaaaacguuuuauu

SEQ ID NO: 3444050 - RNA, 16 nt, Human
gaaaacguuuuauugu

SEQ ID NO: 3444051 - RNA, 12 nt, Human
gaaaacuaaguu

SEQ ID NO: 3444052 - RNA, 14 nt, Human
gaaaacuacauuuu

SEQ ID NO: 3444053 - RNA, 20 nt, Human
gaaaacuagagcucuaagcc

SEQ ID NO: 3444054 - RNA, 13 nt, Human
gaaaacucuauuu

SEQ ID NO: 3444055 - RNA, 12 nt, Human
gaaaacuuaguu

SEQ ID NO: 3444056 - RNA, 10 nt, Human
gaaaacuuca

SEQ ID NO: 3444057 - RNA, 18 nt, Human
gaaaacuuguauuaugug

SEQ ID NO: 3444058 - RNA, 12 nt, Human
gaaaacuuuaaa

SEQ ID NO: 3444059 - RNA, 13 nt, Human
gaaaacuuuaaaa

SEQ ID NO: 3444060 - RNA, 19 nt, Human
gaaaacuuuaaaaaauauu

SEQ ID NO: 3444061 - RNA, 18 nt, Human
gaaaacuuuguuaggcca

SEQ ID NO: 3444062 - RNA, 15 nt, Human
gaaaacuuuucucag

SEQ ID NO: 3444063 - RNA, 17 nt, Human
gaaaacuuuucucagau

SEQ ID NO: 3444064 - RNA, 10 nt, Human
gaaaagaaaa

SEQ ID NO: 3444065 - RNA, 19 nt, Human
gaaaagaaaaaaaaagaaa

SEQ ID NO: 3444066 - RNA, 20 nt, Human
gaaaagaaaaaaaaagaaaa

SEQ ID NO: 3444067 - RNA, 18 nt, Human
gaaaagaaaaaugagccu

SEQ ID NO: 3444068 - RNA, 15 nt, Human
gaaaagaaagcuaca

SEQ ID NO: 3444069 - RNA, 14 nt, Human
gaaaagaaauaaua

SEQ ID NO: 3444070 - RNA, 21 nt, Human
gaaaagaaaucuauagaaagu

SEQ ID NO: 3444071 - RNA, 19 nt, Human
gaaaagaauacagaaagau

SEQ ID NO: 3444072 - RNA, 14 nt, Human
gaaaagacuccaaa

SEQ ID NO: 3444073 - RNA, 16 nt, Human
gaaaagacuccaaaga

SEQ ID NO: 3444074 - RNA, 17 nt, Human
gaaaagacuccaaagaa

SEQ ID NO: 3444075 - RNA, 20 nt, Human
gaaaagacuccaaagaaaug

SEQ ID NO: 3444076 - RNA, 19 nt, Human
gaaaagagaagaagaaaaa

SEQ ID NO: 3444077 - RNA, 17 nt, Human
gaaaagagacaggcagg

SEQ ID NO: 3444078 - RNA, 18 nt, Human
gaaaagagacaggcaggu

SEQ ID NO: 3444079 - RNA, 21 nt, Human
gaaaagagagcagagaauaua

SEQ ID NO: 3444080 - RNA, 19 nt, Human
gaaaagagauauuuuaaaa

SEQ ID NO: 3444081 - RNA, 14 nt, Human
gaaaagagauggcc

SEQ ID NO: 3444082 - RNA, 19 nt, Human
gaaaagaguugggaacuuc

SEQ ID NO: 3444083 - RNA, 20 nt, Human
gaaaagauaaagaccagaaa

SEQ ID NO: 3444084 - RNA, 22 nt, Human
gaaaagauaaagaccagaaauu

SEQ ID NO: 3444085 - RNA, 22 nt, Human
gaaaagaugcacuuugcuuuaa

SEQ ID NO: 3444086 - RNA, 21 nt, Human
gaaaagaugguaucauauauu

SEQ ID NO: 3444087 - RNA, 18 nt, Human
gaaaagauguugugucuu

SEQ ID NO: 3444088 - RNA, 14 nt, Human
gaaaagauuuaagc

SEQ ID NO: 3444089 - RNA, 23 nt, Human
gaaaagauuuuaaucaaguugaa

SEQ ID NO: 3444090 - RNA, 16 nt, Human
gaaaagcaacauucau

SEQ ID NO: 3444091 - RNA, 16 nt, Human
gaaaagcagacauuuu

SEQ ID NO: 3444092 - RNA, 19 nt, Human
gaaaagcagcccuuggcca

SEQ ID NO: 3444093 - RNA, 18 nt, Human
gaaaagcaucagaaagag

SEQ ID NO: 3444094 - RNA, 23 nt, Human
gaaaagcauggcuugaauaagga

SEQ ID NO: 3444095 - RNA, 15 nt, Human
gaaaagccucuguuu

SEQ ID NO: 3444096 - RNA, 13 nt, Human
gaaaagcuaagag

SEQ ID NO: 3444097 - RNA, 23 nt, Human
gaaaagcuagaauugaguguuua

SEQ ID NO: 3444098 - RNA, 22 nt, Human
gaaaagcuaguguaccuccucu

SEQ ID NO: 3444099 - RNA, 17 nt, Human
gaaaagcuauuagccag

SEQ ID NO: 3444100 - RNA, 22 nt, Human
gaaaagcuucuuaauuaauuug

SEQ ID NO: 3444101 - RNA, 22 nt, Human
gaaaagcuuuguuuguucuugu

SEQ ID NO: 3444102 - RNA, 15 nt, Human
gaaaaggaaaagaaa

SEQ ID NO: 3444103 - RNA, 13 nt, Human
gaaaaggaagacu

SEQ ID NO: 3444104 - RNA, 17 nt, Human
gaaaaggagaggaaacu

SEQ ID NO: 3444105 - RNA, 17 nt, Human
gaaaaggccuucuuccc

SEQ ID NO: 3444106 - RNA, 18 nt, Human
gaaaagggaacugaacau

SEQ ID NO: 3444107 - RNA, 21 nt, Human
gaaaagggucuugggaaauau

SEQ ID NO: 3444108 - RNA, 18 nt, Human
gaaauaacagaagaaaau

SEQ ID NO: 3444109 - RNA, 15 nt, Human
gaaauaagcuauuug

SEQ ID NO: 3444110 - RNA, 18 nt, Human
gaaauaagcuauuugaug

SEQ ID NO: 3444111 - RNA, 20 nt, Human
gaaauaagcuauuugaugua

SEQ ID NO: 3444112 - RNA, 13 nt, Human
gaaauaauaaaaa

SEQ ID NO: 3444113 - RNA, 19 nt, Human
gaaauaauaaaaaauuuca

SEQ ID NO: 3444114 - RNA, 17 nt, Human
gaaauaauaaaucuggu

SEQ ID NO: 3444115 - RNA, 16 nt, Human
gaaauaauagaaaugu

SEQ ID NO: 3444116 - RNA, 18 nt, Human
gaaauaauagaaugagca

SEQ ID NO: 3444117 - RNA, 14 nt, Human
gaaauaauaugcau

SEQ ID NO: 3444118 - RNA, 14 nt, Human
gaaauaaugcuaca

SEQ ID NO: 3444119 - RNA, 15 nt, Human
gaaauaauuguuguu

SEQ ID NO: 3444120 - RNA, 19 nt, Human
gaaauaauuguuguucugu

SEQ ID NO: 3444121 - RNA, 14 nt, Human
gaaauacaaaaaua

SEQ ID NO: 3444122 - RNA, 21 nt, Human
gaaauacaauucuacauuguc

SEQ ID NO: 3444123 - RNA, 17 nt, Human
gaaauacauauuuccaa

SEQ ID NO: 3444124 - RNA, 23 nt, Human
gaaauaccucauguuuaugaaaa

SEQ ID NO: 3444125 - RNA, 20 nt, Human
gaaauacgccagaacugcuu

SEQ ID NO: 3444126 - RNA, 16 nt, Human
gaaauacuacuccugu

SEQ ID NO: 3444127 - RNA, 18 nt, Human
gaaauacugcaagaaaau

SEQ ID NO: 3444128 - RNA, 13 nt, Human
gaaauagacaaaa

SEQ ID NO: 3444129 - RNA, 19 nt, Human
gaaauagacaguauauuua

SEQ ID NO: 3444130 - RNA, 15 nt, Human
gaaauagccaaucau

SEQ ID NO: 3444131 - RNA, 15 nt, Human
gaaauagcuuaugaa

SEQ ID NO: 3444132 - RNA, 21 nt, Human
gaaauagcuuaugaaaagaau

SEQ ID NO: 3444133 - RNA, 17 nt, Human
gaaauaguucugugacu

SEQ ID NO: 3444134 - RNA, 14 nt, Human
gaaauauaauaaaa

SEQ ID NO: 3444135 - RNA, 20 nt, Human
gaaauauaauaaaauguguu

SEQ ID NO: 3444136 - RNA, 17 nt, Human
gaaauauacacacagca

SEQ ID NO: 3444137 - RNA, 20 nt, Human
gaaauauauacgaacaaaac

SEQ ID NO: 3444138 - RNA, 22 nt, Human
gaaauauauacgaacaaaacac

SEQ ID NO: 3444139 - RNA, 11 nt, Human
gaaauauauau

SEQ ID NO: 3444140 - RNA, 14 nt, Human
gaaauauauauaca

SEQ ID NO: 3444141 - RNA, 21 nt, Human
gaaauauauauacauauguag

SEQ ID NO: 3444142 - RNA, 17 nt, Human
gaaauauauaugugugu

SEQ ID NO: 3444143 - RNA, 14 nt, Human
gaaauauauauuau

SEQ ID NO: 3444144 - RNA, 20 nt, Human
gaaauauauggucuaauguu

SEQ ID NO: 3444145 - RNA, 22 nt, Human
gaaauauauggucuaauguuua

SEQ ID NO: 3444146 - RNA, 20 nt, Human
gaaauauauuacuuaacugu

SEQ ID NO: 3444147 - RNA, 23 nt, Human
gaaauaucaaagucauuaaagac

SEQ ID NO: 3444148 - RNA, 15 nt, Human
gaaauaucaucacgu

SEQ ID NO: 3444149 - RNA, 12 nt, Human
gaaauaucauuu

SEQ ID NO: 3444150 - RNA, 14 nt, Human
gaaauaucauuuau

SEQ ID NO: 3444151 - RNA, 18 nt, Human
gaaauaucccgggggugg

SEQ ID NO: 3444152 - RNA, 20 nt, Human
gaaauaucccgggggugggg

SEQ ID NO: 3444153 - RNA, 18 nt, Human
gaaauaucugaaaaugua

SEQ ID NO: 3444154 - RNA, 20 nt, Human
gaaauaucugaaaauguaug

SEQ ID NO: 3444155 - RNA, 14 nt, Human
gaaauaucuguauu

SEQ ID NO: 3444156 - RNA, 18 nt, Human
gaaauaucugugaaauau

SEQ ID NO: 3444157 - RNA, 21 nt, Human
gaaauaucugugaaauaucau

SEQ ID NO: 3444158 - RNA, 20 nt, Human
gaaauaugaagaacugagga

SEQ ID NO: 3444159 - RNA, 17 nt, Human
gaaauaugcacaauagc

SEQ ID NO: 3444160 - RNA, 14 nt, Human
gaaauaugcucuuu

SEQ ID NO: 3444161 - RNA, 15 nt, Human
gaaauaugugagauu

SEQ ID NO: 3444162 - RNA, 19 nt, Human
gaaauauuaaacccuggau

SEQ ID NO: 3444163 - RNA, 22 nt, Human
gaaauauuaagcauguuuuguu

SEQ ID NO: 3444164 - RNA, 15 nt, Human
gaaauauuaugcaaa

SEQ ID NO: 3444165 - RNA, 18 nt, Human
gaaauauuaugcaaauuc

SEQ ID NO: 3444166 - RNA, 19 nt, Human
gaaauauuaugcaaauucc

SEQ ID NO: 3444167 - RNA, 22 nt, Human
gaaauauuaugcaaauucccag

SEQ ID NO: 3444168 - RNA, 23 nt, Human
gaaauauuaugcaaauucccaga

SEQ ID NO: 3444169 - RNA, 13 nt, Human
gaaauauuuauuu

SEQ ID NO: 3444170 - RNA, 17 nt, Human
gaaauauuuauuuuaau

SEQ ID NO: 3444171 - RNA, 22 nt, Human
gaaauauuuuaauuuuuaaaug

SEQ ID NO: 3444172 - RNA, 20 nt, Human
gaaauauuuugauaauaaau

SEQ ID NO: 3444173 - RNA, 12 nt, Human
gaaaucaaagug

SEQ ID NO: 3444174 - RNA, 16 nt, Human
gaaaucaaagugcuau

SEQ ID NO: 3444175 - RNA, 17 nt, Human
gaaaucaaagugcuauu

SEQ ID NO: 3444176 - RNA, 16 nt, Human
gaaaucaaauguaaag

SEQ ID NO: 3444177 - RNA, 23 nt, Human
gaaaucaagucaucuauaguuga

SEQ ID NO: 3444178 - RNA, 20 nt, Human
gaaaucagccaaguuuuaua

SEQ ID NO: 3444179 - RNA, 16 nt, Human
gaaaucaguaaacacu

SEQ ID NO: 3444180 - RNA, 19 nt, Human
gaaaucaguaaacacugug

SEQ ID NO: 3444181 - RNA, 20 nt, Human
gaaaucaguaauauuuauau

SEQ ID NO: 3444182 - RNA, 12 nt, Human
gaaaucauguua

SEQ ID NO: 3444183 - RNA, 21 nt, Human
gaaaucauguuaugauaaaaa

SEQ ID NO: 3444184 - RNA, 22 nt, Human
gaaaucccuguuuaauauuuaa

SEQ ID NO: 3444185 - RNA, 23 nt, Human
gaaaucccuguuuaauauuuaaa

SEQ ID NO: 3444186 - RNA, 13 nt, Human
gaaaucccuucau

SEQ ID NO: 3444187 - RNA, 17 nt, Human
gaaauccggagaagcug

SEQ ID NO: 3444188 - RNA, 23 nt, Human
gaaauccuaguuuccucuccuuc

SEQ ID NO: 3444189 - RNA, 15 nt, Human
gaaauccugguuccu

SEQ ID NO: 3444190 - RNA, 18 nt, Human
gaaaucuaggaaaauuau

SEQ ID NO: 3444191 - RNA, 20 nt, Human
gaaaucuaugauuccaggug

SEQ ID NO: 3444192 - RNA, 20 nt, Human
gaaaucuccuuuagccauca

SEQ ID NO: 3444193 - RNA, 19 nt, Human
gaacaaguuguuucauuga

SEQ ID NO: 3444194 - RNA, 17 nt, Human
gaacaauagguaaagcu

SEQ ID NO: 3444195 - RNA, 17 nt, Human
gaacaauugaaguaaac

SEQ ID NO: 3444196 - RNA, 15 nt, Human
gaacaauuuggcaau

SEQ ID NO: 3444197 - RNA, 19 nt, Human
gaacaauuuggcaauuuug

SEQ ID NO: 3444198 - RNA, 14 nt, Human
gaacacacuguguc

SEQ ID NO: 3444199 - RNA, 16 nt, Human
gaacacacuguguccu

SEQ ID NO: 3444200 - RNA, 13 nt, Human
gaacacaggcagc

SEQ ID NO: 3444201 - RNA, 16 nt, Human
gaacacaggcagcuuu

SEQ ID NO: 3444202 - RNA, 15 nt, Human
gaacacaguauuuuc

SEQ ID NO: 3444203 - RNA, 18 nt, Human
gaacaccaagacuugaag

SEQ ID NO: 3444204 - RNA, 21 nt, Human
gaacaccagagaccucaaauu

SEQ ID NO: 3444205 - RNA, 20 nt, Human
gaacaccauugaaggcuuaa

SEQ ID NO: 3444206 - RNA, 13 nt, Human
gaacacccuuaga

SEQ ID NO: 3444207 - RNA, 21 nt, Human
gaacaccuaugcaaagaugaa

SEQ ID NO: 3444208 - RNA, 16 nt, Human
gaacacgcguauuuac

SEQ ID NO: 3444209 - RNA, 14 nt, Human
gaacacggccacau

SEQ ID NO: 3444210 - RNA, 16 nt, Human
gaacacuaaccugacc

SEQ ID NO: 3444211 - RNA, 19 nt, Human
gaacacuaacucaccagcc

SEQ ID NO: 3444212 - RNA, 18 nt, Human
gaacacuaauucauaauc

SEQ ID NO: 3444213 - RNA, 15 nt, Human
gaacacuagacaagc

SEQ ID NO: 3444214 - RNA, 16 nt, Human
gaacacuauuuucaga

SEQ ID NO: 3444215 - RNA, 16 nt, Human
gaacacucaugcugaa

SEQ ID NO: 3444216 - RNA, 17 nt, Human
gaacacucaugcugaaa

SEQ ID NO: 3444217 - RNA, 20 nt, Human
gaacacuccaauuaaggauu

SEQ ID NO: 3444218 - RNA, 15 nt, Human
gaacacucuauaaca

SEQ ID NO: 3444219 - RNA, 23 nt, Human
gaacacugcacucuuaagcuucc

SEQ ID NO: 3444220 - RNA, 21 nt, Human
gaacacugcccucgcacggcc

SEQ ID NO: 3444221 - RNA, 23 nt, Human
gaacacuggggacuuggccucuc

SEQ ID NO: 3444222 - RNA, 14 nt, Human
gaacagaaaacaac

SEQ ID NO: 3444223 - RNA, 17 nt, Human
gaacagaaaacaacaaa

SEQ ID NO: 3444224 - RNA, 13 nt, Human
gaacagaaauacc

SEQ ID NO: 3444225 - RNA, 12 nt, Human
gaacagaaauug

SEQ ID NO: 3444226 - RNA, 23 nt, Human
gaacagaacauagacagaagaaa

SEQ ID NO: 3444227 - RNA, 22 nt, Human
gaacagaacucgguguccccac

SEQ ID NO: 3444228 - RNA, 14 nt, Human
gaacagaaggauga

SEQ ID NO: 3444229 - RNA, 17 nt, Human
gaacagacaggagaaau

SEQ ID NO: 3444230 - RNA, 18 nt, Human
gaacagauaaucccugua

SEQ ID NO: 3444231 - RNA, 20 nt, Human
gaacagaugaccccugccca

SEQ ID NO: 3444232 - RNA, 21 nt, Human
gaacagcagacucagcucuga

SEQ ID NO: 3444233 - RNA, 13 nt, Human
gaacagcaggccc

SEQ ID NO: 3444234 - RNA, 16 nt, Human
gaacagcauggcacuc

SEQ ID NO: 3444235 - RNA, 12 nt, Human
gaacagcuggug

SEQ ID NO: 3444236 - RNA, 20 nt, Human
gaacagcugguguagcuaca

SEQ ID NO: 3444237 - RNA, 15 nt, Human
gaacagcuguaaucu

SEQ ID NO: 3444238 - RNA, 17 nt, Human
gaacagcuguugacucu

SEQ ID NO: 3444239 - RNA, 22 nt, Human
gaacagcuguugacucuaguac

SEQ ID NO: 3444240 - RNA, 17 nt, Human
gaacagcuucagguuau

SEQ ID NO: 3444241 - RNA, 15 nt, Human
gaacaggaaaagaaa

SEQ ID NO: 3444242 - RNA, 15 nt, Human
gaacagguguuuuuc

SEQ ID NO: 3444243 - RNA, 12 nt, Human
gaacaguaaaca

SEQ ID NO: 3444244 - RNA, 22 nt, Human
gaacaguaacauagcugugauu

SEQ ID NO: 3444245 - RNA, 13 nt, Human
gaacagucucuug

SEQ ID NO: 3444246 - RNA, 20 nt, Human
gaacagugauuaccagggac

SEQ ID NO: 3444247 - RNA, 19 nt, Human
gaacagugauuuuuuuuua

SEQ ID NO: 3444248 - RNA, 21 nt, Human
gaacagugguggcaacauuca

SEQ ID NO: 3444249 - RNA, 14 nt, Human
gaacaguguuuccc

SEQ ID NO: 3444250 - RNA, 18 nt, Human
gaacaguguuucccauaa

SEQ ID NO: 3444251 - RNA, 17 nt, Human
gaacaguuuaugcagug

SEQ ID NO: 3444252 - RNA, 16 nt, Human
gaacauaaaaaggaca

SEQ ID NO: 3444253 - RNA, 22 nt, Human
gaacauaaaaaggacaucagca

SEQ ID NO: 3444254 - RNA, 15 nt, Human
gaacauaaagcaaau

SEQ ID NO: 3444255 - RNA, 22 nt, Human
gaacauaucuuagauggggagc

SEQ ID NO: 3444256 - RNA, 17 nt, Human
gaacaucacauuccucu

SEQ ID NO: 3444257 - RNA, 23 nt, Human
gaacaucaccgacgcgucuccug

SEQ ID NO: 3444258 - RNA, 20 nt, Human
gaacaucaucaaggcacugc

SEQ ID NO: 3444259 - RNA, 21 nt, Human
gaacaucaucaaggcacugcc

SEQ ID NO: 3444260 - RNA, 23 nt, Human
gaacauccaaggagaaacagaga

SEQ ID NO: 3444261 - RNA, 17 nt, Human
gaacaucccuuuuucaa

SEQ ID NO: 3444262 - RNA, 13 nt, Human
gaacauccuuccu

SEQ ID NO: 3444263 - RNA, 20 nt, Human
gaacaucuuugacacucugc

SEQ ID NO: 3444264 - RNA, 14 nt, Human
gaacaugaaucaaa

SEQ ID NO: 3444265 - RNA, 12 nt, Human
gaacaugcaguu

SEQ ID NO: 3444266 - RNA, 13 nt, Human
gaacaugcaguuu

SEQ ID NO: 3444267 - RNA, 14 nt, Human
gaacaugcccccug

SEQ ID NO: 3444268 - RNA, 22 nt, Human
gaacauggacuuguauauuugu

SEQ ID NO: 3444269 - RNA, 16 nt, Human
gaacauguacacuggu

SEQ ID NO: 3444270 - RNA, 19 nt, Human
gaacaugugagagguuuga

SEQ ID NO: 3444271 - RNA, 17 nt, Human
gaacauguggcuugaau

SEQ ID NO: 3444272 - RNA, 21 nt, Human
cuacucagaagccugaggcug

SEQ ID NO: 3444273 - RNA, 15 nt, Human
cuacucagcagcccu

SEQ ID NO: 3444274 - RNA, 17 nt, Human
cuacucagcagcccucc

SEQ ID NO: 3444275 - RNA, 19 nt, Human
cuacucagcagcccuccuc

SEQ ID NO: 3444276 - RNA, 21 nt, Human
cuacucagcagcccuccucac

SEQ ID NO: 3444277 - RNA, 13 nt, Human
cuacucaggaggc

SEQ ID NO: 3444278 - RNA, 15 nt, Human
cuacucccagacacc

SEQ ID NO: 3444279 - RNA, 23 nt, Human
cuacuccggaggcugaggcagga

SEQ ID NO: 3444280 - RNA, 18 nt, Human
cuacuccuaccucagccu

SEQ ID NO: 3444281 - RNA, 21 nt, Human
cuacuccuaccucagccuaga

SEQ ID NO: 3444282 - RNA, 15 nt, Human
cuacuccucugcagu

SEQ ID NO: 3444283 - RNA, 11 nt, Human
cuacuccugac

SEQ ID NO: 3444284 - RNA, 13 nt, Human
cuacuccugacuc

SEQ ID NO: 3444285 - RNA, 14 nt, Human
cuacuccugucuuc

SEQ ID NO: 3444286 - RNA, 21 nt, Human
cuacuccugucuucugcuuug

SEQ ID NO: 3444287 - RNA, 22 nt, Human
cuacuccugucuucugcuuugu

SEQ ID NO: 3444288 - RNA, 17 nt, Human
cuacucuccccacgagg

SEQ ID NO: 3444289 - RNA, 19 nt, Human
cuacucuccccacgagggc

SEQ ID NO: 3444290 - RNA, 20 nt, Human
cuacucuccccacgagggcu

SEQ ID NO: 3444291 - RNA, 19 nt, Human
cuacucuguuccuucacau

SEQ ID NO: 3444292 - RNA, 17 nt, Human
cuacucuuaagccaucu

SEQ ID NO: 3444293 - RNA, 18 nt, Human
cuacugaaacagauuuca

SEQ ID NO: 3444294 - RNA, 22 nt, Human
cuacugaaacagauuucauacc

SEQ ID NO: 3444295 - RNA, 15 nt, Human
cuacugaaugucauu

SEQ ID NO: 3444296 - RNA, 20 nt, Human
cuacugacauguggggccag

SEQ ID NO: 3444297 - RNA, 17 nt, Human
cuacugauaaagaaaga

SEQ ID NO: 3444298 - RNA, 16 nt, Human
cuacugauuguuucau

SEQ ID NO: 3444299 - RNA, 17 nt, Human
cuacugauuguuucauu

SEQ ID NO: 3444300 - RNA, 16 nt, Human
cuacugauuuuuguga

SEQ ID NO: 3444301 - RNA, 17 nt, Human
cuacugcacuccagccu

SEQ ID NO: 3444302 - RNA, 19 nt, Human
cuacugcacuccagccugg

SEQ ID NO: 3444303 - RNA, 18 nt, Human
cuacugcagcaccuccag

SEQ ID NO: 3444304 - RNA, 14 nt, Human
cuacugcagcuuua

SEQ ID NO: 3444305 - RNA, 15 nt, Human
cuacugcccaggcac

SEQ ID NO: 3444306 - RNA, 11 nt, Human
cuacugcugug

SEQ ID NO: 3444307 - RNA, 16 nt, Human
cuacuggauucuuauu

SEQ ID NO: 3444308 - RNA, 17 nt, Human
cuacuggcauaguuuca

SEQ ID NO: 3444309 - RNA, 18 nt, Human
cuacuggcauaguuucau

SEQ ID NO: 3444310 - RNA, 14 nt, Human
cuacugggaaggcu

SEQ ID NO: 3444311 - RNA, 14 nt, Human
cuacugggagccua

SEQ ID NO: 3444312 - RNA, 15 nt, Human
cuacugggagccuac

SEQ ID NO: 3444313 - RNA, 18 nt, Human
cuacugggagccuaccca

SEQ ID NO: 3444314 - RNA, 15 nt, Human
cuacuggggaaacug

SEQ ID NO: 3444315 - RNA, 17 nt, Human
cuacuggggaaacuggc

SEQ ID NO: 3444316 - RNA, 19 nt, Human
cuacuggggaaacuggcca

SEQ ID NO: 3444317 - RNA, 20 nt, Human
cuacuggggaaacuggccau

SEQ ID NO: 3444318 - RNA, 19 nt, Human
cuacugggugucauuucau

SEQ ID NO: 3444319 - RNA, 17 nt, Human
cuacuggucuuguggaa

SEQ ID NO: 3444320 - RNA, 21 nt, Human
cuacuguaagcaagaaaaaua

SEQ ID NO: 3444321 - RNA, 21 nt, Human
cuacuguaauuugugauacaa

SEQ ID NO: 3444322 - RNA, 17 nt, Human
cuacuguggaaaaauau

SEQ ID NO: 3444323 - RNA, 21 nt, Human
cuacuguggaaaaauauuuaa

SEQ ID NO: 3444324 - RNA, 14 nt, Human
cuacuguguuccug

SEQ ID NO: 3444325 - RNA, 22 nt, Human
cuacuguucagcuuuuauuccu

SEQ ID NO: 3444326 - RNA, 18 nt, Human
cuacuguuuaagugaauu

SEQ ID NO: 3444327 - RNA, 22 nt, Human
cuacuuaauuccuuucucaucc

SEQ ID NO: 3444328 - RNA, 19 nt, Human
cuacuuaccauaugugcuu

SEQ ID NO: 3444329 - RNA, 12 nt, Human
cuacuuagcauc

SEQ ID NO: 3444330 - RNA, 19 nt, Human
cuacuuagcauccuaagaa

SEQ ID NO: 3444331 - RNA, 23 nt, Human
cuacuuagcauccuaagaaauau

SEQ ID NO: 3444332 - RNA, 18 nt, Human
cuacuuaugaaaugugca

SEQ ID NO: 3444333 - RNA, 16 nt, Human
cuacuuccaaacuaau

SEQ ID NO: 3444334 - RNA, 22 nt, Human
cuacuuccccauggcccugagc

SEQ ID NO: 3444335 - RNA, 14 nt, Human
cuacuuccccuucc

SEQ ID NO: 3444336 - RNA, 17 nt, Human
cuacuuccuccucccca

SEQ ID NO: 3444337 - RNA, 23 nt, Human
gaagcccagccccuacugcugug

SEQ ID NO: 3444338 - RNA, 15 nt, Human
gaagcccaggaaagg

SEQ ID NO: 3444339 - RNA, 21 nt, Human
gaagcccauccugaccagcug

SEQ ID NO: 3444340 - RNA, 18 nt, Human
gaagccccacauguccag

SEQ ID NO: 3444341 - RNA, 23 nt, Human
gaagccccacauguccagcaccu

SEQ ID NO: 3444342 - RNA, 17 nt, Human
gaagcccccagcuaaga

SEQ ID NO: 3444343 - RNA, 21 nt, Human
gaagcccccagcuaagaaccu

SEQ ID NO: 3444344 - RNA, 18 nt, Human
gaagccccugggcccagu

SEQ ID NO: 3444345 - RNA, 17 nt, Human
gaagcccggcuccuggu

SEQ ID NO: 3444346 - RNA, 21 nt, Human
gaagcccggcuccuggucacc

SEQ ID NO: 3444347 - RNA, 13 nt, Human
gaagcccucccag

SEQ ID NO: 3444348 - RNA, 11 nt, Human
gaagcccuccu

SEQ ID NO: 3444349 - RNA, 12 nt, Human
gaagcccuccuu

SEQ ID NO: 3444350 - RNA, 11 nt, Human
gaagcccugga

SEQ ID NO: 3444351 - RNA, 19 nt, Human
gaagcccuggauuucagaa

SEQ ID NO: 3444352 - RNA, 14 nt, Human
gaagcccuguugug

SEQ ID NO: 3444353 - RNA, 15 nt, Human
gaagcccuucuaccu

SEQ ID NO: 3444354 - RNA, 14 nt, Human
gaagccgacucugg

SEQ ID NO: 3444355 - RNA, 17 nt, Human
gaagccgacucuggccc

SEQ ID NO: 3444356 - RNA, 19 nt, Human
gaagccgacucuggcccug

SEQ ID NO: 3444357 - RNA, 20 nt, Human
gaagccgccaguacuuguca

SEQ ID NO: 3444358 - RNA, 14 nt, Human
gaagccgcuggggc

SEQ ID NO: 3444359 - RNA, 21 nt, Human
gaagccgcuggggccaguugg

SEQ ID NO: 3444360 - RNA, 16 nt, Human
gaagccggaggguguu

SEQ ID NO: 3444361 - RNA, 22 nt, Human
gaagccguccuggcgccuggca

SEQ ID NO: 3444362 - RNA, 17 nt, Human
gaagccgugcccugccc

SEQ ID NO: 3444363 - RNA, 16 nt, Human
gaagccucagauuccu

SEQ ID NO: 3444364 - RNA, 20 nt, Human
gaagccucagauuccuuccc

SEQ ID NO: 3444365 - RNA, 19 nt, Human
gaagccuccuuagaaaaaa

SEQ ID NO: 3444366 - RNA, 17 nt, Human
gaagccucuggcuagag

SEQ ID NO: 3444367 - RNA, 13 nt, Human
gaagccugaggcu

SEQ ID NO: 3444368 - RNA, 15 nt, Human
gaagccugcuccuuc

SEQ ID NO: 3444369 - RNA, 19 nt, Human
gaagccugggggccuggcu

SEQ ID NO: 3444370 - RNA, 21 nt, Human
gaagccugggggccuggcugg

SEQ ID NO: 3444371 - RNA, 16 nt, Human
gaagccuucaagcucu

SEQ ID NO: 3444372 - RNA, 18 nt, Human
gaagccuucaagcucuga

SEQ ID NO: 3444373 - RNA, 16 nt, Human
gaagcgagcacugacc

SEQ ID NO: 3444374 - RNA, 15 nt, Human
gaagcuaacagggaa

SEQ ID NO: 3444375 - RNA, 17 nt, Human
gaagcuaacagggaagg

SEQ ID NO: 3444376 - RNA, 18 nt, Human
gaagcuaacagggaaggc

SEQ ID NO: 3444377 - RNA, 21 nt, Human
gaagcuaauuauuuuaauuag

SEQ ID NO: 3444378 - RNA, 22 nt, Human
gaagcuaauuauuuuaauuagg

SEQ ID NO: 3444379 - RNA, 15 nt, Human
gaagcuaauuugcau

SEQ ID NO: 3444380 - RNA, 17 nt, Human
gaagcuaauuugcauua

SEQ ID NO: 3444381 - RNA, 15 nt, Human
gaagcuacagguuac

SEQ ID NO: 3444382 - RNA, 22 nt, Human
gaagcuacugugugugugaaug

SEQ ID NO: 3444383 - RNA, 15 nt, Human
gaagcuacuuuguuu

SEQ ID NO: 3444384 - RNA, 21 nt, Human
gaagcuagacacaugaaggua

SEQ ID NO: 3444385 - RNA, 22 nt, Human
gaagcuagacacaugaagguaa

SEQ ID NO: 3444386 - RNA, 23 nt, Human
gaagcuagacacaugaagguaaa

SEQ ID NO: 3444387 - RNA, 14 nt, Human
gaagcuagucuuuu

SEQ ID NO: 3444388 - RNA, 20 nt, Human
gaagcuaucguaaaauuaag

SEQ ID NO: 3444389 - RNA, 22 nt, Human
gaagcucaccuguugcuuacaa

SEQ ID NO: 3444390 - RNA, 14 nt, Human
gaagcucagacugg

SEQ ID NO: 3444391 - RNA, 21 nt, Human
gaagcucagcugcauuccgca

SEQ ID NO: 3444392 - RNA, 16 nt, Human
gaagcucagggccugg

SEQ ID NO: 3444393 - RNA, 18 nt, Human
gaagcucagggccuggcu

SEQ ID NO: 3444394 - RNA, 20 nt, Human
gaagcucagggccuggcuca

SEQ ID NO: 3444395 - RNA, 13 nt, Human
gaagcuccacugu

SEQ ID NO: 3444396 - RNA, 16 nt, Human
gaagcuccacugucac

SEQ ID NO: 3444397 - RNA, 15 nt, Human
gaagcucccaggaac

SEQ ID NO: 3444398 - RNA, 15 nt, Human
gaagcucccccagca

SEQ ID NO: 3444399 - RNA, 19 nt, Human
gaagcuccgcuuucuaccc

SEQ ID NO: 3444400 - RNA, 20 nt, Human
gaagcuccucuccccagccc

SEQ ID NO: 3444401 - RNA, 23 nt, Human
gaagcuccucuccccagcccaga

SEQ ID NO: 3444402 - RNA, 19 nt, Human
gaagcucucgggcuaggaa

SEQ ID NO: 3444403 - RNA, 16 nt, Human
gaagcucugaagucac

SEQ ID NO: 3444404 - RNA, 20 nt, Human
gaagcucuuacucuuuccua

SEQ ID NO: 3444405 - RNA, 22 nt, Human
gaagcugaagugcauccaaagg

SEQ ID NO: 3444406 - RNA, 19 nt, Human
gaagcugagcaccagggga

SEQ ID NO: 3444407 - RNA, 15 nt, Human
gaagcugcagcuugg

SEQ ID NO: 3444408 - RNA, 22 nt, Human
gaagcugccaggugagaaacug

SEQ ID NO: 3444409 - RNA, 14 nt, Human
gaagcugccugcuu

SEQ ID NO: 3444410 - RNA, 14 nt, Human
gaagcugcuccagg

SEQ ID NO: 3444411 - RNA, 11 nt, Human
gaagcugcuga

SEQ ID NO: 3444412 - RNA, 12 nt, Human
gaagcugcugac

SEQ ID NO: 3444413 - RNA, 14 nt, Human
gaagcugcugacca

SEQ ID NO: 3444414 - RNA, 23 nt, Human
gaagcuggccgaggguccuggcu

SEQ ID NO: 3444415 - RNA, 15 nt, Human
gaagcuggccugaga

SEQ ID NO: 3444416 - RNA, 23 nt, Human
gaagcuguaguagcccuuucugu

SEQ ID NO: 3444417 - RNA, 12 nt, Human
gaagcugugucc

SEQ ID NO: 3444418 - RNA, 23 nt, Human
gaagcuguguccuugcaccugca

SEQ ID NO: 3444419 - RNA, 14 nt, Human
gaagcuuauuaaug

SEQ ID NO: 3444420 - RNA, 21 nt, Human
gaagcuuauuaaugcuaaggg

SEQ ID NO: 3444421 - RNA, 22 nt, Human
gaagcuuauuaaugcuaagggc

SEQ ID NO: 3444422 - RNA, 16 nt, Human
gaagcuuccaguccaa

SEQ ID NO: 3444423 - RNA, 13 nt, Human
gaagcuucuaaua

SEQ ID NO: 3444424 - RNA, 21 nt, Human
gaagcuuucucugcuucagcu

SEQ ID NO: 3444425 - RNA, 21 nt, Human
gaagcuuuguccccugcuuca

SEQ ID NO: 3444426 - RNA, 18 nt, Human
gaagcuuuuaugugaaac

SEQ ID NO: 3444427 - RNA, 18 nt, Human
gaaggaaaaggcagggag

SEQ ID NO: 3444428 - RNA, 20 nt, Human
gaaggaaaaggcagggagcg

SEQ ID NO: 3444429 - RNA, 14 nt, Human
gaaggaaaaugaua

SEQ ID NO: 3444430 - RNA, 17 nt, Human
gaaggaaacccagcucu

SEQ ID NO: 3444431 - RNA, 15 nt, Human
gaaggaaagaugcuc

SEQ ID NO: 3444432 - RNA, 15 nt, Human
gaaggaaaugaauuu

SEQ ID NO: 3444433 - RNA, 23 nt, Human
gaaggaaccaaagcgaauuuuaa

SEQ ID NO: 3444434 - RNA, 20 nt, Human
gaaggaacucuggcuuccag

SEQ ID NO: 3444435 - RNA, 23 nt, Human
gaaggaacucuggcuuccaggua

SEQ ID NO: 3444436 - RNA, 21 nt, Human
gaaggaacuugucucuucauc

SEQ ID NO: 3444437 - RNA, 22 nt, Human
gaaggaaggcuccaucuccagu

SEQ ID NO: 3444438 - RNA, 17 nt, Human
gaaggacagaaaggaga

SEQ ID NO: 3444439 - RNA, 16 nt, Human
gaaggaccacauuuua

SEQ ID NO: 3444440 - RNA, 20 nt, Human
gaaggacuaauagaaaagua

SEQ ID NO: 3444441 - RNA, 19 nt, Human
gaaggacugugacaggcag

SEQ ID NO: 3444442 - RNA, 17 nt, Human
gaaggagaaguaagagg

SEQ ID NO: 3444443 - RNA, 15 nt, Human
gaaggagacacagau

SEQ ID NO: 3444444 - RNA, 16 nt, Human
gaaggagacacagaug

SEQ ID NO: 3444445 - RNA, 18 nt, Human
gaaggagacagagcuggu

SEQ ID NO: 3444446 - RNA, 13 nt, Human
gaaggagagaaag

SEQ ID NO: 3444447 - RNA, 21 nt, Human
gaaggagagaaagugggugag

SEQ ID NO: 3444448 - RNA, 20 nt, Human
gaaggagagaaggggaggag

SEQ ID NO: 3444449 - RNA, 16 nt, Human
gaaggagagccugcug

SEQ ID NO: 3444450 - RNA, 18 nt, Human
gaaggagcugccuggacc

SEQ ID NO: 3444451 - RNA, 20 nt, Human
gaaggaggaaugcuggacug

SEQ ID NO: 3444452 - RNA, 13 nt, Human
gaaggaggaccca

SEQ ID NO: 3444453 - RNA, 16 nt, Human
gaaggaggacccagga

SEQ ID NO: 3444454 - RNA, 12 nt, Human
gaaggaggagag

SEQ ID NO: 3444455 - RNA, 20 nt, Human
gaaggaggcuccaggcagca

SEQ ID NO: 3444456 - RNA, 14 nt, Human
gaaggaggggaagc

SEQ ID NO: 3444457 - RNA, 20 nt, Human
gaaggaggggaagcugcagc

SEQ ID NO: 3444458 - RNA, 13 nt, Human
gaaggaggugagg

SEQ ID NO: 3444459 - RNA, 17 nt, Human
gaaggaggugagggaug

SEQ ID NO: 3444460 - RNA, 12 nt, Human
gaaggauacaaa

SEQ ID NO: 3444461 - RNA, 19 nt, Human
gaaggauacaaaagcaugu

SEQ ID NO: 3444462 - RNA, 14 nt, Human
gaaggaugagcauu

SEQ ID NO: 3444463 - RNA, 14 nt, Human
gaaggaugcugucu

SEQ ID NO: 3444464 - RNA, 21 nt, Human
gaaggauucugcuggccucug

SEQ ID NO: 3444465 - RNA, 19 nt, Human
gaaggauuuuuuaaaguuu

SEQ ID NO: 3444466 - RNA, 14 nt, Human
gaaggcaaaugacu

SEQ ID NO: 3444467 - RNA, 14 nt, Human
gaaggcaagagggg

SEQ ID NO: 3444468 - RNA, 16 nt, Human
gaaggcaagagggggu

SEQ ID NO: 3444469 - RNA, 11 nt, Human
gaaggcaagau

SEQ ID NO: 3444470 - RNA, 15 nt, Human
gaaggcagacagcag

SEQ ID NO: 3444471 - RNA, 16 nt, Human
gaaggcagacagcagg

SEQ ID NO: 3444472 - RNA, 17 nt, Human
gaaggcagagaaaggga

SEQ ID NO: 3444473 - RNA, 18 nt, Human
gaaggcagagaaaucuaa

SEQ ID NO: 3444474 - RNA, 17 nt, Human
gaaggcagcagguggca

SEQ ID NO: 3444475 - RNA, 16 nt, Human
gaaggcagccaccagc

SEQ ID NO: 3444476 - RNA, 15 nt, Human
gaaggcaggcagggc

SEQ ID NO: 3444477 - RNA, 21 nt, Human
gaacuuguaaaggaauuuaaa

SEQ ID NO: 3444478 - RNA, 18 nt, Human
gaacuuguagcuguaaaa

SEQ ID NO: 3444479 - RNA, 15 nt, Human
gaacuuguuuucugg

SEQ ID NO: 3444480 - RNA, 14 nt, Human
gaacuuuauuucca

SEQ ID NO: 3444481 - RNA, 12 nt, Human
gaacuuucauuu

SEQ ID NO: 3444482 - RNA, 22 nt, Human
gaagugagggcucacucagcca

SEQ ID NO: 3444483 - RNA, 23 nt, Human
gaagugcaucuggagagaacagg

SEQ ID NO: 3444484 - RNA, 15 nt, Human
gaagugcgugaaugu

SEQ ID NO: 3444485 - RNA, 16 nt, Human
gaagugcgugaaugua

SEQ ID NO: 3444486 - RNA, 21 nt, Human
gaagugcgugaauguauguaa

SEQ ID NO: 3444487 - RNA, 20 nt, Human
gaagugcuggcaaccacuaa

SEQ ID NO: 3444488 - RNA, 18 nt, Human
gaagugcuguuuauuaau

SEQ ID NO: 3444489 - RNA, 21 nt, Human
gaagugcuuaguguacuugga

SEQ ID NO: 3444490 - RNA, 16 nt, Human
gaaguggaccaggaca

SEQ ID NO: 3444491 - RNA, 17 nt, Human
gaagaguggguuucaca

SEQ ID NO: 3444492 - RNA, 18 nt, Human
gaagaguggguuucacaa

SEQ ID NO: 3444493 - RNA, 14 nt, Human
gaagaguguacugg

SEQ ID NO: 3444494 - RNA, 13 nt, Human
gaagagugugugu

SEQ ID NO: 3444495 - RNA, 22 nt, Human
gaagaguugccccgucucuguu

SEQ ID NO: 3444496 - RNA, 21 nt, Human
gaagaguugugcacgcagauu

SEQ ID NO: 3444497 - RNA, 21 nt, Human
gaagauaaguguauuuuucaa

SEQ ID NO: 3444498 - RNA, 20 nt, Human
gaagauaauauuaaggaaga

SEQ ID NO: 3444499 - RNA, 13 nt, Human
gaagauacuuugu

SEQ ID NO: 3444500 - RNA, 13 nt, Human
gaagauaggcucu

SEQ ID NO: 3444501 - RNA, 17 nt, Human
gaagauaggcucugcac

SEQ ID NO: 3444502 - RNA, 21 nt, Human
gaagauagucuuggaagcugu

SEQ ID NO: 3444503 - RNA, 21 nt, Human
gaagauauaacuauugcccag

SEQ ID NO: 3444504 - RNA, 16 nt, Human
gaagaucacgcucccc

SEQ ID NO: 3444505 - RNA, 19 nt, Human
gaagaucacuuugcucuga

SEQ ID NO: 3444506 - RNA, 19 nt, Human
gaagaucauuuugaaauug

SEQ ID NO: 3444507 - RNA, 21 nt, Human
gaagauccagcugccuauuga

SEQ ID NO: 3444508 - RNA, 18 nt, Human
gaagaucccccagaaaag

SEQ ID NO: 3444509 - RNA, 15 nt, Human
gaagauccccucagg

SEQ ID NO: 3444510 - RNA, 20 nt, Human
gaagauccccucaggacugc

SEQ ID NO: 3444511 - RNA, 14 nt, Human
gaagauccugcggg

SEQ ID NO: 3444512 - RNA, 20 nt, Human
gaagauccugugaggagccc

SEQ ID NO: 3444513 - RNA, 18 nt, Human
gaagaucguuaguaucua

SEQ ID NO: 3444514 - RNA, 21 nt, Human
gaagaucuaaauaaaaugcua

SEQ ID NO: 3444515 - RNA, 13 nt, Human
gaagaucuguaau

SEQ ID NO: 3444516 - RNA, 13 nt, Human
gaagaugaaagag

SEQ ID NO: 3444517 - RNA, 15 nt, Human
gaagaugaauggcgu

SEQ ID NO: 3444518 - RNA, 15 nt, Human
gaagaugacuuccca

SEQ ID NO: 3444519 - RNA, 13 nt, Human
gaagaugaucaga

SEQ ID NO: 3444520 - RNA, 21 nt, Human
gaagaugcagcaaaaugugaa

SEQ ID NO: 3444521 - RNA, 18 nt, Human
gaagaugcauuguaguuu

SEQ ID NO: 3444522 - RNA, 16 nt, Human
gaagauggcauccugu

SEQ ID NO: 3444523 - RNA, 21 nt, Human
gaagauguuuaacuuaaucaa

SEQ ID NO: 3444524 - RNA, 18 nt, Human
gaagauuauuuuuuauga

SEQ ID NO: 3444525 - RNA, 21 nt, Human
gaagauucuucccauucucca

SEQ ID NO: 3444526 - RNA, 14 nt, Human
gaagauucuuuccc

SEQ ID NO: 3444527 - RNA, 22 nt, Human
gaagauugagauguguucacaa

SEQ ID NO: 3444528 - RNA, 20 nt, Human
gaagauuugaugcuggagag

SEQ ID NO: 3444529 - RNA, 15 nt, Human
gaagauuuucagucu

SEQ ID NO: 3444530 - RNA, 23 nt, Human
gaagauuuugaaauuuuuauuaa

SEQ ID NO: 3444531 - RNA, 19 nt, Human
gaagcaaaaacgaaagcug

SEQ ID NO: 3444532 - RNA, 21 nt, Human
gaagcaaaaacgaaagcuggg

SEQ ID NO: 3444533 - RNA, 15 nt, Human
gaagcaaauaaauau

SEQ ID NO: 3444534 - RNA, 21 nt, Human
gaagcaaaugucaugcugccu

SEQ ID NO: 3444535 - RNA, 23 nt, Human
gaagcaaaugucaugcugccuua

SEQ ID NO: 3444536 - RNA, 14 nt, Human
gaagcaacauuuua

SEQ ID NO: 3444537 - RNA, 16 nt, Human
gaagcaagcuuaaugg

SEQ ID NO: 3444538 - RNA, 13 nt, Human
gaagcaaggaaga

SEQ ID NO: 3444539 - RNA, 14 nt, Human
gaagcaaggcggug

SEQ ID NO: 3444540 - RNA, 18 nt, Human
gaagcaauaaagaagagu

SEQ ID NO: 3444541 - RNA, 13 nt, Human
gaagcacagcuuc

SEQ ID NO: 3444542 - RNA, 17 nt, Human
gaagcacagugaucaag

SEQ ID NO: 3444543 - RNA, 14 nt, Human
gaagcacaugccuc

SEQ ID NO: 3444544 - RNA, 20 nt, Human
gaagcacaugccucucucag

SEQ ID NO: 3444545 - RNA, 22 nt, Human
gaagcacaugccucucucaggc

SEQ ID NO: 3444546 - RNA, 16 nt, Human
gaagcaccauaacuuu

SEQ ID NO: 3444547 - RNA, 16 nt, Human
gaagcaccccaugcca

SEQ ID NO: 3444548 - RNA, 14 nt, Human
gaagcagaauaaag

SEQ ID NO: 3444549 - RNA, 15 nt, Human
gaagcagaauaaagc

SEQ ID NO: 3444550 - RNA, 17 nt, Human
gaagcagaauaaagcaa

SEQ ID NO: 3444551 - RNA, 18 nt, Human
gaagcagaauaaagcaau

SEQ ID NO: 3444552 - RNA, 22 nt, Human
gaagcagaauaaagcaauuuuc

SEQ ID NO: 3444553 - RNA, 23 nt, Human
gaagcagaccauuggggcuccca

SEQ ID NO: 3444554 - RNA, 14 nt, Human
gaagcagagagaug

SEQ ID NO: 3444555 - RNA, 15 nt, Human
gaagcagagagaugc

SEQ ID NO: 3444556 - RNA, 15 nt, Human
gaagcagaggaagga

SEQ ID NO: 3444557 - RNA, 21 nt, Human
gaagcagaugcaaagaggcaa

SEQ ID NO: 3444558 - RNA, 23 nt, Human
gaagcagaugcaaagaggcaaga

SEQ ID NO: 3444559 - RNA, 18 nt, Human
gaagcagcaacuuguccu

SEQ ID NO: 3444560 - RNA, 13 nt, Human
gaagcagcagccu

SEQ ID NO: 3444561 - RNA, 12 nt, Human
gaagcagccucu

SEQ ID NO: 3444562 - RNA, 15 nt, Human
gaagcagguuaaaug

SEQ ID NO: 3444563 - RNA, 17 nt, Human
gaagcagguuaaauguu

SEQ ID NO: 3444564 - RNA, 23 nt, Human
gaagcagguugaggggcuccugg

SEQ ID NO: 3444565 - RNA, 18 nt, Human
gaagcagugccuuccaua

SEQ ID NO: 3444566 - RNA, 16 nt, Human
gaagcaugaaaaagca

SEQ ID NO: 3444567 - RNA, 17 nt, Human
gaagcauguaggagaau

SEQ ID NO: 3444568 - RNA, 14 nt, Human
gaagcauguuucau

SEQ ID NO: 3444569 - RNA, 20 nt, Human
gaagcauuaacuucucugga

SEQ ID NO: 3444570 - RNA, 16 nt, Human
gaagcauucucauugg

SEQ ID NO: 3444571 - RNA, 17 nt, Human
gaagcauucuccccagu

SEQ ID NO: 3444572 - RNA, 20 nt, Human
gaagcauuguaaaauaauuc

SEQ ID NO: 3444573 - RNA, 18 nt, Human
gaagcauuuacuuugugu

SEQ ID NO: 3444574 - RNA, 15 nt, Human
gaagcauuuguauuu

SEQ ID NO: 3444575 - RNA, 20 nt, Human
gaagcauuuguauuuugugu

SEQ ID NO: 3444576 - RNA, 13 nt, Human
gaagcauuuguuu

SEQ ID NO: 3444577 - RNA, 17 nt, Human
gaagcauuuuauaaauc

SEQ ID NO: 3444578 - RNA, 14 nt, Human
gaagccaaagaaaa

SEQ ID NO: 3444579 - RNA, 16 nt, Human
gaagccaaagaaaaau

SEQ ID NO: 3444580 - RNA, 15 nt, Human
gaagccaagggaaag

SEQ ID NO: 3444581 - RNA, 17 nt, Human
gaagccaagggaaaggg

SEQ ID NO: 3444582 - RNA, 20 nt, Human
gaagccaagggaaaggggug

SEQ ID NO: 3444583 - RNA, 13 nt, Human
gaagccaaguggg

SEQ ID NO: 3444584 - RNA, 23 nt, Human
gaagccaaguggggugcugggag

SEQ ID NO: 3444585 - RNA, 20 nt, Human
gaagccaauucagacaggca

SEQ ID NO: 3444586 - RNA, 15 nt, Human
gaagccacagcccag

SEQ ID NO: 3444587 - RNA, 15 nt, Human
gaagccacaggccug

SEQ ID NO: 3444588 - RNA, 17 nt, Human
gaagccacaggccugag

SEQ ID NO: 3444589 - RNA, 17 nt, Human
gaagccacccaaagcag

SEQ ID NO: 3444590 - RNA, 12 nt, Human
gaagccacccuc

SEQ ID NO: 3444591 - RNA, 19 nt, Human
gaagccacccucccagcuc

SEQ ID NO: 3444592 - RNA, 20 nt, Human
gaagccacccucccagcucu

SEQ ID NO: 3444593 - RNA, 18 nt, Human
gaagccacugaagcuggg

SEQ ID NO: 3444594 - RNA, 15 nt, Human
gaagccagcaggcuc

SEQ ID NO: 3444595 - RNA, 18 nt, Human
gaagccagcugccuagga

SEQ ID NO: 3444596 - RNA, 13 nt, Human
gaagccaggagca

SEQ ID NO: 3444597 - RNA, 19 nt, Human
gaagccaucuaaaguaaaa

SEQ ID NO: 3444598 - RNA, 14 nt, Human
gaagccauugucuu

SEQ ID NO: 3444599 - RNA, 16 nt, Human
gaagcccaagugaaau

SEQ ID NO: 3444600 - RNA, 18 nt, Human
gaagcccaauugcuggag

SEQ ID NO: 3444601 - RNA, 10 nt, Human
gaagcccaga

SEQ ID NO: 3444602 - RNA, 22 nt, Human
gaagcccagccccuacugcugu

SEQ ID NO: 3444603 - RNA, 13 nt, Human
gaagcccaggaaa

SEQ ID NO: 3444604 - RNA, 20 nt, Human
gaagcccaggaaaggcucca

SEQ ID NO: 3444605 - RNA, 21 nt, Human
gaagcccaggaaaggcuccag

SEQ ID NO: 3444606 - RNA, 14 nt, Human
gaagcccaggagcc

SEQ ID NO: 3444607 - RNA, 23 nt, Human
gaagcccaggccccuuuucacuc

SEQ ID NO: 3444608 - RNA, 16 nt, Human
gaagcccauccugacc

SEQ ID NO: 3444609 - RNA, 14 nt, Human
gaagccccugggcc

SEQ ID NO: 3444610 - RNA, 19 nt, Human
gaagccccuuccccauggg

SEQ ID NO: 3444611 - RNA, 16 nt, Human
gaagcccggcuccugg

SEQ ID NO: 3444612 - RNA, 18 nt, Human
gaagcccggcuccugguc

SEQ ID NO: 3444613 - RNA, 17 nt, Human
gaagcccuccaaaagca

SEQ ID NO: 3444614 - RNA, 15 nt, Human
gaagcccucccaggu

SEQ ID NO: 3444615 - RNA, 15 nt, Human
gaagcccuccuucca

SEQ ID NO: 3444616 - RNA, 16 nt, Human
gaagcccuccuuccac

SEQ ID NO: 3444617 - RNA, 19 nt, Human
gaagcccuccuuccacgga

SEQ ID NO: 3444618 - RNA, 18 nt, Human
gaagcccuggauuucaga

SEQ ID NO: 3444619 - RNA, 21 nt, Human
gaagcccuggauuucagaaag

SEQ ID NO: 3444620 - RNA, 22 nt, Human
gaagcccuggauuucagaaaga

SEQ ID NO: 3444621 - RNA, 23 nt, Human
gaagcccuguugugccacagagu

SEQ ID NO: 3444622 - RNA, 23 nt, Human
gaagccgccaggaccgccaaaga

SEQ ID NO: 3444623 - RNA, 20 nt, Human
gaagccgcuggggccaguug

SEQ ID NO: 3444624 - RNA, 15 nt, Human
gaagccggcggccca

SEQ ID NO: 3444625 - RNA, 19 nt, Human
gaagccgugcccugccccc

SEQ ID NO: 3444626 - RNA, 13 nt, Human
gacacaggcccuc

SEQ ID NO: 3444627 - RNA, 12 nt, Human
gacacaggccug

SEQ ID NO: 3444628 - RNA, 21 nt, Human
gacacaggccuguguagcugu

SEQ ID NO: 3444629 - RNA, 22 nt, Human
gacacaggggacacccagaaac

SEQ ID NO: 3444630 - RNA, 17 nt, Human
gacacaggucuuuccua

SEQ ID NO: 3444631 - RNA, 22 nt, Human
gacacaggucuuuccuaaggcu

SEQ ID NO: 3444632 - RNA, 17 nt, Human
gacacagugaccauacu

SEQ ID NO: 3444633 - RNA, 22 nt, Human
gacacaguucaauucucauuug

SEQ ID NO: 3444634 - RNA, 14 nt, Human
gacacaguuccugg

SEQ ID NO: 3444635 - RNA, 19 nt, Human
gacacauacucauuuuuca

SEQ ID NO: 3444636 - RNA, 20 nt, Human
gacacaugaagguaaauaaa

SEQ ID NO: 3444637 - RNA, 17 nt, Human
gacacaugccagggcca

SEQ ID NO: 3444638 - RNA, 23 nt, Human
gacacauguccaagaagcccagg

SEQ ID NO: 3444639 - RNA, 14 nt, Human
gacacauuuaagga

SEQ ID NO: 3444640 - RNA, 20 nt, Human
gacacauuuuuuaggaaaug

SEQ ID NO: 3444641 - RNA, 15 nt, Human
gacaccaaaguucua

SEQ ID NO: 3444642 - RNA, 15 nt, Human
gacaccacacccagc

SEQ ID NO: 3444643 - RNA, 17 nt, Human
gacaccacacccagccu

SEQ ID NO: 3444644 - RNA, 21 nt, Human
gacaccacacccagccucagu

SEQ ID NO: 3444645 - RNA, 19 nt, Human
gacaccagagcagaugcag

SEQ ID NO: 3444646 - RNA, 14 nt, Human
gacaccagccaggc

SEQ ID NO: 3444647 - RNA, 14 nt, Human
gacacccaggacuu

SEQ ID NO: 3444648 - RNA, 13 nt, Human
gacacccccucgc

SEQ ID NO: 3444649 - RNA, 20 nt, Human
gacaccccuuauccaggacu

SEQ ID NO: 3444650 - RNA, 10 nt, Human
gacacccggc

SEQ ID NO: 3444651 - RNA, 13 nt, Human
gacacccucaacc

SEQ ID NO: 3444652 - RNA, 13 nt, Human
gacacccuggcag

SEQ ID NO: 3444653 - RNA, 19 nt, Human
gacacccuucucccacucu

SEQ ID NO: 3444654 - RNA, 19 nt, Human
gacaccgggccaguaucua

SEQ ID NO: 3444655 - RNA, 22 nt, Human
gacaccgggccaguaucuauau

SEQ ID NO: 3444656 - RNA, 15 nt, Human
gacaccuaggcuagg

SEQ ID NO: 3444657 - RNA, 20 nt, Human
gacaccuaggcuaggguggg

SEQ ID NO: 3444658 - RNA, 11 nt, Human
gacaccucaga

SEQ ID NO: 3444659 - RNA, 17 nt, Human
gacaccugcaccucccc

SEQ ID NO: 3444660 - RNA, 22 nt, Human
gacaccugcaccuccccccacu

SEQ ID NO: 3444661 - RNA, 23 nt, Human
gacaccugcccugcccugccacc

SEQ ID NO: 3444662 - RNA, 12 nt, Human
gacaccugggag

SEQ ID NO: 3444663 - RNA, 16 nt, Human
gacaccuguacuggag

SEQ ID NO: 3444664 - RNA, 17 nt, Human
gacaccuguacuggaga

SEQ ID NO: 3444665 - RNA, 18 nt, Human
gacaccuguacuggagag

SEQ ID NO: 3444666 - RNA, 14 nt, Human
gacaccuuuagguu

SEQ ID NO: 3444667 - RNA, 14 nt, Human
gacacgcacggcag

SEQ ID NO: 3444668 - RNA, 20 nt, Human
gacacgcacggcagccacag

SEQ ID NO: 3444669 - RNA, 21 nt, Human
gacacgcacggcagccacagc

SEQ ID NO: 3444670 - RNA, 22 nt, Human
gacacgcacggcagccacagcu

SEQ ID NO: 3444671 - RNA, 22 nt, Human
gacacgcgccccccucccagag

SEQ ID NO: 3444672 - RNA, 23 nt, Human
gacacgcucuucuauuuuauucc

SEQ ID NO: 3444673 - RNA, 19 nt, Human
gacacggaucugagaaucu

SEQ ID NO: 3444674 - RNA, 17 nt, Human
gacacgggcagccuggc

SEQ ID NO: 3444675 - RNA, 15 nt, Human
gacacgggccugucc

SEQ ID NO: 3444676 - RNA, 20 nt, Human
gacacgggccuguccacagg

SEQ ID NO: 3444677 - RNA, 15 nt, Human
gacacggggcagugg

SEQ ID NO: 3444678 - RNA, 19 nt, Human
gacacgugggcuccccucu

SEQ ID NO: 3444679 - RNA, 17 nt, Human
gacacuaaccacgcugg

SEQ ID NO: 3444680 - RNA, 20 nt, Human
gacacuaauggggcggugag

SEQ ID NO: 3444681 - RNA, 14 nt, Human
gacacuacacccag

SEQ ID NO: 3444682 - RNA, 16 nt, Human
gacacuacacccagca

SEQ ID NO: 3444683 - RNA, 17 nt, Human
gacacuacacccagcaa

SEQ ID NO: 3444684 - RNA, 20 nt, Human
gacacuacacccagcaauag

SEQ ID NO: 3444685 - RNA, 12 nt, Human
gacacuauaucu

SEQ ID NO: 3444686 - RNA, 16 nt, Human
gacacuauucacuaaa

SEQ ID NO: 3444687 - RNA, 23 nt, Human
gacacucaagucccccaagaccu

SEQ ID NO: 3444688 - RNA, 16 nt, Human
gacacucauauaauua

SEQ ID NO: 3444689 - RNA, 21 nt, Human
gacacuccagggacacacagc

SEQ ID NO: 3444690 - RNA, 12 nt, Human
gacacuccagug

SEQ ID NO: 3444691 - RNA, 16 nt, Human
gacacuccagugccag

SEQ ID NO: 3444692 - RNA, 19 nt, Human
gacacuccagugccagcaa

SEQ ID NO: 3444693 - RNA, 21 nt, Human
gacacuccuagagaacgcagc

SEQ ID NO: 3444694 - RNA, 22 nt, Human
gacacuccuagagaacgcagcc

SEQ ID NO: 3444695 - RNA, 17 nt, Human
gacacucuccuugcagu

SEQ ID NO: 3444696 - RNA, 18 nt, Human
gacacucuccuugcaguu

SEQ ID NO: 3444697 - RNA, 14 nt, Human
cucaauuucucuau

SEQ ID NO: 3444698 - RNA, 16 nt, Human
cucaauuucugaacac

SEQ ID NO: 3444699 - RNA, 23 nt, Human
cucaauuuuaucccucaccugua

SEQ ID NO: 3444700 - RNA, 17 nt, Human
cucaauuuucacugugu

SEQ ID NO: 3444701 - RNA, 21 nt, Human
cucaauuuuugguugaauaaa

SEQ ID NO: 3444702 - RNA, 17 nt, Human
cucaauuuuugucucag

SEQ ID NO: 3444703 - RNA, 20 nt, Human
cucaauuuuugucucagaag

SEQ ID NO: 3444704 - RNA, 18 nt, Human
cucacaaaugaaaccuga

SEQ ID NO: 3444705 - RNA, 17 nt, Human
cucacaacagcugccug

SEQ ID NO: 3444706 - RNA, 19 nt, Human
cucacaacauggugucugg

SEQ ID NO: 3444707 - RNA, 16 nt, Human
cucacaaccugaaccu

SEQ ID NO: 3444708 - RNA, 17 nt, Human
cucacaagaagaccaga

SEQ ID NO: 3444709 - RNA, 19 nt, Human
cucacaagaagaccagacu

SEQ ID NO: 3444710 - RNA, 21 nt, Human
cucacaauagccgauaucaga

SEQ ID NO: 3444711 - RNA, 17 nt, Human
cucacacacccugaggu

SEQ ID NO: 3444712 - RNA, 12 nt, Human
cucacacagcca

SEQ ID NO: 3444713 - RNA, 14 nt, Human
cucacacagccagg

SEQ ID NO: 3444714 - RNA, 15 nt, Human
cucacacagccaggu

SEQ ID NO: 3444715 - RNA, 19 nt, Human
cucacacagccaggugccu

SEQ ID NO: 3444716 - RNA, 20 nt, Human
cucacacagccaggugccuu

SEQ ID NO: 3444717 - RNA, 21 nt, Human
cucacacaggacccccuuccc

SEQ ID NO: 3444718 - RNA, 13 nt, Human
cucacacaggcau

SEQ ID NO: 3444719 - RNA, 21 nt, Human
cucacacaggcauuuccuggg

SEQ ID NO: 3444720 - RNA, 23 nt, Human
cucacacaggcauuuccugggug

SEQ ID NO: 3444721 - RNA, 14 nt, Human
cucacacaugagca

SEQ ID NO: 3444722 - RNA, 20 nt, Human
cucacaccacuagccucagg

SEQ ID NO: 3444723 - RNA, 13 nt, Human
cucacacccaccg

SEQ ID NO: 3444724 - RNA, 22 nt, Human
cucacacccaccguccgcccug

SEQ ID NO: 3444725 - RNA, 19 nt, Human
cucacaccgcgucugguga

SEQ ID NO: 3444726 - RNA, 13 nt, Human
cucacacucaccc

SEQ ID NO: 3444727 - RNA, 13 nt, Human
cucacacugagaa

SEQ ID NO: 3444728 - RNA, 14 nt, Human
cucacacugagaau

SEQ ID NO: 3444729 - RNA, 17 nt, Human
cucacagaacccuugga

SEQ ID NO: 3444730 - RNA, 13 nt, Human
cucacagaagaau

SEQ ID NO: 3444731 - RNA, 12 nt, Human
cucacagacagg

SEQ ID NO: 3444732 - RNA, 18 nt, Human
cucacagacaggaccccu

SEQ ID NO: 3444733 - RNA, 20 nt, Human
cucacagaccuggagccccu

SEQ ID NO: 3444734 - RNA, 20 nt, Human
cucacagagucaaggccugc

SEQ ID NO: 3444735 - RNA, 19 nt, Human
cucacagcacaugcuggcc

SEQ ID NO: 3444736 - RNA, 12 nt, Human
cucacagccucu

SEQ ID NO: 3444737 - RNA, 21 nt, Human
cucacagccucugaccccucc

SEQ ID NO: 3444738 - RNA, 16 nt, Human
cucacagcuaugcaaa

SEQ ID NO: 3444739 - RNA, 13 nt, Human
cucacagcugagu

SEQ ID NO: 3444740 - RNA, 23 nt, Human
cucacagguuggaagagaaucac

SEQ ID NO: 3444741 - RNA, 19 nt, Human
cucacaguaacccaaaccu

SEQ ID NO: 3444742 - RNA, 23 nt, Human
cucacaguaacccaaaccucaag

SEQ ID NO: 3444743 - RNA, 17 nt, Human
cucacaguccuuaccag

SEQ ID NO: 3444744 - RNA, 19 nt, Human
cucacaguccuuaccagca

SEQ ID NO: 3444745 - RNA, 14 nt, Human
cucacagugacccu

SEQ ID NO: 3444746 - RNA, 18 nt, Human
cucacagugacccuuccc

SEQ ID NO: 3444747 - RNA, 20 nt, Human
cucacaguuccucgcccugg

SEQ ID NO: 3444748 - RNA, 21 nt, Human
cucacaguuccucgcccuggg

SEQ ID NO: 3444749 - RNA, 20 nt, Human
cucacauagcuuacaagcca

SEQ ID NO: 3444750 - RNA, 22 nt, Human
cucacaugauuccagccaucac

SEQ ID NO: 3444751 - RNA, 15 nt, Human
cucacaugcuggaca

SEQ ID NO: 3444752 - RNA, 22 nt, Human
cucacaugcuggacaggucugg

SEQ ID NO: 3444753 - RNA, 23 nt, Human
cucacaugcuggacaggucuggg

SEQ ID NO: 3444754 - RNA, 16 nt, Human
cucacauggaaugagg

SEQ ID NO: 3444755 - RNA, 18 nt, Human
cucacauggaaugagggu

SEQ ID NO: 3444756 - RNA, 20 nt, Human
cucacauggaaugaggguuu

SEQ ID NO: 3444757 - RNA, 19 nt, Human
cucacaugguuuacauccu

SEQ ID NO: 3444758 - RNA, 22 nt, Human
cucacaugucaguaccuucaaa

SEQ ID NO: 3444759 - RNA, 15 nt, Human
cucacauuuauucug

SEQ ID NO: 3444760 - RNA, 22 nt, Human
cucacauuuauucugcucacau

SEQ ID NO: 3444761 - RNA, 15 nt, Human
cucacauuuuuuucu

SEQ ID NO: 3444762 - RNA, 14 nt, Human
cucaccacccacuu

SEQ ID NO: 3444763 - RNA, 17 nt, Human
cucaccacugcccccug

SEQ ID NO: 3444764 - RNA, 22 nt, Human
cucaccagccccacugccagca

SEQ ID NO: 3444765 - RNA, 19 nt, Human
cucaccagccccagugccc

SEQ ID NO: 3444766 - RNA, 18 nt, Human
cucaccaggcagccucug

SEQ ID NO: 3444767 - RNA, 20 nt, Human
cucaccaguguccccuccac

SEQ ID NO: 3444768 - RNA, 23 nt, Human
cucaccaguguccccuccacugu

SEQ ID NO: 3444769 - RNA, 14 nt, Human
cucaccaucugugc

SEQ ID NO: 3444770 - RNA, 18 nt, Human
gaauugaccaucugcuuu

SEQ ID NO: 3444771 - RNA, 18 nt, Human
gaauugacuucgacugug

SEQ ID NO: 3444772 - RNA, 14 nt, Human
gaauugagcugcag

SEQ ID NO: 3444773 - RNA, 22 nt, Human
gaauugaggggauuaauaugaa

SEQ ID NO: 3444774 - RNA, 14 nt, Human
gaauugaguaaugg

SEQ ID NO: 3444775 - RNA, 16 nt, Human
gaauugaguaauggug

SEQ ID NO: 3444776 - RNA, 19 nt, Human
gaauugaguguuuaaaguu

SEQ ID NO: 3444777 - RNA, 22 nt, Human
gaauugauugggcacaucauuu

SEQ ID NO: 3444778 - RNA, 12 nt, Human
gaauugauuugc

SEQ ID NO: 3444779 - RNA, 18 nt, Human
gaauugauuugcauugaa

SEQ ID NO: 3444780 - RNA, 12 nt, Human
gaauugcauuga

SEQ ID NO: 3444781 - RNA, 13 nt, Human
gaauugcauugac

SEQ ID NO: 3444782 - RNA, 21 nt, Human
gaauugcauuuuuuaaaacaa

SEQ ID NO: 3444783 - RNA, 23 nt, Human
gaauugcauuuuuuaaaacaaga

SEQ ID NO: 3444784 - RNA, 15 nt, Human
gaauugccagucuuu

SEQ ID NO: 3444785 - RNA, 18 nt, Human
gaauugccagucuuuugu

SEQ ID NO: 3444786 - RNA, 22 nt, Human
gaauugccugcagagagaagcc

SEQ ID NO: 3444787 - RNA, 24 nt, Human
gaauugcuuguuugcuucaacugu

SEQ ID NO: 3444788 - RNA, 20 nt, Human
gaauugggcggcucugaagc

SEQ ID NO: 3444789 - RNA, 20 nt, Human
gaauuggguggggggcuuca

SEQ ID NO: 3444790 - RNA, 23 nt, Human
gaauuggguggggggcuucauac

SEQ ID NO: 3444791 - RNA, 23 nt, Human
gaauuguaaaagcaacaucagcu

SEQ ID NO: 3444792 - RNA, 22 nt, Human
gaauuguaaggaaugauuaauu

SEQ ID NO: 3444793 - RNA, 23 nt, Human
gaauuguccccaguuugcagaaa

SEQ ID NO: 3444794 - RNA, 18 nt, Human
gaauuguggcuauccuga

SEQ ID NO: 3444795 - RNA, 23 nt, Human
gaauuguguuuauaauuuuaaau

SEQ ID NO: 3444796 - RNA, 20 nt, Human
gaauuuaaagaaaaaaaugu

SEQ ID NO: 3444797 - RNA, 22 nt, Human
gaauuuaaauagcuuuuuucuc

SEQ ID NO: 3444798 - RNA, 13 nt, Human
gaauuuaaauaua

SEQ ID NO: 3444799 - RNA, 11 nt, Human
gaauuuaacaa

SEQ ID NO: 3444800 - RNA, 12 nt, Human
gaauuuaacaau

SEQ ID NO: 3444801 - RNA, 22 nt, Human
gaauuuaacaaugcgaauggua

SEQ ID NO: 3444802 - RNA, 16 nt, Human
gaauuuacuggacaua

SEQ ID NO: 3444803 - RNA, 13 nt, Human
gaauuuauaccuc

SEQ ID NO: 3444804 - RNA, 17 nt, Human
gaauuuauucaauuccu

SEQ ID NO: 3444805 - RNA, 12 nt, Human
gaauuucaccug

SEQ ID NO: 3444806 - RNA, 22 nt, Human
gaauuucccaaagcagugcaug

SEQ ID NO: 3444807 - RNA, 17 nt, Human
gaauuucccacauaccc

SEQ ID NO: 3444808 - RNA, 15 nt, Human
gaauuucccaggacc

SEQ ID NO: 3444809 - RNA, 22 nt, Human
gaauuucccaggacccugaagg

SEQ ID NO: 3444810 - RNA, 17 nt, Human
gaauuucuaaaaaacag

SEQ ID NO: 3444811 - RNA, 20 nt, Human
gaauuucuaggacugaauua

SEQ ID NO: 3444812 - RNA, 17 nt, Human
gaauuucuuaacuucuu

SEQ ID NO: 3444813 - RNA, 18 nt, Human
gaauuucuuaacuucuug

SEQ ID NO: 3444814 - RNA, 19 nt, Human
gaauuucuucacuguugaa

SEQ ID NO: 3444815 - RNA, 11 nt, Human
gaauuucuugu

SEQ ID NO: 3444816 - RNA, 17 nt, Human
gaauuugagugcucuga

SEQ ID NO: 3444817 - RNA, 13 nt, Human
gaauuugcaaagu

SEQ ID NO: 3444818 - RNA, 10 nt, Human
gaauuugcau

SEQ ID NO: 3444819 - RNA, 17 nt, Human
gaauuugcauacuuacc

SEQ ID NO: 3444820 - RNA, 18 nt, Human
gaauuugcauacuuaccu

SEQ ID NO: 3444821 - RNA, 19 nt, Human
gaauuuggagacucugugg

SEQ ID NO: 3444822 - RNA, 19 nt, Human
gaauuuggccugcacuaau

SEQ ID NO: 3444823 - RNA, 19 nt, Human
gaauuuggggcuuccaagu

SEQ ID NO: 3444824 - RNA, 17 nt, Human
gaauuuguaaccucagc

SEQ ID NO: 3444825 - RNA, 19 nt, Human
gaauuuguaaccucagcuc

SEQ ID NO: 3444826 - RNA, 22 nt, Human
gaauuuguaaguuuaugucuaa

SEQ ID NO: 3444827 - RNA, 15 nt, Human
gaauuuuaaaagaug

SEQ ID NO: 3444828 - RNA, 21 nt, Human
gaauuuuaaaagaugcaaugu

SEQ ID NO: 3444829 - RNA, 23 nt, Human
gaauuuuaaaagaugcaauguag

SEQ ID NO: 3444830 - RNA, 12 nt, Human
gaauuuuaaagu

SEQ ID NO: 3444831 - RNA, 15 nt, Human
gaauuuuaaaguaug

SEQ ID NO: 3444832 - RNA, 15 nt, Human
gaauuuuaagugcuu

SEQ ID NO: 3444833 - RNA, 19 nt, Human
gaauuuuauacuuucccua

SEQ ID NO: 3444834 - RNA, 14 nt, Human
gaauuuucauuuua

SEQ ID NO: 3444835 - RNA, 16 nt, Human
gaauuuucauuuuaca

SEQ ID NO: 3444836 - RNA, 20 nt, Human
gaauuuucauuuuacaguua

SEQ ID NO: 3444837 - RNA, 14 nt, Human
gaauuuucccacug

SEQ ID NO: 3444838 - RNA, 22 nt, Human
gaauuuuccugagacaaauuuu

SEQ ID NO: 3444839 - RNA, 16 nt, Human
gaauuuucuaaaagcu

SEQ ID NO: 3444840 - RNA, 13 nt, Human
gaauuuucugugu

SEQ ID NO: 3444841 - RNA, 19 nt, Human
gaauuuuggcugugucucc

SEQ ID NO: 3444842 - RNA, 21 nt, Human
gaauuuugugcccccauguaa

SEQ ID NO: 3444843 - RNA, 22 nt, Human
gaauuuuguguuagagauuuuu

SEQ ID NO: 3444844 - RNA, 17 nt, Human
gaauuuuguucucuggg

SEQ ID NO: 3444845 - RNA, 18 nt, Human
gaauuuuguucucuggga

SEQ ID NO: 3444846 - RNA, 15 nt, Human
gaauuuuguugcugu

SEQ ID NO: 3444847 - RNA, 18 nt, Human
gaauuuuuaugugugauu

SEQ ID NO: 3444848 - RNA, 17 nt, Human
gaauuuuuauuaugcau

SEQ ID NO: 3444849 - RNA, 15 nt, Human
gaauuuuuauuguug

SEQ ID NO: 3444850 - RNA, 22 nt, Human
gaauuuuuccuaugcuauugac

SEQ ID NO: 3444851 - RNA, 13 nt, Human
gaauuuuugcaau

SEQ ID NO: 3444852 - RNA, 14 nt, Human
gaauuuuugcaaua

SEQ ID NO: 3444853 - RNA, 17 nt, Human
gaauuuuuuauucuugu

SEQ ID NO: 3444854 - RNA, 19 nt, Human
gaauuuuuuauucuuguga

SEQ ID NO: 3444855 - RNA, 22 nt, Human
gaauuuuuuucaucuucucugg

SEQ ID NO: 3444856 - RNA, 17 nt, Human
gaauuuuuuugucuuua

SEQ ID NO: 3444857 - RNA, 22 nt, Human
gaauuuuuuuuguuguuucagu

SEQ ID NO: 3444858 - RNA, 18 nt, Human
gacaaaaaauguuuuaaa

SEQ ID NO: 3444859 - RNA, 16 nt, Human
gacaaaaacagccuca

SEQ ID NO: 3444860 - RNA, 17 nt, Human
gacacucugcucugccc

SEQ ID NO: 3444861 - RNA, 15 nt, Human
gacacucuggcuggu

SEQ ID NO: 3444862 - RNA, 23 nt, Human
gacacugaaauauacacacagca

SEQ ID NO: 3444863 - RNA, 22 nt, Human
gacacugaaaugccuuacuuug

SEQ ID NO: 3444864 - RNA, 23 nt, Human
gacacugcagaaacccugagcag

SEQ ID NO: 3444865 - RNA, 12 nt, Human
gacacugccugg

SEQ ID NO: 3444866 - RNA, 13 nt, Human
gacacugccuggg

SEQ ID NO: 3444867 - RNA, 14 nt, Human
gacacugccugggc

SEQ ID NO: 3444868 - RNA, 14 nt, Human
gacacugcucuaac

SEQ ID NO: 3444869 - RNA, 14 nt, Human
gacacuggccccuc

SEQ ID NO: 3444870 - RNA, 20 nt, Human
gacacugguauuccugccuc

SEQ ID NO: 3444871 - RNA, 16 nt, Human
gacacugugcccagcc

SEQ ID NO: 3444872 - RNA, 20 nt, Human
gacacugugcccagcccgga

SEQ ID NO: 3444873 - RNA, 22 nt, Human
gacacuguucucccuucggugg

SEQ ID NO: 3444874 - RNA, 22 nt, Human
gacacuguucuuagcucaauga

SEQ ID NO: 3444875 - RNA, 23 nt, Human
gacacuguucuuagcucaaugag

SEQ ID NO: 3444876 - RNA, 20 nt, Human
gacacuuaauacuaccuuga

SEQ ID NO: 3444877 - RNA, 19 nt, Human
gacacuuaauucuguucug

SEQ ID NO: 3444878 - RNA, 19 nt, Human
gacacuucaaggugacaga

SEQ ID NO: 3444879 - RNA, 15 nt, Human
gacacuucagagagc

SEQ ID NO: 3444880 - RNA, 19 nt, Human
gacacuucagagagcuggu

SEQ ID NO: 3444881 - RNA, 14 nt, Human
gacacuuccugccu

SEQ ID NO: 3444882 - RNA, 17 nt, Human
gacacuugauacuuguu

SEQ ID NO: 3444883 - RNA, 18 nt, Human
gacacuuugaaauguguu

SEQ ID NO: 3444884 - RNA, 21 nt, Human
gacacuuuucaugugugauuu

SEQ ID NO: 3444885 - RNA, 14 nt, Human
gacacuuuuucuuu

SEQ ID NO: 3444886 - RNA, 16 nt, Human
gacagaaaacauguuu

SEQ ID NO: 3444887 - RNA, 22 nt, Human
gacagaaaauauguauuaacac

SEQ ID NO: 3444888 - RNA, 13 nt, Human
gacagaacacugu

SEQ ID NO: 3444889 - RNA, 17 nt, Human
gacagaaccacagggcu

SEQ ID NO: 3444890 - RNA, 15 nt, Human
gacagaagcagcucu

SEQ ID NO: 3444891 - RNA, 15 nt, Human
gacagaaggaccagc

SEQ ID NO: 3444892 - RNA, 14 nt, Human
gacagaaggugcca

SEQ ID NO: 3444893 - RNA, 23 nt, Human
gacagaaggugccacuuuaccca

SEQ ID NO: 3444894 - RNA, 16 nt, Human
gacagaagucuccuca

SEQ ID NO: 3444895 - RNA, 20 nt, Human
gacagaaguuugcacuaucu

SEQ ID NO: 3444896 - RNA, 15 nt, Human
gacagaauguaucug

SEQ ID NO: 3444897 - RNA, 18 nt, Human
gacagaauguaucuguga

SEQ ID NO: 3444898 - RNA, 13 nt, Human
gacagaauuuuuu

SEQ ID NO: 3444899 - RNA, 23 nt, Human
gacagacaacacugggaaacaga

SEQ ID NO: 3444900 - RNA, 20 nt, Human
gacagacacaggcccggcuc

SEQ ID NO: 3444901 - RNA, 23 nt, Human
gacagacacuucuaaaugaagug

SEQ ID NO: 3444902 - RNA, 16 nt, Human
gacagacagcccucca

SEQ ID NO: 3444903 - RNA, 14 nt, Human
gacagacaggcucu

SEQ ID NO: 3444904 - RNA, 18 nt, Human
gacagaccacaucuuuau

SEQ ID NO: 3444905 - RNA, 22 nt, Human
gacagaccacaucuuuaucugu

SEQ ID NO: 3444906 - RNA, 23 nt, Human
gacagacucacaaccugaaccua

SEQ ID NO: 3444907 - RNA, 16 nt, Human
gacagacuccugagga

SEQ ID NO: 3444908 - RNA, 22 nt, Human
gacagacugcaagaggcuccug

SEQ ID NO: 3444909 - RNA, 15 nt, Human
gacagacuugagaac

SEQ ID NO: 3444910 - RNA, 17 nt, Human
gacagagaaggcagcag

SEQ ID NO: 3444911 - RNA, 12 nt, Human
gacagagaaggg

SEQ ID NO: 3444912 - RNA, 15 nt, Human
gacagagacaccugc

SEQ ID NO: 3444913 - RNA, 16 nt, Human
gacagagacaccugca

SEQ ID NO: 3444914 - RNA, 18 nt, Human
gacgcugugcugcccugc

SEQ ID NO: 3444915 - RNA, 21 nt, Human
gacgcugugcugcccugccca

SEQ ID NO: 3444916 - RNA, 13 nt, Human
gacgcuucugaau

SEQ ID NO: 3444917 - RNA, 13 nt, Human
gacgcuugcucug

SEQ ID NO: 3444918 - RNA, 18 nt, Human
gacggagucccaccuugg

SEQ ID NO: 3444919 - RNA, 21 nt, Human
gacggagucccaccuuggcug

SEQ ID NO: 3444920 - RNA, 20 nt, Human
cucaucauucucugucucau

SEQ ID NO: 3444921 - RNA, 23 nt, Human
cucaucauucucugucucaucca

SEQ ID NO: 3444922 - RNA, 18 nt, Human
cucauccacauacccuga

SEQ ID NO: 3444923 - RNA, 20 nt, Human
cucauccacauacccugacc

SEQ ID NO: 3444924 - RNA, 24 nt, Human
cucauccaccccaucccuccccag

SEQ ID NO: 3444925 - RNA, 15 nt, Human
cucauccagggcucu

SEQ ID NO: 3444926 - RNA, 14 nt, Human
cucaucccacgcac

SEQ ID NO: 3444927 - RNA, 10 nt, Human
cucaucccau

SEQ ID NO: 3444928 - RNA, 22 nt, Human
cucauccccaggggucccagcc

SEQ ID NO: 3444929 - RNA, 16 nt, Human
cucauccccaguccca

SEQ ID NO: 3444930 - RNA, 19 nt, Human
cucaucccguguucuccuu

SEQ ID NO: 3444931 - RNA, 14 nt, Human
cucauccgaggcag

SEQ ID NO: 3444932 - RNA, 16 nt, Human
cucauccucagaugcu

SEQ ID NO: 3444933 - RNA, 15 nt, Human
cucauccucauaccc

SEQ ID NO: 3444934 - RNA, 23 nt, Human
cucauccuccuggaaccuugcug

SEQ ID NO: 3444935 - RNA, 14 nt, Human
cucauccuccuucu

SEQ ID NO: 3444936 - RNA, 14 nt, Human
cucauccugcaggc

SEQ ID NO: 3444937 - RNA, 15 nt, Human
cucauccuuuucucc

SEQ ID NO: 3444938 - RNA, 16 nt, Human
cucaucgcguccuccu

SEQ ID NO: 3444939 - RNA, 15 nt, Human
cucaucucuguccca

SEQ ID NO: 3444940 - RNA, 19 nt, Human
cucaucucuuagcuccccu

SEQ ID NO: 3444941 - RNA, 12 nt, Human
cucaucugcugg

SEQ ID NO: 3444942 - RNA, 12 nt, Human
cucaucugggga

SEQ ID NO: 3444943 - RNA, 19 nt, Human
cucaucuggggagcaggca

SEQ ID NO: 3444944 - RNA, 13 nt, Human
cucaucugucccu

SEQ ID NO: 3444945 - RNA, 15 nt, Human
cucaucugucccucc

SEQ ID NO: 3444946 - RNA, 18 nt, Human
cucaucugucccuccggg

SEQ ID NO: 3444947 - RNA, 22 nt, Human
cucaucuugacagagccugccc

SEQ ID NO: 3444948 - RNA, 16 nt, Human
cucaucuugugaaaug

SEQ ID NO: 3444949 - RNA, 14 nt, Human
cucaucuuucccuc

SEQ ID NO: 3444950 - RNA, 16 nt, Human
cucaucuuucccuccu

SEQ ID NO: 3444951 - RNA, 20 nt, Human
cucaucuuucccuccuuggu

SEQ ID NO: 3444952 - RNA, 13 nt, Human
cucaucuuucuug

SEQ ID NO: 3444953 - RNA, 12 nt, Human
cucaugaaccuc

SEQ ID NO: 3444954 - RNA, 13 nt, Human
cucaugaaucugc

SEQ ID NO: 3444955 - RNA, 12 nt, Human
cucaugaaugua

SEQ ID NO: 3444956 - RNA, 22 nt, Human
cucaugaauguaaauuuguacu

SEQ ID NO: 3444957 - RNA, 15 nt, Human
cucaugaggggagag

SEQ ID NO: 3444958 - RNA, 19 nt, Human
cucaugcaaaucaauuacu

SEQ ID NO: 3444959 - RNA, 16 nt, Human
cucaugcaucuccacc

SEQ ID NO: 3444960 - RNA, 18 nt, Human
cucaugcaucuccaccug

SEQ ID NO: 3444961 - RNA, 15 nt, Human
cucaugcauugcuug

SEQ ID NO: 3444962 - RNA, 17 nt, Human
cucaugcccacccccug

SEQ ID NO: 3444963 - RNA, 22 nt, Human
cucaugcccccuuucagauguc

SEQ ID NO: 3444964 - RNA, 23 nt, Human
cucaugcccccuuucagaugucu

SEQ ID NO: 3444965 - RNA, 20 nt, Human
cucaugccucagccuccuga

SEQ ID NO: 3444966 - RNA, 15 nt, Human
cucaugcuaauauaa

SEQ ID NO: 3444967 - RNA, 14 nt, Human
cucaugcugaaagc

SEQ ID NO: 3444968 - RNA, 15 nt, Human
cucaugcugaaagcc

SEQ ID NO: 3444969 - RNA, 12 nt, Human
cucaugcugcca

SEQ ID NO: 3444970 - RNA, 19 nt, Human
cucaugcugccccugccuu

SEQ ID NO: 3444971 - RNA, 17 nt, Human
cucauggccccucugac

SEQ ID NO: 3444972 - RNA, 19 nt, Human
cucauggccccucugaccu

SEQ ID NO: 3444973 - RNA, 20 nt, Human
cucauggccccucugaccug

SEQ ID NO: 3444974 - RNA, 17 nt, Human
cucaugggccccucuga

SEQ ID NO: 3444975 - RNA, 15 nt, Human
cucauggguggcacu

SEQ ID NO: 3444976 - RNA, 19 nt, Human
cucauggguggcacucagu

SEQ ID NO: 3444977 - RNA, 14 nt, Human
cucaugugauuuac

SEQ ID NO: 3444978 - RNA, 15 nt, Human
cucauguggcuggaa

SEQ ID NO: 3444979 - RNA, 9 nt, Human
cucaugugu

SEQ ID NO: 3444980 - RNA, 19 nt, Human
cucaugugugcucuucuuc

SEQ ID NO: 3444981 - RNA, 18 nt, Human
cucauguuuaugaaaaua

SEQ ID NO: 3444982 - RNA, 16 nt, Human
cucauguuuucaacug

SEQ ID NO: 3444983 - RNA, 17 nt, Human
cucauguuuuccauugu

SEQ ID NO: 3444984 - RNA, 13 nt, Human
cucauuaaaaaaa

SEQ ID NO: 3444985 - RNA, 18 nt, Human
cucauuacggcuccucuc

SEQ ID NO: 3444986 - RNA, 13 nt, Human
cucauuagacugg

SEQ ID NO: 3444987 - RNA, 14 nt, Human
cucauuagacugga

SEQ ID NO: 3444988 - RNA, 17 nt, Human
cucauuaggauggcuag

SEQ ID NO: 3444989 - RNA, 18 nt, Human
cucauuaggauggcuagu

SEQ ID NO: 3444990 - RNA, 19 nt, Human
cucauucaaaaguugaaau

SEQ ID NO: 3444991 - RNA, 22 nt, Human
cucauucaggaaaacugacaga

SEQ ID NO: 3444992 - RNA, 15 nt, Human
cucauucauuuuaua

SEQ ID NO: 3444993 - RNA, 18 nt, Human
cucauuccaacagugagu

SEQ ID NO: 3444994 - RNA, 21 nt, Human
cucauuccaccuucccaugcc

SEQ ID NO: 3444995 - RNA, 17 nt, Human
cucauuccauaaauguc

SEQ ID NO: 3444996 - RNA, 18 nt, Human
cucauuccauaaaugucg

SEQ ID NO: 3444997 - RNA, 21 nt, Human
cucauuccuccaccugccgug

SEQ ID NO: 3444998 - RNA, 16 nt, Human
cucauuccugccuguc

SEQ ID NO: 3444999 - RNA, 17 nt, Human
cucauuccugccugucu

SEQ ID NO: 3445000 - RNA, 20 nt, Human
cucauuccugccugucuccu

SEQ ID NO: 3445001 - RNA, 22 nt, Human
cucauucuccuuguguuacuaa

SEQ ID NO: 3445002 - RNA, 17 nt, Human
cucauucugaaggagcc

SEQ ID NO: 3445003 - RNA, 19 nt, Human
cucauucugaaggagcccc

SEQ ID NO: 3445004 - RNA, 13 nt, Human
cucauucuucugu

SEQ ID NO: 3445005 - RNA, 17 nt, Human
cucauugacaagaacug

SEQ ID NO: 3445006 - RNA, 16 nt, Human
cucauugaccugaggc

SEQ ID NO: 3445007 - RNA, 20 nt, Human
cucauugcugagccucugcu

SEQ ID NO: 3445008 - RNA, 19 nt, Human
cucauugcuuacaagccua

SEQ ID NO: 3445009 - RNA, 20 nt, Human
cucauugcuuggaauucagc

SEQ ID NO: 3445010 - RNA, 19 nt, Human
cucauuggaaauuuagcau

SEQ ID NO: 3445011 - RNA, 17 nt, Human
cucauuggacccuucca

SEQ ID NO: 3445012 - RNA, 12 nt, Human
cucauugggguu

SEQ ID NO: 3445013 - RNA, 19 nt, Human
cucauugucuguguagagu

SEQ ID NO: 3445014 - RNA, 14 nt, Human
cucauuuaaaguau

SEQ ID NO: 3445015 - RNA, 19 nt, Human
cucauuuaaaguauuuuau

SEQ ID NO: 3445016 - RNA, 20 nt, Human
cucauuuaaaguauuuuauu

SEQ ID NO: 3445017 - RNA, 14 nt, Human
cucauuuaaauauc

SEQ ID NO: 3445018 - RNA, 16 nt, Human
cucauuuaagggaaaa

SEQ ID NO: 3445019 - RNA, 17 nt, Human
cucauuuaagggaaaaa

SEQ ID NO: 3445020 - RNA, 18 nt, Human
cucauuuaagggaaaaau

SEQ ID NO: 3445021 - RNA, 19 nt, Human
cucauuuaauccucccuuc

SEQ ID NO: 3445022 - RNA, 14 nt, Human
cucauuuagccugu

SEQ ID NO: 3445023 - RNA, 18 nt, Human
cucauuuagccuguccug

SEQ ID NO: 3445024 - RNA, 19 nt, Human
cucauuuagccuguccugu

SEQ ID NO: 3445025 - RNA, 23 nt, Human
cucauuucaccccucccuuucuc

SEQ ID NO: 3445026 - RNA, 13 nt, Human
cucauuucaggau

SEQ ID NO: 3445027 - RNA, 15 nt, Human
cucauuucaucucau

SEQ ID NO: 3445028 - RNA, 12 nt, Human
cucauuuccaag

SEQ ID NO: 3445029 - RNA, 14 nt, Human
cucauuuccaagca

SEQ ID NO: 3445030 - RNA, 16 nt, Human
cucauuucuaaaagaa

SEQ ID NO: 3445031 - RNA, 18 nt, Human
cucauuugucacacacuu

SEQ ID NO: 3445032 - RNA, 17 nt, Human
cucauuuguuaaaauua

SEQ ID NO: 3445033 - RNA, 18 nt, Human
cucauuuuaaugauuguu

SEQ ID NO: 3445034 - RNA, 20 nt, Human
cucauuuuuuuaauuuauua

SEQ ID NO: 3445035 - RNA, 19 nt, Human
cuccaaaaaucugccuggg

SEQ ID NO: 3445036 - RNA, 17 nt, Human
cuccaaaacccaugugg

SEQ ID NO: 3445037 - RNA, 20 nt, Human
cuccaaaacccaugugggaa

SEQ ID NO: 3445038 - RNA, 15 nt, Human
cuccaaaauaaaacu

SEQ ID NO: 3445039 - RNA, 18 nt, Human
cuccaaaauaaaacuuuu

SEQ ID NO: 3445040 - RNA, 16 nt, Human
cuccaaaccuucacac

SEQ ID NO: 3445041 - RNA, 23 nt, Human
cuccaaagaggugacugggcccu

SEQ ID NO: 3445042 - RNA, 22 nt, Human
cuccaaaguauuguacaaauaa

SEQ ID NO: 3445043 - RNA, 12 nt, Human
cuccaaagucau

SEQ ID NO: 3445044 - RNA, 19 nt, Human
cuccaaagucauaauugca

SEQ ID NO: 3445045 - RNA, 20 nt, Human
cuccaaagucauaauugcau

SEQ ID NO: 3445046 - RNA, 21 nt, Human
cuccaaagucauaauugcauu

SEQ ID NO: 3445047 - RNA, 16 nt, Human
cuccaaaguuauccag

SEQ ID NO: 3445048 - RNA, 21 nt, Human
cuccaaauggagaagcugcag

SEQ ID NO: 3445049 - RNA, 12 nt, Human
cuccaacaauaa

SEQ ID NO: 3445050 - RNA, 15 nt, Human
cuccaacaccaagca

SEQ ID NO: 3445051 - RNA, 22 nt, Human
cuccaacaccaagcacagcagc

SEQ ID NO: 3445052 - RNA, 14 nt, Human
cuccaaccccccag

SEQ ID NO: 3445053 - RNA, 17 nt, Human
cuccaaccccccagcac

SEQ ID NO: 3445054 - RNA, 19 nt, Human
cuccaaccccccagcacug

SEQ ID NO: 3445055 - RNA, 19 nt, Human
cuccaaccgggaugggagc

SEQ ID NO: 3445056 - RNA, 20 nt, Human
cuccaaccuaaccugugucu

SEQ ID NO: 3445057 - RNA, 18 nt, Human
cuccaacuccaacaucca

SEQ ID NO: 3445058 - RNA, 18 nt, Human
cuccaacuggauuauaaa

SEQ ID NO: 3445059 - RNA, 19 nt, Human
gaccuguugguuccaagcc

SEQ ID NO: 3445060 - RNA, 14 nt, Human
gaccuuaaaugcaa

SEQ ID NO: 3445061 - RNA, 18 nt, Human
gaccuuacgaucaggcac

SEQ ID NO: 3445062 - RNA, 22 nt, Human
gaccuuaguguuucugugcaug

SEQ ID NO: 3445063 - RNA, 23 nt, Human
gaccuuaguguuucugugcaugg

SEQ ID NO: 3445064 - RNA, 21 nt, Human
gaccuuaucugugcgugaaac

SEQ ID NO: 3445065 - RNA, 19 nt, Human
gaccuucacucuaagaugu

SEQ ID NO: 3445066 - RNA, 16 nt, Human
gaccuucauuucaugu

SEQ ID NO: 3445067 - RNA, 16 nt, Human
gaccuuccucgcagag

SEQ ID NO: 3445068 - RNA, 19 nt, Human
gaccuuccucgcagagagg

SEQ ID NO: 3445069 - RNA, 20 nt, Human
gaccuuccucgcagagaggc

SEQ ID NO: 3445070 - RNA, 22 nt, Human
gaccuuccucgcagagaggcca

SEQ ID NO: 3445071 - RNA, 14 nt, Human
gaccuuccugccac

SEQ ID NO: 3445072 - RNA, 16 nt, Human
gaccuuccugccacca

SEQ ID NO: 3445073 - RNA, 23 nt, Human
gaccuuccugccaccagucacug

SEQ ID NO: 3445074 - RNA, 19 nt, Human
gaccuucuagaauuauaag

SEQ ID NO: 3445075 - RNA, 15 nt, Human
gaccuucuaggaagc

SEQ ID NO: 3445076 - RNA, 15 nt, Human
gaccuucuccuucac

SEQ ID NO: 3445077 - RNA, 23 nt, Human
gaccuugaacuggguacuugugg

SEQ ID NO: 3445078 - RNA, 23 nt, Human
gaccuugcaacuucaugucaacu

SEQ ID NO: 3445079 - RNA, 16 nt, Human
gaccuuggagagacac

SEQ ID NO: 3445080 - RNA, 18 nt, Human
gaccuuggagagacacag

SEQ ID NO: 3445081 - RNA, 21 nt, Human
gaccuugggccaaauccgcuc

SEQ ID NO: 3445082 - RNA, 18 nt, Human
gaccuuguaauguaacug

SEQ ID NO: 3445083 - RNA, 20 nt, Human
gaccuuguuguuguuaaaua

SEQ ID NO: 3445084 - RNA, 18 nt, Human
cuccaagggcuucugcac

SEQ ID NO: 3445085 - RNA, 23 nt, Human
cuccaagggcuucugcacccucc

SEQ ID NO: 3445086 - RNA, 18 nt, Human
cuccaaggugauguugua

SEQ ID NO: 3445087 - RNA, 21 nt, Human
cuccaagucucaguggcuuca

SEQ ID NO: 3445088 - RNA, 18 nt, Human
cuccaagugccagaggug

SEQ ID NO: 3445089 - RNA, 19 nt, Human
cuccaauaucagugcucga

SEQ ID NO: 3445090 - RNA, 22 nt, Human
cuccaaucccaccaacccucag

SEQ ID NO: 3445091 - RNA, 16 nt, Human
cuccaauccugccccc

SEQ ID NO: 3445092 - RNA, 21 nt, Human
cuccaaugcuguuaucccugc

SEQ ID NO: 3445093 - RNA, 17 nt, Human
cuccaaugucugcugag

SEQ ID NO: 3445094 - RNA, 17 nt, Human
cuccaauuaaggauuuu

SEQ ID NO: 3445095 - RNA, 15 nt, Human
cuccaauuuuuuaag

SEQ ID NO: 3445096 - RNA, 14 nt, Human
cuccacacacacaa

SEQ ID NO: 3445097 - RNA, 20 nt, Human
cuccacacacauaauggcag

SEQ ID NO: 3445098 - RNA, 17 nt, Human
cuccacacccucuccca

SEQ ID NO: 3445099 - RNA, 16 nt, Human
cuccacaccugcggcc

SEQ ID NO: 3445100 - RNA, 16 nt, Human
cuccacagccauccca

SEQ ID NO: 3445101 - RNA, 14 nt, Human
cuccacagcgaggg

SEQ ID NO: 3445102 - RNA, 15 nt, Human
cuccacagcuaccuc

SEQ ID NO: 3445103 - RNA, 15 nt, Human
cuccacagcugccuc

SEQ ID NO: 3445104 - RNA, 13 nt, Human
cuccacaguguug

SEQ ID NO: 3445105 - RNA, 23 nt, Human
cuccacaguucaguggcagggcu

SEQ ID NO: 3445106 - RNA, 22 nt, Human
cuccacaguucgaccugcggcu

SEQ ID NO: 3445107 - RNA, 20 nt, Human
cuccacauauuucagugagg

SEQ ID NO: 3445108 - RNA, 14 nt, Human
cuccacauccuuuc

SEQ ID NO: 3445109 - RNA, 13 nt, Human
cuccacaucugcc

SEQ ID NO: 3445110 - RNA, 16 nt, Human
cuccacaucugccuua

SEQ ID NO: 3445111 - RNA, 17 nt, Human
cuccacaucugccuuaa

SEQ ID NO: 3445112 - RNA, 12 nt, Human
cuccaccaaccc

SEQ ID NO: 3445113 - RNA, 12 nt, Human
cuccaccaccac

SEQ ID NO: 3445114 - RNA, 15 nt, Human
cuccaccaccacugg

SEQ ID NO: 3445115 - RNA, 17 nt, Human
cuccaccaccacuggcc

SEQ ID NO: 3445116 - RNA, 19 nt, Human
cuccaccaccacuggccac

SEQ ID NO: 3445117 - RNA, 21 nt, Human
cuccaccaccacuggccacca

SEQ ID NO: 3445118 - RNA, 12 nt, Human
cuccaccaccca

SEQ ID NO: 3445119 - RNA, 16 nt, Human
cuccaccacccaaaag

SEQ ID NO: 3445120 - RNA, 22 nt, Human
cuccaccaccgcccgucugugu

SEQ ID NO: 3445121 - RNA, 23 nt, Human
cuccacccauccuaucagccugu

SEQ ID NO: 3445122 - RNA, 12 nt, Human
cuccaccccacu

SEQ ID NO: 3445123 - RNA, 15 nt, Human
cuccaccccacucac

SEQ ID NO: 3445124 - RNA, 20 nt, Human
cuccaccccacucacagaga

SEQ ID NO: 3445125 - RNA, 16 nt, Human
cuccaccccagccccc

SEQ ID NO: 3445126 - RNA, 14 nt, Human
cuccaccccaggac

SEQ ID NO: 3445127 - RNA, 14 nt, Human
cuccacccccagcu

SEQ ID NO: 3445128 - RNA, 19 nt, Human
cuccacccccagcugcuug

SEQ ID NO: 3445129 - RNA, 21 nt, Human
cuccaccccccagaaccuguc

SEQ ID NO: 3445130 - RNA, 14 nt, Human
cuccacccuccacc

SEQ ID NO: 3445131 - RNA, 16 nt, Human
cuccacccucugagcu

SEQ ID NO: 3445132 - RNA, 17 nt, Human
cuccacccucugagcuu

SEQ ID NO: 3445133 - RNA, 12 nt, Human
cuccacccugcu

SEQ ID NO: 3445134 - RNA, 15 nt, Human
cuccacccugcucuc

SEQ ID NO: 3445135 - RNA, 13 nt, Human
cuccacccugucc

SEQ ID NO: 3445136 - RNA, 17 nt, Human
cuccaccgcagaaggaa

SEQ ID NO: 3445137 - RNA, 18 nt, Human
cuccaccgcagaaggaag

SEQ ID NO: 3445138 - RNA, 15 nt, Human
cuccaccgcugccua

SEQ ID NO: 3445139 - RNA, 21 nt, Human
cuccaccuaguggcuguccag

SEQ ID NO: 3445140 - RNA, 23 nt, Human
cuccaccuaguggcuguccagug

SEQ ID NO: 3445141 - RNA, 14 nt, Human
cuccaccucagccu

SEQ ID NO: 3445142 - RNA, 15 nt, Human
cuccaccucagccuu

SEQ ID NO: 3445143 - RNA, 14 nt, Human
cuccaccucccugc

SEQ ID NO: 3445144 - RNA, 12 nt, Human
cuccaccuucca

SEQ ID NO: 3445145 - RNA, 14 nt, Human
cuccaccuucccac

SEQ ID NO: 3445146 - RNA, 20 nt, Human
cuccacgauccugccacccu

SEQ ID NO: 3445147 - RNA, 15 nt, Human
cuccacgcgcuucga

SEQ ID NO: 3445148 - RNA, 17 nt, Human
cuccacguucugcucau

SEQ ID NO: 3445149 - RNA, 14 nt, Human
cuccacucagcugu

SEQ ID NO: 3445150 - RNA, 19 nt, Human
cuccacuccuuccugccac

SEQ ID NO: 3445151 - RNA, 22 nt, Human
cuccacuccuuccugccaccug

SEQ ID NO: 3445152 - RNA, 13 nt, Human
cuccacucucccc

SEQ ID NO: 3445153 - RNA, 13 nt, Human
cuccacucugcuu

SEQ ID NO: 3445154 - RNA, 15 nt, Human
cuccacucugcuucu

SEQ ID NO: 3445155 - RNA, 17 nt, Human
cuccacucugcuucucu

SEQ ID NO: 3445156 - RNA, 15 nt, Human
cuccacugcccucug

SEQ ID NO: 3445157 - RNA, 16 nt, Human
cuccacugccucugga

SEQ ID NO: 3445158 - RNA, 13 nt, Human
cuccacugucaca

SEQ ID NO: 3445159 - RNA, 13 nt, Human
cuccacugugcac

SEQ ID NO: 3445160 - RNA, 16 nt, Human
cuccacugugcacacc

SEQ ID NO: 3445161 - RNA, 22 nt, Human
cuccacugugccuuugcaaauc

SEQ ID NO: 3445162 - RNA, 21 nt, Human
cuccacuucuuguuccccacu

SEQ ID NO: 3445163 - RNA, 17 nt, Human
cuccacuuggucuguga

SEQ ID NO: 3445164 - RNA, 22 nt, Human
cuccacuuggucugugagaugc

SEQ ID NO: 3445165 - RNA, 23 nt, Human
cuccacuuggucugugagaugcu

SEQ ID NO: 3445166 - RNA, 14 nt, Human
cuccacuuucagcu

SEQ ID NO: 3445167 - RNA, 15 nt, Human
cuccacuuucagcug

SEQ ID NO: 3445168 - RNA, 18 nt, Human
cuccacuuucagcugucu

SEQ ID NO: 3445169 - RNA, 19 nt, Human
cuccacuuucuagccagag

SEQ ID NO: 3445170 - RNA, 22 nt, Human
cuccacuuucuagccagaggag

SEQ ID NO: 3445171 - RNA, 22 nt, Human
cuccagaaaugucuaaaugcug

SEQ ID NO: 3445172 - RNA, 14 nt, Human
cuccagaacccauu

SEQ ID NO: 3445173 - RNA, 15 nt, Human
cuccagaagauagcu

SEQ ID NO: 3445174 - RNA, 20 nt, Human
cuccagaagcacugggauca

SEQ ID NO: 3445175 - RNA, 20 nt, Human
cuccagaagccucuggcuag

SEQ ID NO: 3445176 - RNA, 21 nt, Human
cuccagaagccucuggcuaga

SEQ ID NO: 3445177 - RNA, 18 nt, Human
cuccagaauuucccaaag

SEQ ID NO: 3445178 - RNA, 21 nt, Human
cuccagaauuucccaaagcag

SEQ ID NO: 3445179 - RNA, 22 nt, Human
cuccagaauuucccaaagcagu

SEQ ID NO: 3445180 - RNA, 18 nt, Human
cuccagaauuuggaaauc

SEQ ID NO: 3445181 - RNA, 22 nt, Human
cuccagaauuuggaaauccuag

SEQ ID NO: 3445182 - RNA, 16 nt, Human
cuccagacacaugucc

SEQ ID NO: 3445183 - RNA, 17 nt, Human
cuccagacccaccacac

SEQ ID NO: 3445184 - RNA, 21 nt, Human
cuccagacccccaccccuucc

SEQ ID NO: 3445185 - RNA, 22 nt, Human
cuccagacccccaccccuuccc

SEQ ID NO: 3445186 - RNA, 14 nt, Human
cuccagacccccag

SEQ ID NO: 3445187 - RNA, 21 nt, Human
cuccagaccccuggcuuuuca

SEQ ID NO: 3445188 - RNA, 11 nt, Human
cuccagaccug

SEQ ID NO: 3445189 - RNA, 19 nt, Human
cuccagacguaggggaggg

SEQ ID NO: 3445190 - RNA, 14 nt, Human
cuccagacucucug

SEQ ID NO: 3445191 - RNA, 16 nt, Human
cuccagagccccacag

SEQ ID NO: 3445192 - RNA, 21 nt, Human
cuccagauagcucauuucauu

SEQ ID NO: 3445193 - RNA, 17 nt, Human
cuccagauguuuccaga

SEQ ID NO: 3445194 - RNA, 19 nt, Human
cuccagauuagagccugua

SEQ ID NO: 3445195 - RNA, 22 nt, Human
cuccagauuagagccuguaaac

SEQ ID NO: 3445196 - RNA, 21 nt, Human
cuccagcaacacagccugggc

SEQ ID NO: 3445197 - RNA, 16 nt, Human
cuccagcacaaacaca

SEQ ID NO: 3445198 - RNA, 19 nt, Human
cuccagcacaaacacaagg

SEQ ID NO: 3445199 - RNA, 21 nt, Human
cuccagcacaaacacaagguc

SEQ ID NO: 3445200 - RNA, 13 nt, Human
cuccagccaaccc

SEQ ID NO: 3445201 - RNA, 13 nt, Human
cuccagccagcaa

SEQ ID NO: 3445202 - RNA, 24 nt, Human
cuccagccagcaaugauguccaga

SEQ ID NO: 3445203 - RNA, 20 nt, Human
gagacaggaaaauccucugg

SEQ ID NO: 3445204 - RNA, 21 nt, Human
gagacaggaaaauccucuggc

SEQ ID NO: 3445205 - RNA, 15 nt, Human
gagacaggagggcaa

SEQ ID NO: 3445206 - RNA, 12 nt, Human
gagacaggcaga

SEQ ID NO: 3445207 - RNA, 13 nt, Human
gagacaggguuug

SEQ ID NO: 3445208 - RNA, 22 nt, Human
gagacaggguuuugccauguug

SEQ ID NO: 3445209 - RNA, 16 nt, Human
gagacagugaauuugg

SEQ ID NO: 3445210 - RNA, 17 nt, Human
gagacagugaucuccau

SEQ ID NO: 3445211 - RNA, 14 nt, Human
gagacagugggaaa

SEQ ID NO: 3445212 - RNA, 15 nt, Human
gagacagugggaaau

SEQ ID NO: 3445213 - RNA, 22 nt, Human
gagacaguugggugagaacaac

SEQ ID NO: 3445214 - RNA, 18 nt, Human
gagacauacuugaagggc

SEQ ID NO: 3445215 - RNA, 20 nt, Human
gagacauacuugaagggcca

SEQ ID NO: 3445216 - RNA, 16 nt, Human
gagacauuaacucauu

SEQ ID NO: 3445217 - RNA, 18 nt, Human
gagacauuccugggcaca

SEQ ID NO: 3445218 - RNA, 22 nt, Human
gagaccaagacucugaaaucuc

SEQ ID NO: 3445219 - RNA, 18 nt, Human
gagaccaaggcgggagca

SEQ ID NO: 3445220 - RNA, 23 nt, Human
gagaccagccugggcaacaaagu

SEQ ID NO: 3445221 - RNA, 19 nt, Human
gagaccagccugggcagca

SEQ ID NO: 3445222 - RNA, 15 nt, Human
gagaccaggcccugg

SEQ ID NO: 3445223 - RNA, 23 nt, Human
gagaccaguugaauaaaagugca

SEQ ID NO: 3445224 - RNA, 12 nt, Human
gagaccaucccu

SEQ ID NO: 3445225 - RNA, 14 nt, Human
gagaccaucccuga

SEQ ID NO: 3445226 - RNA, 12 nt, Human
gagaccauccug

SEQ ID NO: 3445227 - RNA, 17 nt, Human
gagaccaugcagagcgc

SEQ ID NO: 3445228 - RNA, 15 nt, Human
gagaccccaggcugu

SEQ ID NO: 3445229 - RNA, 13 nt, Human
gagacccccacac

SEQ ID NO: 3445230 - RNA, 23 nt, Human
gagacccccacaccucaguuccc

SEQ ID NO: 3445231 - RNA, 14 nt, Human
gagaccccuggccu

SEQ ID NO: 3445232 - RNA, 15 nt, Human
gagaccccuggccuc

SEQ ID NO: 3445233 - RNA, 14 nt, Human
gagaccccugucuc

SEQ ID NO: 3445234 - RNA, 15 nt, Human
gagaccccugucucc

SEQ ID NO: 3445235 - RNA, 19 nt, Human
gagacccucguggccuucc

SEQ ID NO: 3445236 - RNA, 17 nt, Human
gagaccggccugccagg

SEQ ID NO: 3445237 - RNA, 13 nt, Human
gagaccguccuca

SEQ ID NO: 3445238 - RNA, 14 nt, Human
gagaccguccucac

SEQ ID NO: 3445239 - RNA, 17 nt, Human
gagaccuacaggcugac

SEQ ID NO: 3445240 - RNA, 16 nt, Human
gagaccuaccucaggu

SEQ ID NO: 3445241 - RNA, 15 nt, Human
gagaccucagccaug

SEQ ID NO: 3445242 - RNA, 11 nt, Human
gagaccucauc

SEQ ID NO: 3445243 - RNA, 12 nt, Human
gagaccucauca

SEQ ID NO: 3445244 - RNA, 18 nt, Human
gagaccucaucaggauga

SEQ ID NO: 3445245 - RNA, 13 nt, Human
gagaccuccugcc

SEQ ID NO: 3445246 - RNA, 18 nt, Human
gagaccugacaagcacug

SEQ ID NO: 3445247 - RNA, 12 nt, Human
gagaccugcccc

SEQ ID NO: 3445248 - RNA, 19 nt, Human
gagaccuggcacuggaugc

SEQ ID NO: 3445249 - RNA, 23 nt, Human
gagaccuguuuuaaaaaggaacu

SEQ ID NO: 3445250 - RNA, 19 nt, Human
gagacggagucccaccuug

SEQ ID NO: 3445251 - RNA, 16 nt, Human
gagacgggcccuggug

SEQ ID NO: 3445252 - RNA, 15 nt, Human
gagacggucgagcag

SEQ ID NO: 3445253 - RNA, 21 nt, Human
gagacguggaaccucugucuc

SEQ ID NO: 3445254 - RNA, 15 nt, Human
gagacguguacauag

SEQ ID NO: 3445255 - RNA, 16 nt, Human
gagacguguacauagu

SEQ ID NO: 3445256 - RNA, 23 nt, Human
gagacuaaccccaccacacccuc

SEQ ID NO: 3445257 - RNA, 18 nt, Human
gagacuaugcguuuuuau

SEQ ID NO: 3445258 - RNA, 21 nt, Human
gagacuauggagccuggcaca

SEQ ID NO: 3445259 - RNA, 19 nt, Human
gagacuauguaaaaauaac

SEQ ID NO: 3445260 - RNA, 13 nt, Human
gagacuauuuaaa

SEQ ID NO: 3445261 - RNA, 15 nt, Human
gagacucacaggaag

SEQ ID NO: 3445262 - RNA, 16 nt, Human
gagacucaccucugcc

SEQ ID NO: 3445263 - RNA, 18 nt, Human
gagacucaccucugccuc

SEQ ID NO: 3445264 - RNA, 23 nt, Human
gagacucaccucugccucaaugu

SEQ ID NO: 3445265 - RNA, 14 nt, Human
gagacucagccugc

SEQ ID NO: 3445266 - RNA, 13 nt, Human
gagacucagugca

SEQ ID NO: 3445267 - RNA, 17 nt, Human
gagacucccaugaagcc

SEQ ID NO: 3445268 - RNA, 20 nt, Human
gagacucccaugaagccuuu

SEQ ID NO: 3445269 - RNA, 13 nt, Human
gagacuccugcag

SEQ ID NO: 3445270 - RNA, 16 nt, Human
gagacuccugcaggca

SEQ ID NO: 3445271 - RNA, 19 nt, Human
gagacuccugcaggcagcc

SEQ ID NO: 3445272 - RNA, 21 nt, Human
gagacuccugcaggcagccag

SEQ ID NO: 3445273 - RNA, 14 nt, Human
gagacucgagaacu

SEQ ID NO: 3445274 - RNA, 17 nt, Human
gagacucgagaacuuuc

SEQ ID NO: 3445275 - RNA, 20 nt, Human
gagacucgcgacaaugcaaa

SEQ ID NO: 3445276 - RNA, 21 nt, Human
gagacucgcgacaaugcaaac

SEQ ID NO: 3445277 - RNA, 19 nt, Human
gagacucucuuaggagcag

SEQ ID NO: 3445278 - RNA, 12 nt, Human
gagacucuggcc

SEQ ID NO: 3445279 - RNA, 14 nt, Human
gagacucugucuca

SEQ ID NO: 3445280 - RNA, 19 nt, Human
gagacugcgggaugguccu

SEQ ID NO: 3445281 - RNA, 22 nt, Human
gagacugcgggaugguccuggg

SEQ ID NO: 3445282 - RNA, 17 nt, Human
gagacugcuccugagcc

SEQ ID NO: 3445283 - RNA, 20 nt, Human
gagacugcuucccauccuac

SEQ ID NO: 3445284 - RNA, 14 nt, Human
gagacugggcugag

SEQ ID NO: 3445285 - RNA, 15 nt, Human
gagacugggcugagg

SEQ ID NO: 3445286 - RNA, 17 nt, Human
gagacugggcugaggga

SEQ ID NO: 3445287 - RNA, 20 nt, Human
gagacugggcugagggagcc

SEQ ID NO: 3445288 - RNA, 16 nt, Human
gagacuggggggcuug

SEQ ID NO: 3445289 - RNA, 13 nt, Human
gagacuguagauu

SEQ ID NO: 3445290 - RNA, 23 nt, Human
gagacuguagauugcuucuguag

SEQ ID NO: 3445291 - RNA, 22 nt, Human
gagacugucccugaaaccuagu

SEQ ID NO: 3445292 - RNA, 23 nt, Human
gagacugucucaagagggcacug

SEQ ID NO: 3445293 - RNA, 14 nt, Human
cucccugccccucc

SEQ ID NO: 3445294 - RNA, 17 nt, Human
cucccugccccucccuu

SEQ ID NO: 3445295 - RNA, 20 nt, Human
cucccugccccucccuucaa

SEQ ID NO: 3445296 - RNA, 16 nt, Human
cucccugccgccucaa

SEQ ID NO: 3445297 - RNA, 14 nt, Human
cucccugccuccug

SEQ ID NO: 3445298 - RNA, 16 nt, Human
cucccugcugcuccua

SEQ ID NO: 3445299 - RNA, 17 nt, Human
cucccugcugcuccuag

SEQ ID NO: 3445300 - RNA, 11 nt, Human
cucccugcugu

SEQ ID NO: 3445301 - RNA, 14 nt, Human
cucccugcuguccc

SEQ ID NO: 3445302 - RNA, 12 nt, Human
cucccugcuuug

SEQ ID NO: 3445303 - RNA, 12 nt, Human
cucccuggaaug

SEQ ID NO: 3445304 - RNA, 23 nt, Human
cucccuggaaugaguugaggcca

SEQ ID NO: 3445305 - RNA, 23 nt, Human
cucccuggaguguggcugaggag

SEQ ID NO: 3445306 - RNA, 13 nt, Human
cucccuggauuuu

SEQ ID NO: 3445307 - RNA, 12 nt, Human
cucccuggcccu

SEQ ID NO: 3445308 - RNA, 15 nt, Human
cucccuggcccucaa

SEQ ID NO: 3445309 - RNA, 11 nt, Human
cucccuggcuc

SEQ ID NO: 3445310 - RNA, 14 nt, Human
cucccuggcuccca

SEQ ID NO: 3445311 - RNA, 15 nt, Human
cucccuggcucccuc

SEQ ID NO: 3445312 - RNA, 21 nt, Human
cucccuggcugcccuggcccu

SEQ ID NO: 3445313 - RNA, 22 nt, Human
cucccuggcugcccuggcccug

SEQ ID NO: 3445314 - RNA, 10 nt, Human
cucccugggg

SEQ ID NO: 3445315 - RNA, 14 nt, Human
cucccuggguucag

SEQ ID NO: 3445316 - RNA, 19 nt, Human
cucccuggugagagggccg

SEQ ID NO: 3445317 - RNA, 19 nt, Human
cucccuguaaccucuucag

SEQ ID NO: 3445318 - RNA, 15 nt, Human
cucccuguacagugu

SEQ ID NO: 3445319 - RNA, 11 nt, Human
cucccuguccu

SEQ ID NO: 3445320 - RNA, 13 nt, Human
cucccuguccucc

SEQ ID NO: 3445321 - RNA, 19 nt, Human
cucccugugcccccagggu

SEQ ID NO: 3445322 - RNA, 19 nt, Human
cucccuguuccccagagaa

SEQ ID NO: 3445323 - RNA, 21 nt, Human
cucccuguuugaagccugccc

SEQ ID NO: 3445324 - RNA, 23 nt, Human
cucccuguuugaagccugcccuu

SEQ ID NO: 3445325 - RNA, 22 nt, Human
cucccuucaaccauuccccaug

SEQ ID NO: 3445326 - RNA, 19 nt, Human
cucccuucaugcauggaaa

SEQ ID NO: 3445327 - RNA, 16 nt, Human
cucccuucccaccucu

SEQ ID NO: 3445328 - RNA, 17 nt, Human
cucccuucccaccucuc

SEQ ID NO: 3445329 - RNA, 14 nt, Human
cucccuuccgaccc

SEQ ID NO: 3445330 - RNA, 17 nt, Human
cucccuuccgacccucu

SEQ ID NO: 3445331 - RNA, 22 nt, Human
cucccuuccgacccucugggaa

SEQ ID NO: 3445332 - RNA, 14 nt, Human
cucccuuccucuuu

SEQ ID NO: 3445333 - RNA, 13 nt, Human
cucccuucggugg

SEQ ID NO: 3445334 - RNA, 22 nt, Human
cucccuucgguggaagagcuca

SEQ ID NO: 3445335 - RNA, 16 nt, Human
cucccuucuacagccu

SEQ ID NO: 3445336 - RNA, 18 nt, Human
cucccuucuaccugccac

SEQ ID NO: 3445337 - RNA, 21 nt, Human
cucccuucuaccugccacuca

SEQ ID NO: 3445338 - RNA, 14 nt, Human
cucccuucucccau

SEQ ID NO: 3445339 - RNA, 13 nt, Human
cucccuucucccu

SEQ ID NO: 3445340 - RNA, 15 nt, Human
cucccuucucccugg

SEQ ID NO: 3445341 - RNA, 15 nt, Human
cucccuucugcuacu

SEQ ID NO: 3445342 - RNA, 14 nt, Human
cucccuucuguuga

SEQ ID NO: 3445343 - RNA, 15 nt, Human
cucccuugaccugcu

SEQ ID NO: 3445344 - RNA, 23 nt, Human
cucccuugacuuugcuccucaca

SEQ ID NO: 3445345 - RNA, 14 nt, Human
cucccuugggcucc

SEQ ID NO: 3445346 - RNA, 17 nt, Human
cucccuugggcucugau

SEQ ID NO: 3445347 - RNA, 18 nt, Human
cucccuugggcucugaug

SEQ ID NO: 3445348 - RNA, 20 nt, Human
cucccuugguggcaagagcc

SEQ ID NO: 3445349 - RNA, 16 nt, Human
gagaugaauuaaauuu

SEQ ID NO: 3445350 - RNA, 17 nt, Human
gagaugagaggggagag

SEQ ID NO: 3445351 - RNA, 13 nt, Human
gagaugaggccag

SEQ ID NO: 3445352 - RNA, 14 nt, Human
gagaugaggccaga

SEQ ID NO: 3445353 - RNA, 21 nt, Human
gagaugagggaugggccuggc

SEQ ID NO: 3445354 - RNA, 20 nt, Human
gagaugaugaaaauauuuaa

SEQ ID NO: 3445355 - RNA, 18 nt, Human
gagaugauucagaagggg

SEQ ID NO: 3445356 - RNA, 14 nt, Human
gagaugcagaggua

SEQ ID NO: 3445357 - RNA, 13 nt, Human
gagaugcagcugg

SEQ ID NO: 3445358 - RNA, 16 nt, Human
gagaugcagugccagg

SEQ ID NO: 3445359 - RNA, 21 nt, Human
gagaugcguuguuacaggaag

SEQ ID NO: 3445360 - RNA, 16 nt, Human
gagaugcugagggugu

SEQ ID NO: 3445361 - RNA, 12 nt, Human
gagaugcuggcu

SEQ ID NO: 3445362 - RNA, 17 nt, Human
gagaugcuguaacuuaa

SEQ ID NO: 3445363 - RNA, 17 nt, Human
gagaugcugugccccug

SEQ ID NO: 3445364 - RNA, 22 nt, Human
gagauggacaguucacacccug

SEQ ID NO: 3445365 - RNA, 14 nt, Human
gagauggaggagga

SEQ ID NO: 3445366 - RNA, 16 nt, Human
gagauggaggaggagg

SEQ ID NO: 3445367 - RNA, 18 nt, Human
gagauggagucuugcucu

SEQ ID NO: 3445368 - RNA, 15 nt, Human
gagauggaucacaua

SEQ ID NO: 3445369 - RNA, 17 nt, Human
gagaugggacugggagg

SEQ ID NO: 3445370 - RNA, 18 nt, Human
gagauggggagaaaccua

SEQ ID NO: 3445371 - RNA, 16 nt, Human
gagauguaaaagguau

SEQ ID NO: 3445372 - RNA, 15 nt, Human
gagauguaagagcuu

SEQ ID NO: 3445373 - RNA, 15 nt, Human
gagauguagcaaaac

SEQ ID NO: 3445374 - RNA, 16 nt, Human
gagauguaugaaggcu

SEQ ID NO: 3445375 - RNA, 20 nt, Human
gagauguauguuuggcucug

SEQ ID NO: 3445376 - RNA, 15 nt, Human
gagaugucuuggaac

SEQ ID NO: 3445377 - RNA, 20 nt, Human
gagauguguaauuuuucugu

SEQ ID NO: 3445378 - RNA, 18 nt, Human
gagauguguguugauacu

SEQ ID NO: 3445379 - RNA, 15 nt, Human
gagauuaccuccuga

SEQ ID NO: 3445380 - RNA, 16 nt, Human
gagauuagagggaggu

SEQ ID NO: 3445381 - RNA, 23 nt, Human
gagauuauuuacaagaagaacuc

SEQ ID NO: 3445382 - RNA, 12 nt, Human
gagauucauuuu

SEQ ID NO: 3445383 - RNA, 16 nt, Human
gagauugaacuccaag

SEQ ID NO: 3445384 - RNA, 14 nt, Human
gagauugaauuuca

SEQ ID NO: 3445385 - RNA, 17 nt, Human
gagauugagaaggagag

SEQ ID NO: 3445386 - RNA, 18 nt, Human
gagauugcaccacugcac

SEQ ID NO: 3445387 - RNA, 13 nt, Human
gagauugcuaauu

SEQ ID NO: 3445388 - RNA, 14 nt, Human
gagauuggaaggaa

SEQ ID NO: 3445389 - RNA, 16 nt, Human
gagauuggaucaagua

SEQ ID NO: 3445390 - RNA, 21 nt, Human
gagauugugccacuucacucc

SEQ ID NO: 3445391 - RNA, 22 nt, Human
gagauuuaccagggauguagau

SEQ ID NO: 3445392 - RNA, 13 nt, Human
gagauuucaucug

SEQ ID NO: 3445393 - RNA, 22 nt, Human
gagauuucaucugcucuccuuc

SEQ ID NO: 3445394 - RNA, 12 nt, Human
gagauuugucua

SEQ ID NO: 3445395 - RNA, 19 nt, Human
gagauuuuuaaaaaauauu

SEQ ID NO: 3445396 - RNA, 22 nt, Human
gagcaaacugcaugcccagaga

SEQ ID NO: 3445397 - RNA, 23 nt, Human
gagcaaacugcaugcccagagac

SEQ ID NO: 3445398 - RNA, 17 nt, Human
gagcaaaguagaucaug

SEQ ID NO: 3445399 - RNA, 14 nt, Human
gagcaaagucuaaa

SEQ ID NO: 3445400 - RNA, 16 nt, Human
gagcaaagucuaaagu

SEQ ID NO: 3445401 - RNA, 19 nt, Human
gagcaaagucuaaaguuua

SEQ ID NO: 3445402 - RNA, 14 nt, Human
gagcaaagugaggg

SEQ ID NO: 3445403 - RNA, 13 nt, Human
gagcaacauuuua

SEQ ID NO: 3445404 - RNA, 15 nt, Human
gagcaaccguggccc

SEQ ID NO: 3445405 - RNA, 22 nt, Human
gagcaaccguggcccuuccugg

SEQ ID NO: 3445406 - RNA, 16 nt, Human
gagcaaccucucacuc

SEQ ID NO: 3445407 - RNA, 21 nt, Human
gagcaaccucucacuccccau

SEQ ID NO: 3445408 - RNA, 20 nt, Human
gagcaacgaccagggccgag

SEQ ID NO: 3445409 - RNA, 20 nt, Human
gagcaagaccccaucucaaa

SEQ ID NO: 3445410 - RNA, 18 nt, Human
gagcaagacgcugugcug

SEQ ID NO: 3445411 - RNA, 21 nt, Human
gagcaagacgcugugcugccc

SEQ ID NO: 3445412 - RNA, 23 nt, Human
gagcaagacgcugugcugcccug

SEQ ID NO: 3445413 - RNA, 12 nt, Human
gagcaagacucu

SEQ ID NO: 3445414 - RNA, 14 nt, Human
gagcaagagcuggc

SEQ ID NO: 3445415 - RNA, 13 nt, Human
gagcaagcuuuuu

SEQ ID NO: 3445416 - RNA, 21 nt, Human
gagcaaggaagguaaaaaguu

SEQ ID NO: 3445417 - RNA, 23 nt, Human
gagcaauauuuauggaugcaaca

SEQ ID NO: 3445418 - RNA, 16 nt, Human
gagcacacccagcccc

SEQ ID NO: 3445419 - RNA, 13 nt, Human
gagcacacuguag

SEQ ID NO: 3445420 - RNA, 12 nt, Human
gagcacagcccu

SEQ ID NO: 3445421 - RNA, 14 nt, Human
gagcacagcccucc

SEQ ID NO: 3445422 - RNA, 15 nt, Human
gagcacaggcagcug

SEQ ID NO: 3445423 - RNA, 16 nt, Human
gagcacaggucccacc

SEQ ID NO: 3445424 - RNA, 18 nt, Human
gagcacaggucccaccuc

SEQ ID NO: 3445425 - RNA, 16 nt, Human
gagcacccauuccaaa

SEQ ID NO: 3445426 - RNA, 19 nt, Human
gagcacccauuccaaagcu

SEQ ID NO: 3445427 - RNA, 17 nt, Human
gagcaccccucucugca

SEQ ID NO: 3445428 - RNA, 21 nt, Human
gagcaccccucucugcaucug

SEQ ID NO: 3445429 - RNA, 14 nt, Human
gagcacccucugga

SEQ ID NO: 3445430 - RNA, 13 nt, Human
gagcacccugagg

SEQ ID NO: 3445431 - RNA, 18 nt, Human
gagcaccgugucaagcug

SEQ ID NO: 3445432 - RNA, 21 nt, Human
gagcaccgugucaagcugcuc

SEQ ID NO: 3445433 - RNA, 22 nt, Human
gagcaccgugucaagcugcucu

SEQ ID NO: 3445434 - RNA, 19 nt, Human
gagcaccuccacauccucc

SEQ ID NO: 3445435 - RNA, 17 nt, Human
gagcaccuccagccuga

SEQ ID NO: 3445436 - RNA, 14 nt, Human
gagcaccugcuguc

SEQ ID NO: 3445437 - RNA, 23 nt, Human
gagcaccugcuucaugcucagcc

SEQ ID NO: 3445438 - RNA, 16 nt, Human
gagcaccuuccucacu

SEQ ID NO: 3445439 - RNA, 13 nt, Human
gagcacugccagg

SEQ ID NO: 3445440 - RNA, 14 nt, Human
gagcacuggagugc

SEQ ID NO: 3445441 - RNA, 20 nt, Human
gagcacuggagugcagggag

SEQ ID NO: 3445442 - RNA, 22 nt, Human
gagcacuggaguggcucgccag

SEQ ID NO: 3445443 - RNA, 22 nt, Human
gagcagaaaacccuugggccag

SEQ ID NO: 3445444 - RNA, 22 nt, Human
gagcagaaauuuaucuuucaaa

SEQ ID NO: 3445445 - RNA, 23 nt, Human
gagcagaacggagccccaggccu

SEQ ID NO: 3445446 - RNA, 16 nt, Human
gagcagaagcagcaac

SEQ ID NO: 3445447 - RNA, 17 nt, Human
gagcagaaggggagaug

SEQ ID NO: 3445448 - RNA, 23 nt, Human
gagcagacuggcggggggcccau

SEQ ID NO: 3445449 - RNA, 18 nt, Human
gagcagacuggugagcag

SEQ ID NO: 3445450 - RNA, 15 nt, Human
gagcagacugguggg

SEQ ID NO: 3445451 - RNA, 13 nt, Human
gagcagagacacu

SEQ ID NO: 3445452 - RNA, 21 nt, Human
gagcagagacacuaacgacuu

SEQ ID NO: 3445453 - RNA, 24 nt, Human
gagcagagacaugacucagccugu

SEQ ID NO: 3445454 - RNA, 21 nt, Human
gagcagagagcuuagccugga

SEQ ID NO: 3445455 - RNA, 15 nt, Human
gagcagagcaggcaa

SEQ ID NO: 3445456 - RNA, 13 nt, Human
gagcagaggcagc

SEQ ID NO: 3445457 - RNA, 15 nt, Human
gagcagaggggcuga

SEQ ID NO: 3445458 - RNA, 21 nt, Human
gagcagaugcagagagccauu

SEQ ID NO: 3445459 - RNA, 11 nt, Human
gagcagcaccu

SEQ ID NO: 3445460 - RNA, 21 nt, Human
gagcagcagguagccugcugg

SEQ ID NO: 3445461 - RNA, 16 nt, Human
gagcagcagugaaaac

SEQ ID NO: 3445462 - RNA, 20 nt, Human
gagcagccaccccaugcugg

SEQ ID NO: 3445463 - RNA, 16 nt, Human
gagcagcccuggaguc

SEQ ID NO: 3445464 - RNA, 15 nt, Human
gagcagccuggagcc

SEQ ID NO: 3445465 - RNA, 15 nt, Human
gagauaccagcgagg

SEQ ID NO: 3445466 - RNA, 13 nt, Human
gagauacucuggg

SEQ ID NO: 3445467 - RNA, 21 nt, Human
gagauacuuggucacagccag

SEQ ID NO: 3445468 - RNA, 23 nt, Human
gagauacuuggucacagccaggc

SEQ ID NO: 3445469 - RNA, 13 nt, Human
gagauacuuuuuc

SEQ ID NO: 3445470 - RNA, 15 nt, Human
gagauagcauuguga

SEQ ID NO: 3445471 - RNA, 16 nt, Human
gagauagcauugugaa

SEQ ID NO: 3445472 - RNA, 22 nt, Human
gagauagccaaggccaaaggaa

SEQ ID NO: 3445473 - RNA, 14 nt, Human
gagauagccugugg

SEQ ID NO: 3445474 - RNA, 17 nt, Human
gagauagccuguggccc

SEQ ID NO: 3445475 - RNA, 21 nt, Human
gagauagccuguggcccuguc

SEQ ID NO: 3445476 - RNA, 22 nt, Human
gagauaggaaggucauuuccau

SEQ ID NO: 3445477 - RNA, 16 nt, Human
gagauauggcagcgaa

SEQ ID NO: 3445478 - RNA, 17 nt, Human
gagauauggcagcgaaa

SEQ ID NO: 3445479 - RNA, 22 nt, Human
gagauauuuacaugaauugcau

SEQ ID NO: 3445480 - RNA, 14 nt, Human
gagauauuuuguaa

SEQ ID NO: 3445481 - RNA, 22 nt, Human
gagauauuuuguaaaauguauu

SEQ ID NO: 3445482 - RNA, 13 nt, Human
gagaucaaagaug

SEQ ID NO: 3445483 - RNA, 15 nt, Human
gagaucaaagaugaa

SEQ ID NO: 3445484 - RNA, 18 nt, Human
gagauccagggcaaggcc

SEQ ID NO: 3445485 - RNA, 18 nt, Human
gagaucccaacacugcca

SEQ ID NO: 3445486 - RNA, 15 nt, Human
gagauccccugagcc

SEQ ID NO: 3445487 - RNA, 17 nt, Human
gagaucccgccucuucu

SEQ ID NO: 3445488 - RNA, 15 nt, Human
gagauccuuaucgaa

SEQ ID NO: 3445489 - RNA, 18 nt, Human
gagauccuuguguuuauc

SEQ ID NO: 3445490 - RNA, 15 nt, Human
gagaucuaaaaauaa

SEQ ID NO: 3445491 - RNA, 19 nt, Human
gagaucuaagccuuuccau

SEQ ID NO: 3445492 - RNA, 23 nt, Human
gagaucuaaggaugucacagggc

SEQ ID NO: 3445493 - RNA, 22 nt, Human
gagaucuccuugcccuagauga

SEQ ID NO: 3445494 - RNA, 20 nt, Human
gaggaguaaccgcuccaggu

SEQ ID NO: 3445495 - RNA, 19 nt, Human
gaggagucugagguccuga

SEQ ID NO: 3445496 - RNA, 20 nt, Human
gaggagucugagguccugag

SEQ ID NO: 3445497 - RNA, 11 nt, Human
gaggaguucaa

SEQ ID NO: 3445498 - RNA, 14 nt, Human
gaggaguucaauga

SEQ ID NO: 3445499 - RNA, 13 nt, Human
gaggauacgacag

SEQ ID NO: 3445500 - RNA, 19 nt, Human
gaggaucacagugcugaga

SEQ ID NO: 3445501 - RNA, 13 nt, Human
gaggaucucuuga

SEQ ID NO: 3445502 - RNA, 16 nt, Human
gaggaucucuugagcc

SEQ ID NO: 3445503 - RNA, 14 nt, Human
gaggaugagagccc

SEQ ID NO: 3445504 - RNA, 18 nt, Human
gaggaugagagcccagag

SEQ ID NO: 3445505 - RNA, 22 nt, Human
gaggaugagcucuacccagggc

SEQ ID NO: 3445506 - RNA, 13 nt, Human
gaggaugagcugg

SEQ ID NO: 3445507 - RNA, 21 nt, Human
gaggaugcagagucagcagaa

SEQ ID NO: 3445508 - RNA, 14 nt, Human
gaggauggagagag

SEQ ID NO: 3445509 - RNA, 16 nt, Human
gaggauggccaguguc

SEQ ID NO: 3445510 - RNA, 19 nt, Human
gaggauggccagugucugu

SEQ ID NO: 3445511 - RNA, 14 nt, Human
gaggauggcccagg

SEQ ID NO: 3445512 - RNA, 15 nt, Human
gaggaugggaaggag

SEQ ID NO: 3445513 - RNA, 19 nt, Human
gaggaugggaaggagggag

SEQ ID NO: 3445514 - RNA, 18 nt, Human
gaggaugucccugggcca

SEQ ID NO: 3445515 - RNA, 19 nt, Human
gaggaugucccugggccag

SEQ ID NO: 3445516 - RNA, 15 nt, Human
gaggaugucugggcc

SEQ ID NO: 3445517 - RNA, 14 nt, Human
gaggaugugggcag

SEQ ID NO: 3445518 - RNA, 12 nt, Human
gaggauguucug

SEQ ID NO: 3445519 - RNA, 17 nt, Human
gaggauguucugggaca

SEQ ID NO: 3445520 - RNA, 15 nt, Human
gaggauugcuaucug

SEQ ID NO: 3445521 - RNA, 18 nt, Human
gaggauugcuugagccca

SEQ ID NO: 3445522 - RNA, 15 nt, Human
gaggauuucaagccu

SEQ ID NO: 3445523 - RNA, 16 nt, Human
gaggaauucuguauag

SEQ ID NO: 3445524 - RNA, 17 nt, Human
gaggaauucuguauaga

SEQ ID NO: 3445525 - RNA, 22 nt, Human
gaggaauuuucuuuguguagcu

SEQ ID NO: 3445526 - RNA, 13 nt, Human
gaggacaaaacuu

SEQ ID NO: 3445527 - RNA, 23 nt, Human
gaggacaaaacuucuugucagac

SEQ ID NO: 3445528 - RNA, 18 nt, Human
gaggacaagagaaaaaag

SEQ ID NO: 3445529 - RNA, 14 nt, Human
gaggacacaugucc

SEQ ID NO: 3445530 - RNA, 21 nt, Human
gaggacagaugccuccuuccu

SEQ ID NO: 3445531 - RNA, 14 nt, Human
gaggacagcugucc

SEQ ID NO: 3445532 - RNA, 14 nt, Human
gaggacaggcggga

SEQ ID NO: 3445533 - RNA, 13 nt, Human
gaggacagggagg

SEQ ID NO: 3445534 - RNA, 22 nt, Human
gaggaccacuccuguacacuga

SEQ ID NO: 3445535 - RNA, 13 nt, Human
gaggaccagggcc

SEQ ID NO: 3445536 - RNA, 13 nt, Human
gaggaccagggcu

SEQ ID NO: 3445537 - RNA, 14 nt, Human
gaggacccagaccc

SEQ ID NO: 3445538 - RNA, 11 nt, Human
gaggacccagg

SEQ ID NO: 3445539 - RNA, 12 nt, Human
gaggacccagga

SEQ ID NO: 3445540 - RNA, 20 nt, Human
gaggacccaggaaaggcagg

SEQ ID NO: 3445541 - RNA, 14 nt, Human
gaggacccagggcu

SEQ ID NO: 3445542 - RNA, 16 nt, Human
gaggacccagggcucu

SEQ ID NO: 3445543 - RNA, 15 nt, Human
gaggaccucugggcu

SEQ ID NO: 3445544 - RNA, 22 nt, Human
gaggaccugacccuacucccuu

SEQ ID NO: 3445545 - RNA, 13 nt, Human
gaggaccugagcc

SEQ ID NO: 3445546 - RNA, 14 nt, Human
gaggaccugagccu

SEQ ID NO: 3445547 - RNA, 21 nt, Human
gaggaccugagccugccgagc

SEQ ID NO: 3445548 - RNA, 22 nt, Human
gaggaccugagccugccgagca

SEQ ID NO: 3445549 - RNA, 13 nt, Human
gaggaccugcccg

SEQ ID NO: 3445550 - RNA, 17 nt, Human
gaggaccuggggcacag

SEQ ID NO: 3445551 - RNA, 18 nt, Human
gaggaccuggggcacagu

SEQ ID NO: 3445552 - RNA, 23 nt, Human
gaggaccuguauuuaagcaaaua

SEQ ID NO: 3445553 - RNA, 15 nt, Human
gaggacgcucucugg

SEQ ID NO: 3445554 - RNA, 20 nt, Human
gaggacgcucucuggccuuc

SEQ ID NO: 3445555 - RNA, 18 nt, Human
gaggacucacuugcccac

SEQ ID NO: 3445556 - RNA, 23 nt, Human
gaggacuccaggcagcagacaca

SEQ ID NO: 3445557 - RNA, 20 nt, Human
gaggacucccaacccuggcu

SEQ ID NO: 3445558 - RNA, 21 nt, Human
gaggacucccaacccuggcuu

SEQ ID NO: 3445559 - RNA, 20 nt, Human
gaggacucgcuuguaaauac

SEQ ID NO: 3445560 - RNA, 20 nt, Human
gaggacuguagggagggcgg

SEQ ID NO: 3445561 - RNA, 21 nt, Human
gaggacuguagggagggcggc

SEQ ID NO: 3445562 - RNA, 17 nt, Human
gaggacuugugucucug

SEQ ID NO: 3445563 - RNA, 18 nt, Human
gaggacuugugucucugu

SEQ ID NO: 3445564 - RNA, 9 nt, Human
gaggagaaa

SEQ ID NO: 3445565 - RNA, 14 nt, Human
gaggagaagaaaau

SEQ ID NO: 3445566 - RNA, 12 nt, Human
gaggagaagaau

SEQ ID NO: 3445567 - RNA, 20 nt, Human
gaggagaagaauuuucagac

SEQ ID NO: 3445568 - RNA, 16 nt, Human
gaggagagaaaauaua

SEQ ID NO: 3445569 - RNA, 15 nt, Human
gaggagagaagaaug

SEQ ID NO: 3445570 - RNA, 21 nt, Human
gaggagagaagaaugagccua

SEQ ID NO: 3445571 - RNA, 20 nt, Human
gaggagagagcagcuucugc

SEQ ID NO: 3445572 - RNA, 17 nt, Human
gaggagagaggcagaga

SEQ ID NO: 3445573 - RNA, 24 nt, Human
gaggagagauagccuguggcccug

SEQ ID NO: 3445574 - RNA, 17 nt, Human
gaggagagccagagaag

SEQ ID NO: 3445575 - RNA, 22 nt, Human
gaggagagccagagaagugaca

SEQ ID NO: 3445576 - RNA, 15 nt, Human
gaggagcagugcagg

SEQ ID NO: 3445577 - RNA, 13 nt, Human
gaggagccaggca

SEQ ID NO: 3445578 - RNA, 20 nt, Human
gaggagcccaggccaggacu

SEQ ID NO: 3445579 - RNA, 21 nt, Human
gaggagcccauacucagccug

SEQ ID NO: 3445580 - RNA, 17 nt, Human
gaggagccccaucuguc

SEQ ID NO: 3445581 - RNA, 20 nt, Human
gaggagcccccacccuguuc

SEQ ID NO: 3445582 - RNA, 13 nt, Human
gaggagcccugcc

SEQ ID NO: 3445583 - RNA, 15 nt, Human
gaggagcccugccuc

SEQ ID NO: 3445584 - RNA, 18 nt, Human
gaggagcucaggacacua

SEQ ID NO: 3445585 - RNA, 21 nt, Human
gaggagcuugggggaugacua

SEQ ID NO: 3445586 - RNA, 18 nt, Human
gaggaggaaaucccuuca

SEQ ID NO: 3445587 - RNA, 14 nt, Human
gaggaggaggaggu

SEQ ID NO: 3445588 - RNA, 21 nt, Human
gaggaggaugucccugggcca

SEQ ID NO: 3445589 - RNA, 12 nt, Human
gaggaggcagca

SEQ ID NO: 3445590 - RNA, 15 nt, Human
gaggaggccaccucu

SEQ ID NO: 3445591 - RNA, 18 nt, Human
gaggaggccaccucucca

SEQ ID NO: 3445592 - RNA, 20 nt, Human
gaggaggccaccucuccaag

SEQ ID NO: 3445593 - RNA, 13 nt, Human
gaggaggccucca

SEQ ID NO: 3445594 - RNA, 21 nt, Human
gaggaggccuugggcucugcu

SEQ ID NO: 3445595 - RNA, 13 nt, Human
gaggagggcaggc

SEQ ID NO: 3445596 - RNA, 15 nt, Human
gaggagggcaggcau

SEQ ID NO: 3445597 - RNA, 17 nt, Human
gaggaggggccgcugcc

SEQ ID NO: 3445598 - RNA, 21 nt, Human
gaggagggucuagaggccuga

SEQ ID NO: 3445599 - RNA, 15 nt, Human
gaggaggugccugga

SEQ ID NO: 3445600 - RNA, 21 nt, Human
gaggaggugugaggaggaggc

SEQ ID NO: 3445601 - RNA, 21 nt, Human
gaggaguaaaauucaguuuuu

SEQ ID NO: 3445602 - RNA, 11 nt, Human
gaggaguaaca

SEQ ID NO: 3445603 - RNA, 14 nt, Human
gaggagucugaggu

SEQ ID NO: 3445604 - RNA, 15 nt, Human
gaggagucugagguc

SEQ ID NO: 3445605 - RNA, 23 nt, Human
gaggagucugagguccugagcac

SEQ ID NO: 3445606 - RNA, 13 nt, Human
gaggagugaggaa

SEQ ID NO: 3445607 - RNA, 14 nt, Human
gaggaguggaggug

SEQ ID NO: 3445608 - RNA, 12 nt, Human
gaggaguucaau

SEQ ID NO: 3445609 - RNA, 18 nt, Human
gaggaguuuccuaaaagu

SEQ ID NO: 3445610 - RNA, 20 nt, Human
gaggaguuuccuaaaaguuc

SEQ ID NO: 3445611 - RNA, 18 nt, Human
gaggauauauuuucacuu

SEQ ID NO: 3445612 - RNA, 18 nt, Human
gaggaucacagugcugag

SEQ ID NO: 3445613 - RNA, 16 nt, Human
gaggaucacuggagcc

SEQ ID NO: 3445614 - RNA, 16 nt, Human
gaggaucagaaaguaa

SEQ ID NO: 3445615 - RNA, 19 nt, Human
gaggaucucuugagccugg

SEQ ID NO: 3445616 - RNA, 22 nt, Human
gaggaucucuugagccugggag

SEQ ID NO: 3445617 - RNA, 15 nt, Human
gaggaugagagccca

SEQ ID NO: 3445618 - RNA, 17 nt, Human
gaggaugagagcccaga

SEQ ID NO: 3445619 - RNA, 12 nt, Human
gaggauggagag

SEQ ID NO: 3445620 - RNA, 14 nt, Human
gaggauggccagug

SEQ ID NO: 3445621 - RNA, 20 nt, Human
gaggauggccagugucuguc

SEQ ID NO: 3445622 - RNA, 14 nt, Human
gaggaugggcucgc

SEQ ID NO: 3445623 - RNA, 21 nt, Human
gaggauguaaagaucaauaaa

SEQ ID NO: 3445624 - RNA, 20 nt, Human
gaggaugucacucagaugga

SEQ ID NO: 3445625 - RNA, 18 nt, Human
gaggaugucucaaacuuc

SEQ ID NO: 3445626 - RNA, 22 nt, Human
gaggauugcuugagcccaggag

SEQ ID NO: 3445627 - RNA, 16 nt, Human
gaggauugcuugagcu

SEQ ID NO: 3445628 - RNA, 20 nt, Human
gaggauugcuugagcucagg

SEQ ID NO: 3445629 - RNA, 22 nt, Human
gaggauuuaagggauggaaaag

SEQ ID NO: 3445630 - RNA, 12 nt, Human
gaggauuuagaa

SEQ ID NO: 3445631 - RNA, 17 nt, Human
gaggauuucaagccugc

SEQ ID NO: 3445632 - RNA, 17 nt, Human
gaggauuuuuuucugag

SEQ ID NO: 3445633 - RNA, 20 nt, Human
gaggcaaagcuggcucaccu

SEQ ID NO: 3445634 - RNA, 21 nt, Human
gaggcaauccuaccuugcuuu

SEQ ID NO: 3445635 - RNA, 21 nt, Human
gaggcaauuagacacuuugga

SEQ ID NO: 3445636 - RNA, 13 nt, Human
gaggcaccaggaa

SEQ ID NO: 3445637 - RNA, 21 nt, Human
gaggcaccauucaggaaccug

SEQ ID NO: 3445638 - RNA, 21 nt, Human
gaggcagaaagcagaggcugg

SEQ ID NO: 3445639 - RNA, 16 nt, Human
gaggcugcagcgagcu

SEQ ID NO: 3445640 - RNA, 23 nt, Human
gaggcugccccaccccuccccau

SEQ ID NO: 3445641 - RNA, 15 nt, Human
gaggcugccccucuc

SEQ ID NO: 3445642 - RNA, 14 nt, Human
gaggcugccuccca

SEQ ID NO: 3445643 - RNA, 15 nt, Human
gaggcugccucccaa

SEQ ID NO: 3445644 - RNA, 21 nt, Human
gaggcugcucggggugcacag

SEQ ID NO: 3445645 - RNA, 23 nt, Human
gaggcugcucggggugcacagga

SEQ ID NO: 3445646 - RNA, 15 nt, Human
gaggcuggaggcagg

SEQ ID NO: 3445647 - RNA, 19 nt, Human
gaggcuggaguuggggcag

SEQ ID NO: 3445648 - RNA, 13 nt, Human
gaggcuggcacag

SEQ ID NO: 3445649 - RNA, 15 nt, Human
gaggcuggccucaga

SEQ ID NO: 3445650 - RNA, 18 nt, Human
gaggcuggccucuacauc

SEQ ID NO: 3445651 - RNA, 16 nt, Human
gaggcuggcuggggcc

SEQ ID NO: 3445652 - RNA, 23 nt, Human
gaggcugggaauggaggggcaga

SEQ ID NO: 3445653 - RNA, 21 nt, Human
gaggcugggacgcucugcugu

SEQ ID NO: 3445654 - RNA, 15 nt, Human
gaggcugggccaagc

SEQ ID NO: 3445655 - RNA, 23 nt, Human
gaggcugggccaagccagggaug

SEQ ID NO: 3445656 - RNA, 17 nt, Human
gaggcugggggagagcc

SEQ ID NO: 3445657 - RNA, 13 nt, Human
gaggcugguuuug

SEQ ID NO: 3445658 - RNA, 23 nt, Human
gaggcuguaggacucgcagucag

SEQ ID NO: 3445659 - RNA, 20 nt, Human
gaggcugucuucucaggcuc

SEQ ID NO: 3445660 - RNA, 23 nt, Human
gaggcuguggucacagcggaggu

SEQ ID NO: 3445661 - RNA, 16 nt, Human
gaggcuuccagagagu

SEQ ID NO: 3445662 - RNA, 21 nt, Human
gaggcuuccagagaguccucu

SEQ ID NO: 3445663 - RNA, 22 nt, Human
gaggcuuccagagaguccucug

SEQ ID NO: 3445664 - RNA, 18 nt, Human
gaggcuucuccgccagcc

SEQ ID NO: 3445665 - RNA, 21 nt, Human
gaggcuucuccgccagccucc

SEQ ID NO: 3445666 - RNA, 23 nt, Human
gaggcuucuccgccagccuccuc

SEQ ID NO: 3445667 - RNA, 17 nt, Human
gaggcuugucagagcug

SEQ ID NO: 3445668 - RNA, 14 nt, Human
gaggcuuuccaugg

SEQ ID NO: 3445669 - RNA, 12 nt, Human
gagggaaaccuu

SEQ ID NO: 3445670 - RNA, 15 nt, Human
gagggaacagacagg

SEQ ID NO: 3445671 - RNA, 18 nt, Human
gagggaacagacaggaga

SEQ ID NO: 3445672 - RNA, 19 nt, Human
gagggaacagacaggagaa

SEQ ID NO: 3445673 - RNA, 17 nt, Human
gagggaaggauuuagga

SEQ ID NO: 3445674 - RNA, 19 nt, Human
gagggaagggagccaaggg

SEQ ID NO: 3445675 - RNA, 20 nt, Human
gagggaaggguuucucuauu

SEQ ID NO: 3445676 - RNA, 14 nt, Human
gagggaaugugaaa

SEQ ID NO: 3445677 - RNA, 18 nt, Human
gagggaauugaggucugc

SEQ ID NO: 3445678 - RNA, 18 nt, Human
gagggacaaaggagccug

SEQ ID NO: 3445679 - RNA, 19 nt, Human
gagggacaaaggagccugu

SEQ ID NO: 3445680 - RNA, 16 nt, Human
gagggaccagccaaga

SEQ ID NO: 3445681 - RNA, 14 nt, Human
gagggaccucuccc

SEQ ID NO: 3445682 - RNA, 16 nt, Human
gagggacgccuggggg

SEQ ID NO: 3445683 - RNA, 22 nt, Human
gagggacgcggcucccggggca

SEQ ID NO: 3445684 - RNA, 15 nt, Human
gagggacggccaaga

SEQ ID NO: 3445685 - RNA, 19 nt, Human
gagggacucugaagccucu

SEQ ID NO: 3445686 - RNA, 21 nt, Human
gagggacucugaagccucugg

SEQ ID NO: 3445687 - RNA, 14 nt, Human
gagggagaagcaug

SEQ ID NO: 3445688 - RNA, 20 nt, Human
gaggcugugugccuggggga

SEQ ID NO: 3445689 - RNA, 21 nt, Human
gaggcugugugccugggggag

SEQ ID NO: 3445690 - RNA, 17 nt, Human
gaggcuguucccaccag

SEQ ID NO: 3445691 - RNA, 20 nt, Human
gaggcuuccagagaguccuc

SEQ ID NO: 3445692 - RNA, 15 nt, Human
gaggcuuccugcguc

SEQ ID NO: 3445693 - RNA, 21 nt, Human
gaggcuuccugcguccuccuc

SEQ ID NO: 3445694 - RNA, 15 nt, Human
gaggcuucuccgcca

SEQ ID NO: 3445695 - RNA, 19 nt, Human
gaggcuucuccgccagccu

SEQ ID NO: 3445696 - RNA, 16 nt, Human
gaggcuucuucagauc

SEQ ID NO: 3445697 - RNA, 15 nt, Human
gaggcuugcugagag

SEQ ID NO: 3445698 - RNA, 22 nt, Human
gaggcuugggaccgccagaugg

SEQ ID NO: 3445699 - RNA, 14 nt, Human
gaggcuuggggcug

SEQ ID NO: 3445700 - RNA, 19 nt, Human
gaggcuuguuuaccuuucu

SEQ ID NO: 3445701 - RNA, 16 nt, Human
gaggcuuuguguugua

SEQ ID NO: 3445702 - RNA, 13 nt, Human
gagggaaaauguu

SEQ ID NO: 3445703 - RNA, 21 nt, Human
gagggaaagcccagaaaagga

SEQ ID NO: 3445704 - RNA, 16 nt, Human
gagggaaaggccagca

SEQ ID NO: 3445705 - RNA, 15 nt, Human
gagggaaagugcaua

SEQ ID NO: 3445706 - RNA, 20 nt, Human
gagggaagaguggaggugga

SEQ ID NO: 3445707 - RNA, 14 nt, Human
gagggaagggacgg

SEQ ID NO: 3445708 - RNA, 16 nt, Human
gagggaaugaaccugg

SEQ ID NO: 3445709 - RNA, 16 nt, Human
gagggacaaaggagcc

SEQ ID NO: 3445710 - RNA, 21 nt, Human
gagggacaaaggagccuguga

SEQ ID NO: 3445711 - RNA, 21 nt, Human
gagggacaaauuuaaaacaaa

SEQ ID NO: 3445712 - RNA, 17 nt, Human
gagggaccaacugggcc

SEQ ID NO: 3445713 - RNA, 16 nt, Human
gagggaccauguguca

SEQ ID NO: 3445714 - RNA, 23 nt, Human
gagggacgccugggggugccagg

SEQ ID NO: 3445715 - RNA, 14 nt, Human
gagggacucugaag

SEQ ID NO: 3445716 - RNA, 20 nt, Human
gagggacucugaagccucug

SEQ ID NO: 3445717 - RNA, 15 nt, Human
gagggacugccucug

SEQ ID NO: 3445718 - RNA, 18 nt, Human
gagggacugccucugcca

SEQ ID NO: 3445719 - RNA, 15 nt, Human
gagggacugucgcug

SEQ ID NO: 3445720 - RNA, 16 nt, Human
gagggagaacaagacc

SEQ ID NO: 3445721 - RNA, 13 nt, Human
gagggagaaggga

SEQ ID NO: 3445722 - RNA, 23 nt, Human
gagggagagguggagcaaaguga

SEQ ID NO: 3445723 - RNA, 12 nt, Human
gagggagaugga

SEQ ID NO: 3445724 - RNA, 17 nt, Human
gagggagcacaaccccc

SEQ ID NO: 3445725 - RNA, 23 nt, Human
gagggagcuccaacucagaaggg

SEQ ID NO: 3445726 - RNA, 15 nt, Human
gagggagcugagaag

SEQ ID NO: 3445727 - RNA, 16 nt, Human
gagggagcugagaaga

SEQ ID NO: 3445728 - RNA, 14 nt, Human
gagggaggaccugg

SEQ ID NO: 3445729 - RNA, 15 nt, Human
gagggaggaccuggg

SEQ ID NO: 3445730 - RNA, 13 nt, Human
gagggaggaggcc

SEQ ID NO: 3445731 - RNA, 17 nt, Human
gagggaggaggccaccu

SEQ ID NO: 3445732 - RNA, 11 nt, Human
gagggaggccc

SEQ ID NO: 3445733 - RNA, 12 nt, Human
gagggaggggaa

SEQ ID NO: 3445734 - RNA, 12 nt, Human
gagggaggggcc

SEQ ID NO: 3445735 - RNA, 14 nt, Human
gagggagguaagga

SEQ ID NO: 3445736 - RNA, 14 nt, Human
gagggagugacaga

SEQ ID NO: 3445737 - RNA, 18 nt, Human
gagggagugaguggcccu

SEQ ID NO: 3445738 - RNA, 14 nt, Human
gagggauggacuga

SEQ ID NO: 3445739 - RNA, 19 nt, Human
gagggauggcggguggggg

SEQ ID NO: 3445740 - RNA, 13 nt, Human
gagggaugggccu

SEQ ID NO: 3445741 - RNA, 18 nt, Human
gagggauucugguuccag

SEQ ID NO: 3445742 - RNA, 12 nt, Human
gagggcacacac

SEQ ID NO: 3445743 - RNA, 23 nt, Human
gagggcacauuccuugccugcac

SEQ ID NO: 3445744 - RNA, 15 nt, Human
gagggcacuggagcu

SEQ ID NO: 3445745 - RNA, 17 nt, Human
gagggcacugguggccc

SEQ ID NO: 3445746 - RNA, 17 nt, Human
gagggcagaaagguucu

SEQ ID NO: 3445747 - RNA, 23 nt, Human
gagggcagaaagguucugcccgg

SEQ ID NO: 3445748 - RNA, 17 nt, Human
gagggcagacuggggca

SEQ ID NO: 3445749 - RNA, 14 nt, Human
gagggcagagcugg

SEQ ID NO: 3445750 - RNA, 16 nt, Human
gagggcagagcuggug

SEQ ID NO: 3445751 - RNA, 17 nt, Human
gagggcagagcuggugc

SEQ ID NO: 3445752 - RNA, 15 nt, Human
gagggcagaggcugg

SEQ ID NO: 3445753 - RNA, 16 nt, Human
gagggcagaggcugga

SEQ ID NO: 3445754 - RNA, 15 nt, Human
gagggcagcagccag

SEQ ID NO: 3445755 - RNA, 15 nt, Human
gagggcagcagggcu

SEQ ID NO: 3445756 - RNA, 18 nt, Human
gagggcaguucgcagcca

SEQ ID NO: 3445757 - RNA, 13 nt, Human
gagggcccagagc

SEQ ID NO: 3445758 - RNA, 22 nt, Human
gagggcccagagcaggaagcau

SEQ ID NO: 3445759 - RNA, 17 nt, Human
gagggccccucugccca

SEQ ID NO: 3445760 - RNA, 18 nt, Human
gagggccccucugcccag

SEQ ID NO: 3445761 - RNA, 17 nt, Human
gagggcccugagcugag

SEQ ID NO: 3445762 - RNA, 16 nt, Human
gagggccgagugagag

SEQ ID NO: 3445763 - RNA, 14 nt, Human
gagggccugcaagg

SEQ ID NO: 3445764 - RNA, 21 nt, Human
gagggccugcuggaggccuca

SEQ ID NO: 3445765 - RNA, 19 nt, Human
gagggccugugggagccug

SEQ ID NO: 3445766 - RNA, 23 nt, Human
gagggcgaccccgucacagccuc

SEQ ID NO: 3445767 - RNA, 20 nt, Human
gagggcuagaaucuggagag

SEQ ID NO: 3445768 - RNA, 15 nt, Human
gagggcucugaggcg

SEQ ID NO: 3445769 - RNA, 13 nt, Human
gagggcugcccug

SEQ ID NO: 3445770 - RNA, 15 nt, Human
gagggcuggaaucug

SEQ ID NO: 3445771 - RNA, 17 nt, Human
gagggcuggaggcccag

SEQ ID NO: 3445772 - RNA, 13 nt, Human
gagggcuggcugg

SEQ ID NO: 3445773 - RNA, 16 nt, Human
gagggcuggcuggccu

SEQ ID NO: 3445774 - RNA, 19 nt, Human
gagggcuuccucuagaagc

SEQ ID NO: 3445775 - RNA, 21 nt, Human
gagggcuuccucuagaagcca

SEQ ID NO: 3445776 - RNA, 22 nt, Human
gagggcuuccucuagaagccaa

SEQ ID NO: 3445777 - RNA, 17 nt, Human
gaggggaaaaaaauguu

SEQ ID NO: 3445778 - RNA, 16 nt, Human
gaggggaagcuucugu

SEQ ID NO: 3445779 - RNA, 14 nt, Human
gaggggaagucccu

SEQ ID NO: 3445780 - RNA, 13 nt, Human
gaggggacagguc

SEQ ID NO: 3445781 - RNA, 14 nt, Human
gaggggaccaggag

SEQ ID NO: 3445782 - RNA, 21 nt, Human
gaggggacgcugguagagaug

SEQ ID NO: 3445783 - RNA, 15 nt, Human
gaggggacucugggc

SEQ ID NO: 3445784 - RNA, 18 nt, Human
gaguuguguuguucuuuu

SEQ ID NO: 3445785 - RNA, 16 nt, Human
gaguuguuguguacag

SEQ ID NO: 3445786 - RNA, 16 nt, Human
gaguuguuuucagacu

SEQ ID NO: 3445787 - RNA, 14 nt, Human
gaguuguuuuugua

SEQ ID NO: 3445788 - RNA, 18 nt, Human
gaguuguuuuuguauauu

SEQ ID NO: 3445789 - RNA, 20 nt, Human
gaguuuaaaaucaucagaaa

SEQ ID NO: 3445790 - RNA, 19 nt, Human
gaguuuaagaccagccugg

SEQ ID NO: 3445791 - RNA, 22 nt, Human
gaguuuaccauuuguaauaaag

SEQ ID NO: 3445792 - RNA, 23 nt, Human
gaguuuaccauuuguaauaaagu

SEQ ID NO: 3445793 - RNA, 18 nt, Human
gaguuuagcccugaacau

SEQ ID NO: 3445794 - RNA, 18 nt, Human
gaguuucacagugugauu

SEQ ID NO: 3445795 - RNA, 16 nt, Human
gaguuuccaaaaccag

SEQ ID NO: 3445796 - RNA, 20 nt, Human
gaguuuccucaggcugcugg

SEQ ID NO: 3445797 - RNA, 15 nt, Human
gaguuucgagguaga

SEQ ID NO: 3445798 - RNA, 13 nt, Human
gaguuucuguuug

SEQ ID NO: 3445799 - RNA, 14 nt, Human
gaguuucuguuuga

SEQ ID NO: 3445800 - RNA, 22 nt, Human
gaguuugaaggaggugagggau

SEQ ID NO: 3445801 - RNA, 23 nt, Human
gaguuugccccguucuguuugua

SEQ ID NO: 3445802 - RNA, 13 nt, Human
gaguuugcccugg

SEQ ID NO: 3445803 - RNA, 18 nt, Human
gaguuugcuauuagagca

SEQ ID NO: 3445804 - RNA, 14 nt, Human
gaguuuggccagaa

SEQ ID NO: 3445805 - RNA, 13 nt, Human
gaguuuggucugg

SEQ ID NO: 3445806 - RNA, 12 nt, Human
gaguuuguuucu

SEQ ID NO: 3445807 - RNA, 21 nt, Human
gaguuuuccauggcaggaagg

SEQ ID NO: 3445808 - RNA, 22 nt, Human
gaguuuuccucuauacaucucu

SEQ ID NO: 3445809 - RNA, 23 nt, Human
gaguuuuccucuauacaucucuc

SEQ ID NO: 3445810 - RNA, 21 nt, Human
gaguuuucucuuuguggggcu

SEQ ID NO: 3445811 - RNA, 16 nt, Human
gaguuuuggaugcagu

SEQ ID NO: 3445812 - RNA, 18 nt, Human
gaguuuuuauggggcuga

SEQ ID NO: 3445813 - RNA, 23 nt, Human
gauaaaaaauuuuguaauuuucu

SEQ ID NO: 3445814 - RNA, 21 nt, Human
gauaaaaagauguucagucau

SEQ ID NO: 3445815 - RNA, 18 nt, Human
gauaaaaagccagggcug

SEQ ID NO: 3445816 - RNA, 19 nt, Human
gauaaaaagccagggcugg

SEQ ID NO: 3445817 - RNA, 22 nt, Human
gauaaaacugggccuguagcuc

SEQ ID NO: 3445818 - RNA, 16 nt, Human
gauaaaagauggccau

SEQ ID NO: 3445819 - RNA, 18 nt, Human
gauaaaaugacuacuuag

SEQ ID NO: 3445820 - RNA, 22 nt, Human
gauaaaauuauagaugggaaug

SEQ ID NO: 3445821 - RNA, 13 nt, Human
gauaaacaguagu

SEQ ID NO: 3445822 - RNA, 15 nt, Human
gauaaacuuuuagaa

SEQ ID NO: 3445823 - RNA, 17 nt, Human
gauaaagaaaaaaauac

SEQ ID NO: 3445824 - RNA, 18 nt, Human
gauaaagaaaaaaauacu

SEQ ID NO: 3445825 - RNA, 14 nt, Human
gauaaagaaaagaa

SEQ ID NO: 3445826 - RNA, 18 nt, Human
gauaaagaccagaaauuc

SEQ ID NO: 3445827 - RNA, 13 nt, Human
gauaaagaugauc

SEQ ID NO: 3445828 - RNA, 22 nt, Human
gauaaagaugcaaggaccagga

SEQ ID NO: 3445829 - RNA, 13 nt, Human
gauaaagauuucu

SEQ ID NO: 3445830 - RNA, 15 nt, Human
gauaaagcacagcug

SEQ ID NO: 3445831 - RNA, 19 nt, Human
gauaaagccacugaaaauu

SEQ ID NO: 3445832 - RNA, 15 nt, Human
gauaaaguaguaaaa

SEQ ID NO: 3445833 - RNA, 16 nt, Human
gauaaaguuucucaga

SEQ ID NO: 3445834 - RNA, 22 nt, Human
gauaaauauuauauuauauaua

SEQ ID NO: 3445835 - RNA, 13 nt, Human
gauaaauauuuga

SEQ ID NO: 3445836 - RNA, 20 nt, Human
gauaaaucagucaagcuguu

SEQ ID NO: 3445837 - RNA, 17 nt, Human
gauaaaucauaaaguca

SEQ ID NO: 3445838 - RNA, 18 nt, Human
gauaaaucauaaagucag

SEQ ID NO: 3445839 - RNA, 15 nt, Human
gauaaaugauucaaa

SEQ ID NO: 3445840 - RNA, 22 nt, Human
gauaaauggcuuccuggcaaua

SEQ ID NO: 3445841 - RNA, 13 nt, Human
gauaaauuauaag

SEQ ID NO: 3445842 - RNA, 22 nt, Human
gauaaauuaugguaaaauuuug

SEQ ID NO: 3445843 - RNA, 13 nt, Human
gauaacaaagaua

SEQ ID NO: 3445844 - RNA, 18 nt, Human
gauaacaaagauaucuuu

SEQ ID NO: 3445845 - RNA, 17 nt, Human
gauaacaaccuggagac

SEQ ID NO: 3445846 - RNA, 15 nt, Human
gauaacaagaucuuu

SEQ ID NO: 3445847 - RNA, 19 nt, Human
gauaacaauguuuuaacaa

SEQ ID NO: 3445848 - RNA, 16 nt, Human
gauaacagcacugacu

SEQ ID NO: 3445849 - RNA, 20 nt, Human
gauaacagggauugauuuua

SEQ ID NO: 3445850 - RNA, 23 nt, Human
gauaacagggauugauuuuaaaa

SEQ ID NO: 3445851 - RNA, 15 nt, Human
gauaaccagcuguaa

SEQ ID NO: 3445852 - RNA, 23 nt, Human
gauaaccuauaugauuuauaguu

SEQ ID NO: 3445853 - RNA, 13 nt, Human
gauaacuagaugg

SEQ ID NO: 3445854 - RNA, 11 nt, Human
gauaacucucc

SEQ ID NO: 3445855 - RNA, 14 nt, Human
gauaacucuuugga

SEQ ID NO: 3445856 - RNA, 15 nt, Human
gauaacucuuuggau

SEQ ID NO: 3445857 - RNA, 21 nt, Human
gauaacugaaaauuauuuaaa

SEQ ID NO: 3445858 - RNA, 18 nt, Human
gauaacugcaauuuuaau

SEQ ID NO: 3445859 - RNA, 22 nt, Human
gauaagaaccuuuugagugccu

SEQ ID NO: 3445860 - RNA, 17 nt, Human
gauaagaaugcugguuu

SEQ ID NO: 3445861 - RNA, 17 nt, Human
gauaagaccaccaccuc

SEQ ID NO: 3445862 - RNA, 14 nt, Human
gauaagaucuuuua

SEQ ID NO: 3445863 - RNA, 20 nt, Human
gauaagaucuuuuauuuugc

SEQ ID NO: 3445864 - RNA, 23 nt, Human
gauaagccacucugucccuuccu

SEQ ID NO: 3445865 - RNA, 13 nt, Human
gauaaggaaauca

SEQ ID NO: 3445866 - RNA, 15 nt, Human
gauaaggaagaaaca

SEQ ID NO: 3445867 - RNA, 15 nt, Human
gauaaggccuguggg

SEQ ID NO: 3445868 - RNA, 17 nt, Human
gauaagguaaaaugcca

SEQ ID NO: 3445869 - RNA, 23 nt, Human
gauaagguaccuuucacauagag

SEQ ID NO: 3445870 - RNA, 12 nt, Human
gauaaguucaua

SEQ ID NO: 3445871 - RNA, 18 nt, Human
gauaaguuggaaacacua

SEQ ID NO: 3445872 - RNA, 22 nt, Human
gauaaguuggaaacacuaaaug

SEQ ID NO: 3445873 - RNA, 22 nt, Human
gauaauaaauugaaauugugaa

SEQ ID NO: 3445874 - RNA, 16 nt, Human
gauaauaauauauguu

SEQ ID NO: 3445875 - RNA, 19 nt, Human
gauaauaauauuguuuuuc

SEQ ID NO: 3445876 - RNA, 18 nt, Human
gauaauacaccacuacau

SEQ ID NO: 3445877 - RNA, 21 nt, Human
gauaauacaccacuacauucu

SEQ ID NO: 3445878 - RNA, 13 nt, Human
gauaauagauucu

SEQ ID NO: 3445879 - RNA, 18 nt, Human
gauaauauuguggugcca

SEQ ID NO: 3445880 - RNA, 21 nt, Human
gauaauauuuuacauacacug

SEQ ID NO: 3445881 - RNA, 17 nt, Human
gauaaucaacugggcug

SEQ ID NO: 3445882 - RNA, 13 nt, Human
gauaaugaacaga

SEQ ID NO: 3445883 - RNA, 20 nt, Human
gauaaugccggugagaauaa

SEQ ID NO: 3445884 - RNA, 21 nt, Human
gauaaugugauauuauacaua

SEQ ID NO: 3445885 - RNA, 21 nt, Human
gauaauguuaaauuuguaagu

SEQ ID NO: 3445886 - RNA, 14 nt, Human
gauaauuaaccaag

SEQ ID NO: 3445887 - RNA, 23 nt, Human
gauaauuaaccaagguagaauga

SEQ ID NO: 3445888 - RNA, 15 nt, Human
gauaauucuuauuuu

SEQ ID NO: 3445889 - RNA, 15 nt, Human
gauaauuucagggug

SEQ ID NO: 3445890 - RNA, 12 nt, Human
gauaauuuugca

SEQ ID NO: 3445891 - RNA, 17 nt, Human
gauacaaaagcauguga

SEQ ID NO: 3445892 - RNA, 20 nt, Human
gauacaacuucaagugcaug

SEQ ID NO: 3445893 - RNA, 11 nt, Human
gauacaauaaa

SEQ ID NO: 3445894 - RNA, 16 nt, Human
gauaauauauuguguu

SEQ ID NO: 3445895 - RNA, 23 nt, Human
gauaauauuacuguuuauuucug

SEQ ID NO: 3445896 - RNA, 15 nt, Human
gauaauauuguuugg

SEQ ID NO: 3445897 - RNA, 13 nt, Human
gauaaucagccuc

SEQ ID NO: 3445898 - RNA, 16 nt, Human
gauaaucagccucuua

SEQ ID NO: 3445899 - RNA, 21 nt, Human
gauaaucagugugucuaaauu

SEQ ID NO: 3445900 - RNA, 15 nt, Human
gauaaugcuguugcc

SEQ ID NO: 3445901 - RNA, 11 nt, Human
gauaauguuaa

SEQ ID NO: 3445902 - RNA, 12 nt, Human
gauaauguuaaa

SEQ ID NO: 3445903 - RNA, 21 nt, Human
gauaauguugugguuuguugc

SEQ ID NO: 3445904 - RNA, 17 nt, Human
gauaauuauugguaauu

SEQ ID NO: 3445905 - RNA, 14 nt, Human
gauaauugcuauuu

SEQ ID NO: 3445906 - RNA, 14 nt, Human
gauaauuguugaaa

SEQ ID NO: 3445907 - RNA, 14 nt, Human
gauacaaccucccu

SEQ ID NO: 3445908 - RNA, 16 nt, Human
gauacaagauuagaag

SEQ ID NO: 3445909 - RNA, 17 nt, Human
gauacaaucagcugcuu

SEQ ID NO: 3445910 - RNA, 13 nt, Human
gauacacacacac

SEQ ID NO: 3445911 - RNA, 19 nt, Human
gauacacccaaaguaucag

SEQ ID NO: 3445912 - RNA, 19 nt, Human
gauacaccgggccuggaga

SEQ ID NO: 3445913 - RNA, 18 nt, Human
gauacaggaaaagcugcu

SEQ ID NO: 3445914 - RNA, 21 nt, Human
gauacaggaaaagcugcugac

SEQ ID NO: 3445915 - RNA, 17 nt, Human
gauacagucaacaagcc

SEQ ID NO: 3445916 - RNA, 19 nt, Human
gauacagucaacaagccug

SEQ ID NO: 3445917 - RNA, 18 nt, Human
gauacagucccuaaagaa

SEQ ID NO: 3445918 - RNA, 13 nt, Human
gauacauaauaaa

SEQ ID NO: 3445919 - RNA, 14 nt, Human
gauacauaauaaaa

SEQ ID NO: 3445920 - RNA, 15 nt, Human
gauacauaauaaaaa

SEQ ID NO: 3445921 - RNA, 21 nt, Human
gauacauacaccagcauuccu

SEQ ID NO: 3445922 - RNA, 18 nt, Human
gauacauaugagugugga

SEQ ID NO: 3445923 - RNA, 17 nt, Human
gauacauccaaagcaga

SEQ ID NO: 3445924 - RNA, 21 nt, Human
gauacauccaaagcagacagc

SEQ ID NO: 3445925 - RNA, 12 nt, Human
gauacaugugcc

SEQ ID NO: 3445926 - RNA, 19 nt, Human
gauaccaagaugccaucug

SEQ ID NO: 3445927 - RNA, 14 nt, Human
gauaccagaaggga

SEQ ID NO: 3445928 - RNA, 12 nt, Human
gauaccagcccc

SEQ ID NO: 3445929 - RNA, 14 nt, Human
gauaugaauauaug

SEQ ID NO: 3445930 - RNA, 22 nt, Human
gauaugaguauacaauauauaa

SEQ ID NO: 3445931 - RNA, 21 nt, Human
gauaugaguuguuuucagacu

SEQ ID NO: 3445932 - RNA, 14 nt, Human
gauaugauucaaau

SEQ ID NO: 3445933 - RNA, 20 nt, Human
gauaugauuuaaaacaugua

SEQ ID NO: 3445934 - RNA, 14 nt, Human
gauaugcagaagga

SEQ ID NO: 3445935 - RNA, 22 nt, Human
gauaugcuuguaacuaaaauaa

SEQ ID NO: 3445936 - RNA, 13 nt, Human
gauauggagaauu

SEQ ID NO: 3445937 - RNA, 12 nt, Human
gauauggagccc

SEQ ID NO: 3445938 - RNA, 15 nt, Human
gauauggagcccugu

SEQ ID NO: 3445939 - RNA, 17 nt, Human
gauaugggacauuuuug

SEQ ID NO: 3445940 - RNA, 20 nt, Human
gauaugggacugagccuggc

SEQ ID NO: 3445941 - RNA, 21 nt, Human
gauaugguggguggacagggg

SEQ ID NO: 3445942 - RNA, 16 nt, Human
gauauguaaaacauuu

SEQ ID NO: 3445943 - RNA, 17 nt, Human
gauauguaaaacauuua

SEQ ID NO: 3445944 - RNA, 19 nt, Human
gauauguaaacauaauucu

SEQ ID NO: 3445945 - RNA, 20 nt, Human
gauauguaccuaacgaagua

SEQ ID NO: 3445946 - RNA, 17 nt, Human
gauauguauggguaggg

SEQ ID NO: 3445947 - RNA, 20 nt, Human
gauauguauucuuuucucag

SEQ ID NO: 3445948 - RNA, 17 nt, Human
gauaugugaaacaaugu

SEQ ID NO: 3445949 - RNA, 17 nt, Human
gauauuaaugcccagac

SEQ ID NO: 3445950 - RNA, 13 nt, Human
gauauuacuuuau

SEQ ID NO: 3445951 - RNA, 14 nt, Human
gauauuacuuuauc

SEQ ID NO: 3445952 - RNA, 15 nt, Human
gauauuacuuuauca

SEQ ID NO: 3445953 - RNA, 23 nt, Human
gauauuauuagaaauuagaaaaa

SEQ ID NO: 3445954 - RNA, 17 nt, Human
gauauucagaauuauga

SEQ ID NO: 3445955 - RNA, 14 nt, Human
gauauucagaugua

SEQ ID NO: 3445956 - RNA, 12 nt, Human
gauauucuaaga

SEQ ID NO: 3445957 - RNA, 21 nt, Human
gauauucuuuguuaauuugga

SEQ ID NO: 3445958 - RNA, 17 nt, Human
gauauugcugaagaauc

SEQ ID NO: 3445959 - RNA, 13 nt, Human
gauauuguacaua

SEQ ID NO: 3445960 - RNA, 16 nt, Human
gauauuguacauaaaa

SEQ ID NO: 3445961 - RNA, 18 nt, Human
gauauuguacauaaaaga

SEQ ID NO: 3445962 - RNA, 22 nt, Human
gauauugucagaguucugcucu

SEQ ID NO: 3445963 - RNA, 23 nt, Human
gauauuuauauuuuuauuuuauu

SEQ ID NO: 3445964 - RNA, 16 nt, Human
gauauuuccaucauua

SEQ ID NO: 3445965 - RNA, 18 nt, Human
gauauuugcaguuuuuca

SEQ ID NO: 3445966 - RNA, 20 nt, Human
gauauuugcaguuuuucauu

SEQ ID NO: 3445967 - RNA, 14 nt, Human
gauauuuggcuuaa

SEQ ID NO: 3445968 - RNA, 12 nt, Human
gauauuuucaaa

SEQ ID NO: 3445969 - RNA, 15 nt, Human
gauauuuucugugcc

SEQ ID NO: 3445970 - RNA, 15 nt, Human
gauauuuugcuuugu

SEQ ID NO: 3445971 - RNA, 16 nt, Human
gauauuuugcuuugug

SEQ ID NO: 3445972 - RNA, 17 nt, Human
gauauuuuguaaaaugu

SEQ ID NO: 3445973 - RNA, 20 nt, Human
gauauuuuguaaaauguauu

SEQ ID NO: 3445974 - RNA, 15 nt, Human
gauauuuuuuuaagu

SEQ ID NO: 3445975 - RNA, 16 nt, Human
gaucaaaaacuauuug

SEQ ID NO: 3445976 - RNA, 23 nt, Human
gaucaaaaaggcuuauaaaacag

SEQ ID NO: 3445977 - RNA, 23 nt, Human
gaucaaaagguuaauaaaguaau

SEQ ID NO: 3445978 - RNA, 17 nt, Human
gaucaaaauaaaaagug

SEQ ID NO: 3445979 - RNA, 22 nt, Human
gaucaaaccccgaccaccugcc

SEQ ID NO: 3445980 - RNA, 15 nt, Human
gaucaaagaugaaaa

SEQ ID NO: 3445981 - RNA, 18 nt, Human
gaucaaagaugaaaagua

SEQ ID NO: 3445982 - RNA, 14 nt, Human
gaucaaauacuuua

SEQ ID NO: 3445983 - RNA, 16 nt, Human
gaucaaauaguugcau

SEQ ID NO: 3445984 - RNA, 14 nt, Human
gaucaaauguuuaa

SEQ ID NO: 3445985 - RNA, 20 nt, Human
gaucaaauguuuaaucauau

SEQ ID NO: 3445986 - RNA, 18 nt, Human
gaucaaccagcuaagaaa

SEQ ID NO: 3445987 - RNA, 14 nt, Human
gaucaagcugugag

SEQ ID NO: 3445988 - RNA, 23 nt, Human
gaucaagucggaucuaguccagc

SEQ ID NO: 3445989 - RNA, 18 nt, Human
gaucaauaaaaugugauu

SEQ ID NO: 3445990 - RNA, 21 nt, Human
gaucaauaaaaugugauuuuu

SEQ ID NO: 3445991 - RNA, 13 nt, Human
gaucaaugaaaug

SEQ ID NO: 3445992 - RNA, 22 nt, Human
gaucaauggcgcagugccucug

SEQ ID NO: 3445993 - RNA, 16 nt, Human
gaucaauuaaauguag

SEQ ID NO: 3445994 - RNA, 16 nt, Human
gaucaauuauaguuuc

SEQ ID NO: 3445995 - RNA, 19 nt, Human
gaucaauuauaguuucuga

SEQ ID NO: 3445996 - RNA, 16 nt, Human
gaucacaaaugacuuu

SEQ ID NO: 3445997 - RNA, 21 nt, Human
gaucacaacgugcauugugcu

SEQ ID NO: 3445998 - RNA, 17 nt, Human
gaucacaagauggaauu

SEQ ID NO: 3445999 - RNA, 17 nt, Human
gaucacagagacauucc

SEQ ID NO: 3446000 - RNA, 13 nt, Human
gaucacagaggcu

SEQ ID NO: 3446001 - RNA, 20 nt, Human
gaucacagcugcuuucuguu

SEQ ID NO: 3446002 - RNA, 19 nt, Human
gaucacauaacagaaugca

SEQ ID NO: 3446003 - RNA, 14 nt, Human
gaucaccagcccgg

SEQ ID NO: 3446004 - RNA, 18 nt, Human
gaucaccagcccggccug

SEQ ID NO: 3446005 - RNA, 19 nt, Human
gaucaccauguauuuugua

SEQ ID NO: 3446006 - RNA, 16 nt, Human
gaucacgccacugcac

SEQ ID NO: 3446007 - RNA, 22 nt, Human
gaucacgcuccccgccuguucc

SEQ ID NO: 3446008 - RNA, 16 nt, Human
gaucacggcucacugc

SEQ ID NO: 3446009 - RNA, 12 nt, Human
gaucacuacugc

SEQ ID NO: 3446010 - RNA, 14 nt, Human
gaucacuacugcag

SEQ ID NO: 3446011 - RNA, 16 nt, Human
gaucacugaauuuaua

SEQ ID NO: 3446012 - RNA, 17 nt, Human
gaucacuggagcccagg

SEQ ID NO: 3446013 - RNA, 18 nt, Human
gaucacuggagcccagga

SEQ ID NO: 3446014 - RNA, 23 nt, Human
gaucacuuagcgaacccuuuauu

SEQ ID NO: 3446015 - RNA, 17 nt, Human
gaucacuuguuguuuua

SEQ ID NO: 3446016 - RNA, 22 nt, Human
gaucacuuucucaguuuucaua

SEQ ID NO: 3446017 - RNA, 20 nt, Human
gaucagaaaguaauuucuuc

SEQ ID NO: 3446018 - RNA, 20 nt, Human
gaucagaccaaacagugcug

SEQ ID NO: 3446019 - RNA, 15 nt, Human
gaucagagcaggacc

SEQ ID NO: 3446020 - RNA, 21 nt, Human
gaucagccccacccuggccua

SEQ ID NO: 3446021 - RNA, 13 nt, Human
gaucagcguggcc

SEQ ID NO: 3446022 - RNA, 17 nt, Human
gaucagcuguuugucau

SEQ ID NO: 3446023 - RNA, 13 nt, Human
gaucaggcacagg

SEQ ID NO: 3446024 - RNA, 14 nt, Human
gaucaggcucccag

SEQ ID NO: 3446025 - RNA, 11 nt, Human
gaucaggucau

SEQ ID NO: 3446026 - RNA, 22 nt, Human
gaucaguaguuugcauuucaga

SEQ ID NO: 3446027 - RNA, 19 nt, Human
gaucaguauuuaacuaauu

SEQ ID NO: 3446028 - RNA, 23 nt, Human
gaucagugggccuccaaggaggg

SEQ ID NO: 3446029 - RNA, 20 nt, Human
gaucaguguaccauuugccu

SEQ ID NO: 3446030 - RNA, 11 nt, Human
gaucaguguug

SEQ ID NO: 3446031 - RNA, 15 nt, Human
gaucauaaacugacu

SEQ ID NO: 3446032 - RNA, 19 nt, Human
gaucauaaaguuagaaucu

SEQ ID NO: 3446033 - RNA, 13 nt, Human
gaucauaaggcuu

SEQ ID NO: 3446034 - RNA, 22 nt, Human
gaucauagauuucugauuuuau

SEQ ID NO: 3446035 - RNA, 17 nt, Human
gaucauagguauuucaa

SEQ ID NO: 3446036 - RNA, 12 nt, Human
gaucauaguuuu

SEQ ID NO: 3446037 - RNA, 18 nt, Human
gaucauaguuuuauuuau

SEQ ID NO: 3446038 - RNA, 22 nt, Human
gaucauaguuuuauuuauauuu

SEQ ID NO: 3446039 - RNA, 19 nt, Human
gaucauauacgugaaaauu

SEQ ID NO: 3446040 - RNA, 21 nt, Human
gaucaucaacaagauuuccuu

SEQ ID NO: 3446041 - RNA, 13 nt, Human
gaucaucaugcag

SEQ ID NO: 3446042 - RNA, 21 nt, Human
gaucauccacugugccaugug

SEQ ID NO: 3446043 - RNA, 21 nt, Human
gaucauccuuuccagcaugag

SEQ ID NO: 3446044 - RNA, 14 nt, Human
gaucaucgccagag

SEQ ID NO: 3446045 - RNA, 23 nt, Human
gaucaucgucauuugcugugaac

SEQ ID NO: 3446046 - RNA, 19 nt, Human
gaucaugaaaguagacagu

SEQ ID NO: 3446047 - RNA, 12 nt, Human
gaucaugaauaa

SEQ ID NO: 3446048 - RNA, 10 nt, Human
gaucaugaga

SEQ ID NO: 3446049 - RNA, 20 nt, Human
gaucauggcucacugcagcc

SEQ ID NO: 3446050 - RNA, 18 nt, Human
gaucaugguguaauaaga

SEQ ID NO: 3446051 - RNA, 21 nt, Human
gaucaugguguaauaagacau

SEQ ID NO: 3446052 - RNA, 19 nt, Human
gaucauguacuuuuuagua

SEQ ID NO: 3446053 - RNA, 20 nt, Human
gaucauguacuuuuuaguaa

SEQ ID NO: 3446054 - RNA, 14 nt, Human
gaucauuaucagcc

SEQ ID NO: 3446055 - RNA, 15 nt, Human
gaucauuuucccccc

SEQ ID NO: 3446056 - RNA, 18 nt, Human
gaucauuuuccccccacu

SEQ ID NO: 3446057 - RNA, 23 nt, Human
gaucauuuucuuaucuucugcaa

SEQ ID NO: 3446058 - RNA, 20 nt, Human
gauccaaaagaagcccccag

SEQ ID NO: 3446059 - RNA, 22 nt, Human
gauccaaaagaagcccccagcu

SEQ ID NO: 3446060 - RNA, 16 nt, Human
cucuuuuauauuugua

SEQ ID NO: 3446061 - RNA, 23 nt, Human
cucuuuuauauuuguaggagaaa

SEQ ID NO: 3446062 - RNA, 17 nt, Human
cucuuuuaucuccugaa

SEQ ID NO: 3446063 - RNA, 16 nt, Human
cucuuuuccaaacaca

SEQ ID NO: 3446064 - RNA, 14 nt, Human
cucuuuucucugug

SEQ ID NO: 3446065 - RNA, 15 nt, Human
cucuuuucugcauca

SEQ ID NO: 3446066 - RNA, 20 nt, Human
cucuuuugaauccaugcuug

SEQ ID NO: 3446067 - RNA, 21 nt, Human
cucuuuugcuugccaaaguac

SEQ ID NO: 3446068 - RNA, 21 nt, Human
cucuuuugcuuuauuccagaa

SEQ ID NO: 3446069 - RNA, 14 nt, Human
cucuuuuguaaauu

SEQ ID NO: 3446070 - RNA, 19 nt, Human
cucuuuuguuaaauaauau

SEQ ID NO: 3446071 - RNA, 20 nt, Human
cucuuuuuagggccaggcag

SEQ ID NO: 3446072 - RNA, 21 nt, Human
cucuuuuuccaucauaauucu

SEQ ID NO: 3446073 - RNA, 15 nt, Human
gauucuguggaacaa

SEQ ID NO: 3446074 - RNA, 23 nt, Human
gauucuuauggacaaugacccag

SEQ ID NO: 3446075 - RNA, 23 nt, Human
gauucuuauguagcaggaaauaa

SEQ ID NO: 3446076 - RNA, 16 nt, Human
gauucuucaaaagcau

SEQ ID NO: 3446077 - RNA, 19 nt, Human
gauucuucccauucuccau

SEQ ID NO: 3446078 - RNA, 18 nt, Human
gauucuuccucccucccu

SEQ ID NO: 3446079 - RNA, 23 nt, Human
gauucuuggcccgcacagagcug

SEQ ID NO: 3446080 - RNA, 16 nt, Human
gauucuuguuuugcuu

SEQ ID NO: 3446081 - RNA, 15 nt, Human
gauucuuuagagaag

SEQ ID NO: 3446082 - RNA, 19 nt, Human
gauucuuuccauuaugauu

SEQ ID NO: 3446083 - RNA, 17 nt, Human
gauucuuuccauuugca

SEQ ID NO: 3446084 - RNA, 20 nt, Human
gauucuuucccaauucacau

SEQ ID NO: 3446085 - RNA, 16 nt, Human
gauucuuuccugaggc

SEQ ID NO: 3446086 - RNA, 19 nt, Human
gauucuuuccugaggcugg

SEQ ID NO: 3446087 - RNA, 20 nt, Human
gauucuuuuuaaaguguuuc

SEQ ID NO: 3446088 - RNA, 15 nt, Human
gauugaaaacuuuuc

SEQ ID NO: 3446089 - RNA, 14 nt, Human
gauugaaaaggaag

SEQ ID NO: 3446090 - RNA, 19 nt, Human
gauugaaaauguccaggaa

SEQ ID NO: 3446091 - RNA, 19 nt, Human
gauugacagcuuugcugcu

SEQ ID NO: 3446092 - RNA, 19 nt, Human
gauugacaguaacuugguu

SEQ ID NO: 3446093 - RNA, 15 nt, Human
gauugaccugcuccg

SEQ ID NO: 3446094 - RNA, 23 nt, Human
gauugacuaacucaaauacacau

SEQ ID NO: 3446095 - RNA, 19 nt, Human
gauugagaaggagagaaag

SEQ ID NO: 3446096 - RNA, 22 nt, Human
gauugaggccugcccucaggga

SEQ ID NO: 3446097 - RNA, 14 nt, Human
gauugagugagggc

SEQ ID NO: 3446098 - RNA, 19 nt, Human
gauugauaucuauaaaaua

SEQ ID NO: 3446099 - RNA, 17 nt, Human
gauugauuugaagaaca

SEQ ID NO: 3446100 - RNA, 20 nt, Human
gauugcaacaggcugggcuu

SEQ ID NO: 3446101 - RNA, 14 nt, Human
gauugcacauuguu

SEQ ID NO: 3446102 - RNA, 17 nt, Human
gauugcacguggccucu

SEQ ID NO: 3446103 - RNA, 20 nt, Human
gauugcacguggccucuuga

SEQ ID NO: 3446104 - RNA, 19 nt, Human
gauugcagaauuguuuaga

SEQ ID NO: 3446105 - RNA, 12 nt, Human
gauugcagcuuu

SEQ ID NO: 3446106 - RNA, 18 nt, Human
gauugcagcuuuauguuc

SEQ ID NO: 3446107 - RNA, 17 nt, Human
gauugcaugugacucug

SEQ ID NO: 3446108 - RNA, 22 nt, Human
gauugcauuagaaauagacagu

SEQ ID NO: 3446109 - RNA, 19 nt, Human
gauugccggucuugacagc

SEQ ID NO: 3446110 - RNA, 13 nt, Human
gauugccucugaa

SEQ ID NO: 3446111 - RNA, 21 nt, Human
gauugcgagagauguguguug

SEQ ID NO: 3446112 - RNA, 22 nt, Human
gauugcgagagauguguguuga

SEQ ID NO: 3446113 - RNA, 16 nt, Human
gauugcgcaaaacuga

SEQ ID NO: 3446114 - RNA, 14 nt, Human
gauugcuaaaugua

SEQ ID NO: 3446115 - RNA, 13 nt, Human
gauugcuaauugc

SEQ ID NO: 3446116 - RNA, 17 nt, Human
gauugcuaauugcuguu

SEQ ID NO: 3446117 - RNA, 21 nt, Human
gauugcuaauugcuguugaaa

SEQ ID NO: 3446118 - RNA, 18 nt, Human
gauugcugauaauaaauu

SEQ ID NO: 3446119 - RNA, 16 nt, Human
gauugcugccacuuuu

SEQ ID NO: 3446120 - RNA, 21 nt, Human
gauugcugccccaucagugcu

SEQ ID NO: 3446121 - RNA, 16 nt, Human
gauugcuugagcccag

SEQ ID NO: 3446122 - RNA, 18 nt, Human
gauugcuugagcucagga

SEQ ID NO: 3446123 - RNA, 18 nt, Human
gauugcuuuuaaaauuuu

SEQ ID NO: 3446124 - RNA, 20 nt, Human
gauuggaaggagacacagau

SEQ ID NO: 3446125 - RNA, 18 nt, Human
gaugugauuuaauagugu

SEQ ID NO: 3446126 - RNA, 24 nt, Human
gaugugauuuaauaguguuaauca

SEQ ID NO: 3446127 - RNA, 19 nt, Human
gaugugcaauugauuucuu

SEQ ID NO: 3446128 - RNA, 14 nt, Human
gaugugcacccaug

SEQ ID NO: 3446129 - RNA, 15 nt, Human
gaugugcagcagauu

SEQ ID NO: 3446130 - RNA, 23 nt, Human
gaugugcauuuuugugaaaugaa

SEQ ID NO: 3446131 - RNA, 12 nt, Human
gaugugccuaaa

SEQ ID NO: 3446132 - RNA, 13 nt, Human
gaugugcuuaaca

SEQ ID NO: 3446133 - RNA, 24 nt, Human
gauguggagcacaaaagccucuca

SEQ ID NO: 3446134 - RNA, 11 nt, Human
gauguggagcc

SEQ ID NO: 3446135 - RNA, 12 nt, Human
gauguggagcca

SEQ ID NO: 3446136 - RNA, 13 nt, Human
gauguggagccag

SEQ ID NO: 3446137 - RNA, 15 nt, Human
gauguggagccaggc

SEQ ID NO: 3446138 - RNA, 17 nt, Human
gauguggaguggggcag

SEQ ID NO: 3446139 - RNA, 12 nt, Human
gauguggcccug

SEQ ID NO: 3446140 - RNA, 23 nt, Human
gauguggcccuggcugccggcac

SEQ ID NO: 3446141 - RNA, 22 nt, Human
gaugugggagggagcagacagg

SEQ ID NO: 3446142 - RNA, 13 nt, Human
gaugugggcagcu

SEQ ID NO: 3446143 - RNA, 14 nt, Human
gaugugggcagcuu

SEQ ID NO: 3446144 - RNA, 19 nt, Human
gaugugggccaccauugca

SEQ ID NO: 3446145 - RNA, 16 nt, Human
gauguggguuccacag

SEQ ID NO: 3446146 - RNA, 18 nt, Human
gauguggguuccacagac

SEQ ID NO: 3446147 - RNA, 16 nt, Human
gauguggucacagcug

SEQ ID NO: 3446148 - RNA, 20 nt, Human
gauguggugccugaggucug

SEQ ID NO: 3446149 - RNA, 19 nt, Human
gauguguaauuuuucugua

SEQ ID NO: 3446150 - RNA, 13 nt, Human
gauguguccucag

SEQ ID NO: 3446151 - RNA, 11 nt, Human
gauguguccug

SEQ ID NO: 3446152 - RNA, 13 nt, Human
gauguguccugac

SEQ ID NO: 3446153 - RNA, 18 nt, Human
gauguguccugacacugc

SEQ ID NO: 3446154 - RNA, 21 nt, Human
gauguguccugauaagcugag

SEQ ID NO: 3446155 - RNA, 17 nt, Human
gaugugucuucaauuug

SEQ ID NO: 3446156 - RNA, 18 nt, Human
gauguguggacuguggca

SEQ ID NO: 3446157 - RNA, 22 nt, Human
gauguguguugauacuguugca

SEQ ID NO: 3446158 - RNA, 16 nt, Human
gauguguuugcuuucu

SEQ ID NO: 3446159 - RNA, 18 nt, Human
gauguguuugcuuucuga

SEQ ID NO: 3446160 - RNA, 11 nt, Human
gauguuaacac

SEQ ID NO: 3446161 - RNA, 14 nt, Human
gauguuaaccagaa

SEQ ID NO: 3446162 - RNA, 21 nt, Human
gauguuacaaguuuauauaua

SEQ ID NO: 3446163 - RNA, 20 nt, Human
gauguuacaucacaguguuu

SEQ ID NO: 3446164 - RNA, 17 nt, Human
gauguuacuccaaaacu

SEQ ID NO: 3446165 - RNA, 16 nt, Human
gauguuaggcugggcc

SEQ ID NO: 3446166 - RNA, 14 nt, Human
gauguuaguguuuu

SEQ ID NO: 3446167 - RNA, 16 nt, Human
gauguuaguuuuccuu

SEQ ID NO: 3446168 - RNA, 16 nt, Human
gauguuauauuuuucu

SEQ ID NO: 3446169 - RNA, 19 nt, Human
gauguucagcacugucccu

SEQ ID NO: 3446170 - RNA, 13 nt, Human
gauguucagugua

SEQ ID NO: 3446171 - RNA, 14 nt, Human
gauguucaguguaa

SEQ ID NO: 3446172 - RNA, 15 nt, Human
gauguucaguguaau

SEQ ID NO: 3446173 - RNA, 14 nt, Human
gauguucauuuaga

SEQ ID NO: 3446174 - RNA, 13 nt, Human
gauguucuaaggc

SEQ ID NO: 3446175 - RNA, 14 nt, Human
gauguucuaaggcu

SEQ ID NO: 3446176 - RNA, 23 nt, Human
gauguucuacuuuguucugcugu

SEQ ID NO: 3446177 - RNA, 15 nt, Human
gauguucucuaucau

SEQ ID NO: 3446178 - RNA, 21 nt, Human
gauguucucuaucauuuaaua

SEQ ID NO: 3446179 - RNA, 18 nt, Human
gauguucuggauaccauu

SEQ ID NO: 3446180 - RNA, 21 nt, Human
gauguucuuucacccuuuucu

SEQ ID NO: 3446181 - RNA, 21 nt, Human
gauguugaugcaauccuuaca

SEQ ID NO: 3446182 - RNA, 19 nt, Human
gauguugccauguguuuua

SEQ ID NO: 3446183 - RNA, 22 nt, Human
gauguuuaaaacaccuucuaua

SEQ ID NO: 3446184 - RNA, 18 nt, Human
gauguuuauucuucuaga

SEQ ID NO: 3446185 - RNA, 21 nt, Human
gauguuuauucuucuagaguu

SEQ ID NO: 3446186 - RNA, 20 nt, Human
gauguuucuuuuguauguaa

SEQ ID NO: 3446187 - RNA, 14 nt, Human
gauguuuguggccu

SEQ ID NO: 3446188 - RNA, 21 nt, Human
gauguuuuacgucugggagaa

SEQ ID NO: 3446189 - RNA, 13 nt, Human
gauguuuuuaaaa

SEQ ID NO: 3446190 - RNA, 22 nt, Human
gauguuuuuaaaaguuucaaug

SEQ ID NO: 3446191 - RNA, 15 nt, Human
gauguuuuuaaaauc

SEQ ID NO: 3446192 - RNA, 16 nt, Human
gauuaaacgugcagac

SEQ ID NO: 3446193 - RNA, 15 nt, Human
gauuaaacugaguga

SEQ ID NO: 3446194 - RNA, 15 nt, Human
gauuaaacuuaaucu

SEQ ID NO: 3446195 - RNA, 15 nt, Human
gauuaaacuuaugaa

SEQ ID NO: 3446196 - RNA, 20 nt, Human
gauuaaagaugagcuuuguc

SEQ ID NO: 3446197 - RNA, 18 nt, Human
gauuaaagcuaaggaccu

SEQ ID NO: 3446198 - RNA, 17 nt, Human
gauuaaauaagauucua

SEQ ID NO: 3446199 - RNA, 18 nt, Human
gauuaaauaagauucuaa

SEQ ID NO: 3446200 - RNA, 12 nt, Human
gauuaaauacau

SEQ ID NO: 3446201 - RNA, 13 nt, Human
gauuaaauacaua

SEQ ID NO: 3446202 - RNA, 23 nt, Human
gauuaaauauagauuagaaaaau

SEQ ID NO: 3446203 - RNA, 21 nt, Human
gauuaaaugacacucauauaa

SEQ ID NO: 3446204 - RNA, 12 nt, Human
gauuaaauucuu

SEQ ID NO: 3446205 - RNA, 16 nt, Human
gauuaacaaauaugcu

SEQ ID NO: 3446206 - RNA, 17 nt, Human
gauuaacuuauuuagag

SEQ ID NO: 3446207 - RNA, 22 nt, Human
gauuaagagauggguuugacaa

SEQ ID NO: 3446208 - RNA, 22 nt, Human
gauuaagaucucagugguuaag

SEQ ID NO: 3446209 - RNA, 12 nt, Human
gauuaagauuuu

SEQ ID NO: 3446210 - RNA, 18 nt, Human
gauuaagauuuuacaaaa

SEQ ID NO: 3446211 - RNA, 16 nt, Human
gauuaaggucucucuu

SEQ ID NO: 3446212 - RNA, 20 nt, Human
gauuaaggucucucuuugga

SEQ ID NO: 3446213 - RNA, 17 nt, Human
gauuaauagcauucgaa

SEQ ID NO: 3446214 - RNA, 15 nt, Human
gauuaauccagaaua

SEQ ID NO: 3446215 - RNA, 16 nt, Human
gauuacaaaucagaag

SEQ ID NO: 3446216 - RNA, 17 nt, Human
gauuacaaaucagaagu

SEQ ID NO: 3446217 - RNA, 23 nt, Human
gauuacaaaucagaagucaucuu

SEQ ID NO: 3446218 - RNA, 17 nt, Human
gcacagugguggcaggg

SEQ ID NO: 3446219 - RNA, 18 nt, Human
gcacagugguggcagggc

SEQ ID NO: 3446220 - RNA, 22 nt, Human
gcacagugguggcagggccuag

SEQ ID NO: 3446221 - RNA, 23 nt, Human
gcacagugucugggcugacuggg

SEQ ID NO: 3446222 - RNA, 17 nt, Human
gcacaguguuaaaugaa

SEQ ID NO: 3446223 - RNA, 15 nt, Human
gcacaguucaugguu

SEQ ID NO: 3446224 - RNA, 21 nt, Human
gcacaguugaagggaggggcu

SEQ ID NO: 3446225 - RNA, 12 nt, Human
gcacaguuugaa

SEQ ID NO: 3446226 - RNA, 14 nt, Human
gcacaguuugaaca

SEQ ID NO: 3446227 - RNA, 15 nt, Human
gcacaguuugaacaa

SEQ ID NO: 3446228 - RNA, 14 nt, Human
gcacaguuuucuga

SEQ ID NO: 3446229 - RNA, 17 nt, Human
gcacaguuuucugagaa

SEQ ID NO: 3446230 - RNA, 22 nt, Human
gcacaguuuucugagaaagacu

SEQ ID NO: 3446231 - RNA, 23 nt, Human
gcacauagaaaguaaauaaaagg

SEQ ID NO: 3446232 - RNA, 21 nt, Human
gcacauagcuaucaagugugc

SEQ ID NO: 3446233 - RNA, 14 nt, Human
gcacauauugagca

SEQ ID NO: 3446234 - RNA, 23 nt, Human
gcacaucagcacgauuucuguuu

SEQ ID NO: 3446235 - RNA, 21 nt, Human
gcacauccauucccaagaaau

SEQ ID NO: 3446236 - RNA, 17 nt, Human
gcacauccuaugcaaua

SEQ ID NO: 3446237 - RNA, 19 nt, Human
gcacaucucaacaggccuc

SEQ ID NO: 3446238 - RNA, 21 nt, Human
gcacaucucaacaggccucag

SEQ ID NO: 3446239 - RNA, 16 nt, Human
gcacaucucugcuuga

SEQ ID NO: 3446240 - RNA, 13 nt, Human
gcacaucugcauu

SEQ ID NO: 3446241 - RNA, 22 nt, Human
gcacaucuguaaaucuacacac

SEQ ID NO: 3446242 - RNA, 13 nt, Human
gcacaugaagaaa

SEQ ID NO: 3446243 - RNA, 15 nt, Human
gcacaugaagaaaua

SEQ ID NO: 3446244 - RNA, 13 nt, Human
gcacaugauuuca

SEQ ID NO: 3446245 - RNA, 19 nt, Human
gcacaugauuucacaaaua

SEQ ID NO: 3446246 - RNA, 17 nt, Human
gcacaugcaccuaccca

SEQ ID NO: 3446247 - RNA, 14 nt, Human
gcacaugccucucu

SEQ ID NO: 3446248 - RNA, 17 nt, Human
gcacaugccucucucag

SEQ ID NO: 3446249 - RNA, 23 nt, Human
gcacaugcugagucucccaaggc

SEQ ID NO: 3446250 - RNA, 16 nt, Human
gcacaugcuggccagc

SEQ ID NO: 3446251 - RNA, 15 nt, Human
gcacaugucuuaaug

SEQ ID NO: 3446252 - RNA, 20 nt, Human
gcacaugucuuguacaugug

SEQ ID NO: 3446253 - RNA, 14 nt, Human
gcacauuaaaugac

SEQ ID NO: 3446254 - RNA, 16 nt, Human
gcacauuaaaugacuc

SEQ ID NO: 3446255 - RNA, 21 nt, Human
gcacauuaaaugacucuuccc

SEQ ID NO: 3446256 - RNA, 17 nt, Human
gcacauuggaaagcaca

SEQ ID NO: 3446257 - RNA, 18 nt, Human
gcacauuguuguuuuuuu

SEQ ID NO: 3446258 - RNA, 19 nt, Human
gcacauuuccccagaccug

SEQ ID NO: 3446259 - RNA, 15 nt, Human
gcaccaaaagaagua

SEQ ID NO: 3446260 - RNA, 17 nt, Human
gcaccaaaauaagaaaa

SEQ ID NO: 3446261 - RNA, 19 nt, Human
gcaccaaaauaagaaaaga

SEQ ID NO: 3446262 - RNA, 20 nt, Human
gcaccaaaauaagaaaagau

SEQ ID NO: 3446263 - RNA, 19 nt, Human
gcaccaaagaugcagccgc

SEQ ID NO: 3446264 - RNA, 21 nt, Human
gcaccaaagaugcagccgccu

SEQ ID NO: 3446265 - RNA, 22 nt, Human
gcaccaaaucaaaaucucucca

SEQ ID NO: 3446266 - RNA, 14 nt, Human
gcaccaacccagcc

SEQ ID NO: 3446267 - RNA, 16 nt, Human
gcaccaagcccacagg

SEQ ID NO: 3446268 - RNA, 21 nt, Human
gcaccaaggaaaaagcagaga

SEQ ID NO: 3446269 - RNA, 15 nt, Human
gcaccacaaaauaua

SEQ ID NO: 3446270 - RNA, 13 nt, Human
gcaccaccaagcc

SEQ ID NO: 3446271 - RNA, 16 nt, Human
gcaccaccaggucucc

SEQ ID NO: 3446272 - RNA, 19 nt, Human
gcaccaccaugccaggcua

SEQ ID NO: 3446273 - RNA, 22 nt, Human
gcaccacccuagucccuucccc

SEQ ID NO: 3446274 - RNA, 22 nt, Human
gcaccaccgagagaggcuggga

SEQ ID NO: 3446275 - RNA, 15 nt, Human
gcaccacgggcccgg

SEQ ID NO: 3446276 - RNA, 18 nt, Human
gcaccacucaagaccaaa

SEQ ID NO: 3446277 - RNA, 16 nt, Human
gcaccagacacccagg

SEQ ID NO: 3446278 - RNA, 18 nt, Human
gcaccagacacccaggac

SEQ ID NO: 3446279 - RNA, 21 nt, Human
gcaccagaggcugcagaaggc

SEQ ID NO: 3446280 - RNA, 13 nt, Human
gcaccagccagcg

SEQ ID NO: 3446281 - RNA, 19 nt, Human
gcaccagccagcguagcag

SEQ ID NO: 3446282 - RNA, 17 nt, Human
gcaccagcgaagggagu

SEQ ID NO: 3446283 - RNA, 20 nt, Human
gcaccagcuucuccaggcuc

SEQ ID NO: 3446284 - RNA, 13 nt, Human
gcaccaggaagcc

SEQ ID NO: 3446285 - RNA, 14 nt, Human
gcaccaggaagccg

SEQ ID NO: 3446286 - RNA, 13 nt, Human
gcaccaggagaca

SEQ ID NO: 3446287 - RNA, 23 nt, Human
gcaccaggcacgaacccaccugc

SEQ ID NO: 3446288 - RNA, 18 nt, Human
gcaccaggcgcugcccac

SEQ ID NO: 3446289 - RNA, 20 nt, Human
gcaccagggacuaugaaugg

SEQ ID NO: 3446290 - RNA, 18 nt, Human
gcaccagggguuucucgc

SEQ ID NO: 3446291 - RNA, 13 nt, Human
gcaccauccccuc

SEQ ID NO: 3446292 - RNA, 14 nt, Human
gcaccauccccucc

SEQ ID NO: 3446293 - RNA, 21 nt, Human
gcaccaucccuuuuugaagug

SEQ ID NO: 3446294 - RNA, 13 nt, Human
gcaccauccgcca

SEQ ID NO: 3446295 - RNA, 18 nt, Human
gcaccauccgccagggcc

SEQ ID NO: 3446296 - RNA, 16 nt, Human
gcaccaugcugcuggg

SEQ ID NO: 3446297 - RNA, 23 nt, Human
gcaccaugcugcuggggaagaca

SEQ ID NO: 3446298 - RNA, 22 nt, Human
gcaccauucaggaaccuggacc

SEQ ID NO: 3446299 - RNA, 14 nt, Human
gcaccauugcugcu

SEQ ID NO: 3446300 - RNA, 22 nt, Human
gcaccauugcugcuccuuagcu

SEQ ID NO: 3446301 - RNA, 22 nt, Human
gcacccacccagcacccagcaa

SEQ ID NO: 3446302 - RNA, 13 nt, Human
gcacccacccugg

SEQ ID NO: 3446303 - RNA, 20 nt, Human
gcacccaccguggaggagga

SEQ ID NO: 3446304 - RNA, 20 nt, Human
gcacccaggaggggaacacu

SEQ ID NO: 3446305 - RNA, 17 nt, Human
gcacccagugagcacuc

SEQ ID NO: 3446306 - RNA, 16 nt, Human
gcacccauccuagaga

SEQ ID NO: 3446307 - RNA, 23 nt, Human
gcacccauuaugcgcuguggcca

SEQ ID NO: 3446308 - RNA, 13 nt, Human
gcacccccacccu

SEQ ID NO: 3446309 - RNA, 20 nt, Human
gcacccccagccugggccua

SEQ ID NO: 3446310 - RNA, 17 nt, Human
gcaccccccuguucuaa

SEQ ID NO: 3446311 - RNA, 21 nt, Human
gcaccccccuguucuaagggg

SEQ ID NO: 3446312 - RNA, 15 nt, Human
gcacccccuccugcu

SEQ ID NO: 3446313 - RNA, 17 nt, Human
gcacccccuccugcugc

SEQ ID NO: 3446314 - RNA, 19 nt, Human
gcacccccuccugcugcag

SEQ ID NO: 3446315 - RNA, 14 nt, Human
gcacccccuggaga

SEQ ID NO: 3446316 - RNA, 14 nt, Human
gcaccccgcugcgg

SEQ ID NO: 3446317 - RNA, 23 nt, Human
gcaccccuuccugggcacacgcu

SEQ ID NO: 3446318 - RNA, 13 nt, Human
gcaccccuucucu

SEQ ID NO: 3446319 - RNA, 19 nt, Human
gcaccccuucucuccuccc

SEQ ID NO: 3446320 - RNA, 22 nt, Human
gcaccccuucucuccuccccaa

SEQ ID NO: 3446321 - RNA, 13 nt, Human
gcacccgccucuc

SEQ ID NO: 3446322 - RNA, 18 nt, Human
gcacccggccccugcugg

SEQ ID NO: 3446323 - RNA, 16 nt, Human
gcacccgggcucaggg

SEQ ID NO: 3446324 - RNA, 13 nt, Human
gcacccuauaaau

SEQ ID NO: 3446325 - RNA, 15 nt, Human
gcacccucaggcagg

SEQ ID NO: 3446326 - RNA, 15 nt, Human
gcacccuccccuccc

SEQ ID NO: 3446327 - RNA, 11 nt, Human
gcacccugagg

SEQ ID NO: 3446328 - RNA, 17 nt, Human
gcacccuggggccugga

SEQ ID NO: 3446329 - RNA, 20 nt, Human
gcacccuggggccuggaccu

SEQ ID NO: 3446330 - RNA, 18 nt, Human
gcacccuucuuuccucuu

SEQ ID NO: 3446331 - RNA, 21 nt, Human
gcacccuucuuuccucuuccc

SEQ ID NO: 3446332 - RNA, 19 nt, Human
cugcacaagccagggugug

SEQ ID NO: 3446333 - RNA, 13 nt, Human
cugcacaagcugc

SEQ ID NO: 3446334 - RNA, 14 nt, Human
cugcacaagcugca

SEQ ID NO: 3446335 - RNA, 22 nt, Human
cugcacaagcugcacccucagg

SEQ ID NO: 3446336 - RNA, 21 nt, Human
cugcacaauaacuccucccag

SEQ ID NO: 3446337 - RNA, 23 nt, Human
cugcacaauaacuccucccaggg

SEQ ID NO: 3446338 - RNA, 11 nt, Human
cugcacacaag

SEQ ID NO: 3446339 - RNA, 22 nt, Human
cugcacacaagcccacagcaca

SEQ ID NO: 3446340 - RNA, 19 nt, Human
cugcacacaccucagaggc

SEQ ID NO: 3446341 - RNA, 20 nt, Human
cugcacacaccucagaggcu

SEQ ID NO: 3446342 - RNA, 18 nt, Human
cugcacacccuccagaga

SEQ ID NO: 3446343 - RNA, 20 nt, Human
cugcacacgcuccuuccucu

SEQ ID NO: 3446344 - RNA, 11 nt, Human
cugcacagagc

SEQ ID NO: 3446345 - RNA, 14 nt, Human
cugcacagagcucu

SEQ ID NO: 3446346 - RNA, 18 nt, Human
cugcacagggcagcuggg

SEQ ID NO: 3446347 - RNA, 20 nt, Human
cugcacagggcagcugggcc

SEQ ID NO: 3446348 - RNA, 22 nt, Human
cugcacagggcagcugggccca

SEQ ID NO: 3446349 - RNA, 16 nt, Human
cugcacagugacuucu

SEQ ID NO: 3446350 - RNA, 18 nt, Human
cugcacaguuuucuggcu

SEQ ID NO: 3446351 - RNA, 21 nt, Human
cugcacaguuuucuggcugga

SEQ ID NO: 3446352 - RNA, 22 nt, Human
cugcacaugaaucccacccaca

SEQ ID NO: 3446353 - RNA, 22 nt, Human
cugcacaugacucggggguggg

SEQ ID NO: 3446354 - RNA, 21 nt, Human
cugcacaugauuucacaaaua

SEQ ID NO: 3446355 - RNA, 20 nt, Human
cugcacaugcagcugcaccc

SEQ ID NO: 3446356 - RNA, 21 nt, Human
cugcacauuaaggagaaaucu

SEQ ID NO: 3446357 - RNA, 13 nt, Human
cugcaccaaccca

SEQ ID NO: 3446358 - RNA, 12 nt, Human
cugcaccagagc

SEQ ID NO: 3446359 - RNA, 13 nt, Human
cugcaccagagca

SEQ ID NO: 3446360 - RNA, 12 nt, Human
cugcacccagga

SEQ ID NO: 3446361 - RNA, 15 nt, Human
cugcacccaggaggg

SEQ ID NO: 3446362 - RNA, 15 nt, Human
gcaccuaauccaggc

SEQ ID NO: 3446363 - RNA, 18 nt, Human
gcaccuaauccaggcaga

SEQ ID NO: 3446364 - RNA, 23 nt, Human
gcaccuaauccaggcagauccag

SEQ ID NO: 3446365 - RNA, 18 nt, Human
gcaccuacaguguacagu

SEQ ID NO: 3446366 - RNA, 18 nt, Human
gcaccuaccaccacgccc

SEQ ID NO: 3446367 - RNA, 15 nt, Human
gcaccuaccaucagg

SEQ ID NO: 3446368 - RNA, 20 nt, Human
gcaccuaccaucagggacag

SEQ ID NO: 3446369 - RNA, 23 nt, Human
gcaccuacuacaucgcccuccac

SEQ ID NO: 3446370 - RNA, 14 nt, Human
gcaccuacuuacau

SEQ ID NO: 3446371 - RNA, 21 nt, Human
gcaccuauagucccagcuacu

SEQ ID NO: 3446372 - RNA, 15 nt, Human
gcaccuccagccuga

SEQ ID NO: 3446373 - RNA, 13 nt, Human
gcaccuccaggcc

SEQ ID NO: 3446374 - RNA, 15 nt, Human
gcaccuccaggccug

SEQ ID NO: 3446375 - RNA, 20 nt, Human
gcaccuccaggccuguugcu

SEQ ID NO: 3446376 - RNA, 12 nt, Human
gcaccucccagc

SEQ ID NO: 3446377 - RNA, 14 nt, Human
gcaccucccagccc

SEQ ID NO: 3446378 - RNA, 19 nt, Human
gcaccuccccccacugcag

SEQ ID NO: 3446379 - RNA, 15 nt, Human
gcaccuccucagccu

SEQ ID NO: 3446380 - RNA, 12 nt, Human
gcaccuccugcc

SEQ ID NO: 3446381 - RNA, 19 nt, Human
gcaccugcaaucccagcua

SEQ ID NO: 3446382 - RNA, 20 nt, Human
gcaccugcagguugggccau

SEQ ID NO: 3446383 - RNA, 21 nt, Human
gcaccugcagguugggccaua

SEQ ID NO: 3446384 - RNA, 22 nt, Human
gcaccugcauccguaguucccu

SEQ ID NO: 3446385 - RNA, 17 nt, Human
gcaccugccagccuggc

SEQ ID NO: 3446386 - RNA, 22 nt, Human
gcaccugccagccuggcuucug

SEQ ID NO: 3446387 - RNA, 22 nt, Human
gcaccugcccccugguggacag

SEQ ID NO: 3446388 - RNA, 19 nt, Human
gcaccugccgaccucgucc

SEQ ID NO: 3446389 - RNA, 13 nt, Human
gcaccugccucag

SEQ ID NO: 3446390 - RNA, 14 nt, Human
gcaccugccucagg

SEQ ID NO: 3446391 - RNA, 22 nt, Human
gcaccuggaauauauaaccagu

SEQ ID NO: 3446392 - RNA, 18 nt, Human
gcaccuggcaucgcacca

SEQ ID NO: 3446393 - RNA, 17 nt, Human
gcaccugggcccugggg

SEQ ID NO: 3446394 - RNA, 18 nt, Human
gcaccugggcccuggggc

SEQ ID NO: 3446395 - RNA, 22 nt, Human
gcaccugggcccuggggccugu

SEQ ID NO: 3446396 - RNA, 23 nt, Human
gcaccugggcccuggggccugua

SEQ ID NO: 3446397 - RNA, 17 nt, Human
gcaccuggggaguggga

SEQ ID NO: 3446398 - RNA, 22 nt, Human
gcaccugguggccaugcuccuc

SEQ ID NO: 3446399 - RNA, 18 nt, Human
gcaccuguaaugugcgag

SEQ ID NO: 3446400 - RNA, 20 nt, Human
gcaccuguccccacccucca

SEQ ID NO: 3446401 - RNA, 21 nt, Human
gcaccuguccccacccuccac

SEQ ID NO: 3446402 - RNA, 19 nt, Human
gcaccugucgcccagugcc

SEQ ID NO: 3446403 - RNA, 14 nt, Human
gcaccugucugcuc

SEQ ID NO: 3446404 - RNA, 14 nt, Human
gcaccuuagacagu

SEQ ID NO: 3446405 - RNA, 13 nt, Human
gcaccuuaguggc

SEQ ID NO: 3446406 - RNA, 14 nt, Human
gcaccuucccccuc

SEQ ID NO: 3446407 - RNA, 19 nt, Human
gcaccuugugccuggggug

SEQ ID NO: 3446408 - RNA, 20 nt, Human
gcaccuugugucuguacacg

SEQ ID NO: 3446409 - RNA, 22 nt, Human
gcaccuuuccuucaagccagca

SEQ ID NO: 3446410 - RNA, 19 nt, Human
gcaccuuugcacaggaugc

SEQ ID NO: 3446411 - RNA, 14 nt, Human
gcaccuuuuacugu

SEQ ID NO: 3446412 - RNA, 17 nt, Human
gcacgaacccaccugcu

SEQ ID NO: 3446413 - RNA, 23 nt, Human
gcacgaacccaccugcugagaga

SEQ ID NO: 3446414 - RNA, 13 nt, Human
gcacgacagugga

SEQ ID NO: 3446415 - RNA, 13 nt, Human
gcacgauuucugu

SEQ ID NO: 3446416 - RNA, 14 nt, Human
gcacgcacacacac

SEQ ID NO: 3446417 - RNA, 15 nt, Human
gcacgcacacacaca

SEQ ID NO: 3446418 - RNA, 16 nt, Human
gcacgcacacugucug

SEQ ID NO: 3446419 - RNA, 12 nt, Human
gcacggacaaua

SEQ ID NO: 3446420 - RNA, 17 nt, Human
gcacggacaauaaaccu

SEQ ID NO: 3446421 - RNA, 16 nt, Human
gcacggcagccacagc

SEQ ID NO: 3446422 - RNA, 20 nt, Human
gcacggcucuguccccagcc

SEQ ID NO: 3446423 - RNA, 12 nt, Human
gcacggcugcug

SEQ ID NO: 3446424 - RNA, 18 nt, Human
gcacguaaaguacuugua

SEQ ID NO: 3446425 - RNA, 16 nt, Human
gcacguaguaggguca

SEQ ID NO: 3446426 - RNA, 14 nt, Human
gcacguauuuuaau

SEQ ID NO: 3446427 - RNA, 13 nt, Human
gcacgucauggga

SEQ ID NO: 3446428 - RNA, 13 nt, Human
gcacgugcacaaa

SEQ ID NO: 3446429 - RNA, 20 nt, Human
gcacguggagagcuggugcc

SEQ ID NO: 3446430 - RNA, 14 nt, Human
gcacguggccucuu

SEQ ID NO: 3446431 - RNA, 14 nt, Human
gcacguguguuuuu

SEQ ID NO: 3446432 - RNA, 18 nt, Human
gcacguguguuuuucuau

SEQ ID NO: 3446433 - RNA, 19 nt, Human
gcacguguguuuuucuauu

SEQ ID NO: 3446434 - RNA, 15 nt, Human
gcacguuuaaaguuc

SEQ ID NO: 3446435 - RNA, 17 nt, Human
gcacuaaagccagccug

SEQ ID NO: 3446436 - RNA, 21 nt, Human
gcacuaaagccagccugaccu

SEQ ID NO: 3446437 - RNA, 23 nt, Human
gcacuaaagccagccugaccuuc

SEQ ID NO: 3446438 - RNA, 19 nt, Human
gcacuaaaguauguaaagu

SEQ ID NO: 3446439 - RNA, 19 nt, Human
gcacuaaggugugcucuga

SEQ ID NO: 3446440 - RNA, 20 nt, Human
gcacuaagucucuuuuuuac

SEQ ID NO: 3446441 - RNA, 17 nt, Human
gcacuacaccuugccuu

SEQ ID NO: 3446442 - RNA, 13 nt, Human
gcacuacaugugg

SEQ ID NO: 3446443 - RNA, 20 nt, Human
gcacuaccacuccugccaag

SEQ ID NO: 3446444 - RNA, 21 nt, Human
gcacuaccacuccugccaagg

SEQ ID NO: 3446445 - RNA, 13 nt, Human
gcacuacuccucu

SEQ ID NO: 3446446 - RNA, 17 nt, Human
gcacuacugggugucau

SEQ ID NO: 3446447 - RNA, 16 nt, Human
gcacuagagaaugcac

SEQ ID NO: 3446448 - RNA, 20 nt, Human
gcacuagagaaugcacagau

SEQ ID NO: 3446449 - RNA, 13 nt, Human
gcacuagccuuug

SEQ ID NO: 3446450 - RNA, 15 nt, Human
gcacuagccuuuggc

SEQ ID NO: 3446451 - RNA, 21 nt, Human
gcacuagccuuuggcucugga

SEQ ID NO: 3446452 - RNA, 21 nt, Human
gcacuaggggauauaggagag

SEQ ID NO: 3446453 - RNA, 14 nt, Human
gcacuauaauguaa

SEQ ID NO: 3446454 - RNA, 20 nt, Human
gcacuauaauguaagcucua

SEQ ID NO: 3446455 - RNA, 22 nt, Human
gcacuauagccuaggugacaga

SEQ ID NO: 3446456 - RNA, 18 nt, Human
gcacuauauacaucacgu

SEQ ID NO: 3446457 - RNA, 19 nt, Human
gcacuaucuuucagcucca

SEQ ID NO: 3446458 - RNA, 18 nt, Human
gcacuauuuauuuacaaa

SEQ ID NO: 3446459 - RNA, 21 nt, Human
gcacucaaaucuuaagaaaua

SEQ ID NO: 3446460 - RNA, 19 nt, Human
gcacucaaccuuaagaccu

SEQ ID NO: 3446461 - RNA, 23 nt, Human
gcacucacacaggacccccuucc

SEQ ID NO: 3446462 - RNA, 17 nt, Human
gcacucacagaccugga

SEQ ID NO: 3446463 - RNA, 19 nt, Human
gcacucacagaccuggagc

SEQ ID NO: 3446464 - RNA, 13 nt, Human
gcacucacaugcu

SEQ ID NO: 3446465 - RNA, 17 nt, Human
gcacucacccaugugcc

SEQ ID NO: 3446466 - RNA, 13 nt, Human
gcacucagaagac

SEQ ID NO: 3446467 - RNA, 23 nt, Human
gcacuccaaccuaaccugugucu

SEQ ID NO: 3446468 - RNA, 12 nt, Human
gcacuccagccu

SEQ ID NO: 3446469 - RNA, 14 nt, Human
gcacuccagccugg

SEQ ID NO: 3446470 - RNA, 17 nt, Human
gcacuccagccugggug

SEQ ID NO: 3446471 - RNA, 21 nt, Human
gcacuccaugcuuagucacug

SEQ ID NO: 3446472 - RNA, 15 nt, Human
gcacuccccugcugg

SEQ ID NO: 3446473 - RNA, 17 nt, Human
gcacuccccugcugggu

SEQ ID NO: 3446474 - RNA, 22 nt, Human
gcacuccccugcuggguguggc

SEQ ID NO: 3446475 - RNA, 16 nt, Human
gcacucccuccagcac

SEQ ID NO: 3446476 - RNA, 17 nt, Human
gcacuccggccugauga

SEQ ID NO: 3446477 - RNA, 20 nt, Human
gcacuccucgguacucccau

SEQ ID NO: 3446478 - RNA, 21 nt, Human
gcacucgugugcaacagacaa

SEQ ID NO: 3446479 - RNA, 22 nt, Human
gcacucuggaugauggauucca

SEQ ID NO: 3446480 - RNA, 12 nt, Human
gcacucugugcc

SEQ ID NO: 3446481 - RNA, 20 nt, Human
gcacucugugcccaugggca

SEQ ID NO: 3446482 - RNA, 15 nt, Human
gcacucuuaaagcaa

SEQ ID NO: 3446483 - RNA, 16 nt, Human
gcacucuuaagcuucc

SEQ ID NO: 3446484 - RNA, 17 nt, Human
gcacugaaaaaaaaucu

SEQ ID NO: 3446485 - RNA, 20 nt, Human
gcacugaaaauaccaucagg

SEQ ID NO: 3446486 - RNA, 9 nt, Human
gcacugaag

SEQ ID NO: 3446487 - RNA, 12 nt, Human
gcacugacagau

SEQ ID NO: 3446488 - RNA, 17 nt, Human
gcacugacccuuccaga

SEQ ID NO: 3446489 - RNA, 14 nt, Human
gcacugacucugga

SEQ ID NO: 3446490 - RNA, 16 nt, Human
gcacugacugggcaua

SEQ ID NO: 3446491 - RNA, 18 nt, Human
gcacugacuucuaaguaa

SEQ ID NO: 3446492 - RNA, 19 nt, Human
gcacugagagagcgcagcc

SEQ ID NO: 3446493 - RNA, 18 nt, Human
cugcagccuuugccuccc

SEQ ID NO: 3446494 - RNA, 20 nt, Human
cugcagcggccacacuguac

SEQ ID NO: 3446495 - RNA, 17 nt, Human
cugcagcucacccagcc

SEQ ID NO: 3446496 - RNA, 13 nt, Human
cugcagcucccuc

SEQ ID NO: 3446497 - RNA, 14 nt, Human
cugcagcucccuca

SEQ ID NO: 3446498 - RNA, 18 nt, Human
cugcagcucucaugcugc

SEQ ID NO: 3446499 - RNA, 13 nt, Human
cugcagcugaccu

SEQ ID NO: 3446500 - RNA, 15 nt, Human
cugcagcuggacaga

SEQ ID NO: 3446501 - RNA, 17 nt, Human
cugcagcuggacagagg

SEQ ID NO: 3446502 - RNA, 19 nt, Human
cugcagcuggacagagggg

SEQ ID NO: 3446503 - RNA, 13 nt, Human
cugcagcugggcu

SEQ ID NO: 3446504 - RNA, 14 nt, Human
cugcagcugggcug

SEQ ID NO: 3446505 - RNA, 11 nt, Human
cugcagcuucc

SEQ ID NO: 3446506 - RNA, 12 nt, Human
cugcagcuuccu

SEQ ID NO: 3446507 - RNA, 15 nt, Human
cugcccugcccaccu

SEQ ID NO: 3446508 - RNA, 17 nt, Human
cugcccugcccaccugg

SEQ ID NO: 3446509 - RNA, 18 nt, Human
cugcccugcccuagcucc

SEQ ID NO: 3446510 - RNA, 15 nt, Human
cugcccugccugagg

SEQ ID NO: 3446511 - RNA, 22 nt, Human
cugcccugcugagucccaggcu

SEQ ID NO: 3446512 - RNA, 21 nt, Human
cugcccugcugccgccuccca

SEQ ID NO: 3446513 - RNA, 22 nt, Human
cugcccuggaacauccuuugca

SEQ ID NO: 3446514 - RNA, 16 nt, Human
cugcccuggcccugag

SEQ ID NO: 3446515 - RNA, 17 nt, Human
cugcccuggcccugagg

SEQ ID NO: 3446516 - RNA, 22 nt, Human
cugcccuggcccugaggugugg

SEQ ID NO: 3446517 - RNA, 12 nt, Human
cugcccuggcug

SEQ ID NO: 3446518 - RNA, 17 nt, Human
cugcccuggcugcugcc

SEQ ID NO: 3446519 - RNA, 15 nt, Human
cugcccugggaggca

SEQ ID NO: 3446520 - RNA, 18 nt, Human
cugcccuggugcugccac

SEQ ID NO: 3446521 - RNA, 17 nt, Human
cugcccugguuuccugc

SEQ ID NO: 3446522 - RNA, 20 nt, Human
cugcccugguuuccugcccu

SEQ ID NO: 3446523 - RNA, 22 nt, Human
cugcccugguuuccugcccugg

SEQ ID NO: 3446524 - RNA, 12 nt, Human
cugcccugucua

SEQ ID NO: 3446525 - RNA, 12 nt, Human
cugcccugugag

SEQ ID NO: 3446526 - RNA, 20 nt, Human
cugcccugugggaccccagg

SEQ ID NO: 3446527 - RNA, 21 nt, Human
cugcccugugggaccccaggc

SEQ ID NO: 3446528 - RNA, 12 nt, Human
cugcccuuaccu

SEQ ID NO: 3446529 - RNA, 16 nt, Human
cugcccuuaccugcca

SEQ ID NO: 3446530 - RNA, 15 nt, Human
cugcccuuaggccac

SEQ ID NO: 3446531 - RNA, 22 nt, Human
cugcccuuccucaguuuaaucc

SEQ ID NO: 3446532 - RNA, 16 nt, Human
cugcccuugaucagcc

SEQ ID NO: 3446533 - RNA, 17 nt, Human
cugcccuugaucagccc

SEQ ID NO: 3446534 - RNA, 12 nt, Human
cugcccuugggc

SEQ ID NO: 3446535 - RNA, 15 nt, Human
cugcccuugucccac

SEQ ID NO: 3446536 - RNA, 16 nt, Human
cugcccuugucugaga

SEQ ID NO: 3446537 - RNA, 21 nt, Human
cugcccuuucugggcaccggg

SEQ ID NO: 3446538 - RNA, 23 nt, Human
cugcccuuuguccuccugcugcc

SEQ ID NO: 3446539 - RNA, 15 nt, Human
cugcccuuuuuucug

SEQ ID NO: 3446540 - RNA, 19 nt, Human
cugcccuuuuuucugccuc

SEQ ID NO: 3446541 - RNA, 20 nt, Human
cugcccuuuuuucugccucc

SEQ ID NO: 3446542 - RNA, 15 nt, Human
cugccgaccagagcc

SEQ ID NO: 3446543 - RNA, 19 nt, Human
cugccgacuccuggguuga

SEQ ID NO: 3446544 - RNA, 18 nt, Human
cugccgcaauacaggaac

SEQ ID NO: 3446545 - RNA, 17 nt, Human
cugccgcaccccagagu

SEQ ID NO: 3446546 - RNA, 14 nt, Human
cugccgcagagcug

SEQ ID NO: 3446547 - RNA, 16 nt, Human
cugccgcagagcuggc

SEQ ID NO: 3446548 - RNA, 20 nt, Human
cugccgcagcccugcagagg

SEQ ID NO: 3446549 - RNA, 15 nt, Human
cugccgccucccagc

SEQ ID NO: 3446550 - RNA, 14 nt, Human
gcagcaccugcccu

SEQ ID NO: 3446551 - RNA, 15 nt, Human
gcagcacggacaaua

SEQ ID NO: 3446552 - RNA, 19 nt, Human
gcagcacucacacaggacc

SEQ ID NO: 3446553 - RNA, 12 nt, Human
gcagcagaaggg

SEQ ID NO: 3446554 - RNA, 22 nt, Human
gcagcagaaggggguggugucu

SEQ ID NO: 3446555 - RNA, 13 nt, Human
gcagcagacacau

SEQ ID NO: 3446556 - RNA, 20 nt, Human
gcagcagauuggaaggagac

SEQ ID NO: 3446557 - RNA, 13 nt, Human
gcagcagcagccc

SEQ ID NO: 3446558 - RNA, 13 nt, Human
gcagcagccagcc

SEQ ID NO: 3446559 - RNA, 15 nt, Human
gcagcagccagcccu

SEQ ID NO: 3446560 - RNA, 16 nt, Human
gcagcagccagcccug

SEQ ID NO: 3446561 - RNA, 21 nt, Human
gcagcagccagcccugccugg

SEQ ID NO: 3446562 - RNA, 14 nt, Human
gcagcagcccaagc

SEQ ID NO: 3446563 - RNA, 20 nt, Human
gcagcagcccaagcuucccu

SEQ ID NO: 3446564 - RNA, 22 nt, Human
gcagcagccucgccccuggcag

SEQ ID NO: 3446565 - RNA, 12 nt, Human
gcagcagcuugc

SEQ ID NO: 3446566 - RNA, 16 nt, Human
gcagcaggaggccagg

SEQ ID NO: 3446567 - RNA, 14 nt, Human
gcagcaggaggggg

SEQ ID NO: 3446568 - RNA, 14 nt, Human
gcagcaggccuguu

SEQ ID NO: 3446569 - RNA, 15 nt, Human
gcagcagggaugccc

SEQ ID NO: 3446570 - RNA, 17 nt, Human
gcagcagggaugcccug

SEQ ID NO: 3446571 - RNA, 20 nt, Human
gcagcagggaugcccuggag

SEQ ID NO: 3446572 - RNA, 18 nt, Human
gcagcagguagccugcug

SEQ ID NO: 3446573 - RNA, 21 nt, Human
gcagcaggugauuggaccagg

SEQ ID NO: 3446574 - RNA, 12 nt, Human
gcagcaggugcu

SEQ ID NO: 3446575 - RNA, 13 nt, Human
gcagcaggugcug

SEQ ID NO: 3446576 - RNA, 14 nt, Human
gcagcagugaaaac

SEQ ID NO: 3446577 - RNA, 17 nt, Human
gcagcagugagucucuu

SEQ ID NO: 3446578 - RNA, 21 nt, Human
gcagcagugagucucuucaga

SEQ ID NO: 3446579 - RNA, 15 nt, Human
gcagcagugugaggc

SEQ ID NO: 3446580 - RNA, 20 nt, Human
gcagcagugugaggccaggg

SEQ ID NO: 3446581 - RNA, 15 nt, Human
gcagcauaaaggccu

SEQ ID NO: 3446582 - RNA, 14 nt, Human
gcagcauaugagga

SEQ ID NO: 3446583 - RNA, 23 nt, Human
gcagcaucggacaagacccccag

SEQ ID NO: 3446584 - RNA, 14 nt, Human
gcagcaucucuacc

SEQ ID NO: 3446585 - RNA, 19 nt, Human
gcagcaucuucacuucuaa

SEQ ID NO: 3446586 - RNA, 14 nt, Human
gcagcaucuucugg

SEQ ID NO: 3446587 - RNA, 20 nt, Human
gcagcauguugcugaggagu

SEQ ID NO: 3446588 - RNA, 15 nt, Human
gcagcauugacuggu

SEQ ID NO: 3446589 - RNA, 14 nt, Human
gcagcauuucacuu

SEQ ID NO: 3446590 - RNA, 11 nt, Human
gcagcauuuga

SEQ ID NO: 3446591 - RNA, 20 nt, Human
gcagccaaguagccucuccu

SEQ ID NO: 3446592 - RNA, 18 nt, Human
gcagccacacuucucagg

SEQ ID NO: 3446593 - RNA, 16 nt, Human
gcagccacauuccuga

SEQ ID NO: 3446594 - RNA, 18 nt, Human
gcagccacuuaggacaaa

SEQ ID NO: 3446595 - RNA, 23 nt, Human
gcagccagaccuauuccuccugg

SEQ ID NO: 3446596 - RNA, 21 nt, Human
gcagccagccaaacacacaga

SEQ ID NO: 3446597 - RNA, 21 nt, Human
gcagccagcccagcccagcug

SEQ ID NO: 3446598 - RNA, 23 nt, Human
gcagccagcccagcccagcuggu

SEQ ID NO: 3446599 - RNA, 20 nt, Human
gcagccagcccugccuggag

SEQ ID NO: 3446600 - RNA, 13 nt, Human
gcagccagccgug

SEQ ID NO: 3446601 - RNA, 22 nt, Human
gcagccagccgugagugcagac

SEQ ID NO: 3446602 - RNA, 13 nt, Human
gcagccagcucuc

SEQ ID NO: 3446603 - RNA, 17 nt, Human
gcagccagcucucagcc

SEQ ID NO: 3446604 - RNA, 15 nt, Human
gcagccagggagagc

SEQ ID NO: 3446605 - RNA, 19 nt, Human
gcagccagggagagcccag

SEQ ID NO: 3446606 - RNA, 13 nt, Human
gcagccaguucaa

SEQ ID NO: 3446607 - RNA, 17 nt, Human
gcagcccaagcuucccu

SEQ ID NO: 3446608 - RNA, 17 nt, Human
gcagcccacccugcugc

SEQ ID NO: 3446609 - RNA, 20 nt, Human
gcagcccacccugcugcugg

SEQ ID NO: 3446610 - RNA, 13 nt, Human
gcagcccagccag

SEQ ID NO: 3446611 - RNA, 14 nt, Human
gcagcccagccagc

SEQ ID NO: 3446612 - RNA, 14 nt, Human
gcagcccaggaagu

SEQ ID NO: 3446613 - RNA, 17 nt, Human
gcagcccaggccggggu

SEQ ID NO: 3446614 - RNA, 13 nt, Human
gcagcccaugccc

SEQ ID NO: 3446615 - RNA, 17 nt, Human
gcagcccaugcccaccu

SEQ ID NO: 3446616 - RNA, 19 nt, Human
gcagcccauuucuccagaa

SEQ ID NO: 3446617 - RNA, 22 nt, Human
gcagccccacaccagggccagc

SEQ ID NO: 3446618 - RNA, 14 nt, Human
gcagccccgggagg

SEQ ID NO: 3446619 - RNA, 20 nt, Human
gcagccccgugggguuccuc

SEQ ID NO: 3446620 - RNA, 20 nt, Human
gcagccccuguucuggcaga

SEQ ID NO: 3446621 - RNA, 19 nt, Human
gcagcccgcaucagcugcu

SEQ ID NO: 3446622 - RNA, 18 nt, Human
gcagcccgcuaggcucgc

SEQ ID NO: 3446623 - RNA, 24 nt, Human
gcagcccgggucaucuguaccucu

SEQ ID NO: 3446624 - RNA, 19 nt, Human
gcagcccguguggccccuu

SEQ ID NO: 3446625 - RNA, 20 nt, Human
gcagcccguguggccccuuc

SEQ ID NO: 3446626 - RNA, 21 nt, Human
gcagcccguguggccccuuca

SEQ ID NO: 3446627 - RNA, 22 nt, Human
gcagcccuaaggaucucucagg

SEQ ID NO: 3446628 - RNA, 13 nt, Human
gcagcccuagagc

SEQ ID NO: 3446629 - RNA, 17 nt, Human
gcagcccuagagccugc

SEQ ID NO: 3446630 - RNA, 22 nt, Human
gcagcccuagagccugccugga

SEQ ID NO: 3446631 - RNA, 13 nt, Human
gcagcccuccuca

SEQ ID NO: 3446632 - RNA, 19 nt, Human
gcagcccucggcgcuccgg

SEQ ID NO: 3446633 - RNA, 13 nt, Human
gcagcccugcaga

SEQ ID NO: 3446634 - RNA, 14 nt, Human
gcagcccugcagag

SEQ ID NO: 3446635 - RNA, 15 nt, Human
gcagcccugcagagg

SEQ ID NO: 3446636 - RNA, 17 nt, Human
gcagcccugcagagggc

SEQ ID NO: 3446637 - RNA, 16 nt, Human
gcagcccugccccaca

SEQ ID NO: 3446638 - RNA, 14 nt, Human
gcagcccuggccca

SEQ ID NO: 3446639 - RNA, 17 nt, Human
gcagcccuggcccauca

SEQ ID NO: 3446640 - RNA, 12 nt, Human
gcagcccuugcu

SEQ ID NO: 3446641 - RNA, 20 nt, Human
gcagccgccuuccuugaccu

SEQ ID NO: 3446642 - RNA, 17 nt, Human
gcagccgcugagcgagg

SEQ ID NO: 3446643 - RNA, 19 nt, Human
gcagccucaaccuccuggg

SEQ ID NO: 3446644 - RNA, 15 nt, Human
gcagccucacagucc

SEQ ID NO: 3446645 - RNA, 15 nt, Human
gcagccucagagaca

SEQ ID NO: 3446646 - RNA, 13 nt, Human
gcagccucaggac

SEQ ID NO: 3446647 - RNA, 15 nt, Human
gcagccucaggacug

SEQ ID NO: 3446648 - RNA, 19 nt, Human
gcagccucaggacugggag

SEQ ID NO: 3446649 - RNA, 18 nt, Human
gcagccucccauccaggg

SEQ ID NO: 3446650 - RNA, 15 nt, Human
gcagccuccuccuga

SEQ ID NO: 3446651 - RNA, 18 nt, Human
gcagccuccuccugacca

SEQ ID NO: 3446652 - RNA, 19 nt, Human
gcagccucgaacuccuggg

SEQ ID NO: 3446653 - RNA, 21 nt, Human
gcaguagacauuuuaacaaga

SEQ ID NO: 3446654 - RNA, 18 nt, Human
gcaguagagucaucucca

SEQ ID NO: 3446655 - RNA, 20 nt, Human
gcaguagagucaucuccauc

SEQ ID NO: 3446656 - RNA, 15 nt, Human
gcaguagauuuucuu

SEQ ID NO: 3446657 - RNA, 20 nt, Human
gcaguaggccggugugccug

SEQ ID NO: 3446658 - RNA, 13 nt, Human
gcaguaggggagg

SEQ ID NO: 3446659 - RNA, 12 nt, Human
gcaguagucucu

SEQ ID NO: 3446660 - RNA, 12 nt, Human
gcaguauauuuc

SEQ ID NO: 3446661 - RNA, 13 nt, Human
gcaguaugguaca

SEQ ID NO: 3446662 - RNA, 17 nt, Human
gcaguaugguacauuuu

SEQ ID NO: 3446663 - RNA, 21 nt, Human
gcagucacuucggccagagcu

SEQ ID NO: 3446664 - RNA, 22 nt, Human
gcagucaucuugaccaagcagg

SEQ ID NO: 3446665 - RNA, 19 nt, Human
gcagucauuauccagguaa

SEQ ID NO: 3446666 - RNA, 23 nt, Human
gcaguccacuucugacagccuca

SEQ ID NO: 3446667 - RNA, 12 nt, Human
gcaguccaugca

SEQ ID NO: 3446668 - RNA, 16 nt, Human
gcagucccaagcggug

SEQ ID NO: 3446669 - RNA, 23 nt, Human
gcagucccugagaccauuuaaca

SEQ ID NO: 3446670 - RNA, 17 nt, Human
gcaguccugccucagcc

SEQ ID NO: 3446671 - RNA, 18 nt, Human
gcaguccuggaagccagc

SEQ ID NO: 3446672 - RNA, 23 nt, Human
gcaguccuuuuacuacagcuaug

SEQ ID NO: 3446673 - RNA, 16 nt, Human
gcagucgggggcuggc

SEQ ID NO: 3446674 - RNA, 18 nt, Human
gcagucgggggcuggccu

SEQ ID NO: 3446675 - RNA, 18 nt, Human
gcagucgugccugugucc

SEQ ID NO: 3446676 - RNA, 19 nt, Human
gcagucgugccugugucca

SEQ ID NO: 3446677 - RNA, 18 nt, Human
gcagucuccucuuuaaaa

SEQ ID NO: 3446678 - RNA, 20 nt, Human
gcagucuccucuuuaaaaca

SEQ ID NO: 3446679 - RNA, 23 nt, Human
gcagucucuauaccaauaaagug

SEQ ID NO: 3446680 - RNA, 13 nt, Human
gcagucuggaggg

SEQ ID NO: 3446681 - RNA, 14 nt, Human
gcagucuucaguuu

SEQ ID NO: 3446682 - RNA, 22 nt, Human
gcagugagaaaaagcuccuguc

SEQ ID NO: 3446683 - RNA, 14 nt, Human
gcagugagagcaga

SEQ ID NO: 3446684 - RNA, 13 nt, Human
gcagugagcagaa

SEQ ID NO: 3446685 - RNA, 18 nt, Human
gcagugagucucuucaga

SEQ ID NO: 3446686 - RNA, 18 nt, Human
gcagugagugagccuggc

SEQ ID NO: 3446687 - RNA, 19 nt, Human
gcagugaguuacagcgaga

SEQ ID NO: 3446688 - RNA, 16 nt, Human
gcagugauauggcaga

SEQ ID NO: 3446689 - RNA, 19 nt, Human
gcagugauauggcagaaga

SEQ ID NO: 3446690 - RNA, 17 nt, Human
gcagugauauucuuugu

SEQ ID NO: 3446691 - RNA, 21 nt, Human
gcagugaugcuggaugcuccu

SEQ ID NO: 3446692 - RNA, 13 nt, Human
gcagugauuuuua

SEQ ID NO: 3446693 - RNA, 20 nt, Human
gcagugcaagagacucuggc

SEQ ID NO: 3446694 - RNA, 22 nt, Human
gcagugcagcaaccagagcacu

SEQ ID NO: 3446695 - RNA, 15 nt, Human
gcagugcaggcacag

SEQ ID NO: 3446696 - RNA, 23 nt, Human
gcagugccccuagcuuagagccu

SEQ ID NO: 3446697 - RNA, 15 nt, Human
gcagugccugauaag

SEQ ID NO: 3446698 - RNA, 15 nt, Human
gcagugccuuccaua

SEQ ID NO: 3446699 - RNA, 22 nt, Human
gcagugccuuccauaauuauga

SEQ ID NO: 3446700 - RNA, 14 nt, Human
gcagugcucaccca

SEQ ID NO: 3446701 - RNA, 18 nt, Human
gcagugcucgcuguugcu

SEQ ID NO: 3446702 - RNA, 18 nt, Human
gcagugcuuggcccagga

SEQ ID NO: 3446703 - RNA, 20 nt, Human
gcagugcuuggcccaggagu

SEQ ID NO: 3446704 - RNA, 15 nt, Human
gcaguggagagggac

SEQ ID NO: 3446705 - RNA, 18 nt, Human
gcaguggagguagaauga

SEQ ID NO: 3446706 - RNA, 20 nt, Human
gcaguggagguagaaugacu

SEQ ID NO: 3446707 - RNA, 14 nt, Human
gcaguggagguggg

SEQ ID NO: 3446708 - RNA, 22 nt, Human
gcaguggcaucaucucagcuca

SEQ ID NO: 3446709 - RNA, 19 nt, Human
gcaguggcgcauucuaggc

SEQ ID NO: 3446710 - RNA, 20 nt, Human
gcaguggcugguccagggcu

SEQ ID NO: 3446711 - RNA, 14 nt, Human
gcagugggaaaaau

SEQ ID NO: 3446712 - RNA, 19 nt, Human
gcagugggaaaaauguagg

SEQ ID NO: 3446713 - RNA, 21 nt, Human
gcagugggacagggcauggcc

SEQ ID NO: 3446714 - RNA, 14 nt, Human
gcagugggagcugc

SEQ ID NO: 3446715 - RNA, 15 nt, Human
gcagugggagcugcc

SEQ ID NO: 3446716 - RNA, 16 nt, Human
gcagugggagcugccu

SEQ ID NO: 3446717 - RNA, 17 nt, Human
gcagugggagcugccug

SEQ ID NO: 3446718 - RNA, 18 nt, Human
gcagugggagcugccugu

SEQ ID NO: 3446719 - RNA, 15 nt, Human
gcagugggccuggcc

SEQ ID NO: 3446720 - RNA, 21 nt, Human
gcagugggguuucgcagccug

SEQ ID NO: 3446721 - RNA, 18 nt, Human
gcaguggugcgaucuggg

SEQ ID NO: 3446722 - RNA, 19 nt, Human
gcaguggugcgaucugggu

SEQ ID NO: 3446723 - RNA, 23 nt, Human
gcaguggugguuuucuguucuuu

SEQ ID NO: 3446724 - RNA, 15 nt, Human
gcagcgagccugcua

SEQ ID NO: 3446725 - RNA, 13 nt, Human
gcagcgagggcgg

SEQ ID NO: 3446726 - RNA, 14 nt, Human
gcagcgagggcgga

SEQ ID NO: 3446727 - RNA, 21 nt, Human
gcagcgagggcggagccggcc

SEQ ID NO: 3446728 - RNA, 24 nt, Human
gcagcgaguuguggaaagccucug

SEQ ID NO: 3446729 - RNA, 14 nt, Human
gcagcgccaggcug

SEQ ID NO: 3446730 - RNA, 18 nt, Human
gcagcgcccuuccucucc

SEQ ID NO: 3446731 - RNA, 17 nt, Human
gcagcgcggggagcccg

SEQ ID NO: 3446732 - RNA, 14 nt, Human
gcagcucaaaggca

SEQ ID NO: 3446733 - RNA, 17 nt, Human
gcagcucaacuuucugu

SEQ ID NO: 3446734 - RNA, 14 nt, Human
gcagcucaccucuc

SEQ ID NO: 3446735 - RNA, 16 nt, Human
gcagcucaccucuccc

SEQ ID NO: 3446736 - RNA, 20 nt, Human
gcagcucaccucucccuugg

SEQ ID NO: 3446737 - RNA, 16 nt, Human
gcagcucacuacccua

SEQ ID NO: 3446738 - RNA, 15 nt, Human
gcagcucagcuuccc

SEQ ID NO: 3446739 - RNA, 15 nt, Human
gcagcucuccaguca

SEQ ID NO: 3446740 - RNA, 21 nt, Human
gcagcucuccagucaggaggc

SEQ ID NO: 3446741 - RNA, 12 nt, Human
gcagcucucccc

SEQ ID NO: 3446742 - RNA, 15 nt, Human
gcagcucuccccuuc

SEQ ID NO: 3446743 - RNA, 20 nt, Human
gcagcucuggacagccccac

SEQ ID NO: 3446744 - RNA, 14 nt, Human
gcagcucuugcccu

SEQ ID NO: 3446745 - RNA, 16 nt, Human
gcagcucuugcccuuc

SEQ ID NO: 3446746 - RNA, 18 nt, Human
gcagcucuugcccuuccc

SEQ ID NO: 3446747 - RNA, 20 nt, Human
gcagcucuugcccuucccug

SEQ ID NO: 3446748 - RNA, 19 nt, Human
gcagcugaaauaugcuggc

SEQ ID NO: 3446749 - RNA, 12 nt, Human
gcagcugaaauu

SEQ ID NO: 3446750 - RNA, 21 nt, Human
gcagcugauguuggaagagaa

SEQ ID NO: 3446751 - RNA, 14 nt, Human
gcagcugccagaga

SEQ ID NO: 3446752 - RNA, 15 nt, Human
gcagcugccagagaa

SEQ ID NO: 3446753 - RNA, 12 nt, Human
gcagcugccucc

SEQ ID NO: 3446754 - RNA, 13 nt, Human
gcagcugccuccc

SEQ ID NO: 3446755 - RNA, 17 nt, Human
gcagcugcgguccaccc

SEQ ID NO: 3446756 - RNA, 22 nt, Human
gcagcugcgguccacccaggag

SEQ ID NO: 3446757 - RNA, 12 nt, Human
gcagcuggacag

SEQ ID NO: 3446758 - RNA, 17 nt, Human
gcagcuggacagagggg

SEQ ID NO: 3446759 - RNA, 23 nt, Human
gcagcuggacagaggggacucug

SEQ ID NO: 3446760 - RNA, 15 nt, Human
gcagcuggacuaccc

SEQ ID NO: 3446761 - RNA, 16 nt, Human
gcagcuggacucugca

SEQ ID NO: 3446762 - RNA, 17 nt, Human
gcagcugggagaagggg

SEQ ID NO: 3446763 - RNA, 15 nt, Human
gcagcugggcccaac

SEQ ID NO: 3446764 - RNA, 21 nt, Human
gcagcugggcccaacccuguc

SEQ ID NO: 3446765 - RNA, 15 nt, Human
gcagcugucccuugc

SEQ ID NO: 3446766 - RNA, 10 nt, Human
gcagcuguug

SEQ ID NO: 3446767 - RNA, 16 nt, Human
gcagcuguugcaguga

SEQ ID NO: 3446768 - RNA, 17 nt, Human
gcagcuguuuuguugac

SEQ ID NO: 3446769 - RNA, 15 nt, Human
gcagcuuagggcccu

SEQ ID NO: 3446770 - RNA, 19 nt, Human
gcagcuuauaaugggcucu

SEQ ID NO: 3446771 - RNA, 12 nt, Human
gcagcuuccaga

SEQ ID NO: 3446772 - RNA, 22 nt, Human
gcagcuucugcccccugcagaa

SEQ ID NO: 3446773 - RNA, 14 nt, Human
gcagcuucuguccu

SEQ ID NO: 3446774 - RNA, 19 nt, Human
gcagcuugaggguugggcu

SEQ ID NO: 3446775 - RNA, 14 nt, Human
gcagcuugccccgg

SEQ ID NO: 3446776 - RNA, 15 nt, Human
gcagcuugcugcacc

SEQ ID NO: 3446777 - RNA, 20 nt, Human
gcagcuuguagccagccggg

SEQ ID NO: 3446778 - RNA, 21 nt, Human
gcagcuuguagccagccgggg

SEQ ID NO: 3446779 - RNA, 22 nt, Human
gcagcuuguagccagccggggc

SEQ ID NO: 3446780 - RNA, 21 nt, Human
gcagcuuuaaacucagggaca

SEQ ID NO: 3446781 - RNA, 22 nt, Human
gcagcuuuaaacucagggacag

SEQ ID NO: 3446782 - RNA, 22 nt, Human
gcagcuuuaaccauuaaaacug

SEQ ID NO: 3446783 - RNA, 19 nt, Human
gcagcuuuagaaucccagc

SEQ ID NO: 3446784 - RNA, 16 nt, Human
gcagcuuuuaaaagau

SEQ ID NO: 3446785 - RNA, 23 nt, Human
gcaggaaaugaaaaugucuugug

SEQ ID NO: 3446786 - RNA, 14 nt, Human
gcaggaacucccag

SEQ ID NO: 3446787 - RNA, 21 nt, Human
gcaggaagcauucagagagca

SEQ ID NO: 3446788 - RNA, 14 nt, Human
gcaggaagcucaga

SEQ ID NO: 3446789 - RNA, 17 nt, Human
gcaggaagcucagacug

SEQ ID NO: 3446790 - RNA, 15 nt, Human
gcaggaaggagagcc

SEQ ID NO: 3446791 - RNA, 13 nt, Human
gcaggaaggagcu

SEQ ID NO: 3446792 - RNA, 15 nt, Human
gcaggaaggagcugc

SEQ ID NO: 3446793 - RNA, 16 nt, Human
gcaggaaggagcugcc

SEQ ID NO: 3446794 - RNA, 17 nt, Human
gcaggaaggagcugccu

SEQ ID NO: 3446795 - RNA, 19 nt, Human
gcaggaaggagcugccugg

SEQ ID NO: 3446796 - RNA, 14 nt, Human
gcaggaaggccugg

SEQ ID NO: 3446797 - RNA, 20 nt, Human
gcaggaaggcugagaggaga

SEQ ID NO: 3446798 - RNA, 22 nt, Human
gccaauuaggggguaaggcccc

SEQ ID NO: 3446799 - RNA, 15 nt, Human
gccaauuauguuaaa

SEQ ID NO: 3446800 - RNA, 16 nt, Human
gccaauuauguuaaac

SEQ ID NO: 3446801 - RNA, 17 nt, Human
gccaauuauguuaaacu

SEQ ID NO: 3446802 - RNA, 15 nt, Human
gccaauucagacagg

SEQ ID NO: 3446803 - RNA, 17 nt, Human
gccaauucagacaggca

SEQ ID NO: 3446804 - RNA, 13 nt, Human
gccaauuccuaua

SEQ ID NO: 3446805 - RNA, 19 nt, Human
gccaauugaauaggaucaa

SEQ ID NO: 3446806 - RNA, 15 nt, Human
gccaauuuuucugca

SEQ ID NO: 3446807 - RNA, 16 nt, Human
gccaauuuuucugcac

SEQ ID NO: 3446808 - RNA, 22 nt, Human
gccacaaauucuuugacacuca

SEQ ID NO: 3446809 - RNA, 20 nt, Human
gccacaacuccuacaugaug

SEQ ID NO: 3446810 - RNA, 16 nt, Human
gccacaagaaauuuga

SEQ ID NO: 3446811 - RNA, 16 nt, Human
gccacaagacccuugu

SEQ ID NO: 3446812 - RNA, 17 nt, Human
gccacaaggaagaaauu

SEQ ID NO: 3446813 - RNA, 22 nt, Human
gccacaaggaagaaauuaacuu

SEQ ID NO: 3446814 - RNA, 21 nt, Human
gccacaaggacuuccugucca

SEQ ID NO: 3446815 - RNA, 15 nt, Human
gccacaagucuucca

SEQ ID NO: 3446816 - RNA, 16 nt, Human
gccacaagucuuccag

SEQ ID NO: 3446817 - RNA, 21 nt, Human
gccacaaugaacaucccuuuu

SEQ ID NO: 3446818 - RNA, 18 nt, Human
gccacacaaacguuuacu

SEQ ID NO: 3446819 - RNA, 20 nt, Human
gccacacacacagaaaauau

SEQ ID NO: 3446820 - RNA, 23 nt, Human
gccacacacacagaaaauauacu

SEQ ID NO: 3446821 - RNA, 20 nt, Human
gccacacagaccaccaucca

SEQ ID NO: 3446822 - RNA, 13 nt, Human
gccacacagcugc

SEQ ID NO: 3446823 - RNA, 15 nt, Human
gccacacaguauuuu

SEQ ID NO: 3446824 - RNA, 15 nt, Human
gccacaccaagcugu

SEQ ID NO: 3446825 - RNA, 20 nt, Human
gccacaccaagcugugccac

SEQ ID NO: 3446826 - RNA, 23 nt, Human
gccacaccaagcugugccacccu

SEQ ID NO: 3446827 - RNA, 19 nt, Human
gccacaccaucuccuuuca

SEQ ID NO: 3446828 - RNA, 16 nt, Human
gccacacccucccccg

SEQ ID NO: 3446829 - RNA, 17 nt, Human
gccacacgagaaccuga

SEQ ID NO: 3446830 - RNA, 13 nt, Human
gccacacucagca

SEQ ID NO: 3446831 - RNA, 16 nt, Human
gccacacucagcacaa

SEQ ID NO: 3446832 - RNA, 17 nt, Human
gccacacucuccaucac

SEQ ID NO: 3446833 - RNA, 23 nt, Human
gccacacuucaggcucuucuccu

SEQ ID NO: 3446834 - RNA, 22 nt, Human
gccacacuucucaggacacagg

SEQ ID NO: 3446835 - RNA, 14 nt, Human
gccacagagaaagu

SEQ ID NO: 3446836 - RNA, 19 nt, Human
gccacagcagcauuuuuau

SEQ ID NO: 3446837 - RNA, 14 nt, Human
gccacagccagaac

SEQ ID NO: 3446838 - RNA, 12 nt, Human
gccacagccagg

SEQ ID NO: 3446839 - RNA, 13 nt, Human
gccacagcccagc

SEQ ID NO: 3446840 - RNA, 20 nt, Human
gccacagcccuuuugucucu

SEQ ID NO: 3446841 - RNA, 15 nt, Human
gccacagcgccagcc

SEQ ID NO: 3446842 - RNA, 10 nt, Human
gccacagcuu

SEQ ID NO: 3446843 - RNA, 13 nt, Human
gccacagcuuuug

SEQ ID NO: 3446844 - RNA, 15 nt, Human
gccacagcuuuugca

SEQ ID NO: 3446845 - RNA, 16 nt, Human
gccacagcuuuugcaa

SEQ ID NO: 3446846 - RNA, 18 nt, Human
gccacaggacacagucag

SEQ ID NO: 3446847 - RNA, 12 nt, Human
gccacaggaccc

SEQ ID NO: 3446848 - RNA, 13 nt, Human
gccacaggccucc

SEQ ID NO: 3446849 - RNA, 12 nt, Human
gccacaggccug

SEQ ID NO: 3446850 - RNA, 20 nt, Human
gccacagugggaugaaccag

SEQ ID NO: 3446851 - RNA, 15 nt, Human
gccacaucaaaccuu

SEQ ID NO: 3446852 - RNA, 14 nt, Human
gccacaucccccaa

SEQ ID NO: 3446853 - RNA, 13 nt, Human
gccacaucccucu

SEQ ID NO: 3446854 - RNA, 16 nt, Human
gccacaucuuaaacuu

SEQ ID NO: 3446855 - RNA, 23 nt, Human
gccacaucuugaucugcucagcc

SEQ ID NO: 3446856 - RNA, 20 nt, Human
gccacaugagucccaguggg

SEQ ID NO: 3446857 - RNA, 20 nt, Human
gccacauggggcugggcagc

SEQ ID NO: 3446858 - RNA, 16 nt, Human
gccacauuagaacuuc

SEQ ID NO: 3446859 - RNA, 20 nt, Human
gccacauuccugaugcuucu

SEQ ID NO: 3446860 - RNA, 21 nt, Human
gccacauugaaaaauguccac

SEQ ID NO: 3446861 - RNA, 12 nt, Human
gccacauuuaau

SEQ ID NO: 3446862 - RNA, 15 nt, Human
gccaccaaagcugcc

SEQ ID NO: 3446863 - RNA, 19 nt, Human
gccaccaaagcugcccacu

SEQ ID NO: 3446864 - RNA, 20 nt, Human
gccaccaaagcugcccacug

SEQ ID NO: 3446865 - RNA, 16 nt, Human
gccaccaacagccacu

SEQ ID NO: 3446866 - RNA, 12 nt, Human
gccaccaacucu

SEQ ID NO: 3446867 - RNA, 16 nt, Human
gccaccaacuggcccu

SEQ ID NO: 3446868 - RNA, 19 nt, Human
gccaccaacuggcccucuu

SEQ ID NO: 3446869 - RNA, 18 nt, Human
gccaccaacuuacaaaaa

SEQ ID NO: 3446870 - RNA, 14 nt, Human
gccaccacgcccgg

SEQ ID NO: 3446871 - RNA, 17 nt, Human
gccaccacgccuagccu

SEQ ID NO: 3446872 - RNA, 15 nt, Human
gccaccacguccagc

SEQ ID NO: 3446873 - RNA, 12 nt, Human
gccaccagagac

SEQ ID NO: 3446874 - RNA, 15 nt, Human
gccaccagcucugcc

SEQ ID NO: 3446875 - RNA, 12 nt, Human
gccaccaggcca

SEQ ID NO: 3446876 - RNA, 20 nt, Human
gccaccaggccaccucccca

SEQ ID NO: 3446877 - RNA, 13 nt, Human
gccaccaggcugg

SEQ ID NO: 3446878 - RNA, 16 nt, Human
gccaccaggcuggcgc

SEQ ID NO: 3446879 - RNA, 19 nt, Human
gccaccaggcuggcgcagc

SEQ ID NO: 3446880 - RNA, 21 nt, Human
gccaccaggugccuuucaaau

SEQ ID NO: 3446881 - RNA, 11 nt, Human
gccaccaguuc

SEQ ID NO: 3446882 - RNA, 19 nt, Human
gccaccaguucucaugggu

SEQ ID NO: 3446883 - RNA, 22 nt, Human
gccaccaugcccagcucagagg

SEQ ID NO: 3446884 - RNA, 16 nt, Human
gccaccauggccagcc

SEQ ID NO: 3446885 - RNA, 22 nt, Human
gccaccauuccuggaaaccaca

SEQ ID NO: 3446886 - RNA, 21 nt, Human
gccacccaccucccugccucc

SEQ ID NO: 3446887 - RNA, 13 nt, Human
gccacccagguga

SEQ ID NO: 3446888 - RNA, 20 nt, Human
gccaccccacccucccugga

SEQ ID NO: 3446889 - RNA, 19 nt, Human
gccacccccgcuggaggau

SEQ ID NO: 3446890 - RNA, 16 nt, Human
gccaccccuccuuccu

SEQ ID NO: 3446891 - RNA, 18 nt, Human
gccacccguucugcuggc

SEQ ID NO: 3446892 - RNA, 18 nt, Human
gccacccuaccuguucag

SEQ ID NO: 3446893 - RNA, 22 nt, Human
gccacccuagccaaugucuccu

SEQ ID NO: 3446894 - RNA, 16 nt, Human
gccacccucccagcuc

SEQ ID NO: 3446895 - RNA, 18 nt, Human
gccacccucccagcucug

SEQ ID NO: 3446896 - RNA, 12 nt, Human
gccacccugggc

SEQ ID NO: 3446897 - RNA, 18 nt, Human
gccacccugggcucugug

SEQ ID NO: 3446898 - RNA, 21 nt, Human
gccacccugggcucugugggc

SEQ ID NO: 3446899 - RNA, 20 nt, Human
gccaccgccuugcccagccu

SEQ ID NO: 3446900 - RNA, 20 nt, Human
gccaccgcuuccggcuccug

SEQ ID NO: 3446901 - RNA, 22 nt, Human
gccaccgugccuggccacgccc

SEQ ID NO: 3446902 - RNA, 15 nt, Human
gccaccuaucucgug

SEQ ID NO: 3446903 - RNA, 21 nt, Human
gccaccuaucucgugggagag

SEQ ID NO: 3446904 - RNA, 17 nt, Human
gccaccuccccaggccg

SEQ ID NO: 3446905 - RNA, 12 nt, Human
gccaccuccccu

SEQ ID NO: 3446906 - RNA, 13 nt, Human
gccaccuccccua

SEQ ID NO: 3446907 - RNA, 15 nt, Human
gccaccuccccuauc

SEQ ID NO: 3446908 - RNA, 17 nt, Human
gccaccuccccuaucca

SEQ ID NO: 3446909 - RNA, 21 nt, Human
gccaccuccccuauccaccca

SEQ ID NO: 3446910 - RNA, 21 nt, Human
gccaccuccccuugccagcug

SEQ ID NO: 3446911 - RNA, 21 nt, Human
gccaccuccuaaaaggcccag

SEQ ID NO: 3446912 - RNA, 18 nt, Human
gccaccucuaacagcacc

SEQ ID NO: 3446913 - RNA, 14 nt, Human
gccaccucuccaag

SEQ ID NO: 3446914 - RNA, 22 nt, Human
gccaccucuccaagggcuucug

SEQ ID NO: 3446915 - RNA, 23 nt, Human
gccaccucuccaagggcuucugc

SEQ ID NO: 3446916 - RNA, 15 nt, Human
gccaccucucccuca

SEQ ID NO: 3446917 - RNA, 16 nt, Human
gccaccucucuccuuu

SEQ ID NO: 3446918 - RNA, 15 nt, Human
gccaccucuuccugg

SEQ ID NO: 3446919 - RNA, 18 nt, Human
gccaccucuuccuggccg

SEQ ID NO: 3446920 - RNA, 16 nt, Human
gccaccugaauaaaga

SEQ ID NO: 3446921 - RNA, 18 nt, Human
gccaccugaggugggccc

SEQ ID NO: 3446922 - RNA, 19 nt, Human
gccaccugaggugggccca

SEQ ID NO: 3446923 - RNA, 20 nt, Human
gccaccugaggugggcccag

SEQ ID NO: 3446924 - RNA, 23 nt, Human
gccaccugaggugggcccaggac

SEQ ID NO: 3446925 - RNA, 21 nt, Human
gccaccugaguuccugaggug

SEQ ID NO: 3446926 - RNA, 16 nt, Human
gccaccugcaggucac

SEQ ID NO: 3446927 - RNA, 13 nt, Human
gccaccugccccc

SEQ ID NO: 3446928 - RNA, 14 nt, Human
gccaccugccugcg

SEQ ID NO: 3446929 - RNA, 22 nt, Human
gccaccugccugcgucuuccgc

SEQ ID NO: 3446930 - RNA, 14 nt, Human
gccaccuggacccc

SEQ ID NO: 3446931 - RNA, 18 nt, Human
gccaccuggaccccugca

SEQ ID NO: 3446932 - RNA, 12 nt, Human
gccaccuggggc

SEQ ID NO: 3446933 - RNA, 17 nt, Human
gccaccuggggcaguca

SEQ ID NO: 3446934 - RNA, 18 nt, Human
gccaccugucccaccuca

SEQ ID NO: 3446935 - RNA, 12 nt, Human
gccaccugucug

SEQ ID NO: 3446936 - RNA, 13 nt, Human
cugcuucucugac

SEQ ID NO: 3446937 - RNA, 14 nt, Human
cugcuucucugacu

SEQ ID NO: 3446938 - RNA, 15 nt, Human
cugcuucucugacuu

SEQ ID NO: 3446939 - RNA, 22 nt, Human
cugcuucucugacuucugccug

SEQ ID NO: 3446940 - RNA, 15 nt, Human
cugcuucugaaugug

SEQ ID NO: 3446941 - RNA, 19 nt, Human
cugcuucugaaugugcuga

SEQ ID NO: 3446942 - RNA, 13 nt, Human
cugcuucugcacc

SEQ ID NO: 3446943 - RNA, 19 nt, Human
cuggccccaugucucucag

SEQ ID NO: 3446944 - RNA, 23 nt, Human
cuggcccccaaccucagggcucc

SEQ ID NO: 3446945 - RNA, 19 nt, Human
cuggcccccacuggcugug

SEQ ID NO: 3446946 - RNA, 21 nt, Human
cuggcccccacuggcuguggg

SEQ ID NO: 3446947 - RNA, 23 nt, Human
cuggcccccacuggcugugggcu

SEQ ID NO: 3446948 - RNA, 13 nt, Human
cuggccccccugg

SEQ ID NO: 3446949 - RNA, 19 nt, Human
cuggccccccugguccccu

SEQ ID NO: 3446950 - RNA, 13 nt, Human
cuggcccccuccc

SEQ ID NO: 3446951 - RNA, 19 nt, Human
cuggcccccucccuggaug

SEQ ID NO: 3446952 - RNA, 23 nt, Human
cuggccccgccgccugguacuca

SEQ ID NO: 3446953 - RNA, 19 nt, Human
cuggccccggaucagagca

SEQ ID NO: 3446954 - RNA, 23 nt, Human
cuggccccggaucagagcaggac

SEQ ID NO: 3446955 - RNA, 13 nt, Human
cuggccccucacc

SEQ ID NO: 3446956 - RNA, 15 nt, Human
cuggccccucaccug

SEQ ID NO: 3446957 - RNA, 13 nt, Human
cuggccccucagg

SEQ ID NO: 3446958 - RNA, 22 nt, Human
cuggccccucagggucccuggu

SEQ ID NO: 3446959 - RNA, 14 nt, Human
cuggccccucgccu

SEQ ID NO: 3446960 - RNA, 18 nt, Human
cuggccccugagaucucu

SEQ ID NO: 3446961 - RNA, 22 nt, Human
cuggccccugagaucucugcag

SEQ ID NO: 3446962 - RNA, 23 nt, Human
cuggccccugagaucucugcagg

SEQ ID NO: 3446963 - RNA, 21 nt, Human
cuggccccuuugggcccugca

SEQ ID NO: 3446964 - RNA, 22 nt, Human
cuggccccuuugggcccugcau

SEQ ID NO: 3446965 - RNA, 18 nt, Human
cuggcccgugacagacuc

SEQ ID NO: 3446966 - RNA, 19 nt, Human
cuggcccgugacagacucc

SEQ ID NO: 3446967 - RNA, 19 nt, Human
cuggcccuagacucggggu

SEQ ID NO: 3446968 - RNA, 23 nt, Human
cuggcccuaugcuuccggccucc

SEQ ID NO: 3446969 - RNA, 18 nt, Human
cuggcccucaaggccucc

SEQ ID NO: 3446970 - RNA, 23 nt, Human
cuggcccucaaggccucccacag

SEQ ID NO: 3446971 - RNA, 19 nt, Human
cuggcccucaccccugccc

SEQ ID NO: 3446972 - RNA, 22 nt, Human
cuggcccucucugaaggaggcc

SEQ ID NO: 3446973 - RNA, 16 nt, Human
cuggcccucuguguug

SEQ ID NO: 3446974 - RNA, 13 nt, Human
cuggcccugaggu

SEQ ID NO: 3446975 - RNA, 14 nt, Human
cuggcccugaggug

SEQ ID NO: 3446976 - RNA, 17 nt, Human
cuggcccugaggugugg

SEQ ID NO: 3446977 - RNA, 19 nt, Human
cuggcccugaggugugggg

SEQ ID NO: 3446978 - RNA, 20 nt, Human
cuggcccugagguguggggg

SEQ ID NO: 3446979 - RNA, 14 nt, Human
cuggcccugccuuc

SEQ ID NO: 3446980 - RNA, 17 nt, Human
cuggcccugcuuccugc

SEQ ID NO: 3446981 - RNA, 15 nt, Human
cuggcccuggggccu

SEQ ID NO: 3446982 - RNA, 20 nt, Human
cuggccgaggguccuggcuc

SEQ ID NO: 3446983 - RNA, 20 nt, Human
cuggccgaguccaagcuggg

SEQ ID NO: 3446984 - RNA, 13 nt, Human
cuggccgcccccu

SEQ ID NO: 3446985 - RNA, 14 nt, Human
cuggccgccucacc

SEQ ID NO: 3446986 - RNA, 16 nt, Human
cuggccgccucacccc

SEQ ID NO: 3446987 - RNA, 18 nt, Human
cuggccgccucacccccu

SEQ ID NO: 3446988 - RNA, 17 nt, Human
cuggccgccugggucca

SEQ ID NO: 3446989 - RNA, 18 nt, Human
cuggccgcgccaaauaau

SEQ ID NO: 3446990 - RNA, 23 nt, Human
cuggccggagucagugccagguc

SEQ ID NO: 3446991 - RNA, 13 nt, Human
cuggccggccagc

SEQ ID NO: 3446992 - RNA, 21 nt, Human
cuggccggccagccagccacu

SEQ ID NO: 3446993 - RNA, 22 nt, Human
cuggccggccagccagccacuc

SEQ ID NO: 3446994 - RNA, 23 nt, Human
cuggccggccagccagccacucu

SEQ ID NO: 3446995 - RNA, 22 nt, Human
cuggccgggaccccgagccugg

SEQ ID NO: 3446996 - RNA, 18 nt, Human
gcccaccuccccacgccc

SEQ ID NO: 3446997 - RNA, 14 nt, Human
gcccaccugccggc

SEQ ID NO: 3446998 - RNA, 22 nt, Human
gcccaccugccuggccggccag

SEQ ID NO: 3446999 - RNA, 14 nt, Human
gcccaccuggccac

SEQ ID NO: 3447000 - RNA, 15 nt, Human
gcccaccuggccucu

SEQ ID NO: 3447001 - RNA, 17 nt, Human
gcccaccuggccucugc

SEQ ID NO: 3447002 - RNA, 20 nt, Human
gcccaccuggccucugcacu

SEQ ID NO: 3447003 - RNA, 15 nt, Human
gcccaccuuggcuca

SEQ ID NO: 3447004 - RNA, 18 nt, Human
gcccaccuuggcucaagu

SEQ ID NO: 3447005 - RNA, 17 nt, Human
gcccacgcucacccccu

SEQ ID NO: 3447006 - RNA, 18 nt, Human
gcccacgcugacuacagg

SEQ ID NO: 3447007 - RNA, 19 nt, Human
gcccacgcugacuacaggg

SEQ ID NO: 3447008 - RNA, 22 nt, Human
gcccacgcugacuacagggccg

SEQ ID NO: 3447009 - RNA, 16 nt, Human
gcccacgcuggagugc

SEQ ID NO: 3447010 - RNA, 22 nt, Human
gcccacgcuggagugcagugag

SEQ ID NO: 3447011 - RNA, 16 nt, Human
gcccacguagggcggc

SEQ ID NO: 3447012 - RNA, 16 nt, Human
gcccacguccugucag

SEQ ID NO: 3447013 - RNA, 23 nt, Human
gcccacguccugucagugccgcc

SEQ ID NO: 3447014 - RNA, 18 nt, Human
gcccacguucucucugcc

SEQ ID NO: 3447015 - RNA, 21 nt, Human
gcccacguucucucugccugu

SEQ ID NO: 3447016 - RNA, 13 nt, Human
gcccacucccugc

SEQ ID NO: 3447017 - RNA, 15 nt, Human
gcccacucccugcaa

SEQ ID NO: 3447018 - RNA, 15 nt, Human
gcccacuccugcucu

SEQ ID NO: 3447019 - RNA, 19 nt, Human
gcccacuccugcucugcuc

SEQ ID NO: 3447020 - RNA, 16 nt, Human
gcccacugcccacccc

SEQ ID NO: 3447021 - RNA, 18 nt, Human
gcccacuguccugggccu

SEQ ID NO: 3447022 - RNA, 23 nt, Human
gcccacugugccucagagaccag

SEQ ID NO: 3447023 - RNA, 11 nt, Human
gcccacuuccc

SEQ ID NO: 3447024 - RNA, 16 nt, Human
gcccacuucccugggu

SEQ ID NO: 3447025 - RNA, 23 nt, Human
gcccacuuguauccucugguucu

SEQ ID NO: 3447026 - RNA, 22 nt, Human
gcccacuugucccacuaucugg

SEQ ID NO: 3447027 - RNA, 13 nt, Human
gcccagaauacug

SEQ ID NO: 3447028 - RNA, 21 nt, Human
gcccagacacagaagaggcug

SEQ ID NO: 3447029 - RNA, 14 nt, Human
gcccagagaacagc

SEQ ID NO: 3447030 - RNA, 15 nt, Human
gcccagagaagccaa

SEQ ID NO: 3447031 - RNA, 16 nt, Human
gcccagagacccagcg

SEQ ID NO: 3447032 - RNA, 19 nt, Human
gcccagagagaagagcccc

SEQ ID NO: 3447033 - RNA, 19 nt, Human
gcccagagaugccuccacc

SEQ ID NO: 3447034 - RNA, 15 nt, Human
gcccagagcaggaag

SEQ ID NO: 3447035 - RNA, 15 nt, Human
gcccagagcccagcu

SEQ ID NO: 3447036 - RNA, 12 nt, Human
gcccagagcugg

SEQ ID NO: 3447037 - RNA, 16 nt, Human
gcccagaggacuccca

SEQ ID NO: 3447038 - RNA, 22 nt, Human
gcccagaggagcugggagccgg

SEQ ID NO: 3447039 - RNA, 21 nt, Human
gcccagaggccaacacugugg

SEQ ID NO: 3447040 - RNA, 15 nt, Human
gcccagagggccugc

SEQ ID NO: 3447041 - RNA, 21 nt, Human
gcccagagggccugcaaggga

SEQ ID NO: 3447042 - RNA, 19 nt, Human
gcccagagggucugggggc

SEQ ID NO: 3447043 - RNA, 16 nt, Human
gcccagagucccccca

SEQ ID NO: 3447044 - RNA, 16 nt, Human
gcccagaucagccaga

SEQ ID NO: 3447045 - RNA, 18 nt, Human
gcccagaucagccagaag

SEQ ID NO: 3447046 - RNA, 21 nt, Human
gcccagauguuuuacgucugg

SEQ ID NO: 3447047 - RNA, 18 nt, Human
gcccagcauugcugguuc

SEQ ID NO: 3447048 - RNA, 19 nt, Human
gcccagcauugcugguucu

SEQ ID NO: 3447049 - RNA, 20 nt, Human
gcccagccaaacccugucug

SEQ ID NO: 3447050 - RNA, 18 nt, Human
gcccagccacggacgcug

SEQ ID NO: 3447051 - RNA, 22 nt, Human
gcccagccagcgucggucugug

SEQ ID NO: 3447052 - RNA, 21 nt, Human
gcccagccauuaccauggaga

SEQ ID NO: 3447053 - RNA, 9 nt, Human
gcccagccc

SEQ ID NO: 3447054 - RNA, 16 nt, Human
gcccagcccauggaga

SEQ ID NO: 3447055 - RNA, 15 nt, Human
gcccagcccccacag

SEQ ID NO: 3447056 - RNA, 23 nt, Human
gcccagcccccacagugcugucu

SEQ ID NO: 3447057 - RNA, 18 nt, Human
gcccagccccuacugcug

SEQ ID NO: 3447058 - RNA, 18 nt, Human
gcccagcccggaccuugg

SEQ ID NO: 3447059 - RNA, 16 nt, Human
gcccagcccuaaacau

SEQ ID NO: 3447060 - RNA, 21 nt, Human
gcccagcccugcuggccgccu

SEQ ID NO: 3447061 - RNA, 13 nt, Human
gcccagccggccu

SEQ ID NO: 3447062 - RNA, 15 nt, Human
gcccagccggccucu

SEQ ID NO: 3447063 - RNA, 15 nt, Human
gcccagccucuuucc

SEQ ID NO: 3447064 - RNA, 16 nt, Human
gcccagccuggaugcc

SEQ ID NO: 3447065 - RNA, 20 nt, Human
gcccagcggacaguggcagg

SEQ ID NO: 3447066 - RNA, 19 nt, Human
gcccagcggccccucccac

SEQ ID NO: 3447067 - RNA, 19 nt, Human
gcccagcuauaccugugcc

SEQ ID NO: 3447068 - RNA, 20 nt, Human
gcccagcuauaccugugccu

SEQ ID NO: 3447069 - RNA, 12 nt, Human
gcccagcuccag

SEQ ID NO: 3447070 - RNA, 17 nt, Human
gcccagcucccccggga

SEQ ID NO: 3447071 - RNA, 19 nt, Human
gcccagcucccccgggagg

SEQ ID NO: 3447072 - RNA, 23 nt, Human
gcccagcuccugacacugcugga

SEQ ID NO: 3447073 - RNA, 19 nt, Human
gcccagcugcucugcccag

SEQ ID NO: 3447074 - RNA, 23 nt, Human
gcccagcugcucugcccagagcu

SEQ ID NO: 3447075 - RNA, 14 nt, Human
gcccagcugggcuc

SEQ ID NO: 3447076 - RNA, 15 nt, Human
gcccagcugggucag

SEQ ID NO: 3447077 - RNA, 19 nt, Human
gcccagcugggucaggcag

SEQ ID NO: 3447078 - RNA, 17 nt, Human
gcccagcuggugggaag

SEQ ID NO: 3447079 - RNA, 21 nt, Human
gcccagcuugaaaccuucacu

SEQ ID NO: 3447080 - RNA, 14 nt, Human
gcccagcuugggcc

SEQ ID NO: 3447081 - RNA, 21 nt, Human
gcccagcuugggcccagcugg

SEQ ID NO: 3447082 - RNA, 23 nt, Human
gcccagcuuuucauugcugugac

SEQ ID NO: 3447083 - RNA, 22 nt, Human
gcccaggaaaggcuccaggagc

SEQ ID NO: 3447084 - RNA, 14 nt, Human
gcccaggaccagcu

SEQ ID NO: 3447085 - RNA, 18 nt, Human
gcccaggaccaucauccu

SEQ ID NO: 3447086 - RNA, 20 nt, Human
gccaugaggaguugcuguuu

SEQ ID NO: 3447087 - RNA, 19 nt, Human
gccaugaggccucagugga

SEQ ID NO: 3447088 - RNA, 20 nt, Human
gccaugaguuccagaaagua

SEQ ID NO: 3447089 - RNA, 13 nt, Human
gccaugaugccuc

SEQ ID NO: 3447090 - RNA, 17 nt, Human
gccaugauggcaacaga

SEQ ID NO: 3447091 - RNA, 21 nt, Human
gccaugauggcaacagaucug

SEQ ID NO: 3447092 - RNA, 22 nt, Human
gccaugauguggaguggggcag

SEQ ID NO: 3447093 - RNA, 15 nt, Human
gccaugcagaaagca

SEQ ID NO: 3447094 - RNA, 13 nt, Human
gccaugccagcug

SEQ ID NO: 3447095 - RNA, 14 nt, Human
gccaugccagcugg

SEQ ID NO: 3447096 - RNA, 15 nt, Human
gccaugccagcuggc

SEQ ID NO: 3447097 - RNA, 17 nt, Human
gccaugccucagcccug

SEQ ID NO: 3447098 - RNA, 21 nt, Human
gccaugccucagcccugaccc

SEQ ID NO: 3447099 - RNA, 18 nt, Human
gccaugcuccucuucccc

SEQ ID NO: 3447100 - RNA, 20 nt, Human
gccaugcuccucuuccccag

SEQ ID NO: 3447101 - RNA, 14 nt, Human
gccaugcuccuggc

SEQ ID NO: 3447102 - RNA, 14 nt, Human
gccaugcugaaggg

SEQ ID NO: 3447103 - RNA, 17 nt, Human
gccaugcugaggccugg

SEQ ID NO: 3447104 - RNA, 17 nt, Human
gccauggaacuguuucc

SEQ ID NO: 3447105 - RNA, 22 nt, Human
gccauggacucuacacugugaa

SEQ ID NO: 3447106 - RNA, 19 nt, Human
gccauggacucuguccuga

SEQ ID NO: 3447107 - RNA, 17 nt, Human
gccauggagaaagcuga

SEQ ID NO: 3447108 - RNA, 21 nt, Human
gccauggagaaagcugacuug

SEQ ID NO: 3447109 - RNA, 15 nt, Human
gccauggagagcugg

SEQ ID NO: 3447110 - RNA, 18 nt, Human
gccauggaggcacacagc

SEQ ID NO: 3447111 - RNA, 19 nt, Human
gccauggaguugugaucau

SEQ ID NO: 3447112 - RNA, 18 nt, Human
gccauggccugcaaacug

SEQ ID NO: 3447113 - RNA, 21 nt, Human
gccauggccugcaaacuggga

SEQ ID NO: 3447114 - RNA, 16 nt, Human
gccauggcgugucccu

SEQ ID NO: 3447115 - RNA, 17 nt, Human
gccauggcgugucccuc

SEQ ID NO: 3447116 - RNA, 17 nt, Human
gccauggcucagggugg

SEQ ID NO: 3447117 - RNA, 19 nt, Human
gccaugggacagggaggac

SEQ ID NO: 3447118 - RNA, 22 nt, Human
gccaugggacagggaggacgcu

SEQ ID NO: 3447119 - RNA, 12 nt, Human
gccaugggaggc

SEQ ID NO: 3447120 - RNA, 21 nt, Human
gccaugggcacaaagggccca

SEQ ID NO: 3447121 - RNA, 19 nt, Human
gccaugggcacugugggua

SEQ ID NO: 3447122 - RNA, 17 nt, Human
gccauguaccuccccug

SEQ ID NO: 3447123 - RNA, 20 nt, Human
gccauguaccuccccugccu

SEQ ID NO: 3447124 - RNA, 18 nt, Human
gccauguagaagcugcau

SEQ ID NO: 3447125 - RNA, 17 nt, Human
gccaugucaaacaaaua

SEQ ID NO: 3447126 - RNA, 14 nt, Human
gccauguccaaaga

SEQ ID NO: 3447127 - RNA, 22 nt, Human
gccaugucugggaacagggacg

SEQ ID NO: 3447128 - RNA, 21 nt, Human
gccaugucuucucccuggaau

SEQ ID NO: 3447129 - RNA, 22 nt, Human
gccaugucuucucccuggaaug

SEQ ID NO: 3447130 - RNA, 17 nt, Human
gccaugugaagagggag

SEQ ID NO: 3447131 - RNA, 14 nt, Human
gccaugugacucug

SEQ ID NO: 3447132 - RNA, 15 nt, Human
gccaugugacucugg

SEQ ID NO: 3447133 - RNA, 17 nt, Human
gccaugugcaccuuggg

SEQ ID NO: 3447134 - RNA, 20 nt, Human
gccaugugcauaguuucuuu

SEQ ID NO: 3447135 - RNA, 23 nt, Human
gccauguuaauguaaucugaugg

SEQ ID NO: 3447136 - RNA, 17 nt, Human
gccauguuggccaggcu

SEQ ID NO: 3447137 - RNA, 19 nt, Human
gccauguuggccaggcugg

SEQ ID NO: 3447138 - RNA, 20 nt, Human
gccauguuggccaggcuggu

SEQ ID NO: 3447139 - RNA, 21 nt, Human
gccauguugugccucccuggu

SEQ ID NO: 3447140 - RNA, 15 nt, Human
gccauguuuaagauu

SEQ ID NO: 3447141 - RNA, 21 nt, Human
gccauguuuaagauuuaauuu

SEQ ID NO: 3447142 - RNA, 13 nt, Human
gccauguuuauua

SEQ ID NO: 3447143 - RNA, 14 nt, Human
gccauguuuauuac

SEQ ID NO: 3447144 - RNA, 23 nt, Human
gccauuaaaugaauauuuugaua

SEQ ID NO: 3447145 - RNA, 16 nt, Human
gccauuauuuucuguc

SEQ ID NO: 3447146 - RNA, 17 nt, Human
gccauuauuuucuguca

SEQ ID NO: 3447147 - RNA, 18 nt, Human
gccauuauuuucugucag

SEQ ID NO: 3447148 - RNA, 22 nt, Human
gccauuauuuucugucagauga

SEQ ID NO: 3447149 - RNA, 18 nt, Human
gccauuccccgucucugg

SEQ ID NO: 3447150 - RNA, 17 nt, Human
gccauucuccacagcaa

SEQ ID NO: 3447151 - RNA, 12 nt, Human
gccauucuuucc

SEQ ID NO: 3447152 - RNA, 17 nt, Human
gccauugacuucuuccc

SEQ ID NO: 3447153 - RNA, 18 nt, Human
gccauugccaccaggaga

SEQ ID NO: 3447154 - RNA, 19 nt, Human
gccauugccaccaggagaa

SEQ ID NO: 3447155 - RNA, 20 nt, Human
gccauuggcuauuuaaaacu

SEQ ID NO: 3447156 - RNA, 12 nt, Human
gccauugucuuu

SEQ ID NO: 3447157 - RNA, 13 nt, Human
gccauugucuuua

SEQ ID NO: 3447158 - RNA, 19 nt, Human
gccauugugaaccaaugca

SEQ ID NO: 3447159 - RNA, 21 nt, Human
gccauuuagccaccaucuuug

SEQ ID NO: 3447160 - RNA, 14 nt, Human
gccauuucaugucc

SEQ ID NO: 3447161 - RNA, 22 nt, Human
gccauuucuuccacaagagccc

SEQ ID NO: 3447162 - RNA, 20 nt, Human
gccauuugcaauaacagcug

SEQ ID NO: 3447163 - RNA, 22 nt, Human
gccauuugcaauaacagcugca

SEQ ID NO: 3447164 - RNA, 20 nt, Human
gccauuugcacccuccgccu

SEQ ID NO: 3447165 - RNA, 24 nt, Human
gccccaggaccagcucaggacaga

SEQ ID NO: 3447166 - RNA, 20 nt, Human
gccccaggaccuggcugcca

SEQ ID NO: 3447167 - RNA, 21 nt, Human
gccccaggaccuggcugccau

SEQ ID NO: 3447168 - RNA, 19 nt, Human
gccccaggcaggcugugcg

SEQ ID NO: 3447169 - RNA, 21 nt, Human
gccccaggcagggccaacccu

SEQ ID NO: 3447170 - RNA, 13 nt, Human
gccccagggcacc

SEQ ID NO: 3447171 - RNA, 15 nt, Human
gccccagggcacccu

SEQ ID NO: 3447172 - RNA, 16 nt, Human
gccccagggcuacccu

SEQ ID NO: 3447173 - RNA, 18 nt, Human
gccccagggcuacccucc

SEQ ID NO: 3447174 - RNA, 16 nt, Human
gccccagggucuuccc

SEQ ID NO: 3447175 - RNA, 17 nt, Human
gccccagggucuucccu

SEQ ID NO: 3447176 - RNA, 23 nt, Human
gccccagggucuucccuaccuca

SEQ ID NO: 3447177 - RNA, 17 nt, Human
gccccagucagccucuc

SEQ ID NO: 3447178 - RNA, 21 nt, Human
gccccagugcccacaggauca

SEQ ID NO: 3447179 - RNA, 19 nt, Human
gccccaguggcuguucugg

SEQ ID NO: 3447180 - RNA, 18 nt, Human
gccccaguucaaucuccc

SEQ ID NO: 3447181 - RNA, 22 nt, Human
gccccaguuccuguggcucccu

SEQ ID NO: 3447182 - RNA, 19 nt, Human
gccccaguuguauuuauuu

SEQ ID NO: 3447183 - RNA, 21 nt, Human
gccccauaauuuuuuuuuucc

SEQ ID NO: 3447184 - RNA, 22 nt, Human
gccccaucacugcgccacugcu

SEQ ID NO: 3447185 - RNA, 17 nt, Human
gccccauccuccagcag

SEQ ID NO: 3447186 - RNA, 14 nt, Human
gccccauccucugu

SEQ ID NO: 3447187 - RNA, 22 nt, Human
gccccauccucuguacagagcc

SEQ ID NO: 3447188 - RNA, 23 nt, Human
gccccauccucuguacagagccc

SEQ ID NO: 3447189 - RNA, 18 nt, Human
gccccaucuccccucagc

SEQ ID NO: 3447190 - RNA, 20 nt, Human
gccccaucuccccucagcuc

SEQ ID NO: 3447191 - RNA, 21 nt, Human
gccccaucuccccucagcucg

SEQ ID NO: 3447192 - RNA, 15 nt, Human
gccccaucugugcau

SEQ ID NO: 3447193 - RNA, 17 nt, Human
gccccaugaccuccagc

SEQ ID NO: 3447194 - RNA, 12 nt, Human
gccccaugcugg

SEQ ID NO: 3447195 - RNA, 15 nt, Human
gccccaugcuggagc

SEQ ID NO: 3447196 - RNA, 18 nt, Human
gccccaugcuggagccug

SEQ ID NO: 3447197 - RNA, 15 nt, Human
gccccaugucucuca

SEQ ID NO: 3447198 - RNA, 16 nt, Human
gccccaugucucucag

SEQ ID NO: 3447199 - RNA, 14 nt, Human
gccccauucugccu

SEQ ID NO: 3447200 - RNA, 17 nt, Human
gccccauucugccugcc

SEQ ID NO: 3447201 - RNA, 20 nt, Human
gccccauucugccugcccag

SEQ ID NO: 3447202 - RNA, 21 nt, Human
gccccauucugccugcccagg

SEQ ID NO: 3447203 - RNA, 23 nt, Human
gccccauucugccugcccaggcc

SEQ ID NO: 3447204 - RNA, 16 nt, Human
gcccccaaacccccau

SEQ ID NO: 3447205 - RNA, 22 nt, Human
gcccccaaccauuuccucagac

SEQ ID NO: 3447206 - RNA, 23 nt, Human
gcccccaaccucagggcucccag

SEQ ID NO: 3447207 - RNA, 14 nt, Human
gcccccaagccugc

SEQ ID NO: 3447208 - RNA, 23 nt, Human
gcccccacaauggucccaaacag

SEQ ID NO: 3447209 - RNA, 17 nt, Human
gcccccacaccuggccc

SEQ ID NO: 3447210 - RNA, 19 nt, Human
gcccccacaccuggcccug

SEQ ID NO: 3447211 - RNA, 23 nt, Human
gcccccacaccuggcccuggggc

SEQ ID NO: 3447212 - RNA, 21 nt, Human
gcccccacauuugugccgaca

SEQ ID NO: 3447213 - RNA, 15 nt, Human
gcccccaccacacau

SEQ ID NO: 3447214 - RNA, 21 nt, Human
gcccccaccacacaucccagc

SEQ ID NO: 3447215 - RNA, 22 nt, Human
gcccccaccccggggacccugu

SEQ ID NO: 3447216 - RNA, 12 nt, Human
gcccccacccug

SEQ ID NO: 3447217 - RNA, 22 nt, Human
gcccccacccuguuccugcugc

SEQ ID NO: 3447218 - RNA, 22 nt, Human
gcccccaccgugggcagggagc

SEQ ID NO: 3447219 - RNA, 14 nt, Human
gcccccaccuccac

SEQ ID NO: 3447220 - RNA, 15 nt, Human
gcccccaccuccacc

SEQ ID NO: 3447221 - RNA, 21 nt, Human
gcccccacuggcugugggcuc

SEQ ID NO: 3447222 - RNA, 21 nt, Human
gcccccacuugccucuuccuu

SEQ ID NO: 3447223 - RNA, 12 nt, Human
gcccccagacgc

SEQ ID NO: 3447224 - RNA, 15 nt, Human
gcccccagagccaca

SEQ ID NO: 3447225 - RNA, 16 nt, Human
gcccccagagccacag

SEQ ID NO: 3447226 - RNA, 15 nt, Human
gcccccagcccccuc

SEQ ID NO: 3447227 - RNA, 21 nt, Human
gcccccagccccggggugagu

SEQ ID NO: 3447228 - RNA, 14 nt, Human
gcccccagccuguc

SEQ ID NO: 3447229 - RNA, 18 nt, Human
cugguaggaccaagcauc

SEQ ID NO: 3447230 - RNA, 13 nt, Human
cugguagggcagu

SEQ ID NO: 3447231 - RNA, 17 nt, Human
cugguagguugggacac

SEQ ID NO: 3447232 - RNA, 22 nt, Human
cugguagguugggacaccaggg

SEQ ID NO: 3447233 - RNA, 19 nt, Human
cugguaguuaguagcaugu

SEQ ID NO: 3447234 - RNA, 20 nt, Human
cugguauauccaaaagcuuu

SEQ ID NO: 3447235 - RNA, 19 nt, Human
cugguaucuaauucuuuaa

SEQ ID NO: 3447236 - RNA, 22 nt, Human
cugguaugaacuugaggacaca

SEQ ID NO: 3447237 - RNA, 11 nt, Human
cugguauuaaa

SEQ ID NO: 3447238 - RNA, 17 nt, Human
cugguauuccugccucc

SEQ ID NO: 3447239 - RNA, 20 nt, Human
cugguauucuguucuggagg

SEQ ID NO: 3447240 - RNA, 15 nt, Human
cugguauuguucuca

SEQ ID NO: 3447241 - RNA, 15 nt, Human
cuggucaaccuccug

SEQ ID NO: 3447242 - RNA, 19 nt, Human
cuggucaacuugagcaugu

SEQ ID NO: 3447243 - RNA, 16 nt, Human
cuggucacacacaggu

SEQ ID NO: 3447244 - RNA, 18 nt, Human
cuggucacagccuccucu

SEQ ID NO: 3447245 - RNA, 19 nt, Human
cuggucacaggacucugcc

SEQ ID NO: 3447246 - RNA, 17 nt, Human
cuggucaccuaggaagc

SEQ ID NO: 3447247 - RNA, 18 nt, Human
cuggucaccuaggaagcc

SEQ ID NO: 3447248 - RNA, 19 nt, Human
cuggucaccuaggaagccu

SEQ ID NO: 3447249 - RNA, 22 nt, Human
cuggucaccuaggaagccucag

SEQ ID NO: 3447250 - RNA, 16 nt, Human
cuggucacuucuucug

SEQ ID NO: 3447251 - RNA, 13 nt, Human
cugguccacaggg

SEQ ID NO: 3447252 - RNA, 15 nt, Human
cugguccagggaagc

SEQ ID NO: 3447253 - RNA, 21 nt, Human
cugguccauagagagcaagac

SEQ ID NO: 3447254 - RNA, 18 nt, Human
cugguccaugcagggggc

SEQ ID NO: 3447255 - RNA, 21 nt, Human
cugguccggacacuccuagag

SEQ ID NO: 3447256 - RNA, 22 nt, Human
cugguccuacccauccccgcag

SEQ ID NO: 3447257 - RNA, 14 nt, Human
cugguccugugugc

SEQ ID NO: 3447258 - RNA, 17 nt, Human
cugguccuuccaggccc

SEQ ID NO: 3447259 - RNA, 16 nt, Human
cugguccuuucuuccg

SEQ ID NO: 3447260 - RNA, 15 nt, Human
cuggucgccuuccac

SEQ ID NO: 3447261 - RNA, 23 nt, Human
cuggucgcuccugcccacggagu

SEQ ID NO: 3447262 - RNA, 22 nt, Human
cuggucguaaacaucucagaga

SEQ ID NO: 3447263 - RNA, 19 nt, Human
cuggucucaaacuccugac

SEQ ID NO: 3447264 - RNA, 21 nt, Human
cuggucucaaacuccugggcu

SEQ ID NO: 3447265 - RNA, 18 nt, Human
cuggucucacccuggagg

SEQ ID NO: 3447266 - RNA, 14 nt, Human
cuggucucagcagc

SEQ ID NO: 3447267 - RNA, 16 nt, Human
cuggucuccucagccu

SEQ ID NO: 3447268 - RNA, 22 nt, Human
cuggucuccucuuuguuuuguu

SEQ ID NO: 3447269 - RNA, 22 nt, Human
cuggucuccugcccccacaccu

SEQ ID NO: 3447270 - RNA, 21 nt, Human
cuggucucgaacuccugaccu

SEQ ID NO: 3447271 - RNA, 14 nt, Human
cuggucucuaggcu

SEQ ID NO: 3447272 - RNA, 17 nt, Human
cuggucucucuaugccu

SEQ ID NO: 3447273 - RNA, 21 nt, Human
cuggucucucuaugccucucu

SEQ ID NO: 3447274 - RNA, 24 nt, Human
cuggucucucuaugccucucuaca

SEQ ID NO: 3447275 - RNA, 12 nt, Human
cuggucugaggg

SEQ ID NO: 3447276 - RNA, 19 nt, Human
cuggucugcuguuccagug

SEQ ID NO: 3447277 - RNA, 14 nt, Human
cuggucuguaggga

SEQ ID NO: 3447278 - RNA, 16 nt, Human
cuggucuuauuuguaa

SEQ ID NO: 3447279 - RNA, 12 nt, Human
cuggucuuccuu

SEQ ID NO: 3447280 - RNA, 16 nt, Human
cuggucuucuuugggu

SEQ ID NO: 3447281 - RNA, 18 nt, Human
cuggucuugaacuccugg

SEQ ID NO: 3447282 - RNA, 16 nt, Human
cuggucuugaaguccu

SEQ ID NO: 3447283 - RNA, 18 nt, Human
cuggucuugaaguccugg

SEQ ID NO: 3447284 - RNA, 20 nt, Human
cuggucuuguggaauuggga

SEQ ID NO: 3447285 - RNA, 19 nt, Human
cuggucuuguuagaaaaca

SEQ ID NO: 3447286 - RNA, 12 nt, Human
cuggucuuugag

SEQ ID NO: 3447287 - RNA, 19 nt, Human
cuggucuuugagcucccac

SEQ ID NO: 3447288 - RNA, 14 nt, Human
cuggugaauauuuu

SEQ ID NO: 3447289 - RNA, 14 nt, Human
cuggugacaccagc

SEQ ID NO: 3447290 - RNA, 17 nt, Human
cuggugacaccagccuu

SEQ ID NO: 3447291 - RNA, 20 nt, Human
cuggugacaucagguuuuuc

SEQ ID NO: 3447292 - RNA, 23 nt, Human
cuggugaccuuccaagagccuga

SEQ ID NO: 3447293 - RNA, 13 nt, Human
cuggugacugauu

SEQ ID NO: 3447294 - RNA, 14 nt, Human
cuggugacugauuc

SEQ ID NO: 3447295 - RNA, 17 nt, Human
cuggugacugauucuuc

SEQ ID NO: 3447296 - RNA, 20 nt, Human
cuggugacuuuccucuuugg

SEQ ID NO: 3447297 - RNA, 21 nt, Human
cuggugagagggccgggcaga

SEQ ID NO: 3447298 - RNA, 14 nt, Human
cuggugagccaagc

SEQ ID NO: 3447299 - RNA, 13 nt, Human
cuggugaggaagc

SEQ ID NO: 3447300 - RNA, 15 nt, Human
cuggugaggccuugc

SEQ ID NO: 3447301 - RNA, 21 nt, Human
cuggugagucuuggcggcagc

SEQ ID NO: 3447302 - RNA, 16 nt, Human
cuggugauaaggacau

SEQ ID NO: 3447303 - RNA, 21 nt, Human
cuggugaugcgcaguugcugu

SEQ ID NO: 3447304 - RNA, 21 nt, Human
cuggugauggagguuucauac

SEQ ID NO: 3447305 - RNA, 23 nt, Human
cuggugcaaguugaggacuucuu

SEQ ID NO: 3447306 - RNA, 16 nt, Human
cuggugcacuuuguaa

SEQ ID NO: 3447307 - RNA, 18 nt, Human
cuggugcacuuuguaaau

SEQ ID NO: 3447308 - RNA, 13 nt, Human
cuggugcagggcc

SEQ ID NO: 3447309 - RNA, 14 nt, Human
cuggugcauuacag

SEQ ID NO: 3447310 - RNA, 17 nt, Human
cuggugcauuacagaga

SEQ ID NO: 3447311 - RNA, 21 nt, Human
cuggugccagccuuccucugc

SEQ ID NO: 3447312 - RNA, 20 nt, Human
cuggugcccuaaccucugag

SEQ ID NO: 3447313 - RNA, 11 nt, Human
cuggugcccug

SEQ ID NO: 3447314 - RNA, 15 nt, Human
cuggugcccugcuuu

SEQ ID NO: 3447315 - RNA, 16 nt, Human
cuggugcccugcuuuc

SEQ ID NO: 3447316 - RNA, 17 nt, Human
cuggugcccuggaugcc

SEQ ID NO: 3447317 - RNA, 21 nt, Human
cuggugccucaccccuugcca

SEQ ID NO: 3447318 - RNA, 15 nt, Human
cuggugccuccagag

SEQ ID NO: 3447319 - RNA, 18 nt, Human
cuggugcggcuggccaug

SEQ ID NO: 3447320 - RNA, 20 nt, Human
cuggugcuauaggcuggaga

SEQ ID NO: 3447321 - RNA, 23 nt, Human
cuggugcuauaggcuggagaagc

SEQ ID NO: 3447322 - RNA, 14 nt, Human
cuggugcucucugc

SEQ ID NO: 3447323 - RNA, 19 nt, Human
cuggugcugccucuaccug

SEQ ID NO: 3447324 - RNA, 12 nt, Human
cuggugcugugg

SEQ ID NO: 3447325 - RNA, 17 nt, Human
cuggugcuguggccagg

SEQ ID NO: 3447326 - RNA, 17 nt, Human
cuggugcuuccaaauau

SEQ ID NO: 3447327 - RNA, 17 nt, Human
cugguggacaguccugg

SEQ ID NO: 3447328 - RNA, 22 nt, Human
cugguggagaaagcacugaccu

SEQ ID NO: 3447329 - RNA, 17 nt, Human
cugguggcagcucaccu

SEQ ID NO: 3447330 - RNA, 15 nt, Human
cugguggcagcugcg

SEQ ID NO: 3447331 - RNA, 22 nt, Human
cugguggcaggggcuucuagcu

SEQ ID NO: 3447332 - RNA, 13 nt, Human
cugguggcccagg

SEQ ID NO: 3447333 - RNA, 22 nt, Human
cugguggccccguuucuggugg

SEQ ID NO: 3447334 - RNA, 16 nt, Human
cugguggccccugccu

SEQ ID NO: 3447335 - RNA, 22 nt, Human
cugguggcccgacagccuggca

SEQ ID NO: 3447336 - RNA, 17 nt, Human
cugguggcccucucccc

SEQ ID NO: 3447337 - RNA, 14 nt, Human
cugguggccucugc

SEQ ID NO: 3447338 - RNA, 15 nt, Human
cugguggccucugcc

SEQ ID NO: 3447339 - RNA, 15 nt, Human
cugguggcucccgga

SEQ ID NO: 3447340 - RNA, 23 nt, Human
cuggugggaggggcgcccaccuc

SEQ ID NO: 3447341 - RNA, 24 nt, Human
cuggugggaucugugcccagagau

SEQ ID NO: 3447342 - RNA, 12 nt, Human
cuggugggccuc

SEQ ID NO: 3447343 - RNA, 14 nt, Human
cugguggggcagcu

SEQ ID NO: 3447344 - RNA, 17 nt, Human
cugguggggcagcuccu

SEQ ID NO: 3447345 - RNA, 22 nt, Human
cuggugggguguguuccaacug

SEQ ID NO: 3447346 - RNA, 16 nt, Human
cugguggguccagggg

SEQ ID NO: 3447347 - RNA, 21 nt, Human
cuggugggugccuaggccugg

SEQ ID NO: 3447348 - RNA, 16 nt, Human
cuggugguauuuucaa

SEQ ID NO: 3447349 - RNA, 20 nt, Human
cuggugguucacucuuggag

SEQ ID NO: 3447350 - RNA, 21 nt, Human
cuggugguucacucuuggagc

SEQ ID NO: 3447351 - RNA, 21 nt, Human
cuggugguuucacggugccag

SEQ ID NO: 3447352 - RNA, 17 nt, Human
cugguguagcuacagag

SEQ ID NO: 3447353 - RNA, 19 nt, Human
cugguguagcuacagagaa

SEQ ID NO: 3447354 - RNA, 21 nt, Human
cugguguagcuacagagaaac

SEQ ID NO: 3447355 - RNA, 17 nt, Human
cuggugucaccccagag

SEQ ID NO: 3447356 - RNA, 18 nt, Human
cuggugucaccccagagc

SEQ ID NO: 3447357 - RNA, 19 nt, Human
cuggugucaccccagagcc

SEQ ID NO: 3447358 - RNA, 20 nt, Human
cuggugucaccccagagcca

SEQ ID NO: 3447359 - RNA, 15 nt, Human
cuggugucacuuacu

SEQ ID NO: 3447360 - RNA, 14 nt, Human
cugguguccugacc

SEQ ID NO: 3447361 - RNA, 16 nt, Human
cugguguccugaccac

SEQ ID NO: 3447362 - RNA, 17 nt, Human
cugguguccugaccacc

SEQ ID NO: 3447363 - RNA, 17 nt, Human
cuggugugaacuaaacu

SEQ ID NO: 3447364 - RNA, 14 nt, Human
cuggugugguacag

SEQ ID NO: 3447365 - RNA, 20 nt, Human
cuggugugguacagagaagc

SEQ ID NO: 3447366 - RNA, 21 nt, Human
cuggugugguacagagaagcc

SEQ ID NO: 3447367 - RNA, 22 nt, Human
cuggugugguacagagaagcca

SEQ ID NO: 3447368 - RNA, 12 nt, Human
cugguguuaaca

SEQ ID NO: 3447369 - RNA, 16 nt, Human
cugguguuaacagaag

SEQ ID NO: 3447370 - RNA, 22 nt, Human
cugguguuuaggugaauuaauu

SEQ ID NO: 3447371 - RNA, 14 nt, Human
cugguguuucuuga

SEQ ID NO: 3447372 - RNA, 20 nt, Human
cugguuagcucagccccagc

SEQ ID NO: 3447373 - RNA, 20 nt, Human
cuguacuugguccaacugca

SEQ ID NO: 3447374 - RNA, 21 nt, Human
cuguacuugguccaacugcaa

SEQ ID NO: 3447375 - RNA, 17 nt, Human
cuguacuuucuauuuua

SEQ ID NO: 3447376 - RNA, 18 nt, Human
cuguacuuuucauucucu

SEQ ID NO: 3447377 - RNA, 20 nt, Human
cuguagaaaugguuguauua

SEQ ID NO: 3447378 - RNA, 21 nt, Human
cuguagaauagccuguggccu

SEQ ID NO: 3447379 - RNA, 14 nt, Human
cuguagaaucaauu

SEQ ID NO: 3447380 - RNA, 16 nt, Human
cuguagaaucaauuua

SEQ ID NO: 3447381 - RNA, 18 nt, Human
cuguagagccuucugaug

SEQ ID NO: 3447382 - RNA, 15 nt, Human
cuguagagugggagc

SEQ ID NO: 3447383 - RNA, 13 nt, Human
cuguagaguugcu

SEQ ID NO: 3447384 - RNA, 18 nt, Human
cuguagauggaaaaacuu

SEQ ID NO: 3447385 - RNA, 15 nt, Human
cuguagauucugugg

SEQ ID NO: 3447386 - RNA, 19 nt, Human
cuguagcaucuucuggagu

SEQ ID NO: 3447387 - RNA, 20 nt, Human
cuguagcaucuucuggaguc

SEQ ID NO: 3447388 - RNA, 21 nt, Human
cuguagcccacucugcucgcc

SEQ ID NO: 3447389 - RNA, 18 nt, Human
cuguagccccagugacag

SEQ ID NO: 3447390 - RNA, 13 nt, Human
cuguagccuucug

SEQ ID NO: 3447391 - RNA, 22 nt, Human
gccgugugagugugacagggcc

SEQ ID NO: 3447392 - RNA, 22 nt, Human
gccgugugugugcguccugucg

SEQ ID NO: 3447393 - RNA, 18 nt, Human
gccguguguugcaugcag

SEQ ID NO: 3447394 - RNA, 18 nt, Human
gccguugaagaggaaggg

SEQ ID NO: 3447395 - RNA, 18 nt, Human
gccguugcugacuuagaa

SEQ ID NO: 3447396 - RNA, 23 nt, Human
gccguuugagaagaaaacaucua

SEQ ID NO: 3447397 - RNA, 15 nt, Human
gccuaaaaauaaagc

SEQ ID NO: 3447398 - RNA, 14 nt, Human
gccuaaaaaugcaa

SEQ ID NO: 3447399 - RNA, 15 nt, Human
gccuaaaaguaaaca

SEQ ID NO: 3447400 - RNA, 22 nt, Human
gccuaaaagugggcuugauucu

SEQ ID NO: 3447401 - RNA, 20 nt, Human
gccuaaaaucuuggaaguac

SEQ ID NO: 3447402 - RNA, 23 nt, Human
gccuaaauccauuuggaaaucuu

SEQ ID NO: 3447403 - RNA, 16 nt, Human
gccuaacaccagcguu

SEQ ID NO: 3447404 - RNA, 15 nt, Human
gccuaagacauguaa

SEQ ID NO: 3447405 - RNA, 12 nt, Human
gccuaagaggcu

SEQ ID NO: 3447406 - RNA, 12 nt, Human
gccuaaggacuu

SEQ ID NO: 3447407 - RNA, 17 nt, Human
gccuaaguggcugcuga

SEQ ID NO: 3447408 - RNA, 21 nt, Human
gccuaauaaaacugaugugaa

SEQ ID NO: 3447409 - RNA, 14 nt, Human
gccuaaucccuggg

SEQ ID NO: 3447410 - RNA, 22 nt, Human
gccuaaucccugggcauugcuu

SEQ ID NO: 3447411 - RNA, 22 nt, Human
gccuaaucucauaccucugacc

SEQ ID NO: 3447412 - RNA, 14 nt, Human
gccuacagaugaac

SEQ ID NO: 3447413 - RNA, 16 nt, Human
gccuacaggagugagc

SEQ ID NO: 3447414 - RNA, 16 nt, Human
gccuacccacccccag

SEQ ID NO: 3447415 - RNA, 14 nt, Human
gccuaccccgcaga

SEQ ID NO: 3447416 - RNA, 17 nt, Human
gccuaccccgcagacac

SEQ ID NO: 3447417 - RNA, 14 nt, Human
gccuaccugcucuc

SEQ ID NO: 3447418 - RNA, 22 nt, Human
gccuacuccugucuucugcuuu

SEQ ID NO: 3447419 - RNA, 19 nt, Human
gccuacucgcuugcuagaa

SEQ ID NO: 3447420 - RNA, 13 nt, Human
gccuagaagcugg

SEQ ID NO: 3447421 - RNA, 14 nt, Human
gccuagaccagcag

SEQ ID NO: 3447422 - RNA, 16 nt, Human
gccuagaccagcagac

SEQ ID NO: 3447423 - RNA, 13 nt, Human
gccuagaggccug

SEQ ID NO: 3447424 - RNA, 17 nt, Human
gccuagauccacacaca

SEQ ID NO: 3447425 - RNA, 17 nt, Human
gccuagcaagcuggccu

SEQ ID NO: 3447426 - RNA, 12 nt, Human
gccuagcacagc

SEQ ID NO: 3447427 - RNA, 16 nt, Human
gccuagcacagcagcu

SEQ ID NO: 3447428 - RNA, 20 nt, Human
gccuagcauacguacacauu

SEQ ID NO: 3447429 - RNA, 23 nt, Human
gccuagcauacguacacauuuua

SEQ ID NO: 3447430 - RNA, 14 nt, Human
gccuagcccacccu

SEQ ID NO: 3447431 - RNA, 16 nt, Human
gccuagcccacccugc

SEQ ID NO: 3447432 - RNA, 18 nt, Human
gccuagccucacgcuccu

SEQ ID NO: 3447433 - RNA, 17 nt, Human
gccuagcugcuacaaag

SEQ ID NO: 3447434 - RNA, 23 nt, Human
gccuagcugcuacaaagaagaca

SEQ ID NO: 3447435 - RNA, 13 nt, Human
gccuagcugcugu

SEQ ID NO: 3447436 - RNA, 15 nt, Human
gccuaggaccacuca

SEQ ID NO: 3447437 - RNA, 23 nt, Human
gccuaggaccacucagccccuag

SEQ ID NO: 3447438 - RNA, 16 nt, Human
gccuaggaggguccuc

SEQ ID NO: 3447439 - RNA, 22 nt, Human
gccuaggauucacaccccaccu

SEQ ID NO: 3447440 - RNA, 23 nt, Human
gccuaggauucacaccccaccug

SEQ ID NO: 3447441 - RNA, 20 nt, Human
gccuaggccucagccagaga

SEQ ID NO: 3447442 - RNA, 12 nt, Human
gccuaggccugg

SEQ ID NO: 3447443 - RNA, 14 nt, Human
gccuaggcugcauu

SEQ ID NO: 3447444 - RNA, 20 nt, Human
gccuaggugacagagugaga

SEQ ID NO: 3447445 - RNA, 15 nt, Human
gccuagucagccaca

SEQ ID NO: 3447446 - RNA, 22 nt, Human
gccuagucagccacaugggaaa

SEQ ID NO: 3447447 - RNA, 14 nt, Human
gccuagucccuucc

SEQ ID NO: 3447448 - RNA, 19 nt, Human
gccuaguggggucucccuc

SEQ ID NO: 3447449 - RNA, 23 nt, Human
gccuaguggggucucccucuccu

SEQ ID NO: 3447450 - RNA, 22 nt, Human
gccuauaagccaaaauuaaggu

SEQ ID NO: 3447451 - RNA, 21 nt, Human
gccuauaaugaagcuuuauac

SEQ ID NO: 3447452 - RNA, 23 nt, Human
gccuaucaaagaccuugugugua

SEQ ID NO: 3447453 - RNA, 13 nt, Human
gccuaucagugug

SEQ ID NO: 3447454 - RNA, 15 nt, Human
gccuaucagugugcc

SEQ ID NO: 3447455 - RNA, 13 nt, Human
gccuauccgcugc

SEQ ID NO: 3447456 - RNA, 18 nt, Human
gccuauccgcugccagcc

SEQ ID NO: 3447457 - RNA, 21 nt, Human
gccuaucuccuagggcuaugg

SEQ ID NO: 3447458 - RNA, 18 nt, Human
gccuaugacuugggcacc

SEQ ID NO: 3447459 - RNA, 22 nt, Human
gccuaugagcauccugagcccc

SEQ ID NO: 3447460 - RNA, 18 nt, Human
gccuaugaucccagcacu

SEQ ID NO: 3447461 - RNA, 13 nt, Human
gccuauggagagc

SEQ ID NO: 3447462 - RNA, 16 nt, Human
gccuauggagagcccu

SEQ ID NO: 3447463 - RNA, 22 nt, Human
gccuaugugcaugcagcaucua

SEQ ID NO: 3447464 - RNA, 22 nt, Human
gccuauuaguaguuaauucugu

SEQ ID NO: 3447465 - RNA, 23 nt, Human
gccuauugcuagagcuccucccu

SEQ ID NO: 3447466 - RNA, 23 nt, Human
gccuauuuuuuuagauugagaaa

SEQ ID NO: 3447467 - RNA, 13 nt, Human
gccucaaaaugug

SEQ ID NO: 3447468 - RNA, 15 nt, Human
gccucaaaggcccgc

SEQ ID NO: 3447469 - RNA, 17 nt, Human
gccucaaaggcccgcuc

SEQ ID NO: 3447470 - RNA, 20 nt, Human
gccucaaauaaaaagugcuu

SEQ ID NO: 3447471 - RNA, 14 nt, Human
gccucaaauccagg

SEQ ID NO: 3447472 - RNA, 18 nt, Human
gccucaaauccaggaccc

SEQ ID NO: 3447473 - RNA, 17 nt, Human
gccucaacccucccuca

SEQ ID NO: 3447474 - RNA, 19 nt, Human
gccucaacccucccucagc

SEQ ID NO: 3447475 - RNA, 21 nt, Human
gccucaacccucccucagccc

SEQ ID NO: 3447476 - RNA, 23 nt, Human
gccucaacccucccucagccccu

SEQ ID NO: 3447477 - RNA, 15 nt, Human
gccucaaccucccaa

SEQ ID NO: 3447478 - RNA, 15 nt, Human
gccucaacuccuccc

SEQ ID NO: 3447479 - RNA, 22 nt, Human
gccucaacucugcugagggucc

SEQ ID NO: 3447480 - RNA, 13 nt, Human
gccucaaggacuu

SEQ ID NO: 3447481 - RNA, 14 nt, Human
gccucaaugccagu

SEQ ID NO: 3447482 - RNA, 21 nt, Human
gccucaaugugaaucagaccc

SEQ ID NO: 3447483 - RNA, 23 nt, Human
gccucacacgguuugaagccugg

SEQ ID NO: 3447484 - RNA, 15 nt, Human
gccucacagaagaau

SEQ ID NO: 3447485 - RNA, 19 nt, Human
gccucaccagcccuggcaa

SEQ ID NO: 3447486 - RNA, 15 nt, Human
gccucacccaccccu

SEQ ID NO: 3447487 - RNA, 19 nt, Human
gccucacccaccccugcac

SEQ ID NO: 3447488 - RNA, 23 nt, Human
gccucacccccucgggucuccuc

SEQ ID NO: 3447489 - RNA, 16 nt, Human
gccucaccucuaccca

SEQ ID NO: 3447490 - RNA, 12 nt, Human
gccucacugaaa

SEQ ID NO: 3447491 - RNA, 17 nt, Human
gccucacuggggcagac

SEQ ID NO: 3447492 - RNA, 20 nt, Human
gccucacuugaaugugucac

SEQ ID NO: 3447493 - RNA, 23 nt, Human
gccucacuuuuaaugaacaaaug

SEQ ID NO: 3447494 - RNA, 16 nt, Human
gccucagacucauaca

SEQ ID NO: 3447495 - RNA, 15 nt, Human
gccucagacugcacc

SEQ ID NO: 3447496 - RNA, 19 nt, Human
gccucagacugcacccagg

SEQ ID NO: 3447497 - RNA, 20 nt, Human
gccucagacugcacccagga

SEQ ID NO: 3447498 - RNA, 21 nt, Human
gccucagacugcacccaggag

SEQ ID NO: 3447499 - RNA, 18 nt, Human
gccucagagaccagggcu

SEQ ID NO: 3447500 - RNA, 15 nt, Human
gccucagcauccugg

SEQ ID NO: 3447501 - RNA, 21 nt, Human
gccucagcauccuggcacccg

SEQ ID NO: 3447502 - RNA, 15 nt, Human
gccucagccauucac

SEQ ID NO: 3447503 - RNA, 17 nt, Human
gccucagccauucacug

SEQ ID NO: 3447504 - RNA, 22 nt, Human
gccucagcccugacccugugga

SEQ ID NO: 3447505 - RNA, 14 nt, Human
gccucagccuccca

SEQ ID NO: 3447506 - RNA, 16 nt, Human
gccucagcgcggcccu

SEQ ID NO: 3447507 - RNA, 20 nt, Human
gccucagcuacccacuaucc

SEQ ID NO: 3447508 - RNA, 15 nt, Human
gccucagcucccaca

SEQ ID NO: 3447509 - RNA, 21 nt, Human
gccucagcucccacaagccuc

SEQ ID NO: 3447510 - RNA, 16 nt, Human
gccucagcuuccccag

SEQ ID NO: 3447511 - RNA, 17 nt, Human
gccucaggacugggagc

SEQ ID NO: 3447512 - RNA, 23 nt, Human
gccucagggcagccugccuggag

SEQ ID NO: 3447513 - RNA, 16 nt, Human
gccucaggggucugag

SEQ ID NO: 3447514 - RNA, 12 nt, Human
gccucaggugcu

SEQ ID NO: 3447515 - RNA, 16 nt, Human
gccucaggugggccgc

SEQ ID NO: 3447516 - RNA, 13 nt, Human
gccucagguuccu

SEQ ID NO: 3447517 - RNA, 16 nt, Human
gccucacuugaaugug

SEQ ID NO: 3447518 - RNA, 18 nt, Human
gccucacuugaauguguc

SEQ ID NO: 3447519 - RNA, 23 nt, Human
gccucagaauugaucauuuuccc

SEQ ID NO: 3447520 - RNA, 12 nt, Human
gccucagagacc

SEQ ID NO: 3447521 - RNA, 18 nt, Human
gccucagauuccuuccca

SEQ ID NO: 3447522 - RNA, 22 nt, Human
gccucagauuccuucccaugga

SEQ ID NO: 3447523 - RNA, 13 nt, Human
gccucagccagag

SEQ ID NO: 3447524 - RNA, 15 nt, Human
gccucagccagagaa

SEQ ID NO: 3447525 - RNA, 17 nt, Human
gccucagcccugacccu

SEQ ID NO: 3447526 - RNA, 16 nt, Human
gccucagccuccugag

SEQ ID NO: 3447527 - RNA, 14 nt, Human
gccucagcugccuc

SEQ ID NO: 3447528 - RNA, 19 nt, Human
gccucagcugccucacuuc

SEQ ID NO: 3447529 - RNA, 17 nt, Human
gccucagcuuccccagu

SEQ ID NO: 3447530 - RNA, 16 nt, Human
gccucaggacugggag

SEQ ID NO: 3447531 - RNA, 23 nt, Human
gccucaggacugggagcccccag

SEQ ID NO: 3447532 - RNA, 12 nt, Human
gccucaggcugc

SEQ ID NO: 3447533 - RNA, 18 nt, Human
gccucagggcagccugcc

SEQ ID NO: 3447534 - RNA, 20 nt, Human
gccucaguaagacgacaagg

SEQ ID NO: 3447535 - RNA, 21 nt, Human
gccucaguauauuuaaacuca

SEQ ID NO: 3447536 - RNA, 16 nt, Human
gccucaguccuccccu

SEQ ID NO: 3447537 - RNA, 15 nt, Human
gccucagucucccuc

SEQ ID NO: 3447538 - RNA, 21 nt, Human
gccucagucucccuucuccca

SEQ ID NO: 3447539 - RNA, 11 nt, Human
gccucagugga

SEQ ID NO: 3447540 - RNA, 22 nt, Human
gccucaguggacuuuccacccc

SEQ ID NO: 3447541 - RNA, 13 nt, Human
gccucauauuuaa

SEQ ID NO: 3447542 - RNA, 16 nt, Human
gccucauccgaggcag

SEQ ID NO: 3447543 - RNA, 17 nt, Human
gccucauccgaggcagg

SEQ ID NO: 3447544 - RNA, 22 nt, Human
gccucauccgaggcagggucag

SEQ ID NO: 3447545 - RNA, 19 nt, Human
gccucaugcuaagacucag

SEQ ID NO: 3447546 - RNA, 22 nt, Human
gccucauguccacugguucuuc

SEQ ID NO: 3447547 - RNA, 15 nt, Human
gccucauguggcugg

SEQ ID NO: 3447548 - RNA, 17 nt, Human
gccucauguggcuggaa

SEQ ID NO: 3447549 - RNA, 18 nt, Human
gccucauguggcuggaag

SEQ ID NO: 3447550 - RNA, 15 nt, Human
gccucauuuuuuucc

SEQ ID NO: 3447551 - RNA, 17 nt, Human
gccuccaaccccucgcc

SEQ ID NO: 3447552 - RNA, 17 nt, Human
gccuccaagcuccaucu

SEQ ID NO: 3447553 - RNA, 23 nt, Human
gccuccaaggaggggcuguaaaa

SEQ ID NO: 3447554 - RNA, 12 nt, Human
gccuccaccacc

SEQ ID NO: 3447555 - RNA, 15 nt, Human
gccuccaccaccacu

SEQ ID NO: 3447556 - RNA, 16 nt, Human
gccuccaccaccacug

SEQ ID NO: 3447557 - RNA, 15 nt, Human
gccuccacccucuga

SEQ ID NO: 3447558 - RNA, 17 nt, Human
gccuccacccucugagc

SEQ ID NO: 3447559 - RNA, 18 nt, Human
gccuccacccucugagcu

SEQ ID NO: 3447560 - RNA, 12 nt, Human
gccuccaccgcu

SEQ ID NO: 3447561 - RNA, 22 nt, Human
gccuccacucccacuucccuga

SEQ ID NO: 3447562 - RNA, 19 nt, Human
gccuccagaacucacuggg

SEQ ID NO: 3447563 - RNA, 21 nt, Human
gccuccagcccucucacugug

SEQ ID NO: 3447564 - RNA, 11 nt, Human
gccuccagccu

SEQ ID NO: 3447565 - RNA, 12 nt, Human
gccuccagccuc

SEQ ID NO: 3447566 - RNA, 15 nt, Human
gccuccagccucugu

SEQ ID NO: 3447567 - RNA, 12 nt, Human
gccuccagcuca

SEQ ID NO: 3447568 - RNA, 13 nt, Human
gccuccagcucag

SEQ ID NO: 3447569 - RNA, 19 nt, Human
gccuccaggaaccacacca

SEQ ID NO: 3447570 - RNA, 21 nt, Human
gccuccaggcccgucugucca

SEQ ID NO: 3447571 - RNA, 12 nt, Human
gccuccagggcu

SEQ ID NO: 3447572 - RNA, 20 nt, Human
gccuccagggcuggacugag

SEQ ID NO: 3447573 - RNA, 18 nt, Human
gccuccaggugcagaggu

SEQ ID NO: 3447574 - RNA, 12 nt, Human
gccuccaggugu

SEQ ID NO: 3447575 - RNA, 15 nt, Human
gccuccaucagcuaa

SEQ ID NO: 3447576 - RNA, 15 nt, Human
gccuccauccaaggc

SEQ ID NO: 3447577 - RNA, 21 nt, Human
gccuccauuccuggagcccga

SEQ ID NO: 3447578 - RNA, 17 nt, Human
gccuccauucugaccau

SEQ ID NO: 3447579 - RNA, 13 nt, Human
gccucccaaagug

SEQ ID NO: 3447580 - RNA, 19 nt, Human
gccucccaaagugcuggga

SEQ ID NO: 3447581 - RNA, 13 nt, Human
gccucccaacuca

SEQ ID NO: 3447582 - RNA, 16 nt, Human
gccucccaacucaccc

SEQ ID NO: 3447583 - RNA, 21 nt, Human
gccucccaaggagaacaaaua

SEQ ID NO: 3447584 - RNA, 12 nt, Human
gccucccacagu

SEQ ID NO: 3447585 - RNA, 23 nt, Human
gccucccacagugacucgggcuc

SEQ ID NO: 3447586 - RNA, 12 nt, Human
gccucccacccc

SEQ ID NO: 3447587 - RNA, 17 nt, Human
gccucccacccccaucu

SEQ ID NO: 3447588 - RNA, 21 nt, Human
gccucccacccgaugcugcuu

SEQ ID NO: 3447589 - RNA, 13 nt, Human
gccucccacuggg

SEQ ID NO: 3447590 - RNA, 14 nt, Human
gccucccacugggg

SEQ ID NO: 3447591 - RNA, 14 nt, Human
gccucccagccugg

SEQ ID NO: 3447592 - RNA, 22 nt, Human
gccucccauccagggcccccau

SEQ ID NO: 3447593 - RNA, 16 nt, Human
gccuccccaccuccag

SEQ ID NO: 3447594 - RNA, 21 nt, Human
gccuccccacggccgcuccag

SEQ ID NO: 3447595 - RNA, 17 nt, Human
gccuccccagcucaccc

SEQ ID NO: 3447596 - RNA, 16 nt, Human
gccuccccauuuccca

SEQ ID NO: 3447597 - RNA, 20 nt, Human
gccuccccauuucccaucug

SEQ ID NO: 3447598 - RNA, 21 nt, Human
gccuccccauuucccaucugc

SEQ ID NO: 3447599 - RNA, 18 nt, Human
gccuccccgaaacaggcu

SEQ ID NO: 3447600 - RNA, 22 nt, Human
gccuccccuccucugcuugcca

SEQ ID NO: 3447601 - RNA, 14 nt, Human
gccuccccugccag

SEQ ID NO: 3447602 - RNA, 15 nt, Human
gccuccccugccagg

SEQ ID NO: 3447603 - RNA, 17 nt, Human
gccuccccugccagggc

SEQ ID NO: 3447604 - RNA, 18 nt, Human
gccuccccugccagggca

SEQ ID NO: 3447605 - RNA, 18 nt, Human
gccucccgaauagcuggg

SEQ ID NO: 3447606 - RNA, 16 nt, Human
gccucccgaguagcug

SEQ ID NO: 3447607 - RNA, 23 nt, Human
gccucccgaguagcugggacuac

SEQ ID NO: 3447608 - RNA, 14 nt, Human
gccucccucaaccc

SEQ ID NO: 3447609 - RNA, 21 nt, Human
gccucccuccaccccaggacg

SEQ ID NO: 3447610 - RNA, 18 nt, Human
gccucccuccccugcccu

SEQ ID NO: 3447611 - RNA, 19 nt, Human
gccucccuccccugcccuc

SEQ ID NO: 3447612 - RNA, 21 nt, Human
gccucccucucucuucugcuc

SEQ ID NO: 3447613 - RNA, 12 nt, Human
gccucccucuga

SEQ ID NO: 3447614 - RNA, 11 nt, Human
gccucccugaa

SEQ ID NO: 3447615 - RNA, 14 nt, Human
gccucccugccagu

SEQ ID NO: 3447616 - RNA, 14 nt, Human
gccucccugccuca

SEQ ID NO: 3447617 - RNA, 21 nt, Human
gccucccuguugaagcucugg

SEQ ID NO: 3447618 - RNA, 14 nt, Human
gccucccuuguggc

SEQ ID NO: 3447619 - RNA, 12 nt, Human
gccuccggccuc

SEQ ID NO: 3447620 - RNA, 16 nt, Human
gccuccggccuccccu

SEQ ID NO: 3447621 - RNA, 19 nt, Human
gccuccggcgucagccucc

SEQ ID NO: 3447622 - RNA, 16 nt, Human
gccuccgggaccccca

SEQ ID NO: 3447623 - RNA, 20 nt, Human
gccuccgggacccccaggac

SEQ ID NO: 3447624 - RNA, 16 nt, Human
gccuccguauuucaga

SEQ ID NO: 3447625 - RNA, 19 nt, Human
gccuccgucacuaccuggc

SEQ ID NO: 3447626 - RNA, 18 nt, Human
gccuccguccccugccca

SEQ ID NO: 3447627 - RNA, 14 nt, Human
gccuccucaccccc

SEQ ID NO: 3447628 - RNA, 17 nt, Human
gccuccucacccccagc

SEQ ID NO: 3447629 - RNA, 12 nt, Human
gccuccucagga

SEQ ID NO: 3447630 - RNA, 15 nt, Human
gccuccucaggagcc

SEQ ID NO: 3447631 - RNA, 17 nt, Human
gccuccucaucccgugu

SEQ ID NO: 3447632 - RNA, 22 nt, Human
gccuccucaucccguguucucc

SEQ ID NO: 3447633 - RNA, 13 nt, Human
gccuccuccagcc

SEQ ID NO: 3447634 - RNA, 13 nt, Human
gccuccucccucc

SEQ ID NO: 3447635 - RNA, 14 nt, Human
gccuccucccuccc

SEQ ID NO: 3447636 - RNA, 19 nt, Human
gccuccucccucccucucc

SEQ ID NO: 3447637 - RNA, 21 nt, Human
gccuccucccucccucuccga

SEQ ID NO: 3447638 - RNA, 15 nt, Human
gccuccuccugacca

SEQ ID NO: 3447639 - RNA, 22 nt, Human
gccuccucuaacaggggcuggu

SEQ ID NO: 3447640 - RNA, 21 nt, Human
gccuccucucauaaaagagac

SEQ ID NO: 3447641 - RNA, 23 nt, Human
gccuccucucucaguuuuuauau

SEQ ID NO: 3447642 - RNA, 17 nt, Human
gccuccucuggacggca

SEQ ID NO: 3447643 - RNA, 20 nt, Human
gccuccucuggacggcaggc

SEQ ID NO: 3447644 - RNA, 16 nt, Human
gccuccucuguccagg

SEQ ID NO: 3447645 - RNA, 17 nt, Human
gccuccucugucugccc

SEQ ID NO: 3447646 - RNA, 20 nt, Human
gccuccucuucaccccggca

SEQ ID NO: 3447647 - RNA, 20 nt, Human
gccuccugacacaccugcag

SEQ ID NO: 3447648 - RNA, 23 nt, Human
gccuccugacacaccugcagccu

SEQ ID NO: 3447649 - RNA, 17 nt, Human
gccuccugaccugaggc

SEQ ID NO: 3447650 - RNA, 15 nt, Human
gccuccuggcccagg

SEQ ID NO: 3447651 - RNA, 19 nt, Human
gccuccuggcccaggugag

SEQ ID NO: 3447652 - RNA, 13 nt, Human
gccuccugugggg

SEQ ID NO: 3447653 - RNA, 14 nt, Human
gccuccugugggga

SEQ ID NO: 3447654 - RNA, 13 nt, Human
gccuccugugugu

SEQ ID NO: 3447655 - RNA, 17 nt, Human
gccuccuuccaccuccc

SEQ ID NO: 3447656 - RNA, 18 nt, Human
gccuccuuccaccucccu

SEQ ID NO: 3447657 - RNA, 13 nt, Human
gccuccuuccucu

SEQ ID NO: 3447658 - RNA, 21 nt, Human
gccucgaacuccugggcucaa

SEQ ID NO: 3447659 - RNA, 17 nt, Human
gccucgaacuggcugca

SEQ ID NO: 3447660 - RNA, 15 nt, Human
gccucgacacguggg

SEQ ID NO: 3447661 - RNA, 22 nt, Human
gccucgacacgugggcuccccu

SEQ ID NO: 3447662 - RNA, 15 nt, Human
gccucgaggugccuu

SEQ ID NO: 3447663 - RNA, 15 nt, Human
gcgaccccaucugcc

SEQ ID NO: 3447664 - RNA, 13 nt, Human
gcgacccuggggg

SEQ ID NO: 3447665 - RNA, 19 nt, Human
gcgacccugggggcacagg

SEQ ID NO: 3447666 - RNA, 13 nt, Human
gcgaccgcccccu

SEQ ID NO: 3447667 - RNA, 10 nt, Human
gcgaccuccu

SEQ ID NO: 3447668 - RNA, 23 nt, Human
gcgaccuuccucauccaccccau

SEQ ID NO: 3447669 - RNA, 21 nt, Human
gcgacguuagucgugagcucu

SEQ ID NO: 3447670 - RNA, 22 nt, Human
gcgacguuagucgugagcucuu

SEQ ID NO: 3447671 - RNA, 21 nt, Human
gcgacucuauagacucuagga

SEQ ID NO: 3447672 - RNA, 14 nt, Human
gcgagacuccgucu

SEQ ID NO: 3447673 - RNA, 18 nt, Human
gcgagacuccgucucaaa

SEQ ID NO: 3447674 - RNA, 14 nt, Human
gcgagagaggagcc

SEQ ID NO: 3447675 - RNA, 16 nt, Human
gcgagagaggagccag

SEQ ID NO: 3447676 - RNA, 19 nt, Human
gcgagagaucaaagaugaa

SEQ ID NO: 3447677 - RNA, 16 nt, Human
gcgagaggcagagaaa

SEQ ID NO: 3447678 - RNA, 17 nt, Human
gcgagcccugguggcag

SEQ ID NO: 3447679 - RNA, 12 nt, Human
gcgagccugcua

SEQ ID NO: 3447680 - RNA, 19 nt, Human
gcgaggagaugcuccuugg

SEQ ID NO: 3447681 - RNA, 16 nt, Human
gcgaggcagaggacag

SEQ ID NO: 3447682 - RNA, 15 nt, Human
gcgagggcagcugcu

SEQ ID NO: 3447683 - RNA, 16 nt, Human
gcgaggucaacagaga

SEQ ID NO: 3447684 - RNA, 22 nt, Human
gcgagugaaugccagugugcug

SEQ ID NO: 3447685 - RNA, 15 nt, Human
gcgagugccaggacu

SEQ ID NO: 3447686 - RNA, 22 nt, Human
gcgagugccaggacuccccagg

SEQ ID NO: 3447687 - RNA, 20 nt, Human
gcgagugugugcaugugugu

SEQ ID NO: 3447688 - RNA, 13 nt, Human
gcgauauacagau

SEQ ID NO: 3447689 - RNA, 19 nt, Human
gcgauauacagaugaaaau

SEQ ID NO: 3447690 - RNA, 20 nt, Human
gcgaucauggcucacugcag

SEQ ID NO: 3447691 - RNA, 22 nt, Human
gcgaucauggcucacugcagcc

SEQ ID NO: 3447692 - RNA, 14 nt, Human
gcgaucucagcuca

SEQ ID NO: 3447693 - RNA, 18 nt, Human
gcgaucucuccacugugc

SEQ ID NO: 3447694 - RNA, 22 nt, Human
gcgauguggaacugcugccacu

SEQ ID NO: 3447695 - RNA, 18 nt, Human
gcgauucccucucccagg

SEQ ID NO: 3447696 - RNA, 19 nt, Human
gcgauucccucucccaggc

SEQ ID NO: 3447697 - RNA, 22 nt, Human
gcgauucccucucccaggcccc

SEQ ID NO: 3447698 - RNA, 20 nt, Human
gcgauucuggauaaagccac

SEQ ID NO: 3447699 - RNA, 17 nt, Human
gcgauucuucugcuuca

SEQ ID NO: 3447700 - RNA, 23 nt, Human
gcgauucuucugcuucagccucc

SEQ ID NO: 3447701 - RNA, 12 nt, Human
gcgcaagccugu

SEQ ID NO: 3447702 - RNA, 21 nt, Human
gcgcaagccuguaaucccagc

SEQ ID NO: 3447703 - RNA, 22 nt, Human
gcgcaagccuguaaucccagcu

SEQ ID NO: 3447704 - RNA, 23 nt, Human
gcgcaagccuguaaucccagcua

SEQ ID NO: 3447705 - RNA, 18 nt, Human
gcgcacaaggcugaccaa

SEQ ID NO: 3447706 - RNA, 16 nt, Human
gcgcacacacacacau

SEQ ID NO: 3447707 - RNA, 18 nt, Human
gcgcacacacacacauac

SEQ ID NO: 3447708 - RNA, 12 nt, Human
gcgcaccugccc

SEQ ID NO: 3447709 - RNA, 21 nt, Human
gcgcacuuuccuccuggcaga

SEQ ID NO: 3447710 - RNA, 20 nt, Human
gcgcagcauauucaggaagc

SEQ ID NO: 3447711 - RNA, 18 nt, Human
gcgcagcuggacucugca

SEQ ID NO: 3447712 - RNA, 14 nt, Human
gcgcaggcuggccc

SEQ ID NO: 3447713 - RNA, 15 nt, Human
gcgcaggcuggcccu

SEQ ID NO: 3447714 - RNA, 21 nt, Human
gcgcagugccucuggucuggg

SEQ ID NO: 3447715 - RNA, 14 nt, Human
gcgcagugccuugc

SEQ ID NO: 3447716 - RNA, 16 nt, Human
gcgcaguugcugucag

SEQ ID NO: 3447717 - RNA, 13 nt, Human
gcgcaucagacug

SEQ ID NO: 3447718 - RNA, 22 nt, Human
gcgcaucuugccuccaggugca

SEQ ID NO: 3447719 - RNA, 13 nt, Human
gcgccaauaaacc

SEQ ID NO: 3447720 - RNA, 22 nt, Human
gcgccacugugcuccagccugg

SEQ ID NO: 3447721 - RNA, 17 nt, Human
gcgccagcacagaaaca

SEQ ID NO: 3447722 - RNA, 14 nt, Human
gcgccaguccugcu

SEQ ID NO: 3447723 - RNA, 16 nt, Human
gcgccauugcacucca

SEQ ID NO: 3447724 - RNA, 20 nt, Human
gcgccauugcacuccagccu

SEQ ID NO: 3447725 - RNA, 13 nt, Human
gcgcccagggcug

SEQ ID NO: 3447726 - RNA, 19 nt, Human
gcgcccagggcugggagga

SEQ ID NO: 3447727 - RNA, 19 nt, Human
gcgcccaguccuuccaccu

SEQ ID NO: 3447728 - RNA, 18 nt, Human
gcgccccaacccguggag

SEQ ID NO: 3447729 - RNA, 21 nt, Human
gcgccccaacccguggaggcu

SEQ ID NO: 3447730 - RNA, 22 nt, Human
gcgcccccuccgcccugccacu

SEQ ID NO: 3447731 - RNA, 12 nt, Human
gcgccccuagcc

SEQ ID NO: 3447732 - RNA, 22 nt, Human
gcgcccgccccugcagcacgga

SEQ ID NO: 3447733 - RNA, 13 nt, Human
gcgcccgcgcccg

SEQ ID NO: 3447734 - RNA, 12 nt, Human
gcgcccugcaga

SEQ ID NO: 3447735 - RNA, 13 nt, Human
gcgcccugcagac

SEQ ID NO: 3447736 - RNA, 12 nt, Human
gcgcccuggccc

SEQ ID NO: 3447737 - RNA, 19 nt, Human
gcgccgcaaaccacacugg

SEQ ID NO: 3447738 - RNA, 15 nt, Human
gcgccgucuccaggg

SEQ ID NO: 3447739 - RNA, 20 nt, Human
gcgccgugaguucucagggc

SEQ ID NO: 3447740 - RNA, 22 nt, Human
gcgccgugaguucucagggcuc

SEQ ID NO: 3447741 - RNA, 22 nt, Human
gcgccucaacucugcugagggu

SEQ ID NO: 3447742 - RNA, 20 nt, Human
gcgccucaggcugcuggggc

SEQ ID NO: 3447743 - RNA, 12 nt, Human
gcgccucccucc

SEQ ID NO: 3447744 - RNA, 14 nt, Human
gcgccucccuccac

SEQ ID NO: 3447745 - RNA, 19 nt, Human
gcgccucccuccaccccag

SEQ ID NO: 3447746 - RNA, 22 nt, Human
gcgccucccuccaccccaggac

SEQ ID NO: 3447747 - RNA, 22 nt, Human
gcgccuccuuccuugcuguccu

SEQ ID NO: 3447748 - RNA, 21 nt, Human
gcgccucgccggaucugaggg

SEQ ID NO: 3447749 - RNA, 17 nt, Human
gcgccugccccucccag

SEQ ID NO: 3447750 - RNA, 16 nt, Human
gcgccugcugcaugcc

SEQ ID NO: 3447751 - RNA, 15 nt, Human
gcgccugugguucug

SEQ ID NO: 3447752 - RNA, 13 nt, Human
gcgcgcacacaca

SEQ ID NO: 3447753 - RNA, 20 nt, Human
gcgcgcccucccuuggcgug

SEQ ID NO: 3447754 - RNA, 21 nt, Human
gcgcggacauccccugcuggc

SEQ ID NO: 3447755 - RNA, 17 nt, Human
gcgcggggagcccgucg

SEQ ID NO: 3447756 - RNA, 20 nt, Human
gcgcgguggcgggcaccugu

SEQ ID NO: 3447757 - RNA, 20 nt, Human
gcgcgguggcucacgccugu

SEQ ID NO: 3447758 - RNA, 14 nt, Human
gcgcgugaggcccg

SEQ ID NO: 3447759 - RNA, 22 nt, Human
gcgcuaacuugcuuaaauguga

SEQ ID NO: 3447760 - RNA, 20 nt, Human
gcgcuaucucccugccuccu

SEQ ID NO: 3447761 - RNA, 14 nt, Human
gcgcuaucuucaca

SEQ ID NO: 3447762 - RNA, 16 nt, Human
gcgcucagggccaugc

SEQ ID NO: 3447763 - RNA, 16 nt, Human
gccucuuaugggcugg

SEQ ID NO: 3447764 - RNA, 22 nt, Human
gccucuucccccugcuuccacc

SEQ ID NO: 3447765 - RNA, 22 nt, Human
gccucuuccucccucauuccac

SEQ ID NO: 3447766 - RNA, 23 nt, Human
gccucuucucuacucuagggaaa

SEQ ID NO: 3447767 - RNA, 16 nt, Human
gccucuucucucagac

SEQ ID NO: 3447768 - RNA, 15 nt, Human
gccucuucugggagg

SEQ ID NO: 3447769 - RNA, 18 nt, Human
gccucuucugggagggca

SEQ ID NO: 3447770 - RNA, 15 nt, Human
gccucuucuucuuca

SEQ ID NO: 3447771 - RNA, 16 nt, Human
gccucuucuucuucag

SEQ ID NO: 3447772 - RNA, 20 nt, Human
gccucuucuucuucagaaga

SEQ ID NO: 3447773 - RNA, 21 nt, Human
gccucuucuucuucagaagac

SEQ ID NO: 3447774 - RNA, 15 nt, Human
gccucuugaccaggc

SEQ ID NO: 3447775 - RNA, 18 nt, Human
gccucuugagcaguggcu

SEQ ID NO: 3447776 - RNA, 18 nt, Human
gccucuuggaaaaaguga

SEQ ID NO: 3447777 - RNA, 16 nt, Human
gccucuugucuuccua

SEQ ID NO: 3447778 - RNA, 16 nt, Human
gccucuuucauccacu

SEQ ID NO: 3447779 - RNA, 20 nt, Human
gccucuuuuaccugcugcuu

SEQ ID NO: 3447780 - RNA, 15 nt, Human
gccugaacagaagcu

SEQ ID NO: 3447781 - RNA, 14 nt, Human
gccugaacccaaga

SEQ ID NO: 3447782 - RNA, 14 nt, Human
gccugaaccuucca

SEQ ID NO: 3447783 - RNA, 18 nt, Human
gccugaaggggcgucugu

SEQ ID NO: 3447784 - RNA, 22 nt, Human
gccugaaggggcgucuguuccc

SEQ ID NO: 3447785 - RNA, 22 nt, Human
gccugacacacuaaccaagcug

SEQ ID NO: 3447786 - RNA, 15 nt, Human
gccugacagaaacca

SEQ ID NO: 3447787 - RNA, 16 nt, Human
gccugacagccagaac

SEQ ID NO: 3447788 - RNA, 22 nt, Human
gccugacauuuggaguguuccc

SEQ ID NO: 3447789 - RNA, 19 nt, Human
gccugaccucccccuccuu

SEQ ID NO: 3447790 - RNA, 22 nt, Human
gccugaccucccccuccuuccc

SEQ ID NO: 3447791 - RNA, 23 nt, Human
gccugacucccccaguccccuuc

SEQ ID NO: 3447792 - RNA, 13 nt, Human
gccugacugcuca

SEQ ID NO: 3447793 - RNA, 15 nt, Human
gccugacugcucaga

SEQ ID NO: 3447794 - RNA, 16 nt, Human
gccugacuucugcugg

SEQ ID NO: 3447795 - RNA, 19 nt, Human
gccugacuucugcuggcau

SEQ ID NO: 3447796 - RNA, 22 nt, Human
gccugagaagagagaucaaaug

SEQ ID NO: 3447797 - RNA, 12 nt, Human
gccugagaccca

SEQ ID NO: 3447798 - RNA, 16 nt, Human
gccugagacccaggac

SEQ ID NO: 3447799 - RNA, 17 nt, Human
gccugagacccaggacu

SEQ ID NO: 3447800 - RNA, 14 nt, Human
gccugagaggcagg

SEQ ID NO: 3447801 - RNA, 18 nt, Human
gccugagaggcaggcaua

SEQ ID NO: 3447802 - RNA, 20 nt, Human
gccugagaggcaggcauaga

SEQ ID NO: 3447803 - RNA, 13 nt, Human
gccugagaugccu

SEQ ID NO: 3447804 - RNA, 14 nt, Human
gccugagaugccug

SEQ ID NO: 3447805 - RNA, 16 nt, Human
gccugagauuucaucu

SEQ ID NO: 3447806 - RNA, 16 nt, Human
gccugagcaguccuug

SEQ ID NO: 3447807 - RNA, 23 nt, Human
gccuuuuuuccccagacuuguug

SEQ ID NO: 3447808 - RNA, 15 nt, Human
gccuuuuuucuguau

SEQ ID NO: 3447809 - RNA, 17 nt, Human
gcgaacccuuuauuuga

SEQ ID NO: 3447810 - RNA, 19 nt, Human
gcgaagacccucuugccca

SEQ ID NO: 3447811 - RNA, 22 nt, Human
gcgaagacccucuugcccaucc

SEQ ID NO: 3447812 - RNA, 16 nt, Human
gcgaaguagcuugcuc

SEQ ID NO: 3447813 - RNA, 20 nt, Human
gcgaaguauauaaauuggcu

SEQ ID NO: 3447814 - RNA, 12 nt, Human
gcgaauauuuug

SEQ ID NO: 3447815 - RNA, 15 nt, Human
gcgaauccaagcucc

SEQ ID NO: 3447816 - RNA, 22 nt, Human
gcgaauccaagcucccugcccc

SEQ ID NO: 3447817 - RNA, 16 nt, Human
gcgaaucuuuuuuagc

SEQ ID NO: 3447818 - RNA, 22 nt, Human
gcgaaugguagucuaaccaaau

SEQ ID NO: 3447819 - RNA, 16 nt, Human
gcgaauuuuaaaagau

SEQ ID NO: 3447820 - RNA, 18 nt, Human
gcgacacugggaggccag

SEQ ID NO: 3447821 - RNA, 18 nt, Human
gcucagggaccauggcuu

SEQ ID NO: 3447822 - RNA, 20 nt, Human
gcucagggccaugcugaggc

SEQ ID NO: 3447823 - RNA, 15 nt, Human
gcucaggggcagcuc

SEQ ID NO: 3447824 - RNA, 15 nt, Human
gcucaggucccuggg

SEQ ID NO: 3447825 - RNA, 14 nt, Human
gcucaggugucccu

SEQ ID NO: 3447826 - RNA, 17 nt, Human
gcucaggugucccugca

SEQ ID NO: 3447827 - RNA, 12 nt, Human
gcucaguaaacg

SEQ ID NO: 3447828 - RNA, 16 nt, Human
gcucaguaauuugagg

SEQ ID NO: 3447829 - RNA, 14 nt, Human
gcucagucucagga

SEQ ID NO: 3447830 - RNA, 17 nt, Human
gcucagucucaggagca

SEQ ID NO: 3447831 - RNA, 21 nt, Human
gcucagucucaggagcauggg

SEQ ID NO: 3447832 - RNA, 14 nt, Human
gcucagucucccuu

SEQ ID NO: 3447833 - RNA, 16 nt, Human
gcucagucucccuuuc

SEQ ID NO: 3447834 - RNA, 23 nt, Human
gcucagucuucccuagggcuggg

SEQ ID NO: 3447835 - RNA, 17 nt, Human
gcucagugaaguugcug

SEQ ID NO: 3447836 - RNA, 17 nt, Human
gcucagugcaaccucug

SEQ ID NO: 3447837 - RNA, 16 nt, Human
gcucaguucagaauca

SEQ ID NO: 3447838 - RNA, 12 nt, Human
gcucaguuguag

SEQ ID NO: 3447839 - RNA, 17 nt, Human
gcucaguuguagaaugu

SEQ ID NO: 3447840 - RNA, 23 nt, Human
gcucaguuguagaauguauugua

SEQ ID NO: 3447841 - RNA, 20 nt, Human
gcucauacaggaaugaagcc

SEQ ID NO: 3447842 - RNA, 15 nt, Human
gcucauauuucccau

SEQ ID NO: 3447843 - RNA, 15 nt, Human
gcucaucagaaacaa

SEQ ID NO: 3447844 - RNA, 19 nt, Human
gcucaucauucucugucuc

SEQ ID NO: 3447845 - RNA, 14 nt, Human
gcucaucugcuggu

SEQ ID NO: 3447846 - RNA, 17 nt, Human
gcucaugcauaguccca

SEQ ID NO: 3447847 - RNA, 18 nt, Human
gcucauggacuucugcca

SEQ ID NO: 3447848 - RNA, 14 nt, Human
gcucauuaaacuuu

SEQ ID NO: 3447849 - RNA, 18 nt, Human
gcuccaaacccucgaggc

SEQ ID NO: 3447850 - RNA, 20 nt, Human
gcuccaaagucauaauugca

SEQ ID NO: 3447851 - RNA, 17 nt, Human
gcuccaaaugcagcuuu

SEQ ID NO: 3447852 - RNA, 20 nt, Human
gcuccaaccgggaugggagc

SEQ ID NO: 3447853 - RNA, 15 nt, Human
gcuccaaccugcaaa

SEQ ID NO: 3447854 - RNA, 14 nt, Human
gcuccaagaccuag

SEQ ID NO: 3447855 - RNA, 14 nt, Human
gcuccaagauucua

SEQ ID NO: 3447856 - RNA, 15 nt, Human
gcuccaagcucccag

SEQ ID NO: 3447857 - RNA, 16 nt, Human
gcuccacacacacaaa

SEQ ID NO: 3447858 - RNA, 17 nt, Human
gcuccacacacacaaaa

SEQ ID NO: 3447859 - RNA, 22 nt, Human
gcuccacacccucucccaggac

SEQ ID NO: 3447860 - RNA, 19 nt, Human
gcuccaccaagaaagcagg

SEQ ID NO: 3447861 - RNA, 12 nt, Human
gcuccaccacau

SEQ ID NO: 3447862 - RNA, 20 nt, Human
gcuccaccagcaucaccugc

SEQ ID NO: 3447863 - RNA, 16 nt, Human
gcuccaccccacucac

SEQ ID NO: 3447864 - RNA, 19 nt, Human
gcuccacccuggccgaguc

SEQ ID NO: 3447865 - RNA, 14 nt, Human
gcuccacccuuggc

SEQ ID NO: 3447866 - RNA, 17 nt, Human
gcuccacccuuggccug

SEQ ID NO: 3447867 - RNA, 19 nt, Human
gcuccaccuugcagcucuc

SEQ ID NO: 3447868 - RNA, 21 nt, Human
gcuccacucugacuggcacag

SEQ ID NO: 3447869 - RNA, 16 nt, Human
gcuccacucugcuucu

SEQ ID NO: 3447870 - RNA, 17 nt, Human
gcuccacucugcuucuc

SEQ ID NO: 3447871 - RNA, 23 nt, Human
gcuccacucugcuucucugacuu

SEQ ID NO: 3447872 - RNA, 18 nt, Human
gcuccacuuggucuguga

SEQ ID NO: 3447873 - RNA, 21 nt, Human
gcuccagaauuuggaaauccu

SEQ ID NO: 3447874 - RNA, 15 nt, Human
gcuccagacccccag

SEQ ID NO: 3447875 - RNA, 17 nt, Human
gcuccagacccccagca

SEQ ID NO: 3447876 - RNA, 13 nt, Human
gcuccagaccuga

SEQ ID NO: 3447877 - RNA, 22 nt, Human
gcuccagaccugauccuggagg

SEQ ID NO: 3447878 - RNA, 12 nt, Human
gcuccagagggc

SEQ ID NO: 3447879 - RNA, 18 nt, Human
gcuccagaugcagggcag

SEQ ID NO: 3447880 - RNA, 23 nt, Human
gcuccagcaacacagccugggcc

SEQ ID NO: 3447881 - RNA, 22 nt, Human
gcuccagccaaccccuguggag

SEQ ID NO: 3447882 - RNA, 14 nt, Human
gcuccagccaucuc

SEQ ID NO: 3447883 - RNA, 13 nt, Human
gcuccagcucacc

SEQ ID NO: 3447884 - RNA, 17 nt, Human
gcuccagcucaccagcc

SEQ ID NO: 3447885 - RNA, 18 nt, Human
gcuccagcucaccagccc

SEQ ID NO: 3447886 - RNA, 13 nt, Human
gcuccagcugccc

SEQ ID NO: 3447887 - RNA, 16 nt, Human
gcuccagcugccccgg

SEQ ID NO: 3447888 - RNA, 17 nt, Human
gcuccagcuggccggga

SEQ ID NO: 3447889 - RNA, 20 nt, Human
gcuccagcuggccgggagcc

SEQ ID NO: 3447890 - RNA, 17 nt, Human
gcuccagcuuucugcca

SEQ ID NO: 3447891 - RNA, 15 nt, Human
gcuccaggcacccag

SEQ ID NO: 3447892 - RNA, 15 nt, Human
gcuccaggcagcacc

SEQ ID NO: 3447893 - RNA, 20 nt, Human
gcuccaggcagcacccaggu

SEQ ID NO: 3447894 - RNA, 15 nt, Human
gcuccaggccugcag

SEQ ID NO: 3447895 - RNA, 19 nt, Human
gcuccaggccugcagcagg

SEQ ID NO: 3447896 - RNA, 12 nt, Human
gcuccaggcucc

SEQ ID NO: 3447897 - RNA, 13 nt, Human
gcuccaggcuccu

SEQ ID NO: 3447898 - RNA, 20 nt, Human
gcuccagggaauccaagccu

SEQ ID NO: 3447899 - RNA, 19 nt, Human
gcuccagggaugauucaag

SEQ ID NO: 3447900 - RNA, 14 nt, Human
gcuccaguccugcu

SEQ ID NO: 3447901 - RNA, 17 nt, Human
gcuccagucugcugccc

SEQ ID NO: 3447902 - RNA, 19 nt, Human
gcuccaguguccugagcuc

SEQ ID NO: 3447903 - RNA, 23 nt, Human
gcuccaguguccugagcucagcg

SEQ ID NO: 3447904 - RNA, 20 nt, Human
gcuccauacacacgcugccu

SEQ ID NO: 3447905 - RNA, 17 nt, Human
gcuccauccuccuggga

SEQ ID NO: 3447906 - RNA, 22 nt, Human
gcuccauuuucuuauugcgcug

SEQ ID NO: 3447907 - RNA, 23 nt, Human
gcucccaacacaaggugggcagg

SEQ ID NO: 3447908 - RNA, 12 nt, Human
gcucccaaggga

SEQ ID NO: 3447909 - RNA, 16 nt, Human
gcucccaaggggccug

SEQ ID NO: 3447910 - RNA, 15 nt, Human
gcucccacaagccuc

SEQ ID NO: 3447911 - RNA, 16 nt, Human
gcucccacaagccuga

SEQ ID NO: 3447912 - RNA, 13 nt, Human
gcucccacagaac

SEQ ID NO: 3447913 - RNA, 14 nt, Human
gcucccacaggcag

SEQ ID NO: 3447914 - RNA, 17 nt, Human
gcucccacaggcagcuu

SEQ ID NO: 3447915 - RNA, 18 nt, Human
gcucccacaggcagcuuu

SEQ ID NO: 3447916 - RNA, 16 nt, Human
gcucccacaggcccuu

SEQ ID NO: 3447917 - RNA, 21 nt, Human
gcucccacaggcccuuccucu

SEQ ID NO: 3447918 - RNA, 16 nt, Human
gcucccacauucugau

SEQ ID NO: 3447919 - RNA, 19 nt, Human
gcucccagcagcccuaagg

SEQ ID NO: 3447920 - RNA, 16 nt, Human
gcucccagccaggccc

SEQ ID NO: 3447921 - RNA, 16 nt, Human
gcucccaggaccacag

SEQ ID NO: 3447922 - RNA, 12 nt, Human
gcucccaggccg

SEQ ID NO: 3447923 - RNA, 22 nt, Human
gcucccagggacaccugggaga

SEQ ID NO: 3447924 - RNA, 22 nt, Human
gcucccagggccaugaacuuug

SEQ ID NO: 3447925 - RNA, 18 nt, Human
gcucccaggggucucccu

SEQ ID NO: 3447926 - RNA, 19 nt, Human
gcucccaggggucucccug

SEQ ID NO: 3447927 - RNA, 19 nt, Human
gcucccaggugcagccaga

SEQ ID NO: 3447928 - RNA, 18 nt, Human
gcucccagugucuuccug

SEQ ID NO: 3447929 - RNA, 23 nt, Human
gcucccagugucuuccugugggg

SEQ ID NO: 3447930 - RNA, 17 nt, Human
gcucccauuucuacucu

SEQ ID NO: 3447931 - RNA, 18 nt, Human
gcucccauuucuacucuc

SEQ ID NO: 3447932 - RNA, 22 nt, Human
gcuccccacagcgucccuggcg

SEQ ID NO: 3447933 - RNA, 17 nt, Human
gcuccccacucugcucu

SEQ ID NO: 3447934 - RNA, 18 nt, Human
gcuccccacucugcucug

SEQ ID NO: 3447935 - RNA, 19 nt, Human
gcuccccacucugcucuga

SEQ ID NO: 3447936 - RNA, 19 nt, Human
gcuccccacugccuacugc

SEQ ID NO: 3447937 - RNA, 16 nt, Human
gcuccccagcccaggg

SEQ ID NO: 3447938 - RNA, 16 nt, Human
gcuccccagcccuggc

SEQ ID NO: 3447939 - RNA, 18 nt, Human
gcuccccagcccuggcuc

SEQ ID NO: 3447940 - RNA, 21 nt, Human
gcuccccagcccuggcucugc

SEQ ID NO: 3447941 - RNA, 13 nt, Human
gcuccccagugaa

SEQ ID NO: 3447942 - RNA, 20 nt, Human
gcucccccacccccucccca

SEQ ID NO: 3447943 - RNA, 22 nt, Human
gcucccccagcaaagcccccag

SEQ ID NO: 3447944 - RNA, 18 nt, Human
gcucccccauccuccccu

SEQ ID NO: 3447945 - RNA, 21 nt, Human
gcuccccucuauuuagcauga

SEQ ID NO: 3447946 - RNA, 13 nt, Human
gcuccccugagga

SEQ ID NO: 3447947 - RNA, 16 nt, Human
gcuccccugcagcccu

SEQ ID NO: 3447948 - RNA, 17 nt, Human
gcuccccugcagcccug

SEQ ID NO: 3447949 - RNA, 19 nt, Human
gcuccccugcagcccuggc

SEQ ID NO: 3447950 - RNA, 13 nt, Human
gcuccccuucccc

SEQ ID NO: 3447951 - RNA, 20 nt, Human
gcuccccuuccccuuccuuc

SEQ ID NO: 3447952 - RNA, 14 nt, Human
gcgcuauuacaaau

SEQ ID NO: 3447953 - RNA, 14 nt, Human
gcgcucaguaaacg

SEQ ID NO: 3447954 - RNA, 22 nt, Human
gcgcuccgggacguggcaccuc

SEQ ID NO: 3447955 - RNA, 18 nt, Human
gcgcuccuggcccagccu

SEQ ID NO: 3447956 - RNA, 20 nt, Human
gcgcuccuggcccagccuuu

SEQ ID NO: 3447957 - RNA, 23 nt, Human
gcgcucuguggaugccagggccg

SEQ ID NO: 3447958 - RNA, 23 nt, Human
gcgcugacaaccaccgcucccca

SEQ ID NO: 3447959 - RNA, 10 nt, Human
gcgcuggccc

SEQ ID NO: 3447960 - RNA, 13 nt, Human
gcgcuggcccagc

SEQ ID NO: 3447961 - RNA, 14 nt, Human
gcgcuggcccagcc

SEQ ID NO: 3447962 - RNA, 15 nt, Human
gcgcuggcccagccg

SEQ ID NO: 3447963 - RNA, 16 nt, Human
gcgcuggcccagccgg

SEQ ID NO: 3447964 - RNA, 19 nt, Human
gcgcuggcccagccggccu

SEQ ID NO: 3447965 - RNA, 15 nt, Human
gcgcugggcacuucc

SEQ ID NO: 3447966 - RNA, 23 nt, Human
gcgcugucaggauugcgagagau

SEQ ID NO: 3447967 - RNA, 21 nt, Human
gcgcuucacuuggguccaggc

SEQ ID NO: 3447968 - RNA, 13 nt, Human
gcgcuugcuggcc

SEQ ID NO: 3447969 - RNA, 15 nt, Human
gcgcuugcuggccag

SEQ ID NO: 3447970 - RNA, 13 nt, Human
gcgcuugggcgcc

SEQ ID NO: 3447971 - RNA, 23 nt, Human
gcgcuugggcgccgugcugggca

SEQ ID NO: 3447972 - RNA, 14 nt, Human
gcgcuuugggaggc

SEQ ID NO: 3447973 - RNA, 17 nt, Human
gcgcuuuugcuggucac

SEQ ID NO: 3447974 - RNA, 11 nt, Human
gcggacagcca

SEQ ID NO: 3447975 - RNA, 13 nt, Human
gcggacagccacg

SEQ ID NO: 3447976 - RNA, 16 nt, Human
gcggacaguggcagga

SEQ ID NO: 3447977 - RNA, 14 nt, Human
gcggacgggcuguc

SEQ ID NO: 3447978 - RNA, 22 nt, Human
gcggagagaggccuugucccag

SEQ ID NO: 3447979 - RNA, 15 nt, Human
gcggagaguacagug

SEQ ID NO: 3447980 - RNA, 16 nt, Human
gcggagaguacaguga

SEQ ID NO: 3447981 - RNA, 22 nt, Human
gcggagaguacagugagccaag

SEQ ID NO: 3447982 - RNA, 18 nt, Human
gcggagcaagaggaggcc

SEQ ID NO: 3447983 - RNA, 13 nt, Human
gcucccucucccc

SEQ ID NO: 3447984 - RNA, 15 nt, Human
gcucccucucccccu

SEQ ID NO: 3447985 - RNA, 13 nt, Human
gcucccucugccu

SEQ ID NO: 3447986 - RNA, 23 nt, Human
gcucccucugccugaaccuucca

SEQ ID NO: 3447987 - RNA, 19 nt, Human
gcucccucuuggucuuccc

SEQ ID NO: 3447988 - RNA, 13 nt, Human
gcucccugaagcc

SEQ ID NO: 3447989 - RNA, 15 nt, Human
gcucccugaagccag

SEQ ID NO: 3447990 - RNA, 18 nt, Human
gcucccugaagccagccu

SEQ ID NO: 3447991 - RNA, 18 nt, Human
gcucccugacugggaguu

SEQ ID NO: 3447992 - RNA, 15 nt, Human
gcucccugccccaaa

SEQ ID NO: 3447993 - RNA, 13 nt, Human
gcucccuggagcc

SEQ ID NO: 3447994 - RNA, 23 nt, Human
gcucccuguaggguccaaccaga

SEQ ID NO: 3447995 - RNA, 22 nt, Human
gcucccugugacaaaauuuuau

SEQ ID NO: 3447996 - RNA, 16 nt, Human
gcucccugugccccca

SEQ ID NO: 3447997 - RNA, 15 nt, Human
gcucccuucagcccc

SEQ ID NO: 3447998 - RNA, 19 nt, Human
gcucccuucagcccccagc

SEQ ID NO: 3447999 - RNA, 20 nt, Human
gcucccuucccaccucucuc

SEQ ID NO: 3448000 - RNA, 23 nt, Human
gcuccgacuugugcacaggcaga

SEQ ID NO: 3448001 - RNA, 17 nt, Human
gcuccgcaggacuuccc

SEQ ID NO: 3448002 - RNA, 14 nt, Human
gcuccgccucugcu

SEQ ID NO: 3448003 - RNA, 17 nt, Human
gcuccgccucugcuggc

SEQ ID NO: 3448004 - RNA, 18 nt, Human
gcuccgcuuucuacccag

SEQ ID NO: 3448005 - RNA, 22 nt, Human
gcuccggcguguguucaguguu

SEQ ID NO: 3448006 - RNA, 23 nt, Human
gcuccggcguguguucaguguua

SEQ ID NO: 3448007 - RNA, 22 nt, Human
gcuccgggacguggcaccuccu

SEQ ID NO: 3448008 - RNA, 15 nt, Human
gcuccgggcuccgac

SEQ ID NO: 3448009 - RNA, 22 nt, Human
gcuccguccaggagccugugcc

SEQ ID NO: 3448010 - RNA, 13 nt, Human
gcuccgugccucc

SEQ ID NO: 3448011 - RNA, 13 nt, Human
gcuccguggagga

SEQ ID NO: 3448012 - RNA, 15 nt, Human
gcuccuagagggagg

SEQ ID NO: 3448013 - RNA, 16 nt, Human
gcuccuagagggaggg

SEQ ID NO: 3448014 - RNA, 14 nt, Human
gcuccuagcagaga

SEQ ID NO: 3448015 - RNA, 14 nt, Human
gcuccuaucugugu

SEQ ID NO: 3448016 - RNA, 22 nt, Human
gcuccucaaccccuccccucca

SEQ ID NO: 3448017 - RNA, 14 nt, Human
gcuccucacauagc

SEQ ID NO: 3448018 - RNA, 16 nt, Human
gcuccucacugcccgc

SEQ ID NO: 3448019 - RNA, 18 nt, Human
gcuccucacugcccgcac

SEQ ID NO: 3448020 - RNA, 18 nt, Human
gcuccuccagggccacgu

SEQ ID NO: 3448021 - RNA, 23 nt, Human
gcuccuccagggccacgugccag

SEQ ID NO: 3448022 - RNA, 11 nt, Human
gcuccucccac

SEQ ID NO: 3448023 - RNA, 12 nt, Human
gcuccucccagc

SEQ ID NO: 3448024 - RNA, 21 nt, Human
gcuccucccucccucugccgg

SEQ ID NO: 3448025 - RNA, 21 nt, Human
gcuccucccucugaggcugua

SEQ ID NO: 3448026 - RNA, 22 nt, Human
gcuccucccucugaggcuguag

SEQ ID NO: 3448027 - RNA, 14 nt, Human
gcuccucccuggcu

SEQ ID NO: 3448028 - RNA, 23 nt, Human
gcuccucccuggcugcccuggcc

SEQ ID NO: 3448029 - RNA, 20 nt, Human
gcuccuccgugcuuccucag

SEQ ID NO: 3448030 - RNA, 17 nt, Human
gcuccuccuucugcugc

SEQ ID NO: 3448031 - RNA, 15 nt, Human
gcuccucgagggcag

SEQ ID NO: 3448032 - RNA, 18 nt, Human
gcuccucucacuucccag

SEQ ID NO: 3448033 - RNA, 14 nt, Human
gcuccucuccaggc

SEQ ID NO: 3448034 - RNA, 17 nt, Human
gcuccucuccagucuga

SEQ ID NO: 3448035 - RNA, 15 nt, Human
gcuccucuccuggag

SEQ ID NO: 3448036 - RNA, 16 nt, Human
gcuccucugggcagga

SEQ ID NO: 3448037 - RNA, 13 nt, Human
gcuccucugucuc

SEQ ID NO: 3448038 - RNA, 17 nt, Human
gcuccucugucucgagc

SEQ ID NO: 3448039 - RNA, 14 nt, Human
gcuccucuguggug

SEQ ID NO: 3448040 - RNA, 21 nt, Human
gcuccugaccaguugcaguca

SEQ ID NO: 3448041 - RNA, 16 nt, Human
gcuccugagcccccag

SEQ ID NO: 3448042 - RNA, 22 nt, Human
gcuccugaggggcaucugcccc

SEQ ID NO: 3448043 - RNA, 11 nt, Human
gcuccugcagc

SEQ ID NO: 3448044 - RNA, 15 nt, Human
gcuccugcagcaugg

SEQ ID NO: 3448045 - RNA, 11 nt, Human
gcuccugccca

SEQ ID NO: 3448046 - RNA, 21 nt, Human
gcuccuggaaaggcucagucu

SEQ ID NO: 3448047 - RNA, 22 nt, Human
gcuccuggaaaggcucagucuc

SEQ ID NO: 3448048 - RNA, 18 nt, Human
gcuccuggcagaagggag

SEQ ID NO: 3448049 - RNA, 22 nt, Human
gcuccuggcagaagggagcagc

SEQ ID NO: 3448050 - RNA, 19 nt, Human
gcuccuggcccacugcauc

SEQ ID NO: 3448051 - RNA, 20 nt, Human
gcuccuggcccacugcaucg

SEQ ID NO: 3448052 - RNA, 17 nt, Human
gcuccuggccuugcuga

SEQ ID NO: 3448053 - RNA, 22 nt, Human
gcuccugguauggguuucuccc

SEQ ID NO: 3448054 - RNA, 17 nt, Human
gcuccuguccccugcua

SEQ ID NO: 3448055 - RNA, 19 nt, Human
gcuccuguccccugcuaca

SEQ ID NO: 3448056 - RNA, 15 nt, Human
gcuccuguccuccca

SEQ ID NO: 3448057 - RNA, 22 nt, Human
gcuccuguccucccauccccug

SEQ ID NO: 3448058 - RNA, 16 nt, Human
gcuccugucugccagc

SEQ ID NO: 3448059 - RNA, 17 nt, Human
gcuccugucugccagcc

SEQ ID NO: 3448060 - RNA, 18 nt, Human
gcuccugucugccagcca

SEQ ID NO: 3448061 - RNA, 15 nt, Human
gcuccugugcccuua

SEQ ID NO: 3448062 - RNA, 21 nt, Human
gcuccugugcuacuuugccuu

SEQ ID NO: 3448063 - RNA, 22 nt, Human
gcuccugugcuuucccugaacu

SEQ ID NO: 3448064 - RNA, 17 nt, Human
gcuccuuaaggcucuuu

SEQ ID NO: 3448065 - RNA, 21 nt, Human
gcuccuuaaggcucuuuugua

SEQ ID NO: 3448066 - RNA, 13 nt, Human
gcuccuuagcugc

SEQ ID NO: 3448067 - RNA, 19 nt, Human
gcuccuuagcugccaagcc

SEQ ID NO: 3448068 - RNA, 21 nt, Human
gcuccuucaacaaggcuugcu

SEQ ID NO: 3448069 - RNA, 22 nt, Human
gcuccuucaacaaggcuugcug

SEQ ID NO: 3448070 - RNA, 23 nt, Human
gcuccuucccaggaguggaggag

SEQ ID NO: 3448071 - RNA, 13 nt, Human
gcuccuucccauc

SEQ ID NO: 3448072 - RNA, 18 nt, Human
gcuccuuccucugaggcu

SEQ ID NO: 3448073 - RNA, 22 nt, Human
gcuccuuccucugaggcugaaa

SEQ ID NO: 3448074 - RNA, 23 nt, Human
gcuccuuccuggagacugcccag

SEQ ID NO: 3448075 - RNA, 15 nt, Human
gcuccuuccuucacc

SEQ ID NO: 3448076 - RNA, 15 nt, Human
gcuccuucuguccua

SEQ ID NO: 3448077 - RNA, 19 nt, Human
gcuccuuggcuuaccugac

SEQ ID NO: 3448078 - RNA, 21 nt, Human
gcuccuugggaggaagcagaa

SEQ ID NO: 3448079 - RNA, 17 nt, Human
gcuccuugggcccuuug

SEQ ID NO: 3448080 - RNA, 17 nt, Human
gcuccuugugggccugg

SEQ ID NO: 3448081 - RNA, 20 nt, Human
gcuccuugugggccugggcu

SEQ ID NO: 3448082 - RNA, 21 nt, Human
gcuccuugugggccugggcuc

SEQ ID NO: 3448083 - RNA, 17 nt, Human
gcuccuuuagcgcccag

SEQ ID NO: 3448084 - RNA, 20 nt, Human
gcuccuuuguguguguguca

SEQ ID NO: 3448085 - RNA, 14 nt, Human
gcuccuuuuucucc

SEQ ID NO: 3448086 - RNA, 15 nt, Human
gcucgaaucucugug

SEQ ID NO: 3448087 - RNA, 16 nt, Human
gcucgagcaugccugg

SEQ ID NO: 3448088 - RNA, 17 nt, Human
gcucgagcaugccugga

SEQ ID NO: 3448089 - RNA, 21 nt, Human
gcucgagcaugccuggauggg

SEQ ID NO: 3448090 - RNA, 21 nt, Human
gcucgauccaaauugugcuuc

SEQ ID NO: 3448091 - RNA, 15 nt, Human
gcucgccuucccucc

SEQ ID NO: 3448092 - RNA, 15 nt, Human
gcucggaggaagccc

SEQ ID NO: 3448093 - RNA, 14 nt, Human
gcucggaggcccca

SEQ ID NO: 3448094 - RNA, 15 nt, Human
gcucggaggcugccc

SEQ ID NO: 3448095 - RNA, 16 nt, Human
gcucggaggcugcccc

SEQ ID NO: 3448096 - RNA, 15 nt, Human
gcucacgugugugac

SEQ ID NO: 3448097 - RNA, 17 nt, Human
gcucacgugugugacuc

SEQ ID NO: 3448098 - RNA, 23 nt, Human
gcucacucaucaauggggccagu

SEQ ID NO: 3448099 - RNA, 13 nt, Human
gcucacugcagcc

SEQ ID NO: 3448100 - RNA, 16 nt, Human
gcucacugcagccuca

SEQ ID NO: 3448101 - RNA, 12 nt, Human
gcucacugccag

SEQ ID NO: 3448102 - RNA, 23 nt, Human
gcucacugccaggccagccuccg

SEQ ID NO: 3448103 - RNA, 23 nt, Human
gcucacuucugggcuucaucugg

SEQ ID NO: 3448104 - RNA, 17 nt, Human
gcucagaaaauaucccu

SEQ ID NO: 3448105 - RNA, 17 nt, Human
gcucagaacaguaucuu

SEQ ID NO: 3448106 - RNA, 21 nt, Human
gcucagaaggcucuucugacu

SEQ ID NO: 3448107 - RNA, 18 nt, Human
gcucagaaguuucuucuu

SEQ ID NO: 3448108 - RNA, 16 nt, Human
gcucagaccagcucuu

SEQ ID NO: 3448109 - RNA, 15 nt, Human
gcucagacccccacu

SEQ ID NO: 3448110 - RNA, 19 nt, Human
gcucagacccccacucuca

SEQ ID NO: 3448111 - RNA, 13 nt, Human
gcucagagagggu

SEQ ID NO: 3448112 - RNA, 15 nt, Human
gcucagagagggugg

SEQ ID NO: 3448113 - RNA, 20 nt, Human
gcucagaggcgcacugugac

SEQ ID NO: 3448114 - RNA, 19 nt, Human
gcucagagggggacugcug

SEQ ID NO: 3448115 - RNA, 20 nt, Human
gcucagagggggacugcugc

SEQ ID NO: 3448116 - RNA, 21 nt, Human
gcucagaggguguccugcacc

SEQ ID NO: 3448117 - RNA, 15 nt, Human
gcucagcaaggccac

SEQ ID NO: 3448118 - RNA, 11 nt, Human
gcucagcccac

SEQ ID NO: 3448119 - RNA, 14 nt, Human
gcucagcccacccc

SEQ ID NO: 3448120 - RNA, 17 nt, Human
gcucagcccaccccccu

SEQ ID NO: 3448121 - RNA, 15 nt, Human
gcucagccccacccc

SEQ ID NO: 3448122 - RNA, 20 nt, Human
gcucagccccaccccagggc

SEQ ID NO: 3448123 - RNA, 18 nt, Human
gcucagcccucccugccc

SEQ ID NO: 3448124 - RNA, 15 nt, Human
gcucagcccugagga

SEQ ID NO: 3448125 - RNA, 12 nt, Human
gcucagcccugc

SEQ ID NO: 3448126 - RNA, 13 nt, Human
gcucagcccugga

SEQ ID NO: 3448127 - RNA, 16 nt, Human
gcucagcccuggaggu

SEQ ID NO: 3448128 - RNA, 20 nt, Human
gcucagcccuggaggugcca

SEQ ID NO: 3448129 - RNA, 21 nt, Human
gcucagcggggacagcuccuu

SEQ ID NO: 3448130 - RNA, 22 nt, Human
gcucagcggggacagcuccuuc

SEQ ID NO: 3448131 - RNA, 23 nt, Human
gcucagcggggacagcuccuucu

SEQ ID NO: 3448132 - RNA, 20 nt, Human
gcucagcuacugauuuuugu

SEQ ID NO: 3448133 - RNA, 19 nt, Human
gcucagcucggggagccuu

SEQ ID NO: 3448134 - RNA, 15 nt, Human
gcucagcucuggcuc

SEQ ID NO: 3448135 - RNA, 21 nt, Human
gcucagcuuuuugucuuuucu

SEQ ID NO: 3448136 - RNA, 13 nt, Human
gcucaggaaaacg

SEQ ID NO: 3448137 - RNA, 17 nt, Human
gcucaggacagaugcca

SEQ ID NO: 3448138 - RNA, 20 nt, Human
gcucaggacagaugccacac

SEQ ID NO: 3448139 - RNA, 17 nt, Human
gcucaggacucagaagc

SEQ ID NO: 3448140 - RNA, 14 nt, Human
gcucaggagcccug

SEQ ID NO: 3448141 - RNA, 21 nt, Human
gcucaggagcccugggaggcu

SEQ ID NO: 3448142 - RNA, 13 nt, Human
gcucaggaggcuu

SEQ ID NO: 3448143 - RNA, 12 nt, Human
gcucaggcaggg

SEQ ID NO: 3448144 - RNA, 16 nt, Human
gcucaggcaggggccu

SEQ ID NO: 3448145 - RNA, 22 nt, Human
gcucaggcuacuauagguccag

SEQ ID NO: 3448146 - RNA, 22 nt, Human
gcucaggcugcagcuggacaga

SEQ ID NO: 3448147 - RNA, 17 nt, Human
gcucagggaaaggccag

SEQ ID NO: 3448148 - RNA, 17 nt, Human
gcucagggaccacagca

SEQ ID NO: 3448149 - RNA, 19 nt, Human
gcucagggccaugcugagg

SEQ ID NO: 3448150 - RNA, 12 nt, Human
gcucagggccug

SEQ ID NO: 3448151 - RNA, 13 nt, Human
gcucagggccugg

SEQ ID NO: 3448152 - RNA, 17 nt, Human
gcucagggccuggcuca

SEQ ID NO: 3448153 - RNA, 18 nt, Human
gcucagggccuggcucag

SEQ ID NO: 3448154 - RNA, 18 nt, Human
gcucaggggcccuggagc

SEQ ID NO: 3448155 - RNA, 17 nt, Human
gcucagggggcgccugu

SEQ ID NO: 3448156 - RNA, 21 nt, Human
gcucaggucacauaaaacuuu

SEQ ID NO: 3448157 - RNA, 21 nt, Human
gcucaggugcuggggccuggu

SEQ ID NO: 3448158 - RNA, 21 nt, Human
gcucagguggggucacucugg

SEQ ID NO: 3448159 - RNA, 22 nt, Human
gcucagguggggucacucuggc

SEQ ID NO: 3448160 - RNA, 19 nt, Human
gcucagucucccuuucccu

SEQ ID NO: 3448161 - RNA, 18 nt, Human
gcucagugcaaccucugc

SEQ ID NO: 3448162 - RNA, 17 nt, Human
gcucaguggggcagagg

SEQ ID NO: 3448163 - RNA, 17 nt, Human
gcucaguucagaaucac

SEQ ID NO: 3448164 - RNA, 16 nt, Human
gcucaguucuagucuc

SEQ ID NO: 3448165 - RNA, 20 nt, Human
gcucauauuccugcagccug

SEQ ID NO: 3448166 - RNA, 21 nt, Human
gcucauccccaccugucuuca

SEQ ID NO: 3448167 - RNA, 13 nt, Human
gcucaucugcugg

SEQ ID NO: 3448168 - RNA, 15 nt, Human
gcucaucugcugguc

SEQ ID NO: 3448169 - RNA, 16 nt, Human
gcucaucugcuggucc

SEQ ID NO: 3448170 - RNA, 23 nt, Human
gcucaucugcugguccgugggac

SEQ ID NO: 3448171 - RNA, 13 nt, Human
gcucaucuguugu

SEQ ID NO: 3448172 - RNA, 16 nt, Human
gcucaugggccccucu

SEQ ID NO: 3448173 - RNA, 22 nt, Human
gcucaugggccccucugacucc

SEQ ID NO: 3448174 - RNA, 22 nt, Human
gcucaugugugcaacaggguau

SEQ ID NO: 3448175 - RNA, 17 nt, Human
gcucauuaaacuuuuuu

SEQ ID NO: 3448176 - RNA, 21 nt, Human
gcucauuauaaugucauuaaa

SEQ ID NO: 3448177 - RNA, 22 nt, Human
gcucauucagcaucugaccucu

SEQ ID NO: 3448178 - RNA, 15 nt, Human
gcucauucauuuuau

SEQ ID NO: 3448179 - RNA, 17 nt, Human
gcucauucauuuuauau

SEQ ID NO: 3448180 - RNA, 18 nt, Human
gcucauucauuuuauauu

SEQ ID NO: 3448181 - RNA, 23 nt, Human
gcucauucauuuuauauugaaaa

SEQ ID NO: 3448182 - RNA, 18 nt, Human
gcucauucuaaugauggc

SEQ ID NO: 3448183 - RNA, 12 nt, Human
gcucauuuaagu

SEQ ID NO: 3448184 - RNA, 12 nt, Human
gcucauuuacug

SEQ ID NO: 3448185 - RNA, 14 nt, Human
gcucauuucaggau

SEQ ID NO: 3448186 - RNA, 12 nt, Human
gcucauuucaug

SEQ ID NO: 3448187 - RNA, 14 nt, Human
gcucauuuuggacu

SEQ ID NO: 3448188 - RNA, 16 nt, Human
cuucauuagagcaggc

SEQ ID NO: 3448189 - RNA, 14 nt, Human
cuucauuauucucu

SEQ ID NO: 3448190 - RNA, 18 nt, Human
cuucauuauuuuaaaaau

SEQ ID NO: 3448191 - RNA, 22 nt, Human
cuucauucaagucuaugaugcu

SEQ ID NO: 3448192 - RNA, 19 nt, Human
cuucauucaauauugacau

SEQ ID NO: 3448193 - RNA, 22 nt, Human
cuucauucaauauugacauuug

SEQ ID NO: 3448194 - RNA, 13 nt, Human
cuucauucuauca

SEQ ID NO: 3448195 - RNA, 14 nt, Human
cuucauucucguga

SEQ ID NO: 3448196 - RNA, 18 nt, Human
cuucauucugagaccaaa

SEQ ID NO: 3448197 - RNA, 20 nt, Human
cuucauucuugaaagcugug

SEQ ID NO: 3448198 - RNA, 21 nt, Human
cuucauucuugaaagcugugg

SEQ ID NO: 3448199 - RNA, 14 nt, Human
cuucauugagaguu

SEQ ID NO: 3448200 - RNA, 23 nt, Human
cuucauugagaguuuugucuuga

SEQ ID NO: 3448201 - RNA, 15 nt, Human
cuucauuucauugua

SEQ ID NO: 3448202 - RNA, 18 nt, Human
cuucauuucauuguauga

SEQ ID NO: 3448203 - RNA, 18 nt, Human
cuucauuuccugugucuu

SEQ ID NO: 3448204 - RNA, 19 nt, Human
cuucauuucugauauagaa

SEQ ID NO: 3448205 - RNA, 20 nt, Human
cuucauuucugauauagaau

SEQ ID NO: 3448206 - RNA, 13 nt, Human
cuucauuuguguc

SEQ ID NO: 3448207 - RNA, 21 nt, Human
cuucauuuuauuaauauuuuu

SEQ ID NO: 3448208 - RNA, 14 nt, Human
cuuccaaaaauuac

SEQ ID NO: 3448209 - RNA, 16 nt, Human
cuuccaaaaauuauua

SEQ ID NO: 3448210 - RNA, 17 nt, Human
cuuccaaaaauuauuau

SEQ ID NO: 3448211 - RNA, 12 nt, Human
cuuccaaagaaa

SEQ ID NO: 3448212 - RNA, 17 nt, Human
cuuccaaagaauucuua

SEQ ID NO: 3448213 - RNA, 21 nt, Human
cuuccaaagcagagagcauua

SEQ ID NO: 3448214 - RNA, 17 nt, Human
cuuccaaauaauaaagu

SEQ ID NO: 3448215 - RNA, 19 nt, Human
cuuccaaauaauaaagucu

SEQ ID NO: 3448216 - RNA, 19 nt, Human
cuuccaaccauuuaucuug

SEQ ID NO: 3448217 - RNA, 14 nt, Human
cuuccaacugcugc

SEQ ID NO: 3448218 - RNA, 18 nt, Human
cuuccaagaccugacuca

SEQ ID NO: 3448219 - RNA, 13 nt, Human
cuuccacaagagc

SEQ ID NO: 3448220 - RNA, 15 nt, Human
cuuccacaagagccc

SEQ ID NO: 3448221 - RNA, 17 nt, Human
cuuccacaagagcccag

SEQ ID NO: 3448222 - RNA, 18 nt, Human
cuuccacaagagcccagg

SEQ ID NO: 3448223 - RNA, 19 nt, Human
cuuccacaagagcccaggc

SEQ ID NO: 3448224 - RNA, 23 nt, Human
cuuccacaagagcccaggccucc

SEQ ID NO: 3448225 - RNA, 23 nt, Human
cuuccacacccccaccccuugcu

SEQ ID NO: 3448226 - RNA, 18 nt, Human
cuuccacagggucccaca

SEQ ID NO: 3448227 - RNA, 23 nt, Human
cuuccaccaaguuggaacauccu

SEQ ID NO: 3448228 - RNA, 14 nt, Human
cuuccaccagccug

SEQ ID NO: 3448229 - RNA, 16 nt, Human
cuuccaccucacccca

SEQ ID NO: 3448230 - RNA, 16 nt, Human
cuuccacgcugucucc

SEQ ID NO: 3448231 - RNA, 18 nt, Human
cuuccacgcugucuccag

SEQ ID NO: 3448232 - RNA, 21 nt, Human
cuuccacgcugucuccagacc

SEQ ID NO: 3448233 - RNA, 20 nt, Human
cuuccacguacugcagccuc

SEQ ID NO: 3448234 - RNA, 21 nt, Human
cuuccacuuuuuuuuguaugu

SEQ ID NO: 3448235 - RNA, 17 nt, Human
cuuccagaaucccaaga

SEQ ID NO: 3448236 - RNA, 12 nt, Human
cuuccagacaua

SEQ ID NO: 3448237 - RNA, 18 nt, Human
cuuccagagaguccucug

SEQ ID NO: 3448238 - RNA, 20 nt, Human
cuuccagagaguccucugga

SEQ ID NO: 3448239 - RNA, 21 nt, Human
cuuccagagaguccucuggau

SEQ ID NO: 3448240 - RNA, 19 nt, Human
gcuccagagcaacgaccag

SEQ ID NO: 3448241 - RNA, 17 nt, Human
gcuccagaugcagggca

SEQ ID NO: 3448242 - RNA, 21 nt, Human
gcuccagaugcagggcaguca

SEQ ID NO: 3448243 - RNA, 22 nt, Human
gcuccagaugcagggcagucau

SEQ ID NO: 3448244 - RNA, 22 nt, Human
gcuccagcaacacagccugggc

SEQ ID NO: 3448245 - RNA, 19 nt, Human
gcuccagcaccauccgcca

SEQ ID NO: 3448246 - RNA, 16 nt, Human
gcuccagccaaccccu

SEQ ID NO: 3448247 - RNA, 18 nt, Human
gcuccagccccuuuccaa

SEQ ID NO: 3448248 - RNA, 12 nt, Human
gcuccagccuga

SEQ ID NO: 3448249 - RNA, 13 nt, Human
gcuccagccugac

SEQ ID NO: 3448250 - RNA, 21 nt, Human
gcuccagcgaucucuccacug

SEQ ID NO: 3448251 - RNA, 12 nt, Human
gcuccagcugcc

SEQ ID NO: 3448252 - RNA, 21 nt, Human
gcuccagcugcucugucuucu

SEQ ID NO: 3448253 - RNA, 11 nt, Human
gcuccagcugu

SEQ ID NO: 3448254 - RNA, 11 nt, Human
gcuccaggagc

SEQ ID NO: 3448255 - RNA, 15 nt, Human
gcuccaggagcagcc

SEQ ID NO: 3448256 - RNA, 18 nt, Human
gcuccaggagcagccaca

SEQ ID NO: 3448257 - RNA, 12 nt, Human
gcuccaggcagc

SEQ ID NO: 3448258 - RNA, 18 nt, Human
gcuccaggccagggggcc

SEQ ID NO: 3448259 - RNA, 23 nt, Human
gcuccaggcuccuuuagcgccca

SEQ ID NO: 3448260 - RNA, 24 nt, Human
gcuccaggcuccuuuagcgcccag

SEQ ID NO: 3448261 - RNA, 21 nt, Human
gcuccagggaauccaagccuc

SEQ ID NO: 3448262 - RNA, 22 nt, Human
gcuccagggaauccaagccucc

SEQ ID NO: 3448263 - RNA, 23 nt, Human
gcuccagggaauccaagccucca

SEQ ID NO: 3448264 - RNA, 18 nt, Human
gcuccagggagauuuuga

SEQ ID NO: 3448265 - RNA, 13 nt, Human
gcuccagggccag

SEQ ID NO: 3448266 - RNA, 18 nt, Human
gcuccagguggcucugag

SEQ ID NO: 3448267 - RNA, 21 nt, Human
gcuccagguggcucugaggug

SEQ ID NO: 3448268 - RNA, 17 nt, Human
gcuccaguccugcucuc

SEQ ID NO: 3448269 - RNA, 21 nt, Human
gcuccaguccugcucucuacc

SEQ ID NO: 3448270 - RNA, 18 nt, Human
gcuccagucugcugcccu

SEQ ID NO: 3448271 - RNA, 21 nt, Human
gcuccagucugcugcccucca

SEQ ID NO: 3448272 - RNA, 12 nt, Human
gcuccaguggaa

SEQ ID NO: 3448273 - RNA, 22 nt, Human
gcuccaguguccugagcucagc

SEQ ID NO: 3448274 - RNA, 21 nt, Human
gcuccauacacacgcugccuu

SEQ ID NO: 3448275 - RNA, 22 nt, Human
gcuccaucccaaccaggcaccu

SEQ ID NO: 3448276 - RNA, 14 nt, Human
gcuccaucuuauuu

SEQ ID NO: 3448277 - RNA, 17 nt, Human
gcuccaugugccucuuu

SEQ ID NO: 3448278 - RNA, 19 nt, Human
gcuccauuuaaacagaugu

SEQ ID NO: 3448279 - RNA, 23 nt, Human
gcuccauuuaaacagauguccau

SEQ ID NO: 3448280 - RNA, 15 nt, Human
gcucccaaggggccu

SEQ ID NO: 3448281 - RNA, 17 nt, Human
gcucccaaggggccuga

SEQ ID NO: 3448282 - RNA, 19 nt, Human
gcucccacaagccugaggg

SEQ ID NO: 3448283 - RNA, 19 nt, Human
gcucccacagaacacagca

SEQ ID NO: 3448284 - RNA, 20 nt, Human
gcucccacaggcccuuccuc

SEQ ID NO: 3448285 - RNA, 22 nt, Human
gcucccacaggcccuuccucuc

SEQ ID NO: 3448286 - RNA, 22 nt, Human
gcucccaccuccugacacccuu

SEQ ID NO: 3448287 - RNA, 18 nt, Human
gcucccacuucugccaga

SEQ ID NO: 3448288 - RNA, 17 nt, Human
gcucccagccaggcccu

SEQ ID NO: 3448289 - RNA, 14 nt, Human
gcucccagccucag

SEQ ID NO: 3448290 - RNA, 13 nt, Human
gcucccaggagcc

SEQ ID NO: 3448291 - RNA, 21 nt, Human
gcucccaggcauuccccagga

SEQ ID NO: 3448292 - RNA, 19 nt, Human
gcucccaggggcucccucc

SEQ ID NO: 3448293 - RNA, 16 nt, Human
gcucccaggggucucc

SEQ ID NO: 3448294 - RNA, 14 nt, Human
gcucccaggugcag

SEQ ID NO: 3448295 - RNA, 13 nt, Human
gcucccagugucu

SEQ ID NO: 3448296 - RNA, 17 nt, Human
gcucccauccugugugu

SEQ ID NO: 3448297 - RNA, 20 nt, Human
gcucccauucacucuuccag

SEQ ID NO: 3448298 - RNA, 15 nt, Human
gcucccauuucuacu

SEQ ID NO: 3448299 - RNA, 19 nt, Human
gcuccccacagcgucccug

SEQ ID NO: 3448300 - RNA, 14 nt, Human
gcuccccacucugc

SEQ ID NO: 3448301 - RNA, 20 nt, Human
gcuccccacucugcucugau

SEQ ID NO: 3448302 - RNA, 13 nt, Human
gcuccccagccca

SEQ ID NO: 3448303 - RNA, 14 nt, Human
gcuccccagcccag

SEQ ID NO: 3448304 - RNA, 14 nt, Human
gcuccccagcccca

SEQ ID NO: 3448305 - RNA, 20 nt, Human
gcucccccagcuccccccac

SEQ ID NO: 3448306 - RNA, 16 nt, Human
gcucccccauccuccc

SEQ ID NO: 3448307 - RNA, 11 nt, Human
gcuccccccag

SEQ ID NO: 3448308 - RNA, 21 nt, Human
gcuccccccagcccccuaaga

SEQ ID NO: 3448309 - RNA, 17 nt, Human
gcucccccgggaggggc

SEQ ID NO: 3448310 - RNA, 17 nt, Human
gcucccccuccaccugc

SEQ ID NO: 3448311 - RNA, 12 nt, Human
gcucccccuguc

SEQ ID NO: 3448312 - RNA, 14 nt, Human
gcucccccuguccc

SEQ ID NO: 3448313 - RNA, 12 nt, Human
gcuccccuccaa

SEQ ID NO: 3448314 - RNA, 21 nt, Human
gcuccccuccccaacugacca

SEQ ID NO: 3448315 - RNA, 15 nt, Human
gcuccccucggagaa

SEQ ID NO: 3448316 - RNA, 21 nt, Human
gcuccccucggagaagagcug

SEQ ID NO: 3448317 - RNA, 19 nt, Human
gcuccccucuauuuagcau

SEQ ID NO: 3448318 - RNA, 12 nt, Human
gcuccccucuuc

SEQ ID NO: 3448319 - RNA, 19 nt, Human
gcucccggggcagggcagc

SEQ ID NO: 3448320 - RNA, 22 nt, Human
gcucccggguccuuggcccccu

SEQ ID NO: 3448321 - RNA, 19 nt, Human
gcucccuaagccagccugg

SEQ ID NO: 3448322 - RNA, 14 nt, Human
gcucccucccagga

SEQ ID NO: 3448323 - RNA, 18 nt, Human
gcucccucccccugcccc

SEQ ID NO: 3448324 - RNA, 17 nt, Human
gcucccuccccugcccu

SEQ ID NO: 3448325 - RNA, 23 nt, Human
gcucccuccccugcccuggucca

SEQ ID NO: 3448326 - RNA, 13 nt, Human
gcucccucccgca

SEQ ID NO: 3448327 - RNA, 16 nt, Human
gcucccuccgccccca

SEQ ID NO: 3448328 - RNA, 16 nt, Human
gcucccuccuccaggc

SEQ ID NO: 3448329 - RNA, 14 nt, Human
gcucccugaagcca

SEQ ID NO: 3448330 - RNA, 24 nt, Human
gcucccugaagccagccuucuucc

SEQ ID NO: 3448331 - RNA, 16 nt, Human
gcucccugacugggag

SEQ ID NO: 3448332 - RNA, 14 nt, Human
gcucccugccccaa

SEQ ID NO: 3448333 - RNA, 12 nt, Human
gcucccuggggg

SEQ ID NO: 3448334 - RNA, 21 nt, Human
gcucccuguaaccucuucaga

SEQ ID NO: 3448335 - RNA, 20 nt, Human
gcucccuucagcccccagcc

SEQ ID NO: 3448336 - RNA, 18 nt, Human
gcucccuugaccugcuga

SEQ ID NO: 3448337 - RNA, 22 nt, Human
gcuccgacuugugcacaggcag

SEQ ID NO: 3448338 - RNA, 15 nt, Human
gcuccgaggacccag

SEQ ID NO: 3448339 - RNA, 16 nt, Human
gcuccgaggacccagg

SEQ ID NO: 3448340 - RNA, 16 nt, Human
gcuccgcaggacuucc

SEQ ID NO: 3448341 - RNA, 12 nt, Human
gcuccgcccuua

SEQ ID NO: 3448342 - RNA, 20 nt, Human
gcuccgcccuuaguccccca

SEQ ID NO: 3448343 - RNA, 15 nt, Human
gcuccgccuggccug

SEQ ID NO: 3448344 - RNA, 15 nt, Human
gcuccgcugccgugc

SEQ ID NO: 3448345 - RNA, 12 nt, Human
gcuccgcugcuc

SEQ ID NO: 3448346 - RNA, 19 nt, Human
gcuccgcugcuccuuggcu

SEQ ID NO: 3448347 - RNA, 13 nt, Human
gcuccgcugugug

SEQ ID NO: 3448348 - RNA, 21 nt, Human
gcuccgcuuucuacccagcga

SEQ ID NO: 3448349 - RNA, 21 nt, Human
gcuccggccucugccuuugca

SEQ ID NO: 3448350 - RNA, 16 nt, Human
gcuccgucuccugcgg

SEQ ID NO: 3448351 - RNA, 12 nt, Human
gcuccgucugac

SEQ ID NO: 3448352 - RNA, 17 nt, Human
gcuccgugccuccacca

SEQ ID NO: 3448353 - RNA, 23 nt, Human
gcuccuaacccuuaucaccagcu

SEQ ID NO: 3448354 - RNA, 16 nt, Human
cuucccccauagccac

SEQ ID NO: 3448355 - RNA, 18 nt, Human
cuucccccauagccaccc

SEQ ID NO: 3448356 - RNA, 13 nt, Human
cuucccccucccc

SEQ ID NO: 3448357 - RNA, 18 nt, Human
cuucccccucucccaguu

SEQ ID NO: 3448358 - RNA, 13 nt, Human
cuucccccuucca

SEQ ID NO: 3448359 - RNA, 18 nt, Human
cuucccccuuuuuugucc

SEQ ID NO: 3448360 - RNA, 22 nt, Human
cuuccccgagggaugaugccac

SEQ ID NO: 3448361 - RNA, 18 nt, Human
cuuccccggagggcugcg

SEQ ID NO: 3448362 - RNA, 12 nt, Human
cuuccccucacu

SEQ ID NO: 3448363 - RNA, 19 nt, Human
cuuccccucuaaugcucac

SEQ ID NO: 3448364 - RNA, 21 nt, Human
cuuccccucuaaugcucacgc

SEQ ID NO: 3448365 - RNA, 21 nt, Human
cuuccccuuauccucccugua

SEQ ID NO: 3448366 - RNA, 14 nt, Human
cuuccccuuccuuc

SEQ ID NO: 3448367 - RNA, 16 nt, Human
cuuccccuugcccagg

SEQ ID NO: 3448368 - RNA, 17 nt, Human
cuuccccuugcccuugc

SEQ ID NO: 3448369 - RNA, 15 nt, Human
cuucccgccagaggg

SEQ ID NO: 3448370 - RNA, 23 nt, Human
cuucccgcucagcccucccugcc

SEQ ID NO: 3448371 - RNA, 19 nt, Human
cuucccgggccagggcugc

SEQ ID NO: 3448372 - RNA, 21 nt, Human
cuucccgucccauauccugcc

SEQ ID NO: 3448373 - RNA, 23 nt, Human
cuucccgucccauauccugccuc

SEQ ID NO: 3448374 - RNA, 12 nt, Human
cuucccuaaucu

SEQ ID NO: 3448375 - RNA, 20 nt, Human
cuucccuagaggguuccugu

SEQ ID NO: 3448376 - RNA, 22 nt, Human
cuucccuagcuuuagacccugg

SEQ ID NO: 3448377 - RNA, 23 nt, Human
cuucccuagcuuuagacccuggg

SEQ ID NO: 3448378 - RNA, 16 nt, Human
cuucccuaucuuugcc

SEQ ID NO: 3448379 - RNA, 18 nt, Human
cuucccuaucuuugccac

SEQ ID NO: 3448380 - RNA, 15 nt, Human
cuucccucacaccgc

SEQ ID NO: 3448381 - RNA, 13 nt, Human
cuucccucccugc

SEQ ID NO: 3448382 - RNA, 14 nt, Human
cuucccucccugcu

SEQ ID NO: 3448383 - RNA, 13 nt, Human
cuucccuccuccc

SEQ ID NO: 3448384 - RNA, 18 nt, Human
cuucccuccucccauguc

SEQ ID NO: 3448385 - RNA, 16 nt, Human
gcugaggcgggagaau

SEQ ID NO: 3448386 - RNA, 16 nt, Human
gcugaggcuggcacag

SEQ ID NO: 3448387 - RNA, 15 nt, Human
gcugaggcuggggga

SEQ ID NO: 3448388 - RNA, 22 nt, Human
gcugaggcugggggagagccgu

SEQ ID NO: 3448389 - RNA, 14 nt, Human
gcugagggagccug

SEQ ID NO: 3448390 - RNA, 16 nt, Human
gcugagggcagacugg

SEQ ID NO: 3448391 - RNA, 13 nt, Human
gcugagggcagcu

SEQ ID NO: 3448392 - RNA, 20 nt, Human
gcugagggcaguucgcagcc

SEQ ID NO: 3448393 - RNA, 13 nt, Human
gcugagggccugc

SEQ ID NO: 3448394 - RNA, 23 nt, Human
gcugagggugagugggugaauaa

SEQ ID NO: 3448395 - RNA, 19 nt, Human
gcugaggguguuucuuccu

SEQ ID NO: 3448396 - RNA, 15 nt, Human
gcugaggugcccagg

SEQ ID NO: 3448397 - RNA, 20 nt, Human
gcugaggugcccaggagaag

SEQ ID NO: 3448398 - RNA, 13 nt, Human
gcugagguuccuc

SEQ ID NO: 3448399 - RNA, 17 nt, Human
gcugagguuccucugcc

SEQ ID NO: 3448400 - RNA, 15 nt, Human
gcugaguagcucugc

SEQ ID NO: 3448401 - RNA, 17 nt, Human
gcugaguaggaggccuc

SEQ ID NO: 3448402 - RNA, 13 nt, Human
gcugagucuccca

SEQ ID NO: 3448403 - RNA, 16 nt, Human
gcugagucucccaagg

SEQ ID NO: 3448404 - RNA, 22 nt, Human
gcugagugaaaaaucuguggaa

SEQ ID NO: 3448405 - RNA, 15 nt, Human
gcugagugagcugaa

SEQ ID NO: 3448406 - RNA, 21 nt, Human
gcugaguggcaggggacagga

SEQ ID NO: 3448407 - RNA, 17 nt, Human
gcugagugggagaaggc

SEQ ID NO: 3448408 - RNA, 21 nt, Human
gcugauaaaagauacauuugu

SEQ ID NO: 3448409 - RNA, 19 nt, Human
gcugauaauuuuaaauucu

SEQ ID NO: 3448410 - RNA, 20 nt, Human
cuucuggagucuccaguggu

SEQ ID NO: 3448411 - RNA, 18 nt, Human
cuucuggauggauuuuau

SEQ ID NO: 3448412 - RNA, 18 nt, Human
cuucuggcagauucaaau

SEQ ID NO: 3448413 - RNA, 15 nt, Human
cuucuggccucccac

SEQ ID NO: 3448414 - RNA, 13 nt, Human
cuucuggccuugu

SEQ ID NO: 3448415 - RNA, 14 nt, Human
cuucuggcuuccuu

SEQ ID NO: 3448416 - RNA, 19 nt, Human
cuucugggagggcagcagg

SEQ ID NO: 3448417 - RNA, 16 nt, Human
cuucuggggcaggcug

SEQ ID NO: 3448418 - RNA, 11 nt, Human
cuucugggguc

SEQ ID NO: 3448419 - RNA, 15 nt, Human
cuucuggguggggca

SEQ ID NO: 3448420 - RNA, 17 nt, Human
cuucuggguuccuuccu

SEQ ID NO: 3448421 - RNA, 17 nt, Human
cuucugguacucuccua

SEQ ID NO: 3448422 - RNA, 18 nt, Human
cuucuggugaccuuccaa

SEQ ID NO: 3448423 - RNA, 20 nt, Human
cuucuggugaccuuccaaga

SEQ ID NO: 3448424 - RNA, 19 nt, Human
cuucugguuuaaacuuguu

SEQ ID NO: 3448425 - RNA, 14 nt, Human
cuucuguacgucug

SEQ ID NO: 3448426 - RNA, 20 nt, Human
cuucuguacgucugacaggc

SEQ ID NO: 3448427 - RNA, 21 nt, Human
cuucuguacgucugacaggca

SEQ ID NO: 3448428 - RNA, 11 nt, Human
cuucuguaguu

SEQ ID NO: 3448429 - RNA, 12 nt, Human
cuucuguauaua

SEQ ID NO: 3448430 - RNA, 17 nt, Human
cuucuguauauaaaugg

SEQ ID NO: 3448431 - RNA, 17 nt, Human
cuucuguccugguguca

SEQ ID NO: 3448432 - RNA, 14 nt, Human
cuucugucuccagc

SEQ ID NO: 3448433 - RNA, 18 nt, Human
cuucugucuucacaacag

SEQ ID NO: 3448434 - RNA, 20 nt, Human
cuucugugagacccccacac

SEQ ID NO: 3448435 - RNA, 21 nt, Human
cuucugugagacccccacacc

SEQ ID NO: 3448436 - RNA, 14 nt, Human
cuucugugaugagc

SEQ ID NO: 3448437 - RNA, 17 nt, Human
cuucugugaugagcuga

SEQ ID NO: 3448438 - RNA, 17 nt, Human
cuucugugcaccugggc

SEQ ID NO: 3448439 - RNA, 21 nt, Human
cuucugugcaccugggcucuc

SEQ ID NO: 3448440 - RNA, 23 nt, Human
cuucugugcccagaauacugaug

SEQ ID NO: 3448441 - RNA, 14 nt, Human
cuucugugcccagc

SEQ ID NO: 3448442 - RNA, 16 nt, Human
cuucugugcccagcuc

SEQ ID NO: 3448443 - RNA, 17 nt, Human
cuucugugcccagcuca

SEQ ID NO: 3448444 - RNA, 18 nt, Human
cuucugugcccagcucag

SEQ ID NO: 3448445 - RNA, 15 nt, Human
cuucuguggcucaca

SEQ ID NO: 3448446 - RNA, 19 nt, Human
cuucuguggggacuccggc

SEQ ID NO: 3448447 - RNA, 16 nt, Human
cuucuguggggccccu

SEQ ID NO: 3448448 - RNA, 20 nt, Human
cuucuguggggccccucacc

SEQ ID NO: 3448449 - RNA, 13 nt, Human
cuucuguggguuu

SEQ ID NO: 3448450 - RNA, 13 nt, Human
cuucuguguaucu

SEQ ID NO: 3448451 - RNA, 11 nt, Human
cuucuguguuu

SEQ ID NO: 3448452 - RNA, 14 nt, Human
cuucuguucugcag

SEQ ID NO: 3448453 - RNA, 21 nt, Human
cuucuguugcugccucaugcu

SEQ ID NO: 3448454 - RNA, 20 nt, Human
cuucuguugucaccuucacc

SEQ ID NO: 3448455 - RNA, 21 nt, Human
cuucuguugucaccuucaccu

SEQ ID NO: 3448456 - RNA, 13 nt, Human
cuucuguuucuag

SEQ ID NO: 3448457 - RNA, 16 nt, Human
cuucuguuucuaguug

SEQ ID NO: 3448458 - RNA, 17 nt, Human
cuucuguuuucuguuuc

SEQ ID NO: 3448459 - RNA, 21 nt, Human
cuucuuaaccccaguaagcca

SEQ ID NO: 3448460 - RNA, 12 nt, Human
cuucuuaauuaa

SEQ ID NO: 3448461 - RNA, 14 nt, Human
cuucuuaauuaauu

SEQ ID NO: 3448462 - RNA, 21 nt, Human
cuucuuacuuggaacugaagg

SEQ ID NO: 3448463 - RNA, 22 nt, Human
cuucuuagcuaucauugcuucc

SEQ ID NO: 3448464 - RNA, 16 nt, Human
cuucuuauacauuuga

SEQ ID NO: 3448465 - RNA, 22 nt, Human
cuucuuauggaauugauuugca

SEQ ID NO: 3448466 - RNA, 16 nt, Human
cuucuuauuauauaua

SEQ ID NO: 3448467 - RNA, 14 nt, Human
cuucuucacccagc

SEQ ID NO: 3448468 - RNA, 23 nt, Human
cuucuucacccagcuaaucugua

SEQ ID NO: 3448469 - RNA, 20 nt, Human
cuucuucagaagacacugca

SEQ ID NO: 3448470 - RNA, 14 nt, Human
cuucuucagagacu

SEQ ID NO: 3448471 - RNA, 22 nt, Human
cuucuucagagacuccugcagg

SEQ ID NO: 3448472 - RNA, 14 nt, Human
cuucuucagagcug

SEQ ID NO: 3448473 - RNA, 18 nt, Human
cuucuucagaucagugcu

SEQ ID NO: 3448474 - RNA, 14 nt, Human
cuucuucagggacu

SEQ ID NO: 3448475 - RNA, 12 nt, Human
cuucuucagggc

SEQ ID NO: 3448476 - RNA, 14 nt, Human
cuucuuccauccca

SEQ ID NO: 3448477 - RNA, 15 nt, Human
cuucuuccaucccag

SEQ ID NO: 3448478 - RNA, 20 nt, Human
cuucuuccaucccaggacac

SEQ ID NO: 3448479 - RNA, 15 nt, Human
cuucuuccuuucucu

SEQ ID NO: 3448480 - RNA, 17 nt, Human
cuucuucggggaacucc

SEQ ID NO: 3448481 - RNA, 20 nt, Human
cuucuucggggaacuccugg

SEQ ID NO: 3448482 - RNA, 12 nt, Human
cuucuucuguaa

SEQ ID NO: 3448483 - RNA, 15 nt, Human
cuucuucuguaauau

SEQ ID NO: 3448484 - RNA, 22 nt, Human
cuucuucuguaauauuuacaau

SEQ ID NO: 3448485 - RNA, 19 nt, Human
cuucuucuguccaagcaga

SEQ ID NO: 3448486 - RNA, 21 nt, Human
cuucuucuuuugagcaacuuu

SEQ ID NO: 3448487 - RNA, 17 nt, Human
cuucuucuuuuugcugu

SEQ ID NO: 3448488 - RNA, 13 nt, Human
cuucuugaaaucc

SEQ ID NO: 3448489 - RNA, 20 nt, Human
cuucuugaacacucaugcug

SEQ ID NO: 3448490 - RNA, 21 nt, Human
cuucuugaacacucaugcuga

SEQ ID NO: 3448491 - RNA, 22 nt, Human
cuucuugaacacucaugcugaa

SEQ ID NO: 3448492 - RNA, 19 nt, Human
cuucuugaauauaaaaaau

SEQ ID NO: 3448493 - RNA, 22 nt, Human
cuucuugaauggcaauguuuug

SEQ ID NO: 3448494 - RNA, 22 nt, Human
cuucuugcauccuuccuauaac

SEQ ID NO: 3448495 - RNA, 15 nt, Human
cuucuugcugcccug

SEQ ID NO: 3448496 - RNA, 20 nt, Human
cuucuugcugcccugcccca

SEQ ID NO: 3448497 - RNA, 19 nt, Human
cuucuuggggcccagugca

SEQ ID NO: 3448498 - RNA, 21 nt, Human
cuucuuggggguaagcugauu

SEQ ID NO: 3448499 - RNA, 20 nt, Human
cuucuuggucuuauuuauua

SEQ ID NO: 3448500 - RNA, 13 nt, Human
cuucuugucagac

SEQ ID NO: 3448501 - RNA, 14 nt, Human
cuucuugucagaca

SEQ ID NO: 3448502 - RNA, 20 nt, Human
cuucuugucagacauaaagc

SEQ ID NO: 3448503 - RNA, 17 nt, Human
cuucuuuaauugaucua

SEQ ID NO: 3448504 - RNA, 22 nt, Human
cuucuuuauaauucuacuuuga

SEQ ID NO: 3448505 - RNA, 14 nt, Human
cuucuuucauuuuc

SEQ ID NO: 3448506 - RNA, 23 nt, Human
cuucuuucccuuccuccauccuc

SEQ ID NO: 3448507 - RNA, 11 nt, Human
cuucuuuccuc

SEQ ID NO: 3448508 - RNA, 14 nt, Human
cuucuuuccucuuc

SEQ ID NO: 3448509 - RNA, 16 nt, Human
cuucuuuccucuuccc

SEQ ID NO: 3448510 - RNA, 16 nt, Human
cuucuuucugucuuua

SEQ ID NO: 3448511 - RNA, 21 nt, Human
cuucuuucuuugggaauauuu

SEQ ID NO: 3448512 - RNA, 12 nt, Human
cuucuuugaaga

SEQ ID NO: 3448513 - RNA, 13 nt, Human
cuucuuugaagaa

SEQ ID NO: 3448514 - RNA, 12 nt, Human
cuucuuugcccu

SEQ ID NO: 3448515 - RNA, 18 nt, Human
cuucuuuggguaaacgug

SEQ ID NO: 3448516 - RNA, 17 nt, Human
cuucuuuucacauucuu

SEQ ID NO: 3448517 - RNA, 14 nt, Human
cuucuuuucucaug

SEQ ID NO: 3448518 - RNA, 16 nt, Human
cuucuuuucuuuguau

SEQ ID NO: 3448519 - RNA, 14 nt, Human
cuucuuuugauuau

SEQ ID NO: 3448520 - RNA, 14 nt, Human
cuucuuuugcucuu

SEQ ID NO: 3448521 - RNA, 20 nt, Human
cuucuuuuuauuuucuuuug

SEQ ID NO: 3448522 - RNA, 23 nt, Human
cuucuuuuuauuuucuuuuguaa

SEQ ID NO: 3448523 - RNA, 16 nt, Human
cuucuuuuucuggacu

SEQ ID NO: 3448524 - RNA, 20 nt, Human
cuucuuuuuucaaaagaaag

SEQ ID NO: 3448525 - RNA, 17 nt, Human
cuucuuuuuuugugaug

SEQ ID NO: 3448526 - RNA, 14 nt, Human
cuugaaaaaaaaca

SEQ ID NO: 3448527 - RNA, 20 nt, Human
cuugaaaaaaaacaguggau

SEQ ID NO: 3448528 - RNA, 12 nt, Human
cuugaaaaaugc

SEQ ID NO: 3448529 - RNA, 18 nt, Human
cuugaaaaaugcauguug

SEQ ID NO: 3448530 - RNA, 19 nt, Human
ggaagcagugccuuccaua

SEQ ID NO: 3448531 - RNA, 20 nt, Human
ggaagcauguaggagaaucc

SEQ ID NO: 3448532 - RNA, 21 nt, Human
ggaagcauguaggagaaucca

SEQ ID NO: 3448533 - RNA, 22 nt, Human
ggaagccaaaauguaggcuuag

SEQ ID NO: 3448534 - RNA, 22 nt, Human
ggaagccacccucccagcucug

SEQ ID NO: 3448535 - RNA, 13 nt, Human
ggaagccagcagg

SEQ ID NO: 3448536 - RNA, 15 nt, Human
ggaagccagcaggcu

SEQ ID NO: 3448537 - RNA, 16 nt, Human
ggaagccagcaggcuc

SEQ ID NO: 3448538 - RNA, 21 nt, Human
ggaagccagcaggcucucagg

SEQ ID NO: 3448539 - RNA, 23 nt, Human
ggaagccagcaggcucucaggcc

SEQ ID NO: 3448540 - RNA, 14 nt, Human
ggaagcccagcucc

SEQ ID NO: 3448541 - RNA, 14 nt, Human
ggaagcccauccug

SEQ ID NO: 3448542 - RNA, 15 nt, Human
ggaagccccugggcc

SEQ ID NO: 3448543 - RNA, 23 nt, Human
ggaagcccuggauuucagaaaga

SEQ ID NO: 3448544 - RNA, 21 nt, Human
ggaagccgagcuccagagcaa

SEQ ID NO: 3448545 - RNA, 16 nt, Human
ggaagccgugcccugc

SEQ ID NO: 3448546 - RNA, 14 nt, Human
ggaagccugcaguc

SEQ ID NO: 3448547 - RNA, 16 nt, Human
ggaagcuaauuugcau

SEQ ID NO: 3448548 - RNA, 23 nt, Human
ggaagcuacagguuacaacagau

SEQ ID NO: 3448549 - RNA, 17 nt, Human
ggaagcuagucuuuugc

SEQ ID NO: 3448550 - RNA, 19 nt, Human
ggaagcuagucuuuugcuu

SEQ ID NO: 3448551 - RNA, 23 nt, Human
ggaagcuagucuuuugcuuuugc

SEQ ID NO: 3448552 - RNA, 22 nt, Human
ggaagcucagggccuggcucag

SEQ ID NO: 3448553 - RNA, 14 nt, Human
ggaagcuccacugu

SEQ ID NO: 3448554 - RNA, 23 nt, Human
ggaagcuccacugucacccucca

SEQ ID NO: 3448555 - RNA, 13 nt, Human
ggaagcuccuggu

SEQ ID NO: 3448556 - RNA, 12 nt, Human
ggaagcugcagc

SEQ ID NO: 3448557 - RNA, 15 nt, Human
ggaagcugcagcuug

SEQ ID NO: 3448558 - RNA, 13 nt, Human
ggaagcuuccagu

SEQ ID NO: 3448559 - RNA, 22 nt, Human
ggaagcuuucucugcuucagcu

SEQ ID NO: 3448560 - RNA, 19 nt, Human
ggaagcuuuguccccugcu

SEQ ID NO: 3448561 - RNA, 19 nt, Human
ggaaggaaagaaagaagga

SEQ ID NO: 3448562 - RNA, 16 nt, Human
ggaaggaacucuggcu

SEQ ID NO: 3448563 - RNA, 13 nt, Human
ggaaggacccuga

SEQ ID NO: 3448564 - RNA, 19 nt, Human
ggaaggagacacagauguu

SEQ ID NO: 3448565 - RNA, 20 nt, Human
ggaaggagacacagauguuc

SEQ ID NO: 3448566 - RNA, 15 nt, Human
ggaaggagacucacc

SEQ ID NO: 3448567 - RNA, 16 nt, Human
ggaaggagagccugcu

SEQ ID NO: 3448568 - RNA, 14 nt, Human
ggaaggagcugccu

SEQ ID NO: 3448569 - RNA, 15 nt, Human
ggaaggagcugccug

SEQ ID NO: 3448570 - RNA, 20 nt, Human
ggaaggagcugccuggaccc

SEQ ID NO: 3448571 - RNA, 22 nt, Human
ggaaggagcugccuggacccgu

SEQ ID NO: 3448572 - RNA, 16 nt, Human
ggaaggaggacccagg

SEQ ID NO: 3448573 - RNA, 17 nt, Human
ggaaggaggagccuguc

SEQ ID NO: 3448574 - RNA, 22 nt, Human
ggaaggauucugcuggccucug

SEQ ID NO: 3448575 - RNA, 21 nt, Human
gcugauacauaacuaaauuug

SEQ ID NO: 3448576 - RNA, 15 nt, Human
gcugauauaaauucu

SEQ ID NO: 3448577 - RNA, 16 nt, Human
gcugaucgugcuaaau

SEQ ID NO: 3448578 - RNA, 12 nt, Human
gcugaucucagg

SEQ ID NO: 3448579 - RNA, 16 nt, Human
gcugaucucagggaag

SEQ ID NO: 3448580 - RNA, 17 nt, Human
gcugaucucagggaagc

SEQ ID NO: 3448581 - RNA, 21 nt, Human
gcugaucucagggaagcccag

SEQ ID NO: 3448582 - RNA, 17 nt, Human
gcugaugaaucacuguu

SEQ ID NO: 3448583 - RNA, 17 nt, Human
gcugauggagccuuccc

SEQ ID NO: 3448584 - RNA, 15 nt, Human
gcugauggugcaaug

SEQ ID NO: 3448585 - RNA, 21 nt, Human
gcugauggugcaaugaccuuu

SEQ ID NO: 3448586 - RNA, 20 nt, Human
gcugauguagcaugcuuguu

SEQ ID NO: 3448587 - RNA, 17 nt, Human
gcugauguucaguguaa

SEQ ID NO: 3448588 - RNA, 20 nt, Human
gcugauguucaguguaauuu

SEQ ID NO: 3448589 - RNA, 21 nt, Human
gcugauucucagggucucugc

SEQ ID NO: 3448590 - RNA, 14 nt, Human
gcugauuguauuua

SEQ ID NO: 3448591 - RNA, 17 nt, Human
gcugauuuggugaccaa

SEQ ID NO: 3448592 - RNA, 14 nt, Human
gcugauuuuaacaa

SEQ ID NO: 3448593 - RNA, 17 nt, Human
gcugauuuuauucuuga

SEQ ID NO: 3448594 - RNA, 11 nt, Human
gcugauuuuuu

SEQ ID NO: 3448595 - RNA, 13 nt, Human
gcugcaaaggaca

SEQ ID NO: 3448596 - RNA, 15 nt, Human
gcugcaaaggacaga

SEQ ID NO: 3448597 - RNA, 11 nt, Human
gcugcaaagug

SEQ ID NO: 3448598 - RNA, 13 nt, Human
gcugcaaaguguu

SEQ ID NO: 3448599 - RNA, 14 nt, Human
gcugcaacaaaaug

SEQ ID NO: 3448600 - RNA, 14 nt, Human
gcugcaaggccuuu

SEQ ID NO: 3448601 - RNA, 12 nt, Human
gcugcaagguac

SEQ ID NO: 3448602 - RNA, 12 nt, Human
gcugcaagguuu

SEQ ID NO: 3448603 - RNA, 19 nt, Human
gcugcaagguuuaggcugg

SEQ ID NO: 3448604 - RNA, 18 nt, Human
gcugcacagggcagcugg

SEQ ID NO: 3448605 - RNA, 13 nt, Human
gcugcaccaaccc

SEQ ID NO: 3448606 - RNA, 18 nt, Human
gcugcaccaacccagccg

SEQ ID NO: 3448607 - RNA, 19 nt, Human
gcugcaccaacccagccgc

SEQ ID NO: 3448608 - RNA, 20 nt, Human
gcugcaccaacccagccgcu

SEQ ID NO: 3448609 - RNA, 23 nt, Human
gcugcaccaacccagccgcugcc

SEQ ID NO: 3448610 - RNA, 13 nt, Human
gcugcaccagagc

SEQ ID NO: 3448611 - RNA, 17 nt, Human
gcugcaccagagcaacc

SEQ ID NO: 3448612 - RNA, 19 nt, Human
gcugcaccccuuccugggc

SEQ ID NO: 3448613 - RNA, 21 nt, Human
gcugcaccccuuccugggcac

SEQ ID NO: 3448614 - RNA, 15 nt, Human
gcugcacccucaggc

SEQ ID NO: 3448615 - RNA, 18 nt, Human
gcugcacccucaggcagg

SEQ ID NO: 3448616 - RNA, 22 nt, Human
gcugcaccggcuggccuggccc

SEQ ID NO: 3448617 - RNA, 14 nt, Human
gcugcacucugugc

SEQ ID NO: 3448618 - RNA, 22 nt, Human
gcugcacucugugcccaugggc

SEQ ID NO: 3448619 - RNA, 16 nt, Human
gcugcagaaggccaag

SEQ ID NO: 3448620 - RNA, 21 nt, Human
gcugcagagcagugggccugg

SEQ ID NO: 3448621 - RNA, 18 nt, Human
gcugcagaggccagaggc

SEQ ID NO: 3448622 - RNA, 22 nt, Human
gcugcagaggccagaggccccc

SEQ ID NO: 3448623 - RNA, 15 nt, Human
gcugcagaggggcag

SEQ ID NO: 3448624 - RNA, 19 nt, Human
gcugcagaggggcaggccc

SEQ ID NO: 3448625 - RNA, 15 nt, Human
gcugcagagucacaa

SEQ ID NO: 3448626 - RNA, 18 nt, Human
gcugcagauuugggcugg

SEQ ID NO: 3448627 - RNA, 23 nt, Human
gcugcagcaccgaggggccuuug

SEQ ID NO: 3448628 - RNA, 21 nt, Human
gcugcagcagcgguggccucu

SEQ ID NO: 3448629 - RNA, 14 nt, Human
gcugcagccucagg

SEQ ID NO: 3448630 - RNA, 18 nt, Human
gcugcagccucaggacug

SEQ ID NO: 3448631 - RNA, 19 nt, Human
gcugcagccucaggacugg

SEQ ID NO: 3448632 - RNA, 21 nt, Human
gcugcagccucaggacuggga

SEQ ID NO: 3448633 - RNA, 16 nt, Human
gcugcagccugcgcca

SEQ ID NO: 3448634 - RNA, 13 nt, Human
gcugcagcuggac

SEQ ID NO: 3448635 - RNA, 17 nt, Human
gcugcagcuggacagag

SEQ ID NO: 3448636 - RNA, 15 nt, Human
gcugcagcugggcug

SEQ ID NO: 3448637 - RNA, 10 nt, Human
gcugcagcuu

SEQ ID NO: 3448638 - RNA, 13 nt, Human
gcugcagcuuggg

SEQ ID NO: 3448639 - RNA, 15 nt, Human
gcugcaggaaucaaa

SEQ ID NO: 3448640 - RNA, 17 nt, Human
gcugcaggacuugagaa

SEQ ID NO: 3448641 - RNA, 19 nt, Human
gcugcagggcuuuaaaauu

SEQ ID NO: 3448642 - RNA, 20 nt, Human
gcugcaggggcucuggagag

SEQ ID NO: 3448643 - RNA, 17 nt, Human
gcugcaguucgacucug

SEQ ID NO: 3448644 - RNA, 17 nt, Human
gcugcaguugccaguca

SEQ ID NO: 3448645 - RNA, 17 nt, Human
gcugcaguuuugcuauc

SEQ ID NO: 3448646 - RNA, 14 nt, Human
gcugcauccagagg

SEQ ID NO: 3448647 - RNA, 22 nt, Human
gcugcaucccccccaccucucc

SEQ ID NO: 3448648 - RNA, 20 nt, Human
gcugcaucggaggccaggac

SEQ ID NO: 3448649 - RNA, 15 nt, Human
gcugcaucuacucag

SEQ ID NO: 3448650 - RNA, 13 nt, Human
gcugcaucuuaua

SEQ ID NO: 3448651 - RNA, 17 nt, Human
gcugcaucuuauagcac

SEQ ID NO: 3448652 - RNA, 16 nt, Human
gcugcaugcccucuca

SEQ ID NO: 3448653 - RNA, 17 nt, Human
gcugcaugcccucucag

SEQ ID NO: 3448654 - RNA, 19 nt, Human
gcugcaugcccucucaggc

SEQ ID NO: 3448655 - RNA, 20 nt, Human
gcugcaugcccucucaggcc

SEQ ID NO: 3448656 - RNA, 18 nt, Human
gcugcaugccuggucuuu

SEQ ID NO: 3448657 - RNA, 22 nt, Human
gcugcauggcagggggcugcug

SEQ ID NO: 3448658 - RNA, 22 nt, Human
gcugcauggggugggguagggc

SEQ ID NO: 3448659 - RNA, 18 nt, Human
gcugcauuuaaaagauac

SEQ ID NO: 3448660 - RNA, 19 nt, Human
gcugcauuuaaaagauaca

SEQ ID NO: 3448661 - RNA, 23 nt, Human
gcugcauuuuaauuuuaaccaaa

SEQ ID NO: 3448662 - RNA, 17 nt, Human
gcugccaaauuuuggcc

SEQ ID NO: 3448663 - RNA, 15 nt, Human
gcugccaagccccau

SEQ ID NO: 3448664 - RNA, 17 nt, Human
gcugccaauauccuaau

SEQ ID NO: 3448665 - RNA, 20 nt, Human
gcugccaaugggagcucaug

SEQ ID NO: 3448666 - RNA, 23 nt, Human
gcugccacaccagucacaugacc

SEQ ID NO: 3448667 - RNA, 17 nt, Human
gcugccacacuucaggc

SEQ ID NO: 3448668 - RNA, 21 nt, Human
gcugccacacuucaggcucuu

SEQ ID NO: 3448669 - RNA, 20 nt, Human
gcugccacccaccucccugc

SEQ ID NO: 3448670 - RNA, 22 nt, Human
gcugccacccaccucccugccu

SEQ ID NO: 3448671 - RNA, 23 nt, Human
gcugccacccaccucccugccuc

SEQ ID NO: 3448672 - RNA, 12 nt, Human
gcugccacugag

SEQ ID NO: 3448673 - RNA, 14 nt, Human
gcugccacuuuuua

SEQ ID NO: 3448674 - RNA, 14 nt, Human
gcuguuuuuguugu

SEQ ID NO: 3448675 - RNA, 13 nt, Human
gcuguuuuuuugu

SEQ ID NO: 3448676 - RNA, 17 nt, Human
gcuuaaaaaaaacucuu

SEQ ID NO: 3448677 - RNA, 15 nt, Human
gcuuaaaaaucauug

SEQ ID NO: 3448678 - RNA, 13 nt, Human
gcuuaaaacuuug

SEQ ID NO: 3448679 - RNA, 14 nt, Human
gcuuaaaauacaag

SEQ ID NO: 3448680 - RNA, 22 nt, Human
gcuuaaauauaguuccuaagaa

SEQ ID NO: 3448681 - RNA, 17 nt, Human
gcuuaaaugugaauuac

SEQ ID NO: 3448682 - RNA, 13 nt, Human
gcuuaaauuucuu

SEQ ID NO: 3448683 - RNA, 14 nt, Human
gcuuaacuucacau

SEQ ID NO: 3448684 - RNA, 16 nt, Human
gcuuaacuucacauau

SEQ ID NO: 3448685 - RNA, 12 nt, Human
gcuuaagaaaaa

SEQ ID NO: 3448686 - RNA, 20 nt, Human
gcuuaagaaaucuaguauuu

SEQ ID NO: 3448687 - RNA, 16 nt, Human
gcuuaagggaguuuaa

SEQ ID NO: 3448688 - RNA, 13 nt, Human
gcuuaaguuccag

SEQ ID NO: 3448689 - RNA, 17 nt, Human
gcuuaauaaaaaugaca

SEQ ID NO: 3448690 - RNA, 21 nt, Human
gcuuaauaaaaaugacagacu

SEQ ID NO: 3448691 - RNA, 15 nt, Human
gcuuaaucauuuuca

SEQ ID NO: 3448692 - RNA, 15 nt, Human
gcuuaaucuuugaaa

SEQ ID NO: 3448693 - RNA, 14 nt, Human
gcuuaaugcuucuu

SEQ ID NO: 3448694 - RNA, 20 nt, Human
gcuuaauggcugauaauuuu

SEQ ID NO: 3448695 - RNA, 22 nt, Human
gcuuacaagccagcuggagaaa

SEQ ID NO: 3448696 - RNA, 23 nt, Human
gcuuacaauuuuuuuaauuuugu

SEQ ID NO: 3448697 - RNA, 18 nt, Human
gcuuacacaucucagacc

SEQ ID NO: 3448698 - RNA, 11 nt, Human
gcuuacauuuu

SEQ ID NO: 3448699 - RNA, 12 nt, Human
gcuuaccugaca

SEQ ID NO: 3448700 - RNA, 16 nt, Human
gcuuaccugacacaag

SEQ ID NO: 3448701 - RNA, 21 nt, Human
gcuuaccugaccucuugcugu

SEQ ID NO: 3448702 - RNA, 16 nt, Human
gcuuacggcccuggcc

SEQ ID NO: 3448703 - RNA, 17 nt, Human
gcuuacggcccuggccu

SEQ ID NO: 3448704 - RNA, 14 nt, Human
gcuuacguaguucu

SEQ ID NO: 3448705 - RNA, 17 nt, Human
gcuuacuaagcuuugcc

SEQ ID NO: 3448706 - RNA, 21 nt, Human
gcuuacuacaugugggagcuu

SEQ ID NO: 3448707 - RNA, 13 nt, Human
gcuuacuauuucu

SEQ ID NO: 3448708 - RNA, 16 nt, Human
gcuuagaccucagccu

SEQ ID NO: 3448709 - RNA, 18 nt, Human
gcuuagaccucagccugu

SEQ ID NO: 3448710 - RNA, 21 nt, Human
gcuuagacuucgacucaggau

SEQ ID NO: 3448711 - RNA, 23 nt, Human
gcuuagacuucgacucaggaucc

SEQ ID NO: 3448712 - RNA, 16 nt, Human
gcuuagagaauguucu

SEQ ID NO: 3448713 - RNA, 13 nt, Human
gcuuagagacagu

SEQ ID NO: 3448714 - RNA, 12 nt, Human
gcuuagagcagu

SEQ ID NO: 3448715 - RNA, 11 nt, Human
gcuuagcagga

SEQ ID NO: 3448716 - RNA, 16 nt, Human
gcuuagcaggagagga

SEQ ID NO: 3448717 - RNA, 21 nt, Human
gcuuagcaggagaggagagcc

SEQ ID NO: 3448718 - RNA, 17 nt, Human
gcuuagcuuugcucugc

SEQ ID NO: 3448719 - RNA, 18 nt, Human
gcuuaggcagggcucucu

SEQ ID NO: 3448720 - RNA, 22 nt, Human
gcuuagggacaggaccccagcu

SEQ ID NO: 3448721 - RNA, 18 nt, Human
gcuuagggcccuggaggc

SEQ ID NO: 3448722 - RNA, 15 nt, Human
gcuuagggucucagg

SEQ ID NO: 3448723 - RNA, 16 nt, Human
gcuuaguaaaauuuau

SEQ ID NO: 3448724 - RNA, 23 nt, Human
gcuuaguaaugcuacgugugauu

SEQ ID NO: 3448725 - RNA, 14 nt, Human
gcuuaguaucucau

SEQ ID NO: 3448726 - RNA, 20 nt, Human
gcuuagucacugagacagcc

SEQ ID NO: 3448727 - RNA, 18 nt, Human
gcuuagucacugccugca

SEQ ID NO: 3448728 - RNA, 12 nt, Human
gcuuaguuugug

SEQ ID NO: 3448729 - RNA, 14 nt, Human
gcuuaguuugugug

SEQ ID NO: 3448730 - RNA, 12 nt, Human
gcuuauaaaaca

SEQ ID NO: 3448731 - RNA, 13 nt, Human
gcuuauaaaacag

SEQ ID NO: 3448732 - RNA, 19 nt, Human
gcuuauacgaaauaauugu

SEQ ID NO: 3448733 - RNA, 23 nt, Human
gcuuauacgaaauaauuguuguu

SEQ ID NO: 3448734 - RNA, 17 nt, Human
gcuuauaucuggccucu

SEQ ID NO: 3448735 - RNA, 20 nt, Human
gcuuauaucuggccucugcu

SEQ ID NO: 3448736 - RNA, 20 nt, Human
gcuuaucaauuugucauuuu

SEQ ID NO: 3448737 - RNA, 15 nt, Human
gcuuauccauaaaaa

SEQ ID NO: 3448738 - RNA, 23 nt, Human
gcuuaugauagcaaauggccuca

SEQ ID NO: 3448739 - RNA, 15 nt, Human
gcuuauuaaugcuaa

SEQ ID NO: 3448740 - RNA, 16 nt, Human
gcuuauuaaugcuaag

SEQ ID NO: 3448741 - RNA, 19 nt, Human
gcuuauuaaugcuaagggc

SEQ ID NO: 3448742 - RNA, 14 nt, Human
gcuuauuauugaag

SEQ ID NO: 3448743 - RNA, 17 nt, Human
gcuuauuccaugacugc

SEQ ID NO: 3448744 - RNA, 18 nt, Human
gcuuauuccaugacugcu

SEQ ID NO: 3448745 - RNA, 17 nt, Human
gcuuauuguuccaagac

SEQ ID NO: 3448746 - RNA, 18 nt, Human
gcuuauuuaauuaaaaaa

SEQ ID NO: 3448747 - RNA, 22 nt, Human
gcuuauuuaauuaaaaaauuuc

SEQ ID NO: 3448748 - RNA, 16 nt, Human
gcuuauuuauuaacag

SEQ ID NO: 3448749 - RNA, 12 nt, Human
gcuuauuuuaau

SEQ ID NO: 3448750 - RNA, 18 nt, Human
gcuuauuuuaaugugaug

SEQ ID NO: 3448751 - RNA, 21 nt, Human
gcuuauuuuaaugugaugaug

SEQ ID NO: 3448752 - RNA, 22 nt, Human
gcuucaacauucuuugcaagau

SEQ ID NO: 3448753 - RNA, 14 nt, Human
gcuucaaggauccu

SEQ ID NO: 3448754 - RNA, 22 nt, Human
gcuucaagucugugccuggagc

SEQ ID NO: 3448755 - RNA, 23 nt, Human
gcuucaagucugugccuggagcu

SEQ ID NO: 3448756 - RNA, 22 nt, Human
gcuucaauacccaaauccucuc

SEQ ID NO: 3448757 - RNA, 15 nt, Human
gcuucaauuuauacc

SEQ ID NO: 3448758 - RNA, 20 nt, Human
gcuucaauuuauugcacaaa

SEQ ID NO: 3448759 - RNA, 18 nt, Human
gcuucacaguagagccag

SEQ ID NO: 3448760 - RNA, 20 nt, Human
gcuucacaguagagccagcu

SEQ ID NO: 3448761 - RNA, 21 nt, Human
gcuucacaguagagccagcuu

SEQ ID NO: 3448762 - RNA, 22 nt, Human
gcuucacaguagagccagcuug

SEQ ID NO: 3448763 - RNA, 20 nt, Human
gcuucaccauggccuuauga

SEQ ID NO: 3448764 - RNA, 20 nt, Human
gcuucaccccaaucccagcu

SEQ ID NO: 3448765 - RNA, 22 nt, Human
gcuucacccugaaugguuccau

SEQ ID NO: 3448766 - RNA, 15 nt, Human
gcuucacggaagagc

SEQ ID NO: 3448767 - RNA, 20 nt, Human
gcuucacggaagagccuugc

SEQ ID NO: 3448768 - RNA, 17 nt, Human
gcuucacuccugcugua

SEQ ID NO: 3448769 - RNA, 14 nt, Human
gcuucacuguauaa

SEQ ID NO: 3448770 - RNA, 15 nt, Human
gcuucacuguauaaa

SEQ ID NO: 3448771 - RNA, 19 nt, Human
gcuucagauguggagccag

SEQ ID NO: 3448772 - RNA, 16 nt, Human
gcuucagccacaguuu

SEQ ID NO: 3448773 - RNA, 15 nt, Human
gcuucagcuccagcc

SEQ ID NO: 3448774 - RNA, 23 nt, Human
gcuucaggcccccgccuuggccu

SEQ ID NO: 3448775 - RNA, 23 nt, Human
gcuucagggcgcacagcaugaga

SEQ ID NO: 3448776 - RNA, 15 nt, Human
gcuucagguccaggc

SEQ ID NO: 3448777 - RNA, 12 nt, Human
gcuucagguuau

SEQ ID NO: 3448778 - RNA, 17 nt, Human
gcuucagguuaucgaaa

SEQ ID NO: 3448779 - RNA, 21 nt, Human
gcuucagguuaucgaaauaac

SEQ ID NO: 3448780 - RNA, 17 nt, Human
cuugugacccagcacug

SEQ ID NO: 3448781 - RNA, 14 nt, Human
cuugugacuagugc

SEQ ID NO: 3448782 - RNA, 20 nt, Human
cuugugacuagugcugaagc

SEQ ID NO: 3448783 - RNA, 17 nt, Human
cuugugaggaaagucau

SEQ ID NO: 3448784 - RNA, 23 nt, Human
cuugugaggaaagucauuggcuu

SEQ ID NO: 3448785 - RNA, 20 nt, Human
cuugugaugucauacagaga

SEQ ID NO: 3448786 - RNA, 22 nt, Human
cuugugaugucauacagagaag

SEQ ID NO: 3448787 - RNA, 21 nt, Human
cuugugauuucuuuaaaagaa

SEQ ID NO: 3448788 - RNA, 21 nt, Human
cuugugcaaaauauuugacua

SEQ ID NO: 3448789 - RNA, 18 nt, Human
cuugugcacaggcagagc

SEQ ID NO: 3448790 - RNA, 17 nt, Human
cuugugcagaaaacauu

SEQ ID NO: 3448791 - RNA, 18 nt, Human
cuugugcagaaaacauug

SEQ ID NO: 3448792 - RNA, 19 nt, Human
cuugugcagaaaacauugu

SEQ ID NO: 3448793 - RNA, 20 nt, Human
cuugugcagaaaacauuguu

SEQ ID NO: 3448794 - RNA, 17 nt, Human
cuugugccacacccucc

SEQ ID NO: 3448795 - RNA, 16 nt, Human
cuugugccuggcucag

SEQ ID NO: 3448796 - RNA, 15 nt, Human
cuugugccugggagu

SEQ ID NO: 3448797 - RNA, 22 nt, Human
cuugugcuggauggagcccagg

SEQ ID NO: 3448798 - RNA, 23 nt, Human
cuugugcuggauggagcccaggc

SEQ ID NO: 3448799 - RNA, 17 nt, Human
cuugugcuuugcucuug

SEQ ID NO: 3448800 - RNA, 23 nt, Human
cuugugcuuugcucuugucccac

SEQ ID NO: 3448801 - RNA, 20 nt, Human
cuugugcuuuuccuauuugu

SEQ ID NO: 3448802 - RNA, 15 nt, Human
cuuguggacacagcu

SEQ ID NO: 3448803 - RNA, 16 nt, Human
cuuguggacacagcuc

SEQ ID NO: 3448804 - RNA, 15 nt, Human
cuuguggacuaaaag

SEQ ID NO: 3448805 - RNA, 18 nt, Human
cuuguggacuaaaagaua

SEQ ID NO: 3448806 - RNA, 13 nt, Human
cuuguggagcccc

SEQ ID NO: 3448807 - RNA, 16 nt, Human
cuuguggauguuuuaa

SEQ ID NO: 3448808 - RNA, 16 nt, Human
cuuguggcagcaacgg

SEQ ID NO: 3448809 - RNA, 15 nt, Human
cuugugggccugggc

SEQ ID NO: 3448810 - RNA, 22 nt, Human
cuugugggccugggcuccugga

SEQ ID NO: 3448811 - RNA, 16 nt, Human
cuuguggggccuggga

SEQ ID NO: 3448812 - RNA, 16 nt, Human
cuuguggguccaugcu

SEQ ID NO: 3448813 - RNA, 24 nt, Human
cuuguggguccaugcuaacaaaga

SEQ ID NO: 3448814 - RNA, 15 nt, Human
cuugugguccaaaua

SEQ ID NO: 3448815 - RNA, 16 nt, Human
cuuguggucccacccc

SEQ ID NO: 3448816 - RNA, 20 nt, Human
cuugugguuuucaaauugga

SEQ ID NO: 3448817 - RNA, 16 nt, Human
cuuguguaauuuaugu

SEQ ID NO: 3448818 - RNA, 15 nt, Human
ggagcacuggagugc

SEQ ID NO: 3448819 - RNA, 18 nt, Human
ggagcacuggagugcagg

SEQ ID NO: 3448820 - RNA, 13 nt, Human
ggagcacugggcu

SEQ ID NO: 3448821 - RNA, 20 nt, Human
ggagcacugggcucccgggc

SEQ ID NO: 3448822 - RNA, 23 nt, Human
ggagcagaaaacccuugggccag

SEQ ID NO: 3448823 - RNA, 16 nt, Human
ggagcagaacugaacc

SEQ ID NO: 3448824 - RNA, 13 nt, Human
ggagcagaaucag

SEQ ID NO: 3448825 - RNA, 23 nt, Human
ggagcagaaucaguauugggagc

SEQ ID NO: 3448826 - RNA, 20 nt, Human
ggagcagacaggaggaauca

SEQ ID NO: 3448827 - RNA, 14 nt, Human
ggagcagagaaggc

SEQ ID NO: 3448828 - RNA, 19 nt, Human
ggagcagagcugauggaga

SEQ ID NO: 3448829 - RNA, 12 nt, Human
ggagcagagggg

SEQ ID NO: 3448830 - RNA, 19 nt, Human
ggagcagaggggcagaggc

SEQ ID NO: 3448831 - RNA, 21 nt, Human
ggagcaggagauugagaagga

SEQ ID NO: 3448832 - RNA, 23 nt, Human
ggagcaggagauugagaaggaga

SEQ ID NO: 3448833 - RNA, 18 nt, Human
ggagcaggcgguggggag

SEQ ID NO: 3448834 - RNA, 13 nt, Human
ggagcagggaagg

SEQ ID NO: 3448835 - RNA, 17 nt, Human
ggagcaguccaugcaug

SEQ ID NO: 3448836 - RNA, 18 nt, Human
ggagcaguccaugcauga

SEQ ID NO: 3448837 - RNA, 14 nt, Human
ggagcagugcaggc

SEQ ID NO: 3448838 - RNA, 18 nt, Human
ggagcagugucuuccaua

SEQ ID NO: 3448839 - RNA, 17 nt, Human
ggagcauccaccuccuu

SEQ ID NO: 3448840 - RNA, 22 nt, Human
ggagcauccaccuccuucucug

SEQ ID NO: 3448841 - RNA, 14 nt, Human
ggagcaugggccug

SEQ ID NO: 3448842 - RNA, 16 nt, Human
ggagcaugggccuggc

SEQ ID NO: 3448843 - RNA, 15 nt, Human
ggagcauggggauaa

SEQ ID NO: 3448844 - RNA, 20 nt, Human
ggagcauguuuuguauacaa

SEQ ID NO: 3448845 - RNA, 17 nt, Human
ggagccaaauguggcau

SEQ ID NO: 3448846 - RNA, 15 nt, Human
ggagccaacugcugc

SEQ ID NO: 3448847 - RNA, 16 nt, Human
ggagccaacugcugcu

SEQ ID NO: 3448848 - RNA, 15 nt, Human
ggagccaccaguucu

SEQ ID NO: 3448849 - RNA, 16 nt, Human
ggagccacuccucuga

SEQ ID NO: 3448850 - RNA, 19 nt, Human
ggagccacuccucugacuc

SEQ ID NO: 3448851 - RNA, 15 nt, Human
ggagccacucuguuc

SEQ ID NO: 3448852 - RNA, 12 nt, Human
ggagccagcucu

SEQ ID NO: 3448853 - RNA, 13 nt, Human
ggagccagggcug

SEQ ID NO: 3448854 - RNA, 22 nt, Human
ggagccaugcgcccccuccgcc

SEQ ID NO: 3448855 - RNA, 21 nt, Human
ggagcccacgacacugcagcc

SEQ ID NO: 3448856 - RNA, 23 nt, Human
ggagcccacggcuaagaggcugc

SEQ ID NO: 3448857 - RNA, 14 nt, Human
ggagcccacugucc

SEQ ID NO: 3448858 - RNA, 17 nt, Human
ggagcccacuguccugg

SEQ ID NO: 3448859 - RNA, 18 nt, Human
ggagcccaggagucccac

SEQ ID NO: 3448860 - RNA, 19 nt, Human
ggagcccaggcgggagcgg

SEQ ID NO: 3448861 - RNA, 22 nt, Human
ggagcccaggcgggagcggugg

SEQ ID NO: 3448862 - RNA, 12 nt, Human
ggagcccagggc

SEQ ID NO: 3448863 - RNA, 19 nt, Human
ggagcccauacucagccug

SEQ ID NO: 3448864 - RNA, 20 nt, Human
ggagcccauacucagccugc

SEQ ID NO: 3448865 - RNA, 21 nt, Human
ggagcccauacucagccugcu

SEQ ID NO: 3448866 - RNA, 18 nt, Human
ggagcccauuuggagggc

SEQ ID NO: 3448867 - RNA, 21 nt, Human
ggagcccauuuggagggccug

SEQ ID NO: 3448868 - RNA, 23 nt, Human
ggagcccauuuggagggccuggg

SEQ ID NO: 3448869 - RNA, 14 nt, Human
ggagccccacugcc

SEQ ID NO: 3448870 - RNA, 15 nt, Human
ggagccccagccccc

SEQ ID NO: 3448871 - RNA, 16 nt, Human
ggagccccagcccccu

SEQ ID NO: 3448872 - RNA, 17 nt, Human
ggagccccagcuacccu

SEQ ID NO: 3448873 - RNA, 18 nt, Human
ggagccccagcuacccuu

SEQ ID NO: 3448874 - RNA, 22 nt, Human
ggagccccaggccucugugucc

SEQ ID NO: 3448875 - RNA, 20 nt, Human
ggagccccagggucuucccu

SEQ ID NO: 3448876 - RNA, 17 nt, Human
ggagccccauuccuggg

SEQ ID NO: 3448877 - RNA, 16 nt, Human
ggagcccccagccugu

SEQ ID NO: 3448878 - RNA, 13 nt, Human
ggagcccccgccc

SEQ ID NO: 3448879 - RNA, 13 nt, Human
ggagccccugggu

SEQ ID NO: 3448880 - RNA, 21 nt, Human
ggagccccuucugcucagcuc

SEQ ID NO: 3448881 - RNA, 18 nt, Human
ggagcccgcacccccacc

SEQ ID NO: 3448882 - RNA, 20 nt, Human
ggagcccgcacccccacccu

SEQ ID NO: 3448883 - RNA, 13 nt, Human
ggagcccucaucu

SEQ ID NO: 3448884 - RNA, 19 nt, Human
ggagcccugggaggcucug

SEQ ID NO: 3448885 - RNA, 15 nt, Human
ggagccgaagcccag

SEQ ID NO: 3448886 - RNA, 17 nt, Human
ggagccgaagcccaggg

SEQ ID NO: 3448887 - RNA, 21 nt, Human
ggagccgaggccuaccccgca

SEQ ID NO: 3448888 - RNA, 21 nt, Human
ggagccgggaaagaagagccg

SEQ ID NO: 3448889 - RNA, 21 nt, Human
ggagccgggcaaacuggccgc

SEQ ID NO: 3448890 - RNA, 18 nt, Human
ggagccgggucugccucu

SEQ ID NO: 3448891 - RNA, 19 nt, Human
ggagccgguaacuguccug

SEQ ID NO: 3448892 - RNA, 16 nt, Human
ggagccgguggcggug

SEQ ID NO: 3448893 - RNA, 16 nt, Human
ggagccuacccacccc

SEQ ID NO: 3448894 - RNA, 21 nt, Human
ggagccuaggaccacucagcc

SEQ ID NO: 3448895 - RNA, 17 nt, Human
ggagccuaggccaggug

SEQ ID NO: 3448896 - RNA, 18 nt, Human
ggagccuaggccaggugc

SEQ ID NO: 3448897 - RNA, 19 nt, Human
ggagccucauccgaggcag

SEQ ID NO: 3448898 - RNA, 16 nt, Human
ggagccucccugccuc

SEQ ID NO: 3448899 - RNA, 18 nt, Human
ggagccucccugccucag

SEQ ID NO: 3448900 - RNA, 11 nt, Human
ggagccuccug

SEQ ID NO: 3448901 - RNA, 22 nt, Human
ggagccucgcaacccgugccaa

SEQ ID NO: 3448902 - RNA, 20 nt, Human
ggagccugagucagggccca

SEQ ID NO: 3448903 - RNA, 10 nt, Human
ggagccuguc

SEQ ID NO: 3448904 - RNA, 11 nt, Human
ggagccugucc

SEQ ID NO: 3448905 - RNA, 14 nt, Human
ggagccuguccugc

SEQ ID NO: 3448906 - RNA, 17 nt, Human
ggagccugugaacccag

SEQ ID NO: 3448907 - RNA, 18 nt, Human
ggagccugugaacccagg

SEQ ID NO: 3448908 - RNA, 19 nt, Human
ggagccugugaacccagga

SEQ ID NO: 3448909 - RNA, 20 nt, Human
ggagccugugaacccaggac

SEQ ID NO: 3448910 - RNA, 19 nt, Human
ggagccuguguaacagcuc

SEQ ID NO: 3448911 - RNA, 21 nt, Human
ggagccuguguaacagcuccu

SEQ ID NO: 3448912 - RNA, 22 nt, Human
ggagccuguguaacagcuccuu

SEQ ID NO: 3448913 - RNA, 13 nt, Human
ggagccuucccaa

SEQ ID NO: 3448914 - RNA, 20 nt, Human
ggagccuuugguucuggcca

SEQ ID NO: 3448915 - RNA, 22 nt, Human
ggagcgagcaugucguggacac

SEQ ID NO: 3448916 - RNA, 15 nt, Human
ggagcggaaagcagc

SEQ ID NO: 3448917 - RNA, 16 nt, Human
ggagcggaaagcagcu

SEQ ID NO: 3448918 - RNA, 19 nt, Human
ggagcggagguugcaguga

SEQ ID NO: 3448919 - RNA, 13 nt, Human
ggagcgggaccug

SEQ ID NO: 3448920 - RNA, 20 nt, Human
ggagcgggucugcucccaag

SEQ ID NO: 3448921 - RNA, 16 nt, Human
ggagcgucaggguugg

SEQ ID NO: 3448922 - RNA, 16 nt, Human
ggagcuaacacuggcc

SEQ ID NO: 3448923 - RNA, 19 nt, Human
ggagcuaacacuggccccu

SEQ ID NO: 3448924 - RNA, 20 nt, Human
ggagcuaaggcucuaugagu

SEQ ID NO: 3448925 - RNA, 22 nt, Human
ggagcuaccuguguggacagga

SEQ ID NO: 3448926 - RNA, 14 nt, Human
ggagcuagaauuug

SEQ ID NO: 3448927 - RNA, 22 nt, Human
ggagcuaucaggaacagcuaug

SEQ ID NO: 3448928 - RNA, 17 nt, Human
ggagcucagagagggca

SEQ ID NO: 3448929 - RNA, 20 nt, Human
ggagcucagagagggcaggc

SEQ ID NO: 3448930 - RNA, 12 nt, Human
ggagcucagccc

SEQ ID NO: 3448931 - RNA, 21 nt, Human
ggagcucaggaaccgaggcag

SEQ ID NO: 3448932 - RNA, 21 nt, Human
ggagcucaggaaggggugugc

SEQ ID NO: 3448933 - RNA, 20 nt, Human
ggagcuccaacucagaaggg

SEQ ID NO: 3448934 - RNA, 16 nt, Human
ggagcuccagccugac

SEQ ID NO: 3448935 - RNA, 19 nt, Human
ggagcuccaguguccugag

SEQ ID NO: 3448936 - RNA, 17 nt, Human
ggagcuccccuccccaa

SEQ ID NO: 3448937 - RNA, 13 nt, Human
ggagcuccucucc

SEQ ID NO: 3448938 - RNA, 14 nt, Human
ggagcuccugggaa

SEQ ID NO: 3448939 - RNA, 22 nt, Human
ggagcugagcagguguucuuca

SEQ ID NO: 3448940 - RNA, 20 nt, Human
ggagcugcaggggcauggga

SEQ ID NO: 3448941 - RNA, 22 nt, Human
ggagcugccccucucugggccu

SEQ ID NO: 3448942 - RNA, 11 nt, Human
ggagcugccug

SEQ ID NO: 3448943 - RNA, 15 nt, Human
gcuugagccaggagg

SEQ ID NO: 3448944 - RNA, 16 nt, Human
gcuugagcccaggagu

SEQ ID NO: 3448945 - RNA, 12 nt, Human
gcuugagccggg

SEQ ID NO: 3448946 - RNA, 23 nt, Human
gcuugcaaguauguuuuagcaug

SEQ ID NO: 3448947 - RNA, 22 nt, Human
gcuugcacuuuguaacauguuu

SEQ ID NO: 3448948 - RNA, 19 nt, Human
gcuugcagugagccgagau

SEQ ID NO: 3448949 - RNA, 22 nt, Human
gcuugccaaaguacagaauuug

SEQ ID NO: 3448950 - RNA, 20 nt, Human
gcuugccaaggcagaggccu

SEQ ID NO: 3448951 - RNA, 16 nt, Human
gcuugccacagagcgg

SEQ ID NO: 3448952 - RNA, 16 nt, Human
gcuugccaucccuccc

SEQ ID NO: 3448953 - RNA, 21 nt, Human
gcuugccaucccucccuccac

SEQ ID NO: 3448954 - RNA, 17 nt, Human
gcuugccauuuuucaaa

SEQ ID NO: 3448955 - RNA, 23 nt, Human
gcuugcccuaagcagaaagugcc

SEQ ID NO: 3448956 - RNA, 18 nt, Human
gcuugcccuguuaaaaga

SEQ ID NO: 3448957 - RNA, 18 nt, Human
gcuugccgaaacuggaag

SEQ ID NO: 3448958 - RNA, 14 nt, Human
gcuugccucggcuc

SEQ ID NO: 3448959 - RNA, 18 nt, Human
gcuugccucggcuccugc

SEQ ID NO: 3448960 - RNA, 13 nt, Human
gcuugccugcagg

SEQ ID NO: 3448961 - RNA, 14 nt, Human
gcuugccugcaggg

SEQ ID NO: 3448962 - RNA, 13 nt, Human
ggcacccccugca

SEQ ID NO: 3448963 - RNA, 14 nt, Human
ggcacccccuggag

SEQ ID NO: 3448964 - RNA, 15 nt, Human
ggcacccccuggaga

SEQ ID NO: 3448965 - RNA, 16 nt, Human
ggcacccccuggagag

SEQ ID NO: 3448966 - RNA, 19 nt, Human
ggcacccccuggagagaag

SEQ ID NO: 3448967 - RNA, 17 nt, Human
ggcacccggccccugcu

SEQ ID NO: 3448968 - RNA, 19 nt, Human
ggcacccuguggcccuggc

SEQ ID NO: 3448969 - RNA, 12 nt, Human
ggcacccuucuu

SEQ ID NO: 3448970 - RNA, 20 nt, Human
ggcacccuucuuuccucuuc

SEQ ID NO: 3448971 - RNA, 17 nt, Human
ggcaccuaauccaggca

SEQ ID NO: 3448972 - RNA, 22 nt, Human
ggcaccuaauccaggcagaucc

SEQ ID NO: 3448973 - RNA, 15 nt, Human
ggcaccucacaggcc

SEQ ID NO: 3448974 - RNA, 16 nt, Human
ggcaccucacaggccc

SEQ ID NO: 3448975 - RNA, 19 nt, Human
ggcaccucacaggccccag

SEQ ID NO: 3448976 - RNA, 23 nt, Human
ggcaccuccuacgucaaacauga

SEQ ID NO: 3448977 - RNA, 20 nt, Human
ggcaccugcagguugggcca

SEQ ID NO: 3448978 - RNA, 22 nt, Human
ggcaccugccacccugggccug

SEQ ID NO: 3448979 - RNA, 20 nt, Human
ggcaccuguagucccagcua

SEQ ID NO: 3448980 - RNA, 17 nt, Human
ggcaccuuaguggcuuu

SEQ ID NO: 3448981 - RNA, 15 nt, Human
ggcacgggugguccc

SEQ ID NO: 3448982 - RNA, 14 nt, Human
ggcacuagccuuug

SEQ ID NO: 3448983 - RNA, 20 nt, Human
ggcacuagccuuuggcucug

SEQ ID NO: 3448984 - RNA, 15 nt, Human
ggcacuauuuauuua

SEQ ID NO: 3448985 - RNA, 21 nt, Human
ggcacucacagaccuggagcc

SEQ ID NO: 3448986 - RNA, 22 nt, Human
ggcacuccaaccuaaccugugu

SEQ ID NO: 3448987 - RNA, 22 nt, Human
ggcacucuguuauuuagacuca

SEQ ID NO: 3448988 - RNA, 13 nt, Human
ggcacugagcccc

SEQ ID NO: 3448989 - RNA, 20 nt, Human
ggcacugcccugguggcccu

SEQ ID NO: 3448990 - RNA, 14 nt, Human
ggcacugcugggug

SEQ ID NO: 3448991 - RNA, 15 nt, Human
ggcacugcugggugg

SEQ ID NO: 3448992 - RNA, 16 nt, Human
ggcacugcuggguggc

SEQ ID NO: 3448993 - RNA, 19 nt, Human
ggcacugcuggguggccca

SEQ ID NO: 3448994 - RNA, 23 nt, Human
ggcacuggcaaacagggccucug

SEQ ID NO: 3448995 - RNA, 14 nt, Human
ggcacuggcccagg

SEQ ID NO: 3448996 - RNA, 19 nt, Human
ggcacugggaugagccgcu

SEQ ID NO: 3448997 - RNA, 19 nt, Human
ggaaggaggggaagcugca

SEQ ID NO: 3448998 - RNA, 20 nt, Human
ggaaggaggggaagcugcag

SEQ ID NO: 3448999 - RNA, 20 nt, Human
ggaaggaggguuagggaggg

SEQ ID NO: 3449000 - RNA, 13 nt, Human
ggaaggagugaga

SEQ ID NO: 3449001 - RNA, 13 nt, Human
ggaaggauuguaa

SEQ ID NO: 3449002 - RNA, 23 nt, Human
ggaaggauuguaaaaaaaaaugc

SEQ ID NO: 3449003 - RNA, 18 nt, Human
ggaaggcacuucugccug

SEQ ID NO: 3449004 - RNA, 14 nt, Human
ggaaggcagacagc

SEQ ID NO: 3449005 - RNA, 18 nt, Human
ggaaggcagacagcaggc

SEQ ID NO: 3449006 - RNA, 11 nt, Human
ggaaggcaggc

SEQ ID NO: 3449007 - RNA, 12 nt, Human
ggaaggcaggca

SEQ ID NO: 3449008 - RNA, 15 nt, Human
ggaaggcaggcaggg

SEQ ID NO: 3449009 - RNA, 18 nt, Human
ggaaggcaggcagggcuc

SEQ ID NO: 3449010 - RNA, 19 nt, Human
ggaaggcaggcagggcucu

SEQ ID NO: 3449011 - RNA, 21 nt, Human
ggaaggcaggcagggcucucc

SEQ ID NO: 3449012 - RNA, 21 nt, Human
ggaaggcagggaggaggcaga

SEQ ID NO: 3449013 - RNA, 14 nt, Human
ggaaggcccagcac

SEQ ID NO: 3449014 - RNA, 20 nt, Human
ggaaggcuacuucggggcug

SEQ ID NO: 3449015 - RNA, 17 nt, Human
ggaaggcugagaggaga

SEQ ID NO: 3449016 - RNA, 14 nt, Human
ggaaggcuggcugg

SEQ ID NO: 3449017 - RNA, 17 nt, Human
ggaaggcuggcugggca

SEQ ID NO: 3449018 - RNA, 21 nt, Human
ggaaggcuuguugugcuuuua

SEQ ID NO: 3449019 - RNA, 15 nt, Human
ggaagggaaaguuuu

SEQ ID NO: 3449020 - RNA, 21 nt, Human
ggaagggagccaagggaugga

SEQ ID NO: 3449021 - RNA, 17 nt, Human
ggaagggcauccuucug

SEQ ID NO: 3449022 - RNA, 21 nt, Human
ggaagggccagucugggcugc

SEQ ID NO: 3449023 - RNA, 16 nt, Human
ggaaggggacccccgc

SEQ ID NO: 3449024 - RNA, 22 nt, Human
ggaaggggacccccgcccccug

SEQ ID NO: 3449025 - RNA, 14 nt, Human
ggaaggguaaacaa

SEQ ID NO: 3449026 - RNA, 19 nt, Human
ggaagguacuguaugauca

SEQ ID NO: 3449027 - RNA, 20 nt, Human
ggaagguaguucaagaaaug

SEQ ID NO: 3449028 - RNA, 21 nt, Human
ggaagguaguucaagaaauga

SEQ ID NO: 3449029 - RNA, 19 nt, Human
ggaaggucccuuguuucca

SEQ ID NO: 3449030 - RNA, 11 nt, Human
ggaaggugggg

SEQ ID NO: 3449031 - RNA, 19 nt, Human
ggaagguuuggugugugga

SEQ ID NO: 3449032 - RNA, 16 nt, Human
ggaaguacuggagaaa

SEQ ID NO: 3449033 - RNA, 14 nt, Human
ggaaguagaaacaa

SEQ ID NO: 3449034 - RNA, 14 nt, Human
ggaaguagcacagg

SEQ ID NO: 3449035 - RNA, 18 nt, Human
ggaaguaguccuuggcau

SEQ ID NO: 3449036 - RNA, 13 nt, Human
ggaagucaaagca

SEQ ID NO: 3449037 - RNA, 18 nt, Human
ggaagucauccugccaac

SEQ ID NO: 3449038 - RNA, 15 nt, Human
ggaaguccaaugugg

SEQ ID NO: 3449039 - RNA, 16 nt, Human
ggaaguccaauguggc

SEQ ID NO: 3449040 - RNA, 17 nt, Human
ggaaguccaauguggca

SEQ ID NO: 3449041 - RNA, 21 nt, Human
ggaaguccccaggccccagga

SEQ ID NO: 3449042 - RNA, 14 nt, Human
ggaaguccucuggg

SEQ ID NO: 3449043 - RNA, 17 nt, Human
ggaagucuaggagcugg

SEQ ID NO: 3449044 - RNA, 18 nt, Human
ggaagugacauuguguca

SEQ ID NO: 3449045 - RNA, 14 nt, Human
ggaagugaggaagc

SEQ ID NO: 3449046 - RNA, 21 nt, Human
ggaagugagggucagagagga

SEQ ID NO: 3449047 - RNA, 18 nt, Human
ggaaguggggcgggcuuc

SEQ ID NO: 3449048 - RNA, 16 nt, Human
ggaaguguaacagcug

SEQ ID NO: 3449049 - RNA, 17 nt, Human
ggaaguguaacagcuga

SEQ ID NO: 3449050 - RNA, 21 nt, Human
ggaagugugggucugugugug

SEQ ID NO: 3449051 - RNA, 19 nt, Human
ggaaguguguguggcagca

SEQ ID NO: 3449052 - RNA, 17 nt, Human
ggaaguuaaagugaggc

SEQ ID NO: 3449053 - RNA, 13 nt, Human
ggaaguuuagaga

SEQ ID NO: 3449054 - RNA, 18 nt, Human
ggaaguuuagcucugaga

SEQ ID NO: 3449055 - RNA, 14 nt, Human
ggaaguuuucugua

SEQ ID NO: 3449056 - RNA, 14 nt, Human
ggaauaaaaggcuu

SEQ ID NO: 3449057 - RNA, 17 nt, Human
ggaauaaaaggcuugaa

SEQ ID NO: 3449058 - RNA, 22 nt, Human
ggaauaaaaggcuugaagcugu

SEQ ID NO: 3449059 - RNA, 22 nt, Human
ggaauaaauaugccucuccuuu

SEQ ID NO: 3449060 - RNA, 17 nt, Human
ggaauaagaagcaaaua

SEQ ID NO: 3449061 - RNA, 17 nt, Human
ggaauaagacagagacc

SEQ ID NO: 3449062 - RNA, 18 nt, Human
ggaauaagcucccagggc

SEQ ID NO: 3449063 - RNA, 20 nt, Human
ggaauaaggccuuaauaugu

SEQ ID NO: 3449064 - RNA, 19 nt, Human
ggaauaagguacaagaagc

SEQ ID NO: 3449065 - RNA, 22 nt, Human
ggaauaaugggcuuagagcagu

SEQ ID NO: 3449066 - RNA, 16 nt, Human
ggaauaccuguccccc

SEQ ID NO: 3449067 - RNA, 19 nt, Human
ggaauaccugucccccuga

SEQ ID NO: 3449068 - RNA, 19 nt, Human
ggaauacucuuauaucuau

SEQ ID NO: 3449069 - RNA, 19 nt, Human
ggaauacugaacaucugag

SEQ ID NO: 3449070 - RNA, 14 nt, Human
ggaauagcauguca

SEQ ID NO: 3449071 - RNA, 17 nt, Human
ggaauagcaugucacua

SEQ ID NO: 3449072 - RNA, 13 nt, Human
ggaauaguuuuuu

SEQ ID NO: 3449073 - RNA, 14 nt, Human
ggaauaucaauaua

SEQ ID NO: 3449074 - RNA, 13 nt, Human
ggaauaugagcuu

SEQ ID NO: 3449075 - RNA, 19 nt, Human
ggaauauuauauuuggaug

SEQ ID NO: 3449076 - RNA, 13 nt, Human
ggaauauuugaau

SEQ ID NO: 3449077 - RNA, 20 nt, Human
ggaauauuugaaucuugucu

SEQ ID NO: 3449078 - RNA, 17 nt, Human
ggaaucaacagggcagc

SEQ ID NO: 3449079 - RNA, 22 nt, Human
ggaaucaagaugucagacuggc

SEQ ID NO: 3449080 - RNA, 18 nt, Human
ggaaucacaucuuuuaag

SEQ ID NO: 3449081 - RNA, 23 nt, Human
ggaaucagacuucacacugcaag

SEQ ID NO: 3449082 - RNA, 14 nt, Human
ggaauccacuccca

SEQ ID NO: 3449083 - RNA, 20 nt, Human
ggaauccacucccaggcagc

SEQ ID NO: 3449084 - RNA, 16 nt, Human
ggaauccuccuccagg

SEQ ID NO: 3449085 - RNA, 19 nt, Human
ggaauccuccuccagggug

SEQ ID NO: 3449086 - RNA, 12 nt, Human
ggaauccuggca

SEQ ID NO: 3449087 - RNA, 21 nt, Human
ggaaucgaggaaccagagcca

SEQ ID NO: 3449088 - RNA, 16 nt, Human
ggaaucuagaagaaau

SEQ ID NO: 3449089 - RNA, 13 nt, Human
ggaaucuggagag

SEQ ID NO: 3449090 - RNA, 19 nt, Human
ggaaucuggagagcuagaa

SEQ ID NO: 3449091 - RNA, 18 nt, Human
ggaaugaagauaccauca

SEQ ID NO: 3449092 - RNA, 19 nt, Human
ggaaugaagauacugaaau

SEQ ID NO: 3449093 - RNA, 15 nt, Human
ggaaugaagcuugug

SEQ ID NO: 3449094 - RNA, 20 nt, Human
ggaaugagcccagagaacag

SEQ ID NO: 3449095 - RNA, 21 nt, Human
ggaaugaggcuugcugagagg

SEQ ID NO: 3449096 - RNA, 12 nt, Human
ggaaugaggggg

SEQ ID NO: 3449097 - RNA, 23 nt, Human
ggaaugcauuauuuauugcugug

SEQ ID NO: 3449098 - RNA, 19 nt, Human
ggaaugcccuucacuguca

SEQ ID NO: 3449099 - RNA, 19 nt, Human
ggaaugccugagugccugg

SEQ ID NO: 3449100 - RNA, 15 nt, Human
ggaauggcacagccc

SEQ ID NO: 3449101 - RNA, 14 nt, Human
ggaauggcagcagg

SEQ ID NO: 3449102 - RNA, 16 nt, Human
ggaauggcagcagggg

SEQ ID NO: 3449103 - RNA, 16 nt, Human
ggaauguauaguauuu

SEQ ID NO: 3449104 - RNA, 21 nt, Human
ggaauguauaguauuugaaaa

SEQ ID NO: 3449105 - RNA, 16 nt, Human
ggaauguuaaagucag

SEQ ID NO: 3449106 - RNA, 19 nt, Human
ggaauguuugggcagaagg

SEQ ID NO: 3449107 - RNA, 16 nt, Human
ggcagccugcguggcu

SEQ ID NO: 3449108 - RNA, 14 nt, Human
ggcagccuggcucc

SEQ ID NO: 3449109 - RNA, 15 nt, Human
ggcagcgccaagcaa

SEQ ID NO: 3449110 - RNA, 19 nt, Human
ggcagcgcccuuccucucc

SEQ ID NO: 3449111 - RNA, 20 nt, Human
ggcagcgcccuuccucucca

SEQ ID NO: 3449112 - RNA, 14 nt, Human
ggcagcucaccucu

SEQ ID NO: 3449113 - RNA, 16 nt, Human
ggcagcucaccucucc

SEQ ID NO: 3449114 - RNA, 11 nt, Human
ggcagcucucc

SEQ ID NO: 3449115 - RNA, 15 nt, Human
ggcagcucuggacag

SEQ ID NO: 3449116 - RNA, 12 nt, Human
ggcagcugccuc

SEQ ID NO: 3449117 - RNA, 13 nt, Human
ggcagcugccucc

SEQ ID NO: 3449118 - RNA, 16 nt, Human
ggcagcugccuccccu

SEQ ID NO: 3449119 - RNA, 18 nt, Human
ggcagcugccuccccucc

SEQ ID NO: 3449120 - RNA, 19 nt, Human
ggcagcugcgguccaccca

SEQ ID NO: 3449121 - RNA, 13 nt, Human
ggcagcugcuuuu

SEQ ID NO: 3449122 - RNA, 22 nt, Human
ggcagcugggcccaacccuguc

SEQ ID NO: 3449123 - RNA, 16 nt, Human
ggcagcuucugccccc

SEQ ID NO: 3449124 - RNA, 17 nt, Human
ggcagcuucugcccccu

SEQ ID NO: 3449125 - RNA, 22 nt, Human
ggcagcuucugcccccugcaga

SEQ ID NO: 3449126 - RNA, 17 nt, Human
ggcagcuugaggguugg

SEQ ID NO: 3449127 - RNA, 21 nt, Human
ggcagcuugaggguugggcug

SEQ ID NO: 3449128 - RNA, 18 nt, Human
ggcagcuugccccggccc

SEQ ID NO: 3449129 - RNA, 14 nt, Human
ggcagcuuugcuca

SEQ ID NO: 3449130 - RNA, 15 nt, Human
ggcagcuuugcucau

SEQ ID NO: 3449131 - RNA, 14 nt, Human
ggcagcuuuuaaaa

SEQ ID NO: 3449132 - RNA, 15 nt, Human
ggcagcuuuuaaaag

SEQ ID NO: 3449133 - RNA, 11 nt, Human
ggcaggaaaag

SEQ ID NO: 3449134 - RNA, 15 nt, Human
ggcaggaacaaacag

SEQ ID NO: 3449135 - RNA, 23 nt, Human
ggcaggaagcccaauugcuggag

SEQ ID NO: 3449136 - RNA, 16 nt, Human
ggcaggaaggagagcc

SEQ ID NO: 3449137 - RNA, 20 nt, Human
ggcaggacaacgaggaagcc

SEQ ID NO: 3449138 - RNA, 13 nt, Human
ggcaggaccagcc

SEQ ID NO: 3449139 - RNA, 14 nt, Human
ggcaggaccagccc

SEQ ID NO: 3449140 - RNA, 15 nt, Human
ggcaggaccagccca

SEQ ID NO: 3449141 - RNA, 16 nt, Human
ggcaggaccagcccac

SEQ ID NO: 3449142 - RNA, 18 nt, Human
ggcaggacgugggcuggg

SEQ ID NO: 3449143 - RNA, 24 nt, Human
ggcaggaggauugcuugagcccag

SEQ ID NO: 3449144 - RNA, 14 nt, Human
ggcaggaguagcug

SEQ ID NO: 3449145 - RNA, 15 nt, Human
ggcaggauggccugg

SEQ ID NO: 3449146 - RNA, 16 nt, Human
ggcaggauggccuggc

SEQ ID NO: 3449147 - RNA, 13 nt, Human
ggcaggcacagca

SEQ ID NO: 3449148 - RNA, 16 nt, Human
ggcaggcacagcacag

SEQ ID NO: 3449149 - RNA, 13 nt, Human
ggcaggcagcgcc

SEQ ID NO: 3449150 - RNA, 13 nt, Human
ggcaggcagggcu

SEQ ID NO: 3449151 - RNA, 15 nt, Human
ggcaggcagggcucu

SEQ ID NO: 3449152 - RNA, 19 nt, Human
ggcaggcagggcucuccug

SEQ ID NO: 3449153 - RNA, 22 nt, Human
ggcaggcagggcucuccuggcu

SEQ ID NO: 3449154 - RNA, 19 nt, Human
ggcaggccaccuggcucuc

SEQ ID NO: 3449155 - RNA, 15 nt, Human
ggcaggccagcugug

SEQ ID NO: 3449156 - RNA, 14 nt, Human
ggcaggcccugcac

SEQ ID NO: 3449157 - RNA, 15 nt, Human
ggcaggcccugcacu

SEQ ID NO: 3449158 - RNA, 13 nt, Human
ggacacaggccug

SEQ ID NO: 3449159 - RNA, 16 nt, Human
ggacacaguuccuggg

SEQ ID NO: 3449160 - RNA, 17 nt, Human
ggacacaguuccuggga

SEQ ID NO: 3449161 - RNA, 13 nt, Human
ggacacaugucca

SEQ ID NO: 3449162 - RNA, 19 nt, Human
ggacaccacacccagccuc

SEQ ID NO: 3449163 - RNA, 16 nt, Human
ggacaccagccaggcu

SEQ ID NO: 3449164 - RNA, 18 nt, Human
ggacaccagccaggcucu

SEQ ID NO: 3449165 - RNA, 16 nt, Human
ggacaccccgacuuuu

SEQ ID NO: 3449166 - RNA, 19 nt, Human
ggacaccccuuauccagga

SEQ ID NO: 3449167 - RNA, 15 nt, Human
ggacaccgggccagu

SEQ ID NO: 3449168 - RNA, 10 nt, Human
ggacaccugc

SEQ ID NO: 3449169 - RNA, 17 nt, Human
ggacaccugcccugccc

SEQ ID NO: 3449170 - RNA, 19 nt, Human
ggacaccuguacuggagag

SEQ ID NO: 3449171 - RNA, 21 nt, Human
ggacacgcgccccccucccag

SEQ ID NO: 3449172 - RNA, 17 nt, Human
ggacacuaaccacgcug

SEQ ID NO: 3449173 - RNA, 15 nt, Human
ggacacuacacccag

SEQ ID NO: 3449174 - RNA, 17 nt, Human
ggacacuacacccagca

SEQ ID NO: 3449175 - RNA, 18 nt, Human
ggacacuacacccagcaa

SEQ ID NO: 3449176 - RNA, 19 nt, Human
ggacacuacacccagcaau

SEQ ID NO: 3449177 - RNA, 17 nt, Human
ggacacucaaaagcugg

SEQ ID NO: 3449178 - RNA, 14 nt, Human
ggacacucagaccu

SEQ ID NO: 3449179 - RNA, 14 nt, Human
ggacacuccaggga

SEQ ID NO: 3449180 - RNA, 18 nt, Human
ggacacuccagggacaca

SEQ ID NO: 3449181 - RNA, 16 nt, Human
ggacacuccagugcca

SEQ ID NO: 3449182 - RNA, 15 nt, Human
ggacacuccuagaga

SEQ ID NO: 3449183 - RNA, 22 nt, Human
ggacacuuauccacgagagcgc

SEQ ID NO: 3449184 - RNA, 21 nt, Human
ggacacuucccucuguuucuc

SEQ ID NO: 3449185 - RNA, 14 nt, Human
ggacagaaagagac

SEQ ID NO: 3449186 - RNA, 15 nt, Human
ggacagaagcagcuc

SEQ ID NO: 3449187 - RNA, 20 nt, Human
ggacagaaggcuccugcccc

SEQ ID NO: 3449188 - RNA, 17 nt, Human
ggacagagacaccugca

SEQ ID NO: 3449189 - RNA, 18 nt, Human
ggacagagacaccugcac

SEQ ID NO: 3449190 - RNA, 21 nt, Human
ggacagagacaccugcaccuc

SEQ ID NO: 3449191 - RNA, 14 nt, Human
ggacagaggcccca

SEQ ID NO: 3449192 - RNA, 15 nt, Human
ggacagaggccccag

SEQ ID NO: 3449193 - RNA, 16 nt, Human
ggacagaggccccagc

SEQ ID NO: 3449194 - RNA, 13 nt, Human
ggacagaggggac

SEQ ID NO: 3449195 - RNA, 16 nt, Human
ggacagaggggacucu

SEQ ID NO: 3449196 - RNA, 18 nt, Human
ggacagaggggacucugg

SEQ ID NO: 3449197 - RNA, 20 nt, Human
ggacagaggggacucugggc

SEQ ID NO: 3449198 - RNA, 15 nt, Human
ggacagaucaauggc

SEQ ID NO: 3449199 - RNA, 23 nt, Human
ggacagaucaauggcgcagugcc

SEQ ID NO: 3449200 - RNA, 18 nt, Human
ggacagauucagucuugc

SEQ ID NO: 3449201 - RNA, 21 nt, Human
ggacagauugccuguuucuga

SEQ ID NO: 3449202 - RNA, 21 nt, Human
ggacagccacggccaggccag

SEQ ID NO: 3449203 - RNA, 22 nt, Human
ggacagccacggccaggccaga

SEQ ID NO: 3449204 - RNA, 14 nt, Human
ggacagcccagagc

SEQ ID NO: 3449205 - RNA, 17 nt, Human
ggacagcccagagccug

SEQ ID NO: 3449206 - RNA, 18 nt, Human
ggacagcccagagccugg

SEQ ID NO: 3449207 - RNA, 21 nt, Human
ggacagcccagagccuggcug

SEQ ID NO: 3449208 - RNA, 16 nt, Human
ggacagccccuccucc

SEQ ID NO: 3449209 - RNA, 16 nt, Human
ggacagccgccuggag

SEQ ID NO: 3449210 - RNA, 20 nt, Human
ggacagccugagucaccugc

SEQ ID NO: 3449211 - RNA, 22 nt, Human
ggacagccuguggcggugccug

SEQ ID NO: 3449212 - RNA, 11 nt, Human
ggacagcuccu

SEQ ID NO: 3449213 - RNA, 20 nt, Human
ggacagcugugccucgcucc

SEQ ID NO: 3449214 - RNA, 12 nt, Human
ggacagcugugu

SEQ ID NO: 3449215 - RNA, 14 nt, Human
ggacaggaccccag

SEQ ID NO: 3449216 - RNA, 17 nt, Human
ggacaggaccccagcuc

SEQ ID NO: 3449217 - RNA, 20 nt, Human
ggacaggaccccagcucugc

SEQ ID NO: 3449218 - RNA, 21 nt, Human
ggacaggaccccagcucugcg

SEQ ID NO: 3449219 - RNA, 20 nt, Human
ggacaggauguguuugcuuu

SEQ ID NO: 3449220 - RNA, 13 nt, Human
ggacaggcucugc

SEQ ID NO: 3449221 - RNA, 15 nt, Human
ggacagggcuggccc

SEQ ID NO: 3449222 - RNA, 16 nt, Human
ggacagggcuggccca

SEQ ID NO: 3449223 - RNA, 23 nt, Human
ggacagggcuggcccagcccugc

SEQ ID NO: 3449224 - RNA, 20 nt, Human
ggacagguccucaguguccu

SEQ ID NO: 3449225 - RNA, 15 nt, Human
ggacaggucugggag

SEQ ID NO: 3449226 - RNA, 15 nt, Human
ggacagucagcucuu

SEQ ID NO: 3449227 - RNA, 14 nt, Human
ggacagugcugcag

SEQ ID NO: 3449228 - RNA, 14 nt, Human
ggacagugcuucag

SEQ ID NO: 3449229 - RNA, 19 nt, Human
ggacagugcuucagccuga

SEQ ID NO: 3449230 - RNA, 21 nt, Human
ggacagugcuucagccugagg

SEQ ID NO: 3449231 - RNA, 22 nt, Human
ggacagugcuucagccugaggc

SEQ ID NO: 3449232 - RNA, 22 nt, Human
ggacaguggagugcaaaaggcu

SEQ ID NO: 3449233 - RNA, 14 nt, Human
ggacaguggcagga

SEQ ID NO: 3449234 - RNA, 18 nt, Human
ggacaguucacacccugc

SEQ ID NO: 3449235 - RNA, 19 nt, Human
ggacaguucacacccugca

SEQ ID NO: 3449236 - RNA, 20 nt, Human
ggacaguucacacccugcaa

SEQ ID NO: 3449237 - RNA, 23 nt, Human
ggacaguuuaccaguugccuuuu

SEQ ID NO: 3449238 - RNA, 12 nt, Human
ggacaucagcaa

SEQ ID NO: 3449239 - RNA, 14 nt, Human
ggacaucagcuggu

SEQ ID NO: 3449240 - RNA, 20 nt, Human
ggacauccccccgccaaaag

SEQ ID NO: 3449241 - RNA, 16 nt, Human
ggacauccuccuccca

SEQ ID NO: 3449242 - RNA, 21 nt, Human
ggacauccugucaucugagaa

SEQ ID NO: 3449243 - RNA, 21 nt, Human
ggacaugcgguagccagcaca

SEQ ID NO: 3449244 - RNA, 13 nt, Human
ggacauggacaag

SEQ ID NO: 3449245 - RNA, 14 nt, Human
ggacauggacaagg

SEQ ID NO: 3449246 - RNA, 21 nt, Human
ggacauggcuucugaaccugu

SEQ ID NO: 3449247 - RNA, 20 nt, Human
ggacaugggucgcccaugag

SEQ ID NO: 3449248 - RNA, 20 nt, Human
ggacauugcggacagccacg

SEQ ID NO: 3449249 - RNA, 14 nt, Human
ggacauuucucuaa

SEQ ID NO: 3449250 - RNA, 16 nt, Human
ggacauuugcucaugg

SEQ ID NO: 3449251 - RNA, 20 nt, Human
ggacauuugcucauggaauu

SEQ ID NO: 3449252 - RNA, 15 nt, Human
ggacauuuuaugucu

SEQ ID NO: 3449253 - RNA, 20 nt, Human
ggaggccagcacggugguga

SEQ ID NO: 3449254 - RNA, 16 nt, Human
ggaggccagccaguga

SEQ ID NO: 3449255 - RNA, 17 nt, Human
ggaggccaucuggagag

SEQ ID NO: 3449256 - RNA, 14 nt, Human
ggaggcccaaccuc

SEQ ID NO: 3449257 - RNA, 22 nt, Human
ggaggcccagcgcggacauccc

SEQ ID NO: 3449258 - RNA, 13 nt, Human
ggaggcccaguuc

SEQ ID NO: 3449259 - RNA, 15 nt, Human
ggaggccccuggagc

SEQ ID NO: 3449260 - RNA, 18 nt, Human
ggaggccccuggagccag

SEQ ID NO: 3449261 - RNA, 18 nt, Human
ggaggccccuggcccagc

SEQ ID NO: 3449262 - RNA, 19 nt, Human
ggaggccccuggcccagcg

SEQ ID NO: 3449263 - RNA, 17 nt, Human
ggaggcccgcagagcgc

SEQ ID NO: 3449264 - RNA, 15 nt, Human
ggaggccucaggugc

SEQ ID NO: 3449265 - RNA, 19 nt, Human
ggaggccucaggugcuguc

SEQ ID NO: 3449266 - RNA, 14 nt, Human
ggaggccugggggc

SEQ ID NO: 3449267 - RNA, 18 nt, Human
ggaggccuuccagcugcu

SEQ ID NO: 3449268 - RNA, 19 nt, Human
ggaggccuuccagcugcug

SEQ ID NO: 3449269 - RNA, 20 nt, Human
ggaggccuuccagcugcugu

SEQ ID NO: 3449270 - RNA, 23 nt, Human
ggaggccuuucccuaagccagcu

SEQ ID NO: 3449271 - RNA, 19 nt, Human
ggaggcggacguuccagcc

SEQ ID NO: 3449272 - RNA, 20 nt, Human
ggaggcggagaguacaguga

SEQ ID NO: 3449273 - RNA, 20 nt, Human
ggaggcggauguugaaguga

SEQ ID NO: 3449274 - RNA, 16 nt, Human
ggaggcggugggccug

SEQ ID NO: 3449275 - RNA, 22 nt, Human
ggaggcuaugcucaggggcccu

SEQ ID NO: 3449276 - RNA, 16 nt, Human
ggaggcuauguggagu

SEQ ID NO: 3449277 - RNA, 21 nt, Human
ggaggcucacccccuucucca

SEQ ID NO: 3449278 - RNA, 15 nt, Human
ggaggcucagguccc

SEQ ID NO: 3449279 - RNA, 15 nt, Human
ggaggcuccagaggg

SEQ ID NO: 3449280 - RNA, 18 nt, Human
ggaggcuccagagggcac

SEQ ID NO: 3449281 - RNA, 15 nt, Human
ggaggcucuggagcc

SEQ ID NO: 3449282 - RNA, 17 nt, Human
ggaggcucuggagccca

SEQ ID NO: 3449283 - RNA, 20 nt, Human
ggaggcucuggagcccacug

SEQ ID NO: 3449284 - RNA, 17 nt, Human
ggaggcugaggcaggag

SEQ ID NO: 3449285 - RNA, 13 nt, Human
ggaggcugaggcg

SEQ ID NO: 3449286 - RNA, 19 nt, Human
ggaggcugaggugggcaga

SEQ ID NO: 3449287 - RNA, 10 nt, Human
ggaggcugcc

SEQ ID NO: 3449288 - RNA, 22 nt, Human
ggaggcugcccccggcccccug

SEQ ID NO: 3449289 - RNA, 15 nt, Human
ggaggcugccuccca

SEQ ID NO: 3449290 - RNA, 12 nt, Human
ggaggcugcucg

SEQ ID NO: 3449291 - RNA, 23 nt, Human
ggaggcugcucggggugcacagg

SEQ ID NO: 3449292 - RNA, 20 nt, Human
ggaggcuggaggaagggggg

SEQ ID NO: 3449293 - RNA, 15 nt, Human
ggaggcuggcugggg

SEQ ID NO: 3449294 - RNA, 13 nt, Human
ggaggcugguccu

SEQ ID NO: 3449295 - RNA, 17 nt, Human
ggaggcuugucagagcu

SEQ ID NO: 3449296 - RNA, 16 nt, Human
ggagggaagcucuugg

SEQ ID NO: 3449297 - RNA, 15 nt, Human
ggagggaagggagcc

SEQ ID NO: 3449298 - RNA, 18 nt, Human
ggagggaagggagccaag

SEQ ID NO: 3449299 - RNA, 23 nt, Human
ggagggaagggagccaagggaug

SEQ ID NO: 3449300 - RNA, 19 nt, Human
ggagggacaaaggagccug

SEQ ID NO: 3449301 - RNA, 20 nt, Human
ggagggacaaaggagccugu

SEQ ID NO: 3449302 - RNA, 22 nt, Human
ggagggacaaguggacucaggg

SEQ ID NO: 3449303 - RNA, 15 nt, Human
ggagggaggcucagg

SEQ ID NO: 3449304 - RNA, 16 nt, Human
ggagggagggcuccag

SEQ ID NO: 3449305 - RNA, 21 nt, Human
ggagggaugcugccugaguca

SEQ ID NO: 3449306 - RNA, 12 nt, Human
ggagggauuugg

SEQ ID NO: 3449307 - RNA, 21 nt, Human
ggagggcaagggccaugcuga

SEQ ID NO: 3449308 - RNA, 19 nt, Human
ggagggcagagcuggugcg

SEQ ID NO: 3449309 - RNA, 16 nt, Human
ggagggcagcagaagg

SEQ ID NO: 3449310 - RNA, 13 nt, Human
ggagggcagcagg

SEQ ID NO: 3449311 - RNA, 15 nt, Human
ggagggcagcagggc

SEQ ID NO: 3449312 - RNA, 17 nt, Human
ggagggcagcagggcua

SEQ ID NO: 3449313 - RNA, 13 nt, Human
ggagggcaggcau

SEQ ID NO: 3449314 - RNA, 14 nt, Human
ggagggcaggcauc

SEQ ID NO: 3449315 - RNA, 20 nt, Human
ggagggccguaccccacccu

SEQ ID NO: 3449316 - RNA, 17 nt, Human
ggagggcgugacucacc

SEQ ID NO: 3449317 - RNA, 15 nt, Human
ggagggcgugggagc

SEQ ID NO: 3449318 - RNA, 22 nt, Human
ggagggcguucuuaggcugcug

SEQ ID NO: 3449319 - RNA, 20 nt, Human
ggagggcuagaaccuagaag

SEQ ID NO: 3449320 - RNA, 21 nt, Human
ggagggcuagaaccuggaagg

SEQ ID NO: 3449321 - RNA, 20 nt, Human
ggagggcuagaaucuggaga

SEQ ID NO: 3449322 - RNA, 13 nt, Human
ggagggcucugag

SEQ ID NO: 3449323 - RNA, 18 nt, Human
ggagggcucugaggcgcc

SEQ ID NO: 3449324 - RNA, 20 nt, Human
ggagggcuggaaucuggaga

SEQ ID NO: 3449325 - RNA, 13 nt, Human
ggaggggaagcug

SEQ ID NO: 3449326 - RNA, 20 nt, Human
ggaggggacuauuuaugaag

SEQ ID NO: 3449327 - RNA, 14 nt, Human
ggaggggagcucug

SEQ ID NO: 3449328 - RNA, 14 nt, Human
ggaggggaggguaa

SEQ ID NO: 3449329 - RNA, 13 nt, Human
ggaggggccuagg

SEQ ID NO: 3449330 - RNA, 15 nt, Human
ggaggggccuaggcc

SEQ ID NO: 3449331 - RNA, 18 nt, Human
ggaggggccuggcagccg

SEQ ID NO: 3449332 - RNA, 22 nt, Human
ggaggggcgcccaccuccccac

SEQ ID NO: 3449333 - RNA, 20 nt, Human
ggaggggcgcuggcccagcc

SEQ ID NO: 3449334 - RNA, 17 nt, Human
ggaggggcggcaggagg

SEQ ID NO: 3449335 - RNA, 14 nt, Human
ggagggggagaggg

SEQ ID NO: 3449336 - RNA, 13 nt, Human
ggaggggggaggu

SEQ ID NO: 3449337 - RNA, 16 nt, Human
ggaggggggagguggg

SEQ ID NO: 3449338 - RNA, 16 nt, Human
ggaggggguuacaaac

SEQ ID NO: 3449339 - RNA, 23 nt, Human
ggagggguaacuugcaccucuga

SEQ ID NO: 3449340 - RNA, 14 nt, Human
ggagggguugccac

SEQ ID NO: 3449341 - RNA, 13 nt, Human
ggaggguaaauaa

SEQ ID NO: 3449342 - RNA, 15 nt, Human
ggagggucaggaagg

SEQ ID NO: 3449343 - RNA, 20 nt, Human
ggagggucccaagcugggcc

SEQ ID NO: 3449344 - RNA, 19 nt, Human
ggagggugacgggggugaa

SEQ ID NO: 3449345 - RNA, 15 nt, Human
ggaggguggcaggug

SEQ ID NO: 3449346 - RNA, 22 nt, Human
ggagggugggggccaccugccu

SEQ ID NO: 3449347 - RNA, 20 nt, Human
ggaggguuggccugaguuag

SEQ ID NO: 3449348 - RNA, 22 nt, Human
ggagguaaggaauaccuguccc

SEQ ID NO: 3449349 - RNA, 20 nt, Human
ggagguagagguugugguga

SEQ ID NO: 3449350 - RNA, 19 nt, Human
ggaggucacauucaggaag

SEQ ID NO: 3449351 - RNA, 16 nt, Human
ggaggucaggcccugg

SEQ ID NO: 3449352 - RNA, 22 nt, Human
ggaggucgaccccaaagccccu

SEQ ID NO: 3449353 - RNA, 18 nt, Human
ggaggucgaggcaggagg

SEQ ID NO: 3449354 - RNA, 17 nt, Human
ggaggucguguauuugg

SEQ ID NO: 3449355 - RNA, 23 nt, Human
ggaggugaacaagcaaacccaga

SEQ ID NO: 3449356 - RNA, 17 nt, Human
ggaggugauuccaguga

SEQ ID NO: 3449357 - RNA, 14 nt, Human
ggagguggcauccc

SEQ ID NO: 3449358 - RNA, 18 nt, Human
ggagguggcuauggccac

SEQ ID NO: 3449359 - RNA, 15 nt, Human
ggaggugggccgugg

SEQ ID NO: 3449360 - RNA, 14 nt, Human
ggaggugucaggcu

SEQ ID NO: 3449361 - RNA, 18 nt, Human
ggaggugucucaggcugc

SEQ ID NO: 3449362 - RNA, 23 nt, Human
ggagguucuaaggccuaggauuc

SEQ ID NO: 3449363 - RNA, 14 nt, Human
ggagguugaagcca

SEQ ID NO: 3449364 - RNA, 15 nt, Human
ggccgggagccugau

SEQ ID NO: 3449365 - RNA, 14 nt, Human
ggccgggcacagcu

SEQ ID NO: 3449366 - RNA, 12 nt, Human
ggccgggcagag

SEQ ID NO: 3449367 - RNA, 20 nt, Human
ggccggggaacuggccaagc

SEQ ID NO: 3449368 - RNA, 17 nt, Human
ggccggucugcaaguca

SEQ ID NO: 3449369 - RNA, 23 nt, Human
ggccggucugcaagucagaggau

SEQ ID NO: 3449370 - RNA, 17 nt, Human
ggccguaccccacccuc

SEQ ID NO: 3449371 - RNA, 18 nt, Human
ggccguaucuccggcucc

SEQ ID NO: 3449372 - RNA, 15 nt, Human
ggccguccucccggg

SEQ ID NO: 3449373 - RNA, 18 nt, Human
ggccguccucccgggccc

SEQ ID NO: 3449374 - RNA, 20 nt, Human
ggccgucuucacucgccccc

SEQ ID NO: 3449375 - RNA, 13 nt, Human
ggccgugcccagg

SEQ ID NO: 3449376 - RNA, 16 nt, Human
ggccguggcugcccac

SEQ ID NO: 3449377 - RNA, 15 nt, Human
ggccguggcugcugu

SEQ ID NO: 3449378 - RNA, 18 nt, Human
ggccuaaaacuggccuga

SEQ ID NO: 3449379 - RNA, 20 nt, Human
ggccuaaaacuggccugacu

SEQ ID NO: 3449380 - RNA, 16 nt, Human
ggccuaaccugccgag

SEQ ID NO: 3449381 - RNA, 18 nt, Human
ggccuaagaggcugcccu

SEQ ID NO: 3449382 - RNA, 20 nt, Human
ggccuaagaggcugcccucc

SEQ ID NO: 3449383 - RNA, 17 nt, Human
ggccuacaugcuuugug

SEQ ID NO: 3449384 - RNA, 23 nt, Human
ggccuaccccgcagacaccuugg

SEQ ID NO: 3449385 - RNA, 15 nt, Human
ggccuacuccugucu

SEQ ID NO: 3449386 - RNA, 17 nt, Human
ggccuagcccacccugc

SEQ ID NO: 3449387 - RNA, 18 nt, Human
ggccuagcccacccugcu

SEQ ID NO: 3449388 - RNA, 19 nt, Human
ggccuagcugcuacaaaga

SEQ ID NO: 3449389 - RNA, 21 nt, Human
ggccuagcugcuacaaagaag

SEQ ID NO: 3449390 - RNA, 19 nt, Human
ggccuaggaggguccucug

SEQ ID NO: 3449391 - RNA, 15 nt, Human
ggccuaggauucuaa

SEQ ID NO: 3449392 - RNA, 13 nt, Human
ggccuaggcugca

SEQ ID NO: 3449393 - RNA, 15 nt, Human
ggccuagucagccac

SEQ ID NO: 3449394 - RNA, 13 nt, Human
ggccuaucuccua

SEQ ID NO: 3449395 - RNA, 18 nt, Human
ggccuaucuccuagggcu

SEQ ID NO: 3449396 - RNA, 19 nt, Human
ggccuauggagagcccugg

SEQ ID NO: 3449397 - RNA, 19 nt, Human
ggccuauuauauuaaaaua

SEQ ID NO: 3449398 - RNA, 15 nt, Human
ggccuggcuggcuga

SEQ ID NO: 3449399 - RNA, 15 nt, Human
ggccuggcuucuccu

SEQ ID NO: 3449400 - RNA, 17 nt, Human
ggccugggacuuccaug

SEQ ID NO: 3449401 - RNA, 13 nt, Human
ggccugggcagga

SEQ ID NO: 3449402 - RNA, 18 nt, Human
ggccugggcaguggaugg

SEQ ID NO: 3449403 - RNA, 15 nt, Human
ggccugggccgcugc

SEQ ID NO: 3449404 - RNA, 21 nt, Human
ggccugggccguaucuccggc

SEQ ID NO: 3449405 - RNA, 13 nt, Human
ggccugggcuagg

SEQ ID NO: 3449406 - RNA, 16 nt, Human
ggccugggcuccugga

SEQ ID NO: 3449407 - RNA, 14 nt, Human
ggccuggggccuga

SEQ ID NO: 3449408 - RNA, 17 nt, Human
ggccuggggccugagag

SEQ ID NO: 3449409 - RNA, 18 nt, Human
ggccuggggccugagaga

SEQ ID NO: 3449410 - RNA, 18 nt, Human
ggccuggggcuccuuucu

SEQ ID NO: 3449411 - RNA, 23 nt, Human
ggccuggggcuccuuucuccagc

SEQ ID NO: 3449412 - RNA, 20 nt, Human
ggccugggggcugggcagag

SEQ ID NO: 3449413 - RNA, 23 nt, Human
ggccugggggcugggcagaggaa

SEQ ID NO: 3449414 - RNA, 18 nt, Human
ggccugggguaccaagag

SEQ ID NO: 3449415 - RNA, 23 nt, Human
ggccuggguggaucggccuccuc

SEQ ID NO: 3449416 - RNA, 11 nt, Human
ggccugguccc

SEQ ID NO: 3449417 - RNA, 14 nt, Human
ggccuggucccugu

SEQ ID NO: 3449418 - RNA, 19 nt, Human
ggccuggucucacccugga

SEQ ID NO: 3449419 - RNA, 23 nt, Human
ggccuggucucacccuggaggca

SEQ ID NO: 3449420 - RNA, 21 nt, Human
ggccugguuaaauaaggcagg

SEQ ID NO: 3449421 - RNA, 17 nt, Human
ggccugguugaagaaga

SEQ ID NO: 3449422 - RNA, 18 nt, Human
ggccuguacagucugucu

SEQ ID NO: 3449423 - RNA, 15 nt, Human
ggccuguacugccug

SEQ ID NO: 3449424 - RNA, 18 nt, Human
ggccuguccaacacaucu

SEQ ID NO: 3449425 - RNA, 17 nt, Human
ggccugucccuggccau

SEQ ID NO: 3449426 - RNA, 23 nt, Human
ggccugucucauccccagggguc

SEQ ID NO: 3449427 - RNA, 14 nt, Human
ggccugucugugac

SEQ ID NO: 3449428 - RNA, 20 nt, Human
ggccuguggccuguguccca

SEQ ID NO: 3449429 - RNA, 20 nt, Human
ggccuguguagcugugaccu

SEQ ID NO: 3449430 - RNA, 21 nt, Human
ggccuguguagcugugaccug

SEQ ID NO: 3449431 - RNA, 21 nt, Human
ggccuguguucuuccuggccg

SEQ ID NO: 3449432 - RNA, 15 nt, Human
ggccuguugcccuuu

SEQ ID NO: 3449433 - RNA, 24 nt, Human
ggccuguugcuauagagccuaccu

SEQ ID NO: 3449434 - RNA, 17 nt, Human
ggccuuaauuuccuuuu

SEQ ID NO: 3449435 - RNA, 18 nt, Human
ggccuuacaccucguuag

SEQ ID NO: 3449436 - RNA, 15 nt, Human
ggccuuaccccugcc

SEQ ID NO: 3449437 - RNA, 21 nt, Human
ggccuuagugggccagggcug

SEQ ID NO: 3449438 - RNA, 17 nt, Human
ggccuuauugcauccca

SEQ ID NO: 3449439 - RNA, 14 nt, Human
ggccuucauaaugg

SEQ ID NO: 3449440 - RNA, 15 nt, Human
ggccuuccagcugcu

SEQ ID NO: 3449441 - RNA, 16 nt, Human
ggccuuccagcugcug

SEQ ID NO: 3449442 - RNA, 14 nt, Human
ggccuuccccagca

SEQ ID NO: 3449443 - RNA, 17 nt, Human
ggccuuccccagccucu

SEQ ID NO: 3449444 - RNA, 14 nt, Human
ggccuuccccuggc

SEQ ID NO: 3449445 - RNA, 20 nt, Human
ggccuuccccuggcacuggc

SEQ ID NO: 3449446 - RNA, 13 nt, Human
ggccuucggccuc

SEQ ID NO: 3449447 - RNA, 18 nt, Human
ggccuucggccuccaucc

SEQ ID NO: 3449448 - RNA, 23 nt, Human
ggccuucggccuccauccugagg

SEQ ID NO: 3449449 - RNA, 15 nt, Human
ggccuucucugaagg

SEQ ID NO: 3449450 - RNA, 14 nt, Human
ggccuugcccagag

SEQ ID NO: 3449451 - RNA, 15 nt, Human
ggccuugcccagaga

SEQ ID NO: 3449452 - RNA, 12 nt, Human
ggccuuggaaau

SEQ ID NO: 3449453 - RNA, 14 nt, Human
ggccuuggccugga

SEQ ID NO: 3449454 - RNA, 15 nt, Human
ggccuuggccuggag

SEQ ID NO: 3449455 - RNA, 17 nt, Human
ggccuuggccuggagca

SEQ ID NO: 3449456 - RNA, 20 nt, Human
ggccuuggcuuuucuagccu

SEQ ID NO: 3449457 - RNA, 19 nt, Human
ggccuuguccucagccagu

SEQ ID NO: 3449458 - RNA, 16 nt, Human
ggccuuguucugucac

SEQ ID NO: 3449459 - RNA, 14 nt, Human
ggccuuuaaaauuu

SEQ ID NO: 3449460 - RNA, 12 nt, Human
ggccuuuccucu

SEQ ID NO: 3449461 - RNA, 14 nt, Human
ggccuuuccucucu

SEQ ID NO: 3449462 - RNA, 23 nt, Human
ggccuuugcuuaugaauauuuau

SEQ ID NO: 3449463 - RNA, 17 nt, Human
ggccuuuuaacauuuug

SEQ ID NO: 3449464 - RNA, 17 nt, Human
ggccuuuucuggcaccg

SEQ ID NO: 3449465 - RNA, 21 nt, Human
ggcgaccaccgccccuggccg

SEQ ID NO: 3449466 - RNA, 11 nt, Human
ggcgaccuccu

SEQ ID NO: 3449467 - RNA, 16 nt, Human
ggcgagagaggagcca

SEQ ID NO: 3449468 - RNA, 14 nt, Human
ggcgagaggagggg

SEQ ID NO: 3449469 - RNA, 15 nt, Human
ggcgagaggaggggc

SEQ ID NO: 3449470 - RNA, 13 nt, Human
ggcgaggcagagg

SEQ ID NO: 3449471 - RNA, 16 nt, Human
ggcgagucacugccuc

SEQ ID NO: 3449472 - RNA, 23 nt, Human
ggcgagugaaugccagugugcug

SEQ ID NO: 3449473 - RNA, 16 nt, Human
ggcgagugccaggacu

SEQ ID NO: 3449474 - RNA, 20 nt, Human
ggcgaucacaacgugcauug

SEQ ID NO: 3449475 - RNA, 17 nt, Human
ggcgauccaccugucuc

SEQ ID NO: 3449476 - RNA, 21 nt, Human
ggcgaucgcggcggagcuggc

SEQ ID NO: 3449477 - RNA, 16 nt, Human
ggcgcacccuccccuc

SEQ ID NO: 3449478 - RNA, 24 nt, Human
ggcgcagcauauucaggaagcuca

SEQ ID NO: 3449479 - RNA, 16 nt, Human
ggcgcagugccucugg

SEQ ID NO: 3449480 - RNA, 14 nt, Human
ggcgcccaccuccc

SEQ ID NO: 3449481 - RNA, 15 nt, Human
ggcgcccaccucccc

SEQ ID NO: 3449482 - RNA, 24 nt, Human
ggcgcccaccuccccacgcccucc

SEQ ID NO: 3449483 - RNA, 23 nt, Human
ggcgccccaacccguggaggcug

SEQ ID NO: 3449484 - RNA, 22 nt, Human
ggcgccccugccaccucccuga

SEQ ID NO: 3449485 - RNA, 13 nt, Human
ggcgcccucuguc

SEQ ID NO: 3449486 - RNA, 14 nt, Human
ggcgcccucugucc

SEQ ID NO: 3449487 - RNA, 22 nt, Human
ggcgccgcaaaccacacuggac

SEQ ID NO: 3449488 - RNA, 19 nt, Human
ggcgccggcgggcgggccg

SEQ ID NO: 3449489 - RNA, 20 nt, Human
ggcgccgucuccaggggcug

SEQ ID NO: 3449490 - RNA, 21 nt, Human
ggcgccgugcugggcagcccg

SEQ ID NO: 3449491 - RNA, 23 nt, Human
ggcgccucaacucugcugagggu

SEQ ID NO: 3449492 - RNA, 11 nt, Human
ggcgccuggag

SEQ ID NO: 3449493 - RNA, 12 nt, Human
ggcgccuggccu

SEQ ID NO: 3449494 - RNA, 16 nt, Human
ggcgccuggccuccag

SEQ ID NO: 3449495 - RNA, 20 nt, Human
ggcgccuguagucccagcca

SEQ ID NO: 3449496 - RNA, 16 nt, Human
ggcgccugugguucug

SEQ ID NO: 3449497 - RNA, 15 nt, Human
ggcgcggagugaacc

SEQ ID NO: 3449498 - RNA, 16 nt, Human
ggcgcggccagccccg

SEQ ID NO: 3449499 - RNA, 15 nt, Human
ggcgcgguggcucac

SEQ ID NO: 3449500 - RNA, 18 nt, Human
ggcgcgugaggcccgugg

SEQ ID NO: 3449501 - RNA, 22 nt, Human
ggcgcuagcacagcucccuucu

SEQ ID NO: 3449502 - RNA, 21 nt, Human
ggcgcugcccaccugccggcc

SEQ ID NO: 3449503 - RNA, 11 nt, Human
ggcgcugcccc

SEQ ID NO: 3449504 - RNA, 23 nt, Human
ggcgcugccccaucuccccucag

SEQ ID NO: 3449505 - RNA, 19 nt, Human
ggcgcugccccuggcagcc

SEQ ID NO: 3449506 - RNA, 21 nt, Human
ggcgcugccccuggcagcccc

SEQ ID NO: 3449507 - RNA, 20 nt, Human
ggcgcuggguauuggaaaug

SEQ ID NO: 3449508 - RNA, 18 nt, Human
ggcggcccaagcccgacu

SEQ ID NO: 3449509 - RNA, 18 nt, Human
ggcggccccaacucgggc

SEQ ID NO: 3449510 - RNA, 17 nt, Human
ggcggccccucccgccc

SEQ ID NO: 3449511 - RNA, 21 nt, Human
ggcggcuacucagcagcccuc

SEQ ID NO: 3449512 - RNA, 14 nt, Human
ggcggcugagagcc

SEQ ID NO: 3449513 - RNA, 23 nt, Human
ggcggcugagagccccagcugac

SEQ ID NO: 3449514 - RNA, 24 nt, Human
ggcggcuggggucccagcagcugc

SEQ ID NO: 3449515 - RNA, 16 nt, Human
ggcgggacccaggcac

SEQ ID NO: 3449516 - RNA, 13 nt, Human
ggcgggccagcca

SEQ ID NO: 3449517 - RNA, 23 nt, Human
ggcggugcccacaccggggacag

SEQ ID NO: 3449518 - RNA, 15 nt, Human
ggcguaaguacagag

SEQ ID NO: 3449519 - RNA, 18 nt, Human
ggcguaaguacagagaag

SEQ ID NO: 3449520 - RNA, 19 nt, Human
ggcguaaguacagagaagc

SEQ ID NO: 3449521 - RNA, 19 nt, Human
ggcguagagggugcugccc

SEQ ID NO: 3449522 - RNA, 13 nt, Human
ggcgucagccucc

SEQ ID NO: 3449523 - RNA, 14 nt, Human
ggcgucagccucca

SEQ ID NO: 3449524 - RNA, 20 nt, Human
ggcgucagccuccagccucu

SEQ ID NO: 3449525 - RNA, 17 nt, Human
ggcguccaggccgcgcc

SEQ ID NO: 3449526 - RNA, 21 nt, Human
ggcguccgcgcgccagcacag

SEQ ID NO: 3449527 - RNA, 21 nt, Human
ggcgucuguucccccuucaca

SEQ ID NO: 3449528 - RNA, 17 nt, Human
ggcgugagaccugcccc

SEQ ID NO: 3449529 - RNA, 21 nt, Human
aacgcuuaaaggugucuuccu

SEQ ID NO: 3449530 - RNA, 21 nt, Human
aacggacgagauaaugugaac

SEQ ID NO: 3449531 - RNA, 19 nt, Human
aacggagagcgccugcccc

SEQ ID NO: 3449532 - RNA, 19 nt, Human
aacggaggccugcgacccu

SEQ ID NO: 3449533 - RNA, 22 nt, Human
aacggauuauuuuuucagaccg

SEQ ID NO: 3449534 - RNA, 15 nt, Human
aacggccccagcuuc

SEQ ID NO: 3449535 - RNA, 15 nt, Human
aacgggcugcccugc

SEQ ID NO: 3449536 - RNA, 16 nt, Human
aacggggcucuucuca

SEQ ID NO: 3449537 - RNA, 13 nt, Human
aacggugcucagg

SEQ ID NO: 3449538 - RNA, 19 nt, Human
aacguccucuuuaguuuuu

SEQ ID NO: 3449539 - RNA, 15 nt, Human
aacgucuuaaauauu

SEQ ID NO: 3449540 - RNA, 14 nt, Human
aacgugauacauuu

SEQ ID NO: 3449541 - RNA, 16 nt, Human
aacgugauacauuugg

SEQ ID NO: 3449542 - RNA, 23 nt, Human
gaaagacuauucaaacagucuca

SEQ ID NO: 3449543 - RNA, 17 nt, Human
gaaagacuguacaaagu

SEQ ID NO: 3449544 - RNA, 13 nt, Human
gaaagagaaacac

SEQ ID NO: 3449545 - RNA, 13 nt, Human
gaaagagagaaaa

SEQ ID NO: 3449546 - RNA, 14 nt, Human
gaaagagagaaaau

SEQ ID NO: 3449547 - RNA, 16 nt, Human
gaaagagagaaaauaa

SEQ ID NO: 3449548 - RNA, 20 nt, Human
gaaagagagaaaauaaaaag

SEQ ID NO: 3449549 - RNA, 23 nt, Human
gaaagagagaaaauaaaaaguua

SEQ ID NO: 3449550 - RNA, 16 nt, Human
gaaagagagcacugac

SEQ ID NO: 3449551 - RNA, 13 nt, Human
gaaagagauuuaa

SEQ ID NO: 3449552 - RNA, 16 nt, Human
gaaagagauuuaaacu

SEQ ID NO: 3449553 - RNA, 15 nt, Human
gaaagaggaaaagaa

SEQ ID NO: 3449554 - RNA, 17 nt, Human
gaaagaggagugcuugu

SEQ ID NO: 3449555 - RNA, 19 nt, Human
gaaagaggugaccccaggg

SEQ ID NO: 3449556 - RNA, 23 nt, Human
gaaagaggugaccccagggcaca

SEQ ID NO: 3449557 - RNA, 15 nt, Human
gaaagaguaaaggaa

SEQ ID NO: 3449558 - RNA, 16 nt, Human
gaaagaguaggaagac

SEQ ID NO: 3449559 - RNA, 17 nt, Human
gaaagaguuaagaaugu

SEQ ID NO: 3449560 - RNA, 18 nt, Human
gaaagaguuaagaauguc

SEQ ID NO: 3449561 - RNA, 16 nt, Human
gaaagaucaaaagguu

SEQ ID NO: 3449562 - RNA, 17 nt, Human
gaaagaugagcuuuucu

SEQ ID NO: 3449563 - RNA, 17 nt, Human
gaaagaugauuugcaau

SEQ ID NO: 3449564 - RNA, 16 nt, Human
gaaagcaaaaaugcua

SEQ ID NO: 3449565 - RNA, 18 nt, Human
gaaagcaaagcacagaga

SEQ ID NO: 3449566 - RNA, 14 nt, Human
gaaagcaaagggcu

SEQ ID NO: 3449567 - RNA, 14 nt, Human
gaaagcaauaaaug

SEQ ID NO: 3449568 - RNA, 23 nt, Human
gaaagcacaggugggcuucccag

SEQ ID NO: 3449569 - RNA, 21 nt, Human
gaaagcacugcaugaauaaaa

SEQ ID NO: 3449570 - RNA, 14 nt, Human
gaaagcagaacagu

SEQ ID NO: 3449571 - RNA, 19 nt, Human
gaaagcagaggcuggccuc

SEQ ID NO: 3449572 - RNA, 22 nt, Human
gaaagcagaguuuucauuaaau

SEQ ID NO: 3449573 - RNA, 14 nt, Human
gaaagcagcugaac

SEQ ID NO: 3449574 - RNA, 22 nt, Human
gaaagcagggacuugaacccau

SEQ ID NO: 3449575 - RNA, 12 nt, Human
gaaagcaggggc

SEQ ID NO: 3449576 - RNA, 14 nt, Human
gaaagcaggggcua

SEQ ID NO: 3449577 - RNA, 22 nt, Human
gaaagcauaaagcucaaaugaa

SEQ ID NO: 3449578 - RNA, 23 nt, Human
gaaagcauauggguuagauguug

SEQ ID NO: 3449579 - RNA, 18 nt, Human
gaaagcauuugaaugcau

SEQ ID NO: 3449580 - RNA, 13 nt, Human
gaaagccaccucu

SEQ ID NO: 3449581 - RNA, 11 nt, Human
gaaagccaggc

SEQ ID NO: 3449582 - RNA, 23 nt, Human
gaaagccaggcagguagccaggg

SEQ ID NO: 3449583 - RNA, 15 nt, Human
gaaagccagucuuaa

SEQ ID NO: 3449584 - RNA, 21 nt, Human
gaaagcccagaaaaggacaga

SEQ ID NO: 3449585 - RNA, 18 nt, Human
gaaagccccagcacuaac

SEQ ID NO: 3449586 - RNA, 14 nt, Human
gggaaugagcccag

SEQ ID NO: 3449587 - RNA, 17 nt, Human
gggaaugagcccagaga

SEQ ID NO: 3449588 - RNA, 21 nt, Human
gggaaugagcccagagaacag

SEQ ID NO: 3449589 - RNA, 22 nt, Human
gggaaugagcccagagaacagc

SEQ ID NO: 3449590 - RNA, 14 nt, Human
gggaaugaggcuug

SEQ ID NO: 3449591 - RNA, 12 nt, Human
gggaaugagggg

SEQ ID NO: 3449592 - RNA, 15 nt, Human
gggaaugauaugcau

SEQ ID NO: 3449593 - RNA, 21 nt, Human
gggaaugccugagugccuggc

SEQ ID NO: 3449594 - RNA, 11 nt, Human
gggaauguuug

SEQ ID NO: 3449595 - RNA, 22 nt, Human
gggaauguuugggcagaaggga

SEQ ID NO: 3449596 - RNA, 12 nt, Human
gggaauuuccuc

SEQ ID NO: 3449597 - RNA, 22 nt, Human
gggacaaagaggccuuuaacca

SEQ ID NO: 3449598 - RNA, 15 nt, Human
gggacaaaggagccu

SEQ ID NO: 3449599 - RNA, 19 nt, Human
gggacaaauuuaaaacaaa

SEQ ID NO: 3449600 - RNA, 20 nt, Human
gggacaaccuuggcuuggcc

SEQ ID NO: 3449601 - RNA, 19 nt, Human
gggacaacugcucccaccu

SEQ ID NO: 3449602 - RNA, 23 nt, Human
gggacaaggacuaggguccuggg

SEQ ID NO: 3449603 - RNA, 13 nt, Human
gggacaagggauu

SEQ ID NO: 3449604 - RNA, 22 nt, Human
gggacaaguggacucagggcag

SEQ ID NO: 3449605 - RNA, 13 nt, Human
gggacacacagcc

SEQ ID NO: 3449606 - RNA, 14 nt, Human
gggacaccagccag

SEQ ID NO: 3449607 - RNA, 17 nt, Human
gggacaccugcccugcc

SEQ ID NO: 3449608 - RNA, 17 nt, Human
gggacagaggccccagc

SEQ ID NO: 3449609 - RNA, 18 nt, Human
gggacagaggccccagcc

SEQ ID NO: 3449610 - RNA, 13 nt, Human
gggacagaggggg

SEQ ID NO: 3449611 - RNA, 22 nt, Human
gggacagaggggguggccuccc

SEQ ID NO: 3449612 - RNA, 19 nt, Human
gggacagcccagagccugg

SEQ ID NO: 3449613 - RNA, 12 nt, Human
gggacagcuccu

SEQ ID NO: 3449614 - RNA, 21 nt, Human
gggacaggaccccagcucugc

SEQ ID NO: 3449615 - RNA, 22 nt, Human
gggacaggaccccagcucugcg

SEQ ID NO: 3449616 - RNA, 12 nt, Human
gggacagggcug

SEQ ID NO: 3449617 - RNA, 17 nt, Human
gggacagguccucagug

SEQ ID NO: 3449618 - RNA, 22 nt, Human
gggacaguaauaagaauggaaa

SEQ ID NO: 3449619 - RNA, 20 nt, Human
gggacagucaccucauggaa

SEQ ID NO: 3449620 - RNA, 21 nt, Human
gggacagucaccucauggaau

SEQ ID NO: 3449621 - RNA, 12 nt, Human
gggacagucuca

SEQ ID NO: 3449622 - RNA, 18 nt, Human
gggacaugggucgcccau

SEQ ID NO: 3449623 - RNA, 13 nt, Human
gggacauguggaa

SEQ ID NO: 3449624 - RNA, 22 nt, Human
gggaccacagcaaggcaccugc

SEQ ID NO: 3449625 - RNA, 17 nt, Human
gggaccacccugagccg

SEQ ID NO: 3449626 - RNA, 14 nt, Human
gggaccagagcugc

SEQ ID NO: 3449627 - RNA, 20 nt, Human
gggaccagagcugccaccug

SEQ ID NO: 3449628 - RNA, 20 nt, Human
gggaccagcagccccacacc

SEQ ID NO: 3449629 - RNA, 12 nt, Human
gggacccaggcu

SEQ ID NO: 3449630 - RNA, 22 nt, Human
gggacccaggcuccgcccuuag

SEQ ID NO: 3449631 - RNA, 20 nt, Human
gggacccaguggcagggcac

SEQ ID NO: 3449632 - RNA, 21 nt, Human
gggaccccaggcccacucagg

SEQ ID NO: 3449633 - RNA, 17 nt, Human
gggacccccgcccccug

SEQ ID NO: 3449634 - RNA, 19 nt, Human
gggacccccgcccccugcc

SEQ ID NO: 3449635 - RNA, 16 nt, Human
gggaccccgagccugg

SEQ ID NO: 3449636 - RNA, 14 nt, Human
gggaccccugagcu

SEQ ID NO: 3449637 - RNA, 20 nt, Human
gggacccuaagacuccucgg

SEQ ID NO: 3449638 - RNA, 20 nt, Human
gggacccuccaaggccaggc

SEQ ID NO: 3449639 - RNA, 23 nt, Human
gggacccugugacauggugccug

SEQ ID NO: 3449640 - RNA, 20 nt, Human
gggaccggcggaccccagcc

SEQ ID NO: 3449641 - RNA, 13 nt, Human
gggaccucaggcc

SEQ ID NO: 3449642 - RNA, 22 nt, Human
gggaccuccccugaggcucagg

SEQ ID NO: 3449643 - RNA, 19 nt, Human
gggaccugccaggcagggg

SEQ ID NO: 3449644 - RNA, 19 nt, Human
gggacgaagaagagccaca

SEQ ID NO: 3449645 - RNA, 21 nt, Human
gggacgaagaagagccacagu

SEQ ID NO: 3449646 - RNA, 21 nt, Human
gggacggggggccccagucag

SEQ ID NO: 3449647 - RNA, 16 nt, Human
gggacgucccugccca

SEQ ID NO: 3449648 - RNA, 18 nt, Human
gggacguggcucagccag

SEQ ID NO: 3449649 - RNA, 19 nt, Human
gggacguggcucagccagc

SEQ ID NO: 3449650 - RNA, 20 nt, Human
gggacguggcucagccagca

SEQ ID NO: 3449651 - RNA, 22 nt, Human
gggacguggcucagccagcacu

SEQ ID NO: 3449652 - RNA, 15 nt, Human
gggacuaugaauggg

SEQ ID NO: 3449653 - RNA, 18 nt, Human
gggacuauuacauccaca

SEQ ID NO: 3449654 - RNA, 16 nt, Human
gggacucaaugcacug

SEQ ID NO: 3449655 - RNA, 20 nt, Human
gggacucaauuucuccccag

SEQ ID NO: 3449656 - RNA, 19 nt, Human
gggacucugaagccucugg

SEQ ID NO: 3449657 - RNA, 19 nt, Human
gggacugaaaaccucuccu

SEQ ID NO: 3449658 - RNA, 15 nt, Human
gggacugaccagcag

SEQ ID NO: 3449659 - RNA, 14 nt, Human
gggacugagccagu

SEQ ID NO: 3449660 - RNA, 17 nt, Human
gggacugagccaguccc

SEQ ID NO: 3449661 - RNA, 16 nt, Human
gggacugccaccuccc

SEQ ID NO: 3449662 - RNA, 14 nt, Human
gggacugccucugc

SEQ ID NO: 3449663 - RNA, 22 nt, Human
gggacugcugcugccuggccac

SEQ ID NO: 3449664 - RNA, 15 nt, Human
gggacugggagggcc

SEQ ID NO: 3449665 - RNA, 13 nt, Human
gggacuguaaguu

SEQ ID NO: 3449666 - RNA, 13 nt, Human
gggacuugaaguu

SEQ ID NO: 3449667 - RNA, 13 nt, Human
gggacuugugucu

SEQ ID NO: 3449668 - RNA, 14 nt, Human
gggagaaccucagg

SEQ ID NO: 3449669 - RNA, 15 nt, Human
gggagaaccucaggc

SEQ ID NO: 3449670 - RNA, 22 nt, Human
gggagaaugucaguauguggaa

SEQ ID NO: 3449671 - RNA, 19 nt, Human
gggagacacuggccccuca

SEQ ID NO: 3449672 - RNA, 13 nt, Human
gggagacagagca

SEQ ID NO: 3449673 - RNA, 12 nt, Human
gggagacagcau

SEQ ID NO: 3449674 - RNA, 17 nt, Human
gggagaccggccugcca

SEQ ID NO: 3449675 - RNA, 22 nt, Human
gggagaccggccugccaggagg

SEQ ID NO: 3449676 - RNA, 19 nt, Human
gggagaccucagaaguaaa

SEQ ID NO: 3449677 - RNA, 22 nt, Human
gggagacgguuuccagggaggg

SEQ ID NO: 3449678 - RNA, 14 nt, Human
gggagacuuugaug

SEQ ID NO: 3449679 - RNA, 12 nt, Human
gggagagaccuc

SEQ ID NO: 3449680 - RNA, 14 nt, Human
gggagagagagaga

SEQ ID NO: 3449681 - RNA, 22 nt, Human
gggagagagagagagagaggac

SEQ ID NO: 3449682 - RNA, 16 nt, Human
gggagagcaggcuggc

SEQ ID NO: 3449683 - RNA, 23 nt, Human
gggagagcaggcuggcagcucuc

SEQ ID NO: 3449684 - RNA, 12 nt, Human
gggagagccagc

SEQ ID NO: 3449685 - RNA, 14 nt, Human
gggagagccagcuc

SEQ ID NO: 3449686 - RNA, 13 nt, Human
gggagagcccagg

SEQ ID NO: 3449687 - RNA, 15 nt, Human
gggauucccaccaag

SEQ ID NO: 3449688 - RNA, 16 nt, Human
gggauuccugacccag

SEQ ID NO: 3449689 - RNA, 21 nt, Human
gggauucuacuuuaagcacua

SEQ ID NO: 3449690 - RNA, 17 nt, Human
gggauugaaggaugcug

SEQ ID NO: 3449691 - RNA, 17 nt, Human
gggauugcugccacuuu

SEQ ID NO: 3449692 - RNA, 13 nt, Human
gggauuggcugug

SEQ ID NO: 3449693 - RNA, 15 nt, Human
gggauugggccccug

SEQ ID NO: 3449694 - RNA, 16 nt, Human
gggauugggggcuggu

SEQ ID NO: 3449695 - RNA, 17 nt, Human
gggauuguaaaauggug

SEQ ID NO: 3449696 - RNA, 15 nt, Human
gggauuuaauuucca

SEQ ID NO: 3449697 - RNA, 17 nt, Human
gggauuucucccagcuc

SEQ ID NO: 3449698 - RNA, 16 nt, Human
gggcaaagccaggucc

SEQ ID NO: 3449699 - RNA, 14 nt, Human
gggcaaagccuagu

SEQ ID NO: 3449700 - RNA, 17 nt, Human
gggcaaaugccagggcc

SEQ ID NO: 3449701 - RNA, 21 nt, Human
gggcaacauuguucaccuuug

SEQ ID NO: 3449702 - RNA, 20 nt, Human
gggcaacccccagccugcua

SEQ ID NO: 3449703 - RNA, 20 nt, Human
gggcaagaagaucacgcucc

SEQ ID NO: 3449704 - RNA, 20 nt, Human
gggcaagcuccgcaggacuu

SEQ ID NO: 3449705 - RNA, 16 nt, Human
gggcaauauucucugu

SEQ ID NO: 3449706 - RNA, 21 nt, Human
gggcaauuaauuccuucagca

SEQ ID NO: 3449707 - RNA, 17 nt, Human
gggcaauuggaacaaag

SEQ ID NO: 3449708 - RNA, 14 nt, Human
gggcaauugucuga

SEQ ID NO: 3449709 - RNA, 14 nt, Human
gggcaauuuagaaa

SEQ ID NO: 3449710 - RNA, 15 nt, Human
gggcacaaagggccc

SEQ ID NO: 3449711 - RNA, 21 nt, Human
gggcacaacugcaauaacuuc

SEQ ID NO: 3449712 - RNA, 13 nt, Human
gggcacacacugu

SEQ ID NO: 3449713 - RNA, 15 nt, Human
gggcacacgccuccc

SEQ ID NO: 3449714 - RNA, 18 nt, Human
gggcacagaaaauggaag

SEQ ID NO: 3449715 - RNA, 12 nt, Human
gggcacaggagc

SEQ ID NO: 3449716 - RNA, 18 nt, Human
gggcacaggagcuaccug

SEQ ID NO: 3449717 - RNA, 13 nt, Human
gggcacaggaggc

SEQ ID NO: 3449718 - RNA, 13 nt, Human
gggcacagggccu

SEQ ID NO: 3449719 - RNA, 20 nt, Human
gggcacagggccuggcccau

SEQ ID NO: 3449720 - RNA, 13 nt, Human
gggcacagggucu

SEQ ID NO: 3449721 - RNA, 16 nt, Human
gggcacagggucucua

SEQ ID NO: 3449722 - RNA, 15 nt, Human
gggcacaggucaggc

SEQ ID NO: 3449723 - RNA, 20 nt, Human
gggcacaugcugagucuccc

SEQ ID NO: 3449724 - RNA, 22 nt, Human
gggcacaugcugagucucccaa

SEQ ID NO: 3449725 - RNA, 17 nt, Human
gggcaccacaaaauaua

SEQ ID NO: 3449726 - RNA, 12 nt, Human
gggcacccaccc

SEQ ID NO: 3449727 - RNA, 21 nt, Human
gggcacccccagccugggccu

SEQ ID NO: 3449728 - RNA, 20 nt, Human
gggcacccuguggcccuggc

SEQ ID NO: 3449729 - RNA, 19 nt, Human
gggcaccuauagucccagc

SEQ ID NO: 3449730 - RNA, 12 nt, Human
gggcaccugcca

SEQ ID NO: 3449731 - RNA, 16 nt, Human
gggcacugcucucacc

SEQ ID NO: 3449732 - RNA, 14 nt, Human
gggcacugcugggu

SEQ ID NO: 3449733 - RNA, 20 nt, Human
gggcacugcuggguggccca

SEQ ID NO: 3449734 - RNA, 14 nt, Human
gggcacuggagcug

SEQ ID NO: 3449735 - RNA, 13 nt, Human
gggcacuggccca

SEQ ID NO: 3449736 - RNA, 20 nt, Human
gggcacuuuaaaugaagcua

SEQ ID NO: 3449737 - RNA, 15 nt, Human
gggcagaaaguggcc

SEQ ID NO: 3449738 - RNA, 18 nt, Human
gggcagaagggagaagga

SEQ ID NO: 3449739 - RNA, 19 nt, Human
gggcagaagggagaaggau

SEQ ID NO: 3449740 - RNA, 14 nt, Human
gggcagagcacagc

SEQ ID NO: 3449741 - RNA, 12 nt, Human
gggcagagcaga

SEQ ID NO: 3449742 - RNA, 16 nt, Human
gggcagagcagagacc

SEQ ID NO: 3449743 - RNA, 17 nt, Human
gggcagagcagagacca

SEQ ID NO: 3449744 - RNA, 13 nt, Human
gggcagagccggg

SEQ ID NO: 3449745 - RNA, 11 nt, Human
gggcagagcug

SEQ ID NO: 3449746 - RNA, 16 nt, Human
gggcagagcuggcucu

SEQ ID NO: 3449747 - RNA, 19 nt, Human
gggcagagcuggcucugag

SEQ ID NO: 3449748 - RNA, 14 nt, Human
gggcagaggcugga

SEQ ID NO: 3449749 - RNA, 15 nt, Human
gggcagaggcuggag

SEQ ID NO: 3449750 - RNA, 16 nt, Human
gggcagaggcuggagg

SEQ ID NO: 3449751 - RNA, 21 nt, Human
gggcagaggcuggaggcaggg

SEQ ID NO: 3449752 - RNA, 23 nt, Human
gaaagccccugccccuccucucc

SEQ ID NO: 3449753 - RNA, 17 nt, Human
gaaagcccugagcuuuc

SEQ ID NO: 3449754 - RNA, 15 nt, Human
gaaagccucugcugc

SEQ ID NO: 3449755 - RNA, 12 nt, Human
gaaagccugagu

SEQ ID NO: 3449756 - RNA, 24 nt, Human
gaaagccuguuccccucacuggau

SEQ ID NO: 3449757 - RNA, 19 nt, Human
gaaagccuuaagcugcagg

SEQ ID NO: 3449758 - RNA, 16 nt, Human
gaaagccuuagggaag

SEQ ID NO: 3449759 - RNA, 14 nt, Human
gaaagccuuucauu

SEQ ID NO: 3449760 - RNA, 17 nt, Human
gaaagccuuucauuuug

SEQ ID NO: 3449761 - RNA, 21 nt, Human
gaaagccuuucauuuugcuuu

SEQ ID NO: 3449762 - RNA, 22 nt, Human
gaaagccuuucauuuugcuuua

SEQ ID NO: 3449763 - RNA, 19 nt, Human
gaaagcuauauaagacaag

SEQ ID NO: 3449764 - RNA, 12 nt, Human
gaaagcucuaga

SEQ ID NO: 3449765 - RNA, 18 nt, Human
gaaagcucuguugcaauu

SEQ ID NO: 3449766 - RNA, 15 nt, Human
gaaagcugacuuggc

SEQ ID NO: 3449767 - RNA, 18 nt, Human
gaaagcugacuuggcugg

SEQ ID NO: 3449768 - RNA, 19 nt, Human
gaaagcugacuuggcuggu

SEQ ID NO: 3449769 - RNA, 17 nt, Human
gaaagcugagaacuccu

SEQ ID NO: 3449770 - RNA, 19 nt, Human
gaaagcugagaacuccuga

SEQ ID NO: 3449771 - RNA, 24 nt, Human
gaaagcugugaacaggcugggcug

SEQ ID NO: 3449772 - RNA, 15 nt, Human
gaaagcuguguuuau

SEQ ID NO: 3449773 - RNA, 17 nt, Human
gaaagcuucaaacugca

SEQ ID NO: 3449774 - RNA, 16 nt, Human
gaaagcuucagugcug

SEQ ID NO: 3449775 - RNA, 22 nt, Human
gaaagcuuuauuuugagaugua

SEQ ID NO: 3449776 - RNA, 20 nt, Human
gaaagcuuuguugaaagaaa

SEQ ID NO: 3449777 - RNA, 14 nt, Human
gaaaggaaaccuuu

SEQ ID NO: 3449778 - RNA, 15 nt, Human
gaaaggaaaccuuuu

SEQ ID NO: 3449779 - RNA, 16 nt, Human
gaaaggaaagaggcuc

SEQ ID NO: 3449780 - RNA, 21 nt, Human
gaaaggaagcauuguaaaaua

SEQ ID NO: 3449781 - RNA, 23 nt, Human
gaaaggaagcauuguaaaauaau

SEQ ID NO: 3449782 - RNA, 14 nt, Human
gaaaggagaggaaa

SEQ ID NO: 3449783 - RNA, 17 nt, Human
gaaaggagaggaaagaa

SEQ ID NO: 3449784 - RNA, 19 nt, Human
gaaaggagccuaggccagg

SEQ ID NO: 3449785 - RNA, 22 nt, Human
gaaaggagccuaggccaggugc

SEQ ID NO: 3449786 - RNA, 18 nt, Human
gaaaggaggcaugccucu

SEQ ID NO: 3449787 - RNA, 16 nt, Human
gaaaggauauuuaaga

SEQ ID NO: 3449788 - RNA, 22 nt, Human
gaaaggauguaaacagugccug

SEQ ID NO: 3449789 - RNA, 13 nt, Human
gaaaggcaaggga

SEQ ID NO: 3449790 - RNA, 14 nt, Human
gaaaggccagcacu

SEQ ID NO: 3449791 - RNA, 12 nt, Human
gaaaggccagcu

SEQ ID NO: 3449792 - RNA, 14 nt, Human
gaaaggccagcugg

SEQ ID NO: 3449793 - RNA, 14 nt, Human
gaaaggccugcaca

SEQ ID NO: 3449794 - RNA, 15 nt, Human
gaaaggccuuuaaaa

SEQ ID NO: 3449795 - RNA, 21 nt, Human
gaaaggcuccaggagcagcca

SEQ ID NO: 3449796 - RNA, 15 nt, Human
gaaaggcucugaaag

SEQ ID NO: 3449797 - RNA, 16 nt, Human
gaaagggaacagaaag

SEQ ID NO: 3449798 - RNA, 20 nt, Human
gaaagggacgcuacccggga

SEQ ID NO: 3449799 - RNA, 16 nt, Human
gaaagggagggcucug

SEQ ID NO: 3449800 - RNA, 18 nt, Human
gaaagggagggcucugag

SEQ ID NO: 3449801 - RNA, 12 nt, Human
gaaagggauuuu

SEQ ID NO: 3449802 - RNA, 20 nt, Human
gaaagggcaacaauaaaaua

SEQ ID NO: 3449803 - RNA, 20 nt, Human
gaaagggcccuccuuccuaa

SEQ ID NO: 3449804 - RNA, 20 nt, Human
gaaagggccuugacaucagu

SEQ ID NO: 3449805 - RNA, 18 nt, Human
gaaaggggagagccugcu

SEQ ID NO: 3449806 - RNA, 16 nt, Human
gaaaggggagcccacu

SEQ ID NO: 3449807 - RNA, 20 nt, Human
gaaaggggcaggagcucaga

SEQ ID NO: 3449808 - RNA, 17 nt, Human
gaaaggggggagcuggg

SEQ ID NO: 3449809 - RNA, 21 nt, Human
gaaagggguuggggugacagu

SEQ ID NO: 3449810 - RNA, 12 nt, Human
gaaagggucucc

SEQ ID NO: 3449811 - RNA, 18 nt, Human
gaaaggucaccucacuca

SEQ ID NO: 3449812 - RNA, 23 nt, Human
gaaaggugaguuugagcugccuu

SEQ ID NO: 3449813 - RNA, 22 nt, Human
gaaaggugguguuucuguaaga

SEQ ID NO: 3449814 - RNA, 13 nt, Human
gaaagguuuugag

SEQ ID NO: 3449815 - RNA, 14 nt, Human
gaaaguaauuucuu

SEQ ID NO: 3449816 - RNA, 20 nt, Human
gaaaguacacucugcuguuu

SEQ ID NO: 3449817 - RNA, 22 nt, Human
gaaaguacacucugcuguuuga

SEQ ID NO: 3449818 - RNA, 22 nt, Human
gaaaguacuucuccacccugcu

SEQ ID NO: 3449819 - RNA, 17 nt, Human
gaaagucaugaacacau

SEQ ID NO: 3449820 - RNA, 18 nt, Human
gaaagucauuggcuuuau

SEQ ID NO: 3449821 - RNA, 22 nt, Human
gaaagucgaauuaauagcuuuu

SEQ ID NO: 3449822 - RNA, 13 nt, Human
gaaagucuguccu

SEQ ID NO: 3449823 - RNA, 23 nt, Human
gaaagucuguccuugaaggacua

SEQ ID NO: 3449824 - RNA, 17 nt, Human
gaaagugaauaaacuuc

SEQ ID NO: 3449825 - RNA, 22 nt, Human
gaaagugaauaaacuucagcac

SEQ ID NO: 3449826 - RNA, 14 nt, Human
gaaagugaugacau

SEQ ID NO: 3449827 - RNA, 22 nt, Human
gaaagugauuucuagaaagccu

SEQ ID NO: 3449828 - RNA, 13 nt, Human
gaaagugccugac

SEQ ID NO: 3449829 - RNA, 15 nt, Human
gaaagugccuuugca

SEQ ID NO: 3449830 - RNA, 18 nt, Human
gaaagugccuuugcagcu

SEQ ID NO: 3449831 - RNA, 20 nt, Human
gaaagugccuuugcagcuca

SEQ ID NO: 3449832 - RNA, 19 nt, Human
ggcuacucugugccagagc

SEQ ID NO: 3449833 - RNA, 23 nt, Human
ggcuacucugugccagagccugg

SEQ ID NO: 3449834 - RNA, 18 nt, Human
ggcuacuucggggcuggg

SEQ ID NO: 3449835 - RNA, 21 nt, Human
ggcuagaaccaagaagggcua

SEQ ID NO: 3449836 - RNA, 21 nt, Human
ggcuagaaccuagaagggcua

SEQ ID NO: 3449837 - RNA, 14 nt, Human
ggcuagaaccuggc

SEQ ID NO: 3449838 - RNA, 18 nt, Human
ggcuagaauauccuacuu

SEQ ID NO: 3449839 - RNA, 17 nt, Human
ggcuagacuagucucaa

SEQ ID NO: 3449840 - RNA, 17 nt, Human
ggcuagagguucaaaga

SEQ ID NO: 3449841 - RNA, 19 nt, Human
ggcuagaguccucacuccc

SEQ ID NO: 3449842 - RNA, 15 nt, Human
ggcuagcuaagccaa

SEQ ID NO: 3449843 - RNA, 14 nt, Human
ggcuagcuggagcc

SEQ ID NO: 3449844 - RNA, 17 nt, Human
ggcuagcuggagccugg

SEQ ID NO: 3449845 - RNA, 23 nt, Human
ggcuagucaagcuccuccucccu

SEQ ID NO: 3449846 - RNA, 13 nt, Human
ggcuagucagaga

SEQ ID NO: 3449847 - RNA, 23 nt, Human
ggcuagugacuugugucccauga

SEQ ID NO: 3449848 - RNA, 15 nt, Human
ggcuaguugggcuuc

SEQ ID NO: 3449849 - RNA, 18 nt, Human
ggcuauagaugucuuuuc

SEQ ID NO: 3449850 - RNA, 19 nt, Human
ggcuauagcuacaggaagc

SEQ ID NO: 3449851 - RNA, 20 nt, Human
ggcuauagcuacaggaagca

SEQ ID NO: 3449852 - RNA, 22 nt, Human
ggcuauggauuuucuaaggaag

SEQ ID NO: 3449853 - RNA, 13 nt, Human
ggcuauucacaac

SEQ ID NO: 3449854 - RNA, 18 nt, Human
ggcuauuuucuaaagacu

SEQ ID NO: 3449855 - RNA, 20 nt, Human
ggcuauuuucuaaagacuug

SEQ ID NO: 3449856 - RNA, 12 nt, Human
ggcucaaauuuu

SEQ ID NO: 3449857 - RNA, 17 nt, Human
ggcucaagcccaggagg

SEQ ID NO: 3449858 - RNA, 18 nt, Human
ggcucacacaccuguagc

SEQ ID NO: 3449859 - RNA, 13 nt, Human
ggcucacaccugu

SEQ ID NO: 3449860 - RNA, 21 nt, Human
ggcucacacuuggcucugagg

SEQ ID NO: 3449861 - RNA, 13 nt, Human
ggcucaccagaau

SEQ ID NO: 3449862 - RNA, 19 nt, Human
ggcucacccaagcaaggcc

SEQ ID NO: 3449863 - RNA, 13 nt, Human
ggcucacccaguc

SEQ ID NO: 3449864 - RNA, 18 nt, Human
ggcucaccuugugcuggg

SEQ ID NO: 3449865 - RNA, 20 nt, Human
ggcucacgccuaugauccca

SEQ ID NO: 3449866 - RNA, 13 nt, Human
ggcucacgccugu

SEQ ID NO: 3449867 - RNA, 17 nt, Human
ggcucacuauggugcca

SEQ ID NO: 3449868 - RNA, 16 nt, Human
ggcucacucagcacuu

SEQ ID NO: 3449869 - RNA, 23 nt, Human
ggcucacugcaaccuccaccucc

SEQ ID NO: 3449870 - RNA, 18 nt, Human
ggcucacugcagccucga

SEQ ID NO: 3449871 - RNA, 16 nt, Human
ggcucacugcauccuc

SEQ ID NO: 3449872 - RNA, 19 nt, Human
ggcucacugcauccuccgc

SEQ ID NO: 3449873 - RNA, 22 nt, Human
ggcucacugccaggccagccuc

SEQ ID NO: 3449874 - RNA, 17 nt, Human
ggcucagcaaggccacc

SEQ ID NO: 3449875 - RNA, 21 nt, Human
ggcucagcaaggccaccucuu

SEQ ID NO: 3449876 - RNA, 22 nt, Human
ggcucagcaaggccaccucuuc

SEQ ID NO: 3449877 - RNA, 11 nt, Human
ggcucagccug

SEQ ID NO: 3449878 - RNA, 12 nt, Human
ggcucagccugg

SEQ ID NO: 3449879 - RNA, 20 nt, Human
ggcucagcggggacagcucc

SEQ ID NO: 3449880 - RNA, 21 nt, Human
ggcucagcggggacagcuccu

SEQ ID NO: 3449881 - RNA, 22 nt, Human
ggcucagcggggacagcuccuu

SEQ ID NO: 3449882 - RNA, 23 nt, Human
ggcucagcggggacagcuccuuc

SEQ ID NO: 3449883 - RNA, 21 nt, Human
ggcucagcucggggagccuua

SEQ ID NO: 3449884 - RNA, 22 nt, Human
ggcucaggauuucgugggucug

SEQ ID NO: 3449885 - RNA, 15 nt, Human
ggcucaggcaggggc

SEQ ID NO: 3449886 - RNA, 21 nt, Human
ggcucaggcaggggccuccau

SEQ ID NO: 3449887 - RNA, 14 nt, Human
ggcucagggaccac

SEQ ID NO: 3449888 - RNA, 15 nt, Human
ggcucagucucagga

SEQ ID NO: 3449889 - RNA, 21 nt, Human
ggcucagugaaguugcugcuu

SEQ ID NO: 3449890 - RNA, 20 nt, Human
ggcucauagggaagaccugc

SEQ ID NO: 3449891 - RNA, 17 nt, Human
ggcucauauuccugcag

SEQ ID NO: 3449892 - RNA, 19 nt, Human
ggcuccaacacugcugcuc

SEQ ID NO: 3449893 - RNA, 19 nt, Human
ggcuccagacacaugucca

SEQ ID NO: 3449894 - RNA, 16 nt, Human
ggcuccagagggcacu

SEQ ID NO: 3449895 - RNA, 18 nt, Human
ggcuccagaugcagggca

SEQ ID NO: 3449896 - RNA, 19 nt, Human
ggcuccagaugcagggcag

SEQ ID NO: 3449897 - RNA, 18 nt, Human
ggcuccagccaucucaug

SEQ ID NO: 3449898 - RNA, 22 nt, Human
ggcuccagccccucuuggagaa

SEQ ID NO: 3449899 - RNA, 12 nt, Human
ggcuccagcugg

SEQ ID NO: 3449900 - RNA, 12 nt, Human
ggcuccaggagc

SEQ ID NO: 3449901 - RNA, 18 nt, Human
ggcuccaggagcagccac

SEQ ID NO: 3449902 - RNA, 14 nt, Human
ggcuccaggccagg

SEQ ID NO: 3449903 - RNA, 16 nt, Human
ggcuccaggccagggg

SEQ ID NO: 3449904 - RNA, 12 nt, Human
ggcuccaggcuc

SEQ ID NO: 3449905 - RNA, 16 nt, Human
ggcuccaggcuccuuu

SEQ ID NO: 3449906 - RNA, 18 nt, Human
ggcuccagucugcugccc

SEQ ID NO: 3449907 - RNA, 14 nt, Human
ggcuccauauauau

SEQ ID NO: 3449908 - RNA, 14 nt, Human
ggcucccacaggcc

SEQ ID NO: 3449909 - RNA, 17 nt, Human
ggcucccacaggcccuu

SEQ ID NO: 3449910 - RNA, 15 nt, Human
ggcucccagccaggc

SEQ ID NO: 3449911 - RNA, 17 nt, Human
ggcucccagccucagcg

SEQ ID NO: 3449912 - RNA, 13 nt, Human
ggcucccaggaca

SEQ ID NO: 3449913 - RNA, 21 nt, Human
ggcucccaggagccugcccag

SEQ ID NO: 3449914 - RNA, 12 nt, Human
ggcucccagggg

SEQ ID NO: 3449915 - RNA, 23 nt, Human
ggcucccaggggcucccuccgcc

SEQ ID NO: 3449916 - RNA, 21 nt, Human
ggcucccaggggucucccugg

SEQ ID NO: 3449917 - RNA, 15 nt, Human
ggcucccauucacuc

SEQ ID NO: 3449918 - RNA, 18 nt, Human
ggcucccauucacucuuc

SEQ ID NO: 3449919 - RNA, 16 nt, Human
ggcuccccaguacacc

SEQ ID NO: 3449920 - RNA, 22 nt, Human
ggcuccccauguguccugguuc

SEQ ID NO: 3449921 - RNA, 16 nt, Human
ggcucccccaggggcu

SEQ ID NO: 3449922 - RNA, 11 nt, Human
ggcuccccucu

SEQ ID NO: 3449923 - RNA, 18 nt, Human
ggcuccccucuuccucuu

SEQ ID NO: 3449924 - RNA, 19 nt, Human
ggcuccccucuuccucuug

SEQ ID NO: 3449925 - RNA, 11 nt, Human
ggcuccccugg

SEQ ID NO: 3449926 - RNA, 20 nt, Human
ggcuccccuuuuucuuccuc

SEQ ID NO: 3449927 - RNA, 17 nt, Human
ggcucccgccuccaacc

SEQ ID NO: 3449928 - RNA, 20 nt, Human
ggcucccgccuccaaccccu

SEQ ID NO: 3449929 - RNA, 17 nt, Human
ggcucccucacucucag

SEQ ID NO: 3449930 - RNA, 13 nt, Human
ggcucccuccgcc

SEQ ID NO: 3449931 - RNA, 13 nt, Human
ggcucccuuccuc

SEQ ID NO: 3449932 - RNA, 15 nt, Human
ggcuccgcugugugg

SEQ ID NO: 3449933 - RNA, 14 nt, Human
ggcuccggccucug

SEQ ID NO: 3449934 - RNA, 15 nt, Human
ggcuccggccucugc

SEQ ID NO: 3449935 - RNA, 18 nt, Human
ggcuccgucaguaucagg

SEQ ID NO: 3449936 - RNA, 20 nt, Human
ggcuccuaucuguguuuuga

SEQ ID NO: 3449937 - RNA, 20 nt, Human
ggcuccucgagaucccaaca

SEQ ID NO: 3449938 - RNA, 12 nt, Human
ggcuccucucag

SEQ ID NO: 3449939 - RNA, 21 nt, Human
ggcuccucucuaaccuccuuu

SEQ ID NO: 3449940 - RNA, 12 nt, Human
ggcuccugaggg

SEQ ID NO: 3449941 - RNA, 9 nt, Human
ggcuccugc

SEQ ID NO: 3449942 - RNA, 13 nt, Human
ggcuccugccacc

SEQ ID NO: 3449943 - RNA, 12 nt, Human
ggcuccugccca

SEQ ID NO: 3449944 - RNA, 15 nt, Human
ggcuccugcccccau

SEQ ID NO: 3449945 - RNA, 17 nt, Human
ggcuccugccuucuguc

SEQ ID NO: 3449946 - RNA, 11 nt, Human
ggcuccugcug

SEQ ID NO: 3449947 - RNA, 16 nt, Human
ggcuccugcugcacca

SEQ ID NO: 3449948 - RNA, 11 nt, Human
ggcuccugucc

SEQ ID NO: 3449949 - RNA, 13 nt, Human
ggcuccugugccc

SEQ ID NO: 3449950 - RNA, 14 nt, Human
ggcuccugugcccu

SEQ ID NO: 3449951 - RNA, 13 nt, Human
ggcuccugugcua

SEQ ID NO: 3449952 - RNA, 18 nt, Human
ggcuccuguuagcuccuc

SEQ ID NO: 3449953 - RNA, 15 nt, Human
ggcuccuguuuugca

SEQ ID NO: 3449954 - RNA, 20 nt, Human
ggcuccuucccaucgcuguc

SEQ ID NO: 3449955 - RNA, 20 nt, Human
ggcuccuugugggccugggc

SEQ ID NO: 3449956 - RNA, 22 nt, Human
ggcuccuugugggccugggcuc

SEQ ID NO: 3449957 - RNA, 19 nt, Human
ggcuccuuuagcgcccagu

SEQ ID NO: 3449958 - RNA, 16 nt, Human
ggggaccucaggccug

SEQ ID NO: 3449959 - RNA, 16 nt, Human
ggggacgcuccgcugc

SEQ ID NO: 3449960 - RNA, 18 nt, Human
ggggacggggggccccag

SEQ ID NO: 3449961 - RNA, 21 nt, Human
ggggacuagccccuguggaga

SEQ ID NO: 3449962 - RNA, 16 nt, Human
ggggacucugggcuau

SEQ ID NO: 3449963 - RNA, 14 nt, Human
ggggacugccaccu

SEQ ID NO: 3449964 - RNA, 17 nt, Human
ggggacugccaccuccc

SEQ ID NO: 3449965 - RNA, 14 nt, Human
ggggacugucuuuc

SEQ ID NO: 3449966 - RNA, 16 nt, Human
ggggaggcggcacucc

SEQ ID NO: 3449967 - RNA, 18 nt, Human
ggggagggaagggagcca

SEQ ID NO: 3449968 - RNA, 20 nt, Human
ggggagggaagggagccaag

SEQ ID NO: 3449969 - RNA, 21 nt, Human
ggggagggccguaccccaccc

SEQ ID NO: 3449970 - RNA, 13 nt, Human
ggggaggggaagu

SEQ ID NO: 3449971 - RNA, 13 nt, Human
ggggaggggcgcu

SEQ ID NO: 3449972 - RNA, 16 nt, Human
ggggaggggcgcuggc

SEQ ID NO: 3449973 - RNA, 22 nt, Human
ggggaguaaagaauuauuuugu

SEQ ID NO: 3449974 - RNA, 14 nt, Human
ggggaguagagaag

SEQ ID NO: 3449975 - RNA, 14 nt, Human
ggggaguaugcaaa

SEQ ID NO: 3449976 - RNA, 17 nt, Human
ggggagucugaagcaga

SEQ ID NO: 3449977 - RNA, 18 nt, Human
ggggaguuuagggugggg

SEQ ID NO: 3449978 - RNA, 13 nt, Human
gggugaaagaaau

SEQ ID NO: 3449979 - RNA, 20 nt, Human
gggugaacaaagcagccacg

SEQ ID NO: 3449980 - RNA, 12 nt, Human
gggugaaggcug

SEQ ID NO: 3449981 - RNA, 14 nt, Human
gggugaagggagag

SEQ ID NO: 3449982 - RNA, 23 nt, Human
gggugaauaauaaaaguauauau

SEQ ID NO: 3449983 - RNA, 20 nt, Human
gggugacagucaucaucagg

SEQ ID NO: 3449984 - RNA, 22 nt, Human
gggugacagucaucaucagggc

SEQ ID NO: 3449985 - RNA, 20 nt, Human
gggugagaugcuggagaaga

SEQ ID NO: 3449986 - RNA, 14 nt, Human
gggugaggagcugg

SEQ ID NO: 3449987 - RNA, 23 nt, Human
gggugaguuggcuuaccuggccc

SEQ ID NO: 3449988 - RNA, 23 nt, Human
gggugaugagggcagcagccagc

SEQ ID NO: 3449989 - RNA, 15 nt, Human
gggugauggggaggg

SEQ ID NO: 3449990 - RNA, 13 nt, Human
gggugauuccuaa

SEQ ID NO: 3449991 - RNA, 23 nt, Human
gggugauuuuaugaucaguguug

SEQ ID NO: 3449992 - RNA, 16 nt, Human
gggugcacaggagggg

SEQ ID NO: 3449993 - RNA, 15 nt, Human
gggugcagaggcugu

SEQ ID NO: 3449994 - RNA, 16 nt, Human
gggugcagaggcugug

SEQ ID NO: 3449995 - RNA, 14 nt, Human
gggugcagcaguga

SEQ ID NO: 3449996 - RNA, 13 nt, Human
gggugcagcccaa

SEQ ID NO: 3449997 - RNA, 15 nt, Human
gggugcagcugagaa

SEQ ID NO: 3449998 - RNA, 21 nt, Human
gggugccccccuugccagaca

SEQ ID NO: 3449999 - RNA, 12 nt, Human
gggugccgccug

SEQ ID NO: 3450000 - RNA, 19 nt, Human
gggugcgaccccaucugcc

SEQ ID NO: 3450001 - RNA, 15 nt, Human
gggugcuacugggga

SEQ ID NO: 3450002 - RNA, 18 nt, Human
gggugcuaguggugggca

SEQ ID NO: 3450003 - RNA, 21 nt, Human
gggugcucagaauaaggcagg

SEQ ID NO: 3450004 - RNA, 21 nt, Human
gggugcugccccaugaagcca

SEQ ID NO: 3450005 - RNA, 18 nt, Human
gggugcugggaggaggga

SEQ ID NO: 3450006 - RNA, 16 nt, Human
gggugcuguuuugcca

SEQ ID NO: 3450007 - RNA, 12 nt, Human
ggguggaagcuu

SEQ ID NO: 3450008 - RNA, 21 nt, Human
ggguggacaaacuggagucug

SEQ ID NO: 3450009 - RNA, 15 nt, Human
ggguggagaagccau

SEQ ID NO: 3450010 - RNA, 23 nt, Human
ggguggagacugcuucccauccu

SEQ ID NO: 3450011 - RNA, 14 nt, Human
ggguggauauaaau

SEQ ID NO: 3450012 - RNA, 23 nt, Human
ggguggauuuggguuggaaguga

SEQ ID NO: 3450013 - RNA, 15 nt, Human
ggguggcaccagcag

SEQ ID NO: 3450014 - RNA, 20 nt, Human
ggguggcaucauuccaggcc

SEQ ID NO: 3450015 - RNA, 20 nt, Human
ggguggccacagcgccagcc

SEQ ID NO: 3450016 - RNA, 11 nt, Human
ggguggccugu

SEQ ID NO: 3450017 - RNA, 20 nt, Human
ggguggcuacucugugccag

SEQ ID NO: 3450018 - RNA, 13 nt, Human
ggguggcugcagc

SEQ ID NO: 3450019 - RNA, 15 nt, Human
gggugggacacccug

SEQ ID NO: 3450020 - RNA, 19 nt, Human
gggugggacacccugugau

SEQ ID NO: 3450021 - RNA, 13 nt, Human
gggugggccaggc

SEQ ID NO: 3450022 - RNA, 13 nt, Human
ggguggggaaagg

SEQ ID NO: 3450023 - RNA, 18 nt, Human
ggguggggggggugcugg

SEQ ID NO: 3450024 - RNA, 17 nt, Human
ggguggggucaugcccu

SEQ ID NO: 3450025 - RNA, 20 nt, Human
gggugggucagaacccugcc

SEQ ID NO: 3450026 - RNA, 14 nt, Human
gggugggugcucag

SEQ ID NO: 3450027 - RNA, 21 nt, Human
gggugguaagagaauguuaua

SEQ ID NO: 3450028 - RNA, 13 nt, Human
gggugguccugac

SEQ ID NO: 3450029 - RNA, 14 nt, Human
ggguggugcuggga

SEQ ID NO: 3450030 - RNA, 18 nt, Human
ggguggugcugggacuga

SEQ ID NO: 3450031 - RNA, 18 nt, Human
ggguguaaaaccuggaga

SEQ ID NO: 3450032 - RNA, 17 nt, Human
gggugucccagaccccg

SEQ ID NO: 3450033 - RNA, 20 nt, Human
ggguguccccaacagcgccc

SEQ ID NO: 3450034 - RNA, 23 nt, Human
ggguguccugcaccggggccugg

SEQ ID NO: 3450035 - RNA, 17 nt, Human
ggguguccugccugucu

SEQ ID NO: 3450036 - RNA, 19 nt, Human
ggguguccugccugucugc

SEQ ID NO: 3450037 - RNA, 22 nt, Human
ggguguccugccugucugcccc

SEQ ID NO: 3450038 - RNA, 23 nt, Human
gggugucuugggcagagcuggcu

SEQ ID NO: 3450039 - RNA, 17 nt, Human
gggugugcacaucucug

SEQ ID NO: 3450040 - RNA, 16 nt, Human
ggguguggcccugcca

SEQ ID NO: 3450041 - RNA, 14 nt, Human
gggugugggaaagc

SEQ ID NO: 3450042 - RNA, 16 nt, Human
gggugugggaggcccg

SEQ ID NO: 3450043 - RNA, 14 nt, Human
ggguguguguuugu

SEQ ID NO: 3450044 - RNA, 22 nt, Human
ggguguguguuugugugagaga

SEQ ID NO: 3450045 - RNA, 15 nt, Human
ggguguuaauuuaug

SEQ ID NO: 3450046 - RNA, 15 nt, Human
ggguuaaggccugaa

SEQ ID NO: 3450047 - RNA, 18 nt, Human
ggguuagacugccagcuc

SEQ ID NO: 3450048 - RNA, 18 nt, Human
ggguuagauguugccaug

SEQ ID NO: 3450049 - RNA, 20 nt, Human
ggguuauguguaugugccau

SEQ ID NO: 3450050 - RNA, 16 nt, Human
ggguucaaaaugucug

SEQ ID NO: 3450051 - RNA, 16 nt, Human
ggguucagccccuccu

SEQ ID NO: 3450052 - RNA, 19 nt, Human
ggguucagccccuccucug

SEQ ID NO: 3450053 - RNA, 19 nt, Human
ggguucauaggucacuggc

SEQ ID NO: 3450054 - RNA, 21 nt, Human
ggguucauaggucacuggcuc

SEQ ID NO: 3450055 - RNA, 15 nt, Human
ggguucaugaugcag

SEQ ID NO: 3450056 - RNA, 17 nt, Human
ggguucauuauuggaau

SEQ ID NO: 3450057 - RNA, 13 nt, Human
ggguucauuugug

SEQ ID NO: 3450058 - RNA, 14 nt, Human
ggguucauuugugu

SEQ ID NO: 3450059 - RNA, 14 nt, Human
ggguucccccagcc

SEQ ID NO: 3450060 - RNA, 15 nt, Human
ggguucccccagccc

SEQ ID NO: 3450061 - RNA, 17 nt, Human
ggguuccucaaauuuuu

SEQ ID NO: 3450062 - RNA, 21 nt, Human
ggguuccuuccucugagccuu

SEQ ID NO: 3450063 - RNA, 17 nt, Human
ggguucuacccaggugc

SEQ ID NO: 3450064 - RNA, 22 nt, Human
ggguucuaggcaucucuguacu

SEQ ID NO: 3450065 - RNA, 22 nt, Human
ggguucuguaaaauggaaaacu

SEQ ID NO: 3450066 - RNA, 16 nt, Human
ggguucuuuggaagga

SEQ ID NO: 3450067 - RNA, 12 nt, Human
ggguugaaaauu

SEQ ID NO: 3450068 - RNA, 21 nt, Human
ggguugagcagggauccuggu

SEQ ID NO: 3450069 - RNA, 16 nt, Human
ggguuggccccugccc

SEQ ID NO: 3450070 - RNA, 22 nt, Human
ggguuggcgcacccuccccucc

SEQ ID NO: 3450071 - RNA, 12 nt, Human
ggguugggccca

SEQ ID NO: 3450072 - RNA, 22 nt, Human
ggguugggcccagaucuggucc

SEQ ID NO: 3450073 - RNA, 15 nt, Human
ggguugggcuggugu

SEQ ID NO: 3450074 - RNA, 21 nt, Human
ggguuggguucaucugagcaa

SEQ ID NO: 3450075 - RNA, 18 nt, Human
ggguugguccucuugccu

SEQ ID NO: 3450076 - RNA, 14 nt, Human
ggguuggugugcug

SEQ ID NO: 3450077 - RNA, 21 nt, Human
ggguugugaggccuggccagg

SEQ ID NO: 3450078 - RNA, 23 nt, Human
ggguuuaauccccaguaaaauug

SEQ ID NO: 3450079 - RNA, 20 nt, Human
ggguuucaccauguuagcca

SEQ ID NO: 3450080 - RNA, 17 nt, Human
ggguuucgagaagcugc

SEQ ID NO: 3450081 - RNA, 16 nt, Human
ggguuucucuguggcu

SEQ ID NO: 3450082 - RNA, 19 nt, Human
ggguuucugcccugcccac

SEQ ID NO: 3450083 - RNA, 21 nt, Human
ggguuugagagagcagccagg

SEQ ID NO: 3450084 - RNA, 20 nt, Human
ggguuuggaccccagcuggg

SEQ ID NO: 3450085 - RNA, 21 nt, Human
ggguuuggcugugucuaaacu

SEQ ID NO: 3450086 - RNA, 16 nt, Human
ggguuuuaacuuuguu

SEQ ID NO: 3450087 - RNA, 13 nt, Human
ggguuuuaaugua

SEQ ID NO: 3450088 - RNA, 12 nt, Human
ggguuuucuuaa

SEQ ID NO: 3450089 - RNA, 13 nt, Human
ggguuuuguaaug

SEQ ID NO: 3450090 - RNA, 23 nt, Human
ggguuuuuauuuccuaugaugua

SEQ ID NO: 3450091 - RNA, 10 nt, Human
ggguuuuucu

SEQ ID NO: 3450092 - RNA, 20 nt, Human
gguaaaaugaagaauuuaaa

SEQ ID NO: 3450093 - RNA, 15 nt, Human
gguaaaauguauuuu

SEQ ID NO: 3450094 - RNA, 16 nt, Human
gguaaagacuggcuuu

SEQ ID NO: 3450095 - RNA, 19 nt, Human
gguaaauaaaaagaaaggc

SEQ ID NO: 3450096 - RNA, 20 nt, Human
gguaaauaaaccacugugcg

SEQ ID NO: 3450097 - RNA, 15 nt, Human
gguaaauuaagacau

SEQ ID NO: 3450098 - RNA, 11 nt, Human
gguaaauuauu

SEQ ID NO: 3450099 - RNA, 20 nt, Human
gguaaauuuccccaacagug

SEQ ID NO: 3450100 - RNA, 13 nt, Human
gguaaauuucugu

SEQ ID NO: 3450101 - RNA, 15 nt, Human
gguaacagaacagcu

SEQ ID NO: 3450102 - RNA, 16 nt, Human
gguaacagaacagcuu

SEQ ID NO: 3450103 - RNA, 20 nt, Human
gguaacaggcagauacagga

SEQ ID NO: 3450104 - RNA, 18 nt, Human
gguaacuagggaagauaa

SEQ ID NO: 3450105 - RNA, 18 nt, Human
gguaacugcuuucuguuc

SEQ ID NO: 3450106 - RNA, 12 nt, Human
gguaacuguccu

SEQ ID NO: 3450107 - RNA, 14 nt, Human
gguaacuguccugu

SEQ ID NO: 3450108 - RNA, 16 nt, Human
gguaacuugcaccucu

SEQ ID NO: 3450109 - RNA, 12 nt, Human
gguaagaaaaag

SEQ ID NO: 3450110 - RNA, 21 nt, Human
gguaagaaaaagcaaaaggca

SEQ ID NO: 3450111 - RNA, 19 nt, Human
gguaagaauaguagaugug

SEQ ID NO: 3450112 - RNA, 16 nt, Human
gguaagcaacauggcu

SEQ ID NO: 3450113 - RNA, 20 nt, Human
gguaagcacuuaaugaauga

SEQ ID NO: 3450114 - RNA, 15 nt, Human
gguaauaaacuuaga

SEQ ID NO: 3450115 - RNA, 14 nt, Human
gguaauaagggaaa

SEQ ID NO: 3450116 - RNA, 17 nt, Human
gguaaucgaccugccuc

SEQ ID NO: 3450117 - RNA, 18 nt, Human
gguaauguguuuuagagu

SEQ ID NO: 3450118 - RNA, 23 nt, Human
gguaauuauuuugguacuuuuau

SEQ ID NO: 3450119 - RNA, 24 nt, Human
gguacaaccuguucugcuuuccuc

SEQ ID NO: 3450120 - RNA, 21 nt, Human
gguacaaccuuuauucuuuuc

SEQ ID NO: 3450121 - RNA, 14 nt, Human
gguacaacggaggc

SEQ ID NO: 3450122 - RNA, 16 nt, Human
gguacaacggaggccu

SEQ ID NO: 3450123 - RNA, 22 nt, Human
gguggucugcucgggcccaggc

SEQ ID NO: 3450124 - RNA, 15 nt, Human
gguggugaccucugc

SEQ ID NO: 3450125 - RNA, 20 nt, Human
gguggugcugggacugagcc

SEQ ID NO: 3450126 - RNA, 14 nt, Human
ggugguggaucugu

SEQ ID NO: 3450127 - RNA, 14 nt, Human
ggugguggccuggu

SEQ ID NO: 3450128 - RNA, 13 nt, Human
ggugguggggagg

SEQ ID NO: 3450129 - RNA, 23 nt, Human
gguggugucagacccuggaggcc

SEQ ID NO: 3450130 - RNA, 17 nt, Human
ggugguuucagaaaugu

SEQ ID NO: 3450131 - RNA, 18 nt, Human
ggugguuuucuguucuuu

SEQ ID NO: 3450132 - RNA, 17 nt, Human
gguguagcccucccacu

SEQ ID NO: 3450133 - RNA, 20 nt, Human
gguguagcccucccacuuug

SEQ ID NO: 3450134 - RNA, 23 nt, Human
gguguagcucuuagaggaaggag

SEQ ID NO: 3450135 - RNA, 16 nt, Human
gguguaugugugaagu

SEQ ID NO: 3450136 - RNA, 23 nt, Human
gguguauuuauuuuccuccccag

SEQ ID NO: 3450137 - RNA, 14 nt, Human
ggugucaccccaga

SEQ ID NO: 3450138 - RNA, 15 nt, Human
ggugucaccccagag

SEQ ID NO: 3450139 - RNA, 21 nt, Human
ggugucaccccagagccacac

SEQ ID NO: 3450140 - RNA, 13 nt, Human
ggugucacugucc

SEQ ID NO: 3450141 - RNA, 21 nt, Human
ggugucacugucccuccuggu

SEQ ID NO: 3450142 - RNA, 23 nt, Human
ggugucacuuacuguuucuguca

SEQ ID NO: 3450143 - RNA, 23 nt, Human
ggugucagacccuggaggcccca

SEQ ID NO: 3450144 - RNA, 18 nt, Human
gguguccccaccaucugc

SEQ ID NO: 3450145 - RNA, 16 nt, Human
gguguccccagcccac

SEQ ID NO: 3450146 - RNA, 13 nt, Human
gguguccugacca

SEQ ID NO: 3450147 - RNA, 19 nt, Human
gguguccugccugucugcc

SEQ ID NO: 3450148 - RNA, 17 nt, Human
ggugucgcgccuucucc

SEQ ID NO: 3450149 - RNA, 20 nt, Human
ggugucgcgccuucuccccc

SEQ ID NO: 3450150 - RNA, 21 nt, Human
ggugucgcgccuucucccccc

SEQ ID NO: 3450151 - RNA, 13 nt, Human
ggugucgggcaug

SEQ ID NO: 3450152 - RNA, 23 nt, Human
ggugucuccaaccccccagcacu

SEQ ID NO: 3450153 - RNA, 14 nt, Human
ggugucuuucucuu

SEQ ID NO: 3450154 - RNA, 15 nt, Human
ggugugaacccggga

SEQ ID NO: 3450155 - RNA, 16 nt, Human
ggugugaacccgggag

SEQ ID NO: 3450156 - RNA, 15 nt, Human
ggugugaccugaggg

SEQ ID NO: 3450157 - RNA, 13 nt, Human
ggugugagcagca

SEQ ID NO: 3450158 - RNA, 15 nt, Human
ggugugaucgucuga

SEQ ID NO: 3450159 - RNA, 16 nt, Human
ggugugcaccaggguu

SEQ ID NO: 3450160 - RNA, 14 nt, Human
ggugugccugcagc

SEQ ID NO: 3450161 - RNA, 18 nt, Human
ggugugccuuccagaucc

SEQ ID NO: 3450162 - RNA, 21 nt, Human
ggugugcggccuuuggcuuca

SEQ ID NO: 3450163 - RNA, 13 nt, Human
ggugugcucugau

SEQ ID NO: 3450164 - RNA, 14 nt, Human
gguguggagaagcg

SEQ ID NO: 3450165 - RNA, 23 nt, Human
gguguggagaagcggcuggcagc

SEQ ID NO: 3450166 - RNA, 18 nt, Human
gguguggcccauggcugu

SEQ ID NO: 3450167 - RNA, 19 nt, Human
gguguggcccugccaucuu

SEQ ID NO: 3450168 - RNA, 23 nt, Human
ggugugggggccccgucucaggu

SEQ ID NO: 3450169 - RNA, 15 nt, Human
gguguggguguccug

SEQ ID NO: 3450170 - RNA, 22 nt, Human
gguguggguguccugccugucu

SEQ ID NO: 3450171 - RNA, 14 nt, Human
ggugugguacagag

SEQ ID NO: 3450172 - RNA, 16 nt, Human
ggugugguacagagaa

SEQ ID NO: 3450173 - RNA, 21 nt, Human
ggugugguacagagaagccag

SEQ ID NO: 3450174 - RNA, 23 nt, Human
ggugugucccccucuguccaggc

SEQ ID NO: 3450175 - RNA, 18 nt, Human
gguguguuccaacugccc

SEQ ID NO: 3450176 - RNA, 13 nt, Human
gguguguuuuugg

SEQ ID NO: 3450177 - RNA, 14 nt, Human
gguguguuuuuggg

SEQ ID NO: 3450178 - RNA, 13 nt, Human
gguguuaacagaa

SEQ ID NO: 3450179 - RNA, 12 nt, Human
gguguuauuugg

SEQ ID NO: 3450180 - RNA, 18 nt, Human
gguguuucuagcacuggc

SEQ ID NO: 3450181 - RNA, 20 nt, Human
gguguuugaaaauaguuuau

SEQ ID NO: 3450182 - RNA, 17 nt, Human
gguguuuuaaaaaaucu

SEQ ID NO: 3450183 - RNA, 22 nt, Human
gguguuuuucuuguaaaugugu

SEQ ID NO: 3450184 - RNA, 21 nt, Human
gaauaaaauguugaaaaguca

SEQ ID NO: 3450185 - RNA, 23 nt, Human
gaauaaaauguugaaaagucaaa

SEQ ID NO: 3450186 - RNA, 17 nt, Human
gaauaaaauuauuuugg

SEQ ID NO: 3450187 - RNA, 14 nt, Human
gaauaaacaccacu

SEQ ID NO: 3450188 - RNA, 11 nt, Human
gaauaaacuuc

SEQ ID NO: 3450189 - RNA, 16 nt, Human
gaauaaacuucagcac

SEQ ID NO: 3450190 - RNA, 18 nt, Human
gaauaaagaauacuugaa

SEQ ID NO: 3450191 - RNA, 17 nt, Human
gaauaaaggcaguuuuc

SEQ ID NO: 3450192 - RNA, 20 nt, Human
gaauaaaggcaguuuucuaa

SEQ ID NO: 3450193 - RNA, 16 nt, Human
gaauaaaguugaagcu

SEQ ID NO: 3450194 - RNA, 22 nt, Human
gaauaaauaaauguaucuuauu

SEQ ID NO: 3450195 - RNA, 11 nt, Human
gaauaaauaug

SEQ ID NO: 3450196 - RNA, 12 nt, Human
gaauaaauaugc

SEQ ID NO: 3450197 - RNA, 16 nt, Human
gaauaaauaugccucu

SEQ ID NO: 3450198 - RNA, 15 nt, Human
gaauaaaugucacuu

SEQ ID NO: 3450199 - RNA, 18 nt, Human
gaauaaaugucacuuuuu

SEQ ID NO: 3450200 - RNA, 20 nt, Human
gaauaaauucccaacuucuc

SEQ ID NO: 3450201 - RNA, 16 nt, Human
gaauaaauugauuuuu

SEQ ID NO: 3450202 - RNA, 15 nt, Human
gaauaaauugcuccu

SEQ ID NO: 3450203 - RNA, 23 nt, Human
gaauaaccacuuaaaaaaugucc

SEQ ID NO: 3450204 - RNA, 15 nt, Human
gaauaacuagcacca

SEQ ID NO: 3450205 - RNA, 11 nt, Human
gaauaagaaaa

SEQ ID NO: 3450206 - RNA, 17 nt, Human
gaauaagaaaguuucac

SEQ ID NO: 3450207 - RNA, 15 nt, Human
gaauaagaauuugca

SEQ ID NO: 3450208 - RNA, 17 nt, Human
gaauaagaauuugcaua

SEQ ID NO: 3450209 - RNA, 17 nt, Human
gaauaagcacuuuuuaa

SEQ ID NO: 3450210 - RNA, 17 nt, Human
gaauaagguacaagaag

SEQ ID NO: 3450211 - RNA, 20 nt, Human
gaauaagugccaggauggaa

SEQ ID NO: 3450212 - RNA, 12 nt, Human
gaauaaguuauu

SEQ ID NO: 3450213 - RNA, 14 nt, Human
gaauaaguuauugc

SEQ ID NO: 3450214 - RNA, 19 nt, Human
gaauaauaaaaguauauau

SEQ ID NO: 3450215 - RNA, 21 nt, Human
gaauaauaaaaguauauauau

SEQ ID NO: 3450216 - RNA, 16 nt, Human
gaauaauaaauauuua

SEQ ID NO: 3450217 - RNA, 22 nt, Human
gaauaauaauuagguuaacauu

SEQ ID NO: 3450218 - RNA, 17 nt, Human
gaauaauacaguaucuc

SEQ ID NO: 3450219 - RNA, 16 nt, Human
gaauaauacauugaau

SEQ ID NO: 3450220 - RNA, 15 nt, Human
gaauaauagaagaac

SEQ ID NO: 3450221 - RNA, 19 nt, Human
gaauaauaugcugccaaau

SEQ ID NO: 3450222 - RNA, 18 nt, Human
gaauaaucacgcuuuccu

SEQ ID NO: 3450223 - RNA, 20 nt, Human
gaauaauccuaaacauauga

SEQ ID NO: 3450224 - RNA, 15 nt, Human
gaauaaucuuugggu

SEQ ID NO: 3450225 - RNA, 22 nt, Human
gaauaaucuuuggguaacuuca

SEQ ID NO: 3450226 - RNA, 17 nt, Human
gaauaaugccuuuguaa

SEQ ID NO: 3450227 - RNA, 14 nt, Human
gaauaauuacagug

SEQ ID NO: 3450228 - RNA, 13 nt, Human
gaauaauuauuua

SEQ ID NO: 3450229 - RNA, 20 nt, Human
gaauaauuauuuauuuaaua

SEQ ID NO: 3450230 - RNA, 16 nt, Human
gaauaauucuuugauu

SEQ ID NO: 3450231 - RNA, 19 nt, Human
gaauaauuuauaguaauga

SEQ ID NO: 3450232 - RNA, 21 nt, Human
gaauaauuuauaguaaugagu

SEQ ID NO: 3450233 - RNA, 21 nt, Human
gaauaauuucccaauuaggaa

SEQ ID NO: 3450234 - RNA, 16 nt, Human
gaauacaaacauauuu

SEQ ID NO: 3450235 - RNA, 12 nt, Human
gaauacagcagc

SEQ ID NO: 3450236 - RNA, 20 nt, Human
gaauacagcagcaagaaaaa

SEQ ID NO: 3450237 - RNA, 13 nt, Human
gaauacaguguua

SEQ ID NO: 3450238 - RNA, 21 nt, Human
gaauaccacucuguaauugca

SEQ ID NO: 3450239 - RNA, 21 nt, Human
gaauaccccaagacucccaug

SEQ ID NO: 3450240 - RNA, 19 nt, Human
gaauaccucuuugaaagaa

SEQ ID NO: 3450241 - RNA, 13 nt, Human
gaauaccuguccc

SEQ ID NO: 3450242 - RNA, 17 nt, Human
gaauaccuuagugcagu

SEQ ID NO: 3450243 - RNA, 20 nt, Human
gaauaccuuagugcaguuau

SEQ ID NO: 3450244 - RNA, 19 nt, Human
gaauacucagggaaagcau

SEQ ID NO: 3450245 - RNA, 20 nt, Human
gaauacucuuauaucuauau

SEQ ID NO: 3450246 - RNA, 22 nt, Human
gaauacugaacaucugaguccu

SEQ ID NO: 3450247 - RNA, 16 nt, Human
gaauacugauggaauu

SEQ ID NO: 3450248 - RNA, 14 nt, Human
gaauacugcuugaa

SEQ ID NO: 3450249 - RNA, 12 nt, Human
gaauacuugaac

SEQ ID NO: 3450250 - RNA, 15 nt, Human
gaauacuugaacuug

SEQ ID NO: 3450251 - RNA, 20 nt, Human
gaauacuuugaauguguuuc

SEQ ID NO: 3450252 - RNA, 24 nt, Human
gaauacuuugcagcacagcugaga

SEQ ID NO: 3450253 - RNA, 23 nt, Human
gaauagaaauaaaggaugugauu

SEQ ID NO: 3450254 - RNA, 18 nt, Human
gaauagaagcuaagguuu

SEQ ID NO: 3450255 - RNA, 20 nt, Human
gaauagaaggaaacuagcuu

SEQ ID NO: 3450256 - RNA, 19 nt, Human
gaauagcaaggugcucaca

SEQ ID NO: 3450257 - RNA, 20 nt, Human
gaauagcaucuguacaaagg

SEQ ID NO: 3450258 - RNA, 23 nt, Human
gaauagccacauuuggaauacuu

SEQ ID NO: 3450259 - RNA, 17 nt, Human
gaauagccuagauauga

SEQ ID NO: 3450260 - RNA, 18 nt, Human
gaauaggacuuguuuuug

SEQ ID NO: 3450261 - RNA, 20 nt, Human
gaauaggcauuaacacaaag

SEQ ID NO: 3450262 - RNA, 23 nt, Human
gaauaggcgaucacaacgugcau

SEQ ID NO: 3450263 - RNA, 19 nt, Human
gaauagggcuaggaauaua

SEQ ID NO: 3450264 - RNA, 17 nt, Human
gaauaguauccuccagg

SEQ ID NO: 3450265 - RNA, 23 nt, Human
gaauagucuagauggcuccucuc

SEQ ID NO: 3450266 - RNA, 13 nt, Human
gaauauaaacacu

SEQ ID NO: 3450267 - RNA, 23 nt, Human
gggcaguucgcagccacccugag

SEQ ID NO: 3450268 - RNA, 14 nt, Human
gggcauaaauuauu

SEQ ID NO: 3450269 - RNA, 19 nt, Human
gggcauccauaccagcucg

SEQ ID NO: 3450270 - RNA, 14 nt, Human
gggcauccaugggg

SEQ ID NO: 3450271 - RNA, 14 nt, Human
gggcaucuccagga

SEQ ID NO: 3450272 - RNA, 16 nt, Human
gggcaucuugcuggcu

SEQ ID NO: 3450273 - RNA, 22 nt, Human
gggcaugagggguuccuccccu

SEQ ID NO: 3450274 - RNA, 16 nt, Human
gggcaugccccggcca

SEQ ID NO: 3450275 - RNA, 22 nt, Human
gggcaugccccggccaccucug

SEQ ID NO: 3450276 - RNA, 23 nt, Human
gggcaugccccggccaccucugc

SEQ ID NO: 3450277 - RNA, 14 nt, Human
gggcaugccuugug

SEQ ID NO: 3450278 - RNA, 17 nt, Human
gggcaugcuggggcaag

SEQ ID NO: 3450279 - RNA, 16 nt, Human
gggcauggccagcagc

SEQ ID NO: 3450280 - RNA, 20 nt, Human
gggcauggccagguggccac

SEQ ID NO: 3450281 - RNA, 15 nt, Human
gggcauggggugggc

SEQ ID NO: 3450282 - RNA, 17 nt, Human
gggcauggggugggccu

SEQ ID NO: 3450283 - RNA, 19 nt, Human
gggcaugguguucuccugc

SEQ ID NO: 3450284 - RNA, 20 nt, Human
gggcauguauuggccuggag

SEQ ID NO: 3450285 - RNA, 13 nt, Human
gggcauucucucu

SEQ ID NO: 3450286 - RNA, 18 nt, Human
gggcauugauggggaagg

SEQ ID NO: 3450287 - RNA, 14 nt, Human
gggcauugcuuucc

SEQ ID NO: 3450288 - RNA, 21 nt, Human
gggcauuucuugcgagccucg

SEQ ID NO: 3450289 - RNA, 14 nt, Human
gggccaaagaaaca

SEQ ID NO: 3450290 - RNA, 21 nt, Human
gggccaaauccgcucucuucc

SEQ ID NO: 3450291 - RNA, 23 nt, Human
gggccaaauccgcucucuuccug

SEQ ID NO: 3450292 - RNA, 11 nt, Human
gggccaacacc

SEQ ID NO: 3450293 - RNA, 23 nt, Human
gggccaacuugagggcccagagc

SEQ ID NO: 3450294 - RNA, 13 nt, Human
gggccaagaaaga

SEQ ID NO: 3450295 - RNA, 19 nt, Human
gggccacagggcgagacuc

SEQ ID NO: 3450296 - RNA, 19 nt, Human
gggccacauagaugcugau

SEQ ID NO: 3450297 - RNA, 19 nt, Human
gggccaccgccuugcccag

SEQ ID NO: 3450298 - RNA, 13 nt, Human
gggccaccugccu

SEQ ID NO: 3450299 - RNA, 14 nt, Human
gggccaccugccug

SEQ ID NO: 3450300 - RNA, 15 nt, Human
gggccaccugccugc

SEQ ID NO: 3450301 - RNA, 12 nt, Human
gggccacuccuu

SEQ ID NO: 3450302 - RNA, 19 nt, Human
gggccacuccuuccugccc

SEQ ID NO: 3450303 - RNA, 16 nt, Human
gggccacucugccucu

SEQ ID NO: 3450304 - RNA, 22 nt, Human
gggccacugguccccaacaaug

SEQ ID NO: 3450305 - RNA, 20 nt, Human
gggccacugugguggcagug

SEQ ID NO: 3450306 - RNA, 16 nt, Human
gggccagacaugccac

SEQ ID NO: 3450307 - RNA, 13 nt, Human
gggccagagccag

SEQ ID NO: 3450308 - RNA, 12 nt, Human
gggccagaggcu

SEQ ID NO: 3450309 - RNA, 13 nt, Human
gggccagccaggc

SEQ ID NO: 3450310 - RNA, 17 nt, Human
gggccagccaggcgggc

SEQ ID NO: 3450311 - RNA, 22 nt, Human
gggccagccaggcgggcucaag

SEQ ID NO: 3450312 - RNA, 17 nt, Human
gggccagccccucccac

SEQ ID NO: 3450313 - RNA, 12 nt, Human
gggccagccucu

SEQ ID NO: 3450314 - RNA, 11 nt, Human
gggccagcucc

SEQ ID NO: 3450315 - RNA, 17 nt, Human
gggccaggacugagccc

SEQ ID NO: 3450316 - RNA, 11 nt, Human
gggccaggcag

SEQ ID NO: 3450317 - RNA, 23 nt, Human
gggccaggccgggccuguacagu

SEQ ID NO: 3450318 - RNA, 15 nt, Human
gggccaggcuggguc

SEQ ID NO: 3450319 - RNA, 13 nt, Human
gggccagggcccu

SEQ ID NO: 3450320 - RNA, 18 nt, Human
gggccagggcccugcaga

SEQ ID NO: 3450321 - RNA, 13 nt, Human
gggccagggcugc

SEQ ID NO: 3450322 - RNA, 16 nt, Human
gggccagggcugcccc

SEQ ID NO: 3450323 - RNA, 22 nt, Human
gggccaguccugccuggccagg

SEQ ID NO: 3450324 - RNA, 16 nt, Human
gggccagucugggcug

SEQ ID NO: 3450325 - RNA, 20 nt, Human
gggccagucugggcugccgg

SEQ ID NO: 3450326 - RNA, 22 nt, Human
gggccagucuguggaucagaga

SEQ ID NO: 3450327 - RNA, 14 nt, Human
gggccagugcucca

SEQ ID NO: 3450328 - RNA, 18 nt, Human
gggccagugcuccagcca

SEQ ID NO: 3450329 - RNA, 17 nt, Human
gggccaguggggccugu

SEQ ID NO: 3450330 - RNA, 20 nt, Human
gggccaguggggccugugga

SEQ ID NO: 3450331 - RNA, 14 nt, Human
gggccaguuggucc

SEQ ID NO: 3450332 - RNA, 18 nt, Human
gggccaguuggucccccu

SEQ ID NO: 3450333 - RNA, 16 nt, Human
gggccauacuggccuc

SEQ ID NO: 3450334 - RNA, 17 nt, Human
gggccauccugucccac

SEQ ID NO: 3450335 - RNA, 18 nt, Human
gggccaugagcuccagac

SEQ ID NO: 3450336 - RNA, 23 nt, Human
gggccaugauggcaacagaucug

SEQ ID NO: 3450337 - RNA, 20 nt, Human
gggccaugcugaggccuggg

SEQ ID NO: 3450338 - RNA, 19 nt, Human
gggccauggcucagggugg

SEQ ID NO: 3450339 - RNA, 14 nt, Human
gggccauguccaaa

SEQ ID NO: 3450340 - RNA, 16 nt, Human
gggccauucuccacag

SEQ ID NO: 3450341 - RNA, 13 nt, Human
gggcccaaaggcc

SEQ ID NO: 3450342 - RNA, 19 nt, Human
gggcccaagacagaugccc

SEQ ID NO: 3450343 - RNA, 19 nt, Human
gggcccaaggcggccccuc

SEQ ID NO: 3450344 - RNA, 22 nt, Human
gguuucuaaagcugccagccga

SEQ ID NO: 3450345 - RNA, 12 nt, Human
gguuucuagcau

SEQ ID NO: 3450346 - RNA, 20 nt, Human
gguuucucucuacagugcca

SEQ ID NO: 3450347 - RNA, 14 nt, Human
gguuucugauucuu

SEQ ID NO: 3450348 - RNA, 14 nt, Human
gguuucugcccugc

SEQ ID NO: 3450349 - RNA, 15 nt, Human
gguuucugcccugcc

SEQ ID NO: 3450350 - RNA, 15 nt, Human
gguuucuuucagauu

SEQ ID NO: 3450351 - RNA, 15 nt, Human
gguuucuuuuuaagu

SEQ ID NO: 3450352 - RNA, 15 nt, Human
gguuugaauauaaac

SEQ ID NO: 3450353 - RNA, 22 nt, Human
gguuugacuccgcuggaggugg

SEQ ID NO: 3450354 - RNA, 12 nt, Human
gguuugagaaau

SEQ ID NO: 3450355 - RNA, 18 nt, Human
gguuugcagaugacaaaa

SEQ ID NO: 3450356 - RNA, 21 nt, Human
gguuugccgguggugcaggua

SEQ ID NO: 3450357 - RNA, 16 nt, Human
gguuugccugagggcg

SEQ ID NO: 3450358 - RNA, 12 nt, Human
gguuuggacccc

SEQ ID NO: 3450359 - RNA, 17 nt, Human
gguuuggcgggccaagg

SEQ ID NO: 3450360 - RNA, 19 nt, Human
gguuugguuuuguuuuuug

SEQ ID NO: 3450361 - RNA, 13 nt, Human
gguuuguauauug

SEQ ID NO: 3450362 - RNA, 14 nt, Human
gguuuguguucuuc

SEQ ID NO: 3450363 - RNA, 19 nt, Human
gguuuguguuugaguuuua

SEQ ID NO: 3450364 - RNA, 16 nt, Human
gguuuuaaagugauua

SEQ ID NO: 3450365 - RNA, 15 nt, Human
gguuuuaacuuuguu

SEQ ID NO: 3450366 - RNA, 15 nt, Human
gguuuuagguucuaa

SEQ ID NO: 3450367 - RNA, 15 nt, Human
gguuuuauauuuuua

SEQ ID NO: 3450368 - RNA, 11 nt, Human
gguuuuaugau

SEQ ID NO: 3450369 - RNA, 19 nt, Human
gguuuuauuguuuaaaauc

SEQ ID NO: 3450370 - RNA, 21 nt, Human
gguuuuccaaucauuugacua

SEQ ID NO: 3450371 - RNA, 10 nt, Human
gguuuuccug

SEQ ID NO: 3450372 - RNA, 14 nt, Human
gguuuucuggaugg

SEQ ID NO: 3450373 - RNA, 12 nt, Human
gguuuucuguuu

SEQ ID NO: 3450374 - RNA, 14 nt, Human
gguuuucuucccau

SEQ ID NO: 3450375 - RNA, 19 nt, Human
gguuuugcuauuagacugu

SEQ ID NO: 3450376 - RNA, 20 nt, Human
gguuuuguaauuuguuugaa

SEQ ID NO: 3450377 - RNA, 13 nt, Human
gguuuugugccau

SEQ ID NO: 3450378 - RNA, 14 nt, Human
gguuuuguuccccu

SEQ ID NO: 3450379 - RNA, 18 nt, Human
gguuuuuaaauuuuguaa

SEQ ID NO: 3450380 - RNA, 17 nt, Human
gguuuuuacuuaacugu

SEQ ID NO: 3450381 - RNA, 15 nt, Human
gguuuuuauuaguac

SEQ ID NO: 3450382 - RNA, 14 nt, Human
gguuuuuauuuccu

SEQ ID NO: 3450383 - RNA, 18 nt, Human
gguuuuuauuucuccuuu

SEQ ID NO: 3450384 - RNA, 13 nt, Human
gguuuuucaauua

SEQ ID NO: 3450385 - RNA, 14 nt, Human
gguuuuucaauuaa

SEQ ID NO: 3450386 - RNA, 18 nt, Human
gguuuuucaauuaaacgg

SEQ ID NO: 3450387 - RNA, 12 nt, Human
gguuuuucccug

SEQ ID NO: 3450388 - RNA, 20 nt, Human
gguuuuuggacuucuggggu

SEQ ID NO: 3450389 - RNA, 14 nt, Human
gguuuuuuaguuga

SEQ ID NO: 3450390 - RNA, 22 nt, Human
guaaaaaaaaaaaaaagcaaca

SEQ ID NO: 3450391 - RNA, 18 nt, Human
guaaaaaaaaaaaaguua

SEQ ID NO: 3450392 - RNA, 19 nt, Human
guaaaaaaaaaaacaauua

SEQ ID NO: 3450393 - RNA, 13 nt, Human
guaaaaaaaaaug

SEQ ID NO: 3450394 - RNA, 16 nt, Human
guaaaaaaugguguuu

SEQ ID NO: 3450395 - RNA, 22 nt, Human
guaaaaacacugaaaaauuaua

SEQ ID NO: 3450396 - RNA, 12 nt, Human
guaaaaagaaaa

SEQ ID NO: 3450397 - RNA, 18 nt, Human
guaaaaauaaccuugcag

SEQ ID NO: 3450398 - RNA, 15 nt, Human
guaaaaaugauuuca

SEQ ID NO: 3450399 - RNA, 19 nt, Human
guaaaaauuaaaaguuaug

SEQ ID NO: 3450400 - RNA, 19 nt, Human
guaaaacaaacaauaccug

SEQ ID NO: 3450401 - RNA, 13 nt, Human
guaaaacacagag

SEQ ID NO: 3450402 - RNA, 14 nt, Human
guaaaacacagagg

SEQ ID NO: 3450403 - RNA, 18 nt, Human
guaaaaccacagcaguug

SEQ ID NO: 3450404 - RNA, 23 nt, Human
guaaaaccacagcaguugaaaag

SEQ ID NO: 3450405 - RNA, 21 nt, Human
guaaaacuacacaucccuaau

SEQ ID NO: 3450406 - RNA, 15 nt, Human
guaaaacugaggcac

SEQ ID NO: 3450407 - RNA, 15 nt, Human
guaaaacuuuauuuu

SEQ ID NO: 3450408 - RNA, 19 nt, Human
guaaaagcagcauaaagaa

SEQ ID NO: 3450409 - RNA, 17 nt, Human
guaaaagguauuaaauu

SEQ ID NO: 3450410 - RNA, 19 nt, Human
guaaaauaaauauugucuu

SEQ ID NO: 3450411 - RNA, 21 nt, Human
guaaaauauagcuguacaaau

SEQ ID NO: 3450412 - RNA, 18 nt, Human
guaaaauauuuugaauca

SEQ ID NO: 3450413 - RNA, 22 nt, Human
gacacagcucuucuccaggcug

SEQ ID NO: 3450414 - RNA, 22 nt, Human
gacacagcuuuaucaccagaga

SEQ ID NO: 3450415 - RNA, 23 nt, Human
gacacagcuuuaucaccagagag

SEQ ID NO: 3450416 - RNA, 18 nt, Human
gacacaggaaaccaacac

SEQ ID NO: 3450417 - RNA, 16 nt, Human
gacacaggaugaagca

SEQ ID NO: 3450418 - RNA, 17 nt, Human
gacacaggcccggcucc

SEQ ID NO: 3450419 - RNA, 13 nt, Human
gacacaggccugu

SEQ ID NO: 3450420 - RNA, 16 nt, Human
gacacaggccugugua

SEQ ID NO: 3450421 - RNA, 19 nt, Human
gacacagggacuugaaguu

SEQ ID NO: 3450422 - RNA, 21 nt, Human
gacacagggacuugaaguugu

SEQ ID NO: 3450423 - RNA, 15 nt, Human
gacacaguuccuggg

SEQ ID NO: 3450424 - RNA, 16 nt, Human
gacacaguuccuggga

SEQ ID NO: 3450425 - RNA, 15 nt, Human
gacacauaugagggg

SEQ ID NO: 3450426 - RNA, 16 nt, Human
gacacauaugaggggg

SEQ ID NO: 3450427 - RNA, 22 nt, Human
gacacauaugcaccuugugucu

SEQ ID NO: 3450428 - RNA, 21 nt, Human
gacacaugaagguaaauaaaa

SEQ ID NO: 3450429 - RNA, 20 nt, Human
gacacauguccaagaagccc

SEQ ID NO: 3450430 - RNA, 15 nt, Human
gacacauuuaaggau

SEQ ID NO: 3450431 - RNA, 23 nt, Human
gacacauuuaagguguaguauua

SEQ ID NO: 3450432 - RNA, 19 nt, Human
gacacauuuuuuaggaaau

SEQ ID NO: 3450433 - RNA, 23 nt, Human
gacaccaaccgacaggcccuggc

SEQ ID NO: 3450434 - RNA, 16 nt, Human
gacaccacacccagcc

SEQ ID NO: 3450435 - RNA, 19 nt, Human
gacaccacacccagccuca

SEQ ID NO: 3450436 - RNA, 12 nt, Human
gacaccagagca

SEQ ID NO: 3450437 - RNA, 15 nt, Human
gacaccagagcagau

SEQ ID NO: 3450438 - RNA, 19 nt, Human
gacaccagccaggcucugu

SEQ ID NO: 3450439 - RNA, 20 nt, Human
gacaccagccuuucucccag

SEQ ID NO: 3450440 - RNA, 23 nt, Human
gacaccauuaccaaaauaauaaa

SEQ ID NO: 3450441 - RNA, 18 nt, Human
gacaccauuggaccccac

SEQ ID NO: 3450442 - RNA, 14 nt, Human
gacacccaaagggu

SEQ ID NO: 3450443 - RNA, 13 nt, Human
gacacccaggacu

SEQ ID NO: 3450444 - RNA, 15 nt, Human
gacacccauuuucac

SEQ ID NO: 3450445 - RNA, 11 nt, Human
gacaccccacu

SEQ ID NO: 3450446 - RNA, 19 nt, Human
gacacccgugagcgccugu

SEQ ID NO: 3450447 - RNA, 23 nt, Human
gacacccugugauggggcccugc

SEQ ID NO: 3450448 - RNA, 15 nt, Human
gacacccuucuccca

SEQ ID NO: 3450449 - RNA, 19 nt, Human
gacaccggcuggcagggcu

SEQ ID NO: 3450450 - RNA, 17 nt, Human
gacaccuacugaguggc

SEQ ID NO: 3450451 - RNA, 13 nt, Human
gacaccucagagc

SEQ ID NO: 3450452 - RNA, 9 nt, Human
gacaccugc

SEQ ID NO: 3450453 - RNA, 16 nt, Human
gacaccugcaccuccc

SEQ ID NO: 3450454 - RNA, 19 nt, Human
gacaccugcaccucccccc

SEQ ID NO: 3450455 - RNA, 15 nt, Human
gacaccugcccugcc

SEQ ID NO: 3450456 - RNA, 18 nt, Human
gacaccugggagaaaucu

SEQ ID NO: 3450457 - RNA, 20 nt, Human
gacaccuguacuggagagca

SEQ ID NO: 3450458 - RNA, 15 nt, Human
gacaccuugacaggg

SEQ ID NO: 3450459 - RNA, 14 nt, Human
gacaccuuggacau

SEQ ID NO: 3450460 - RNA, 15 nt, Human
gacacgaauauugcu

SEQ ID NO: 3450461 - RNA, 18 nt, Human
gacacgaauauugcugau

SEQ ID NO: 3450462 - RNA, 20 nt, Human
gacacggaucugagaaucuu

SEQ ID NO: 3450463 - RNA, 20 nt, Human
gacacgggcagccuggcucc

SEQ ID NO: 3450464 - RNA, 19 nt, Human
gacacgggccuguccacag

SEQ ID NO: 3450465 - RNA, 22 nt, Human
gacacggucggggcaucuggcc

SEQ ID NO: 3450466 - RNA, 21 nt, Human
gacacguguggcgggcagugg

SEQ ID NO: 3450467 - RNA, 16 nt, Human
gacacuaaccacgcug

SEQ ID NO: 3450468 - RNA, 15 nt, Human
gacacuaacgacuuc

SEQ ID NO: 3450469 - RNA, 17 nt, Human
gacacuaaguuauagua

SEQ ID NO: 3450470 - RNA, 18 nt, Human
gacacuacacccagcaau

SEQ ID NO: 3450471 - RNA, 14 nt, Human
gacacuagaaaacu

SEQ ID NO: 3450472 - RNA, 20 nt, Human
gacacuauaguuuaaaacac

SEQ ID NO: 3450473 - RNA, 23 nt, Human
gacacuauaguuuaaaacacauu

SEQ ID NO: 3450474 - RNA, 15 nt, Human
gacacucagaccuga

SEQ ID NO: 3450475 - RNA, 21 nt, Human
gacacuccccgaagucuuuug

SEQ ID NO: 3450476 - RNA, 15 nt, Human
gacacucccuugggc

SEQ ID NO: 3450477 - RNA, 21 nt, Human
gacacucuauaagauuccaaa

SEQ ID NO: 3450478 - RNA, 14 nt, Human
gacacucuccuugc

SEQ ID NO: 3450479 - RNA, 17 nt, Human
gacacucucuggaagcc

SEQ ID NO: 3450480 - RNA, 15 nt, Human
gacacucugcucugc

SEQ ID NO: 3450481 - RNA, 19 nt, Human
gacacugaaaguuuuguaa

SEQ ID NO: 3450482 - RNA, 16 nt, Human
gacacugccacacagg

SEQ ID NO: 3450483 - RNA, 19 nt, Human
gacacugcggggcuuggcu

SEQ ID NO: 3450484 - RNA, 22 nt, Human
gacacugcggggcuuggcugag

SEQ ID NO: 3450485 - RNA, 13 nt, Human
gacacugcuggag

SEQ ID NO: 3450486 - RNA, 12 nt, Human
gacacuggcaug

SEQ ID NO: 3450487 - RNA, 13 nt, Human
gacacuggccccu

SEQ ID NO: 3450488 - RNA, 15 nt, Human
gacacuggccccuca

SEQ ID NO: 3450489 - RNA, 23 nt, Human
gacacuggcucauauuccugcag

SEQ ID NO: 3450490 - RNA, 17 nt, Human
gacacuggcugccagcu

SEQ ID NO: 3450491 - RNA, 22 nt, Human
gacacuggcugccagcuauuuu

SEQ ID NO: 3450492 - RNA, 23 nt, Human
gacacugggaggccagugagcca

SEQ ID NO: 3450493 - RNA, 19 nt, Human
gacacugguauuccugccu

SEQ ID NO: 3450494 - RNA, 23 nt, Human
gacacugguuuacacuuuaugcc

SEQ ID NO: 3450495 - RNA, 18 nt, Human
gacacuguucuuagcuca

SEQ ID NO: 3450496 - RNA, 18 nt, Human
gacacuguugauaaaaac

SEQ ID NO: 3450497 - RNA, 22 nt, Human
gacacuguuuacaagaaaaaau

SEQ ID NO: 3450498 - RNA, 19 nt, Human
gacacuucacgcccuuggc

SEQ ID NO: 3450499 - RNA, 18 nt, Human
gacacuucagagagcugg

SEQ ID NO: 3450500 - RNA, 17 nt, Human
gacacuucccucuguuu

SEQ ID NO: 3450501 - RNA, 18 nt, Human
gacacuucccucuguuuc

SEQ ID NO: 3450502 - RNA, 20 nt, Human
gacacuucccucuguuucuc

SEQ ID NO: 3450503 - RNA, 20 nt, Human
gacacuuccgucacauccca

SEQ ID NO: 3450504 - RNA, 22 nt, Human
gacacuugccuucuucacccag

SEQ ID NO: 3450505 - RNA, 23 nt, Human
gacacuugccuucuucacccagc

SEQ ID NO: 3450506 - RNA, 23 nt, Human
gacacuuuaauuaccaaccuguu

SEQ ID NO: 3450507 - RNA, 15 nt, Human
gacacuuugaaaugu

SEQ ID NO: 3450508 - RNA, 22 nt, Human
gacacuuugaaauguguuucug

SEQ ID NO: 3450509 - RNA, 21 nt, Human
gacacuuuucauaucauuucu

SEQ ID NO: 3450510 - RNA, 13 nt, Human
gacagaaaauaug

SEQ ID NO: 3450511 - RNA, 17 nt, Human
gacagaaaauauguauu

SEQ ID NO: 3450512 - RNA, 14 nt, Human
gacagaaagcagaa

SEQ ID NO: 3450513 - RNA, 22 nt, Human
gacagaaaggagaguggccauu

SEQ ID NO: 3450514 - RNA, 15 nt, Human
gacagaacacugucu

SEQ ID NO: 3450515 - RNA, 20 nt, Human
gacagaaccccuacaugaaa

SEQ ID NO: 3450516 - RNA, 18 nt, Human
gacagaacuugaaugugu

SEQ ID NO: 3450517 - RNA, 16 nt, Human
gacagaagcagcucuu

SEQ ID NO: 3450518 - RNA, 15 nt, Human
gacagaagcaggcug

SEQ ID NO: 3450519 - RNA, 16 nt, Human
gacagaagcaggcugg

SEQ ID NO: 3450520 - RNA, 17 nt, Human
gacagaagcaggcugga

SEQ ID NO: 3450521 - RNA, 16 nt, Human
gacagaauauguuuca

SEQ ID NO: 3450522 - RNA, 20 nt, Human
gacagaauguaucugugaag

SEQ ID NO: 3450523 - RNA, 13 nt, Human
gacagacacacac

SEQ ID NO: 3450524 - RNA, 16 nt, Human
gacagagaccuccugc

SEQ ID NO: 3450525 - RNA, 21 nt, Human
gacagagagagauacucuggg

SEQ ID NO: 3450526 - RNA, 19 nt, Human
gacagagaggacgugggcg

SEQ ID NO: 3450527 - RNA, 15 nt, Human
gacagagaggacugu

SEQ ID NO: 3450528 - RNA, 19 nt, Human
gacagagaggacuguaggg

SEQ ID NO: 3450529 - RNA, 19 nt, Human
gacagagccccacccucag

SEQ ID NO: 3450530 - RNA, 16 nt, Human
gacagagcccugugag

SEQ ID NO: 3450531 - RNA, 13 nt, Human
gacagagccugcc

SEQ ID NO: 3450532 - RNA, 23 nt, Human
gacagagcgugagcugagcaggc

SEQ ID NO: 3450533 - RNA, 20 nt, Human
gacagagcuacacaggggaa

SEQ ID NO: 3450534 - RNA, 14 nt, Human
gacagaggcagccc

SEQ ID NO: 3450535 - RNA, 23 nt, Human
gacagaggcagccccauucugcc

SEQ ID NO: 3450536 - RNA, 13 nt, Human
gacagaggcccca

SEQ ID NO: 3450537 - RNA, 20 nt, Human
gacagagggaaacacagcag

SEQ ID NO: 3450538 - RNA, 19 nt, Human
gacagaggggacucugggc

SEQ ID NO: 3450539 - RNA, 13 nt, Human
gacagagggggug

SEQ ID NO: 3450540 - RNA, 18 nt, Human
gacagaggggguggccuc

SEQ ID NO: 3450541 - RNA, 22 nt, Human
gacagaggggguggccucccaa

SEQ ID NO: 3450542 - RNA, 14 nt, Human
gacagagucucacu

SEQ ID NO: 3450543 - RNA, 15 nt, Human
gacagauaccuccaa

SEQ ID NO: 3450544 - RNA, 21 nt, Human
gacagauaccuccaacccugc

SEQ ID NO: 3450545 - RNA, 23 nt, Human
gacagauaccuccaacccugccg

SEQ ID NO: 3450546 - RNA, 16 nt, Human
gacagaucaagcugug

SEQ ID NO: 3450547 - RNA, 23 nt, Human
gacagaucaagcugugagacagu

SEQ ID NO: 3450548 - RNA, 18 nt, Human
gacagaucaauggcgcag

SEQ ID NO: 3450549 - RNA, 19 nt, Human
gacagaucucugcuuugga

SEQ ID NO: 3450550 - RNA, 20 nt, Human
gacagaugaaugccguggau

SEQ ID NO: 3450551 - RNA, 16 nt, Human
gacagaugaggcuuuc

SEQ ID NO: 3450552 - RNA, 14 nt, Human
gacagaugccccag

SEQ ID NO: 3450553 - RNA, 20 nt, Human
gacagaugccccagagcugu

SEQ ID NO: 3450554 - RNA, 18 nt, Human
gguagaaugaccuuguaa

SEQ ID NO: 3450555 - RNA, 19 nt, Human
gguagaauguaaagcuugu

SEQ ID NO: 3450556 - RNA, 14 nt, Human
guagccagcaccug

SEQ ID NO: 3450557 - RNA, 21 nt, Human
guagccagccggggcgagugg

SEQ ID NO: 3450558 - RNA, 22 nt, Human
guagccagggggacuagccccu

SEQ ID NO: 3450559 - RNA, 22 nt, Human
guagccaggucccccugcagcu

SEQ ID NO: 3450560 - RNA, 14 nt, Human
guagccaugggacc

SEQ ID NO: 3450561 - RNA, 15 nt, Human
guagccaugggacca

SEQ ID NO: 3450562 - RNA, 21 nt, Human
guagcccacacuugagaggau

SEQ ID NO: 3450563 - RNA, 16 nt, Human
guagcccacucugcuc

SEQ ID NO: 3450564 - RNA, 20 nt, Human
guagcccacucugcucgccu

SEQ ID NO: 3450565 - RNA, 14 nt, Human
guagcccaggcugg

SEQ ID NO: 3450566 - RNA, 15 nt, Human
guagcccaggcugga

SEQ ID NO: 3450567 - RNA, 17 nt, Human
guagcccauccuucccu

SEQ ID NO: 3450568 - RNA, 15 nt, Human
guagcccccucuucc

SEQ ID NO: 3450569 - RNA, 16 nt, Human
ggucccacaucccugg

SEQ ID NO: 3450570 - RNA, 17 nt, Human
ggucccacaucccuggg

SEQ ID NO: 3450571 - RNA, 20 nt, Human
ggucccacaucccugggccu

SEQ ID NO: 3450572 - RNA, 17 nt, Human
ggucccaccccacacac

SEQ ID NO: 3450573 - RNA, 12 nt, Human
ggucccacuucc

SEQ ID NO: 3450574 - RNA, 13 nt, Human
ggucccacuuccc

SEQ ID NO: 3450575 - RNA, 17 nt, Human
ggucccacuuccccucc

SEQ ID NO: 3450576 - RNA, 14 nt, Human
ggucccagcagcug

SEQ ID NO: 3450577 - RNA, 15 nt, Human
ggucccagcucccug

SEQ ID NO: 3450578 - RNA, 20 nt, Human
ggucccagcucccuggcucc

SEQ ID NO: 3450579 - RNA, 22 nt, Human
ggucccagugggaggggcaggc

SEQ ID NO: 3450580 - RNA, 12 nt, Human
ggucccauccag

SEQ ID NO: 3450581 - RNA, 13 nt, Human
ggucccauccagg

SEQ ID NO: 3450582 - RNA, 16 nt, Human
gguccccaccugggac

SEQ ID NO: 3450583 - RNA, 22 nt, Human
ggucccccacucuaaagcaaau

SEQ ID NO: 3450584 - RNA, 13 nt, Human
ggucccccucagc

SEQ ID NO: 3450585 - RNA, 13 nt, Human
ggucccccugcag

SEQ ID NO: 3450586 - RNA, 15 nt, Human
ggucccccugcagcu

SEQ ID NO: 3450587 - RNA, 13 nt, Human
ggucccccuucca

SEQ ID NO: 3450588 - RNA, 21 nt, Human
ggucccgugcagcuucugucc

SEQ ID NO: 3450589 - RNA, 12 nt, Human
ggucccuaauaa

SEQ ID NO: 3450590 - RNA, 16 nt, Human
ggucccuaauaaagcu

SEQ ID NO: 3450591 - RNA, 20 nt, Human
ggucccuccagaaccacccc

SEQ ID NO: 3450592 - RNA, 23 nt, Human
ggucccugauaacaaccuggaga

SEQ ID NO: 3450593 - RNA, 13 nt, Human
ggucccugccuua

SEQ ID NO: 3450594 - RNA, 18 nt, Human
ggucccugguggcagcuc

SEQ ID NO: 3450595 - RNA, 22 nt, Human
ggucccugguggcagcucaccu

SEQ ID NO: 3450596 - RNA, 19 nt, Human
ggucccuugagaccucagc

SEQ ID NO: 3450597 - RNA, 22 nt, Human
gguccgaguguguuucauccuu

SEQ ID NO: 3450598 - RNA, 18 nt, Human
gguccggcagcuucugcc

SEQ ID NO: 3450599 - RNA, 17 nt, Human
gguccgugcuaaggacu

SEQ ID NO: 3450600 - RNA, 18 nt, Human
gguccuaaaagcaaaaua

SEQ ID NO: 3450601 - RNA, 22 nt, Human
gguccuaccaauagauucccca

SEQ ID NO: 3450602 - RNA, 22 nt, Human
gguccuagaggcccuuugcugu

SEQ ID NO: 3450603 - RNA, 16 nt, Human
gguccuaggcuggaag

SEQ ID NO: 3450604 - RNA, 16 nt, Human
gguccuccccucucuu

SEQ ID NO: 3450605 - RNA, 17 nt, Human
gguccuccccucucuug

SEQ ID NO: 3450606 - RNA, 19 nt, Human
gguccuccuccagggacag

SEQ ID NO: 3450607 - RNA, 19 nt, Human
gguccucuucugggccuga

SEQ ID NO: 3450608 - RNA, 15 nt, Human
gguccucuugccucc

SEQ ID NO: 3450609 - RNA, 13 nt, Human
gguccugagaccu

SEQ ID NO: 3450610 - RNA, 15 nt, Human
gguccugagcacugc

SEQ ID NO: 3450611 - RNA, 16 nt, Human
gguccugagcacugcc

SEQ ID NO: 3450612 - RNA, 18 nt, Human
gguccugagcacugccag

SEQ ID NO: 3450613 - RNA, 20 nt, Human
gguccugagcacugccagga

SEQ ID NO: 3450614 - RNA, 17 nt, Human
gguccugagggucccca

SEQ ID NO: 3450615 - RNA, 19 nt, Human
gguccugcagucuggcuga

SEQ ID NO: 3450616 - RNA, 12 nt, Human
gguccugcugca

SEQ ID NO: 3450617 - RNA, 14 nt, Human
gguccugcugcagu

SEQ ID NO: 3450618 - RNA, 12 nt, Human
gguccuggccau

SEQ ID NO: 3450619 - RNA, 14 nt, Human
gguccuggccaucc

SEQ ID NO: 3450620 - RNA, 12 nt, Human
gguccuggcucc

SEQ ID NO: 3450621 - RNA, 14 nt, Human
gguccuggcuccug

SEQ ID NO: 3450622 - RNA, 12 nt, Human
gguccuggggcc

SEQ ID NO: 3450623 - RNA, 12 nt, Human
gguccuggggcu

SEQ ID NO: 3450624 - RNA, 12 nt, Human
gguccuggugcc

SEQ ID NO: 3450625 - RNA, 21 nt, Human
gguccugguggggcagcuccu

SEQ ID NO: 3450626 - RNA, 15 nt, Human
gguccuguccccgca

SEQ ID NO: 3450627 - RNA, 17 nt, Human
gguccugucuccccucu

SEQ ID NO: 3450628 - RNA, 12 nt, Human
gguccuguggca

SEQ ID NO: 3450629 - RNA, 18 nt, Human
gguccuguggcaggcagc

SEQ ID NO: 3450630 - RNA, 21 nt, Human
gguccuguggcaggcagcgcc

SEQ ID NO: 3450631 - RNA, 10 nt, Human
gguccuucaa

SEQ ID NO: 3450632 - RNA, 15 nt, Human
gguccuucccucucc

SEQ ID NO: 3450633 - RNA, 14 nt, Human
gguccuucuccaca

SEQ ID NO: 3450634 - RNA, 16 nt, Human
gguccuuggcccccuu

SEQ ID NO: 3450635 - RNA, 20 nt, Human
gguccuuggugugacccucu

SEQ ID NO: 3450636 - RNA, 13 nt, Human
gguccuuuagaaa

SEQ ID NO: 3450637 - RNA, 22 nt, Human
ggucgaggaguaacaauacaaa

SEQ ID NO: 3450638 - RNA, 12 nt, Human
ggucgcccagga

SEQ ID NO: 3450639 - RNA, 13 nt, Human
ggucgcccaggag

SEQ ID NO: 3450640 - RNA, 18 nt, Human
ggucgcuugggaauuuua

SEQ ID NO: 3450641 - RNA, 13 nt, Human
ggucggaccagcu

SEQ ID NO: 3450642 - RNA, 14 nt, Human
ggucggaccagcuu

SEQ ID NO: 3450643 - RNA, 16 nt, Human
ggucggaggcuuggga

SEQ ID NO: 3450644 - RNA, 15 nt, Human
ggucuaaaaauaaac

SEQ ID NO: 3450645 - RNA, 13 nt, Human
ggucuaacuuuug

SEQ ID NO: 3450646 - RNA, 17 nt, Human
ggucuacacugugcuga

SEQ ID NO: 3450647 - RNA, 21 nt, Human
ggucuagaggccugaaauccu

SEQ ID NO: 3450648 - RNA, 12 nt, Human
ggucuauuucua

SEQ ID NO: 3450649 - RNA, 21 nt, Human
ggucucaaacuccugggcuca

SEQ ID NO: 3450650 - RNA, 23 nt, Human
ggucucaaacuccugggcucagg

SEQ ID NO: 3450651 - RNA, 21 nt, Human
ggucucacccuggaggcaccu

SEQ ID NO: 3450652 - RNA, 19 nt, Human
ggucucaccggcucucacc

SEQ ID NO: 3450653 - RNA, 21 nt, Human
ggucucaccggcucucaccug

SEQ ID NO: 3450654 - RNA, 22 nt, Human
ggucucacuauguugcccaggc

SEQ ID NO: 3450655 - RNA, 22 nt, Human
ggucucacucugucgcccaguc

SEQ ID NO: 3450656 - RNA, 20 nt, Human
ggucucagcagcgaccaccc

SEQ ID NO: 3450657 - RNA, 21 nt, Human
ggucucaggauauccuuauca

SEQ ID NO: 3450658 - RNA, 16 nt, Human
ggucucccacguggga

SEQ ID NO: 3450659 - RNA, 14 nt, Human
ggucucccucuccu

SEQ ID NO: 3450660 - RNA, 15 nt, Human
ggucucccucuccug

SEQ ID NO: 3450661 - RNA, 19 nt, Human
ggucucccucuccugccua

SEQ ID NO: 3450662 - RNA, 22 nt, Human
ggucucccucuccugccuacuc

SEQ ID NO: 3450663 - RNA, 20 nt, Human
ggucucccuucucuacacuc

SEQ ID NO: 3450664 - RNA, 19 nt, Human
ggucuccgaaaugcugucu

SEQ ID NO: 3450665 - RNA, 19 nt, Human
ggucuccucaggaccaggg

SEQ ID NO: 3450666 - RNA, 14 nt, Human
ggucuccuccaccg

SEQ ID NO: 3450667 - RNA, 15 nt, Human
ggucuccugccccca

SEQ ID NO: 3450668 - RNA, 16 nt, Human
ggucuccuuggaaauc

SEQ ID NO: 3450669 - RNA, 20 nt, Human
ggucucgaacuccugaccuu

SEQ ID NO: 3450670 - RNA, 23 nt, Human
ggucucgcugaugcugggcuggg

SEQ ID NO: 3450671 - RNA, 21 nt, Human
ggucucgcuuuguugcccagg

SEQ ID NO: 3450672 - RNA, 19 nt, Human
ggucucggaucaggcuccc

SEQ ID NO: 3450673 - RNA, 17 nt, Human
ggucucgucuuccgucu

SEQ ID NO: 3450674 - RNA, 20 nt, Human
ggucucgucuuccgucuccc

SEQ ID NO: 3450675 - RNA, 17 nt, Human
ggucucuaggcugggga

SEQ ID NO: 3450676 - RNA, 16 nt, Human
ggucucuagugcugug

SEQ ID NO: 3450677 - RNA, 21 nt, Human
ggucucucacagacaggaccc

SEQ ID NO: 3450678 - RNA, 12 nt, Human
ggucucucuuug

SEQ ID NO: 3450679 - RNA, 15 nt, Human
ggucucucuuuggac

SEQ ID NO: 3450680 - RNA, 21 nt, Human
ggucucugccaugaacuggag

SEQ ID NO: 3450681 - RNA, 23 nt, Human
ggucucugccaugaacuggaggc

SEQ ID NO: 3450682 - RNA, 14 nt, Human
ggucucuucuccca

SEQ ID NO: 3450683 - RNA, 21 nt, Human
ggucucuucugaauaaagcaa

SEQ ID NO: 3450684 - RNA, 22 nt, Human
ggucucuucugaauaaagcaau

SEQ ID NO: 3450685 - RNA, 21 nt, Human
ggucucuucuuggggcccagu

SEQ ID NO: 3450686 - RNA, 15 nt, Human
ggucugacccacugc

SEQ ID NO: 3450687 - RNA, 22 nt, Human
ggucugagccacagcagcauuu

SEQ ID NO: 3450688 - RNA, 23 nt, Human
ggucugagccacagcagcauuuu

SEQ ID NO: 3450689 - RNA, 22 nt, Human
ggucugaggggcaacugagucu

SEQ ID NO: 3450690 - RNA, 15 nt, Human
ggucugcaagucaga

SEQ ID NO: 3450691 - RNA, 20 nt, Human
ggucugcaagucagaggaug

SEQ ID NO: 3450692 - RNA, 14 nt, Human
ggucugcucccaag

SEQ ID NO: 3450693 - RNA, 23 nt, Human
ggucugcucccaaggggccugag

SEQ ID NO: 3450694 - RNA, 22 nt, Human
ggucugcucgggcccaggccau

SEQ ID NO: 3450695 - RNA, 19 nt, Human
ggucugcucuuucucugcc

SEQ ID NO: 3450696 - RNA, 22 nt, Human
ggucuggagaagcagugagccg

SEQ ID NO: 3450697 - RNA, 15 nt, Human
ggucuggcagccucc

SEQ ID NO: 3450698 - RNA, 20 nt, Human
ggucuggcugguguuaacag

SEQ ID NO: 3450699 - RNA, 21 nt, Human
ggucugggaggaauggacaga

SEQ ID NO: 3450700 - RNA, 20 nt, Human
ggucugggggcacaagacug

SEQ ID NO: 3450701 - RNA, 17 nt, Human
ggugcuaucucccccag

SEQ ID NO: 3450702 - RNA, 19 nt, Human
ggugcuaucucccccagcc

SEQ ID NO: 3450703 - RNA, 21 nt, Human
ggugcuaucucccccagcccc

SEQ ID NO: 3450704 - RNA, 20 nt, Human
ggugcucaccaugcuuccag

SEQ ID NO: 3450705 - RNA, 16 nt, Human
ggugcucagggcugac

SEQ ID NO: 3450706 - RNA, 15 nt, Human
ggugcuccaggcagg

SEQ ID NO: 3450707 - RNA, 20 nt, Human
ggugcucggagaagagcgca

SEQ ID NO: 3450708 - RNA, 21 nt, Human
ggugcucggagaagagcgcag

SEQ ID NO: 3450709 - RNA, 14 nt, Human
ggugcucucugcca

SEQ ID NO: 3450710 - RNA, 16 nt, Human
ggugcucucuuucugu

SEQ ID NO: 3450711 - RNA, 12 nt, Human
ggugcucugucu

SEQ ID NO: 3450712 - RNA, 20 nt, Human
ggugcugacggccagggaga

SEQ ID NO: 3450713 - RNA, 22 nt, Human
ggugcugaguagaugcgcagcc

SEQ ID NO: 3450714 - RNA, 17 nt, Human
ggugcugccucuaccug

SEQ ID NO: 3450715 - RNA, 16 nt, Human
ggugcugccugaaucc

SEQ ID NO: 3450716 - RNA, 17 nt, Human
ggugcugcuacccuccc

SEQ ID NO: 3450717 - RNA, 14 nt, Human
ggugcugcuucccu

SEQ ID NO: 3450718 - RNA, 22 nt, Human
ggugcuggagcacugggcuccc

SEQ ID NO: 3450719 - RNA, 22 nt, Human
ggugcuggaggugggagcagga

SEQ ID NO: 3450720 - RNA, 16 nt, Human
ggugcuggauauuuuc

SEQ ID NO: 3450721 - RNA, 24 nt, Human
ggugcugggacugagccaguccca

SEQ ID NO: 3450722 - RNA, 19 nt, Human
ggugcugggagaggcagcc

SEQ ID NO: 3450723 - RNA, 11 nt, Human
ggugcugggcc

SEQ ID NO: 3450724 - RNA, 19 nt, Human
gacauccauaaagaagcaa

SEQ ID NO: 3450725 - RNA, 23 nt, Human
gacauccauguuccgagaagaac

SEQ ID NO: 3450726 - RNA, 23 nt, Human
gacauccccccgccaaaagcugc

SEQ ID NO: 3450727 - RNA, 13 nt, Human
gacauccucuucu

SEQ ID NO: 3450728 - RNA, 14 nt, Human
gacauccuguauaa

SEQ ID NO: 3450729 - RNA, 21 nt, Human
gacauccugucaucugagaau

SEQ ID NO: 3450730 - RNA, 15 nt, Human
gacaucggaaaaaua

SEQ ID NO: 3450731 - RNA, 15 nt, Human
gacaucucaggggcc

SEQ ID NO: 3450732 - RNA, 17 nt, Human
gacaucucaggggccag

SEQ ID NO: 3450733 - RNA, 13 nt, Human
gacaucucugcac

SEQ ID NO: 3450734 - RNA, 16 nt, Human
gacaucucuuugaauu

SEQ ID NO: 3450735 - RNA, 18 nt, Human
gacaucuggaaucuggag

SEQ ID NO: 3450736 - RNA, 21 nt, Human
gacaucuucaaagcuugaaga

SEQ ID NO: 3450737 - RNA, 13 nt, Human
gacaucuuucucu

SEQ ID NO: 3450738 - RNA, 23 nt, Human
gacaugaaaauagcaauauucuu

SEQ ID NO: 3450739 - RNA, 13 nt, Human
gacaugaagccac

SEQ ID NO: 3450740 - RNA, 12 nt, Human
gacaugaauaug

SEQ ID NO: 3450741 - RNA, 16 nt, Human
gacaugaaugcacacu

SEQ ID NO: 3450742 - RNA, 14 nt, Human
gacaugaucuucuu

SEQ ID NO: 3450743 - RNA, 13 nt, Human
gacaugaugcuuu

SEQ ID NO: 3450744 - RNA, 19 nt, Human
gacaugaugcuuuuacuga

SEQ ID NO: 3450745 - RNA, 16 nt, Human
gacaugauuuccuuga

SEQ ID NO: 3450746 - RNA, 22 nt, Human
gacaugauuuccuugaaugugg

SEQ ID NO: 3450747 - RNA, 15 nt, Human
gacaugcaauaaaau

SEQ ID NO: 3450748 - RNA, 17 nt, Human
gacaugcaauaaaauuu

SEQ ID NO: 3450749 - RNA, 12 nt, Human
gacaugcacuga

SEQ ID NO: 3450750 - RNA, 19 nt, Human
gacaugcccucccuucucc

SEQ ID NO: 3450751 - RNA, 15 nt, Human
gacaugcgggcuggg

SEQ ID NO: 3450752 - RNA, 17 nt, Human
gacaugcgguagccagc

SEQ ID NO: 3450753 - RNA, 19 nt, Human
gacaugcgguagccagcac

SEQ ID NO: 3450754 - RNA, 22 nt, Human
gacaugcgguagccagcacaca

SEQ ID NO: 3450755 - RNA, 14 nt, Human
gacaugcugaagcc

SEQ ID NO: 3450756 - RNA, 15 nt, Human
gacaugcugaagcca

SEQ ID NO: 3450757 - RNA, 15 nt, Human
gacaugcugacuguc

SEQ ID NO: 3450758 - RNA, 15 nt, Human
gacauggaaaugaag

SEQ ID NO: 3450759 - RNA, 20 nt, Human
gacauggagacuccugcccu

SEQ ID NO: 3450760 - RNA, 22 nt, Human
gacauggagacuccugcccugu

SEQ ID NO: 3450761 - RNA, 16 nt, Human
gacauggagguucuaa

SEQ ID NO: 3450762 - RNA, 19 nt, Human
gacauggagguucuaaggc

SEQ ID NO: 3450763 - RNA, 20 nt, Human
gacauggagguucuaaggcc

SEQ ID NO: 3450764 - RNA, 14 nt, Human
gacauggcuguuca

SEQ ID NO: 3450765 - RNA, 21 nt, Human
gacauggcuugccacagcucu

SEQ ID NO: 3450766 - RNA, 15 nt, Human
gacauggggaggaag

SEQ ID NO: 3450767 - RNA, 20 nt, Human
gacaugggugaacuuacuug

SEQ ID NO: 3450768 - RNA, 23 nt, Human
gacauggugccugagaggcaggc

SEQ ID NO: 3450769 - RNA, 12 nt, Human
gacauguacaga

SEQ ID NO: 3450770 - RNA, 14 nt, Human
gacaugugaaaccu

SEQ ID NO: 3450771 - RNA, 19 nt, Human
gacauguggaaagugaauu

SEQ ID NO: 3450772 - RNA, 18 nt, Human
gacauguuauauauuuuu

SEQ ID NO: 3450773 - RNA, 15 nt, Human
gacauguuguaaauu

SEQ ID NO: 3450774 - RNA, 17 nt, Human
gacauguuuuccgugaa

SEQ ID NO: 3450775 - RNA, 20 nt, Human
gacauguuuugauaaaguag

SEQ ID NO: 3450776 - RNA, 17 nt, Human
gacauuaacaguuuucc

SEQ ID NO: 3450777 - RNA, 19 nt, Human
gacauuaacaguuuuccau

SEQ ID NO: 3450778 - RNA, 23 nt, Human
gacauuaacaguuuuccaugaaa

SEQ ID NO: 3450779 - RNA, 20 nt, Human
gacauuaguaacauaauaaa

SEQ ID NO: 3450780 - RNA, 15 nt, Human
gacauuauagacauu

SEQ ID NO: 3450781 - RNA, 13 nt, Human
gacauuaugugug

SEQ ID NO: 3450782 - RNA, 16 nt, Human
gacauuaugugugcau

SEQ ID NO: 3450783 - RNA, 21 nt, Human
gacauucaccugccccaacuc

SEQ ID NO: 3450784 - RNA, 16 nt, Human
gacauucaugccuggc

SEQ ID NO: 3450785 - RNA, 16 nt, Human
gacauuccaagacagu

SEQ ID NO: 3450786 - RNA, 12 nt, Human
gacauucccugc

SEQ ID NO: 3450787 - RNA, 22 nt, Human
gacauuccuaaacuaucuuuuu

SEQ ID NO: 3450788 - RNA, 17 nt, Human
gacauuccugggcacag

SEQ ID NO: 3450789 - RNA, 23 nt, Human
gacauuccugggcacaguuuggu

SEQ ID NO: 3450790 - RNA, 16 nt, Human
gacauuccuugcugaa

SEQ ID NO: 3450791 - RNA, 20 nt, Human
gacauucucgcuucccugaa

SEQ ID NO: 3450792 - RNA, 15 nt, Human
gacauucugaaugcu

SEQ ID NO: 3450793 - RNA, 19 nt, Human
gacauucugaaugcuucua

SEQ ID NO: 3450794 - RNA, 13 nt, Human
gacauucugauuc

SEQ ID NO: 3450795 - RNA, 23 nt, Human
gacauucugauucgaaugacacu

SEQ ID NO: 3450796 - RNA, 22 nt, Human
gacauucugccaggcccccaag

SEQ ID NO: 3450797 - RNA, 23 nt, Human
gacauugaccuauuuccagaaau

SEQ ID NO: 3450798 - RNA, 14 nt, Human
gacauugacuauuu

SEQ ID NO: 3450799 - RNA, 14 nt, Human
gacauugcggacag

SEQ ID NO: 3450800 - RNA, 15 nt, Human
gacauugcggacagc

SEQ ID NO: 3450801 - RNA, 17 nt, Human
gacauugcggacagcca

SEQ ID NO: 3450802 - RNA, 12 nt, Human
gacauugcuaag

SEQ ID NO: 3450803 - RNA, 23 nt, Human
gacauugcuuuacugucaaaaua

SEQ ID NO: 3450804 - RNA, 13 nt, Human
gacauuggagaug

SEQ ID NO: 3450805 - RNA, 15 nt, Human
gacauugucaauaaa

SEQ ID NO: 3450806 - RNA, 18 nt, Human
gacauuguuaaaauaaag

SEQ ID NO: 3450807 - RNA, 13 nt, Human
gacauuguuuugc

SEQ ID NO: 3450808 - RNA, 20 nt, Human
gacauuguuuugccaacauu

SEQ ID NO: 3450809 - RNA, 21 nt, Human
gacauuguuuugccaacauug

SEQ ID NO: 3450810 - RNA, 14 nt, Human
gacauuuagaagaa

SEQ ID NO: 3450811 - RNA, 13 nt, Human
gacauuucucuaa

SEQ ID NO: 3450812 - RNA, 16 nt, Human
gacauuucucuaagag

SEQ ID NO: 3450813 - RNA, 21 nt, Human
gacauuucucuuacugcaaau

SEQ ID NO: 3450814 - RNA, 17 nt, Human
gacauuucuuuucuuuu

SEQ ID NO: 3450815 - RNA, 17 nt, Human
gacauuugcucauggaa

SEQ ID NO: 3450816 - RNA, 19 nt, Human
gacauuuuaacaagaagau

SEQ ID NO: 3450817 - RNA, 16 nt, Human
gacauuuuaugucuuu

SEQ ID NO: 3450818 - RNA, 15 nt, Human
gacauuuucuucaga

SEQ ID NO: 3450819 - RNA, 15 nt, Human
gacauuuugccaaaa

SEQ ID NO: 3450820 - RNA, 23 nt, Human
gacauuuuuccguuugcuuuugu

SEQ ID NO: 3450821 - RNA, 20 nt, Human
gacauuuuuucagucauaua

SEQ ID NO: 3450822 - RNA, 20 nt, Human
gaccaaaaaccaguauugua

SEQ ID NO: 3450823 - RNA, 13 nt, Human
gaccaaaaucccc

SEQ ID NO: 3450824 - RNA, 21 nt, Human
gaccaaaaugacaaugaugau

SEQ ID NO: 3450825 - RNA, 16 nt, Human
gaccaaagggagucug

SEQ ID NO: 3450826 - RNA, 22 nt, Human
gaccaaauuccuuggcaugccu

SEQ ID NO: 3450827 - RNA, 22 nt, Human
gaccaacauggagaaacccugu

SEQ ID NO: 3450828 - RNA, 16 nt, Human
gaccaacccuguuucc

SEQ ID NO: 3450829 - RNA, 21 nt, Human
gaccaacguuacucagggcuc

SEQ ID NO: 3450830 - RNA, 19 nt, Human
gaccaacuagacauucugu

SEQ ID NO: 3450831 - RNA, 14 nt, Human
gaccaacugggccc

SEQ ID NO: 3450832 - RNA, 19 nt, Human
gaccaacuguguuguauua

SEQ ID NO: 3450833 - RNA, 22 nt, Human
gaccaacuguguuguauuaaca

SEQ ID NO: 3450834 - RNA, 20 nt, Human
gaccaagauggcccauccug

SEQ ID NO: 3450835 - RNA, 16 nt, Human
gaccaagcaggaagcu

SEQ ID NO: 3450836 - RNA, 17 nt, Human
gaccaagcaggaagcuc

SEQ ID NO: 3450837 - RNA, 15 nt, Human
gaccaaggaacaaaa

SEQ ID NO: 3450838 - RNA, 16 nt, Human
gaccaaggaacaaaaa

SEQ ID NO: 3450839 - RNA, 17 nt, Human
gaccaaggaccccucac

SEQ ID NO: 3450840 - RNA, 20 nt, Human
gaccaauaaaauuucuaaga

SEQ ID NO: 3450841 - RNA, 21 nt, Human
gaccaauaaaauuucuaagag

SEQ ID NO: 3450842 - RNA, 18 nt, Human
gaccaauauuguacaguu

SEQ ID NO: 3450843 - RNA, 19 nt, Human
gaccaauauuguacaguuu

SEQ ID NO: 3450844 - RNA, 12 nt, Human
gaccacaccucc

SEQ ID NO: 3450845 - RNA, 16 nt, Human
guaaucuguguacaaa

SEQ ID NO: 3450846 - RNA, 17 nt, Human
guaaucuuuaccuguau

SEQ ID NO: 3450847 - RNA, 13 nt, Human
guaaugaaguaaa

SEQ ID NO: 3450848 - RNA, 14 nt, Human
guaaugaauaccuu

SEQ ID NO: 3450849 - RNA, 15 nt, Human
guaaugagggacugg

SEQ ID NO: 3450850 - RNA, 19 nt, Human
guaaugcgauuuuauuacu

SEQ ID NO: 3450851 - RNA, 16 nt, Human
guaaugcgccaauaaa

SEQ ID NO: 3450852 - RNA, 18 nt, Human
guaaugcuacgugugauu

SEQ ID NO: 3450853 - RNA, 20 nt, Human
guaaugcuacgugugauuuu

SEQ ID NO: 3450854 - RNA, 12 nt, Human
guaaugcugcac

SEQ ID NO: 3450855 - RNA, 17 nt, Human
guaaugcugcacuuccu

SEQ ID NO: 3450856 - RNA, 15 nt, Human
guaaugguguagaac

SEQ ID NO: 3450857 - RNA, 12 nt, Human
guaauguaacug

SEQ ID NO: 3450858 - RNA, 19 nt, Human
guaauguaacugcucuugg

SEQ ID NO: 3450859 - RNA, 20 nt, Human
guaauguagcguguuuacau

SEQ ID NO: 3450860 - RNA, 17 nt, Human
guaaugucuugagcucu

SEQ ID NO: 3450861 - RNA, 14 nt, Human
guaaugugaauaaa

SEQ ID NO: 3450862 - RNA, 18 nt, Human
guaaugugugguggccuc

SEQ ID NO: 3450863 - RNA, 17 nt, Human
guaauguguuuuagagu

SEQ ID NO: 3450864 - RNA, 17 nt, Human
guaauguuaauauugau

SEQ ID NO: 3450865 - RNA, 20 nt, Human
guaauguuaauguuauauca

SEQ ID NO: 3450866 - RNA, 17 nt, Human
guaauguuacugaucau

SEQ ID NO: 3450867 - RNA, 20 nt, Human
guaauguuacugaucaugca

SEQ ID NO: 3450868 - RNA, 22 nt, Human
guaauguuacugaucaugcauu

SEQ ID NO: 3450869 - RNA, 23 nt, Human
guaauguuacugaucaugcauug

SEQ ID NO: 3450870 - RNA, 15 nt, Human
guaauguuauuuucu

SEQ ID NO: 3450871 - RNA, 19 nt, Human
guaauguuuucuuugcaaa

SEQ ID NO: 3450872 - RNA, 19 nt, Human
guaauuaaaagaauuuucc

SEQ ID NO: 3450873 - RNA, 19 nt, Human
guaauuaaaagcaaaucau

SEQ ID NO: 3450874 - RNA, 21 nt, Human
guaauuaaaagcaaaucauuu

SEQ ID NO: 3450875 - RNA, 22 nt, Human
guaauuaaacuguuaacuuauu

SEQ ID NO: 3450876 - RNA, 21 nt, Human
guaauuaaguacuauguauca

SEQ ID NO: 3450877 - RNA, 23 nt, Human
guaauuaguaacauguguuaagu

SEQ ID NO: 3450878 - RNA, 20 nt, Human
guaauuagugccacuuaaug

SEQ ID NO: 3450879 - RNA, 21 nt, Human
guaauuagugccacuuaaugu

SEQ ID NO: 3450880 - RNA, 20 nt, Human
guaauuaucgggaacagugu

SEQ ID NO: 3450881 - RNA, 21 nt, Human
guaauuaucgggaacaguguu

SEQ ID NO: 3450882 - RNA, 12 nt, Human
guaauuauugug

SEQ ID NO: 3450883 - RNA, 19 nt, Human
guaauuauuuauguauggu

SEQ ID NO: 3450884 - RNA, 15 nt, Human
guaauuauuugaaug

SEQ ID NO: 3450885 - RNA, 13 nt, Human
guaauucaagaaa

SEQ ID NO: 3450886 - RNA, 12 nt, Human
guaauucuaaau

SEQ ID NO: 3450887 - RNA, 18 nt, Human
guaauucuaaaugaaugu

SEQ ID NO: 3450888 - RNA, 22 nt, Human
guaauucuaaaugaauguuuac

SEQ ID NO: 3450889 - RNA, 23 nt, Human
guaauucuaccaaggucuucuua

SEQ ID NO: 3450890 - RNA, 22 nt, Human
guaauucuuauuccauauuaga

SEQ ID NO: 3450891 - RNA, 15 nt, Human
guaauucuuauucuu

SEQ ID NO: 3450892 - RNA, 16 nt, Human
guaauugaauaaaguu

SEQ ID NO: 3450893 - RNA, 16 nt, Human
guaauugcuuacauuu

SEQ ID NO: 3450894 - RNA, 22 nt, Human
guaauugcuuacauuuuuacaa

SEQ ID NO: 3450895 - RNA, 15 nt, Human
guaauuguaauuuug

SEQ ID NO: 3450896 - RNA, 18 nt, Human
guaauuguacuaaagcca

SEQ ID NO: 3450897 - RNA, 13 nt, Human
guaauugugaaaa

SEQ ID NO: 3450898 - RNA, 14 nt, Human
guaauugugaaaaa

SEQ ID NO: 3450899 - RNA, 21 nt, Human
guaauuguguggauucuuuaa

SEQ ID NO: 3450900 - RNA, 13 nt, Human
guaauuguguuua

SEQ ID NO: 3450901 - RNA, 15 nt, Human
guaauuguguuuaca

SEQ ID NO: 3450902 - RNA, 18 nt, Human
guaauuguguuuacauuu

SEQ ID NO: 3450903 - RNA, 17 nt, Human
guaauuguuguuuguau

SEQ ID NO: 3450904 - RNA, 19 nt, Human
guaauuuaaacaggcccag

SEQ ID NO: 3450905 - RNA, 23 nt, Human
guaauuuaaaugaaagaaaauug

SEQ ID NO: 3450906 - RNA, 18 nt, Human
guaauuuagaaaucauuu

SEQ ID NO: 3450907 - RNA, 18 nt, Human
guaauuuagauuguaaac

SEQ ID NO: 3450908 - RNA, 20 nt, Human
guaauuuauaguuuauacag

SEQ ID NO: 3450909 - RNA, 11 nt, Human
guaauuuauuu

SEQ ID NO: 3450910 - RNA, 13 nt, Human
guaauuucuuugc

SEQ ID NO: 3450911 - RNA, 21 nt, Human
guaauuucuuuuuuuccuuuu

SEQ ID NO: 3450912 - RNA, 13 nt, Human
guaauuugaagau

SEQ ID NO: 3450913 - RNA, 16 nt, Human
guaauuugaggacaac

SEQ ID NO: 3450914 - RNA, 18 nt, Human
guaauuugguuuaaaaau

SEQ ID NO: 3450915 - RNA, 15 nt, Human
guaauuuguaaaaug

SEQ ID NO: 3450916 - RNA, 13 nt, Human
guaauuuguaaag

SEQ ID NO: 3450917 - RNA, 13 nt, Human
guaauuuguaucu

SEQ ID NO: 3450918 - RNA, 21 nt, Human
guaauuuguaucugaaggaga

SEQ ID NO: 3450919 - RNA, 17 nt, Human
guaauuugugauacaau

SEQ ID NO: 3450920 - RNA, 20 nt, Human
guaauuugugauacaaugcu

SEQ ID NO: 3450921 - RNA, 20 nt, Human
guaauuuuacacgcuuuugu

SEQ ID NO: 3450922 - RNA, 22 nt, Human
guaauuuuacacgcuuuuguga

SEQ ID NO: 3450923 - RNA, 18 nt, Human
guaauuuucuugaugacu

SEQ ID NO: 3450924 - RNA, 17 nt, Human
guaauuuuggauuuugc

SEQ ID NO: 3450925 - RNA, 16 nt, Human
guaauuuuguguaaga

SEQ ID NO: 3450926 - RNA, 22 nt, Human
guaauuuuuacccuaaugucuu

SEQ ID NO: 3450927 - RNA, 21 nt, Human
guaauuuuuuuaauuuacaaa

SEQ ID NO: 3450928 - RNA, 18 nt, Human
guacaaaaauaaauuuau

SEQ ID NO: 3450929 - RNA, 14 nt, Human
guacaaaauaaaca

SEQ ID NO: 3450930 - RNA, 23 nt, Human
gaccugcuccgcugcuccuuggc

SEQ ID NO: 3450931 - RNA, 10 nt, Human
gaccugcuga

SEQ ID NO: 3450932 - RNA, 13 nt, Human
gaccugcugaagu

SEQ ID NO: 3450933 - RNA, 18 nt, Human
gaccugcugaccugugca

SEQ ID NO: 3450934 - RNA, 19 nt, Human
gaccugcugaccugugcac

SEQ ID NO: 3450935 - RNA, 13 nt, Human
gaccugcugagcu

SEQ ID NO: 3450936 - RNA, 16 nt, Human
gaccugcugagcucug

SEQ ID NO: 3450937 - RNA, 18 nt, Human
gaccugcugagcucugag

SEQ ID NO: 3450938 - RNA, 21 nt, Human
gaccugcugagggaccagcca

SEQ ID NO: 3450939 - RNA, 13 nt, Human
gaccugcuuuuug

SEQ ID NO: 3450940 - RNA, 14 nt, Human
gaccugcuuuuuga

SEQ ID NO: 3450941 - RNA, 16 nt, Human
gaccugcuuuuugaaa

SEQ ID NO: 3450942 - RNA, 20 nt, Human
gaccugcuuuuugaaaugaa

SEQ ID NO: 3450943 - RNA, 12 nt, Human
gaccuggagccc

SEQ ID NO: 3450944 - RNA, 14 nt, Human
gaccuggagccccu

SEQ ID NO: 3450945 - RNA, 20 nt, Human
gaccuggagccccugggugg

SEQ ID NO: 3450946 - RNA, 16 nt, Human
gaccuggcaaggacac

SEQ ID NO: 3450947 - RNA, 22 nt, Human
gaccuggcacuggaugcagaaa

SEQ ID NO: 3450948 - RNA, 15 nt, Human
gaccuggcagcucug

SEQ ID NO: 3450949 - RNA, 22 nt, Human
gaccugggaauuuucaacaugg

SEQ ID NO: 3450950 - RNA, 14 nt, Human
gaccuggggcacag

SEQ ID NO: 3450951 - RNA, 15 nt, Human
gaccuggggcacagu

SEQ ID NO: 3450952 - RNA, 22 nt, Human
gaccuggggcacaguccaggaa

SEQ ID NO: 3450953 - RNA, 23 nt, Human
gaccugguacccuccuggcucuu

SEQ ID NO: 3450954 - RNA, 19 nt, Human
gaccuguauuuaagcaaau

SEQ ID NO: 3450955 - RNA, 20 nt, Human
gaccugucaugccccccuca

SEQ ID NO: 3450956 - RNA, 14 nt, Human
gaccuguccuccug

SEQ ID NO: 3450957 - RNA, 16 nt, Human
gaccugucuccuggcg

SEQ ID NO: 3450958 - RNA, 17 nt, Human
gaccugugaccagcacu

SEQ ID NO: 3450959 - RNA, 16 nt, Human
gaccugugagcccagc

SEQ ID NO: 3450960 - RNA, 19 nt, Human
gaccugugagcccagcugg

SEQ ID NO: 3450961 - RNA, 14 nt, Human
gaccugugcacacc

SEQ ID NO: 3450962 - RNA, 20 nt, Human
gaccuguggggauuucuccc

SEQ ID NO: 3450963 - RNA, 21 nt, Human
gaccuguggggauuucuccca

SEQ ID NO: 3450964 - RNA, 19 nt, Human
gaccugugucacuacguga

SEQ ID NO: 3450965 - RNA, 17 nt, Human
gaccuguuagcagacag

SEQ ID NO: 3450966 - RNA, 17 nt, Human
gaccuguuuaugagaug

SEQ ID NO: 3450967 - RNA, 22 nt, Human
gaccuuaccccuggcuguuugg

SEQ ID NO: 3450968 - RNA, 16 nt, Human
gaccuuaguguuucug

SEQ ID NO: 3450969 - RNA, 12 nt, Human
gaccuuaucugu

SEQ ID NO: 3450970 - RNA, 14 nt, Human
gaccuuaucugugc

SEQ ID NO: 3450971 - RNA, 19 nt, Human
gaccuucaccaaacauacu

SEQ ID NO: 3450972 - RNA, 20 nt, Human
gaccuucacucuaagauguu

SEQ ID NO: 3450973 - RNA, 18 nt, Human
gaccuuccaagagccuga

SEQ ID NO: 3450974 - RNA, 22 nt, Human
gaccuuccauaaugcuacuguc

SEQ ID NO: 3450975 - RNA, 12 nt, Human
gaccuuccucau

SEQ ID NO: 3450976 - RNA, 22 nt, Human
gaccuuccucauccaccccauc

SEQ ID NO: 3450977 - RNA, 17 nt, Human
gaccuuccucgcagaga

SEQ ID NO: 3450978 - RNA, 21 nt, Human
gaccuuccucgcagagaggcc

SEQ ID NO: 3450979 - RNA, 12 nt, Human
gaccuuccucug

SEQ ID NO: 3450980 - RNA, 21 nt, Human
gaccuuccucuggggcucuag

SEQ ID NO: 3450981 - RNA, 16 nt, Human
gaccuucgggcugugc

SEQ ID NO: 3450982 - RNA, 18 nt, Human
gaccuucgggcugugccc

SEQ ID NO: 3450983 - RNA, 19 nt, Human
gaccuucgggcugugcccg

SEQ ID NO: 3450984 - RNA, 23 nt, Human
gaccuucuaggacgccacccagc

SEQ ID NO: 3450985 - RNA, 20 nt, Human
gaccuucuccuucaccuuug

SEQ ID NO: 3450986 - RNA, 14 nt, Human
gaccuugaacuggg

SEQ ID NO: 3450987 - RNA, 14 nt, Human
gaccuugaugagcu

SEQ ID NO: 3450988 - RNA, 16 nt, Human
gaccuuguaauguaac

SEQ ID NO: 3450989 - RNA, 23 nt, Human
gacuauuuaaacuuauaaaucau

SEQ ID NO: 3450990 - RNA, 16 nt, Human
gacuauuuaacuugag

SEQ ID NO: 3450991 - RNA, 17 nt, Human
gacuauuuuuguuuuua

SEQ ID NO: 3450992 - RNA, 16 nt, Human
gacucaaauguucuaa

SEQ ID NO: 3450993 - RNA, 17 nt, Human
gacucaaauguucuaag

SEQ ID NO: 3450994 - RNA, 22 nt, Human
gacucaacauguuacugaccag

SEQ ID NO: 3450995 - RNA, 16 nt, Human
gacucaagauucccag

SEQ ID NO: 3450996 - RNA, 18 nt, Human
gacucaagauucccagga

SEQ ID NO: 3450997 - RNA, 14 nt, Human
gacucaagccccgg

SEQ ID NO: 3450998 - RNA, 15 nt, Human
gacucaagccccgga

SEQ ID NO: 3450999 - RNA, 18 nt, Human
gacucacaaccugaaccu

SEQ ID NO: 3451000 - RNA, 15 nt, Human
gacucacaagaagac

SEQ ID NO: 3451001 - RNA, 14 nt, Human
gacucacuggcagc

SEQ ID NO: 3451002 - RNA, 16 nt, Human
gacucacuggcagccc

SEQ ID NO: 3451003 - RNA, 13 nt, Human
gacucagaagccu

SEQ ID NO: 3451004 - RNA, 16 nt, Human
gacucagaagccucug

SEQ ID NO: 3451005 - RNA, 19 nt, Human
gacucagaagccucugggu

SEQ ID NO: 3451006 - RNA, 16 nt, Human
gacucagacuccauuu

SEQ ID NO: 3451007 - RNA, 13 nt, Human
gacucagcccuga

SEQ ID NO: 3451008 - RNA, 14 nt, Human
gacucagcucccca

SEQ ID NO: 3451009 - RNA, 20 nt, Human
gacucagcuccccagagucc

SEQ ID NO: 3451010 - RNA, 12 nt, Human
gacucagcucug

SEQ ID NO: 3451011 - RNA, 19 nt, Human
gacucaggaugcccagggc

SEQ ID NO: 3451012 - RNA, 23 nt, Human
gacucaggauuuaaaaacuggaa

SEQ ID NO: 3451013 - RNA, 22 nt, Human
gacucaggcccccaccuggcuc

SEQ ID NO: 3451014 - RNA, 13 nt, Human
gacucagggcagc

SEQ ID NO: 3451015 - RNA, 16 nt, Human
gacucagggcagcgcc

SEQ ID NO: 3451016 - RNA, 12 nt, Human
gacucagggcuc

SEQ ID NO: 3451017 - RNA, 14 nt, Human
gacucagggcuccu

SEQ ID NO: 3451018 - RNA, 16 nt, Human
gacucagggcuccugg

SEQ ID NO: 3451019 - RNA, 19 nt, Human
gacucagggcuccuggguu

SEQ ID NO: 3451020 - RNA, 19 nt, Human
gacucagguggcccuacug

SEQ ID NO: 3451021 - RNA, 20 nt, Human
gacucaggugggcccucuga

SEQ ID NO: 3451022 - RNA, 21 nt, Human
gacucagguuguaguaaagaa

SEQ ID NO: 3451023 - RNA, 23 nt, Human
gacucagguuguaguaaagaaau

SEQ ID NO: 3451024 - RNA, 20 nt, Human
gacucagugcagauggagag

SEQ ID NO: 3451025 - RNA, 22 nt, Human
gacucaucaaucaaauaaguau

SEQ ID NO: 3451026 - RNA, 15 nt, Human
gacucauccugaaca

SEQ ID NO: 3451027 - RNA, 17 nt, Human
gacucauccugaacagc

SEQ ID NO: 3451028 - RNA, 19 nt, Human
gacucauccugaacagcau

SEQ ID NO: 3451029 - RNA, 16 nt, Human
gacucaucuuauaugg

SEQ ID NO: 3451030 - RNA, 15 nt, Human
gacucaucuuucccu

SEQ ID NO: 3451031 - RNA, 17 nt, Human
gacucaucuuucccucc

SEQ ID NO: 3451032 - RNA, 18 nt, Human
gacucaucuuucccuccu

SEQ ID NO: 3451033 - RNA, 22 nt, Human
gacucaugaggaggggcccccc

SEQ ID NO: 3451034 - RNA, 16 nt, Human
gacucauucugaagga

SEQ ID NO: 3451035 - RNA, 21 nt, Human
gacucauugcuucacaaccca

SEQ ID NO: 3451036 - RNA, 21 nt, Human
gacucauuuuaaaaaauggaa

SEQ ID NO: 3451037 - RNA, 12 nt, Human
gacuccaaagaa

SEQ ID NO: 3451038 - RNA, 16 nt, Human
gacuccaaagaaaugu

SEQ ID NO: 3451039 - RNA, 18 nt, Human
gacuccagaucugcaccg

SEQ ID NO: 3451040 - RNA, 15 nt, Human
gacuccagccagcgc

SEQ ID NO: 3451041 - RNA, 23 nt, Human
gacuccagccagcgccucccucc

SEQ ID NO: 3451042 - RNA, 20 nt, Human
gacuccagccugccuggcag

SEQ ID NO: 3451043 - RNA, 21 nt, Human
gacuccaggcagcagacacau

SEQ ID NO: 3451044 - RNA, 12 nt, Human
gacuccaucucu

SEQ ID NO: 3451045 - RNA, 17 nt, Human
gacuccaucucucaucc

SEQ ID NO: 3451046 - RNA, 15 nt, Human
gacucccaacccugg

SEQ ID NO: 3451047 - RNA, 21 nt, Human
gacucccaaguuuccauagca

SEQ ID NO: 3451048 - RNA, 13 nt, Human
gacucccaugaag

SEQ ID NO: 3451049 - RNA, 13 nt, Human
gacucccauuccu

SEQ ID NO: 3451050 - RNA, 23 nt, Human
gacucccauuccugaagaaccag

SEQ ID NO: 3451051 - RNA, 22 nt, Human
gacucccccaguccccuucccg

SEQ ID NO: 3451052 - RNA, 14 nt, Human
gacucccuccucac

SEQ ID NO: 3451053 - RNA, 20 nt, Human
gacucccuccucaccucugg

SEQ ID NO: 3451054 - RNA, 24 nt, Human
gacucccuccucaccucuggacug

SEQ ID NO: 3451055 - RNA, 18 nt, Human
gacuccggcugugcuggg

SEQ ID NO: 3451056 - RNA, 17 nt, Human
gacuccuaggcaggaca

SEQ ID NO: 3451057 - RNA, 21 nt, Human
gacuccuccccacccuccugg

SEQ ID NO: 3451058 - RNA, 20 nt, Human
gacuccucggccuggcuccu

SEQ ID NO: 3451059 - RNA, 14 nt, Human
gacuccucugucca

SEQ ID NO: 3451060 - RNA, 19 nt, Human
gacuccugaggacagcugu

SEQ ID NO: 3451061 - RNA, 20 nt, Human
gacuccugaggacagcuguc

SEQ ID NO: 3451062 - RNA, 21 nt, Human
gacuccugaggacagcugucc

SEQ ID NO: 3451063 - RNA, 23 nt, Human
gacuccugcacacgcuccuuccu

SEQ ID NO: 3451064 - RNA, 12 nt, Human
gacuccugcagg

SEQ ID NO: 3451065 - RNA, 15 nt, Human
gacuccugcaggcag

SEQ ID NO: 3451066 - RNA, 18 nt, Human
gacuccugcaggcagcca

SEQ ID NO: 3451067 - RNA, 11 nt, Human
gacuccugggu

SEQ ID NO: 3451068 - RNA, 13 nt, Human
gacuccugguccu

SEQ ID NO: 3451069 - RNA, 16 nt, Human
gacuccugugcaacuu

SEQ ID NO: 3451070 - RNA, 22 nt, Human
gacuccuugagagaccaggcaa

SEQ ID NO: 3451071 - RNA, 13 nt, Human
gacucgacucugu

SEQ ID NO: 3451072 - RNA, 19 nt, Human
gacucgagaacuuucauuu

SEQ ID NO: 3451073 - RNA, 13 nt, Human
gacucgcgacaau

SEQ ID NO: 3451074 - RNA, 19 nt, Human
gacucgcgacaaugcaaac

SEQ ID NO: 3451075 - RNA, 13 nt, Human
gacucgcuuguaa

SEQ ID NO: 3451076 - RNA, 17 nt, Human
gacucgggcuccugugc

SEQ ID NO: 3451077 - RNA, 19 nt, Human
gacucgggcuccugugccc

SEQ ID NO: 3451078 - RNA, 19 nt, Human
gacucgguuucuccaaacu

SEQ ID NO: 3451079 - RNA, 15 nt, Human
gacucuaagaaagaa

SEQ ID NO: 3451080 - RNA, 21 nt, Human
gacucuaagguuaucuacuuu

SEQ ID NO: 3451081 - RNA, 23 nt, Human
gacucuaccucauaucaguuugc

SEQ ID NO: 3451082 - RNA, 19 nt, Human
gacucuagaguccaagguu

SEQ ID NO: 3451083 - RNA, 19 nt, Human
gacucuaggugcccuugga

SEQ ID NO: 3451084 - RNA, 23 nt, Human
gacucuaguacugugaauccagu

SEQ ID NO: 3451085 - RNA, 18 nt, Human
gacucuauucuuuaacuc

SEQ ID NO: 3451086 - RNA, 16 nt, Human
gacucucagcccagaa

SEQ ID NO: 3451087 - RNA, 19 nt, Human
gacucucagcccagaagaa

SEQ ID NO: 3451088 - RNA, 12 nt, Human
gacucucuguga

SEQ ID NO: 3451089 - RNA, 13 nt, Human
gacucucugugac

SEQ ID NO: 3451090 - RNA, 16 nt, Human
gacucugaagccucug

SEQ ID NO: 3451091 - RNA, 20 nt, Human
gacucugaaucuuuuucaga

SEQ ID NO: 3451092 - RNA, 22 nt, Human
gacucugaggcucuuucugggc

SEQ ID NO: 3451093 - RNA, 14 nt, Human
gacucugcacauga

SEQ ID NO: 3451094 - RNA, 14 nt, Human
gucagucgccuuuc

SEQ ID NO: 3451095 - RNA, 23 nt, Human
gucagucgccuuucagcaggcag

SEQ ID NO: 3451096 - RNA, 17 nt, Human
gucagucuuuuucuguu

SEQ ID NO: 3451097 - RNA, 22 nt, Human
gucagugccgccgccucgccca

SEQ ID NO: 3451098 - RNA, 13 nt, Human
gucagugcugccu

SEQ ID NO: 3451099 - RNA, 22 nt, Human
gucagugggaacgugacugccc

SEQ ID NO: 3451100 - RNA, 23 nt, Human
gucaguguccaaagcagggucug

SEQ ID NO: 3451101 - RNA, 16 nt, Human
gucaguuguuauuuau

SEQ ID NO: 3451102 - RNA, 17 nt, Human
gucaguuguuauuuauu

SEQ ID NO: 3451103 - RNA, 21 nt, Human
gucaguuguuauuuauugaaa

SEQ ID NO: 3451104 - RNA, 18 nt, Human
gucauaacuaaauaaagc

SEQ ID NO: 3451105 - RNA, 13 nt, Human
gucauaacuagaa

SEQ ID NO: 3451106 - RNA, 16 nt, Human
gucauaauugcauuga

SEQ ID NO: 3451107 - RNA, 12 nt, Human
gucauacagaga

SEQ ID NO: 3451108 - RNA, 16 nt, Human
gucauaccaaugaaaa

SEQ ID NO: 3451109 - RNA, 20 nt, Human
gucauacuaucuacucuccu

SEQ ID NO: 3451110 - RNA, 16 nt, Human
gucauaggaaguuagc

SEQ ID NO: 3451111 - RNA, 22 nt, Human
gucauauacugccauguacuag

SEQ ID NO: 3451112 - RNA, 17 nt, Human
gucaucaauguauuugu

SEQ ID NO: 3451113 - RNA, 13 nt, Human
gucaucauacaug

SEQ ID NO: 3451114 - RNA, 16 nt, Human
gucaucaucagggccu

SEQ ID NO: 3451115 - RNA, 18 nt, Human
gucaucaucagggccugg

SEQ ID NO: 3451116 - RNA, 21 nt, Human
gucaucaucagggccuggggc

SEQ ID NO: 3451117 - RNA, 23 nt, Human
gucaucaucagggccuggggccu

SEQ ID NO: 3451118 - RNA, 18 nt, Human
gucaucaucauggccagc

SEQ ID NO: 3451119 - RNA, 18 nt, Human
gucauccucacagugaac

SEQ ID NO: 3451120 - RNA, 17 nt, Human
gucaucggcguggccca

SEQ ID NO: 3451121 - RNA, 19 nt, Human
gucaucguaggugauuuga

SEQ ID NO: 3451122 - RNA, 23 nt, Human
gucaucuagcgcaauugaaggau

SEQ ID NO: 3451123 - RNA, 19 nt, Human
gucaucuccaucagcugua

SEQ ID NO: 3451124 - RNA, 19 nt, Human
gucaucugagaaugaacaa

SEQ ID NO: 3451125 - RNA, 16 nt, Human
gucaucugguagauuu

SEQ ID NO: 3451126 - RNA, 17 nt, Human
gucaucuguuagggccu

SEQ ID NO: 3451127 - RNA, 12 nt, Human
gucaucuugcua

SEQ ID NO: 3451128 - RNA, 18 nt, Human
gucaucuuuuucucuaaa

SEQ ID NO: 3451129 - RNA, 18 nt, Human
gucaugaacauguuccug

SEQ ID NO: 3451130 - RNA, 20 nt, Human
gucaugaggagauucugccu

SEQ ID NO: 3451131 - RNA, 15 nt, Human
gucaugaucucccug

SEQ ID NO: 3451132 - RNA, 14 nt, Human
gucaugaugaauca

SEQ ID NO: 3451133 - RNA, 13 nt, Human
gagacaccugcac

SEQ ID NO: 3451134 - RNA, 15 nt, Human
gagacaccugcaccu

SEQ ID NO: 3451135 - RNA, 19 nt, Human
gagacaccugcaccucccc

SEQ ID NO: 3451136 - RNA, 20 nt, Human
gagacaccugcaccuccccc

SEQ ID NO: 3451137 - RNA, 16 nt, Human
gagacacggagcccag

SEQ ID NO: 3451138 - RNA, 14 nt, Human
gagacacugguggg

SEQ ID NO: 3451139 - RNA, 16 nt, Human
gagacacuguugauaa

SEQ ID NO: 3451140 - RNA, 17 nt, Human
gagacacuugccuucuu

SEQ ID NO: 3451141 - RNA, 15 nt, Human
gagacagaagcaggc

SEQ ID NO: 3451142 - RNA, 16 nt, Human
gagacagaauguaucu

SEQ ID NO: 3451143 - RNA, 21 nt, Human
gagacagaauguaucugugaa

SEQ ID NO: 3451144 - RNA, 20 nt, Human
gagacagauaccuccaaccc

SEQ ID NO: 3451145 - RNA, 22 nt, Human
gagacagauaccuccaacccug

SEQ ID NO: 3451146 - RNA, 18 nt, Human
gagacagccccagagcag

SEQ ID NO: 3451147 - RNA, 19 nt, Human
gagacagccccagagcagg

SEQ ID NO: 3451148 - RNA, 17 nt, Human
gagacagcccgggcucu

SEQ ID NO: 3451149 - RNA, 20 nt, Human
gagacagcccgggcucugcc

SEQ ID NO: 3451150 - RNA, 22 nt, Human
gagacagcccgggcucugccuc

SEQ ID NO: 3451151 - RNA, 14 nt, Human
guaucugaaggaga

SEQ ID NO: 3451152 - RNA, 12 nt, Human
guaucugagcag

SEQ ID NO: 3451153 - RNA, 17 nt, Human
guaucugaguugccaag

SEQ ID NO: 3451154 - RNA, 21 nt, Human
guaucuggauucaaauuuauu

SEQ ID NO: 3451155 - RNA, 12 nt, Human
guaucuggugac

SEQ ID NO: 3451156 - RNA, 23 nt, Human
guaucugucuuuccacucuggau

SEQ ID NO: 3451157 - RNA, 20 nt, Human
guaucugugaaguaguucug

SEQ ID NO: 3451158 - RNA, 13 nt, Human
guaucuuaaauuu

SEQ ID NO: 3451159 - RNA, 20 nt, Human
guaucuuccauauuuggaag

SEQ ID NO: 3451160 - RNA, 22 nt, Human
guaucuugcaguaucggcacug

SEQ ID NO: 3451161 - RNA, 21 nt, Human
guaucuugggggacagggcug

SEQ ID NO: 3451162 - RNA, 19 nt, Human
guaucuuucuaugcugcuu

SEQ ID NO: 3451163 - RNA, 16 nt, Human
guaucuuuuuucaaaa

SEQ ID NO: 3451164 - RNA, 16 nt, Human
guaugaaauauaugug

SEQ ID NO: 3451165 - RNA, 20 nt, Human
guaugaaauauaugugaaag

SEQ ID NO: 3451166 - RNA, 19 nt, Human
guaugaacuuuaucuaaag

SEQ ID NO: 3451167 - RNA, 16 nt, Human
guaugaagaguguuau

SEQ ID NO: 3451168 - RNA, 13 nt, Human
guaugaaggcuuu

SEQ ID NO: 3451169 - RNA, 20 nt, Human
guaugaauacagcagcaaga

SEQ ID NO: 3451170 - RNA, 20 nt, Human
guaugaaucuaugccaaaga

SEQ ID NO: 3451171 - RNA, 16 nt, Human
guaugacgcugauaca

SEQ ID NO: 3451172 - RNA, 12 nt, Human
guaugagcugag

SEQ ID NO: 3451173 - RNA, 14 nt, Human
guaugagcugaggg

SEQ ID NO: 3451174 - RNA, 17 nt, Human
guaugaggcauuuguuu

SEQ ID NO: 3451175 - RNA, 21 nt, Human
guaugagucaaugugcagugu

SEQ ID NO: 3451176 - RNA, 13 nt, Human
guaugaucaaaug

SEQ ID NO: 3451177 - RNA, 16 nt, Human
guaugaucaaauguuu

SEQ ID NO: 3451178 - RNA, 17 nt, Human
guaugauguguugugau

SEQ ID NO: 3451179 - RNA, 23 nt, Human
guaugauuuauaaacagacaaua

SEQ ID NO: 3451180 - RNA, 23 nt, Human
guaugcaagcaguuucaauaaag

SEQ ID NO: 3451181 - RNA, 15 nt, Human
guaugcacaauucca

SEQ ID NO: 3451182 - RNA, 16 nt, Human
guaugcacaauuccau

SEQ ID NO: 3451183 - RNA, 19 nt, Human
guaugcacaugaacuuaga

SEQ ID NO: 3451184 - RNA, 15 nt, Human
guaugcagggagcug

SEQ ID NO: 3451185 - RNA, 18 nt, Human
guaugcaugugaagaaag

SEQ ID NO: 3451186 - RNA, 13 nt, Human
guaugcugaucau

SEQ ID NO: 3451187 - RNA, 21 nt, Human
guaugcugaucaucgccagag

SEQ ID NO: 3451188 - RNA, 12 nt, Human
guaugcuucaua

SEQ ID NO: 3451189 - RNA, 14 nt, Human
guaugcuucauaca

SEQ ID NO: 3451190 - RNA, 15 nt, Human
guaugcuucauacag

SEQ ID NO: 3451191 - RNA, 16 nt, Human
guaugcuuugaaugua

SEQ ID NO: 3451192 - RNA, 21 nt, Human
guauggaaaaaccauuugaag

SEQ ID NO: 3451193 - RNA, 16 nt, Human
guauggaaguuuuccu

SEQ ID NO: 3451194 - RNA, 17 nt, Human
guauggaaguuuuccua

SEQ ID NO: 3451195 - RNA, 19 nt, Human
guauggaauacaauguaau

SEQ ID NO: 3451196 - RNA, 17 nt, Human
guauggaauacaguguu

SEQ ID NO: 3451197 - RNA, 21 nt, Human
guauggagcagccuggagacc

SEQ ID NO: 3451198 - RNA, 18 nt, Human
guauggagcucagagagg

SEQ ID NO: 3451199 - RNA, 14 nt, Human
guauggccuguguc

SEQ ID NO: 3451200 - RNA, 15 nt, Human
guauggccuguguca

SEQ ID NO: 3451201 - RNA, 21 nt, Human
guauggcguaaguacagagaa

SEQ ID NO: 3451202 - RNA, 23 nt, Human
guauggcguaaguacagagaagc

SEQ ID NO: 3451203 - RNA, 21 nt, Human
guauggcuuuauuuuuuugaa

SEQ ID NO: 3451204 - RNA, 16 nt, Human
guaugggacuggccuc

SEQ ID NO: 3451205 - RNA, 14 nt, Human
guaugggagagaag

SEQ ID NO: 3451206 - RNA, 14 nt, Human
guaugggcaaaaaa

SEQ ID NO: 3451207 - RNA, 19 nt, Human
guauggguaggguaaauca

SEQ ID NO: 3451208 - RNA, 15 nt, Human
guauggguguguguu

SEQ ID NO: 3451209 - RNA, 14 nt, Human
guaugguaaucuuu

SEQ ID NO: 3451210 - RNA, 15 nt, Human
guauggugcaaugug

SEQ ID NO: 3451211 - RNA, 15 nt, Human
guaugguggcugggu

SEQ ID NO: 3451212 - RNA, 15 nt, Human
guaugguugacacua

SEQ ID NO: 3451213 - RNA, 11 nt, Human
guauguaaaaa

SEQ ID NO: 3451214 - RNA, 11 nt, Human
guauguaaaug

SEQ ID NO: 3451215 - RNA, 15 nt, Human
guauguaaauguaua

SEQ ID NO: 3451216 - RNA, 22 nt, Human
guauguaaugugugguggccuc

SEQ ID NO: 3451217 - RNA, 23 nt, Human
guauguaaugugugguggccuca

SEQ ID NO: 3451218 - RNA, 11 nt, Human
guauguauaau

SEQ ID NO: 3451219 - RNA, 13 nt, Human
guauguaucuauu

SEQ ID NO: 3451220 - RNA, 13 nt, Human
guaugucaaagcu

SEQ ID NO: 3451221 - RNA, 11 nt, Human
guaugucugcc

SEQ ID NO: 3451222 - RNA, 13 nt, Human
guaugucugccau

SEQ ID NO: 3451223 - RNA, 18 nt, Human
guauguggaagugugggu

SEQ ID NO: 3451224 - RNA, 19 nt, Human
guaugugggggucugugug

SEQ ID NO: 3451225 - RNA, 21 nt, Human
guauguguacgugugugugcg

SEQ ID NO: 3451226 - RNA, 19 nt, Human
guauguguaucucacacuc

SEQ ID NO: 3451227 - RNA, 17 nt, Human
guaugugugaagugagu

SEQ ID NO: 3451228 - RNA, 21 nt, Human
guaugugugaagugagugagu

SEQ ID NO: 3451229 - RNA, 13 nt, Human
guauguguguaga

SEQ ID NO: 3451230 - RNA, 14 nt, Human
guauguguguaugg

SEQ ID NO: 3451231 - RNA, 12 nt, Human
guaugugugugu

SEQ ID NO: 3451232 - RNA, 16 nt, Human
guauguguguguaugc

SEQ ID NO: 3451233 - RNA, 18 nt, Human
guauguguuuagaauuga

SEQ ID NO: 3451234 - RNA, 17 nt, Human
guauguguuugugugug

SEQ ID NO: 3451235 - RNA, 17 nt, Human
guauguuagugcaaauu

SEQ ID NO: 3451236 - RNA, 14 nt, Human
guauguuauacaac

SEQ ID NO: 3451237 - RNA, 17 nt, Human
guauguugaagccuuug

SEQ ID NO: 3451238 - RNA, 11 nt, Human
guauguugucc

SEQ ID NO: 3451239 - RNA, 17 nt, Human
guauguuuacacuguca

SEQ ID NO: 3451240 - RNA, 17 nt, Human
guauguuucucuuugau

SEQ ID NO: 3451241 - RNA, 16 nt, Human
guauguuuuagcaugu

SEQ ID NO: 3451242 - RNA, 18 nt, Human
guauguuuuucaguucaa

SEQ ID NO: 3451243 - RNA, 19 nt, Human
guauguuuuuguguauuug

SEQ ID NO: 3451244 - RNA, 15 nt, Human
guauuaaaaaaaaca

SEQ ID NO: 3451245 - RNA, 15 nt, Human
guauuaaaacauugg

SEQ ID NO: 3451246 - RNA, 20 nt, Human
guauuaaaacauuggauuau

SEQ ID NO: 3451247 - RNA, 14 nt, Human
guauuaaaauguau

SEQ ID NO: 3451248 - RNA, 17 nt, Human
guauuaaaauguaugca

SEQ ID NO: 3451249 - RNA, 13 nt, Human
guauuaaagacag

SEQ ID NO: 3451250 - RNA, 14 nt, Human
guauuaaagggggg

SEQ ID NO: 3451251 - RNA, 18 nt, Human
guauuaaauuacauuugu

SEQ ID NO: 3451252 - RNA, 21 nt, Human
guauuaaauuacauuuguaau

SEQ ID NO: 3451253 - RNA, 12 nt, Human
guauuaagaaag

SEQ ID NO: 3451254 - RNA, 14 nt, Human
guauuaagaaagga

SEQ ID NO: 3451255 - RNA, 16 nt, Human
guauuaagauuauaau

SEQ ID NO: 3451256 - RNA, 23 nt, Human
guauuaagauuauaauuguugca

SEQ ID NO: 3451257 - RNA, 17 nt, Human
guauuaagcauauauuu

SEQ ID NO: 3451258 - RNA, 15 nt, Human
guauuaagggauuua

SEQ ID NO: 3451259 - RNA, 18 nt, Human
guauuaauaaauagagca

SEQ ID NO: 3451260 - RNA, 15 nt, Human
guauuaauacuaaaa

SEQ ID NO: 3451261 - RNA, 19 nt, Human
guauuaauacuaaaauaug

SEQ ID NO: 3451262 - RNA, 15 nt, Human
guauuaauucucuuu

SEQ ID NO: 3451263 - RNA, 18 nt, Human
guauuaauuuugauauaa

SEQ ID NO: 3451264 - RNA, 20 nt, Human
guauuacaguggggaaugaa

SEQ ID NO: 3451265 - RNA, 21 nt, Human
guauuagaguuucaaccauga

SEQ ID NO: 3451266 - RNA, 13 nt, Human
guauuagauguuc

SEQ ID NO: 3451267 - RNA, 15 nt, Human
guauuagauguucuc

SEQ ID NO: 3451268 - RNA, 22 nt, Human
guauuagggguaauauauugcu

SEQ ID NO: 3451269 - RNA, 18 nt, Human
guauuauaaauuauguuu

SEQ ID NO: 3451270 - RNA, 19 nt, Human
guauuauaaauuauguuua

SEQ ID NO: 3451271 - RNA, 13 nt, Human
guauuauauguac

SEQ ID NO: 3451272 - RNA, 16 nt, Human
guauuaucaaagggau

SEQ ID NO: 3451273 - RNA, 15 nt, Human
guauuauucugcagc

SEQ ID NO: 3451274 - RNA, 13 nt, Human
guauucaagaaag

SEQ ID NO: 3451275 - RNA, 22 nt, Human
guauucaauuaaagaaauaauu

SEQ ID NO: 3451276 - RNA, 14 nt, Human
guauucauauuugu

SEQ ID NO: 3451277 - RNA, 19 nt, Human
guauuccaccuuaaauuaa

SEQ ID NO: 3451278 - RNA, 23 nt, Human
guauuccuuuuguguacagugug

SEQ ID NO: 3451279 - RNA, 17 nt, Human
gagagaccgaggaggga

SEQ ID NO: 3451280 - RNA, 18 nt, Human
gagagaccucaucaggau

SEQ ID NO: 3451281 - RNA, 13 nt, Human
gagagacgggccc

SEQ ID NO: 3451282 - RNA, 16 nt, Human
gagagacguguacaua

SEQ ID NO: 3451283 - RNA, 17 nt, Human
gagagacguguacauag

SEQ ID NO: 3451284 - RNA, 15 nt, Human
gagagagaaagccag

SEQ ID NO: 3451285 - RNA, 23 nt, Human
gagagagaagugccccugcugcc

SEQ ID NO: 3451286 - RNA, 13 nt, Human
gagagagagagaa

SEQ ID NO: 3451287 - RNA, 13 nt, Human
gagagagagagga

SEQ ID NO: 3451288 - RNA, 15 nt, Human
gagagagaggcagaa

SEQ ID NO: 3451289 - RNA, 20 nt, Human
gagagagcugagugagcuga

SEQ ID NO: 3451290 - RNA, 19 nt, Human
gagagagcuucuguugcug

SEQ ID NO: 3451291 - RNA, 22 nt, Human
gagagagcuucuguugcugccu

SEQ ID NO: 3451292 - RNA, 13 nt, Human
gagagaggacagc

SEQ ID NO: 3451293 - RNA, 15 nt, Human
gagagaggcagagag

SEQ ID NO: 3451294 - RNA, 17 nt, Human
gagagaggcagagagcg

SEQ ID NO: 3451295 - RNA, 21 nt, Human
gagagaggccauucuuuccca

SEQ ID NO: 3451296 - RNA, 18 nt, Human
gagagaggcuaaaauguu

SEQ ID NO: 3451297 - RNA, 19 nt, Human
gagagaggcuaaaauguuu

SEQ ID NO: 3451298 - RNA, 12 nt, Human
gagagaggggaa

SEQ ID NO: 3451299 - RNA, 14 nt, Human
gagagauauaucug

SEQ ID NO: 3451300 - RNA, 15 nt, Human
gagagaucaugagaa

SEQ ID NO: 3451301 - RNA, 19 nt, Human
gagagauguguaauuuuuc

SEQ ID NO: 3451302 - RNA, 22 nt, Human
gagagcaagggaagugguucuu

SEQ ID NO: 3451303 - RNA, 14 nt, Human
gagagcagagaaua

SEQ ID NO: 3451304 - RNA, 16 nt, Human
gagagcagcuucugcc

SEQ ID NO: 3451305 - RNA, 15 nt, Human
gagagcaucggccua

SEQ ID NO: 3451306 - RNA, 16 nt, Human
gagagccagaaccugg

SEQ ID NO: 3451307 - RNA, 12 nt, Human
gagagccagccc

SEQ ID NO: 3451308 - RNA, 22 nt, Human
gagagccagcuaaggggugggg

SEQ ID NO: 3451309 - RNA, 16 nt, Human
gagagccauacauaaa

SEQ ID NO: 3451310 - RNA, 14 nt, Human
gagagcccagaggu

SEQ ID NO: 3451311 - RNA, 23 nt, Human
gagagcccagagguaacagaaca

SEQ ID NO: 3451312 - RNA, 19 nt, Human
gagagcccagagucccccc

SEQ ID NO: 3451313 - RNA, 15 nt, Human
gagagcccaggagcu

SEQ ID NO: 3451314 - RNA, 20 nt, Human
gagagcccaggagcuccccu

SEQ ID NO: 3451315 - RNA, 15 nt, Human
gagagccccuggggc

SEQ ID NO: 3451316 - RNA, 20 nt, Human
gagagcccggcgccccugcc

SEQ ID NO: 3451317 - RNA, 14 nt, Human
gagagcccugaggc

SEQ ID NO: 3451318 - RNA, 15 nt, Human
gagagcccugggacc

SEQ ID NO: 3451319 - RNA, 19 nt, Human
gagagccguggucccugag

SEQ ID NO: 3451320 - RNA, 20 nt, Human
gucuucaaauugucuuuugu

SEQ ID NO: 3451321 - RNA, 16 nt, Human
gucuucaacagcuccc

SEQ ID NO: 3451322 - RNA, 22 nt, Human
gucuucaaccagggauuguuuc

SEQ ID NO: 3451323 - RNA, 14 nt, Human
gucuucaagggcuu

SEQ ID NO: 3451324 - RNA, 13 nt, Human
gucuucacaacag

SEQ ID NO: 3451325 - RNA, 20 nt, Human
gucuucaccugauucaacua

SEQ ID NO: 3451326 - RNA, 16 nt, Human
gucuucacucuuaggc

SEQ ID NO: 3451327 - RNA, 22 nt, Human
gucuucagagauaggccugugg

SEQ ID NO: 3451328 - RNA, 18 nt, Human
gucuucauccccucagaa

SEQ ID NO: 3451329 - RNA, 17 nt, Human
gucuucauuucauugua

SEQ ID NO: 3451330 - RNA, 16 nt, Human
gucuuccacaaagaaa

SEQ ID NO: 3451331 - RNA, 13 nt, Human
gucuuccauaaug

SEQ ID NO: 3451332 - RNA, 12 nt, Human
gucuucccaggg

SEQ ID NO: 3451333 - RNA, 13 nt, Human
gucuucccagggu

SEQ ID NO: 3451334 - RNA, 16 nt, Human
gucuucccuaccucag

SEQ ID NO: 3451335 - RNA, 19 nt, Human
gucuucccuagggcugggu

SEQ ID NO: 3451336 - RNA, 20 nt, Human
gucuucccuagggcugggug

SEQ ID NO: 3451337 - RNA, 19 nt, Human
gucuucccucuucccucag

SEQ ID NO: 3451338 - RNA, 19 nt, Human
gucuuccgccccugccugc

SEQ ID NO: 3451339 - RNA, 14 nt, Human
gucuuccgucuccc

SEQ ID NO: 3451340 - RNA, 14 nt, Human
gucuuccuacucuu

SEQ ID NO: 3451341 - RNA, 16 nt, Human
gucuuccuauuucaga

SEQ ID NO: 3451342 - RNA, 18 nt, Human
gucuuccuauuucagaag

SEQ ID NO: 3451343 - RNA, 15 nt, Human
gucuuccuccaaccc

SEQ ID NO: 3451344 - RNA, 13 nt, Human
gucuuccucccaa

SEQ ID NO: 3451345 - RNA, 14 nt, Human
gucuuccucccaag

SEQ ID NO: 3451346 - RNA, 12 nt, Human
gucuuccugagu

SEQ ID NO: 3451347 - RNA, 14 nt, Human
gucuucguacaguu

SEQ ID NO: 3451348 - RNA, 23 nt, Human
gucuucuaauuucaaaaauauaa

SEQ ID NO: 3451349 - RNA, 14 nt, Human
gucuucuauuuauu

SEQ ID NO: 3451350 - RNA, 17 nt, Human
gucuucuauuuauuuau

SEQ ID NO: 3451351 - RNA, 16 nt, Human
gucuucucauagcauu

SEQ ID NO: 3451352 - RNA, 17 nt, Human
gucuucucauagcauua

SEQ ID NO: 3451353 - RNA, 13 nt, Human
gucuucuccccag

SEQ ID NO: 3451354 - RNA, 13 nt, Human
gucuucucugucu

SEQ ID NO: 3451355 - RNA, 18 nt, Human
gucuucugacaaacugug

SEQ ID NO: 3451356 - RNA, 13 nt, Human
gucuucugccugu

SEQ ID NO: 3451357 - RNA, 14 nt, Human
gucuucugcuuugu

SEQ ID NO: 3451358 - RNA, 17 nt, Human
gucuucuuacuuggaac

SEQ ID NO: 3451359 - RNA, 16 nt, Human
gucuugaacuccuggc

SEQ ID NO: 3451360 - RNA, 18 nt, Human
gucuugaacuccuggccu

SEQ ID NO: 3451361 - RNA, 16 nt, Human
gucuugaaguccuggc

SEQ ID NO: 3451362 - RNA, 15 nt, Human
gucuugaaugucuuu

SEQ ID NO: 3451363 - RNA, 14 nt, Human
gucuugagcucuau

SEQ ID NO: 3451364 - RNA, 16 nt, Human
gucuugcaauggcagc

SEQ ID NO: 3451365 - RNA, 16 nt, Human
gucuugccccaucacu

SEQ ID NO: 3451366 - RNA, 15 nt, Human
gucuugccuauauuu

SEQ ID NO: 3451367 - RNA, 20 nt, Human
gucuugccuuuuucauuauu

SEQ ID NO: 3451368 - RNA, 21 nt, Human
gucuugcuauauugcccaggc

SEQ ID NO: 3451369 - RNA, 19 nt, Human
gucuugcuguugacauauu

SEQ ID NO: 3451370 - RNA, 17 nt, Human
gucuuggaacuugccug

SEQ ID NO: 3451371 - RNA, 21 nt, Human
gucuuggaagcuguuuggaaa

SEQ ID NO: 3451372 - RNA, 14 nt, Human
gucuuggacacugu

SEQ ID NO: 3451373 - RNA, 15 nt, Human
gucuuggauauauag

SEQ ID NO: 3451374 - RNA, 23 nt, Human
gucuuggcggcagcagccaucau

SEQ ID NO: 3451375 - RNA, 16 nt, Human
gucuugggaaauauga

SEQ ID NO: 3451376 - RNA, 21 nt, Human
gucuuguaagagcuauacagu

SEQ ID NO: 3451377 - RNA, 23 nt, Human
gucuugucucagauuuuauuaug

SEQ ID NO: 3451378 - RNA, 13 nt, Human
gucuugugacuag

SEQ ID NO: 3451379 - RNA, 13 nt, Human
gucuuguucuguc

SEQ ID NO: 3451380 - RNA, 16 nt, Human
gucuuguucugucacu

SEQ ID NO: 3451381 - RNA, 16 nt, Human
gucuuuaaaggcccag

SEQ ID NO: 3451382 - RNA, 20 nt, Human
gucuuuaaaggcccagcccc

SEQ ID NO: 3451383 - RNA, 22 nt, Human
gucuuuaaaggcccagccccua

SEQ ID NO: 3451384 - RNA, 22 nt, Human
gucuuuagauagcccuguccug

SEQ ID NO: 3451385 - RNA, 11 nt, Human
gucuuucagua

SEQ ID NO: 3451386 - RNA, 21 nt, Human
gucuuuccaaauuauuucuua

SEQ ID NO: 3451387 - RNA, 20 nt, Human
gucuuuccauuggaucucau

SEQ ID NO: 3451388 - RNA, 19 nt, Human
gucuuucccauggggaggg

SEQ ID NO: 3451389 - RNA, 23 nt, Human
gucuuucucaaagaaauauuaag

SEQ ID NO: 3451390 - RNA, 13 nt, Human
gucuuucuggaga

SEQ ID NO: 3451391 - RNA, 12 nt, Human
gucuuucugggg

SEQ ID NO: 3451392 - RNA, 16 nt, Human
gucuuucuugcucccu

SEQ ID NO: 3451393 - RNA, 19 nt, Human
gucuuucuuuggugccuuu

SEQ ID NO: 3451394 - RNA, 17 nt, Human
gucuuucuuuuuggaca

SEQ ID NO: 3451395 - RNA, 19 nt, Human
gucuuuggaaaaauguuug

SEQ ID NO: 3451396 - RNA, 17 nt, Human
gucuuuggacccugagg

SEQ ID NO: 3451397 - RNA, 18 nt, Human
gucuuuggacccugaggc

SEQ ID NO: 3451398 - RNA, 22 nt, Human
gucuuuggagaaaugcuuagaa

SEQ ID NO: 3451399 - RNA, 16 nt, Human
gucuuuggugaacauu

SEQ ID NO: 3451400 - RNA, 11 nt, Human
gucuuuguaag

SEQ ID NO: 3451401 - RNA, 12 nt, Human
gucuuuguaaga

SEQ ID NO: 3451402 - RNA, 23 nt, Human
gucuuuguaaguaaacugcccug

SEQ ID NO: 3451403 - RNA, 23 nt, Human
gucuuuguaagucaguguugaga

SEQ ID NO: 3451404 - RNA, 21 nt, Human
gucuuuguaaugucaccaccu

SEQ ID NO: 3451405 - RNA, 15 nt, Human
gucuuuguacagaca

SEQ ID NO: 3451406 - RNA, 16 nt, Human
gucuuuguacagacaa

SEQ ID NO: 3451407 - RNA, 10 nt, Human
gucuuuuaaa

SEQ ID NO: 3451408 - RNA, 19 nt, Human
gucuuuuaaaaaguauugc

SEQ ID NO: 3451409 - RNA, 17 nt, Human
gucuuuuaaugcuucau

SEQ ID NO: 3451410 - RNA, 18 nt, Human
gucuuuuauauuuguauc

SEQ ID NO: 3451411 - RNA, 20 nt, Human
gucuuuucuuugccaucucu

SEQ ID NO: 3451412 - RNA, 12 nt, Human
gucuuuugcaug

SEQ ID NO: 3451413 - RNA, 13 nt, Human
gucuuuugcuuuu

SEQ ID NO: 3451414 - RNA, 15 nt, Human
gucuuuuguucgcau

SEQ ID NO: 3451415 - RNA, 16 nt, Human
gucuuuuuagaugccc

SEQ ID NO: 3451416 - RNA, 20 nt, Human
gucuuuuucuguuguaacuu

SEQ ID NO: 3451417 - RNA, 15 nt, Human
gucuuuuuuuguaua

SEQ ID NO: 3451418 - RNA, 17 nt, Human
gucuuuuuuuguauuau

SEQ ID NO: 3451419 - RNA, 16 nt, Human
gucuuuuuuuuaaugu

SEQ ID NO: 3451420 - RNA, 23 nt, Human
gucuuuuuuuuuuaagugaaauu

SEQ ID NO: 3451421 - RNA, 14 nt, Human
gugaaaaaaaaaau

SEQ ID NO: 3451422 - RNA, 15 nt, Human
gugaaaacaagugcu

SEQ ID NO: 3451423 - RNA, 23 nt, Human
gugaaaagaaaaaugagccuggc

SEQ ID NO: 3451424 - RNA, 19 nt, Human
gugaaaauagguauacagu

SEQ ID NO: 3451425 - RNA, 21 nt, Human
gugcccacaccggggacaggc

SEQ ID NO: 3451426 - RNA, 21 nt, Human
gugcccacaggccgcccugcg

SEQ ID NO: 3451427 - RNA, 22 nt, Human
gugcccacagugucaggcacug

SEQ ID NO: 3451428 - RNA, 23 nt, Human
gugcccaccaacaucccauugcc

SEQ ID NO: 3451429 - RNA, 22 nt, Human
gugcccagaacuggacucagga

SEQ ID NO: 3451430 - RNA, 18 nt, Human
gugcccagcccggaccuu

SEQ ID NO: 3451431 - RNA, 11 nt, Human
gugcccagcuu

SEQ ID NO: 3451432 - RNA, 12 nt, Human
gugcccaggaga

SEQ ID NO: 3451433 - RNA, 13 nt, Human
gugcccaggagaa

SEQ ID NO: 3451434 - RNA, 16 nt, Human
gugcccaguuaaucuu

SEQ ID NO: 3451435 - RNA, 17 nt, Human
gugcccaucccuggaag

SEQ ID NO: 3451436 - RNA, 16 nt, Human
gugcccauuccucacc

SEQ ID NO: 3451437 - RNA, 19 nt, Human
gugccccaggaccagcuca

SEQ ID NO: 3451438 - RNA, 21 nt, Human
gugccccaugccuguccagcc

SEQ ID NO: 3451439 - RNA, 22 nt, Human
gugcccccaaccauuuccucag

SEQ ID NO: 3451440 - RNA, 18 nt, Human
gugcccccacugaccaga

SEQ ID NO: 3451441 - RNA, 19 nt, Human
gugcccccacugaccagaa

SEQ ID NO: 3451442 - RNA, 21 nt, Human
gugccccccaccccuggaaga

SEQ ID NO: 3451443 - RNA, 13 nt, Human
gugcccccuccuc

SEQ ID NO: 3451444 - RNA, 14 nt, Human
gugcccccuccucu

SEQ ID NO: 3451445 - RNA, 18 nt, Human
gugcccccuccucuccca

SEQ ID NO: 3451446 - RNA, 14 nt, Human
gugcccccucuacc

SEQ ID NO: 3451447 - RNA, 16 nt, Human
gugccccgccuccccg

SEQ ID NO: 3451448 - RNA, 17 nt, Human
gugccccgccuccccga

SEQ ID NO: 3451449 - RNA, 13 nt, Human
gugccccuagcuu

SEQ ID NO: 3451450 - RNA, 20 nt, Human
gugccccugcugccucccca

SEQ ID NO: 3451451 - RNA, 20 nt, Human
gugccccuuccgccacuggg

SEQ ID NO: 3451452 - RNA, 15 nt, Human
gugcccggggcagca

SEQ ID NO: 3451453 - RNA, 23 nt, Human
gugcccggggcagcagcagcccu

SEQ ID NO: 3451454 - RNA, 20 nt, Human
gugcccuacucauugggguu

SEQ ID NO: 3451455 - RNA, 15 nt, Human
gugcccuccacugcc

SEQ ID NO: 3451456 - RNA, 23 nt, Human
gugcccuccugagggaggaccug

SEQ ID NO: 3451457 - RNA, 19 nt, Human
gugcccucucccacccucu

SEQ ID NO: 3451458 - RNA, 13 nt, Human
gugcccucugggc

SEQ ID NO: 3451459 - RNA, 15 nt, Human
gugcccugagccagg

SEQ ID NO: 3451460 - RNA, 17 nt, Human
gugcccugagccagggu

SEQ ID NO: 3451461 - RNA, 15 nt, Human
gugccgacagaagga

SEQ ID NO: 3451462 - RNA, 18 nt, Human
gugccgccgccucgccca

SEQ ID NO: 3451463 - RNA, 20 nt, Human
gugccgccgccucgcccacc

SEQ ID NO: 3451464 - RNA, 23 nt, Human
gugccgccgccucgcccaccgca

SEQ ID NO: 3451465 - RNA, 23 nt, Human
gugccguguccccugacagggcc

SEQ ID NO: 3451466 - RNA, 20 nt, Human
gugccguguguugcaugcag

SEQ ID NO: 3451467 - RNA, 12 nt, Human
gugccuaaaaua

SEQ ID NO: 3451468 - RNA, 15 nt, Human
gugccuaggccuggg

SEQ ID NO: 3451469 - RNA, 13 nt, Human
gugccucagagac

SEQ ID NO: 3451470 - RNA, 21 nt, Human
gugccuccaccaccacuggcc

SEQ ID NO: 3451471 - RNA, 23 nt, Human
gugccuccaccaccacuggccac

SEQ ID NO: 3451472 - RNA, 23 nt, Human
gugccuccagaggggcucagguc

SEQ ID NO: 3451473 - RNA, 12 nt, Human
gugccucccugg

SEQ ID NO: 3451474 - RNA, 13 nt, Human
gugccucccuggu

SEQ ID NO: 3451475 - RNA, 21 nt, Human
gugccuccucccucccucucc

SEQ ID NO: 3451476 - RNA, 22 nt, Human
gugccuccuuccaccucccucc

SEQ ID NO: 3451477 - RNA, 22 nt, Human
gugccucggcuuuucucagcug

SEQ ID NO: 3451478 - RNA, 14 nt, Human
gugccucuagcuga

SEQ ID NO: 3451479 - RNA, 16 nt, Human
gugccucuagcugaau

SEQ ID NO: 3451480 - RNA, 13 nt, Human
gugccucugccug

SEQ ID NO: 3451481 - RNA, 21 nt, Human
gugccucuggaggccucuggg

SEQ ID NO: 3451482 - RNA, 14 nt, Human
gugccucugggacu

SEQ ID NO: 3451483 - RNA, 15 nt, Human
gugccugagaggcag

SEQ ID NO: 3451484 - RNA, 18 nt, Human
gugccugagaggcaggca

SEQ ID NO: 3451485 - RNA, 21 nt, Human
gugccugauucggcugucuca

SEQ ID NO: 3451486 - RNA, 21 nt, Human
gugccugcaccaggagacaga

SEQ ID NO: 3451487 - RNA, 12 nt, Human
gugccugcuuca

SEQ ID NO: 3451488 - RNA, 13 nt, Human
gugccugcuucag

SEQ ID NO: 3451489 - RNA, 18 nt, Human
gugccuggagcuccuggg

SEQ ID NO: 3451490 - RNA, 16 nt, Human
gugccuggccacgccc

SEQ ID NO: 3451491 - RNA, 19 nt, Human
gugccuggccuggcacaca

SEQ ID NO: 3451492 - RNA, 15 nt, Human
gugccugggaaugua

SEQ ID NO: 3451493 - RNA, 20 nt, Human
gugccuggguggggcugcuc

SEQ ID NO: 3451494 - RNA, 21 nt, Human
gugccuggguggggcugcucc

SEQ ID NO: 3451495 - RNA, 23 nt, Human
gugccuggguggggcugcuccuc

SEQ ID NO: 3451496 - RNA, 19 nt, Human
gugccuguaugcaacaggc

SEQ ID NO: 3451497 - RNA, 15 nt, Human
gugccugucccaccc

SEQ ID NO: 3451498 - RNA, 20 nt, Human
gugccugucuguuacacugg

SEQ ID NO: 3451499 - RNA, 16 nt, Human
gugccugugaggcagg

SEQ ID NO: 3451500 - RNA, 22 nt, Human
gugccuguguccaugcgcucag

SEQ ID NO: 3451501 - RNA, 14 nt, Human
gugccugugugcgu

SEQ ID NO: 3451502 - RNA, 21 nt, Human
gugccuuaccuccugcccagg

SEQ ID NO: 3451503 - RNA, 21 nt, Human
gugccuuauggaacacucuga

SEQ ID NO: 3451504 - RNA, 14 nt, Human
gugccuucauuugg

SEQ ID NO: 3451505 - RNA, 14 nt, Human
gugccuucuguggg

SEQ ID NO: 3451506 - RNA, 21 nt, Human
gugccuucuucagggccuggu

SEQ ID NO: 3451507 - RNA, 19 nt, Human
gugccuuggggaauuuccu

SEQ ID NO: 3451508 - RNA, 16 nt, Human
gugccuuuauuuccac

SEQ ID NO: 3451509 - RNA, 12 nt, Human
gugccuuucaaa

SEQ ID NO: 3451510 - RNA, 18 nt, Human
gugccuuucaaauuuaga

SEQ ID NO: 3451511 - RNA, 16 nt, Human
gugccuuucaggaucu

SEQ ID NO: 3451512 - RNA, 11 nt, Human
gugccuuuccu

SEQ ID NO: 3451513 - RNA, 20 nt, Human
gugccuuuccuguucagcau

SEQ ID NO: 3451514 - RNA, 21 nt, Human
gugccuuuccuguucagcauu

SEQ ID NO: 3451515 - RNA, 17 nt, Human
gugccuuugcaaaucag

SEQ ID NO: 3451516 - RNA, 18 nt, Human
gugccuuuugcaccccuc

SEQ ID NO: 3451517 - RNA, 19 nt, Human
gugccuuuugcaccccucc

SEQ ID NO: 3451518 - RNA, 21 nt, Human
gugccuuuugcaccccuccca

SEQ ID NO: 3451519 - RNA, 21 nt, Human
gugccuuuugcagaagagggu

SEQ ID NO: 3451520 - RNA, 23 nt, Human
gugccuuuugcagaagagggugu

SEQ ID NO: 3451521 - RNA, 16 nt, Human
gugcgaccccaucugc

SEQ ID NO: 3451522 - RNA, 18 nt, Human
gugcgaccccaucugccc

SEQ ID NO: 3451523 - RNA, 23 nt, Human
gugcgaucauggcucacugcagc

SEQ ID NO: 3451524 - RNA, 20 nt, Human
guccugccuggccaggcaga

SEQ ID NO: 3451525 - RNA, 11 nt, Human
guccugccugu

SEQ ID NO: 3451526 - RNA, 16 nt, Human
guccugccugucugcc

SEQ ID NO: 3451527 - RNA, 21 nt, Human
guccugccugucugccccagc

SEQ ID NO: 3451528 - RNA, 13 nt, Human
guccugccugugg

SEQ ID NO: 3451529 - RNA, 14 nt, Human
guccugccuguggc

SEQ ID NO: 3451530 - RNA, 19 nt, Human
guccugcgucgaagcuuug

SEQ ID NO: 3451531 - RNA, 15 nt, Human
guccugcucagcagu

SEQ ID NO: 3451532 - RNA, 14 nt, Human
guccugcuccacag

SEQ ID NO: 3451533 - RNA, 23 nt, Human
guccugcucucuacccagcccau

SEQ ID NO: 3451534 - RNA, 17 nt, Human
guccugcugcaguugcc

SEQ ID NO: 3451535 - RNA, 20 nt, Human
guccuggaggggcuggggac

SEQ ID NO: 3451536 - RNA, 18 nt, Human
guccuggagguuccccag

SEQ ID NO: 3451537 - RNA, 17 nt, Human
guccuggaugauacuaa

SEQ ID NO: 3451538 - RNA, 21 nt, Human
guccuggccagauggcccgga

SEQ ID NO: 3451539 - RNA, 16 nt, Human
guccuggccaucccac

SEQ ID NO: 3451540 - RNA, 17 nt, Human
guccuggcuccugaggg

SEQ ID NO: 3451541 - RNA, 19 nt, Human
guccuggcuccugaggggc

SEQ ID NO: 3451542 - RNA, 15 nt, Human
guccuggcuucaggc

SEQ ID NO: 3451543 - RNA, 20 nt, Human
guccugggagaaccucaggc

SEQ ID NO: 3451544 - RNA, 16 nt, Human
guccugggagugagcu

SEQ ID NO: 3451545 - RNA, 18 nt, Human
guccugggagugagcugg

SEQ ID NO: 3451546 - RNA, 16 nt, Human
guccugggcgcccugg

SEQ ID NO: 3451547 - RNA, 19 nt, Human
guccugggcgcccuggaag

SEQ ID NO: 3451548 - RNA, 11 nt, Human
guccugggggc

SEQ ID NO: 3451549 - RNA, 15 nt, Human
guccugggggccuga

SEQ ID NO: 3451550 - RNA, 17 nt, Human
guccugggggccugacc

SEQ ID NO: 3451551 - RNA, 11 nt, Human
guccuggugcc

SEQ ID NO: 3451552 - RNA, 23 nt, Human
guccuggugcccuggaugcccag

SEQ ID NO: 3451553 - RNA, 11 nt, Human
guccuggugcu

SEQ ID NO: 3451554 - RNA, 14 nt, Human
guccuggugcucuc

SEQ ID NO: 3451555 - RNA, 15 nt, Human
guccuggugcucucu

SEQ ID NO: 3451556 - RNA, 17 nt, Human
guccuggugcucucugc

SEQ ID NO: 3451557 - RNA, 19 nt, Human
guccuggugcucucugcca

SEQ ID NO: 3451558 - RNA, 17 nt, Human
guccugguggggcagcu

SEQ ID NO: 3451559 - RNA, 18 nt, Human
guccugguggggcagcuc

SEQ ID NO: 3451560 - RNA, 23 nt, Human
guccuggugguauuuucaauagc

SEQ ID NO: 3451561 - RNA, 14 nt, Human
guccuguaaacacu

SEQ ID NO: 3451562 - RNA, 18 nt, Human
guccuguaggaguucuau

SEQ ID NO: 3451563 - RNA, 21 nt, Human
guccuguaguugcguggacuc

SEQ ID NO: 3451564 - RNA, 20 nt, Human
guccuguaguuuuauuuuau

SEQ ID NO: 3451565 - RNA, 18 nt, Human
guccuguaugucugucau

SEQ ID NO: 3451566 - RNA, 13 nt, Human
guccugucagugc

SEQ ID NO: 3451567 - RNA, 15 nt, Human
guccugucagugccg

SEQ ID NO: 3451568 - RNA, 21 nt, Human
guccugucagugccgccgccu

SEQ ID NO: 3451569 - RNA, 19 nt, Human
guggacuuagaaagcaggg

SEQ ID NO: 3451570 - RNA, 20 nt, Human
guggacuuagaaagcagggg

SEQ ID NO: 3451571 - RNA, 22 nt, Human
guggacuuagaaagcaggggcu

SEQ ID NO: 3451572 - RNA, 15 nt, Human
guggacuugaacuuu

SEQ ID NO: 3451573 - RNA, 21 nt, Human
guggagaaacuguagucucag

SEQ ID NO: 3451574 - RNA, 22 nt, Human
guggagaaauaaaaauaccucu

SEQ ID NO: 3451575 - RNA, 23 nt, Human
guggagaaauaaaaauaccucuu

SEQ ID NO: 3451576 - RNA, 22 nt, Human
guggagaaauuccuugauucac

SEQ ID NO: 3451577 - RNA, 14 nt, Human
guggagaagccauu

SEQ ID NO: 3451578 - RNA, 17 nt, Human
guggagaaucacaggcu

SEQ ID NO: 3451579 - RNA, 19 nt, Human
guggagaaucacaggcugg

SEQ ID NO: 3451580 - RNA, 20 nt, Human
guggagaaucacaggcuggg

SEQ ID NO: 3451581 - RNA, 21 nt, Human
guggagaaucacaggcugggc

SEQ ID NO: 3451582 - RNA, 16 nt, Human
guggagacugcuuccc

SEQ ID NO: 3451583 - RNA, 20 nt, Human
guggagacuggggggcuuga

SEQ ID NO: 3451584 - RNA, 17 nt, Human
guggagagcuggugccc

SEQ ID NO: 3451585 - RNA, 18 nt, Human
guggagagggaaugugaa

SEQ ID NO: 3451586 - RNA, 22 nt, Human
guggagagggacagcccacuga

SEQ ID NO: 3451587 - RNA, 17 nt, Human
guggagaugucuucgua

SEQ ID NO: 3451588 - RNA, 19 nt, Human
guggagaugucuucguaca

SEQ ID NO: 3451589 - RNA, 18 nt, Human
guggagcaaagugagggc

SEQ ID NO: 3451590 - RNA, 19 nt, Human
guggagcaaagugagggcc

SEQ ID NO: 3451591 - RNA, 23 nt, Human
guggagcagccaacaagcagggg

SEQ ID NO: 3451592 - RNA, 18 nt, Human
guggagccccacacuggg

SEQ ID NO: 3451593 - RNA, 22 nt, Human
guggagccugacagccagaacu

SEQ ID NO: 3451594 - RNA, 23 nt, Human
guggagccugacagccagaacuc

SEQ ID NO: 3451595 - RNA, 15 nt, Human
guggaggaaggauug

SEQ ID NO: 3451596 - RNA, 19 nt, Human
guggaggaaggauuguaaa

SEQ ID NO: 3451597 - RNA, 20 nt, Human
guggaggaaggauuguaaaa

SEQ ID NO: 3451598 - RNA, 16 nt, Human
guggaggaaugcuccc

SEQ ID NO: 3451599 - RNA, 17 nt, Human
guggaggaaugcucccc

SEQ ID NO: 3451600 - RNA, 12 nt, Human
guggaggagcag

SEQ ID NO: 3451601 - RNA, 16 nt, Human
guggaggagguuggga

SEQ ID NO: 3451602 - RNA, 13 nt, Human
guggaggcacuuu

SEQ ID NO: 3451603 - RNA, 15 nt, Human
guggaggcagccagg

SEQ ID NO: 3451604 - RNA, 11 nt, Human
guggaggcagu

SEQ ID NO: 3451605 - RNA, 16 nt, Human
guggaggcugcaguga

SEQ ID NO: 3451606 - RNA, 14 nt, Human
guggaggcuuccug

SEQ ID NO: 3451607 - RNA, 12 nt, Human
guggaggggugu

SEQ ID NO: 3451608 - RNA, 23 nt, Human
guggagggguguggcagugguuu

SEQ ID NO: 3451609 - RNA, 22 nt, Human
guggagguuaaggcugaggaaa

SEQ ID NO: 3451610 - RNA, 22 nt, Human
guggagguugcagugagccaag

SEQ ID NO: 3451611 - RNA, 16 nt, Human
guggagucugccaccc

SEQ ID NO: 3451612 - RNA, 14 nt, Human
guggauagaugccc

SEQ ID NO: 3451613 - RNA, 23 nt, Human
guggaucacaaaguggaacgaaa

SEQ ID NO: 3451614 - RNA, 13 nt, Human
guggaucacagag

SEQ ID NO: 3451615 - RNA, 13 nt, Human
guggaucaccuga

SEQ ID NO: 3451616 - RNA, 17 nt, Human
guggaucuccaaggacc

SEQ ID NO: 3451617 - RNA, 23 nt, Human
guggaugauccccacgccacagc

SEQ ID NO: 3451618 - RNA, 16 nt, Human
guggaugccugguggc

SEQ ID NO: 3451619 - RNA, 23 nt, Human
guggauggguuuuaugagaugga

SEQ ID NO: 3451620 - RNA, 13 nt, Human
guggaugucuucc

SEQ ID NO: 3451621 - RNA, 16 nt, Human
guggaugucuuccuug

SEQ ID NO: 3451622 - RNA, 12 nt, Human
guggauguuacu

SEQ ID NO: 3451623 - RNA, 18 nt, Human
guggauuccgagugguga

SEQ ID NO: 3451624 - RNA, 18 nt, Human
guggauucuuguuuugcu

SEQ ID NO: 3451625 - RNA, 13 nt, Human
guggauucuuuaa

SEQ ID NO: 3451626 - RNA, 17 nt, Human
guggauugccucugaaa

SEQ ID NO: 3451627 - RNA, 14 nt, Human
guggauugcucauc

SEQ ID NO: 3451628 - RNA, 13 nt, Human
guggauuucaguu

SEQ ID NO: 3451629 - RNA, 18 nt, Human
guggauuuuguuuaaaaa

SEQ ID NO: 3451630 - RNA, 22 nt, Human
guggcaaagccuucauugccuu

SEQ ID NO: 3451631 - RNA, 15 nt, Human
guggcaaggcugugc

SEQ ID NO: 3451632 - RNA, 19 nt, Human
guggcaagugaauuugccu

SEQ ID NO: 3451633 - RNA, 22 nt, Human
guggcacacaccuguaguccca

SEQ ID NO: 3451634 - RNA, 12 nt, Human
guggcacaggcc

SEQ ID NO: 3451635 - RNA, 19 nt, Human
guggcacgucaucuaguuu

SEQ ID NO: 3451636 - RNA, 16 nt, Human
guggcacucaacauga

SEQ ID NO: 3451637 - RNA, 14 nt, Human
guggcacugagccc

SEQ ID NO: 3451638 - RNA, 13 nt, Human
guggcacuugggg

SEQ ID NO: 3451639 - RNA, 9 nt, Human
guggcagag

SEQ ID NO: 3451640 - RNA, 15 nt, Human
guggcagagcuugga

SEQ ID NO: 3451641 - RNA, 19 nt, Human
guggcagagcuuggacugg

SEQ ID NO: 3451642 - RNA, 11 nt, Human
guggcagagga

SEQ ID NO: 3451643 - RNA, 14 nt, Human
guggcagcucaccu

SEQ ID NO: 3451644 - RNA, 20 nt, Human
guggcagcucaccucucccu

SEQ ID NO: 3451645 - RNA, 21 nt, Human
guggcagcugcgguccaccca

SEQ ID NO: 3451646 - RNA, 22 nt, Human
guggcagcugcgguccacccag

SEQ ID NO: 3451647 - RNA, 13 nt, Human
guggcagcugcuu

SEQ ID NO: 3451648 - RNA, 17 nt, Human
guggcaggacacugcag

SEQ ID NO: 3451649 - RNA, 19 nt, Human
guggcaggcagcgccaagc

SEQ ID NO: 3451650 - RNA, 14 nt, Human
guggcagggcacag

SEQ ID NO: 3451651 - RNA, 15 nt, Human
guggcagggcacagg

SEQ ID NO: 3451652 - RNA, 12 nt, Human
guggcagggcuc

SEQ ID NO: 3451653 - RNA, 13 nt, Human
guggcagggcuca

SEQ ID NO: 3451654 - RNA, 16 nt, Human
guggcaggggacagga

SEQ ID NO: 3451655 - RNA, 21 nt, Human
guggcaggugaccuucuggga

SEQ ID NO: 3451656 - RNA, 20 nt, Human
guggcaguaaagagaaacuu

SEQ ID NO: 3451657 - RNA, 18 nt, Human
guggcaguggaggugggg

SEQ ID NO: 3451658 - RNA, 17 nt, Human
guggcauagcccagaca

SEQ ID NO: 3451659 - RNA, 20 nt, Human
guggcaucaccuuaggcagg

SEQ ID NO: 3451660 - RNA, 22 nt, Human
guggcaucaccuuaggcaggga

SEQ ID NO: 3451661 - RNA, 16 nt, Human
guggcaucccaguggc

SEQ ID NO: 3451662 - RNA, 18 nt, Human
guggcaucuuugccuugg

SEQ ID NO: 3451663 - RNA, 21 nt, Human
guggcaucuuugccuugggcu

SEQ ID NO: 3451664 - RNA, 19 nt, Human
guggccaaaagcuagacag

SEQ ID NO: 3451665 - RNA, 22 nt, Human
guggccaagaagcaguggccuu

SEQ ID NO: 3451666 - RNA, 23 nt, Human
guggccaagaagcaguggccuua

SEQ ID NO: 3451667 - RNA, 18 nt, Human
guggccaaggagcugcua

SEQ ID NO: 3451668 - RNA, 14 nt, Human
guggccacucagcu

SEQ ID NO: 3451669 - RNA, 16 nt, Human
guggccacuuuaagag

SEQ ID NO: 3451670 - RNA, 15 nt, Human
guggccagaccagag

SEQ ID NO: 3451671 - RNA, 17 nt, Human
guggccagagcugggag

SEQ ID NO: 3451672 - RNA, 13 nt, Human
guggccagcccgg

SEQ ID NO: 3451673 - RNA, 23 nt, Human
guggccaggccgggaaaaagccc

SEQ ID NO: 3451674 - RNA, 16 nt, Human
guggccaucauuucug

SEQ ID NO: 3451675 - RNA, 18 nt, Human
guggccaugacccugccu

SEQ ID NO: 3451676 - RNA, 19 nt, Human
guggccaugcuccucuucc

SEQ ID NO: 3451677 - RNA, 19 nt, Human
guggcccaaggcuggcagg

SEQ ID NO: 3451678 - RNA, 13 nt, Human
guggcccaggacc

SEQ ID NO: 3451679 - RNA, 20 nt, Human
guggcccauccccccucacc

SEQ ID NO: 3451680 - RNA, 15 nt, Human
guggccccacccugg

SEQ ID NO: 3451681 - RNA, 20 nt, Human
guggccccacccugggcccu

SEQ ID NO: 3451682 - RNA, 14 nt, Human
guggccccacccuu

SEQ ID NO: 3451683 - RNA, 13 nt, Human
guggccccaccug

SEQ ID NO: 3451684 - RNA, 13 nt, Human
guggccccagccu

SEQ ID NO: 3451685 - RNA, 21 nt, Human
guggccccagccuggcccagc

SEQ ID NO: 3451686 - RNA, 22 nt, Human
guggccccagccuggcccagcu

SEQ ID NO: 3451687 - RNA, 18 nt, Human
guggcccucuccccugcc

SEQ ID NO: 3451688 - RNA, 13 nt, Human
guggcccugccau

SEQ ID NO: 3451689 - RNA, 19 nt, Human
gagcucuucaggccucccu

SEQ ID NO: 3451690 - RNA, 12 nt, Human
gagcucuuccua

SEQ ID NO: 3451691 - RNA, 17 nt, Human
gagcucuugugaggaaa

SEQ ID NO: 3451692 - RNA, 21 nt, Human
gagcucuugugaggaaaguca

SEQ ID NO: 3451693 - RNA, 14 nt, Human
gagcucuuugcacu

SEQ ID NO: 3451694 - RNA, 22 nt, Human
gagcugaaaaaucacauccugg

SEQ ID NO: 3451695 - RNA, 21 nt, Human
gagcugaaagcugguggcaga

SEQ ID NO: 3451696 - RNA, 17 nt, Human
gagcugacaaaauuuug

SEQ ID NO: 3451697 - RNA, 22 nt, Human
gagcugacacaaaccugccugg

SEQ ID NO: 3451698 - RNA, 17 nt, Human
gagcugacacaggauga

SEQ ID NO: 3451699 - RNA, 20 nt, Human
gagcugagaauagaaggaaa

SEQ ID NO: 3451700 - RNA, 13 nt, Human
gagcugagaugga

SEQ ID NO: 3451701 - RNA, 13 nt, Human
gagcugagcaggg

SEQ ID NO: 3451702 - RNA, 22 nt, Human
gagcugagccaggcuagcugga

SEQ ID NO: 3451703 - RNA, 23 nt, Human
gagcugagccaggcuagcuggag

SEQ ID NO: 3451704 - RNA, 16 nt, Human
gagcugaggcagcagu

SEQ ID NO: 3451705 - RNA, 17 nt, Human
gagcugaggccacacuc

SEQ ID NO: 3451706 - RNA, 14 nt, Human
gagcugagguuuca

SEQ ID NO: 3451707 - RNA, 19 nt, Human
gagcugauauaaauucugu

SEQ ID NO: 3451708 - RNA, 15 nt, Human
gagcugauccagagc

SEQ ID NO: 3451709 - RNA, 21 nt, Human
gagcugaucgcuucuccccca

SEQ ID NO: 3451710 - RNA, 13 nt, Human
gagcugccaccug

SEQ ID NO: 3451711 - RNA, 11 nt, Human
gagcugccagu

SEQ ID NO: 3451712 - RNA, 21 nt, Human
gagcugcccagaguugcuggg

SEQ ID NO: 3451713 - RNA, 13 nt, Human
guguuacauguau

SEQ ID NO: 3451714 - RNA, 23 nt, Human
guguuacccaguaacucaucugu

SEQ ID NO: 3451715 - RNA, 12 nt, Human
guguuaccugua

SEQ ID NO: 3451716 - RNA, 12 nt, Human
guguuacuaagu

SEQ ID NO: 3451717 - RNA, 21 nt, Human
guguuacugcaguugaaaggg

SEQ ID NO: 3451718 - RNA, 15 nt, Human
guguuacuguaauuc

SEQ ID NO: 3451719 - RNA, 21 nt, Human
guguuaggccuggcacagugu

SEQ ID NO: 3451720 - RNA, 21 nt, Human
guguuaguggcaccgccuccc

SEQ ID NO: 3451721 - RNA, 17 nt, Human
guguuagugguuaccca

SEQ ID NO: 3451722 - RNA, 16 nt, Human
guguuaucaccuagcu

SEQ ID NO: 3451723 - RNA, 16 nt, Human
guguuauuuaaagaag

SEQ ID NO: 3451724 - RNA, 17 nt, Human
guguuauuuaaagaaga

SEQ ID NO: 3451725 - RNA, 20 nt, Human
guguuauuuuaaucucagaa

SEQ ID NO: 3451726 - RNA, 16 nt, Human
guguucacugaagacg

SEQ ID NO: 3451727 - RNA, 23 nt, Human
guguucaguguuagcaguggguc

SEQ ID NO: 3451728 - RNA, 12 nt, Human
guguucauacau

SEQ ID NO: 3451729 - RNA, 15 nt, Human
guguuccaacaacca

SEQ ID NO: 3451730 - RNA, 17 nt, Human
guguuccaaguuuccaa

SEQ ID NO: 3451731 - RNA, 20 nt, Human
guguuccccucuugucuccc

SEQ ID NO: 3451732 - RNA, 15 nt, Human
guguucccuuugucu

SEQ ID NO: 3451733 - RNA, 21 nt, Human
guguucccuuugucuuucaaa

SEQ ID NO: 3451734 - RNA, 14 nt, Human
guguucgcuuggcu

SEQ ID NO: 3451735 - RNA, 22 nt, Human
guguucuaagaugugauauucu

SEQ ID NO: 3451736 - RNA, 22 nt, Human
guguucuccugcugcucccuca

SEQ ID NO: 3451737 - RNA, 11 nt, Human
guguucuccuu

SEQ ID NO: 3451738 - RNA, 16 nt, Human
guguucuccuuuuccu

SEQ ID NO: 3451739 - RNA, 14 nt, Human
guguucucucuuau

SEQ ID NO: 3451740 - RNA, 14 nt, Human
guguucuguuacaa

SEQ ID NO: 3451741 - RNA, 15 nt, Human
guguucuguuuuguu

SEQ ID NO: 3451742 - RNA, 17 nt, Human
guguugaaaauguucag

SEQ ID NO: 3451743 - RNA, 21 nt, Human
guguugaagagcagcuccuuc

SEQ ID NO: 3451744 - RNA, 20 nt, Human
guguugccaaauauguccug

SEQ ID NO: 3451745 - RNA, 17 nt, Human
guguugccacaggacac

SEQ ID NO: 3451746 - RNA, 17 nt, Human
guguugccacuuuccaa

SEQ ID NO: 3451747 - RNA, 21 nt, Human
gugacuagugcugaagcuuau

SEQ ID NO: 3451748 - RNA, 15 nt, Human
gugacuauauagaga

SEQ ID NO: 3451749 - RNA, 20 nt, Human
gugacuauauagagauguuu

SEQ ID NO: 3451750 - RNA, 15 nt, Human
gugacucacccaagc

SEQ ID NO: 3451751 - RNA, 20 nt, Human
gugacucgagucacacucaa

SEQ ID NO: 3451752 - RNA, 12 nt, Human
gugacucuuucc

SEQ ID NO: 3451753 - RNA, 18 nt, Human
gugacucuuuuuagggcc

SEQ ID NO: 3451754 - RNA, 16 nt, Human
gugacugaauuucuuu

SEQ ID NO: 3451755 - RNA, 18 nt, Human
gugacugaauuucuuuug

SEQ ID NO: 3451756 - RNA, 21 nt, Human
gugacugauguuaggcugggc

SEQ ID NO: 3451757 - RNA, 23 nt, Human
gugacugccccaacuccuggaag

SEQ ID NO: 3451758 - RNA, 16 nt, Human
gugacugucuggggag

SEQ ID NO: 3451759 - RNA, 17 nt, Human
gugagaaaaagcuccug

SEQ ID NO: 3451760 - RNA, 23 nt, Human
gugagaaaccuguaucuuucuau

SEQ ID NO: 3451761 - RNA, 15 nt, Human
gugagaacuacucag

SEQ ID NO: 3451762 - RNA, 15 nt, Human
gugagaagaauauug

SEQ ID NO: 3451763 - RNA, 21 nt, Human
gugagaagugaaugcugggac

SEQ ID NO: 3451764 - RNA, 20 nt, Human
gugagaccaccucucaauau

SEQ ID NO: 3451765 - RNA, 14 nt, Human
gugagacccccaca

SEQ ID NO: 3451766 - RNA, 17 nt, Human
gugagacccccacaccu

SEQ ID NO: 3451767 - RNA, 16 nt, Human
gugagacccugucucu

SEQ ID NO: 3451768 - RNA, 18 nt, Human
gugagagcgaggcugagc

SEQ ID NO: 3451769 - RNA, 12 nt, Human
gugagagcuggg

SEQ ID NO: 3451770 - RNA, 13 nt, Human
gugagagcugggu

SEQ ID NO: 3451771 - RNA, 23 nt, Human
gugagagggcaugcgcacaaggc

SEQ ID NO: 3451772 - RNA, 12 nt, Human
gugagaugaggg

SEQ ID NO: 3451773 - RNA, 15 nt, Human
gugagaugcagcugg

SEQ ID NO: 3451774 - RNA, 18 nt, Human
gugagaugcagcuggaaa

SEQ ID NO: 3451775 - RNA, 21 nt, Human
gugagaugcuagaacucccuu

SEQ ID NO: 3451776 - RNA, 18 nt, Human
gugagaugcuggagaaga

SEQ ID NO: 3451777 - RNA, 19 nt, Human
gugagaugcuggagaagag

SEQ ID NO: 3451778 - RNA, 15 nt, Human
gugagauguaauugu

SEQ ID NO: 3451779 - RNA, 12 nt, Human
gugagauuuuuu

SEQ ID NO: 3451780 - RNA, 13 nt, Human
gugagauuuuuua

SEQ ID NO: 3451781 - RNA, 21 nt, Human
gugagauuuuuuauugcuagu

SEQ ID NO: 3451782 - RNA, 17 nt, Human
gugagcaaaccugcccc

SEQ ID NO: 3451783 - RNA, 14 nt, Human
gugagcacagccua

SEQ ID NO: 3451784 - RNA, 21 nt, Human
gugagcacggccaacaaagcu

SEQ ID NO: 3451785 - RNA, 21 nt, Human
gugagcagccuggagcccugg

SEQ ID NO: 3451786 - RNA, 15 nt, Human
gugagcaggcuguga

SEQ ID NO: 3451787 - RNA, 20 nt, Human
gugagcauggaacacuucga

SEQ ID NO: 3451788 - RNA, 15 nt, Human
gugagccaccgugcc

SEQ ID NO: 3451789 - RNA, 17 nt, Human
gugagccaccgugccug

SEQ ID NO: 3451790 - RNA, 21 nt, Human
gugagccaccgugccuggcca

SEQ ID NO: 3451791 - RNA, 20 nt, Human
gugagccacugcaccgggcc

SEQ ID NO: 3451792 - RNA, 17 nt, Human
gugagccccugguccug

SEQ ID NO: 3451793 - RNA, 19 nt, Human
gugagccgagaucacgcca

SEQ ID NO: 3451794 - RNA, 12 nt, Human
gugagccgcauc

SEQ ID NO: 3451795 - RNA, 13 nt, Human
gugagccuggcuc

SEQ ID NO: 3451796 - RNA, 14 nt, Human
gugagccuuggcug

SEQ ID NO: 3451797 - RNA, 19 nt, Human
gugagcgccugugcacaca

SEQ ID NO: 3451798 - RNA, 20 nt, Human
gugagcgccugugcacacac

SEQ ID NO: 3451799 - RNA, 13 nt, Human
gugagcugagcag

SEQ ID NO: 3451800 - RNA, 16 nt, Human
gugagcugagcaggcc

SEQ ID NO: 3451801 - RNA, 13 nt, Human
gugagcugcacca

SEQ ID NO: 3451802 - RNA, 19 nt, Human
gugagcugcugccaugaac

SEQ ID NO: 3451803 - RNA, 15 nt, Human
gugagcuuugcugcu

SEQ ID NO: 3451804 - RNA, 19 nt, Human
gugaggaagccgcuggggc

SEQ ID NO: 3451805 - RNA, 18 nt, Human
gugaggaaggcaggaaga

SEQ ID NO: 3451806 - RNA, 22 nt, Human
gugaggagaaugaaauguaugu

SEQ ID NO: 3451807 - RNA, 11 nt, Human
gugaggagcug

SEQ ID NO: 3451808 - RNA, 18 nt, Human
gugaggagcuugaaaccc

SEQ ID NO: 3451809 - RNA, 21 nt, Human
gugaggauaacacaaguaaaa

SEQ ID NO: 3451810 - RNA, 17 nt, Human
gugaggaugaaaaaaua

SEQ ID NO: 3451811 - RNA, 21 nt, Human
gugaggauggccucugcuaag

SEQ ID NO: 3451812 - RNA, 15 nt, Human
gugaggcaggcuuug

SEQ ID NO: 3451813 - RNA, 23 nt, Human
gugaggcagugggucccacuucc

SEQ ID NO: 3451814 - RNA, 23 nt, Human
gugaggccacugaagaggaggag

SEQ ID NO: 3451815 - RNA, 11 nt, Human
gugaggccugg

SEQ ID NO: 3451816 - RNA, 15 nt, Human
gugaggccugucugu

SEQ ID NO: 3451817 - RNA, 12 nt, Human
gugaggcucugc

SEQ ID NO: 3451818 - RNA, 14 nt, Human
gugaggcuguccug

SEQ ID NO: 3451819 - RNA, 18 nt, Human
gugaggguaaguauuuuc

SEQ ID NO: 3451820 - RNA, 18 nt, Human
gugagggucagagaggag

SEQ ID NO: 3451821 - RNA, 15 nt, Human
gugagggucccaugu

SEQ ID NO: 3451822 - RNA, 19 nt, Human
gugagguccugggggccug

SEQ ID NO: 3451823 - RNA, 21 nt, Human
gugaggugcagagugcccaga

SEQ ID NO: 3451824 - RNA, 21 nt, Human
gugagguggaauuauuuuaaa

SEQ ID NO: 3451825 - RNA, 20 nt, Human
gugagguggguuuucuuccc

SEQ ID NO: 3451826 - RNA, 14 nt, Human
gugagguuucccaa

SEQ ID NO: 3451827 - RNA, 17 nt, Human
gugagguuucccaaugg

SEQ ID NO: 3451828 - RNA, 23 nt, Human
gugaguacuacaguccucccauc

SEQ ID NO: 3451829 - RNA, 16 nt, Human
gugaguaucagaauug

SEQ ID NO: 3451830 - RNA, 22 nt, Human
gugagucauuuaaauguguaca

SEQ ID NO: 3451831 - RNA, 16 nt, Human
gugaguccuccagaac

SEQ ID NO: 3451832 - RNA, 18 nt, Human
gugaguccuccagaacuc

SEQ ID NO: 3451833 - RNA, 15 nt, Human
gugagucgaggacag

SEQ ID NO: 3451834 - RNA, 22 nt, Human
gugagucgaggacagggaggug

SEQ ID NO: 3451835 - RNA, 22 nt, Human
gugagucucucugggccuuagg

SEQ ID NO: 3451836 - RNA, 13 nt, Human
gugagugagccug

SEQ ID NO: 3451837 - RNA, 12 nt, Human
gugagugccuuu

SEQ ID NO: 3451838 - RNA, 17 nt, Human
gugagugugacagggcc

SEQ ID NO: 3451839 - RNA, 18 nt, Human
gugagugugacagggcca

SEQ ID NO: 3451840 - RNA, 20 nt, Human
gugagugugacagggccagu

SEQ ID NO: 3451841 - RNA, 23 nt, Human
gugaguguguccaagugugugug

SEQ ID NO: 3451842 - RNA, 20 nt, Human
gugaguguguguuugugcug

SEQ ID NO: 3451843 - RNA, 16 nt, Human
gugaguguuucuauga

SEQ ID NO: 3451844 - RNA, 20 nt, Human
gugaguucucagggcuccug

SEQ ID NO: 3451845 - RNA, 17 nt, Human
gugaguugauagcacag

SEQ ID NO: 3451846 - RNA, 12 nt, Human
gugaguuggcuu

SEQ ID NO: 3451847 - RNA, 15 nt, Human
gugaguuugagcugc

SEQ ID NO: 3451848 - RNA, 17 nt, Human
gugaguuugagcugccu

SEQ ID NO: 3451849 - RNA, 16 nt, Human
gugaguuuggucugga

SEQ ID NO: 3451850 - RNA, 19 nt, Human
gugaguuuggucuggacug

SEQ ID NO: 3451851 - RNA, 15 nt, Human
gugaguuuguuucuu

SEQ ID NO: 3451852 - RNA, 17 nt, Human
gugaguuuguuucuuug

SEQ ID NO: 3451853 - RNA, 21 nt, Human
gugauaagggaaaagauaaag

SEQ ID NO: 3451854 - RNA, 15 nt, Human
gugauaauuuaagag

SEQ ID NO: 3451855 - RNA, 17 nt, Human
gugauacaaugcugugc

SEQ ID NO: 3451856 - RNA, 14 nt, Human
gugauagcacuuuc

SEQ ID NO: 3451857 - RNA, 19 nt, Human
gugauauaaguguguguuu

SEQ ID NO: 3451858 - RNA, 16 nt, Human
guuaagcauuaccacu

SEQ ID NO: 3451859 - RNA, 13 nt, Human
guuaagccuuugg

SEQ ID NO: 3451860 - RNA, 12 nt, Human
guuaagcucugc

SEQ ID NO: 3451861 - RNA, 14 nt, Human
guuaagcuuugaca

SEQ ID NO: 3451862 - RNA, 16 nt, Human
guuaagcuuugacacu

SEQ ID NO: 3451863 - RNA, 16 nt, Human
guuaaggaaacucuua

SEQ ID NO: 3451864 - RNA, 22 nt, Human
guuaaggaccguggcccugccc

SEQ ID NO: 3451865 - RNA, 12 nt, Human
guuaaggccuga

SEQ ID NO: 3451866 - RNA, 16 nt, Human
guuaaggccugaauca

SEQ ID NO: 3451867 - RNA, 16 nt, Human
guuaaggcugaggaaa

SEQ ID NO: 3451868 - RNA, 14 nt, Human
guuaagggaaggaa

SEQ ID NO: 3451869 - RNA, 18 nt, Human
guuaagucuaucugguau

SEQ ID NO: 3451870 - RNA, 15 nt, Human
guuaagucuguuuua

SEQ ID NO: 3451871 - RNA, 14 nt, Human
guuaagugguuuca

SEQ ID NO: 3451872 - RNA, 22 nt, Human
guuaaguugauggugaugaaau

SEQ ID NO: 3451873 - RNA, 15 nt, Human
guuaauacaagguau

SEQ ID NO: 3451874 - RNA, 18 nt, Human
guuaauacgcaggcaucu

SEQ ID NO: 3451875 - RNA, 18 nt, Human
guuaauauugauuuauua

SEQ ID NO: 3451876 - RNA, 14 nt, Human
guuaaucaauuuaa

SEQ ID NO: 3451877 - RNA, 18 nt, Human
guuaaucucuguuaugua

SEQ ID NO: 3451878 - RNA, 14 nt, Human
guuaaucuuaaugu

SEQ ID NO: 3451879 - RNA, 19 nt, Human
guuaaugcuuaagagggaa

SEQ ID NO: 3451880 - RNA, 20 nt, Human
guuaauguauuuguucaugu

SEQ ID NO: 3451881 - RNA, 23 nt, Human
guuaauguuauaucauauguaua

SEQ ID NO: 3451882 - RNA, 14 nt, Human
guuaauuagcauuc

SEQ ID NO: 3451883 - RNA, 12 nt, Human
guuaauuuaaag

SEQ ID NO: 3451884 - RNA, 18 nt, Human
guuaauuuuauucaagaa

SEQ ID NO: 3451885 - RNA, 17 nt, Human
guuaauuuugaagugcu

SEQ ID NO: 3451886 - RNA, 15 nt, Human
guuaauuuuuacaug

SEQ ID NO: 3451887 - RNA, 14 nt, Human
guuaauuuuuccaa

SEQ ID NO: 3451888 - RNA, 20 nt, Human
guuaauuuuuugguacaaaa

SEQ ID NO: 3451889 - RNA, 16 nt, Human
guuacaaacuacagac

SEQ ID NO: 3451890 - RNA, 14 nt, Human
guuacaaacugcaa

SEQ ID NO: 3451891 - RNA, 16 nt, Human
guuacaaacugcaaua

SEQ ID NO: 3451892 - RNA, 19 nt, Human
guuacaaacugcaauagag

SEQ ID NO: 3451893 - RNA, 21 nt, Human
guuacaacagauuugugaacu

SEQ ID NO: 3451894 - RNA, 17 nt, Human
guuacacaaaggaccuc

SEQ ID NO: 3451895 - RNA, 12 nt, Human
guuacacccuuu

SEQ ID NO: 3451896 - RNA, 22 nt, Human
guuacacccuuucuugacaaaa

SEQ ID NO: 3451897 - RNA, 20 nt, Human
guuacacuguuagaacacua

SEQ ID NO: 3451898 - RNA, 12 nt, Human
guuacagaaagu

SEQ ID NO: 3451899 - RNA, 19 nt, Human
guuacagaaaguggugcuc

SEQ ID NO: 3451900 - RNA, 15 nt, Human
guuacagacaaagcg

SEQ ID NO: 3451901 - RNA, 13 nt, Human
guuacagagaccu

SEQ ID NO: 3451902 - RNA, 13 nt, Human
guuacagcucccc

SEQ ID NO: 3451903 - RNA, 22 nt, Human
guuacaguaaugucauaaagug

SEQ ID NO: 3451904 - RNA, 18 nt, Human
guuacaguaugcuugcuc

SEQ ID NO: 3451905 - RNA, 13 nt, Human
guuacaguucugu

SEQ ID NO: 3451906 - RNA, 19 nt, Human
guuacauaagauaaaugug

SEQ ID NO: 3451907 - RNA, 21 nt, Human
guuacaugcauacuucaaaag

SEQ ID NO: 3451908 - RNA, 19 nt, Human
gugauguucuaaggcucug

SEQ ID NO: 3451909 - RNA, 16 nt, Human
gugauguuuuuaugau

SEQ ID NO: 3451910 - RNA, 19 nt, Human
gugauuaaacgugcagacu

SEQ ID NO: 3451911 - RNA, 13 nt, Human
gugauuaaggucu

SEQ ID NO: 3451912 - RNA, 17 nt, Human
gugauuaccagggacug

SEQ ID NO: 3451913 - RNA, 22 nt, Human
gugauuagagggaggagaauga

SEQ ID NO: 3451914 - RNA, 16 nt, Human
gugauuauuucacuuu

SEQ ID NO: 3451915 - RNA, 21 nt, Human
gugauucaaucuguaaacugu

SEQ ID NO: 3451916 - RNA, 23 nt, Human
gugauucaaucuguaaacugugu

SEQ ID NO: 3451917 - RNA, 22 nt, Human
gugauucaauucaacacucccu

SEQ ID NO: 3451918 - RNA, 21 nt, Human
gugauuccuuugaagaggaaa

SEQ ID NO: 3451919 - RNA, 22 nt, Human
gugauucuccugccucagccuc

SEQ ID NO: 3451920 - RNA, 22 nt, Human
gugauugacagcuuugcugcug

SEQ ID NO: 3451921 - RNA, 23 nt, Human
gugauugacagcuuugcugcuga

SEQ ID NO: 3451922 - RNA, 12 nt, Human
gugauugcagcu

SEQ ID NO: 3451923 - RNA, 24 nt, Human
gugauuggccuguagaguugcuga

SEQ ID NO: 3451924 - RNA, 19 nt, Human
gugauuuaagacacuuuuu

SEQ ID NO: 3451925 - RNA, 22 nt, Human
gugauuuaagggcccaggucag

SEQ ID NO: 3451926 - RNA, 16 nt, Human
gugauuuaauaguguu

SEQ ID NO: 3451927 - RNA, 18 nt, Human
gugauuucccguggcccc

SEQ ID NO: 3451928 - RNA, 21 nt, Human
gugauuucccguggccccagc

SEQ ID NO: 3451929 - RNA, 22 nt, Human
gugauuucccguggccccagcc

SEQ ID NO: 3451930 - RNA, 23 nt, Human
gugauuucccguggccccagccu

SEQ ID NO: 3451931 - RNA, 17 nt, Human
gugauuugaaaaauaua

SEQ ID NO: 3451932 - RNA, 13 nt, Human
gugauuugacugu

SEQ ID NO: 3451933 - RNA, 14 nt, Human
gugauuugacuguu

SEQ ID NO: 3451934 - RNA, 14 nt, Human
gugauuuuaacucu

SEQ ID NO: 3451935 - RNA, 17 nt, Human
gugauuuuaacucuguc

SEQ ID NO: 3451936 - RNA, 21 nt, Human
gugauuuuaugaucaguguug

SEQ ID NO: 3451937 - RNA, 22 nt, Human
gugauuuuuauccaaucuuguu

SEQ ID NO: 3451938 - RNA, 20 nt, Human
gugauuuuuaugccaccuga

SEQ ID NO: 3451939 - RNA, 14 nt, Human
gugauuuuuuuguc

SEQ ID NO: 3451940 - RNA, 19 nt, Human
gugcaaaaauuuuuggauu

SEQ ID NO: 3451941 - RNA, 19 nt, Human
gugcaaaauauuugacuau

SEQ ID NO: 3451942 - RNA, 13 nt, Human
gugcaacacuggu

SEQ ID NO: 3451943 - RNA, 13 nt, Human
gugcaacagacaa

SEQ ID NO: 3451944 - RNA, 14 nt, Human
gugcaacagacaag

SEQ ID NO: 3451945 - RNA, 15 nt, Human
gugcaacagacaagu

SEQ ID NO: 3451946 - RNA, 12 nt, Human
gugcaacagcac

SEQ ID NO: 3451947 - RNA, 13 nt, Human
gugcaacccaagg

SEQ ID NO: 3451948 - RNA, 14 nt, Human
gugcaacccuuacc

SEQ ID NO: 3451949 - RNA, 23 nt, Human
gugcaaccucuuggccugaucag

SEQ ID NO: 3451950 - RNA, 16 nt, Human
gugcaacgccgugggc

SEQ ID NO: 3451951 - RNA, 20 nt, Human
gugcaagagacucuggccuc

SEQ ID NO: 3451952 - RNA, 15 nt, Human
gugcaaggcagccgu

SEQ ID NO: 3451953 - RNA, 22 nt, Human
gugcaaguguaugcacgugugc

SEQ ID NO: 3451954 - RNA, 17 nt, Human
gugcaagugucugugug

SEQ ID NO: 3451955 - RNA, 18 nt, Human
gugcaagugucugugugc

SEQ ID NO: 3451956 - RNA, 22 nt, Human
gugcaagugugugcacaugugu

SEQ ID NO: 3451957 - RNA, 19 nt, Human
gugcaauaaaucugaccca

SEQ ID NO: 3451958 - RNA, 16 nt, Human
gugcaauauauuuugu

SEQ ID NO: 3451959 - RNA, 23 nt, Human
gugcaauauauuuuguaugcaag

SEQ ID NO: 3451960 - RNA, 20 nt, Human
gugcaauuucaagguucuaa

SEQ ID NO: 3451961 - RNA, 15 nt, Human
gugcacaaauauuua

SEQ ID NO: 3451962 - RNA, 20 nt, Human
gugcacaaauauuuauuuuc

SEQ ID NO: 3451963 - RNA, 13 nt, Human
gugcacaagcucc

SEQ ID NO: 3451964 - RNA, 21 nt, Human
gugcacaagcuccaagcuccc

SEQ ID NO: 3451965 - RNA, 11 nt, Human
gugcacacaga

SEQ ID NO: 3451966 - RNA, 20 nt, Human
gugcacaccccacucccaca

SEQ ID NO: 3451967 - RNA, 19 nt, Human
gugcacagcacaaauuagu

SEQ ID NO: 3451968 - RNA, 13 nt, Human
gugcacagccacu

SEQ ID NO: 3451969 - RNA, 13 nt, Human
gugcacagcuguc

SEQ ID NO: 3451970 - RNA, 14 nt, Human
gugcacaggagggg

SEQ ID NO: 3451971 - RNA, 12 nt, Human
gugcacaggcag

SEQ ID NO: 3451972 - RNA, 13 nt, Human
gugcacaggcaga

SEQ ID NO: 3451973 - RNA, 13 nt, Human
gugcacagugauu

SEQ ID NO: 3451974 - RNA, 21 nt, Human
gugcacauccgcgugugccug

SEQ ID NO: 3451975 - RNA, 15 nt, Human
gugcacccagaagaa

SEQ ID NO: 3451976 - RNA, 23 nt, Human
gugcacccaugggcucugacaga

SEQ ID NO: 3451977 - RNA, 21 nt, Human
gugcaccuuaccaacuuucug

SEQ ID NO: 3451978 - RNA, 15 nt, Human
gugcacggccagcug

SEQ ID NO: 3451979 - RNA, 18 nt, Human
gugcacguugcuucaggc

SEQ ID NO: 3451980 - RNA, 15 nt, Human
gugcacugcccaugg

SEQ ID NO: 3451981 - RNA, 15 nt, Human
gugcacugggaggcu

SEQ ID NO: 3451982 - RNA, 20 nt, Human
gugcacugggaggcuccccu

SEQ ID NO: 3451983 - RNA, 21 nt, Human
gugcacugggaggcuccccuu

SEQ ID NO: 3451984 - RNA, 15 nt, Human
gugcagacuggaggg

SEQ ID NO: 3451985 - RNA, 23 nt, Human
gugcagaggaaguggaaggcauc

SEQ ID NO: 3451986 - RNA, 12 nt, Human
gugcagaggcug

SEQ ID NO: 3451987 - RNA, 22 nt, Human
gugcagaggcuguggcugguga

SEQ ID NO: 3451988 - RNA, 16 nt, Human
gugcagagugcccaga

SEQ ID NO: 3451989 - RNA, 18 nt, Human
gugcagagugcccagaac

SEQ ID NO: 3451990 - RNA, 21 nt, Human
gugcagcagauuggaaggaga

SEQ ID NO: 3451991 - RNA, 14 nt, Human
gugcagcagggcag

SEQ ID NO: 3451992 - RNA, 22 nt, Human
gugcagccccgccuccaggcca

SEQ ID NO: 3451993 - RNA, 19 nt, Human
gugcagcccguguggcccc

SEQ ID NO: 3451994 - RNA, 18 nt, Human
gugcagccgcugagcgag

SEQ ID NO: 3451995 - RNA, 23 nt, Human
gugcagcucaaggaaaggccuga

SEQ ID NO: 3451996 - RNA, 14 nt, Human
gugcagcugauuuu

SEQ ID NO: 3451997 - RNA, 18 nt, Human
gugcagcugauuuuaaca

SEQ ID NO: 3451998 - RNA, 17 nt, Human
gugcaggagcgcucccu

SEQ ID NO: 3451999 - RNA, 18 nt, Human
gugcaggccugcucaggg

SEQ ID NO: 3452000 - RNA, 15 nt, Human
gugcaggcuggcacc

SEQ ID NO: 3452001 - RNA, 13 nt, Human
gugcaggcuggcc

SEQ ID NO: 3452002 - RNA, 14 nt, Human
gugcaggcuggcca

SEQ ID NO: 3452003 - RNA, 16 nt, Human
guggcuacucugugcc

SEQ ID NO: 3452004 - RNA, 17 nt, Human
guggcuacucugugcca

SEQ ID NO: 3452005 - RNA, 20 nt, Human
guggcuagucaagcuccucc

SEQ ID NO: 3452006 - RNA, 17 nt, Human
guggcuagucagagaga

SEQ ID NO: 3452007 - RNA, 20 nt, Human
guggcuauuaaaacucuuuu

SEQ ID NO: 3452008 - RNA, 22 nt, Human
guggcucacgccuguaauccca

SEQ ID NO: 3452009 - RNA, 14 nt, Human
guggcucaugccug

SEQ ID NO: 3452010 - RNA, 12 nt, Human
guggcuccccuc

SEQ ID NO: 3452011 - RNA, 22 nt, Human
guggcuccccucuauuuagcau

SEQ ID NO: 3452012 - RNA, 21 nt, Human
guggcucuacaacugaguccu

SEQ ID NO: 3452013 - RNA, 16 nt, Human
guggcucugagaaggg

SEQ ID NO: 3452014 - RNA, 15 nt, Human
guggcucugcuggcc

SEQ ID NO: 3452015 - RNA, 15 nt, Human
guggcugacccaguc

SEQ ID NO: 3452016 - RNA, 15 nt, Human
guggcugaccccccu

SEQ ID NO: 3452017 - RNA, 14 nt, Human
guggcugcagccuc

SEQ ID NO: 3452018 - RNA, 19 nt, Human
guggcugcgugccccugcu

SEQ ID NO: 3452019 - RNA, 20 nt, Human
guggcugcgugccccugcug

SEQ ID NO: 3452020 - RNA, 17 nt, Human
guggcugcuagcacuug

SEQ ID NO: 3452021 - RNA, 24 nt, Human
guggcuggaaccacauugaagaau

SEQ ID NO: 3452022 - RNA, 12 nt, Human
guggcuggaaga

SEQ ID NO: 3452023 - RNA, 21 nt, Human
guggcuggguccaggggaugg

SEQ ID NO: 3452024 - RNA, 19 nt, Human
guggcuggguuggagggug

SEQ ID NO: 3452025 - RNA, 22 nt, Human
guggcugucaaugggaccugug

SEQ ID NO: 3452026 - RNA, 17 nt, Human
guggcuguccagugccc

SEQ ID NO: 3452027 - RNA, 18 nt, Human
guggcuguccagugccca

SEQ ID NO: 3452028 - RNA, 22 nt, Human
guggcuuaaaacaacacucaca

SEQ ID NO: 3452029 - RNA, 17 nt, Human
guggcuucacuccugcu

SEQ ID NO: 3452030 - RNA, 15 nt, Human
guggcuucagcucca

SEQ ID NO: 3452031 - RNA, 23 nt, Human
guggcuucccuuuucuuuguuca

SEQ ID NO: 3452032 - RNA, 16 nt, Human
guggcuuucagccucu

SEQ ID NO: 3452033 - RNA, 20 nt, Human
guggcuuuccuuguggcaga

SEQ ID NO: 3452034 - RNA, 16 nt, Human
guggcuuugcauuuua

SEQ ID NO: 3452035 - RNA, 18 nt, Human
guggcuuugcauuuuaaa

SEQ ID NO: 3452036 - RNA, 23 nt, Human
guggcuuugcauuuuaaaaauga

SEQ ID NO: 3452037 - RNA, 17 nt, Human
gugggaacgacugggca

SEQ ID NO: 3452038 - RNA, 18 nt, Human
gugggaacgagaggggaa

SEQ ID NO: 3452039 - RNA, 20 nt, Human
gugggaagcccauccugacc

SEQ ID NO: 3452040 - RNA, 21 nt, Human
gugggaagcccauccugacca

SEQ ID NO: 3452041 - RNA, 13 nt, Human
gugggaagggaga

SEQ ID NO: 3452042 - RNA, 22 nt, Human
gugggacacccugugauggggc

SEQ ID NO: 3452043 - RNA, 20 nt, Human
gugggacgggaugguucugg

SEQ ID NO: 3452044 - RNA, 20 nt, Human
gugggacggugcccaagcca

SEQ ID NO: 3452045 - RNA, 14 nt, Human
gugggacuguacac

SEQ ID NO: 3452046 - RNA, 15 nt, Human
gugggacuguacaca

SEQ ID NO: 3452047 - RNA, 21 nt, Human
gugggagaccggccugccagg

SEQ ID NO: 3452048 - RNA, 15 nt, Human
gugggagagcccagc

SEQ ID NO: 3452049 - RNA, 13 nt, Human
gugggagaggucu

SEQ ID NO: 3452050 - RNA, 12 nt, Human
gugggagcugag

SEQ ID NO: 3452051 - RNA, 14 nt, Human
gugggagcugccug

SEQ ID NO: 3452052 - RNA, 14 nt, Human
gugggagggagcag

SEQ ID NO: 3452053 - RNA, 15 nt, Human
gugggagggagcaga

SEQ ID NO: 3452054 - RNA, 15 nt, Human
gugggaggggcaggc

SEQ ID NO: 3452055 - RNA, 15 nt, Human
gugggaggguaccag

SEQ ID NO: 3452056 - RNA, 16 nt, Human
gugggaggguaccagc

SEQ ID NO: 3452057 - RNA, 13 nt, Human
gugggaggucagg

SEQ ID NO: 3452058 - RNA, 21 nt, Human
gugggaguaguuggagcauug

SEQ ID NO: 3452059 - RNA, 15 nt, Human
gugggagucaucuca

SEQ ID NO: 3452060 - RNA, 13 nt, Human
gugggagugugua

SEQ ID NO: 3452061 - RNA, 13 nt, Human
gugggauccucca

SEQ ID NO: 3452062 - RNA, 18 nt, Human
gugggaucugccccuccc

SEQ ID NO: 3452063 - RNA, 17 nt, Human
gugggaugaaccagccg

SEQ ID NO: 3452064 - RNA, 17 nt, Human
gugggauggaggagaag

SEQ ID NO: 3452065 - RNA, 15 nt, Human
gugggcaauuuagaa

SEQ ID NO: 3452066 - RNA, 20 nt, Human
gugggcacccacccugggac

SEQ ID NO: 3452067 - RNA, 14 nt, Human
gugggcaggaaaag

SEQ ID NO: 3452068 - RNA, 12 nt, Human
gugggcaggugg

SEQ ID NO: 3452069 - RNA, 17 nt, Human
gugggcauucucucucc

SEQ ID NO: 3452070 - RNA, 20 nt, Human
gugggcauuucuugcgagcc

SEQ ID NO: 3452071 - RNA, 12 nt, Human
gugggccagccc

SEQ ID NO: 3452072 - RNA, 14 nt, Human
gugggccaggacag

SEQ ID NO: 3452073 - RNA, 18 nt, Human
gugggccaggacaggccc

SEQ ID NO: 3452074 - RNA, 13 nt, Human
gugggccagggcu

SEQ ID NO: 3452075 - RNA, 19 nt, Human
gugggccagggcugcccug

SEQ ID NO: 3452076 - RNA, 16 nt, Human
gugggccagucugugg

SEQ ID NO: 3452077 - RNA, 15 nt, Human
gugggccauggcaau

SEQ ID NO: 3452078 - RNA, 22 nt, Human
gugggcccaggaccagcugggg

SEQ ID NO: 3452079 - RNA, 13 nt, Human
gugggccuggcca

SEQ ID NO: 3452080 - RNA, 19 nt, Human
gugggccuucagggaguga

SEQ ID NO: 3452081 - RNA, 17 nt, Human
gugggccuugcugggga

SEQ ID NO: 3452082 - RNA, 19 nt, Human
gugggcggcacagccuucu

SEQ ID NO: 3452083 - RNA, 13 nt, Human
gugggcggcagag

SEQ ID NO: 3452084 - RNA, 16 nt, Human
gugggcggcagagagg

SEQ ID NO: 3452085 - RNA, 23 nt, Human
gugggcgggcaggggagggucag

SEQ ID NO: 3452086 - RNA, 21 nt, Human
gugggcgugagaccugccccu

SEQ ID NO: 3452087 - RNA, 14 nt, Human
gugggcuaauuaaa

SEQ ID NO: 3452088 - RNA, 22 nt, Human
gugggcuccccucuuccucuug

SEQ ID NO: 3452089 - RNA, 18 nt, Human
gugggcucugugcaguca

SEQ ID NO: 3452090 - RNA, 16 nt, Human
gugggcugagcccugg

SEQ ID NO: 3452091 - RNA, 19 nt, Human
gugggcugcacucugugcc

SEQ ID NO: 3452092 - RNA, 21 nt, Human
gugggcugcacucugugccca

SEQ ID NO: 3452093 - RNA, 17 nt, Human
gugggcuggacuucuac

SEQ ID NO: 3452094 - RNA, 20 nt, Human
gugggcugggcccucucuuc

SEQ ID NO: 3452095 - RNA, 22 nt, Human
gugggcuggugacccagucaga

SEQ ID NO: 3452096 - RNA, 14 nt, Human
gugggcugugagug

SEQ ID NO: 3452097 - RNA, 15 nt, Human
gugggcuucagggca

SEQ ID NO: 3452098 - RNA, 22 nt, Human
gugggcuucccaguggcugcug

SEQ ID NO: 3452099 - RNA, 23 nt, Human
gugggcuucccaguggcugcugc

SEQ ID NO: 3452100 - RNA, 22 nt, Human
gugggcuuguggggccugggag

SEQ ID NO: 3452101 - RNA, 11 nt, Human
guggggacagg

SEQ ID NO: 3452102 - RNA, 13 nt, Human
guggggacccagg

SEQ ID NO: 3452103 - RNA, 16 nt, Human
guggggacccaggcuc

SEQ ID NO: 3452104 - RNA, 19 nt, Human
guggggagacaccucagag

SEQ ID NO: 3452105 - RNA, 20 nt, Human
guggggagacaccucagagc

SEQ ID NO: 3452106 - RNA, 13 nt, Human
guggggaggggcu

SEQ ID NO: 3452107 - RNA, 18 nt, Human
guggggaucucaggggcu

SEQ ID NO: 3452108 - RNA, 16 nt, Human
guggggauuucuccca

SEQ ID NO: 3452109 - RNA, 18 nt, Human
guggggcaagauuuuccu

SEQ ID NO: 3452110 - RNA, 15 nt, Human
guggggcagagccuc

SEQ ID NO: 3452111 - RNA, 13 nt, Human
guggggcagcuug

SEQ ID NO: 3452112 - RNA, 17 nt, Human
guggggcagcuugaggg

SEQ ID NO: 3452113 - RNA, 14 nt, Human
guggggcagggagc

SEQ ID NO: 3452114 - RNA, 12 nt, Human
guggggccccuc

SEQ ID NO: 3452115 - RNA, 17 nt, Human
guggggccgccgccucu

SEQ ID NO: 3452116 - RNA, 22 nt, Human
guggggccggggcuucugugca

SEQ ID NO: 3452117 - RNA, 14 nt, Human
guggggcgaggcag

SEQ ID NO: 3452118 - RNA, 17 nt, Human
guggggcugcuccucca

SEQ ID NO: 3452119 - RNA, 14 nt, Human
gugggggagggagg

SEQ ID NO: 3452120 - RNA, 14 nt, Human
gugggggcagaggg

SEQ ID NO: 3452121 - RNA, 18 nt, Human
gugggggcagagggcaga

SEQ ID NO: 3452122 - RNA, 14 nt, Human
gugggggggcagag

SEQ ID NO: 3452123 - RNA, 19 nt, Human
guggggguagggggcugga

SEQ ID NO: 3452124 - RNA, 22 nt, Human
guggggguagggggcuggagga

SEQ ID NO: 3452125 - RNA, 14 nt, Human
gugggggucugugu

SEQ ID NO: 3452126 - RNA, 15 nt, Human
gugggggucugugug

SEQ ID NO: 3452127 - RNA, 15 nt, Human
guggggguggaggcu

SEQ ID NO: 3452128 - RNA, 18 nt, Human
guggggguugcuguauaa

SEQ ID NO: 3452129 - RNA, 19 nt, Human
gugggguagguugggagaa

SEQ ID NO: 3452130 - RNA, 15 nt, Human
guggggucacucugg

SEQ ID NO: 3452131 - RNA, 21 nt, Human
guggggucaugcccuccucuc

SEQ ID NO: 3452132 - RNA, 22 nt, Human
gugggguccugccggagaggaa

SEQ ID NO: 3452133 - RNA, 19 nt, Human
guggggucucccucuccug

SEQ ID NO: 3452134 - RNA, 16 nt, Human
guggggugugcuggga

SEQ ID NO: 3452135 - RNA, 15 nt, Human
gugggguucuaggca

SEQ ID NO: 3452136 - RNA, 17 nt, Human
gugggguucugcuggga

SEQ ID NO: 3452137 - RNA, 16 nt, Human
gugggguuuccuggca

SEQ ID NO: 3452138 - RNA, 14 nt, Human
guggguacgggagg

SEQ ID NO: 3452139 - RNA, 15 nt, Human
guggguauaaaagau

SEQ ID NO: 3452140 - RNA, 9 nt, Human
gugggucag

SEQ ID NO: 3452141 - RNA, 20 nt, Human
gugggucccacuuccccucc

SEQ ID NO: 3452142 - RNA, 16 nt, Human
gugggucugugugugu

SEQ ID NO: 3452143 - RNA, 21 nt, Human
gugggucuucagggggccagg

SEQ ID NO: 3452144 - RNA, 16 nt, Human
gugggugacaagagcc

SEQ ID NO: 3452145 - RNA, 20 nt, Human
gugggugagaugcuggagaa

SEQ ID NO: 3452146 - RNA, 14 nt, Human
gugggugcucagaa

SEQ ID NO: 3452147 - RNA, 15 nt, Human
gugggugcucagaau

SEQ ID NO: 3452148 - RNA, 12 nt, Human
guuauauuucag

SEQ ID NO: 3452149 - RNA, 20 nt, Human
guuauauuuuacuacugugg

SEQ ID NO: 3452150 - RNA, 21 nt, Human
guuauauuuuucuuaaaaagu

SEQ ID NO: 3452151 - RNA, 23 nt, Human
guuauauuuuucuuaaaaaguaa

SEQ ID NO: 3452152 - RNA, 20 nt, Human
guuaucaccgugggcucccu

SEQ ID NO: 3452153 - RNA, 22 nt, Human
guuaucaccgugggcucccuga

SEQ ID NO: 3452154 - RNA, 14 nt, Human
guuaucacugugca

SEQ ID NO: 3452155 - RNA, 16 nt, Human
guuaucagugcuuccc

SEQ ID NO: 3452156 - RNA, 14 nt, Human
guuaucaugaauuu

SEQ ID NO: 3452157 - RNA, 18 nt, Human
guuaucaugaauuuuaaa

SEQ ID NO: 3452158 - RNA, 11 nt, Human
guuaucauguu

SEQ ID NO: 3452159 - RNA, 12 nt, Human
guuaucauguua

SEQ ID NO: 3452160 - RNA, 19 nt, Human
guuauccauuuaaaaaugg

SEQ ID NO: 3452161 - RNA, 18 nt, Human
guuaucgaaauaacaaug

SEQ ID NO: 3452162 - RNA, 15 nt, Human
guuaucuaaguuaau

SEQ ID NO: 3452163 - RNA, 18 nt, Human
guuaucuaaguuaauuua

SEQ ID NO: 3452164 - RNA, 21 nt, Human
guuaucuaaguuaauuuaaag

SEQ ID NO: 3452165 - RNA, 23 nt, Human
guuaucuuauacuguacaauaaa

SEQ ID NO: 3452166 - RNA, 19 nt, Human
guuaucuucucaaguucua

SEQ ID NO: 3452167 - RNA, 15 nt, Human
guuaugaaauaaaga

SEQ ID NO: 3452168 - RNA, 18 nt, Human
guuaugaacacuuaaauu

SEQ ID NO: 3452169 - RNA, 13 nt, Human
guuaugaaucagu

SEQ ID NO: 3452170 - RNA, 15 nt, Human
guuaugacuauguaa

SEQ ID NO: 3452171 - RNA, 21 nt, Human
guuaugacuccagaauuuccc

SEQ ID NO: 3452172 - RNA, 22 nt, Human
guuaugauaaaaaauuuuguaa

SEQ ID NO: 3452173 - RNA, 19 nt, Human
guuaugcggucuagggaau

SEQ ID NO: 3452174 - RNA, 23 nt, Human
guuauggaaacuguugccagaga

SEQ ID NO: 3452175 - RNA, 15 nt, Human
guuaugguagaaaaa

SEQ ID NO: 3452176 - RNA, 16 nt, Human
guuaugguagaaaaau

SEQ ID NO: 3452177 - RNA, 15 nt, Human
guuauguaaauaauu

SEQ ID NO: 3452178 - RNA, 19 nt, Human
guuauguaauaaccaaaug

SEQ ID NO: 3452179 - RNA, 22 nt, Human
guuauguaccauaugaucuguu

SEQ ID NO: 3452180 - RNA, 22 nt, Human
guuauguacuaguguucuguuu

SEQ ID NO: 3452181 - RNA, 17 nt, Human
guuauguacuguacuaa

SEQ ID NO: 3452182 - RNA, 15 nt, Human
guuaugucuguuuaa

SEQ ID NO: 3452183 - RNA, 16 nt, Human
guuaugucuguuuaag

SEQ ID NO: 3452184 - RNA, 14 nt, Human
guuauguguguaua

SEQ ID NO: 3452185 - RNA, 20 nt, Human
gauggggagaucggggccag

SEQ ID NO: 3452186 - RNA, 12 nt, Human
gauggggagggg

SEQ ID NO: 3452187 - RNA, 21 nt, Human
gauggggauaaaaugacuacu

SEQ ID NO: 3452188 - RNA, 23 nt, Human
gauggggauaaaaugacuacuua

SEQ ID NO: 3452189 - RNA, 23 nt, Human
gauggggcaggccaccuggcucu

SEQ ID NO: 3452190 - RNA, 21 nt, Human
gauggggcccuaauucagcca

SEQ ID NO: 3452191 - RNA, 22 nt, Human
gauggggcccugccuccuuugu

SEQ ID NO: 3452192 - RNA, 24 nt, Human
gauggggcccugccuccuuuguga

SEQ ID NO: 3452193 - RNA, 16 nt, Human
gaugggggaacucaga

SEQ ID NO: 3452194 - RNA, 21 nt, Human
gaugggggagucugaagcaga

SEQ ID NO: 3452195 - RNA, 23 nt, Human
gauggggggggauguggaucagg

SEQ ID NO: 3452196 - RNA, 18 nt, Human
gauggggguuucaccaua

SEQ ID NO: 3452197 - RNA, 17 nt, Human
gaugggguuucaccaug

SEQ ID NO: 3452198 - RNA, 21 nt, Human
gaugggugaaggcuggcauga

SEQ ID NO: 3452199 - RNA, 23 nt, Human
gauggguucuaauuuuggaugga

SEQ ID NO: 3452200 - RNA, 15 nt, Human
gaugguaagagaaaa

SEQ ID NO: 3452201 - RNA, 22 nt, Human
gaugguaagagaaaagagagaa

SEQ ID NO: 3452202 - RNA, 16 nt, Human
gaugguacgugacccu

SEQ ID NO: 3452203 - RNA, 15 nt, Human
gaugguaucauauau

SEQ ID NO: 3452204 - RNA, 19 nt, Human
gaugguaugcacaauucca

SEQ ID NO: 3452205 - RNA, 15 nt, Human
gauggucacuuaaaa

SEQ ID NO: 3452206 - RNA, 13 nt, Human
gaugguccugggg

SEQ ID NO: 3452207 - RNA, 21 nt, Human
gaugguccuggggcucugugc

SEQ ID NO: 3452208 - RNA, 13 nt, Human
gauggucuggucu

SEQ ID NO: 3452209 - RNA, 17 nt, Human
gauggucuggucuaugu

SEQ ID NO: 3452210 - RNA, 16 nt, Human
gauggucuuacagcag

SEQ ID NO: 3452211 - RNA, 12 nt, Human
gauggugcugag

SEQ ID NO: 3452212 - RNA, 17 nt, Human
gauggugcugagaagcu

SEQ ID NO: 3452213 - RNA, 15 nt, Human
gaugguggagggcca

SEQ ID NO: 3452214 - RNA, 20 nt, Human
gaugguggguggggcugcag

SEQ ID NO: 3452215 - RNA, 16 nt, Human
gaugguguggccugug

SEQ ID NO: 3452216 - RNA, 18 nt, Human
gaugguguggguguccug

SEQ ID NO: 3452217 - RNA, 24 nt, Human
gaugguguucaaaaaacuuguaaa

SEQ ID NO: 3452218 - RNA, 17 nt, Human
gaugguguuuuggggau

SEQ ID NO: 3452219 - RNA, 13 nt, Human
gaugguuccccug

SEQ ID NO: 3452220 - RNA, 21 nt, Human
gaugguuccccuguucacucu

SEQ ID NO: 3452221 - RNA, 22 nt, Human
gaugguucccuugaugaagaag

SEQ ID NO: 3452222 - RNA, 17 nt, Human
gaugguucguucuguuu

SEQ ID NO: 3452223 - RNA, 18 nt, Human
gaugguucuucaccuccu

SEQ ID NO: 3452224 - RNA, 13 nt, Human
gauguaaaaucuu

SEQ ID NO: 3452225 - RNA, 14 nt, Human
gauguaaaaucuug

SEQ ID NO: 3452226 - RNA, 16 nt, Human
gauguaaacagugccu

SEQ ID NO: 3452227 - RNA, 12 nt, Human
gauguaaagaug

SEQ ID NO: 3452228 - RNA, 13 nt, Human
gauguaaagaugu

SEQ ID NO: 3452229 - RNA, 15 nt, Human
gauguaauacuucuu

SEQ ID NO: 3452230 - RNA, 20 nt, Human
gauguaaucucucugcagcu

SEQ ID NO: 3452231 - RNA, 13 nt, Human
gauguaauguuuu

SEQ ID NO: 3452232 - RNA, 22 nt, Human
gauguaauuuaggguacuaaau

SEQ ID NO: 3452233 - RNA, 16 nt, Human
gauguacagucuguca

SEQ ID NO: 3452234 - RNA, 23 nt, Human
gauguacaguugggaaaauaugu

SEQ ID NO: 3452235 - RNA, 18 nt, Human
gauguagccaugaccuua

SEQ ID NO: 3452236 - RNA, 14 nt, Human
gauguaggagggac

SEQ ID NO: 3452237 - RNA, 16 nt, Human
gauguaggagggacug

SEQ ID NO: 3452238 - RNA, 18 nt, Human
gauguauccaugggggca

SEQ ID NO: 3452239 - RNA, 19 nt, Human
gauguaucugaguugccaa

SEQ ID NO: 3452240 - RNA, 20 nt, Human
gauguaugcacacacauaua

SEQ ID NO: 3452241 - RNA, 20 nt, Human
gauguauguugaagccuuug

SEQ ID NO: 3452242 - RNA, 21 nt, Human
gauguauguugaagccuuugu

SEQ ID NO: 3452243 - RNA, 21 nt, Human
gauguauuuugugaguuuguu

SEQ ID NO: 3452244 - RNA, 17 nt, Human
gaugucagcaguugcug

SEQ ID NO: 3452245 - RNA, 19 nt, Human
gaugucagcaguugcuggu

SEQ ID NO: 3452246 - RNA, 15 nt, Human
gaugucauacagaga

SEQ ID NO: 3452247 - RNA, 19 nt, Human
gaugucaucccauugucuu

SEQ ID NO: 3452248 - RNA, 18 nt, Human
gaugucccaacuuguaaa

SEQ ID NO: 3452249 - RNA, 11 nt, Human
gauguccccag

SEQ ID NO: 3452250 - RNA, 19 nt, Human
gaugucccuugaugcacag

SEQ ID NO: 3452251 - RNA, 21 nt, Human
gaugucccuuucuuggccagu

SEQ ID NO: 3452252 - RNA, 21 nt, Human
gauguccucaccacaugcgga

SEQ ID NO: 3452253 - RNA, 19 nt, Human
gaugucuccuaagcaccug

SEQ ID NO: 3452254 - RNA, 21 nt, Human
gaugucugaacuuugggaagc

SEQ ID NO: 3452255 - RNA, 18 nt, Human
gaugucuuauuuuuagau

SEQ ID NO: 3452256 - RNA, 14 nt, Human
gaugucuucauacc

SEQ ID NO: 3452257 - RNA, 22 nt, Human
gaugucuuccuuggagggggga

SEQ ID NO: 3452258 - RNA, 21 nt, Human
gaugucuucguacaguucuuc

SEQ ID NO: 3452259 - RNA, 13 nt, Human
gaugucuucugcc

SEQ ID NO: 3452260 - RNA, 14 nt, Human
gaugucuucugccu

SEQ ID NO: 3452261 - RNA, 21 nt, Human
gaugucuuggaacauuggaau

SEQ ID NO: 3452262 - RNA, 23 nt, Human
gaugucuuuuuauuaaaauauuu

SEQ ID NO: 3452263 - RNA, 16 nt, Human
gaugugaacacaucag

SEQ ID NO: 3452264 - RNA, 14 nt, Human
gaugugaagccaau

SEQ ID NO: 3452265 - RNA, 21 nt, Human
gaugugaauugccugcagaga

SEQ ID NO: 3452266 - RNA, 17 nt, Human
gaugugacauuugucau

SEQ ID NO: 3452267 - RNA, 14 nt, Human
gaugugacuguaua

SEQ ID NO: 3452268 - RNA, 22 nt, Human
gaugugagaaaaccccuuccca

SEQ ID NO: 3452269 - RNA, 11 nt, Human
gaugugauaua

SEQ ID NO: 3452270 - RNA, 18 nt, Human
gaugugauauauaagugu

SEQ ID NO: 3452271 - RNA, 15 nt, Human
gaugugauauucuaa

SEQ ID NO: 3452272 - RNA, 20 nt, Human
gaugugauucaaaagaugcc

SEQ ID NO: 3452273 - RNA, 18 nt, Human
gaugugauuguggaaugg

SEQ ID NO: 3452274 - RNA, 22 nt, Human
gaugugcaaaaauuuuuggauu

SEQ ID NO: 3452275 - RNA, 14 nt, Human
gaugugcaauugau

SEQ ID NO: 3452276 - RNA, 19 nt, Human
gaugugcacguaaaguacu

SEQ ID NO: 3452277 - RNA, 19 nt, Human
gaugugcagcauuucacuu

SEQ ID NO: 3452278 - RNA, 20 nt, Human
gaugugccauuuuaaaaaaa

SEQ ID NO: 3452279 - RNA, 13 nt, Human
gaugugccugggu

SEQ ID NO: 3452280 - RNA, 19 nt, Human
gaugugcuauaaucuguuu

SEQ ID NO: 3452281 - RNA, 21 nt, Human
gaugugcuuugcauuccuaca

SEQ ID NO: 3452282 - RNA, 18 nt, Human
gauguggaacugcugcca

SEQ ID NO: 3452283 - RNA, 21 nt, Human
gauguggcccuggccugcugg

SEQ ID NO: 3452284 - RNA, 12 nt, Human
gaugugggcagc

SEQ ID NO: 3452285 - RNA, 20 nt, Human
gaugugggggaagaccuggc

SEQ ID NO: 3452286 - RNA, 17 nt, Human
gaugugggucaaggaau

SEQ ID NO: 3452287 - RNA, 15 nt, Human
gauguggugaggcag

SEQ ID NO: 3452288 - RNA, 16 nt, Human
gaugugguuuucuuaa

SEQ ID NO: 3452289 - RNA, 20 nt, Human
gauguguaauuuuucuguau

SEQ ID NO: 3452290 - RNA, 12 nt, Human
gauguguacauc

SEQ ID NO: 3452291 - RNA, 18 nt, Human
gauguguccucagggagc

SEQ ID NO: 3452292 - RNA, 22 nt, Human
uaaaaaucuaagcagcuuauug

SEQ ID NO: 3452293 - RNA, 19 nt, Human
uaaaaaucuaccuucugua

SEQ ID NO: 3452294 - RNA, 17 nt, Human
uaaaaaucucaaauuuc

SEQ ID NO: 3452295 - RNA, 23 nt, Human
uaaaaaucucaaauuucuaaauc

SEQ ID NO: 3452296 - RNA, 16 nt, Human
uaaaaaucucucauuu

SEQ ID NO: 3452297 - RNA, 18 nt, Human
uaaaaaucuuuugaagca

SEQ ID NO: 3452298 - RNA, 14 nt, Human
uaaaaaugagaaca

SEQ ID NO: 3452299 - RNA, 18 nt, Human
uaaaaaugagaacauguu

SEQ ID NO: 3452300 - RNA, 22 nt, Human
uaaaaaugagguacucuccugg

SEQ ID NO: 3452301 - RNA, 19 nt, Human
uaaaaaugauuucaguagc

SEQ ID NO: 3452302 - RNA, 18 nt, Human
uaaaaaugggacuucuuu

SEQ ID NO: 3452303 - RNA, 23 nt, Human
uaaaaaugggacuucuuuucaca

SEQ ID NO: 3452304 - RNA, 15 nt, Human
uaaaaaugguuuaaa

SEQ ID NO: 3452305 - RNA, 22 nt, Human
uaaaaaugucuugcuguugaca

SEQ ID NO: 3452306 - RNA, 22 nt, Human
uaaaaauguuaaaauguauucu

SEQ ID NO: 3452307 - RNA, 21 nt, Human
uaaaaauguucuauuuuaauu

SEQ ID NO: 3452308 - RNA, 18 nt, Human
uaaaaauuagccuaagau

SEQ ID NO: 3452309 - RNA, 15 nt, Human
uaaaaauucugaaug

SEQ ID NO: 3452310 - RNA, 17 nt, Human
uaaaaauucugaaugua

SEQ ID NO: 3452311 - RNA, 18 nt, Human
uaaaaauugucuucaugu

SEQ ID NO: 3452312 - RNA, 22 nt, Human
uaaaaauuguuaauuuuuccua

SEQ ID NO: 3452313 - RNA, 17 nt, Human
uaaaacaaaaaacaaua

SEQ ID NO: 3452314 - RNA, 11 nt, Human
uaaaacaaaac

SEQ ID NO: 3452315 - RNA, 21 nt, Human
uaaaacaaaacaaaacaacau

SEQ ID NO: 3452316 - RNA, 14 nt, Human
uaaaacaaaauuug

SEQ ID NO: 3452317 - RNA, 17 nt, Human
uaaaacaaaauuugacu

SEQ ID NO: 3452318 - RNA, 22 nt, Human
uaaaacaacagcucgauccaaa

SEQ ID NO: 3452319 - RNA, 22 nt, Human
uaaaacaagcacuaaacaaaga

SEQ ID NO: 3452320 - RNA, 14 nt, Human
uaaaacaauauugu

SEQ ID NO: 3452321 - RNA, 17 nt, Human
uaaaacacaacaucuuu

SEQ ID NO: 3452322 - RNA, 22 nt, Human
uaaaacacaacaucuuuuucua

SEQ ID NO: 3452323 - RNA, 19 nt, Human
uaaaacaccucugcuuucu

SEQ ID NO: 3452324 - RNA, 19 nt, Human
uaaaacacuuccauaaucu

SEQ ID NO: 3452325 - RNA, 13 nt, Human
uaaaacagaaaaa

SEQ ID NO: 3452326 - RNA, 13 nt, Human
uaaaacagacacu

SEQ ID NO: 3452327 - RNA, 14 nt, Human
uaaaacaguauuua

SEQ ID NO: 3452328 - RNA, 13 nt, Human
uaaaacauagcaa

SEQ ID NO: 3452329 - RNA, 15 nt, Human
uaaaacaucauuccu

SEQ ID NO: 3452330 - RNA, 19 nt, Human
uaaaacaucuuugaaauua

SEQ ID NO: 3452331 - RNA, 12 nt, Human
uaaaacauuaaa

SEQ ID NO: 3452332 - RNA, 17 nt, Human
uaaaacauuaagaaaau

SEQ ID NO: 3452333 - RNA, 19 nt, Human
uaaaacauuggauuauccu

SEQ ID NO: 3452334 - RNA, 21 nt, Human
uaaaacauuggauuauccuga

SEQ ID NO: 3452335 - RNA, 22 nt, Human
uaaaacauuggauuauccugag

SEQ ID NO: 3452336 - RNA, 11 nt, Human
uaaaaccaaag

SEQ ID NO: 3452337 - RNA, 19 nt, Human
uaaaacccauuuaaauuuu

SEQ ID NO: 3452338 - RNA, 19 nt, Human
uaaaaccccaucucuacua

SEQ ID NO: 3452339 - RNA, 21 nt, Human
uaaaaccgaaggugaaaaaaa

SEQ ID NO: 3452340 - RNA, 16 nt, Human
uaaaaccugucaauga

SEQ ID NO: 3452341 - RNA, 22 nt, Human
uaaaaccuuccaugucaagauu

SEQ ID NO: 3452342 - RNA, 16 nt, Human
uaaaaccuuucaaauu

SEQ ID NO: 3452343 - RNA, 21 nt, Human
uaaaaccuuucaaauuucaca

SEQ ID NO: 3452344 - RNA, 16 nt, Human
guuccaaguuuccaaa

SEQ ID NO: 3452345 - RNA, 17 nt, Human
guuccaaguuuccaaac

SEQ ID NO: 3452346 - RNA, 23 nt, Human
guuccaauccuggcucuguggcu

SEQ ID NO: 3452347 - RNA, 11 nt, Human
guuccacagac

SEQ ID NO: 3452348 - RNA, 12 nt, Human
guuccacagacg

SEQ ID NO: 3452349 - RNA, 12 nt, Human
guuccacagagu

SEQ ID NO: 3452350 - RNA, 16 nt, Human
guuccacaguugccac

SEQ ID NO: 3452351 - RNA, 17 nt, Human
guuccaccaucaagcca

SEQ ID NO: 3452352 - RNA, 15 nt, Human
guuccaccccaagag

SEQ ID NO: 3452353 - RNA, 13 nt, Human
guuccacugagcu

SEQ ID NO: 3452354 - RNA, 16 nt, Human
guuccacugagcucca

SEQ ID NO: 3452355 - RNA, 18 nt, Human
guuccacuuauagccucu

SEQ ID NO: 3452356 - RNA, 20 nt, Human
guuccagcaauucuccugcc

SEQ ID NO: 3452357 - RNA, 21 nt, Human
guuccagcaauucuccugccu

SEQ ID NO: 3452358 - RNA, 17 nt, Human
guuccagggucccucug

SEQ ID NO: 3452359 - RNA, 19 nt, Human
guuccagggucccucugug

SEQ ID NO: 3452360 - RNA, 17 nt, Human
guuccaggguucucuug

SEQ ID NO: 3452361 - RNA, 15 nt, Human
guuccaguuucagag

SEQ ID NO: 3452362 - RNA, 23 nt, Human
guuccaugaagaccacauccaca

SEQ ID NO: 3452363 - RNA, 20 nt, Human
guuccaugaguuaucaugaa

SEQ ID NO: 3452364 - RNA, 14 nt, Human
guuccaugccugag

SEQ ID NO: 3452365 - RNA, 15 nt, Human
guuccaugccugagg

SEQ ID NO: 3452366 - RNA, 20 nt, Human
guuccauggccucuucagau

SEQ ID NO: 3452367 - RNA, 16 nt, Human
guuccaugggauacaa

SEQ ID NO: 3452368 - RNA, 19 nt, Human
guuccauuguuuggagaca

SEQ ID NO: 3452369 - RNA, 22 nt, Human
guucccaagaaaggaaaccuuu

SEQ ID NO: 3452370 - RNA, 17 nt, Human
guucccacauuaaagaa

SEQ ID NO: 3452371 - RNA, 14 nt, Human
guucccacuuggag

SEQ ID NO: 3452372 - RNA, 22 nt, Human
guucccagucuucugacaaacu

SEQ ID NO: 3452373 - RNA, 17 nt, Human
guucccauguagccccc

SEQ ID NO: 3452374 - RNA, 18 nt, Human
guucccauguagcccccu

SEQ ID NO: 3452375 - RNA, 19 nt, Human
guucccauguagcccccug

SEQ ID NO: 3452376 - RNA, 15 nt, Human
guuccccaaauacaa

SEQ ID NO: 3452377 - RNA, 13 nt, Human
guuccccacugga

SEQ ID NO: 3452378 - RNA, 14 nt, Human
guuccccacuggag

SEQ ID NO: 3452379 - RNA, 13 nt, Human
guuccccagagaa

SEQ ID NO: 3452380 - RNA, 14 nt, Human
guuccccaugcaga

SEQ ID NO: 3452381 - RNA, 14 nt, Human
guucccccagcccu

SEQ ID NO: 3452382 - RNA, 15 nt, Human
guucccccagcccug

SEQ ID NO: 3452383 - RNA, 18 nt, Human
guucccccuguuucagag

SEQ ID NO: 3452384 - RNA, 20 nt, Human
guuccccuaguaagugccuu

SEQ ID NO: 3452385 - RNA, 13 nt, Human
guuccccucacug

SEQ ID NO: 3452386 - RNA, 14 nt, Human
guuccccucucccu

SEQ ID NO: 3452387 - RNA, 20 nt, Human
guuccccucucccuucccuc

SEQ ID NO: 3452388 - RNA, 22 nt, Human
guuccccucucccuucccuccu

SEQ ID NO: 3452389 - RNA, 22 nt, Human
guuccccucuugucuccccugu

SEQ ID NO: 3452390 - RNA, 12 nt, Human
guuccccuggaa

SEQ ID NO: 3452391 - RNA, 24 nt, Human
guuccccuggaagcagugcccagg

SEQ ID NO: 3452392 - RNA, 15 nt, Human
guuccccuguucacu

SEQ ID NO: 3452393 - RNA, 17 nt, Human
guuccccuguucacucu

SEQ ID NO: 3452394 - RNA, 18 nt, Human
guuccccuguucacucua

SEQ ID NO: 3452395 - RNA, 17 nt, Human
guuccccuguuuauuca

SEQ ID NO: 3452396 - RNA, 19 nt, Human
guuccccuguuuauucaua

SEQ ID NO: 3452397 - RNA, 13 nt, Human
guuccccuuccac

SEQ ID NO: 3452398 - RNA, 20 nt, Human
guucccuacuuccugugacu

SEQ ID NO: 3452399 - RNA, 19 nt, Human
guucccuauuuuucucucc

SEQ ID NO: 3452400 - RNA, 17 nt, Human
guucccucucccuguug

SEQ ID NO: 3452401 - RNA, 14 nt, Human
guucccucugcuca

SEQ ID NO: 3452402 - RNA, 18 nt, Human
guucccucugcucagcca

SEQ ID NO: 3452403 - RNA, 20 nt, Human
guucccugaaaacccagaga

SEQ ID NO: 3452404 - RNA, 16 nt, Human
guucccugucuugucc

SEQ ID NO: 3452405 - RNA, 13 nt, Human
guucccuucuccu

SEQ ID NO: 3452406 - RNA, 21 nt, Human
guucccuugaaacuuugggaa

SEQ ID NO: 3452407 - RNA, 22 nt, Human
guucccuugaaacuuugggaaa

SEQ ID NO: 3452408 - RNA, 15 nt, Human
guucccuuggccuca

SEQ ID NO: 3452409 - RNA, 18 nt, Human
guucccuuggccucagaa

SEQ ID NO: 3452410 - RNA, 22 nt, Human
guucccuuugacgccaucccag

SEQ ID NO: 3452411 - RNA, 13 nt, Human
guucccuuugcuc

SEQ ID NO: 3452412 - RNA, 16 nt, Human
guucccuuugucuuuc

SEQ ID NO: 3452413 - RNA, 18 nt, Human
guuccgcacuuuccacuu

SEQ ID NO: 3452414 - RNA, 19 nt, Human
guuccggauuggcuugugu

SEQ ID NO: 3452415 - RNA, 15 nt, Human
guuccggcauggaca

SEQ ID NO: 3452416 - RNA, 17 nt, Human
guuccuaagaagcuucu

SEQ ID NO: 3452417 - RNA, 19 nt, Human
guuccuaagaagcuucuaa

SEQ ID NO: 3452418 - RNA, 14 nt, Human
guuccuaauccucu

SEQ ID NO: 3452419 - RNA, 22 nt, Human
guuccuauggcuggccacugca

SEQ ID NO: 3452420 - RNA, 14 nt, Human
guuccuauugucau

SEQ ID NO: 3452421 - RNA, 18 nt, Human
guuccuauugucauuaaa

SEQ ID NO: 3452422 - RNA, 16 nt, Human
guuccuccccuccagc

SEQ ID NO: 3452423 - RNA, 14 nt, Human
guuccucguucucc

SEQ ID NO: 3452424 - RNA, 16 nt, Human
guuccucugccugccc

SEQ ID NO: 3452425 - RNA, 13 nt, Human
guuccucugcuca

SEQ ID NO: 3452426 - RNA, 13 nt, Human
guuccucuuugca

SEQ ID NO: 3452427 - RNA, 17 nt, Human
guuccugacaucacagc

SEQ ID NO: 3452428 - RNA, 16 nt, Human
guuccugaugacccag

SEQ ID NO: 3452429 - RNA, 19 nt, Human
guuccugaugacccaggcu

SEQ ID NO: 3452430 - RNA, 15 nt, Human
guuccugcaaugaag

SEQ ID NO: 3452431 - RNA, 19 nt, Human
guuccugcggagugaagag

SEQ ID NO: 3452432 - RNA, 20 nt, Human
guuccugcggagugaagagg

SEQ ID NO: 3452433 - RNA, 17 nt, Human
guuccugcugcugucug

SEQ ID NO: 3452434 - RNA, 19 nt, Human
guuccuggggugcccucca

SEQ ID NO: 3452435 - RNA, 14 nt, Human
guuccugucccugc

SEQ ID NO: 3452436 - RNA, 16 nt, Human
guuccuguggcucccu

SEQ ID NO: 3452437 - RNA, 20 nt, Human
guuuaggauguugaaaaagu

SEQ ID NO: 3452438 - RNA, 15 nt, Human
guuuaggcuauuugu

SEQ ID NO: 3452439 - RNA, 17 nt, Human
guuuagggaacaauuug

SEQ ID NO: 3452440 - RNA, 16 nt, Human
guuuaguaaggcugug

SEQ ID NO: 3452441 - RNA, 13 nt, Human
guuuaguaaguuu

SEQ ID NO: 3452442 - RNA, 15 nt, Human
guuuaguuaaaugag

SEQ ID NO: 3452443 - RNA, 13 nt, Human
guuuauaaaauau

SEQ ID NO: 3452444 - RNA, 18 nt, Human
guuuauaaaauauaaaca

SEQ ID NO: 3452445 - RNA, 15 nt, Human
guuuauaauaaaaau

SEQ ID NO: 3452446 - RNA, 17 nt, Human
guuuauaauuuucugaa

SEQ ID NO: 3452447 - RNA, 19 nt, Human
guuuauacaguuuuaaaga

SEQ ID NO: 3452448 - RNA, 20 nt, Human
guuuauacaguuuuaaagaa

SEQ ID NO: 3452449 - RNA, 23 nt, Human
guuuauagagaaugaugauaaca

SEQ ID NO: 3452450 - RNA, 20 nt, Human
guuuauagagggccaagacu

SEQ ID NO: 3452451 - RNA, 17 nt, Human
guuuauaguuaaucuau

SEQ ID NO: 3452452 - RNA, 18 nt, Human
guuuauaguuaaucuaua

SEQ ID NO: 3452453 - RNA, 12 nt, Human
guuuauauaaau

SEQ ID NO: 3452454 - RNA, 20 nt, Human
guuuauauaagcuuguauuc

SEQ ID NO: 3452455 - RNA, 19 nt, Human
guuuauauggaagaaagua

SEQ ID NO: 3452456 - RNA, 14 nt, Human
guuuauauguguug

SEQ ID NO: 3452457 - RNA, 14 nt, Human
guuuauauuuucaa

SEQ ID NO: 3452458 - RNA, 18 nt, Human
guuuaucaacucaagaau

SEQ ID NO: 3452459 - RNA, 23 nt, Human
guuuaucagauacaucacugcuu

SEQ ID NO: 3452460 - RNA, 14 nt, Human
guuuaucaguaaau

SEQ ID NO: 3452461 - RNA, 14 nt, Human
guuuaucaugaagc

SEQ ID NO: 3452462 - RNA, 20 nt, Human
guuuaucauucaaguguaaa

SEQ ID NO: 3452463 - RNA, 16 nt, Human
guuuaucccuuaagaa

SEQ ID NO: 3452464 - RNA, 22 nt, Human
guuuaucccuuaagaaugaguu

SEQ ID NO: 3452465 - RNA, 18 nt, Human
guuuaucuagauguaaau

SEQ ID NO: 3452466 - RNA, 18 nt, Human
guuuaugaaaaagaagaa

SEQ ID NO: 3452467 - RNA, 15 nt, Human
guuuaugacaguaau

SEQ ID NO: 3452468 - RNA, 16 nt, Human
guuuaugagaaacugg

SEQ ID NO: 3452469 - RNA, 17 nt, Human
guuuaugcaaggaagga

SEQ ID NO: 3452470 - RNA, 17 nt, Human
guuuaugcagugcugcu

SEQ ID NO: 3452471 - RNA, 22 nt, Human
guuuauggccucagcugccuca

SEQ ID NO: 3452472 - RNA, 22 nt, Human
guuuaugugcuauuaauauuug

SEQ ID NO: 3452473 - RNA, 21 nt, Human
guuuauguuccauuaaacgau

SEQ ID NO: 3452474 - RNA, 22 nt, Human
guuuauuaaaauucugaauuuu

SEQ ID NO: 3452475 - RNA, 23 nt, Human
guuuauuaacaaauuauguuaca

SEQ ID NO: 3452476 - RNA, 20 nt, Human
guuuauuaaucuuaguguau

SEQ ID NO: 3452477 - RNA, 23 nt, Human
guuuauuacguaugucugguucu

SEQ ID NO: 3452478 - RNA, 16 nt, Human
guuuauuacuuauuug

SEQ ID NO: 3452479 - RNA, 17 nt, Human
guuuauuacuuccauga

SEQ ID NO: 3452480 - RNA, 14 nt, Human
guuuauuagaugaa

SEQ ID NO: 3452481 - RNA, 18 nt, Human
guuuauuauaaacuguau

SEQ ID NO: 3452482 - RNA, 14 nt, Human
guuuauucaaacug

SEQ ID NO: 3452483 - RNA, 16 nt, Human
guuuauucauaugcau

SEQ ID NO: 3452484 - RNA, 15 nt, Human
guuuauuccagagcu

SEQ ID NO: 3452485 - RNA, 16 nt, Human
guuuauucuucuagag

SEQ ID NO: 3452486 - RNA, 19 nt, Human
guuuauucuucuagaguuc

SEQ ID NO: 3452487 - RNA, 22 nt, Human
guuuauugaguuuguagguaaa

SEQ ID NO: 3452488 - RNA, 21 nt, Human
guuuauuggugaguuaggaac

SEQ ID NO: 3452489 - RNA, 16 nt, Human
guuuauuuaucaguga

SEQ ID NO: 3452490 - RNA, 19 nt, Human
guuuauuuaucagugacag

SEQ ID NO: 3452491 - RNA, 12 nt, Human
guuuauuucauu

SEQ ID NO: 3452492 - RNA, 21 nt, Human
guuuauuuccaaauaaaauga

SEQ ID NO: 3452493 - RNA, 19 nt, Human
guuuauuucuguuucucau

SEQ ID NO: 3452494 - RNA, 22 nt, Human
guuuauuuggaaaggaaugcaa

SEQ ID NO: 3452495 - RNA, 15 nt, Human
guuuauuuuaaaaca

SEQ ID NO: 3452496 - RNA, 18 nt, Human
guuuauuuuucauauugu

SEQ ID NO: 3452497 - RNA, 17 nt, Human
guuuauuuuucuguuac

SEQ ID NO: 3452498 - RNA, 14 nt, Human
guuucaaaaaucug

SEQ ID NO: 3452499 - RNA, 15 nt, Human
guuucaaaauaaaaa

SEQ ID NO: 3452500 - RNA, 19 nt, Human
guuucaaaauaaaaaccaa

SEQ ID NO: 3452501 - RNA, 18 nt, Human
guuucaaacacaaaugca

SEQ ID NO: 3452502 - RNA, 14 nt, Human
guuucaaacuguaa

SEQ ID NO: 3452503 - RNA, 12 nt, Human
guuucaaacuuu

SEQ ID NO: 3452504 - RNA, 19 nt, Human
guuucaaagaugcugugag

SEQ ID NO: 3452505 - RNA, 20 nt, Human
guuucaaagaugcugugagu

SEQ ID NO: 3452506 - RNA, 18 nt, Human
guuucaacggaaagugcu

SEQ ID NO: 3452507 - RNA, 20 nt, Human
guuucaagaggagcccccac

SEQ ID NO: 3452508 - RNA, 18 nt, Human
guuucaaggcacucuaga

SEQ ID NO: 3452509 - RNA, 17 nt, Human
guuucaaguuuuaaagu

SEQ ID NO: 3452510 - RNA, 16 nt, Human
guuucaauaaaguuug

SEQ ID NO: 3452511 - RNA, 15 nt, Human
guuucaaucacuguc

SEQ ID NO: 3452512 - RNA, 21 nt, Human
guuucaaugugauucuaaugu

SEQ ID NO: 3452513 - RNA, 17 nt, Human
guuucaauugcaucucc

SEQ ID NO: 3452514 - RNA, 22 nt, Human
guuucaauugcaucucccagau

SEQ ID NO: 3452515 - RNA, 19 nt, Human
guuucacggugccagguuu

SEQ ID NO: 3452516 - RNA, 13 nt, Human
guuucagaaaugu

SEQ ID NO: 3452517 - RNA, 14 nt, Human
guuucagaaaugug

SEQ ID NO: 3452518 - RNA, 17 nt, Human
guuucagauauauauca

SEQ ID NO: 3452519 - RNA, 20 nt, Human
guuucaggugacaugugaaa

SEQ ID NO: 3452520 - RNA, 16 nt, Human
guuucaguaauaaaac

SEQ ID NO: 3452521 - RNA, 17 nt, Human
guuucaguaauaaaaca

SEQ ID NO: 3452522 - RNA, 18 nt, Human
guuucaguaauaaaacau

SEQ ID NO: 3452523 - RNA, 22 nt, Human
guuucaguaauaaaacaucuuu

SEQ ID NO: 3452524 - RNA, 22 nt, Human
guuucauauucaugcaaguauu

SEQ ID NO: 3452525 - RNA, 13 nt, Human
guuucauauuucu

SEQ ID NO: 3452526 - RNA, 14 nt, Human
guuucauccuuccc

SEQ ID NO: 3452527 - RNA, 17 nt, Human
guuucauccuucccacu

SEQ ID NO: 3452528 - RNA, 18 nt, Human
guuucauguuuugugacu

SEQ ID NO: 3452529 - RNA, 16 nt, Human
guuucauucuccugcc

SEQ ID NO: 3452530 - RNA, 19 nt, Human
guuucauuuagucauguga

SEQ ID NO: 3452531 - RNA, 14 nt, Human
guuuccaaggagcu

SEQ ID NO: 3452532 - RNA, 21 nt, Human
guuuccaauuauuugacuuua

SEQ ID NO: 3452533 - RNA, 13 nt, Human
guuuccacaugcu

SEQ ID NO: 3452534 - RNA, 19 nt, Human
guuuccagacuuccuugag

SEQ ID NO: 3452535 - RNA, 20 nt, Human
guuuccagacuuccuugaga

SEQ ID NO: 3452536 - RNA, 14 nt, Human
guuuccagggaggg

SEQ ID NO: 3452537 - RNA, 23 nt, Human
guuuccaguacaccuuucagcca

SEQ ID NO: 3452538 - RNA, 21 nt, Human
guuucccaucccacugcuccc

SEQ ID NO: 3452539 - RNA, 21 nt, Human
guuucccccaacauauaaaau

SEQ ID NO: 3452540 - RNA, 14 nt, Human
guuuccucaggcug

SEQ ID NO: 3452541 - RNA, 18 nt, Human
guuuccucaggcugcugg

SEQ ID NO: 3452542 - RNA, 20 nt, Human
guuuccuccauuugagaaaa

SEQ ID NO: 3452543 - RNA, 22 nt, Human
guuuccucuguucaaagcugcc

SEQ ID NO: 3452544 - RNA, 17 nt, Human
guuuccugacauugucu

SEQ ID NO: 3452545 - RNA, 14 nt, Human
guuuccuggcacug

SEQ ID NO: 3452546 - RNA, 20 nt, Human
guuuccuggcacugcuucca

SEQ ID NO: 3452547 - RNA, 21 nt, Human
guuuccuggcacugcuuccag

SEQ ID NO: 3452548 - RNA, 22 nt, Human
guuuccuggcacugcuuccagu

SEQ ID NO: 3452549 - RNA, 23 nt, Human
guuuccuuguuuaucagauacau

SEQ ID NO: 3452550 - RNA, 21 nt, Human
gcaaaguauuguaaauuauau

SEQ ID NO: 3452551 - RNA, 21 nt, Human
gcaaagucaugcaaaggcugg

SEQ ID NO: 3452552 - RNA, 15 nt, Human
gcaaagucuaaaguu

SEQ ID NO: 3452553 - RNA, 16 nt, Human
gcaaagucuaaaguuu

SEQ ID NO: 3452554 - RNA, 17 nt, Human
gcaaagugagggccgag

SEQ ID NO: 3452555 - RNA, 18 nt, Human
gcaaaguguuuuguacca

SEQ ID NO: 3452556 - RNA, 16 nt, Human
gcaaaguucuguguuu

SEQ ID NO: 3452557 - RNA, 21 nt, Human
gcaaauaaguguauuuugaaa

SEQ ID NO: 3452558 - RNA, 20 nt, Human
gcaaauaaugaucgaaaaaa

SEQ ID NO: 3452559 - RNA, 18 nt, Human
gcaaauacuuagcaaaaa

SEQ ID NO: 3452560 - RNA, 21 nt, Human
gcaaauagaaaacaggaaaaa

SEQ ID NO: 3452561 - RNA, 11 nt, Human
gcaaauauaaa

SEQ ID NO: 3452562 - RNA, 20 nt, Human
gcaaauaucauacuguucaa

SEQ ID NO: 3452563 - RNA, 12 nt, Human
gcaaaucaaugc

SEQ ID NO: 3452564 - RNA, 13 nt, Human
gcaaaucagaaac

SEQ ID NO: 3452565 - RNA, 15 nt, Human
gcaaaucagaaacuu

SEQ ID NO: 3452566 - RNA, 17 nt, Human
gcaaaucaggcuuuugu

SEQ ID NO: 3452567 - RNA, 18 nt, Human
gcaaaucauuuguuuaaa

SEQ ID NO: 3452568 - RNA, 15 nt, Human
gcaaauccuauguga

SEQ ID NO: 3452569 - RNA, 13 nt, Human
gcaaaugacuuug

SEQ ID NO: 3452570 - RNA, 18 nt, Human
gcaaaugccagggcccgc

SEQ ID NO: 3452571 - RNA, 16 nt, Human
gcaaaugugaccugug

SEQ ID NO: 3452572 - RNA, 14 nt, Human
gcaaauguggcucc

SEQ ID NO: 3452573 - RNA, 15 nt, Human
gcaaauguggcuccu

SEQ ID NO: 3452574 - RNA, 23 nt, Human
gcaaauguuaaaaguuuuauaug

SEQ ID NO: 3452575 - RNA, 12 nt, Human
gcaaauguuaca

SEQ ID NO: 3452576 - RNA, 20 nt, Human
gcaaauguuuauuuaaaaga

SEQ ID NO: 3452577 - RNA, 12 nt, Human
gcaaauucucaa

SEQ ID NO: 3452578 - RNA, 12 nt, Human
gcaaauucuuuu

SEQ ID NO: 3452579 - RNA, 13 nt, Human
gcaaauuuauaau

SEQ ID NO: 3452580 - RNA, 21 nt, Human
gcaaauuuauaauuuuaagau

SEQ ID NO: 3452581 - RNA, 15 nt, Human
uaaaugaacaagaga

SEQ ID NO: 3452582 - RNA, 12 nt, Human
uaaaugaagaaa

SEQ ID NO: 3452583 - RNA, 14 nt, Human
uaaaugaauauuuu

SEQ ID NO: 3452584 - RNA, 15 nt, Human
uaaaugaauauuuug

SEQ ID NO: 3452585 - RNA, 21 nt, Human
uaaaugaauauuuugauaaua

SEQ ID NO: 3452586 - RNA, 16 nt, Human
uaaaugagcuauguau

SEQ ID NO: 3452587 - RNA, 20 nt, Human
uaaaugauucaaaaagucac

SEQ ID NO: 3452588 - RNA, 17 nt, Human
uaaaugauucuuaguga

SEQ ID NO: 3452589 - RNA, 15 nt, Human
uaaaugauuuaaauu

SEQ ID NO: 3452590 - RNA, 18 nt, Human
uaaaugcaauauguauua

SEQ ID NO: 3452591 - RNA, 19 nt, Human
uaaaugcagcccauuucuc

SEQ ID NO: 3452592 - RNA, 21 nt, Human
uaaaugcagcccauuucucca

SEQ ID NO: 3452593 - RNA, 19 nt, Human
uaaaugcaguuacaaauua

SEQ ID NO: 3452594 - RNA, 20 nt, Human
uaaaugcauauccugagcca

SEQ ID NO: 3452595 - RNA, 21 nt, Human
uaaaugcauauccugagccau

SEQ ID NO: 3452596 - RNA, 15 nt, Human
uaaaugccauagaaa

SEQ ID NO: 3452597 - RNA, 23 nt, Human
uaaaugccaucaauaaaaaauua

SEQ ID NO: 3452598 - RNA, 17 nt, Human
uaaaugcccagccccuu

SEQ ID NO: 3452599 - RNA, 15 nt, Human
uaaaugcccucuucu

SEQ ID NO: 3452600 - RNA, 13 nt, Human
uaaaugcccugcu

SEQ ID NO: 3452601 - RNA, 11 nt, Human
uaaaugcugcu

SEQ ID NO: 3452602 - RNA, 12 nt, Human
uaaauggccuca

SEQ ID NO: 3452603 - RNA, 22 nt, Human
uaaauggccucauguggcugga

SEQ ID NO: 3452604 - RNA, 22 nt, Human
uaaaugggacuggagucccugu

SEQ ID NO: 3452605 - RNA, 14 nt, Human
uaaaugggggugca

SEQ ID NO: 3452606 - RNA, 17 nt, Human
uaaaugggggugcauuu

SEQ ID NO: 3452607 - RNA, 14 nt, Human
uaaaugguauagca

SEQ ID NO: 3452608 - RNA, 15 nt, Human
uaaaugguguacaua

SEQ ID NO: 3452609 - RNA, 16 nt, Human
uaaaugguguacauaa

SEQ ID NO: 3452610 - RNA, 14 nt, Human
uaaaugguuaaaag

SEQ ID NO: 3452611 - RNA, 14 nt, Human
uaaauguaacaguc

SEQ ID NO: 3452612 - RNA, 18 nt, Human
uaaauguacagacauauu

SEQ ID NO: 3452613 - RNA, 21 nt, Human
uaaauguacagacauauuuaa

SEQ ID NO: 3452614 - RNA, 21 nt, Human
uaaauguaccuucagaauaag

SEQ ID NO: 3452615 - RNA, 15 nt, Human
uaaauguagaaagug

SEQ ID NO: 3452616 - RNA, 18 nt, Human
uaaauguaguucauacuu

SEQ ID NO: 3452617 - RNA, 15 nt, Human
uaaauguauaaauau

SEQ ID NO: 3452618 - RNA, 19 nt, Human
uaaauguauaaauauacag

SEQ ID NO: 3452619 - RNA, 12 nt, Human
uaaauguauacu

SEQ ID NO: 3452620 - RNA, 15 nt, Human
uaaauguauacuaua

SEQ ID NO: 3452621 - RNA, 20 nt, Human
uaaauguauacuauaguacc

SEQ ID NO: 3452622 - RNA, 12 nt, Human
uaaauguauaua

SEQ ID NO: 3452623 - RNA, 13 nt, Human
uaaauguauauac

SEQ ID NO: 3452624 - RNA, 14 nt, Human
uaaauguauauaca

SEQ ID NO: 3452625 - RNA, 18 nt, Human
uaaauguauauacacaua

SEQ ID NO: 3452626 - RNA, 21 nt, Human
uaaaugucacuuuuugaggca

SEQ ID NO: 3452627 - RNA, 22 nt, Human
uaaaugucacuuuuugaggcaa

SEQ ID NO: 3452628 - RNA, 20 nt, Human
uaaaugucuaguuguaacac

SEQ ID NO: 3452629 - RNA, 22 nt, Human
uaaaugucucuuuaaugucaca

SEQ ID NO: 3452630 - RNA, 13 nt, Human
uaaaugucuuaua

SEQ ID NO: 3452631 - RNA, 15 nt, Human
uaaaugucuuuguaa

SEQ ID NO: 3452632 - RNA, 11 nt, Human
uaaaugugaau

SEQ ID NO: 3452633 - RNA, 13 nt, Human
uaaaugugaauua

SEQ ID NO: 3452634 - RNA, 16 nt, Human
uaaaugugcauucuuu

SEQ ID NO: 3452635 - RNA, 13 nt, Human
uaaauguguguau

SEQ ID NO: 3452636 - RNA, 15 nt, Human
uaaauguguguaugu

SEQ ID NO: 3452637 - RNA, 11 nt, Human
uaaauguguug

SEQ ID NO: 3452638 - RNA, 20 nt, Human
uaaauguguuggacaaaugu

SEQ ID NO: 3452639 - RNA, 15 nt, Human
uaaauguguuuuguu

SEQ ID NO: 3452640 - RNA, 21 nt, Human
uaaauguguuuuguuuauuaa

SEQ ID NO: 3452641 - RNA, 14 nt, Human
uaaauguuaaagau

SEQ ID NO: 3452642 - RNA, 21 nt, Human
uaaauguuaaagauguagcaa

SEQ ID NO: 3452643 - RNA, 22 nt, Human
uaaauguuaaagauguagcaaa

SEQ ID NO: 3452644 - RNA, 16 nt, Human
uaaauguuaagaaaaa

SEQ ID NO: 3452645 - RNA, 17 nt, Human
uaaauguuaccucugaa

SEQ ID NO: 3452646 - RNA, 22 nt, Human
uaaauguuaugacuauguaaac

SEQ ID NO: 3452647 - RNA, 13 nt, Human
uaaauguuauuau

SEQ ID NO: 3452648 - RNA, 23 nt, Human
uaaauguuccuuuccuuuguagu

SEQ ID NO: 3452649 - RNA, 10 nt, Human
uaaauguuug

SEQ ID NO: 3452650 - RNA, 11 nt, Human
uaaauguuuga

SEQ ID NO: 3452651 - RNA, 22 nt, Human
uaaauguuuuauaaguucacaa

SEQ ID NO: 3452652 - RNA, 12 nt, Human
uaaauguuuugu

SEQ ID NO: 3452653 - RNA, 18 nt, Human
uaaauguuuuguaaacuu

SEQ ID NO: 3452654 - RNA, 22 nt, Human
uaaauguuuuguaaacuuugaa

SEQ ID NO: 3452655 - RNA, 18 nt, Human
uaaauguuuuucuaugua

SEQ ID NO: 3452656 - RNA, 16 nt, Human
uaaauuaaacaauuua

SEQ ID NO: 3452657 - RNA, 16 nt, Human
uaaauuaaauaaaaua

SEQ ID NO: 3452658 - RNA, 13 nt, Human
uaaauuaaauaua

SEQ ID NO: 3452659 - RNA, 21 nt, Human
uaaauuaaauauauguaugua

SEQ ID NO: 3452660 - RNA, 14 nt, Human
uaaauuaacuuuua

SEQ ID NO: 3452661 - RNA, 15 nt, Human
uaaauuaacuuuuau

SEQ ID NO: 3452662 - RNA, 19 nt, Human
uaaauuaacuuuuauaaac

SEQ ID NO: 3452663 - RNA, 21 nt, Human
uaaauuaacuuuuauaaacuu

SEQ ID NO: 3452664 - RNA, 22 nt, Human
uaaauuaacuuuuauaaacuuu

SEQ ID NO: 3452665 - RNA, 14 nt, Human
uaaauuacaauuuu

SEQ ID NO: 3452666 - RNA, 16 nt, Human
uaaauuacaauuuuau

SEQ ID NO: 3452667 - RNA, 17 nt, Human
uaaauuacaauuuuauc

SEQ ID NO: 3452668 - RNA, 23 nt, Human
uaaauuacuauagcaaaguagua

SEQ ID NO: 3452669 - RNA, 12 nt, Human
uaaauuagaaaa

SEQ ID NO: 3452670 - RNA, 20 nt, Human
uaaauuagaaaauauucucu

SEQ ID NO: 3452671 - RNA, 14 nt, Human
uaaauuaggaauaa

SEQ ID NO: 3452672 - RNA, 16 nt, Human
uaaauuaggaauaaau

SEQ ID NO: 3452673 - RNA, 17 nt, Human
uaaauuaggaauaaaua

SEQ ID NO: 3452674 - RNA, 22 nt, Human
uaaauuaggaggcucaacaaua

SEQ ID NO: 3452675 - RNA, 18 nt, Human
uaaauuaguacagcacuu

SEQ ID NO: 3452676 - RNA, 17 nt, Human
uaaauuauaacuuaaaa

SEQ ID NO: 3452677 - RNA, 19 nt, Human
uaaauuauaaggacugcau

SEQ ID NO: 3452678 - RNA, 21 nt, Human
uaaauuauaaggacugcaugg

SEQ ID NO: 3452679 - RNA, 16 nt, Human
uaaauuauguaaauua

SEQ ID NO: 3452680 - RNA, 14 nt, Human
uaaauuauguuuau

SEQ ID NO: 3452681 - RNA, 17 nt, Human
uaaauuauguuuauaua

SEQ ID NO: 3452682 - RNA, 19 nt, Human
uaaauuauuaguuuacauc

SEQ ID NO: 3452683 - RNA, 18 nt, Human
uaaauuauuguuuuucuu

SEQ ID NO: 3452684 - RNA, 16 nt, Human
uaaauuauuuauuauu

SEQ ID NO: 3452685 - RNA, 16 nt, Human
uaaauucaacuuugua

SEQ ID NO: 3452686 - RNA, 17 nt, Human
uaaauucacaauagaaa

SEQ ID NO: 3452687 - RNA, 20 nt, Human
uaaauucagauauauuuuuc

SEQ ID NO: 3452688 - RNA, 13 nt, Human
uaaauuccacugg

SEQ ID NO: 3452689 - RNA, 14 nt, Human
uaaauuccacugga

SEQ ID NO: 3452690 - RNA, 19 nt, Human
uaaauuccucaacaguguu

SEQ ID NO: 3452691 - RNA, 17 nt, Human
uaaauuccucuuugcuu

SEQ ID NO: 3452692 - RNA, 19 nt, Human
uaaauucugagacaugugu

SEQ ID NO: 3452693 - RNA, 11 nt, Human
uaaauucugau

SEQ ID NO: 3452694 - RNA, 12 nt, Human
uaaauucugauu

SEQ ID NO: 3452695 - RNA, 16 nt, Human
uaaauucugauuucuu

SEQ ID NO: 3452696 - RNA, 17 nt, Human
uaaauucuugcaaagua

SEQ ID NO: 3452697 - RNA, 13 nt, Human
uaaauucuuuauu

SEQ ID NO: 3452698 - RNA, 13 nt, Human
uaaauucuuucau

SEQ ID NO: 3452699 - RNA, 15 nt, Human
uaaauucuuuuuuaa

SEQ ID NO: 3452700 - RNA, 13 nt, Human
uaaauugaaauug

SEQ ID NO: 3452701 - RNA, 18 nt, Human
uaaauugacacuuaaaaa

SEQ ID NO: 3452702 - RNA, 13 nt, Human
uaaauugauguug

SEQ ID NO: 3452703 - RNA, 18 nt, Human
uaaauugcauaaagcaua

SEQ ID NO: 3452704 - RNA, 12 nt, Human
uaaauugcauca

SEQ ID NO: 3452705 - RNA, 18 nt, Human
uaaauugcaucacuguau

SEQ ID NO: 3452706 - RNA, 15 nt, Human
uaaauugcaugcugc

SEQ ID NO: 3452707 - RNA, 19 nt, Human
uaaauugcaugcugcuuua

SEQ ID NO: 3452708 - RNA, 19 nt, Human
uaaauugcucacaguuauu

SEQ ID NO: 3452709 - RNA, 17 nt, Human
uaaauuggcauggaaau

SEQ ID NO: 3452710 - RNA, 21 nt, Human
uaaauuggccugguauggcug

SEQ ID NO: 3452711 - RNA, 17 nt, Human
uaaauuguacagccggc

SEQ ID NO: 3452712 - RNA, 14 nt, Human
uaaauuguauauuc

SEQ ID NO: 3452713 - RNA, 19 nt, Human
uaaauuguauauucacuuu

SEQ ID NO: 3452714 - RNA, 14 nt, Human
uaaauugucuuaau

SEQ ID NO: 3452715 - RNA, 16 nt, Human
uaaauugucuuuaaaa

SEQ ID NO: 3452716 - RNA, 22 nt, Human
uaaauugucuuuaaaaacuguu

SEQ ID NO: 3452717 - RNA, 23 nt, Human
uaaauugucuuuaaaaacuguuu

SEQ ID NO: 3452718 - RNA, 20 nt, Human
gcaaggcccgagcagcugag

SEQ ID NO: 3452719 - RNA, 22 nt, Human
gcaaggcccgagcagcugagca

SEQ ID NO: 3452720 - RNA, 16 nt, Human
gcaaggcccugcugcc

SEQ ID NO: 3452721 - RNA, 13 nt, Human
gcaaggcugugcu

SEQ ID NO: 3452722 - RNA, 16 nt, Human
gcaagggcagggacag

SEQ ID NO: 3452723 - RNA, 19 nt, Human
gcaagggcggccuuuccca

SEQ ID NO: 3452724 - RNA, 14 nt, Human
gcaagggcucccca

SEQ ID NO: 3452725 - RNA, 18 nt, Human
gcaaggggugccugggaa

SEQ ID NO: 3452726 - RNA, 14 nt, Human
gcaagguaaaauuu

SEQ ID NO: 3452727 - RNA, 22 nt, Human
uaagcaaauacuuagcaaaaag

SEQ ID NO: 3452728 - RNA, 16 nt, Human
uaagcaaauuucaaaa

SEQ ID NO: 3452729 - RNA, 21 nt, Human
uaagcaaauuucaaaagacau

SEQ ID NO: 3452730 - RNA, 23 nt, Human
uaagcaaauuucaaaagacaugu

SEQ ID NO: 3452731 - RNA, 23 nt, Human
uaagcaacaucuagcaaauguua

SEQ ID NO: 3452732 - RNA, 13 nt, Human
uaagcaagagaga

SEQ ID NO: 3452733 - RNA, 22 nt, Human
uaagcaccuguaaugugcgagg

SEQ ID NO: 3452734 - RNA, 18 nt, Human
uaagcacucuuaaagcaa

SEQ ID NO: 3452735 - RNA, 16 nt, Human
uaagcacugugcuaau

SEQ ID NO: 3452736 - RNA, 13 nt, Human
uaagcagaaagug

SEQ ID NO: 3452737 - RNA, 20 nt, Human
uaagcagaccacugauaaaa

SEQ ID NO: 3452738 - RNA, 15 nt, Human
uaagcagaggagggg

SEQ ID NO: 3452739 - RNA, 16 nt, Human
uaagcagaggaggggc

SEQ ID NO: 3452740 - RNA, 16 nt, Human
uaagcagcuaaauuuu

SEQ ID NO: 3452741 - RNA, 17 nt, Human
uaagcagcuuauuguuu

SEQ ID NO: 3452742 - RNA, 18 nt, Human
uaagcaggcgcaagggag

SEQ ID NO: 3452743 - RNA, 12 nt, Human
uaagcagucccu

SEQ ID NO: 3452744 - RNA, 18 nt, Human
uaagcagugucuguguuu

SEQ ID NO: 3452745 - RNA, 18 nt, Human
uaagcauacuuuguaaau

SEQ ID NO: 3452746 - RNA, 19 nt, Human
uaagcauauauuuuuauau

SEQ ID NO: 3452747 - RNA, 21 nt, Human
uaagcauauauuuuuauauuu

SEQ ID NO: 3452748 - RNA, 21 nt, Human
uaagcaucauuauuuauguau

SEQ ID NO: 3452749 - RNA, 18 nt, Human
uaagcauuaccacucagg

SEQ ID NO: 3452750 - RNA, 17 nt, Human
uaagcauuacucuugua

SEQ ID NO: 3452751 - RNA, 14 nt, Human
uaagcauugccugg

SEQ ID NO: 3452752 - RNA, 15 nt, Human
uaagcauugugagua

SEQ ID NO: 3452753 - RNA, 12 nt, Human
uaagcauuguuu

SEQ ID NO: 3452754 - RNA, 15 nt, Human
uaagcauuguuugcu

SEQ ID NO: 3452755 - RNA, 17 nt, Human
uaagcauuguuugcuua

SEQ ID NO: 3452756 - RNA, 15 nt, Human
uaagccaaaacugag

SEQ ID NO: 3452757 - RNA, 18 nt, Human
uaagccaaaacugagcau

SEQ ID NO: 3452758 - RNA, 12 nt, Human
uaagccaaagaa

SEQ ID NO: 3452759 - RNA, 23 nt, Human
uaagccaaagaaaugaacauucc

SEQ ID NO: 3452760 - RNA, 14 nt, Human
uaagccaagggccu

SEQ ID NO: 3452761 - RNA, 15 nt, Human
uaagccaauuuuucu

SEQ ID NO: 3452762 - RNA, 18 nt, Human
uaagccaauuuuucugca

SEQ ID NO: 3452763 - RNA, 20 nt, Human
uaagccagacaucaacagau

SEQ ID NO: 3452764 - RNA, 17 nt, Human
uaagccagcaccggacc

SEQ ID NO: 3452765 - RNA, 13 nt, Human
uaagccagccugg

SEQ ID NO: 3452766 - RNA, 14 nt, Human
uaagccagccuggu

SEQ ID NO: 3452767 - RNA, 24 nt, Human
uaagccagccugguccaugcaggg

SEQ ID NO: 3452768 - RNA, 18 nt, Human
uaagcccacaguauauuu

SEQ ID NO: 3452769 - RNA, 17 nt, Human
uaagccccagcaagcaa

SEQ ID NO: 3452770 - RNA, 13 nt, Human
uaagcccccgcug

SEQ ID NO: 3452771 - RNA, 20 nt, Human
uaagcccugucgagacacuu

SEQ ID NO: 3452772 - RNA, 17 nt, Human
uaagccuaccugcucuc

SEQ ID NO: 3452773 - RNA, 19 nt, Human
uaagccucaucaucagagc

SEQ ID NO: 3452774 - RNA, 12 nt, Human
uaagccuguggc

SEQ ID NO: 3452775 - RNA, 22 nt, Human
uaaacuguuagcacuguugaug

SEQ ID NO: 3452776 - RNA, 13 nt, Human
uaaacuguugcuc

SEQ ID NO: 3452777 - RNA, 13 nt, Human
uaaacuuaaucua

SEQ ID NO: 3452778 - RNA, 18 nt, Human
uaaacuuaaucuaaaugg

SEQ ID NO: 3452779 - RNA, 19 nt, Human
uaaacuuaaucuaaaugga

SEQ ID NO: 3452780 - RNA, 15 nt, Human
uaaacuuagaauaaa

SEQ ID NO: 3452781 - RNA, 19 nt, Human
uaaacuuagaauaaaauug

SEQ ID NO: 3452782 - RNA, 21 nt, Human
uaaacuuagaauaaaauugua

SEQ ID NO: 3452783 - RNA, 15 nt, Human
uaaacuuauaaauca

SEQ ID NO: 3452784 - RNA, 16 nt, Human
uaaacuuauaacccac

SEQ ID NO: 3452785 - RNA, 13 nt, Human
uaaacuuaugaau

SEQ ID NO: 3452786 - RNA, 15 nt, Human
uaaacuuaugaaugu

SEQ ID NO: 3452787 - RNA, 12 nt, Human
uaaacuucagca

SEQ ID NO: 3452788 - RNA, 14 nt, Human
uaaacuucagcacc

SEQ ID NO: 3452789 - RNA, 20 nt, Human
uaaacuucauggucaugggu

SEQ ID NO: 3452790 - RNA, 15 nt, Human
uaaacuuccaaagaa

SEQ ID NO: 3452791 - RNA, 18 nt, Human
uaaacuuccccaucuucu

SEQ ID NO: 3452792 - RNA, 14 nt, Human
uaaacuucucugaa

SEQ ID NO: 3452793 - RNA, 17 nt, Human
uaaacuucucugaaggg

SEQ ID NO: 3452794 - RNA, 22 nt, Human
uaaacuucugcaacaagcaugc

SEQ ID NO: 3452795 - RNA, 23 nt, Human
uaaacuucugcaacaagcaugca

SEQ ID NO: 3452796 - RNA, 22 nt, Human
uaaacuuguuugcugugaacaa

SEQ ID NO: 3452797 - RNA, 12 nt, Human
uaaacuuuaaua

SEQ ID NO: 3452798 - RNA, 16 nt, Human
uaaacuuuaccuuuuu

SEQ ID NO: 3452799 - RNA, 13 nt, Human
uaaacuuucacac

SEQ ID NO: 3452800 - RNA, 11 nt, Human
uaaacuuugaa

SEQ ID NO: 3452801 - RNA, 15 nt, Human
uaaacuuuuaauuca

SEQ ID NO: 3452802 - RNA, 13 nt, Human
uaaacuuuucuga

SEQ ID NO: 3452803 - RNA, 14 nt, Human
uaaacuuuucugau

SEQ ID NO: 3452804 - RNA, 20 nt, Human
uaaacuuuuuucuuacuguc

SEQ ID NO: 3452805 - RNA, 15 nt, Human
uaaacuuuuuuucaa

SEQ ID NO: 3452806 - RNA, 18 nt, Human
uaaacuuuuuuucuguac

SEQ ID NO: 3452807 - RNA, 17 nt, Human
uaaacuuuuuuuugaga

SEQ ID NO: 3452808 - RNA, 18 nt, Human
uaaacuuuuuuuugagaa

SEQ ID NO: 3452809 - RNA, 9 nt, Human
uaaagaaaa

SEQ ID NO: 3452810 - RNA, 11 nt, Human
uaaagaaaaaa

SEQ ID NO: 3452811 - RNA, 12 nt, Human
uaaagaaaaaaa

SEQ ID NO: 3452812 - RNA, 14 nt, Human
uaaagaaaaaaaua

SEQ ID NO: 3452813 - RNA, 16 nt, Human
uaaagaaaaaaauguc

SEQ ID NO: 3452814 - RNA, 22 nt, Human
uaaagaaaaaaaugucaaaagu

SEQ ID NO: 3452815 - RNA, 20 nt, Human
uaaagaaaaaaauugaaaug

SEQ ID NO: 3452816 - RNA, 22 nt, Human
uaaagaaaaaaauugaaaugua

SEQ ID NO: 3452817 - RNA, 17 nt, Human
uaaagaaaaauauuuaa

SEQ ID NO: 3452818 - RNA, 15 nt, Human
uaaagaaaagaugca

SEQ ID NO: 3452819 - RNA, 13 nt, Human
uaaagaaaauaaa

SEQ ID NO: 3452820 - RNA, 14 nt, Human
uaaagaaaauaaaa

SEQ ID NO: 3452821 - RNA, 19 nt, Human
uaaagaaacagcuuucaag

SEQ ID NO: 3452822 - RNA, 14 nt, Human
uaaagaaacauggu

SEQ ID NO: 3452823 - RNA, 13 nt, Human
uaaagaaagagag

SEQ ID NO: 3452824 - RNA, 14 nt, Human
uaaagaaagagaga

SEQ ID NO: 3452825 - RNA, 15 nt, Human
uaaagaaagagagaa

SEQ ID NO: 3452826 - RNA, 19 nt, Human
uaaagaaagagagaaaaua

SEQ ID NO: 3452827 - RNA, 22 nt, Human
uaaagaaagagagaaaauaaaa

SEQ ID NO: 3452828 - RNA, 16 nt, Human
uaaagaaagcaacuuu

SEQ ID NO: 3452829 - RNA, 13 nt, Human
uaaagaaaggaaa

SEQ ID NO: 3452830 - RNA, 15 nt, Human
uaaagaaaggaaaag

SEQ ID NO: 3452831 - RNA, 22 nt, Human
uaaagaaaggaaaagaaaacaa

SEQ ID NO: 3452832 - RNA, 11 nt, Human
uaaagaaaguc

SEQ ID NO: 3452833 - RNA, 17 nt, Human
uaaagaaagucgaauua

SEQ ID NO: 3452834 - RNA, 16 nt, Human
uaaagaaaguguauuu

SEQ ID NO: 3452835 - RNA, 24 nt, Human
uaaagaaaguguauuuggaaauaa

SEQ ID NO: 3452836 - RNA, 16 nt, Human
uaaagaaauagaacaa

SEQ ID NO: 3452837 - RNA, 17 nt, Human
uaaagaaaugucuuaau

SEQ ID NO: 3452838 - RNA, 16 nt, Human
uaaagaaauugcaaua

SEQ ID NO: 3452839 - RNA, 15 nt, Human
uaaagaaauuuacua

SEQ ID NO: 3452840 - RNA, 16 nt, Human
uaaagaaauuuacuau

SEQ ID NO: 3452841 - RNA, 17 nt, Human
uaaagaaauuuacuaua

SEQ ID NO: 3452842 - RNA, 19 nt, Human
uaaagaaauuuacuauaua

SEQ ID NO: 3452843 - RNA, 19 nt, Human
uaaagaacacccuauauuu

SEQ ID NO: 3452844 - RNA, 14 nt, Human
uaaagaacugcaca

SEQ ID NO: 3452845 - RNA, 20 nt, Human
uaaagaacugcacaugaaga

SEQ ID NO: 3452846 - RNA, 13 nt, Human
uaaagaagauguu

SEQ ID NO: 3452847 - RNA, 13 nt, Human
uaaagaagcaaua

SEQ ID NO: 3452848 - RNA, 16 nt, Human
uaaagaaggaugaugu

SEQ ID NO: 3452849 - RNA, 17 nt, Human
uaaagaaguauuuuuag

SEQ ID NO: 3452850 - RNA, 15 nt, Human
uaaagaauaauaugc

SEQ ID NO: 3452851 - RNA, 18 nt, Human
uaaagaauacuugaacuu

SEQ ID NO: 3452852 - RNA, 15 nt, Human
uaaagaauaggacuu

SEQ ID NO: 3452853 - RNA, 14 nt, Human
uaaagaauauauau

SEQ ID NO: 3452854 - RNA, 15 nt, Human
uaaagaaucauuauu

SEQ ID NO: 3452855 - RNA, 13 nt, Human
uaaagaauuauuu

SEQ ID NO: 3452856 - RNA, 16 nt, Human
uaaagaauuauuuugu

SEQ ID NO: 3452857 - RNA, 15 nt, Human
uaaagaauucaaauu

SEQ ID NO: 3452858 - RNA, 19 nt, Human
uaaagacaaagacaaauuc

SEQ ID NO: 3452859 - RNA, 20 nt, Human
uaaagacaaagacaaauucu

SEQ ID NO: 3452860 - RNA, 21 nt, Human
uaaagacaaccauauuuagca

SEQ ID NO: 3452861 - RNA, 15 nt, Human
uaaagacaccuacug

SEQ ID NO: 3452862 - RNA, 21 nt, Human
uaaagacagggaagagcagaa

SEQ ID NO: 3452863 - RNA, 11 nt, Human
uaaagaccaaa

SEQ ID NO: 3452864 - RNA, 19 nt, Human
uaaagacccagggggagaa

SEQ ID NO: 3452865 - RNA, 19 nt, Human
uaaagacccuccuauucua

SEQ ID NO: 3452866 - RNA, 17 nt, Human
uaaagacgauuugucag

SEQ ID NO: 3452867 - RNA, 23 nt, Human
uaaagacguuuuauaagcaucau

SEQ ID NO: 3452868 - RNA, 20 nt, Human
uaaagacuggcuuuuauuaa

SEQ ID NO: 3452869 - RNA, 13 nt, Human
uaaagacugguuu

SEQ ID NO: 3452870 - RNA, 22 nt, Human
uaaagacugguuuucugccaau

SEQ ID NO: 3452871 - RNA, 16 nt, Human
uaaagacuuuuaugau

SEQ ID NO: 3452872 - RNA, 14 nt, Human
uaaagagaaaauug

SEQ ID NO: 3452873 - RNA, 15 nt, Human
uaaagagaaacuuug

SEQ ID NO: 3452874 - RNA, 12 nt, Human
uaaagagaauga

SEQ ID NO: 3452875 - RNA, 22 nt, Human
uaaagagacagugauauuggaa

SEQ ID NO: 3452876 - RNA, 22 nt, Human
uaaagagaccuaccucagguug

SEQ ID NO: 3452877 - RNA, 13 nt, Human
uaaagagacgaau

SEQ ID NO: 3452878 - RNA, 19 nt, Human
uaaagagagaacaggacua

SEQ ID NO: 3452879 - RNA, 16 nt, Human
uaaagagcccuugccu

SEQ ID NO: 3452880 - RNA, 13 nt, Human
uaaagagucuaga

SEQ ID NO: 3452881 - RNA, 19 nt, Human
uaaagagucuagauucaaa

SEQ ID NO: 3452882 - RNA, 21 nt, Human
uaaagagucuagauucaaagg

SEQ ID NO: 3452883 - RNA, 18 nt, Human
uaaagaguuaguuugagu

SEQ ID NO: 3452884 - RNA, 21 nt, Human
uaaagaguuguguuguucuuu

SEQ ID NO: 3452885 - RNA, 17 nt, Human
uaaagauaaagccagaa

SEQ ID NO: 3452886 - RNA, 15 nt, Human
uaaagauauuauuca

SEQ ID NO: 3452887 - RNA, 16 nt, Human
uaaagauauuauucac

SEQ ID NO: 3452888 - RNA, 16 nt, Human
uaaagaucuacaugaa

SEQ ID NO: 3452889 - RNA, 22 nt, Human
uaaagaugcaaggaccaggacu

SEQ ID NO: 3452890 - RNA, 13 nt, Human
uaaagauggaaaa

SEQ ID NO: 3452891 - RNA, 19 nt, Human
uaaagauggaguuucuaag

SEQ ID NO: 3452892 - RNA, 15 nt, Human
uaaagauguuaaaaa

SEQ ID NO: 3452893 - RNA, 20 nt, Human
uaaagauucuauaguucuag

SEQ ID NO: 3452894 - RNA, 17 nt, Human
uaaagauuuaggccaau

SEQ ID NO: 3452895 - RNA, 15 nt, Human
uaaagauuuaucaaa

SEQ ID NO: 3452896 - RNA, 22 nt, Human
uaaagauuuaucaaaucaguca

SEQ ID NO: 3452897 - RNA, 15 nt, Human
uaaagauuucuguuc

SEQ ID NO: 3452898 - RNA, 13 nt, Human
uaaagauuugcuu

SEQ ID NO: 3452899 - RNA, 19 nt, Human
uaaagauuuugaucucaca

SEQ ID NO: 3452900 - RNA, 12 nt, Human
uaaagauuuuuu

SEQ ID NO: 3452901 - RNA, 21 nt, Human
uaaagauuuuuuaauaauuua

SEQ ID NO: 3452902 - RNA, 22 nt, Human
uaaagauuuuuuaauaauuuag

SEQ ID NO: 3452903 - RNA, 21 nt, Human
uaaagcaaaaaaugaaugucu

SEQ ID NO: 3452904 - RNA, 19 nt, Human
uaaagcaaccaaaaagaaa

SEQ ID NO: 3452905 - RNA, 21 nt, Human
uaaagcaaccaaaaagaaaaa

SEQ ID NO: 3452906 - RNA, 22 nt, Human
uaaagcaacugucuauuucugc

SEQ ID NO: 3452907 - RNA, 20 nt, Human
uaaagcaacuguuaugaaau

SEQ ID NO: 3452908 - RNA, 15 nt, Human
uaaagcaauagaaac

SEQ ID NO: 3452909 - RNA, 13 nt, Human
uaaagcaauuuuc

SEQ ID NO: 3452910 - RNA, 19 nt, Human
uaaagcaauuuuccuugaa

SEQ ID NO: 3452911 - RNA, 21 nt, Human
uaaagcaauuuuccuugaagc

SEQ ID NO: 3452912 - RNA, 23 nt, Human
uaaagcaauuuuccuugaagccg

SEQ ID NO: 3452913 - RNA, 22 nt, Human
uaaagcacagucugaugacaca

SEQ ID NO: 3452914 - RNA, 13 nt, Human
uaaagcagccagc

SEQ ID NO: 3452915 - RNA, 17 nt, Human
uaaagcagguucuuguu

SEQ ID NO: 3452916 - RNA, 13 nt, Human
uaaagcaguggac

SEQ ID NO: 3452917 - RNA, 21 nt, Human
uaaagcauaaguauacaguuc

SEQ ID NO: 3452918 - RNA, 17 nt, Human
uaaagcaugaaauguga

SEQ ID NO: 3452919 - RNA, 19 nt, Human
uaaagcaugaaaugugaau

SEQ ID NO: 3452920 - RNA, 21 nt, Human
uaaagcaugaaaugugaauuu

SEQ ID NO: 3452921 - RNA, 13 nt, Human
uaaagcauuccaa

SEQ ID NO: 3452922 - RNA, 16 nt, Human
uaaagcauuccaacaa

SEQ ID NO: 3452923 - RNA, 12 nt, Human
uaaagcauuuau

SEQ ID NO: 3452924 - RNA, 14 nt, Human
uaaagccagccuga

SEQ ID NO: 3452925 - RNA, 21 nt, Human
uaaagccucaagguuuuaggu

SEQ ID NO: 3452926 - RNA, 17 nt, Human
gcaccauucugacucgg

SEQ ID NO: 3452927 - RNA, 20 nt, Human
gcaccauuuaaaaacaggca

SEQ ID NO: 3452928 - RNA, 14 nt, Human
gcacccacccuggg

SEQ ID NO: 3452929 - RNA, 18 nt, Human
gcacccaccguggaggag

SEQ ID NO: 3452930 - RNA, 19 nt, Human
gcacccaccguggaggagg

SEQ ID NO: 3452931 - RNA, 12 nt, Human
gcacccagaaca

SEQ ID NO: 3452932 - RNA, 11 nt, Human
gcacccagccc

SEQ ID NO: 3452933 - RNA, 14 nt, Human
gcacccagcccaga

SEQ ID NO: 3452934 - RNA, 12 nt, Human
gcacccagcccu

SEQ ID NO: 3452935 - RNA, 14 nt, Human
gcacccagcccugg

SEQ ID NO: 3452936 - RNA, 15 nt, Human
gcacccagcccuggu

SEQ ID NO: 3452937 - RNA, 15 nt, Human
gcacccauccuagag

SEQ ID NO: 3452938 - RNA, 17 nt, Human
gcaccccaaagcuuucc

SEQ ID NO: 3452939 - RNA, 20 nt, Human
gcaccccaaagcuuuccugc

SEQ ID NO: 3452940 - RNA, 22 nt, Human
gcaccccagcuggggccaggcu

SEQ ID NO: 3452941 - RNA, 14 nt, Human
gcacccccacccuu

SEQ ID NO: 3452942 - RNA, 15 nt, Human
gcacccccacccuuu

SEQ ID NO: 3452943 - RNA, 18 nt, Human
gcacccccacccuuuggg

SEQ ID NO: 3452944 - RNA, 13 nt, Human
gcacccccagccu

SEQ ID NO: 3452945 - RNA, 15 nt, Human
gcacccccagccugg

SEQ ID NO: 3452946 - RNA, 17 nt, Human
gcacccccagccugggc

SEQ ID NO: 3452947 - RNA, 18 nt, Human
gcacccccagccugggcc

SEQ ID NO: 3452948 - RNA, 23 nt, Human
gcacccccagccugggccuaugg

SEQ ID NO: 3452949 - RNA, 13 nt, Human
gcaccccccuggg

SEQ ID NO: 3452950 - RNA, 14 nt, Human
gcaccccccugggc

SEQ ID NO: 3452951 - RNA, 21 nt, Human
gcaccccccugggcugagaga

SEQ ID NO: 3452952 - RNA, 19 nt, Human
gcaccccccuguucuaagg

SEQ ID NO: 3452953 - RNA, 20 nt, Human
gcaccccccuguucuaaggg

SEQ ID NO: 3452954 - RNA, 14 nt, Human
gcacccccugcagc

SEQ ID NO: 3452955 - RNA, 15 nt, Human
gcacccccugcagcu

SEQ ID NO: 3452956 - RNA, 19 nt, Human
gcacccccugcagcuugua

SEQ ID NO: 3452957 - RNA, 16 nt, Human
gcaccccuuccaugug

SEQ ID NO: 3452958 - RNA, 15 nt, Human
gcaccccuuccuggg

SEQ ID NO: 3452959 - RNA, 17 nt, Human
gcaccccuucucuccuc

SEQ ID NO: 3452960 - RNA, 20 nt, Human
gcaccccuucucuccucccc

SEQ ID NO: 3452961 - RNA, 16 nt, Human
gcacccgccucucccg

SEQ ID NO: 3452962 - RNA, 15 nt, Human
gcacccggccccugc

SEQ ID NO: 3452963 - RNA, 17 nt, Human
gcacccggccccugcug

SEQ ID NO: 3452964 - RNA, 23 nt, Human
gcacccgggcucagggaccacag

SEQ ID NO: 3452965 - RNA, 14 nt, Human
gcacccuauaaauc

SEQ ID NO: 3452966 - RNA, 16 nt, Human
gcacccucaggcaggu

SEQ ID NO: 3452967 - RNA, 19 nt, Human
gcacccucaggcagguggg

SEQ ID NO: 3452968 - RNA, 20 nt, Human
gcacccucauacacagaaac

SEQ ID NO: 3452969 - RNA, 14 nt, Human
gcacccuccacccu

SEQ ID NO: 3452970 - RNA, 19 nt, Human
gcacccuccacccuguccc

SEQ ID NO: 3452971 - RNA, 22 nt, Human
gcacccuccacccuguccccca

SEQ ID NO: 3452972 - RNA, 14 nt, Human
gcacccuccccucc

SEQ ID NO: 3452973 - RNA, 17 nt, Human
gcacccucuccagauga

SEQ ID NO: 3452974 - RNA, 12 nt, Human
gcacccucuggc

SEQ ID NO: 3452975 - RNA, 13 nt, Human
gcacccugagggc

SEQ ID NO: 3452976 - RNA, 15 nt, Human
gcacccugagggcgg

SEQ ID NO: 3452977 - RNA, 19 nt, Human
gcacccuguggcccuggcu

SEQ ID NO: 3452978 - RNA, 12 nt, Human
gcacccuucuuu

SEQ ID NO: 3452979 - RNA, 15 nt, Human
gcacccuucuuuucu

SEQ ID NO: 3452980 - RNA, 14 nt, Human
gcaccgaagcccag

SEQ ID NO: 3452981 - RNA, 15 nt, Human
gcaccggcuggccug

SEQ ID NO: 3452982 - RNA, 19 nt, Human
gcaccggcuggccuggccc

SEQ ID NO: 3452983 - RNA, 23 nt, Human
gcaccggcuggccuggccccuca

SEQ ID NO: 3452984 - RNA, 14 nt, Human
gcaccgggccacag

SEQ ID NO: 3452985 - RNA, 16 nt, Human
gcaccggggccugggc

SEQ ID NO: 3452986 - RNA, 19 nt, Human
gcaccggggccugggcagg

SEQ ID NO: 3452987 - RNA, 20 nt, Human
gcaccgugucaagcugcucu

SEQ ID NO: 3452988 - RNA, 14 nt, Human
gcaccuaaagcagc

SEQ ID NO: 3452989 - RNA, 17 nt, Human
gcaccuaaagcagccag

SEQ ID NO: 3452990 - RNA, 21 nt, Human
gcaccuacaguguacagucuu

SEQ ID NO: 3452991 - RNA, 17 nt, Human
gcaccuaccaccacgcc

SEQ ID NO: 3452992 - RNA, 23 nt, Human
gcaccuaccaucagggacaggau

SEQ ID NO: 3452993 - RNA, 17 nt, Human
gcaccuauagucccagc

SEQ ID NO: 3452994 - RNA, 16 nt, Human
gcaccucagccugcac

SEQ ID NO: 3452995 - RNA, 18 nt, Human
gcaccucagccugcacag

SEQ ID NO: 3452996 - RNA, 16 nt, Human
gcaccuccaggccugu

SEQ ID NO: 3452997 - RNA, 17 nt, Human
gcaccucccagccccug

SEQ ID NO: 3452998 - RNA, 14 nt, Human
gcaccucccauccu

SEQ ID NO: 3452999 - RNA, 17 nt, Human
gcaccucccauccuaau

SEQ ID NO: 3453000 - RNA, 13 nt, Human
gcaccucccccca

SEQ ID NO: 3453001 - RNA, 21 nt, Human
gcaccuccccccacugcaggc

SEQ ID NO: 3453002 - RNA, 12 nt, Human
gcaccuccucag

SEQ ID NO: 3453003 - RNA, 17 nt, Human
gcaccuccucagccuga

SEQ ID NO: 3453004 - RNA, 11 nt, Human
gcaccuccucg

SEQ ID NO: 3453005 - RNA, 20 nt, Human
gcaccuccucggcuggcugu

SEQ ID NO: 3453006 - RNA, 15 nt, Human
gcaccuccugccucg

SEQ ID NO: 3453007 - RNA, 16 nt, Human
gcaccugccagccugg

SEQ ID NO: 3453008 - RNA, 17 nt, Human
gcaccugcccccuggug

SEQ ID NO: 3453009 - RNA, 12 nt, Human
gcaccugccuca

SEQ ID NO: 3453010 - RNA, 15 nt, Human
gcaccugccucagga

SEQ ID NO: 3453011 - RNA, 16 nt, Human
gcaccugccucaggac

SEQ ID NO: 3453012 - RNA, 15 nt, Human
gcaccugcucucuug

SEQ ID NO: 3453013 - RNA, 12 nt, Human
gcaccugcuguc

SEQ ID NO: 3453014 - RNA, 15 nt, Human
gcaccugcugucugg

SEQ ID NO: 3453015 - RNA, 20 nt, Human
gcaccugcuucaugcucagc

SEQ ID NO: 3453016 - RNA, 21 nt, Human
gcaccuggaauauauaaccag

SEQ ID NO: 3453017 - RNA, 20 nt, Human
gcaccuggcugagccuggcu

SEQ ID NO: 3453018 - RNA, 20 nt, Human
gcaccugggcccuggggccu

SEQ ID NO: 3453019 - RNA, 18 nt, Human
gcacuguccugcuccaca

SEQ ID NO: 3453020 - RNA, 20 nt, Human
gcacuguccugcuccacagu

SEQ ID NO: 3453021 - RNA, 21 nt, Human
gcacuguccugcuccacagug

SEQ ID NO: 3453022 - RNA, 22 nt, Human
gcacuguccugcuccacagugu

SEQ ID NO: 3453023 - RNA, 17 nt, Human
gcacugugaaggacccu

SEQ ID NO: 3453024 - RNA, 11 nt, Human
gcacugugcua

SEQ ID NO: 3453025 - RNA, 16 nt, Human
gcacuguuccagccug

SEQ ID NO: 3453026 - RNA, 18 nt, Human
gcacuguucccccugugc

SEQ ID NO: 3453027 - RNA, 17 nt, Human
gcacuguugauguaucu

SEQ ID NO: 3453028 - RNA, 19 nt, Human
gcacuguuuucuaguguau

SEQ ID NO: 3453029 - RNA, 22 nt, Human
gcacuguuuucuaguguaucaa

SEQ ID NO: 3453030 - RNA, 13 nt, Human
gcacuuaaagaag

SEQ ID NO: 3453031 - RNA, 18 nt, Human
gcacuuaaagcuuucaga

SEQ ID NO: 3453032 - RNA, 22 nt, Human
gcacuuaacaagcucccaggcc

SEQ ID NO: 3453033 - RNA, 19 nt, Human
gcacuuaaggcacucuguu

SEQ ID NO: 3453034 - RNA, 22 nt, Human
gcacuuacagauaggccuucuu

SEQ ID NO: 3453035 - RNA, 23 nt, Human
gcacuuauugaccauuuuuuaau

SEQ ID NO: 3453036 - RNA, 15 nt, Human
gcacuucacagagug

SEQ ID NO: 3453037 - RNA, 21 nt, Human
gcacuucagaauuccauaucu

SEQ ID NO: 3453038 - RNA, 14 nt, Human
gcacuucaggaggc

SEQ ID NO: 3453039 - RNA, 19 nt, Human
gcacuucagggcagauuuu

SEQ ID NO: 3453040 - RNA, 18 nt, Human
gcacuucaucuggcugcc

SEQ ID NO: 3453041 - RNA, 15 nt, Human
gcacuucauguaaag

SEQ ID NO: 3453042 - RNA, 18 nt, Human
gcacuucauguaaagugu

SEQ ID NO: 3453043 - RNA, 12 nt, Human
gcacuuccaaaa

SEQ ID NO: 3453044 - RNA, 14 nt, Human
gcacuucccugcug

SEQ ID NO: 3453045 - RNA, 21 nt, Human
gcacuuccuuuuaccugccca

SEQ ID NO: 3453046 - RNA, 21 nt, Human
gcacuucugccugaggggcag

SEQ ID NO: 3453047 - RNA, 14 nt, Human
gcacuugcagacuc

SEQ ID NO: 3453048 - RNA, 14 nt, Human
gcacuugcaucugu

SEQ ID NO: 3453049 - RNA, 14 nt, Human
gcacuugccugggu

SEQ ID NO: 3453050 - RNA, 22 nt, Human
gcacuuggagccaaggguucag

SEQ ID NO: 3453051 - RNA, 13 nt, Human
gcacuuggcccuu

SEQ ID NO: 3453052 - RNA, 22 nt, Human
gcacuugggggcucagcaaggc

SEQ ID NO: 3453053 - RNA, 12 nt, Human
gcacuuguauau

SEQ ID NO: 3453054 - RNA, 23 nt, Human
gcacuugucucauuuuaauguaa

SEQ ID NO: 3453055 - RNA, 23 nt, Human
gcacuugugauuauuuauuauuu

SEQ ID NO: 3453056 - RNA, 19 nt, Human
gcacuuuagaauaugccuu

SEQ ID NO: 3453057 - RNA, 16 nt, Human
gcacuuuccuccuggc

SEQ ID NO: 3453058 - RNA, 17 nt, Human
gcacuuuccuccuggca

SEQ ID NO: 3453059 - RNA, 21 nt, Human
gcacuuucuacaaugugaacu

SEQ ID NO: 3453060 - RNA, 20 nt, Human
gcacuuucuauccucuguaa

SEQ ID NO: 3453061 - RNA, 13 nt, Human
gcacuuugaaaua

SEQ ID NO: 3453062 - RNA, 17 nt, Human
gcacuuugaaauaccuc

SEQ ID NO: 3453063 - RNA, 21 nt, Human
gcacuuugaugucauguguuc

SEQ ID NO: 3453064 - RNA, 17 nt, Human
gcacuuugcuuuaauau

SEQ ID NO: 3453065 - RNA, 16 nt, Human
gcacuuuggcuuauaa

SEQ ID NO: 3453066 - RNA, 20 nt, Human
gcacuuugggaggcugaggc

SEQ ID NO: 3453067 - RNA, 19 nt, Human
gcagaaaaaggcugugcug

SEQ ID NO: 3453068 - RNA, 13 nt, Human
gcagaaaacauug

SEQ ID NO: 3453069 - RNA, 16 nt, Human
gcagaaaacccuuggg

SEQ ID NO: 3453070 - RNA, 17 nt, Human
gcagaaaagcaccugcc

SEQ ID NO: 3453071 - RNA, 21 nt, Human
gcagaaaagcaccugccgacc

SEQ ID NO: 3453072 - RNA, 16 nt, Human
gcagaaaauugccuaa

SEQ ID NO: 3453073 - RNA, 11 nt, Human
gcagaaacaga

SEQ ID NO: 3453074 - RNA, 23 nt, Human
gcagaaacgaagccaucuuucuu

SEQ ID NO: 3453075 - RNA, 20 nt, Human
gcagaaagcaaaauuauguu

SEQ ID NO: 3453076 - RNA, 23 nt, Human
gcagaaagcaaaugugaccugug

SEQ ID NO: 3453077 - RNA, 13 nt, Human
gcagaaagcagag

SEQ ID NO: 3453078 - RNA, 17 nt, Human
gcagaaagcagaggcug

SEQ ID NO: 3453079 - RNA, 19 nt, Human
gcagaaagcaucccucacc

SEQ ID NO: 3453080 - RNA, 23 nt, Human
gcagaaaggaaaaccugaagacu

SEQ ID NO: 3453081 - RNA, 21 nt, Human
gcagaaagguucugcccggga

SEQ ID NO: 3453082 - RNA, 23 nt, Human
gcagaaagugccuuucaggaucu

SEQ ID NO: 3453083 - RNA, 19 nt, Human
gcagaaauccugcaaugaa

SEQ ID NO: 3453084 - RNA, 15 nt, Human
gcagaaaucuagaag

SEQ ID NO: 3453085 - RNA, 16 nt, Human
gcagaaaucugaggaa

SEQ ID NO: 3453086 - RNA, 16 nt, Human
gcagaaauucuguuuu

SEQ ID NO: 3453087 - RNA, 12 nt, Human
gcagaacaguga

SEQ ID NO: 3453088 - RNA, 18 nt, Human
gcagaacagugauuacca

SEQ ID NO: 3453089 - RNA, 15 nt, Human
gcagaaccauuuuug

SEQ ID NO: 3453090 - RNA, 16 nt, Human
gcagaacccuggugag

SEQ ID NO: 3453091 - RNA, 16 nt, Human
gcagaacugagcuccu

SEQ ID NO: 3453092 - RNA, 19 nt, Human
gcagaacugcagucacugc

SEQ ID NO: 3453093 - RNA, 12 nt, Human
gcagaacugcca

SEQ ID NO: 3453094 - RNA, 14 nt, Human
gcagaagaaaggaa

SEQ ID NO: 3453095 - RNA, 22 nt, Human
gcagaagaaugggaauauuuua

SEQ ID NO: 3453096 - RNA, 16 nt, Human
gcagaagacaccagag

SEQ ID NO: 3453097 - RNA, 21 nt, Human
gcagaagacaccagagcagau

SEQ ID NO: 3453098 - RNA, 18 nt, Human
uaaauaccagacugcagg

SEQ ID NO: 3453099 - RNA, 17 nt, Human
uaaauacugcaaaucag

SEQ ID NO: 3453100 - RNA, 16 nt, Human
uaaauagaauguaaau

SEQ ID NO: 3453101 - RNA, 11 nt, Human
uaaauagagca

SEQ ID NO: 3453102 - RNA, 18 nt, Human
uaaauagaguuugcuauu

SEQ ID NO: 3453103 - RNA, 14 nt, Human
uaaauagaugacau

SEQ ID NO: 3453104 - RNA, 12 nt, Human
uaaauagcaugu

SEQ ID NO: 3453105 - RNA, 14 nt, Human
uaaauagcauguau

SEQ ID NO: 3453106 - RNA, 15 nt, Human
uaaauagcauguauu

SEQ ID NO: 3453107 - RNA, 19 nt, Human
uaaauagcauguauugugu

SEQ ID NO: 3453108 - RNA, 18 nt, Human
uaaauagcuagacuggug

SEQ ID NO: 3453109 - RNA, 15 nt, Human
uaaauagcuauaucc

SEQ ID NO: 3453110 - RNA, 19 nt, Human
uaaauagcuauauccaugu

SEQ ID NO: 3453111 - RNA, 21 nt, Human
uaaauaggaaucauucagaaa

SEQ ID NO: 3453112 - RNA, 23 nt, Human
uaaauaggaaucauucagaaaug

SEQ ID NO: 3453113 - RNA, 19 nt, Human
uaaauaguaaaaauaaaau

SEQ ID NO: 3453114 - RNA, 18 nt, Human
uaaauaguauuugagagu

SEQ ID NO: 3453115 - RNA, 12 nt, Human
uaaauauaaaga

SEQ ID NO: 3453116 - RNA, 17 nt, Human
uaaauauaaagacguuu

SEQ ID NO: 3453117 - RNA, 15 nt, Human
uaaauauaauucugu

SEQ ID NO: 3453118 - RNA, 16 nt, Human
uaaauauaauucugua

SEQ ID NO: 3453119 - RNA, 17 nt, Human
uaaauauagauuagaaa

SEQ ID NO: 3453120 - RNA, 20 nt, Human
uaaauauagauuagaaaaau

SEQ ID NO: 3453121 - RNA, 20 nt, Human
uaaauauaguuccuaagaag

SEQ ID NO: 3453122 - RNA, 17 nt, Human
uaaauauauauaaaccu

SEQ ID NO: 3453123 - RNA, 20 nt, Human
uaaauauauauaaagaauau

SEQ ID NO: 3453124 - RNA, 17 nt, Human
uaaauauauauaaauau

SEQ ID NO: 3453125 - RNA, 18 nt, Human
uaaauauauauaaauaua

SEQ ID NO: 3453126 - RNA, 21 nt, Human
uaaauauauauaaauauauau

SEQ ID NO: 3453127 - RNA, 18 nt, Human
uaaauauaucuaccccag

SEQ ID NO: 3453128 - RNA, 21 nt, Human
uaaauauaucuauauuauugu

SEQ ID NO: 3453129 - RNA, 20 nt, Human
uaaauauauguauguaaaaa

SEQ ID NO: 3453130 - RNA, 18 nt, Human
uaaauauauuauuacuug

SEQ ID NO: 3453131 - RNA, 20 nt, Human
uaaauauauuauuacuugua

SEQ ID NO: 3453132 - RNA, 21 nt, Human
uaaauauauuauuacuuguaa

SEQ ID NO: 3453133 - RNA, 17 nt, Human
uaaauauauuuaagaua

SEQ ID NO: 3453134 - RNA, 22 nt, Human
uaaauauauuuaagauaauuau

SEQ ID NO: 3453135 - RNA, 22 nt, Human
uaaauaucccuuggacauuuua

SEQ ID NO: 3453136 - RNA, 14 nt, Human
uaaauaucuuuuau

SEQ ID NO: 3453137 - RNA, 17 nt, Human
uaaauaucuuuuauguu

SEQ ID NO: 3453138 - RNA, 20 nt, Human
uaaauaucuuuuauguuuga

SEQ ID NO: 3453139 - RNA, 22 nt, Human
uaaauaucuuuuauguuugaau

SEQ ID NO: 3453140 - RNA, 19 nt, Human
uaaauaugaagcucaccug

SEQ ID NO: 3453141 - RNA, 19 nt, Human
uaaauaugccucuccuuug

SEQ ID NO: 3453142 - RNA, 21 nt, Human
uaaauaugccucuccuuugua

SEQ ID NO: 3453143 - RNA, 20 nt, Human
uaaauauguacaauuguggg

SEQ ID NO: 3453144 - RNA, 21 nt, Human
uaaauauguuagcaaagaguu

SEQ ID NO: 3453145 - RNA, 17 nt, Human
uaaauauguuucacaca

SEQ ID NO: 3453146 - RNA, 20 nt, Human
uaaauauuaguuaauggauu

SEQ ID NO: 3453147 - RNA, 14 nt, Human
uaaauauucacacu

SEQ ID NO: 3453148 - RNA, 13 nt, Human
uaaauauucuaua

SEQ ID NO: 3453149 - RNA, 15 nt, Human
uaaauauucuauaug

SEQ ID NO: 3453150 - RNA, 19 nt, Human
uaaauauucuauaugaauu

SEQ ID NO: 3453151 - RNA, 11 nt, Human
uaaauauuuac

SEQ ID NO: 3453152 - RNA, 19 nt, Human
uaaauauuuacauaugaaa

SEQ ID NO: 3453153 - RNA, 12 nt, Human
uaaauauuucaa

SEQ ID NO: 3453154 - RNA, 13 nt, Human
uaaauauuucaag

SEQ ID NO: 3453155 - RNA, 12 nt, Human
uaaauauuuccu

SEQ ID NO: 3453156 - RNA, 18 nt, Human
uaaauauuugacuugcau

SEQ ID NO: 3453157 - RNA, 22 nt, Human
uaaauauuuggucucuauuuca

SEQ ID NO: 3453158 - RNA, 17 nt, Human
uaaauauuuuaaagaau

SEQ ID NO: 3453159 - RNA, 16 nt, Human
uaaauauuuucuauuu

SEQ ID NO: 3453160 - RNA, 21 nt, Human
uaaaucacgcuuuuugaaaaa

SEQ ID NO: 3453161 - RNA, 16 nt, Human
uaaaucagauguugaa

SEQ ID NO: 3453162 - RNA, 22 nt, Human
uaaaucauacuccuaugcuuua

SEQ ID NO: 3453163 - RNA, 23 nt, Human
uaacuuauaucaucagcauaccu

SEQ ID NO: 3453164 - RNA, 14 nt, Human
uaacuuauauugaa

SEQ ID NO: 3453165 - RNA, 15 nt, Human
uaacuuauguagaua

SEQ ID NO: 3453166 - RNA, 22 nt, Human
uaacuuauguagauauuuggcu

SEQ ID NO: 3453167 - RNA, 14 nt, Human
uaacuuauugcuga

SEQ ID NO: 3453168 - RNA, 22 nt, Human
uaacuuauugcugauuuuaaug

SEQ ID NO: 3453169 - RNA, 21 nt, Human
uaacuuauuuauguuaaaaga

SEQ ID NO: 3453170 - RNA, 22 nt, Human
uaacuucacauuaaaaaaugaa

SEQ ID NO: 3453171 - RNA, 13 nt, Human
uaacuucaguccu

SEQ ID NO: 3453172 - RNA, 20 nt, Human
uaacuuccacagggucccac

SEQ ID NO: 3453173 - RNA, 23 nt, Human
uaacuuccacagggucccacagc

SEQ ID NO: 3453174 - RNA, 21 nt, Human
uaacuucccugaaaaaucuaa

SEQ ID NO: 3453175 - RNA, 18 nt, Human
uaacuucuaaaacuguac

SEQ ID NO: 3453176 - RNA, 20 nt, Human
uaacuucuaaaacuguacuu

SEQ ID NO: 3453177 - RNA, 13 nt, Human
uaacuucugccug

SEQ ID NO: 3453178 - RNA, 17 nt, Human
uaacuucuuauggaauu

SEQ ID NO: 3453179 - RNA, 12 nt, Human
uaacuucuugcu

SEQ ID NO: 3453180 - RNA, 13 nt, Human
uaacuucuugcuu

SEQ ID NO: 3453181 - RNA, 19 nt, Human
uaacuucuugcuucuuucu

SEQ ID NO: 3453182 - RNA, 20 nt, Human
uaacuucuugcuucuuucua

SEQ ID NO: 3453183 - RNA, 13 nt, Human
uaacuucuuucua

SEQ ID NO: 3453184 - RNA, 22 nt, Human
uaacuugaggguaauaaacuua

SEQ ID NO: 3453185 - RNA, 19 nt, Human
uaacuugauccauuucuaa

SEQ ID NO: 3453186 - RNA, 20 nt, Human
uaacuugauccauuucuaau

SEQ ID NO: 3453187 - RNA, 15 nt, Human
uaacuugcgcagaaa

SEQ ID NO: 3453188 - RNA, 15 nt, Human
uaacuugcuuaaaug

SEQ ID NO: 3453189 - RNA, 17 nt, Human
uaacuugcuuaaaugug

SEQ ID NO: 3453190 - RNA, 20 nt, Human
uaacuugcuuaaaugugaau

SEQ ID NO: 3453191 - RNA, 16 nt, Human
uaacuuggagccccag

SEQ ID NO: 3453192 - RNA, 23 nt, Human
uaacuuggaugaguuuugggaag

SEQ ID NO: 3453193 - RNA, 17 nt, Human
uaacuuggccgcuguau

SEQ ID NO: 3453194 - RNA, 15 nt, Human
uaacuuggcuuucau

SEQ ID NO: 3453195 - RNA, 12 nt, Human
uaacuugggagu

SEQ ID NO: 3453196 - RNA, 16 nt, Human
uaacuugucuaaauaa

SEQ ID NO: 3453197 - RNA, 13 nt, Human
uaacuugucuuaa

SEQ ID NO: 3453198 - RNA, 17 nt, Human
uaacuugucuuaaauaa

SEQ ID NO: 3453199 - RNA, 12 nt, Human
uaacuuuaaguu

SEQ ID NO: 3453200 - RNA, 16 nt, Human
uaacuuuaaguuucag

SEQ ID NO: 3453201 - RNA, 22 nt, Human
uaacuuuaauucucuuucaaag

SEQ ID NO: 3453202 - RNA, 14 nt, Human
uaacuuuacagaaa

SEQ ID NO: 3453203 - RNA, 21 nt, Human
uaacuuuagaaauaaaccuua

SEQ ID NO: 3453204 - RNA, 17 nt, Human
uaacuuuaucacauuau

SEQ ID NO: 3453205 - RNA, 15 nt, Human
uaacuuuauucuuga

SEQ ID NO: 3453206 - RNA, 23 nt, Human
uaacuuucagaagagaugggcuu

SEQ ID NO: 3453207 - RNA, 23 nt, Human
uaacuuucauuaaagcauuuacu

SEQ ID NO: 3453208 - RNA, 16 nt, Human
uaacuuucugaaauaa

SEQ ID NO: 3453209 - RNA, 13 nt, Human
uaacuuucugggu

SEQ ID NO: 3453210 - RNA, 22 nt, Human
uaacuuugcuugcaguagauuu

SEQ ID NO: 3453211 - RNA, 15 nt, Human
uaacuuuuauaaacu

SEQ ID NO: 3453212 - RNA, 17 nt, Human
uaacuuuuauaaacuuu

SEQ ID NO: 3453213 - RNA, 16 nt, Human
uaacuuuugugaauua

SEQ ID NO: 3453214 - RNA, 14 nt, Human
uaacuuuuuauauu

SEQ ID NO: 3453215 - RNA, 16 nt, Human
uaacuuuuuuuuuucu

SEQ ID NO: 3453216 - RNA, 15 nt, Human
uaagaaaaaaauaau

SEQ ID NO: 3453217 - RNA, 22 nt, Human
uaagaaaaaaauaauuuuauga

SEQ ID NO: 3453218 - RNA, 13 nt, Human
uaagaaaaacuuu

SEQ ID NO: 3453219 - RNA, 19 nt, Human
uaagaaaaaggaugcacag

SEQ ID NO: 3453220 - RNA, 23 nt, Human
uaagaaaaaggaugcacagaguu

SEQ ID NO: 3453221 - RNA, 21 nt, Human
uaagaaaagauacgacuuuau

SEQ ID NO: 3453222 - RNA, 14 nt, Human
uaagaaaaguauuu

SEQ ID NO: 3453223 - RNA, 19 nt, Human
uaagaaaaguauuuugaag

SEQ ID NO: 3453224 - RNA, 17 nt, Human
uaagaaaauacaauaaa

SEQ ID NO: 3453225 - RNA, 18 nt, Human
uaagaaaauacaauaaac

SEQ ID NO: 3453226 - RNA, 21 nt, Human
uaagaaaauauauucuuucaa

SEQ ID NO: 3453227 - RNA, 21 nt, Human
uaagaaaauauuuugucuaaa

SEQ ID NO: 3453228 - RNA, 22 nt, Human
uaagaaaauauuuugucuaaaa

SEQ ID NO: 3453229 - RNA, 23 nt, Human
uaagaaaauauuuugucuaaaau

SEQ ID NO: 3453230 - RNA, 21 nt, Human
uaagaaacaacucuuugagaa

SEQ ID NO: 3453231 - RNA, 12 nt, Human
uaagaaacagag

SEQ ID NO: 3453232 - RNA, 15 nt, Human
uaagaaacauuggaa

SEQ ID NO: 3453233 - RNA, 21 nt, Human
uaagaaacauuggaagcaggu

SEQ ID NO: 3453234 - RNA, 18 nt, Human
uaagaaacccagacugaa

SEQ ID NO: 3453235 - RNA, 23 nt, Human
uaagaaaccuacugcccaggcac

SEQ ID NO: 3453236 - RNA, 19 nt, Human
uaagaaacuuuuguaaaga

SEQ ID NO: 3453237 - RNA, 20 nt, Human
uaagaaacuuuuuuauuuaa

SEQ ID NO: 3453238 - RNA, 12 nt, Human
uaagaaagacau

SEQ ID NO: 3453239 - RNA, 13 nt, Human
uaagaaagccuga

SEQ ID NO: 3453240 - RNA, 14 nt, Human
uaagaaagccugag

SEQ ID NO: 3453241 - RNA, 15 nt, Human
uaagaaagccugagu

SEQ ID NO: 3453242 - RNA, 15 nt, Human
uaagaaaggaagcau

SEQ ID NO: 3453243 - RNA, 22 nt, Human
uaagaaagugaagcaaaucaga

SEQ ID NO: 3453244 - RNA, 22 nt, Human
uaagaaauaaaacuguuaaagu

SEQ ID NO: 3453245 - RNA, 13 nt, Human
uaagaaauaaauc

SEQ ID NO: 3453246 - RNA, 18 nt, Human
uaagaaauacuguacaau

SEQ ID NO: 3453247 - RNA, 20 nt, Human
uaagaaauaugugagauuuu

SEQ ID NO: 3453248 - RNA, 14 nt, Human
uaagaaaucaagua

SEQ ID NO: 3453249 - RNA, 21 nt, Human
uaagaaaucucccaugugcau

SEQ ID NO: 3453250 - RNA, 18 nt, Human
uaagaaaugguggaacug

SEQ ID NO: 3453251 - RNA, 16 nt, Human
uaagaaauguauaaac

SEQ ID NO: 3453252 - RNA, 14 nt, Human
uaagaaauugaaua

SEQ ID NO: 3453253 - RNA, 14 nt, Human
uaagaaauuucaca

SEQ ID NO: 3453254 - RNA, 16 nt, Human
uaagaacaacuaccug

SEQ ID NO: 3453255 - RNA, 18 nt, Human
uaagaaccauugauuuaa

SEQ ID NO: 3453256 - RNA, 22 nt, Human
uaagaaccuuuugagugccuua

SEQ ID NO: 3453257 - RNA, 19 nt, Human
uaagaacugcuuucuuucg

SEQ ID NO: 3453258 - RNA, 22 nt, Human
uaagaagaaguucauguccaaa

SEQ ID NO: 3453259 - RNA, 14 nt, Human
uaagaagacaugaa

SEQ ID NO: 3453260 - RNA, 12 nt, Human
uaagaagagacu

SEQ ID NO: 3453261 - RNA, 14 nt, Human
uaagaagaugacuu

SEQ ID NO: 3453262 - RNA, 14 nt, Human
uaagaagcaaauaa

SEQ ID NO: 3453263 - RNA, 13 nt, Human
uaagaagcuguug

SEQ ID NO: 3453264 - RNA, 22 nt, Human
uaagaagcuguuguacauuuau

SEQ ID NO: 3453265 - RNA, 13 nt, Human
uaagaaggcaaaa

SEQ ID NO: 3453266 - RNA, 17 nt, Human
uaagaaggcaaaaaugu

SEQ ID NO: 3453267 - RNA, 20 nt, Human
uaagaaggcaauauuaaccu

SEQ ID NO: 3453268 - RNA, 15 nt, Human
uaagaaguuuuaaaa

SEQ ID NO: 3453269 - RNA, 21 nt, Human
uaagaaguuuuaaaaagccag

SEQ ID NO: 3453270 - RNA, 15 nt, Human
uaagaauaaaauguu

SEQ ID NO: 3453271 - RNA, 21 nt, Human
uaagaauaaaauguugaaaag

SEQ ID NO: 3453272 - RNA, 13 nt, Human
uaagaauaauaaa

SEQ ID NO: 3453273 - RNA, 13 nt, Human
uaagaauaauuua

SEQ ID NO: 3453274 - RNA, 14 nt, Human
uaagaauacagcuu

SEQ ID NO: 3453275 - RNA, 18 nt, Human
uaagaauaccacaucaaa

SEQ ID NO: 3453276 - RNA, 22 nt, Human
uaagaauaccacaucaaauaag

SEQ ID NO: 3453277 - RNA, 18 nt, Human
uaagaauaguagaugugg

SEQ ID NO: 3453278 - RNA, 13 nt, Human
uaagaauauuuga

SEQ ID NO: 3453279 - RNA, 14 nt, Human
uaagaauauuugaa

SEQ ID NO: 3453280 - RNA, 18 nt, Human
uaagaauauuugaaugua

SEQ ID NO: 3453281 - RNA, 19 nt, Human
uaagaaucagaguagaaau

SEQ ID NO: 3453282 - RNA, 17 nt, Human
uaagaaucuagcaagaa

SEQ ID NO: 3453283 - RNA, 17 nt, Human
uaagaaugguugccuua

SEQ ID NO: 3453284 - RNA, 21 nt, Human
uaagaauguugguuuacuuuc

SEQ ID NO: 3453285 - RNA, 17 nt, Human
uaagaauuauuuugaug

SEQ ID NO: 3453286 - RNA, 14 nt, Human
uaagaauucaaacu

SEQ ID NO: 3453287 - RNA, 22 nt, Human
uaagaauucaaacuggggccuc

SEQ ID NO: 3453288 - RNA, 16 nt, Human
uaagaauucagacauc

SEQ ID NO: 3453289 - RNA, 19 nt, Human
uaagaauucugauugauuu

SEQ ID NO: 3453290 - RNA, 16 nt, Human
uaagaauugaguaaug

SEQ ID NO: 3453291 - RNA, 18 nt, Human
uaagaauuugcauacuua

SEQ ID NO: 3453292 - RNA, 19 nt, Human
uaagacaaauauuccuuug

SEQ ID NO: 3453293 - RNA, 20 nt, Human
uaagacacugaaaaaucuaa

SEQ ID NO: 3453294 - RNA, 13 nt, Human
uaagacagagacc

SEQ ID NO: 3453295 - RNA, 16 nt, Human
uaagacauaacguuuu

SEQ ID NO: 3453296 - RNA, 22 nt, Human
uaagacauaacguuuuuccuuu

SEQ ID NO: 3453297 - RNA, 20 nt, Human
uaagacaugauuuccuugaa

SEQ ID NO: 3453298 - RNA, 21 nt, Human
uaagacaugcacuaugaggaa

SEQ ID NO: 3453299 - RNA, 22 nt, Human
uaagacauugggucuauuccag

SEQ ID NO: 3453300 - RNA, 17 nt, Human
uaagaccaccaccucag

SEQ ID NO: 3453301 - RNA, 14 nt, Human
uaagaccagccugg

SEQ ID NO: 3453302 - RNA, 19 nt, Human
uaagaccauaacagccaac

SEQ ID NO: 3453303 - RNA, 21 nt, Human
uacacgaauagacaucaaacu

SEQ ID NO: 3453304 - RNA, 13 nt, Human
uacacgggacuga

SEQ ID NO: 3453305 - RNA, 23 nt, Human
uacacguauuugaauggccuuca

SEQ ID NO: 3453306 - RNA, 13 nt, Human
uacacguguccug

SEQ ID NO: 3453307 - RNA, 18 nt, Human
uacauguguagccugugc

SEQ ID NO: 3453308 - RNA, 16 nt, Human
uacauguguguauaua

SEQ ID NO: 3453309 - RNA, 21 nt, Human
uacauguguguauauaugugu

SEQ ID NO: 3453310 - RNA, 13 nt, Human
uacauguuuauaa

SEQ ID NO: 3453311 - RNA, 15 nt, Human
uacauguuuauaaau

SEQ ID NO: 3453312 - RNA, 17 nt, Human
uacauguuuauaaaucu

SEQ ID NO: 3453313 - RNA, 15 nt, Human
uacauguuuauguaa

SEQ ID NO: 3453314 - RNA, 19 nt, Human
uacauguuuauguaaacaa

SEQ ID NO: 3453315 - RNA, 13 nt, Human
uacauguuugcac

SEQ ID NO: 3453316 - RNA, 14 nt, Human
uacauuaaacauga

SEQ ID NO: 3453317 - RNA, 20 nt, Human
uacauuaaacaugacuccau

SEQ ID NO: 3453318 - RNA, 12 nt, Human
uacauuaauguu

SEQ ID NO: 3453319 - RNA, 20 nt, Human
uacauuagcaguuugcuuug

SEQ ID NO: 3453320 - RNA, 16 nt, Human
uacauuagguugugaa

SEQ ID NO: 3453321 - RNA, 14 nt, Human
uacauucaaauuug

SEQ ID NO: 3453322 - RNA, 21 nt, Human
uacauucaaauuugucugguu

SEQ ID NO: 3453323 - RNA, 22 nt, Human
uacauuccuugauaauguugug

SEQ ID NO: 3453324 - RNA, 19 nt, Human
uaagccuccauuuaguucu

SEQ ID NO: 3453325 - RNA, 13 nt, Human
uaagccuguggcu

SEQ ID NO: 3453326 - RNA, 18 nt, Human
uaagccuguggcugugga

SEQ ID NO: 3453327 - RNA, 21 nt, Human
uaagcuaaagaggcugaaaga

SEQ ID NO: 3453328 - RNA, 15 nt, Human
uaagcuacugccauc

SEQ ID NO: 3453329 - RNA, 17 nt, Human
uaagcuagaagaaguga

SEQ ID NO: 3453330 - RNA, 13 nt, Human
uaagcuaggaaaa

SEQ ID NO: 3453331 - RNA, 17 nt, Human
uaagcuaggaaaagaaa

SEQ ID NO: 3453332 - RNA, 16 nt, Human
uaagcuaguugaauac

SEQ ID NO: 3453333 - RNA, 21 nt, Human
uaagcuaguugaauacuugaa

SEQ ID NO: 3453334 - RNA, 18 nt, Human
uaagcuauuugauguaau

SEQ ID NO: 3453335 - RNA, 21 nt, Human
uaagcuauuuuucuaacuaca

SEQ ID NO: 3453336 - RNA, 20 nt, Human
uaagcucaaggcgugaggau

SEQ ID NO: 3453337 - RNA, 19 nt, Human
uaagcucacguccugagaa

SEQ ID NO: 3453338 - RNA, 12 nt, Human
uaagcucagaau

SEQ ID NO: 3453339 - RNA, 14 nt, Human
uaagcucuuugaaa

SEQ ID NO: 3453340 - RNA, 21 nt, Human
uaagcucuuugaaacaacuuu

SEQ ID NO: 3453341 - RNA, 14 nt, Human
uaagcugcagcuuc

SEQ ID NO: 3453342 - RNA, 18 nt, Human
uaagcugcagcuuccugu

SEQ ID NO: 3453343 - RNA, 13 nt, Human
uaagcuguaaaaa

SEQ ID NO: 3453344 - RNA, 22 nt, Human
uaagcugugucugcccaaugaa

SEQ ID NO: 3453345 - RNA, 22 nt, Human
uaagcuguuacugucuucagua

SEQ ID NO: 3453346 - RNA, 13 nt, Human
uaagcuguuuauu

SEQ ID NO: 3453347 - RNA, 16 nt, Human
uaagcuguuuccauag

SEQ ID NO: 3453348 - RNA, 17 nt, Human
uaagcuuaaaaaaaacu

SEQ ID NO: 3453349 - RNA, 17 nt, Human
uaagcuucaguugcuug

SEQ ID NO: 3453350 - RNA, 16 nt, Human
uaagcuuccaggaaaa

SEQ ID NO: 3453351 - RNA, 16 nt, Human
uaagcuuccauuuuaa

SEQ ID NO: 3453352 - RNA, 16 nt, Human
uaagcuuguauuccuu

SEQ ID NO: 3453353 - RNA, 21 nt, Human
uaagcuuugccagcugcugcu

SEQ ID NO: 3453354 - RNA, 20 nt, Human
uaagcuuuucuuuucuuugu

SEQ ID NO: 3453355 - RNA, 15 nt, Human
uaagcuuuuuggaau

SEQ ID NO: 3453356 - RNA, 17 nt, Human
uaaggaaaaguuuaaua

SEQ ID NO: 3453357 - RNA, 12 nt, Human
uaaggaaacugg

SEQ ID NO: 3453358 - RNA, 15 nt, Human
uaaggaagauaucua

SEQ ID NO: 3453359 - RNA, 21 nt, Human
uaaggaaugauauugcugaag

SEQ ID NO: 3453360 - RNA, 15 nt, Human
uaaggacaaagugcc

SEQ ID NO: 3453361 - RNA, 21 nt, Human
uaaggacaaagugccaaagaa

SEQ ID NO: 3453362 - RNA, 15 nt, Human
uaaggacacacuaau

SEQ ID NO: 3453363 - RNA, 19 nt, Human
uaaggacaugaugcuuuua

SEQ ID NO: 3453364 - RNA, 18 nt, Human
uaaggacauuucccaggg

SEQ ID NO: 3453365 - RNA, 21 nt, Human
uaaggaccugaaauuccaaag

SEQ ID NO: 3453366 - RNA, 22 nt, Human
uaaggaccugaaauuccaaagu

SEQ ID NO: 3453367 - RNA, 12 nt, Human
uaaggacugcau

SEQ ID NO: 3453368 - RNA, 13 nt, Human
uaaggacuuccug

SEQ ID NO: 3453369 - RNA, 14 nt, Human
uaaggacuucuuua

SEQ ID NO: 3453370 - RNA, 22 nt, Human
uaaggacuucuuuaauuuugga

SEQ ID NO: 3453371 - RNA, 16 nt, Human
uaaggacuuguuagau

SEQ ID NO: 3453372 - RNA, 19 nt, Human
uaaggacuuguuagaucua

SEQ ID NO: 3453373 - RNA, 14 nt, Human
uaaggagaauggcc

SEQ ID NO: 3453374 - RNA, 20 nt, Human
uaaggaguaaucuguguaca

SEQ ID NO: 3453375 - RNA, 15 nt, Human
uaaggauaaaucaua

SEQ ID NO: 3453376 - RNA, 17 nt, Human
uaaggauacuuuacaug

SEQ ID NO: 3453377 - RNA, 18 nt, Human
uaaggaugcuuguacaua

SEQ ID NO: 3453378 - RNA, 19 nt, Human
uaaggaugcuuguacauaa

SEQ ID NO: 3453379 - RNA, 19 nt, Human
uaaggauggagccagcucu

SEQ ID NO: 3453380 - RNA, 20 nt, Human
uaaggauggagccagcucug

SEQ ID NO: 3453381 - RNA, 16 nt, Human
uaaggaugggaaggag

SEQ ID NO: 3453382 - RNA, 15 nt, Human
uaaggauugugauau

SEQ ID NO: 3453383 - RNA, 13 nt, Human
uaaggauuuuaug

SEQ ID NO: 3453384 - RNA, 21 nt, Human
uaaggcagauuuuacagagcg

SEQ ID NO: 3453385 - RNA, 13 nt, Human
uaaggcaugaagg

SEQ ID NO: 3453386 - RNA, 15 nt, Human
uaaggcaugaaggau

SEQ ID NO: 3453387 - RNA, 19 nt, Human
uaaggccauuauuguacuu

SEQ ID NO: 3453388 - RNA, 23 nt, Human
uaaggcccccucucaggagccau

SEQ ID NO: 3453389 - RNA, 16 nt, Human
uaaggccgaagaaggg

SEQ ID NO: 3453390 - RNA, 16 nt, Human
uaaggccuaggauucu

SEQ ID NO: 3453391 - RNA, 21 nt, Human
uaaggccuaggauucuaaaau

SEQ ID NO: 3453392 - RNA, 22 nt, Human
uaaggcucugagagucuagauu

SEQ ID NO: 3453393 - RNA, 21 nt, Human
uaaggcugcaagguuuaggcu

SEQ ID NO: 3453394 - RNA, 16 nt, Human
uaaggcuguguaagau

SEQ ID NO: 3453395 - RNA, 22 nt, Human
uaaggcuguguaagauuuguuu

SEQ ID NO: 3453396 - RNA, 22 nt, Human
uaaggcuuugauuaguuuucuu

SEQ ID NO: 3453397 - RNA, 12 nt, Human
uaagggaaaaau

SEQ ID NO: 3453398 - RNA, 20 nt, Human
uaagggaaaaaucaaguauu

SEQ ID NO: 3453399 - RNA, 23 nt, Human
uaagggaacaaguugagcuauga

SEQ ID NO: 3453400 - RNA, 13 nt, Human
uaagggaagaauu

SEQ ID NO: 3453401 - RNA, 19 nt, Human
uaagggaaguaguuaucau

SEQ ID NO: 3453402 - RNA, 16 nt, Human
uaagggacugauguuu

SEQ ID NO: 3453403 - RNA, 22 nt, Human
uaagggacugauguuugugcag

SEQ ID NO: 3453404 - RNA, 16 nt, Human
uaagggaggaggagcu

SEQ ID NO: 3453405 - RNA, 19 nt, Human
uaagggccagaaauaucuu

SEQ ID NO: 3453406 - RNA, 18 nt, Human
uaaggggaauuaacaauu

SEQ ID NO: 3453407 - RNA, 13 nt, Human
uaaggggcagcuu

SEQ ID NO: 3453408 - RNA, 16 nt, Human
uaaggggcccggccag

SEQ ID NO: 3453409 - RNA, 17 nt, Human
uaaggguaucuggugac

SEQ ID NO: 3453410 - RNA, 24 nt, Human
uaagggucauauguuugcuuguau

SEQ ID NO: 3453411 - RNA, 19 nt, Human
uaagggugggugcucagaa

SEQ ID NO: 3453412 - RNA, 18 nt, Human
uaagguacaagaagcauu

SEQ ID NO: 3453413 - RNA, 18 nt, Human
uaagguagaaccucaccu

SEQ ID NO: 3453414 - RNA, 21 nt, Human
uaagguauaucauucuaaaga

SEQ ID NO: 3453415 - RNA, 18 nt, Human
uaaggucauuaccacagg

SEQ ID NO: 3453416 - RNA, 20 nt, Human
uaagguccgguguucuaaga

SEQ ID NO: 3453417 - RNA, 13 nt, Human
uaagguccuaagg

SEQ ID NO: 3453418 - RNA, 17 nt, Human
uaaggugaggccugucu

SEQ ID NO: 3453419 - RNA, 22 nt, Human
uaaggugaggccugucugugac

SEQ ID NO: 3453420 - RNA, 20 nt, Human
uaaggugauauauuuaaaaa

SEQ ID NO: 3453421 - RNA, 15 nt, Human
uaaggugcuaaaucu

SEQ ID NO: 3453422 - RNA, 21 nt, Human
uaaggugcucucuuucugucu

SEQ ID NO: 3453423 - RNA, 20 nt, Human
uaagguggguacgggagggu

SEQ ID NO: 3453424 - RNA, 15 nt, Human
uaaggugugcucuga

SEQ ID NO: 3453425 - RNA, 12 nt, Human
uaagguguuuga

SEQ ID NO: 3453426 - RNA, 15 nt, Human
uaagguguuugaaaa

SEQ ID NO: 3453427 - RNA, 20 nt, Human
uaagguguuugaaaauaguu

SEQ ID NO: 3453428 - RNA, 19 nt, Human
uaagguguuuucuguguaa

SEQ ID NO: 3453429 - RNA, 15 nt, Human
uaagguucuaaggcc

SEQ ID NO: 3453430 - RNA, 16 nt, Human
uaagguucucauagga

SEQ ID NO: 3453431 - RNA, 19 nt, Human
uaagguuucguuucuguau

SEQ ID NO: 3453432 - RNA, 20 nt, Human
uaagguuucguuucuguaua

SEQ ID NO: 3453433 - RNA, 17 nt, Human
uaagguuuuaauuuagu

SEQ ID NO: 3453434 - RNA, 18 nt, Human
uaagguuuuaauuuagua

SEQ ID NO: 3453435 - RNA, 18 nt, Human
uaaguaaaaccacagcag

SEQ ID NO: 3453436 - RNA, 14 nt, Human
uaaguaaauacaau

SEQ ID NO: 3453437 - RNA, 13 nt, Human
uaaguaaaugcua

SEQ ID NO: 3453438 - RNA, 14 nt, Human
uaaguaaaugucug

SEQ ID NO: 3453439 - RNA, 21 nt, Human
uaaguaacuuauuuaugaaag

SEQ ID NO: 3453440 - RNA, 14 nt, Human
uaaguaagaaaaua

SEQ ID NO: 3453441 - RNA, 19 nt, Human
uaaguaagaaaauauuuug

SEQ ID NO: 3453442 - RNA, 19 nt, Human
uaaguaagcaacagcauaa

SEQ ID NO: 3453443 - RNA, 23 nt, Human
uaaguaauuaucgggaacagugu

SEQ ID NO: 3453444 - RNA, 16 nt, Human
uaaguaauucaagaaa

SEQ ID NO: 3453445 - RNA, 12 nt, Human
uaaguacagaga

SEQ ID NO: 3453446 - RNA, 16 nt, Human
uaaguacagagaagcc

SEQ ID NO: 3453447 - RNA, 17 nt, Human
uaaguaccacucaggcc

SEQ ID NO: 3453448 - RNA, 18 nt, Human
uaaguaccacucaggcca

SEQ ID NO: 3453449 - RNA, 13 nt, Human
uaaguacuaugua

SEQ ID NO: 3453450 - RNA, 16 nt, Human
uaaguacuauguauca

SEQ ID NO: 3453451 - RNA, 17 nt, Human
uaaguacuauguaucaa

SEQ ID NO: 3453452 - RNA, 15 nt, Human
uaauggauuucagaa

SEQ ID NO: 3453453 - RNA, 22 nt, Human
uaauggcugauaauuuuaaauu

SEQ ID NO: 3453454 - RNA, 18 nt, Human
uaaugggcuuagagcagu

SEQ ID NO: 3453455 - RNA, 15 nt, Human
uaauggggcggugag

SEQ ID NO: 3453456 - RNA, 17 nt, Human
uaauggggguagcagcu

SEQ ID NO: 3453457 - RNA, 15 nt, Human
uaaugggguccuggc

SEQ ID NO: 3453458 - RNA, 18 nt, Human
uaaugguaccagauaaaa

SEQ ID NO: 3453459 - RNA, 23 nt, Human
uaaugguacugacuuugcuugcu

SEQ ID NO: 3453460 - RNA, 18 nt, Human
uaaugguaguuuuacagu

SEQ ID NO: 3453461 - RNA, 18 nt, Human
uaauggucccauccaggc

SEQ ID NO: 3453462 - RNA, 17 nt, Human
uaauggucuaaaaauaa

SEQ ID NO: 3453463 - RNA, 18 nt, Human
uaauggugccuucauuug

SEQ ID NO: 3453464 - RNA, 13 nt, Human
uaaugguguagaa

SEQ ID NO: 3453465 - RNA, 14 nt, Human
uaaugguguuuuaa

SEQ ID NO: 3453466 - RNA, 13 nt, Human
uaauguaaaauga

SEQ ID NO: 3453467 - RNA, 14 nt, Human
uaauguaaaaugau

SEQ ID NO: 3453468 - RNA, 22 nt, Human
uaauguaacugcucuugggcaa

SEQ ID NO: 3453469 - RNA, 16 nt, Human
uaauguaagcucuacu

SEQ ID NO: 3453470 - RNA, 17 nt, Human
uaauguaagcucuacug

SEQ ID NO: 3453471 - RNA, 13 nt, Human
uaauguacauagu

SEQ ID NO: 3453472 - RNA, 19 nt, Human
uaauguacugauuucagua

SEQ ID NO: 3453473 - RNA, 16 nt, Human
uaauguagccauggga

SEQ ID NO: 3453474 - RNA, 20 nt, Human
uaauguagcguguuuacaug

SEQ ID NO: 3453475 - RNA, 22 nt, Human
uaauguagcguguuuacaugug

SEQ ID NO: 3453476 - RNA, 14 nt, Human
uaauguauauaaaa

SEQ ID NO: 3453477 - RNA, 15 nt, Human
uaauguauauaaaaa

SEQ ID NO: 3453478 - RNA, 16 nt, Human
uaauguauauaaaaau

SEQ ID NO: 3453479 - RNA, 22 nt, Human
uaauguauaugaacuuaacaug

SEQ ID NO: 3453480 - RNA, 19 nt, Human
uaauguaucaaauacauuu

SEQ ID NO: 3453481 - RNA, 17 nt, Human
uaauguauucauauuug

SEQ ID NO: 3453482 - RNA, 18 nt, Human
uaauguauucauauuugu

SEQ ID NO: 3453483 - RNA, 20 nt, Human
uaauguauucauauuuguac

SEQ ID NO: 3453484 - RNA, 18 nt, Human
uaaugucaaacuugaguc

SEQ ID NO: 3453485 - RNA, 18 nt, Human
uaaugucacaggcagguc

SEQ ID NO: 3453486 - RNA, 17 nt, Human
uaaugucaguauuucaa

SEQ ID NO: 3453487 - RNA, 17 nt, Human
uaaugucauaaagugag

SEQ ID NO: 3453488 - RNA, 18 nt, Human
uaaugucccuuucagaga

SEQ ID NO: 3453489 - RNA, 15 nt, Human
uaaugucuucauaaa

SEQ ID NO: 3453490 - RNA, 21 nt, Human
uaaugugaaaaugguccagga

SEQ ID NO: 3453491 - RNA, 12 nt, Human
uaaugugaaacu

SEQ ID NO: 3453492 - RNA, 23 nt, Human
uaaugugaaacuggauuaaacuu

SEQ ID NO: 3453493 - RNA, 19 nt, Human
uaaugugaacuagcuggaa

SEQ ID NO: 3453494 - RNA, 16 nt, Human
uaaugugaccuagcaa

SEQ ID NO: 3453495 - RNA, 19 nt, Human
uaaugugaugauguaauug

SEQ ID NO: 3453496 - RNA, 17 nt, Human
uaaugugccuaguucuu

SEQ ID NO: 3453497 - RNA, 15 nt, Human
uaaugugcuguguaa

SEQ ID NO: 3453498 - RNA, 17 nt, Human
uaaugugcuguguaaag

SEQ ID NO: 3453499 - RNA, 17 nt, Human
uaauguggaagaaaaug

SEQ ID NO: 3453500 - RNA, 22 nt, Human
uaauguggaagaaaaugguuua

SEQ ID NO: 3453501 - RNA, 18 nt, Human
uaaugugggaagaaacaa

SEQ ID NO: 3453502 - RNA, 22 nt, Human
uaaugugggaagaaacaaaccc

SEQ ID NO: 3453503 - RNA, 17 nt, Human
uaauguguaguucaugu

SEQ ID NO: 3453504 - RNA, 19 nt, Human
uaauguguaguucauguaa

SEQ ID NO: 3453505 - RNA, 22 nt, Human
uaauguguaguucauguaaaua

SEQ ID NO: 3453506 - RNA, 18 nt, Human
uaauguuaaauuuguaag

SEQ ID NO: 3453507 - RNA, 17 nt, Human
uaauguuaaccaaggaa

SEQ ID NO: 3453508 - RNA, 16 nt, Human
uaauguuaauauugau

SEQ ID NO: 3453509 - RNA, 11 nt, Human
uaauguuacug

SEQ ID NO: 3453510 - RNA, 15 nt, Human
uaauguuacugauca

SEQ ID NO: 3453511 - RNA, 23 nt, Human
uaauguuacugaucaugcauugu

SEQ ID NO: 3453512 - RNA, 22 nt, Human
uaauguucuuaugcaaaaugga

SEQ ID NO: 3453513 - RNA, 17 nt, Human
uaauguugaacaaaaua

SEQ ID NO: 3453514 - RNA, 22 nt, Human
uaauguugaacaaaauaaauug

SEQ ID NO: 3453515 - RNA, 14 nt, Human
uaauguugauuucu

SEQ ID NO: 3453516 - RNA, 20 nt, Human
uaauguuguaugucuuguuu

SEQ ID NO: 3453517 - RNA, 21 nt, Human
uaauguuguaugucuuguuua

SEQ ID NO: 3453518 - RNA, 13 nt, Human
uaauguugugaau

SEQ ID NO: 3453519 - RNA, 13 nt, Human
uacucacacaggc

SEQ ID NO: 3453520 - RNA, 14 nt, Human
uacucacagccagc

SEQ ID NO: 3453521 - RNA, 16 nt, Human
uacucagaauucucua

SEQ ID NO: 3453522 - RNA, 19 nt, Human
uacucagcagcccuccuca

SEQ ID NO: 3453523 - RNA, 20 nt, Human
uacucagcagcccuccucac

SEQ ID NO: 3453524 - RNA, 12 nt, Human
uacucagcccug

SEQ ID NO: 3453525 - RNA, 13 nt, Human
uacucagcccugg

SEQ ID NO: 3453526 - RNA, 15 nt, Human
uacucagcccugggc

SEQ ID NO: 3453527 - RNA, 12 nt, Human
uacucagccugc

SEQ ID NO: 3453528 - RNA, 14 nt, Human
uacucaggaagaac

SEQ ID NO: 3453529 - RNA, 12 nt, Human
uacucaggaggc

SEQ ID NO: 3453530 - RNA, 15 nt, Human
uacucagggaaagca

SEQ ID NO: 3453531 - RNA, 15 nt, Human
uacucagggcuccuc

SEQ ID NO: 3453532 - RNA, 19 nt, Human
uacucagggcuccucccag

SEQ ID NO: 3453533 - RNA, 15 nt, Human
uacucauaaguaaaa

SEQ ID NO: 3453534 - RNA, 20 nt, Human
uacucauaaugugaaguguu

SEQ ID NO: 3453535 - RNA, 21 nt, Human
uacucauaaugugaaguguua

SEQ ID NO: 3453536 - RNA, 19 nt, Human
uacucauauauaucuaucu

SEQ ID NO: 3453537 - RNA, 14 nt, Human
uacucauguguaug

SEQ ID NO: 3453538 - RNA, 22 nt, Human
uacucauguguaugggcaaaaa

SEQ ID NO: 3453539 - RNA, 15 nt, Human
uacucauuucuaaaa

SEQ ID NO: 3453540 - RNA, 19 nt, Human
uacuccaguggugaagaaa

SEQ ID NO: 3453541 - RNA, 15 nt, Human
uacuccauaaacaga

SEQ ID NO: 3453542 - RNA, 22 nt, Human
uacucccacucccggccuguca

SEQ ID NO: 3453543 - RNA, 13 nt, Human
uacucccaggcac

SEQ ID NO: 3453544 - RNA, 20 nt, Human
uacucccaggcacugucuua

SEQ ID NO: 3453545 - RNA, 17 nt, Human
uacucccaucugugaaa

SEQ ID NO: 3453546 - RNA, 16 nt, Human
uacuccccuugagcug

SEQ ID NO: 3453547 - RNA, 14 nt, Human
uacucccucucagg

SEQ ID NO: 3453548 - RNA, 17 nt, Human
uacuccuaugaucugag

SEQ ID NO: 3453549 - RNA, 18 nt, Human
uacuccuauuuuuguaaa

SEQ ID NO: 3453550 - RNA, 21 nt, Human
uacuccucacacuuacuguaa

SEQ ID NO: 3453551 - RNA, 15 nt, Human
uacuccuccucuuuc

SEQ ID NO: 3453552 - RNA, 19 nt, Human
uacuccuccucuuucucuc

SEQ ID NO: 3453553 - RNA, 22 nt, Human
uacuccuccucuuucucucccc

SEQ ID NO: 3453554 - RNA, 23 nt, Human
uacuccuccucuuucucucccca

SEQ ID NO: 3453555 - RNA, 13 nt, Human
uacuccucugcag

SEQ ID NO: 3453556 - RNA, 22 nt, Human
uacuccucugcagugccuuggg

SEQ ID NO: 3453557 - RNA, 12 nt, Human
uacuccugcaaa

SEQ ID NO: 3453558 - RNA, 17 nt, Human
uacuccugcaaaauuuu

SEQ ID NO: 3453559 - RNA, 22 nt, Human
uacuccuguaauuccuaccucc

SEQ ID NO: 3453560 - RNA, 17 nt, Human
uacuccugugggagccu

SEQ ID NO: 3453561 - RNA, 20 nt, Human
uacuccugugggagccucgc

SEQ ID NO: 3453562 - RNA, 21 nt, Human
uacuccugugggagccucgca

SEQ ID NO: 3453563 - RNA, 21 nt, Human
uacucuaagaucuuagauucu

SEQ ID NO: 3453564 - RNA, 13 nt, Human
uacucuaauucua

SEQ ID NO: 3453565 - RNA, 14 nt, Human
uacucuagagaagu

SEQ ID NO: 3453566 - RNA, 14 nt, Human
uacucuagauaccu

SEQ ID NO: 3453567 - RNA, 21 nt, Human
uacucuagauaccuaaaacau

SEQ ID NO: 3453568 - RNA, 16 nt, Human
uacucuccaaccugga

SEQ ID NO: 3453569 - RNA, 15 nt, Human
uacucuccccacgag

SEQ ID NO: 3453570 - RNA, 20 nt, Human
uacucuccccacgagggcug

SEQ ID NO: 3453571 - RNA, 22 nt, Human
uacucuccccacgagggcuggc

SEQ ID NO: 3453572 - RNA, 14 nt, Human
uacucuccucaucu

SEQ ID NO: 3453573 - RNA, 16 nt, Human
uacucuccucaucucu

SEQ ID NO: 3453574 - RNA, 20 nt, Human
uacucuccucggcccccucc

SEQ ID NO: 3453575 - RNA, 16 nt, Human
uacucucuucuucuca

SEQ ID NO: 3453576 - RNA, 21 nt, Human
uacucugaaauuguaacuaaa

SEQ ID NO: 3453577 - RNA, 12 nt, Human
uacucugaaggg

SEQ ID NO: 3453578 - RNA, 14 nt, Human
uacucugcccucua

SEQ ID NO: 3453579 - RNA, 21 nt, Human
uacucugcuuuuuuucuacug

SEQ ID NO: 3453580 - RNA, 12 nt, Human
uacucuggccuc

SEQ ID NO: 3453581 - RNA, 23 nt, Human
uacucuggggugcugccugaauc

SEQ ID NO: 3453582 - RNA, 17 nt, Human
uacucugguucuuuguu

SEQ ID NO: 3453583 - RNA, 14 nt, Human
uacucugugccaga

SEQ ID NO: 3453584 - RNA, 16 nt, Human
uacucugugccagagc

SEQ ID NO: 3453585 - RNA, 23 nt, Human
uacucugugccagagccuggggc

SEQ ID NO: 3453586 - RNA, 19 nt, Human
uacucuguuccuucacauc

SEQ ID NO: 3453587 - RNA, 14 nt, Human
uacucuuaagccau

SEQ ID NO: 3453588 - RNA, 21 nt, Human
uacucuuaagccaucuuggua

SEQ ID NO: 3453589 - RNA, 18 nt, Human
uacucuuaggaagagaaa

SEQ ID NO: 3453590 - RNA, 20 nt, Human
uacucuuauaucuauauuuu

SEQ ID NO: 3453591 - RNA, 22 nt, Human
uacucuuauaucuauauuuuac

SEQ ID NO: 3453592 - RNA, 22 nt, Human
uacucuucaguuaagccuuugg

SEQ ID NO: 3453593 - RNA, 13 nt, Human
uacucuucucucu

SEQ ID NO: 3453594 - RNA, 14 nt, Human
uacucuugggacau

SEQ ID NO: 3453595 - RNA, 21 nt, Human
uacucuuuacccuugagcccu

SEQ ID NO: 3453596 - RNA, 13 nt, Human
uacuuaagagaaa

SEQ ID NO: 3453597 - RNA, 18 nt, Human
uacuuaagagaaauggca

SEQ ID NO: 3453598 - RNA, 19 nt, Human
uacuuaagagaaauggcaa

SEQ ID NO: 3453599 - RNA, 19 nt, Human
uacuuacccaggugggucc

SEQ ID NO: 3453600 - RNA, 18 nt, Human
uacuuaccuagugaaacu

SEQ ID NO: 3453601 - RNA, 15 nt, Human
uacuuacuaaaauau

SEQ ID NO: 3453602 - RNA, 16 nt, Human
uacuuagaggaaauaa

SEQ ID NO: 3453603 - RNA, 18 nt, Human
uacuuagaguuucuguuu

SEQ ID NO: 3453604 - RNA, 21 nt, Human
uacuuagcacuuggccugaga

SEQ ID NO: 3453605 - RNA, 14 nt, Human
uacuuagcauccua

SEQ ID NO: 3453606 - RNA, 22 nt, Human
uacuuagcauccuaagaaauau

SEQ ID NO: 3453607 - RNA, 16 nt, Human
uacuuagcuuaucaau

SEQ ID NO: 3453608 - RNA, 19 nt, Human
uacuuagcuuaucaauuug

SEQ ID NO: 3453609 - RNA, 17 nt, Human
uacuuaguagauuaaaa

SEQ ID NO: 3453610 - RNA, 20 nt, Human
uacuuaguauugcaaaguca

SEQ ID NO: 3453611 - RNA, 14 nt, Human
uacuuauaaagaag

SEQ ID NO: 3453612 - RNA, 17 nt, Human
uacuuauauaauugcca

SEQ ID NO: 3453613 - RNA, 21 nt, Human
uacuuauauuucccuaaaaua

SEQ ID NO: 3453614 - RNA, 14 nt, Human
uacuuauauuuucg

SEQ ID NO: 3453615 - RNA, 23 nt, Human
uacuuauauuuucguaugaaaau

SEQ ID NO: 3453616 - RNA, 14 nt, Human
uacuuauuacugcu

SEQ ID NO: 3453617 - RNA, 15 nt, Human
uacuuauuacugcua

SEQ ID NO: 3453618 - RNA, 12 nt, Human
uacuuauucauu

SEQ ID NO: 3453619 - RNA, 14 nt, Human
uacuuauucauugu

SEQ ID NO: 3453620 - RNA, 21 nt, Human
uacuuauuuaaauagaugaca

SEQ ID NO: 3453621 - RNA, 20 nt, Human
uacuuauuuuugacaguguu

SEQ ID NO: 3453622 - RNA, 23 nt, Human
uacuucaaaaguauuuuccugua

SEQ ID NO: 3453623 - RNA, 17 nt, Human
uacuucaaaaguuuguu

SEQ ID NO: 3453624 - RNA, 21 nt, Human
uacuucaaauccuugaagauu

SEQ ID NO: 3453625 - RNA, 15 nt, Human
uacuucacuuuaauu

SEQ ID NO: 3453626 - RNA, 16 nt, Human
uacuucacuuuaauuc

SEQ ID NO: 3453627 - RNA, 18 nt, Human
uacuucauguaauccaaa

SEQ ID NO: 3453628 - RNA, 17 nt, Human
uacuuccccauggcccu

SEQ ID NO: 3453629 - RNA, 15 nt, Human
uacuuccccuuccua

SEQ ID NO: 3453630 - RNA, 18 nt, Human
uacuuccccuuccuaauu

SEQ ID NO: 3453631 - RNA, 20 nt, Human
uacuuccccuuccuaauucc

SEQ ID NO: 3453632 - RNA, 20 nt, Human
uacuucccgggccagggcug

SEQ ID NO: 3453633 - RNA, 19 nt, Human
uacuuccuaucaagccagu

SEQ ID NO: 3453634 - RNA, 20 nt, Human
uacuucggggcugggaaguc

SEQ ID NO: 3453635 - RNA, 17 nt, Human
uacuucgucuucuaauu

SEQ ID NO: 3453636 - RNA, 14 nt, Human
uacuucuccagccu

SEQ ID NO: 3453637 - RNA, 16 nt, Human
uacuucucuaauucuu

SEQ ID NO: 3453638 - RNA, 18 nt, Human
uacuucucuauaaaaaau

SEQ ID NO: 3453639 - RNA, 22 nt, Human
uacuucucuauaaaaaauaugu

SEQ ID NO: 3453640 - RNA, 17 nt, Human
uacuucuguaauugugu

SEQ ID NO: 3453641 - RNA, 19 nt, Human
uacuucuuaggguuaugau

SEQ ID NO: 3453642 - RNA, 16 nt, Human
uacuucuuauacauuu

SEQ ID NO: 3453643 - RNA, 14 nt, Human
uacuucuucuguaa

SEQ ID NO: 3453644 - RNA, 14 nt, Human
uacuucuugaaggu

SEQ ID NO: 3453645 - RNA, 16 nt, Human
uacuucuuugcuuugc

SEQ ID NO: 3453646 - RNA, 15 nt, Human
uacuugaaaauuaac

SEQ ID NO: 3453647 - RNA, 20 nt, Human
uacuugaaaucuaggauuau

SEQ ID NO: 3453648 - RNA, 19 nt, Human
uacuugaacaaaaggguca

SEQ ID NO: 3453649 - RNA, 21 nt, Human
uacuugaacaaaagggucaga

SEQ ID NO: 3453650 - RNA, 12 nt, Human
uacuugaaccau

SEQ ID NO: 3453651 - RNA, 21 nt, Human
uacuugaaccauaaaaugucc

SEQ ID NO: 3453652 - RNA, 19 nt, Human
uacuugaacguuuucuaau

SEQ ID NO: 3453653 - RNA, 21 nt, Human
uacuugaacuugccucuuuua

SEQ ID NO: 3453654 - RNA, 13 nt, Human
uacuugaacuugu

SEQ ID NO: 3453655 - RNA, 11 nt, Human
uacuugaaggg

SEQ ID NO: 3453656 - RNA, 14 nt, Human
uacuugaagggcca

SEQ ID NO: 3453657 - RNA, 15 nt, Human
uacuugaagggccag

SEQ ID NO: 3453658 - RNA, 22 nt, Human
uacuugaagucuaaaagcagaa

SEQ ID NO: 3453659 - RNA, 20 nt, Human
uacuugaauaaccaucugaa

SEQ ID NO: 3453660 - RNA, 14 nt, Human
uacuugaauaguau

SEQ ID NO: 3453661 - RNA, 16 nt, Human
uacuugauaagggacu

SEQ ID NO: 3453662 - RNA, 20 nt, Human
uacuugcagcucccauucua

SEQ ID NO: 3453663 - RNA, 14 nt, Human
uacuugccagaagu

SEQ ID NO: 3453664 - RNA, 16 nt, Human
uacuugcucagguacu

SEQ ID NO: 3453665 - RNA, 15 nt, Human
uacuugcucuggacc

SEQ ID NO: 3453666 - RNA, 17 nt, Human
uacuugcucuggaccug

SEQ ID NO: 3453667 - RNA, 18 nt, Human
uacuugcucuggaccugc

SEQ ID NO: 3453668 - RNA, 22 nt, Human
uacuugcucuggaccugccccc

SEQ ID NO: 3453669 - RNA, 18 nt, Human
uacuugcuggcucucaga

SEQ ID NO: 3453670 - RNA, 21 nt, Human
uacuuggaaauauuaaaagaa

SEQ ID NO: 3453671 - RNA, 17 nt, Human
uacuugguccaacugca

SEQ ID NO: 3453672 - RNA, 16 nt, Human
uacuuguaaauauaaa

SEQ ID NO: 3453673 - RNA, 19 nt, Human
uacuuguaaauauaaagac

SEQ ID NO: 3453674 - RNA, 13 nt, Human
uacuuguaauuau

SEQ ID NO: 3453675 - RNA, 14 nt, Human
uacuugucaaagaa

SEQ ID NO: 3453676 - RNA, 15 nt, Human
uacuugucaaagaag

SEQ ID NO: 3453677 - RNA, 16 nt, Human
uacuugucaaagaagg

SEQ ID NO: 3453678 - RNA, 13 nt, Human
uacuugucuguuu

SEQ ID NO: 3453679 - RNA, 15 nt, Human
uacuugucuguuuua

SEQ ID NO: 3453680 - RNA, 20 nt, Human
uacuugucuguuuuaaaaac

SEQ ID NO: 3453681 - RNA, 14 nt, Human
uacuugucuuucug

SEQ ID NO: 3453682 - RNA, 21 nt, Human
uacuugugaaacacagcuguu

SEQ ID NO: 3453683 - RNA, 14 nt, Human
uacuuguggacaca

SEQ ID NO: 3453684 - RNA, 19 nt, Human
uacuuguggacuaaaagau

SEQ ID NO: 3453685 - RNA, 22 nt, Human
uacuuguggacuaaaagauaua

SEQ ID NO: 3453686 - RNA, 18 nt, Human
uacuugugguuuucaaau

SEQ ID NO: 3453687 - RNA, 17 nt, Human
uacuuguuguuuaaugu

SEQ ID NO: 3453688 - RNA, 15 nt, Human
uacuuguuucagagu

SEQ ID NO: 3453689 - RNA, 16 nt, Human
uacuuguuucucuguu

SEQ ID NO: 3453690 - RNA, 21 nt, Human
uacuuuaaaggaaaaaauguu

SEQ ID NO: 3453691 - RNA, 23 nt, Human
uacuuuacauaugcuuuaagaau

SEQ ID NO: 3453692 - RNA, 16 nt, Human
uacuuuaccucucugu

SEQ ID NO: 3453693 - RNA, 17 nt, Human
uacuuuaccucucuguc

SEQ ID NO: 3453694 - RNA, 19 nt, Human
uacuuuaccucucugucau

SEQ ID NO: 3453695 - RNA, 16 nt, Human
uacuuuacucauuuuu

SEQ ID NO: 3453696 - RNA, 14 nt, Human
uacuuuagaagcac

SEQ ID NO: 3453697 - RNA, 16 nt, Human
uacuuuauagaagaau

SEQ ID NO: 3453698 - RNA, 22 nt, Human
uacuuuaucaugaaugcuuuua

SEQ ID NO: 3453699 - RNA, 22 nt, Human
uacuuuccacuugauuuugcaa

SEQ ID NO: 3453700 - RNA, 21 nt, Human
uacuuucccuacccucuagag

SEQ ID NO: 3453701 - RNA, 20 nt, Human
uacuuuccuuuccccagccc

SEQ ID NO: 3453702 - RNA, 22 nt, Human
uacuuugaauguguuucacagu

SEQ ID NO: 3453703 - RNA, 23 nt, Human
uacuuugauucacauguuuucaa

SEQ ID NO: 3453704 - RNA, 18 nt, Human
uacuuugcauugucuguc

SEQ ID NO: 3453705 - RNA, 21 nt, Human
uacuuugccuuuccauaauca

SEQ ID NO: 3453706 - RNA, 22 nt, Human
uacuuugguggccacauaagcc

SEQ ID NO: 3453707 - RNA, 17 nt, Human
uacuuuguaaauucuga

SEQ ID NO: 3453708 - RNA, 16 nt, Human
uacuuuguauacaagu

SEQ ID NO: 3453709 - RNA, 16 nt, Human
uacuuuguaugauauu

SEQ ID NO: 3453710 - RNA, 19 nt, Human
uacuuugucuaagaaacau

SEQ ID NO: 3453711 - RNA, 19 nt, Human
uacuuuguuaggauuuuca

SEQ ID NO: 3453712 - RNA, 23 nt, Human
uacuuuguugcaaguacugcugu

SEQ ID NO: 3453713 - RNA, 18 nt, Human
uacuuuuaaaaacauaac

SEQ ID NO: 3453714 - RNA, 14 nt, Human
uacuuuuaaacugu

SEQ ID NO: 3453715 - RNA, 15 nt, Human
uacuuuuaaacugug

SEQ ID NO: 3453716 - RNA, 22 nt, Human
uacuuuuauaauaaaaggaaaa

SEQ ID NO: 3453717 - RNA, 19 nt, Human
uacuuuucauauuugcacu

SEQ ID NO: 3453718 - RNA, 16 nt, Human
uacuuuuccuuaccuu

SEQ ID NO: 3453719 - RNA, 17 nt, Human
uacuuuuccuucccuca

SEQ ID NO: 3453720 - RNA, 15 nt, Human
uacuuuuccuugcau

SEQ ID NO: 3453721 - RNA, 17 nt, Human
uacuuuugcaugaaaau

SEQ ID NO: 3453722 - RNA, 20 nt, Human
uacuuuuuaaaagguauuuu

SEQ ID NO: 3453723 - RNA, 20 nt, Human
uacuuuuuaaaaucuuuucu

SEQ ID NO: 3453724 - RNA, 14 nt, Human
uacuuuuuaaaugu

SEQ ID NO: 3453725 - RNA, 13 nt, Human
uacuuuuuauaua

SEQ ID NO: 3453726 - RNA, 16 nt, Human
uacuuuuucauucuuu

SEQ ID NO: 3453727 - RNA, 13 nt, Human
uacuuuuuccugg

SEQ ID NO: 3453728 - RNA, 12 nt, Human
uacuuuuucuaa

SEQ ID NO: 3453729 - RNA, 17 nt, Human
uacuuuuucuuuuguaa

SEQ ID NO: 3453730 - RNA, 21 nt, Human
uacuuuuuuaaauauuuucua

SEQ ID NO: 3453731 - RNA, 12 nt, Human
uacuuuuuucca

SEQ ID NO: 3453732 - RNA, 14 nt, Human
uacuuuuuucuuau

SEQ ID NO: 3453733 - RNA, 15 nt, Human
uacuuuuuugaaauc

SEQ ID NO: 3453734 - RNA, 15 nt, Human
uagaaaaaaaauuau

SEQ ID NO: 3453735 - RNA, 15 nt, Human
uagaaaaaaauuacu

SEQ ID NO: 3453736 - RNA, 18 nt, Human
uagaaaaaaguuuacaac

SEQ ID NO: 3453737 - RNA, 14 nt, Human
uagaaaaacaaauc

SEQ ID NO: 3453738 - RNA, 15 nt, Human
uagaaaaacaggcac

SEQ ID NO: 3453739 - RNA, 22 nt, Human
uagaaaaacccugcccccaaau

SEQ ID NO: 3453740 - RNA, 23 nt, Human
uagaaaaaggagcuuaccuccca

SEQ ID NO: 3453741 - RNA, 15 nt, Human
uacauuaaagcaguc

SEQ ID NO: 3453742 - RNA, 20 nt, Human
uacauuaauguuaauucagc

SEQ ID NO: 3453743 - RNA, 15 nt, Human
uacauuaauuaucua

SEQ ID NO: 3453744 - RNA, 22 nt, Human
uacauuaauuauuauugcuguu

SEQ ID NO: 3453745 - RNA, 19 nt, Human
uacauuagcaguuugcuuu

SEQ ID NO: 3453746 - RNA, 17 nt, Human
uacauuagguugugaau

SEQ ID NO: 3453747 - RNA, 12 nt, Human
uacauuaguaaa

SEQ ID NO: 3453748 - RNA, 13 nt, Human
uacauuaguaaau

SEQ ID NO: 3453749 - RNA, 17 nt, Human
uacauuaguaaaugucu

SEQ ID NO: 3453750 - RNA, 15 nt, Human
uacauucaauguuua

SEQ ID NO: 3453751 - RNA, 13 nt, Human
uacauucauuuag

SEQ ID NO: 3453752 - RNA, 15 nt, Human
uacauucucaguuuu

SEQ ID NO: 3453753 - RNA, 21 nt, Human
uacauucucaguuuuucuuaa

SEQ ID NO: 3453754 - RNA, 20 nt, Human
uacauucuucaagaucccau

SEQ ID NO: 3453755 - RNA, 15 nt, Human
uacauucuuuuugcu

SEQ ID NO: 3453756 - RNA, 16 nt, Human
uacauucuuuuugcuc

SEQ ID NO: 3453757 - RNA, 19 nt, Human
uacauugcuggucuuguaa

SEQ ID NO: 3453758 - RNA, 19 nt, Human
uacauuggcugguaacagu

SEQ ID NO: 3453759 - RNA, 23 nt, Human
uacauuguacgaagaguauuuuu

SEQ ID NO: 3453760 - RNA, 19 nt, Human
uacauugucucuaaauugu

SEQ ID NO: 3453761 - RNA, 14 nt, Human
uacauuguucaauu

SEQ ID NO: 3453762 - RNA, 15 nt, Human
uacauuguucaauua

SEQ ID NO: 3453763 - RNA, 16 nt, Human
uacauuuaaaacauua

SEQ ID NO: 3453764 - RNA, 19 nt, Human
uacauuuaaaacauuaaaa

SEQ ID NO: 3453765 - RNA, 22 nt, Human
uacauuuaaagcauugcuguua

SEQ ID NO: 3453766 - RNA, 16 nt, Human
uacauuuaauugagaa

SEQ ID NO: 3453767 - RNA, 16 nt, Human
uacauuuacaaacuga

SEQ ID NO: 3453768 - RNA, 17 nt, Human
uacauuuacaaacugaa

SEQ ID NO: 3453769 - RNA, 16 nt, Human
uacauuuauaauugca

SEQ ID NO: 3453770 - RNA, 18 nt, Human
uacauuuaugauuuaaua

SEQ ID NO: 3453771 - RNA, 20 nt, Human
uacauuuaugauuuaauaaa

SEQ ID NO: 3453772 - RNA, 14 nt, Human
uacauuuauuuauc

SEQ ID NO: 3453773 - RNA, 15 nt, Human
uacauuuccaaauga

SEQ ID NO: 3453774 - RNA, 21 nt, Human
uacauuuccaaauucacaagu

SEQ ID NO: 3453775 - RNA, 16 nt, Human
uacauuucccugugcu

SEQ ID NO: 3453776 - RNA, 19 nt, Human
uacauuucuaagucaaaca

SEQ ID NO: 3453777 - RNA, 22 nt, Human
uacauuucuccuuugauaaaau

SEQ ID NO: 3453778 - RNA, 14 nt, Human
uacauuuggaacua

SEQ ID NO: 3453779 - RNA, 23 nt, Human
uacauuuggagacacaacuauuu

SEQ ID NO: 3453780 - RNA, 18 nt, Human
uacauuuggauaaacaac

SEQ ID NO: 3453781 - RNA, 17 nt, Human
uacauuuguaauuuaag

SEQ ID NO: 3453782 - RNA, 19 nt, Human
uacauuuguaauuuaaggu

SEQ ID NO: 3453783 - RNA, 18 nt, Human
uacauuuguauuuuucca

SEQ ID NO: 3453784 - RNA, 16 nt, Human
uacauuuuaacaugga

SEQ ID NO: 3453785 - RNA, 15 nt, Human
uacauuuuacacacu

SEQ ID NO: 3453786 - RNA, 16 nt, Human
uacauuuuagacagua

SEQ ID NO: 3453787 - RNA, 13 nt, Human
uacauuuuguugu

SEQ ID NO: 3453788 - RNA, 17 nt, Human
uacauuuuguuguaaaa

SEQ ID NO: 3453789 - RNA, 20 nt, Human
uacauuuuguuguaaaaaga

SEQ ID NO: 3453790 - RNA, 23 nt, Human
uacauuuuguuguaaaaagaaaa

SEQ ID NO: 3453791 - RNA, 19 nt, Human
uacauuuuuaagugcugca

SEQ ID NO: 3453792 - RNA, 22 nt, Human
uacauuuuuaagugcugcauuu

SEQ ID NO: 3453793 - RNA, 15 nt, Human
uacauuuuuacaaua

SEQ ID NO: 3453794 - RNA, 16 nt, Human
uacauuuuuacaauaa

SEQ ID NO: 3453795 - RNA, 17 nt, Human
uacauuuuuacaauaaa

SEQ ID NO: 3453796 - RNA, 21 nt, Human
uacauuuuuacaauaaauaau

SEQ ID NO: 3453797 - RNA, 20 nt, Human
uacauuuuuagccuguguca

SEQ ID NO: 3453798 - RNA, 14 nt, Human
uacauuuuuauuua

SEQ ID NO: 3453799 - RNA, 19 nt, Human
uacauuuuuauuuaugaag

SEQ ID NO: 3453800 - RNA, 20 nt, Human
uacauuuuucaacuuugaau

SEQ ID NO: 3453801 - RNA, 16 nt, Human
uacauuuuuugaaaug

SEQ ID NO: 3453802 - RNA, 22 nt, Human
uacauuuuuugaaaugcugaaa

SEQ ID NO: 3453803 - RNA, 11 nt, Human
uaccaaaauaa

SEQ ID NO: 3453804 - RNA, 18 nt, Human
uaccaaaauuauuucaga

SEQ ID NO: 3453805 - RNA, 23 nt, Human
uaccaaaauuauuucagaaaugu

SEQ ID NO: 3453806 - RNA, 14 nt, Human
uaccaaaauuuuaa

SEQ ID NO: 3453807 - RNA, 13 nt, Human
uaccaaaggauag

SEQ ID NO: 3453808 - RNA, 18 nt, Human
uaccaaaguuuuaucaag

SEQ ID NO: 3453809 - RNA, 17 nt, Human
uaccaaaugcuuuaaaa

SEQ ID NO: 3453810 - RNA, 20 nt, Human
uaccaacuguuuagggcccu

SEQ ID NO: 3453811 - RNA, 15 nt, Human
uaccaacuuucaaga

SEQ ID NO: 3453812 - RNA, 21 nt, Human
uaccaacuuucaagaacuugu

SEQ ID NO: 3453813 - RNA, 14 nt, Human
uaccaacuuucugu

SEQ ID NO: 3453814 - RNA, 19 nt, Human
uaccaacuuucuguaaacu

SEQ ID NO: 3453815 - RNA, 21 nt, Human
uaccaagaaaggaaccuguca

SEQ ID NO: 3453816 - RNA, 21 nt, Human
uaccaagaugccaucuguguc

SEQ ID NO: 3453817 - RNA, 18 nt, Human
uaccaaguuauauaaaga

SEQ ID NO: 3453818 - RNA, 13 nt, Human
uaccaauaaagug

SEQ ID NO: 3453819 - RNA, 15 nt, Human
uaccaaugaaaaaau

SEQ ID NO: 3453820 - RNA, 17 nt, Human
uaccaaugaaaaaaugu

SEQ ID NO: 3453821 - RNA, 13 nt, Human
uaccaaugcaugc

SEQ ID NO: 3453822 - RNA, 21 nt, Human
uaccaaugccaagauaauuca

SEQ ID NO: 3453823 - RNA, 13 nt, Human
uaccaaugcugca

SEQ ID NO: 3453824 - RNA, 19 nt, Human
uaccaaugcuuuuaucaaa

SEQ ID NO: 3453825 - RNA, 13 nt, Human
uaccacagugucu

SEQ ID NO: 3453826 - RNA, 18 nt, Human
uaccaccagcugugucca

SEQ ID NO: 3453827 - RNA, 14 nt, Human
uaccacccccacac

SEQ ID NO: 3453828 - RNA, 18 nt, Human
uaccacccgguccccacu

SEQ ID NO: 3453829 - RNA, 23 nt, Human
uaccaccucacuuuuucauuucc

SEQ ID NO: 3453830 - RNA, 10 nt, Human
uaccaccucc

SEQ ID NO: 3453831 - RNA, 19 nt, Human
uaccacggccuccuuuccg

SEQ ID NO: 3453832 - RNA, 15 nt, Human
uaccacuaacuccug

SEQ ID NO: 3453833 - RNA, 14 nt, Human
uaccacucuguaau

SEQ ID NO: 3453834 - RNA, 16 nt, Human
uaccacucuguaauug

SEQ ID NO: 3453835 - RNA, 17 nt, Human
uaccacucuguaauugc

SEQ ID NO: 3453836 - RNA, 19 nt, Human
uaccacugaaucuguacag

SEQ ID NO: 3453837 - RNA, 17 nt, Human
uaccacugcugauauuu

SEQ ID NO: 3453838 - RNA, 15 nt, Human
uaccacuuuagauga

SEQ ID NO: 3453839 - RNA, 17 nt, Human
uaccacuuuugcaaaua

SEQ ID NO: 3453840 - RNA, 17 nt, Human
uaccacuuuuguucuug

SEQ ID NO: 3453841 - RNA, 14 nt, Human
uaccagacugcagg

SEQ ID NO: 3453842 - RNA, 19 nt, Human
uaccagaguuguucugucu

SEQ ID NO: 3453843 - RNA, 12 nt, Human
uaccagcagagc

SEQ ID NO: 3453844 - RNA, 22 nt, Human
uaccagcagagcaccuuagaca

SEQ ID NO: 3453845 - RNA, 17 nt, Human
uaccagcccuggggcug

SEQ ID NO: 3453846 - RNA, 21 nt, Human
uaccagcccuggggcugggcc

SEQ ID NO: 3453847 - RNA, 21 nt, Human
uaccagcugcgcuugcuuuuc

SEQ ID NO: 3453848 - RNA, 22 nt, Human
uaccagcugcgcuugcuuuucu

SEQ ID NO: 3453849 - RNA, 13 nt, Human
uaccagcuuuuaa

SEQ ID NO: 3453850 - RNA, 16 nt, Human
uaccagggauguagau

SEQ ID NO: 3453851 - RNA, 17 nt, Human
uaccagggauguagauu

SEQ ID NO: 3453852 - RNA, 18 nt, Human
uaccaguauuuaacuucu

SEQ ID NO: 3453853 - RNA, 21 nt, Human
uaccagucuuuaaaggcccag

SEQ ID NO: 3453854 - RNA, 15 nt, Human
uaccagugaaccaaa

SEQ ID NO: 3453855 - RNA, 19 nt, Human
uaccagugaauuuuugcaa

SEQ ID NO: 3453856 - RNA, 22 nt, Human
uaccagugaauuuuugcaauaa

SEQ ID NO: 3453857 - RNA, 18 nt, Human
uaccagugcaggcuggcc

SEQ ID NO: 3453858 - RNA, 22 nt, Human
uaccagugcaggcuggccagcc

SEQ ID NO: 3453859 - RNA, 19 nt, Human
uaccaguuaauuuuuccaa

SEQ ID NO: 3453860 - RNA, 14 nt, Human
uaccaguugccuuu

SEQ ID NO: 3453861 - RNA, 16 nt, Human
uaccaguugccuuuua

SEQ ID NO: 3453862 - RNA, 15 nt, Human
uaccauaauguauuu

SEQ ID NO: 3453863 - RNA, 22 nt, Human
uaccauacucauuucuaaaaga

SEQ ID NO: 3453864 - RNA, 22 nt, Human
uaccauauuuauccauuuguaa

SEQ ID NO: 3453865 - RNA, 20 nt, Human
uaccaugaacagaaaacauu

SEQ ID NO: 3453866 - RNA, 18 nt, Human
uaccauguaauggcaguu

SEQ ID NO: 3453867 - RNA, 12 nt, Human
uaccauguacau

SEQ ID NO: 3453868 - RNA, 16 nt, Human
uaccaugucacugugg

SEQ ID NO: 3453869 - RNA, 14 nt, Human
uaccaugucuuucu

SEQ ID NO: 3453870 - RNA, 15 nt, Human
uaccaugugccugau

SEQ ID NO: 3453871 - RNA, 17 nt, Human
uaccaugugcuacaggg

SEQ ID NO: 3453872 - RNA, 16 nt, Human
uaccauuaaaacugcu

SEQ ID NO: 3453873 - RNA, 17 nt, Human
uaccauuaaaacugcuu

SEQ ID NO: 3453874 - RNA, 21 nt, Human
uaccauuaaaauaugcacuaa

SEQ ID NO: 3453875 - RNA, 16 nt, Human
uaccauuaaaccaucu

SEQ ID NO: 3453876 - RNA, 13 nt, Human
uaccauucagauc

SEQ ID NO: 3453877 - RNA, 22 nt, Human
uaccauucagaucacugaauuu

SEQ ID NO: 3453878 - RNA, 23 nt, Human
uaccauucagugauuacugucaa

SEQ ID NO: 3453879 - RNA, 13 nt, Human
uaccauuggaaau

SEQ ID NO: 3453880 - RNA, 17 nt, Human
uaccauuggaaauuuca

SEQ ID NO: 3453881 - RNA, 20 nt, Human
uaccauuggaaauuucacgu

SEQ ID NO: 3453882 - RNA, 13 nt, Human
uaccauuuacaug

SEQ ID NO: 3453883 - RNA, 17 nt, Human
uaccauuuacauguuuu

SEQ ID NO: 3453884 - RNA, 14 nt, Human
uaccauuuauacaa

SEQ ID NO: 3453885 - RNA, 15 nt, Human
uaccauuucagagag

SEQ ID NO: 3453886 - RNA, 22 nt, Human
uagcucaggaccugggaccucc

SEQ ID NO: 3453887 - RNA, 16 nt, Human
uagcucaggugucccu

SEQ ID NO: 3453888 - RNA, 12 nt, Human
uagcucauucuc

SEQ ID NO: 3453889 - RNA, 22 nt, Human
uagcucauucuccuuguguuac

SEQ ID NO: 3453890 - RNA, 14 nt, Human
uagcuccccuccaa

SEQ ID NO: 3453891 - RNA, 14 nt, Human
uagcucccuguucu

SEQ ID NO: 3453892 - RNA, 16 nt, Human
uagcuccucacugugg

SEQ ID NO: 3453893 - RNA, 15 nt, Human
uagcuccuccccugg

SEQ ID NO: 3453894 - RNA, 20 nt, Human
uaccauuuccguaauucuua

SEQ ID NO: 3453895 - RNA, 23 nt, Human
uaccauuuccucagcuuaucucu

SEQ ID NO: 3453896 - RNA, 18 nt, Human
uaccauuuguaauaaagu

SEQ ID NO: 3453897 - RNA, 20 nt, Human
uaccauuuguaauaaaguau

SEQ ID NO: 3453898 - RNA, 23 nt, Human
uaccauuuguaauaaaguauaua

SEQ ID NO: 3453899 - RNA, 23 nt, Human
uaccauuuugggguacccacugc

SEQ ID NO: 3453900 - RNA, 20 nt, Human
uaccauuuuuuaaggaaaca

SEQ ID NO: 3453901 - RNA, 15 nt, Human
uacccaaaagagaaa

SEQ ID NO: 3453902 - RNA, 16 nt, Human
uacccaaacccuaggu

SEQ ID NO: 3453903 - RNA, 14 nt, Human
uacccaaacugcuu

SEQ ID NO: 3453904 - RNA, 22 nt, Human
uacccaaaggauacuguaacac

SEQ ID NO: 3453905 - RNA, 15 nt, Human
uacccaaauuaagag

SEQ ID NO: 3453906 - RNA, 23 nt, Human
uacccaacggcccugcagccagc

SEQ ID NO: 3453907 - RNA, 12 nt, Human
uacccaagcaaa

SEQ ID NO: 3453908 - RNA, 15 nt, Human
uacccaauagcugcc

SEQ ID NO: 3453909 - RNA, 12 nt, Human
uacccaccccca

SEQ ID NO: 3453910 - RNA, 17 nt, Human
uacccacccccacccaa

SEQ ID NO: 3453911 - RNA, 19 nt, Human
uacccacccccacccaagg

SEQ ID NO: 3453912 - RNA, 20 nt, Human
uacccaccgggccacuccuu

SEQ ID NO: 3453913 - RNA, 12 nt, Human
uacccaccuaga

SEQ ID NO: 3453914 - RNA, 23 nt, Human
uacccaccugagcuuuggacaca

SEQ ID NO: 3453915 - RNA, 18 nt, Human
uacccagaaugucagauu

SEQ ID NO: 3453916 - RNA, 16 nt, Human
uacccagagaagcccc

SEQ ID NO: 3453917 - RNA, 15 nt, Human
uacccagagaauaua

SEQ ID NO: 3453918 - RNA, 20 nt, Human
uacccagagaauauauacau

SEQ ID NO: 3453919 - RNA, 14 nt, Human
uacccagccaucug

SEQ ID NO: 3453920 - RNA, 16 nt, Human
uacccagccaucugcc

SEQ ID NO: 3453921 - RNA, 19 nt, Human
uacccagccaucugcccag

SEQ ID NO: 3453922 - RNA, 16 nt, Human
uacccagcccaucuug

SEQ ID NO: 3453923 - RNA, 22 nt, Human
uacccagcccaucuugccucca

SEQ ID NO: 3453924 - RNA, 16 nt, Human
uacccagggccugcag

SEQ ID NO: 3453925 - RNA, 22 nt, Human
uacccaggugcuaggaacacuc

SEQ ID NO: 3453926 - RNA, 23 nt, Human
uacccaguuucuaaacuggagac

SEQ ID NO: 3453927 - RNA, 24 nt, Human
uacccaguuucuaaacuggagacu

SEQ ID NO: 3453928 - RNA, 12 nt, Human
uacccauauccc

SEQ ID NO: 3453929 - RNA, 22 nt, Human
uacccaucccauaugccugggc

SEQ ID NO: 3453930 - RNA, 18 nt, Human
uacccaucgguguccauu

SEQ ID NO: 3453931 - RNA, 15 nt, Human
uacccaucuuaaaaa

SEQ ID NO: 3453932 - RNA, 21 nt, Human
uacccauucguggugaucaau

SEQ ID NO: 3453933 - RNA, 15 nt, Human
uacccauuuguucau

SEQ ID NO: 3453934 - RNA, 19 nt, Human
uaccccaagcgcccuggcc

SEQ ID NO: 3453935 - RNA, 14 nt, Human
uaccccacccucag

SEQ ID NO: 3453936 - RNA, 22 nt, Human
uaccccacccucagcaccccuu

SEQ ID NO: 3453937 - RNA, 23 nt, Human
uaccccacccucagcaccccuuc

SEQ ID NO: 3453938 - RNA, 22 nt, Human
uaccccagacuagauguaguau

SEQ ID NO: 3453939 - RNA, 16 nt, Human
uaccccagcucugcuu

SEQ ID NO: 3453940 - RNA, 12 nt, Human
uacccccaaccu

SEQ ID NO: 3453941 - RNA, 16 nt, Human
uacccccagcugugcu

SEQ ID NO: 3453942 - RNA, 15 nt, Human
uaccccccucugucu

SEQ ID NO: 3453943 - RNA, 20 nt, Human
uacccccgcccaggcuggcc

SEQ ID NO: 3453944 - RNA, 17 nt, Human
uacccccuccucucugc

SEQ ID NO: 3453945 - RNA, 19 nt, Human
uacccccugcaaagcccag

SEQ ID NO: 3453946 - RNA, 13 nt, Human
uacccccuucugg

SEQ ID NO: 3453947 - RNA, 23 nt, Human
uacccccuucugggcaucuguuc

SEQ ID NO: 3453948 - RNA, 15 nt, Human
uaccccucccagcug

SEQ ID NO: 3453949 - RNA, 21 nt, Human
uaccccucccggcccugccug

SEQ ID NO: 3453950 - RNA, 22 nt, Human
uaccccucccggcccugccugc

SEQ ID NO: 3453951 - RNA, 23 nt, Human
uaccccucccggcccugccugcu

SEQ ID NO: 3453952 - RNA, 22 nt, Human
uaccccugccuuugggagcagg

SEQ ID NO: 3453953 - RNA, 13 nt, Human
uaccccuggcugu

SEQ ID NO: 3453954 - RNA, 17 nt, Human
uaccccuggcuguacug

SEQ ID NO: 3453955 - RNA, 13 nt, Human
uacccuaaugucu

SEQ ID NO: 3453956 - RNA, 16 nt, Human
uacccuaaugucuuca

SEQ ID NO: 3453957 - RNA, 19 nt, Human
uacccuaaugucuucauaa

SEQ ID NO: 3453958 - RNA, 15 nt, Human
uacccuagccauucc

SEQ ID NO: 3453959 - RNA, 16 nt, Human
uacccuauaucuauaa

SEQ ID NO: 3453960 - RNA, 21 nt, Human
uacccucaggcauaggccugg

SEQ ID NO: 3453961 - RNA, 14 nt, Human
uacccucccugcug

SEQ ID NO: 3453962 - RNA, 12 nt, Human
uacccuccucca

SEQ ID NO: 3453963 - RNA, 18 nt, Human
uacccuccugcacuguuu

SEQ ID NO: 3453964 - RNA, 21 nt, Human
uacccucgggcccaccuggcc

SEQ ID NO: 3453965 - RNA, 23 nt, Human
uacccucgggcccaccuggccac

SEQ ID NO: 3453966 - RNA, 13 nt, Human
uacccucugaaau

SEQ ID NO: 3453967 - RNA, 14 nt, Human
uacccucugaaaua

SEQ ID NO: 3453968 - RNA, 14 nt, Human
uacccugaccuggc

SEQ ID NO: 3453969 - RNA, 22 nt, Human
uacccugaccuggcccccucag

SEQ ID NO: 3453970 - RNA, 17 nt, Human
uacccugagcugaggca

SEQ ID NO: 3453971 - RNA, 14 nt, Human
uacccuggccccuc

SEQ ID NO: 3453972 - RNA, 18 nt, Human
uacccuggccgcccccug

SEQ ID NO: 3453973 - RNA, 12 nt, Human
uacccugggugu

SEQ ID NO: 3453974 - RNA, 21 nt, Human
uacccuggguguccccgcugc

SEQ ID NO: 3453975 - RNA, 15 nt, Human
uacccuucccugcac

SEQ ID NO: 3453976 - RNA, 19 nt, Human
uacccuucugugcccagcu

SEQ ID NO: 3453977 - RNA, 22 nt, Human
uacccuuuccuccuuuaucaca

SEQ ID NO: 3453978 - RNA, 18 nt, Human
uacccuuuuucuccagcu

SEQ ID NO: 3453979 - RNA, 14 nt, Human
uaccgaaugugucu

SEQ ID NO: 3453980 - RNA, 16 nt, Human
uaccgaaugugucuuu

SEQ ID NO: 3453981 - RNA, 17 nt, Human
uaccgagucucuucucc

SEQ ID NO: 3453982 - RNA, 22 nt, Human
uaccgagucucuucuccacugg

SEQ ID NO: 3453983 - RNA, 15 nt, Human
uaccgccugucucuu

SEQ ID NO: 3453984 - RNA, 17 nt, Human
uaccgccugucucuuua

SEQ ID NO: 3453985 - RNA, 23 nt, Human
uaccgcguaaugcgccaauaaac

SEQ ID NO: 3453986 - RNA, 15 nt, Human
uaccgcguuguaaaa

SEQ ID NO: 3453987 - RNA, 13 nt, Human
uaccgucuacauu

SEQ ID NO: 3453988 - RNA, 17 nt, Human
uaccgucuacauuucac

SEQ ID NO: 3453989 - RNA, 19 nt, Human
uaccgugagcgacaaagau

SEQ ID NO: 3453990 - RNA, 14 nt, Human
uaccguuucuuccc

SEQ ID NO: 3453991 - RNA, 23 nt, Human
uaccuaaaaggaaaucucacccc

SEQ ID NO: 3453992 - RNA, 14 nt, Human
uaccuaaacagaua

SEQ ID NO: 3453993 - RNA, 15 nt, Human
uaccuaaacagauau

SEQ ID NO: 3453994 - RNA, 22 nt, Human
uaccuaaacagauauaaauggc

SEQ ID NO: 3453995 - RNA, 20 nt, Human
uaccuaaaguauuuuuauaa

SEQ ID NO: 3453996 - RNA, 16 nt, Human
uaccuaaguacuguaa

SEQ ID NO: 3453997 - RNA, 19 nt, Human
uaccuaagugacauuugua

SEQ ID NO: 3453998 - RNA, 23 nt, Human
uaccuacauguauuuguuugcau

SEQ ID NO: 3453999 - RNA, 20 nt, Human
uaccuaccacagugucugua

SEQ ID NO: 3454000 - RNA, 16 nt, Human
uaccuacuuucuucag

SEQ ID NO: 3454001 - RNA, 14 nt, Human
uaccuacuuugacu

SEQ ID NO: 3454002 - RNA, 13 nt, Human
uaccuagaagaag

SEQ ID NO: 3454003 - RNA, 22 nt, Human
uaccuagcgggauggggcuccc

SEQ ID NO: 3454004 - RNA, 16 nt, Human
uaccuagugaaacuuu

SEQ ID NO: 3454005 - RNA, 18 nt, Human
uaccuagugaaacuuuuc

SEQ ID NO: 3454006 - RNA, 19 nt, Human
uaccuauaaaguaaagcua

SEQ ID NO: 3454007 - RNA, 17 nt, Human
uaccuauaaugugugua

SEQ ID NO: 3454008 - RNA, 18 nt, Human
uaccuauaauguguguau

SEQ ID NO: 3454009 - RNA, 23 nt, Human
uaccuauauaauaaagcuacuga

SEQ ID NO: 3454010 - RNA, 13 nt, Human
uaccuauguaaca

SEQ ID NO: 3454011 - RNA, 12 nt, Human
uaccuauuugac

SEQ ID NO: 3454012 - RNA, 18 nt, Human
uaccucaacaagaagaau

SEQ ID NO: 3454013 - RNA, 19 nt, Human
uaccucaaccuguaaauua

SEQ ID NO: 3454014 - RNA, 14 nt, Human
uaccucaauguuug

SEQ ID NO: 3454015 - RNA, 18 nt, Human
uaccucaauuuucacugu

SEQ ID NO: 3454016 - RNA, 15 nt, Human
uaccucagccugggc

SEQ ID NO: 3454017 - RNA, 21 nt, Human
uaccucagccugggcgcuggu

SEQ ID NO: 3454018 - RNA, 14 nt, Human
uaccucaggcagcu

SEQ ID NO: 3454019 - RNA, 12 nt, Human
uaccucagguug

SEQ ID NO: 3454020 - RNA, 13 nt, Human
uaccucauguuua

SEQ ID NO: 3454021 - RNA, 18 nt, Human
uaccucauguuuaugaaa

SEQ ID NO: 3454022 - RNA, 22 nt, Human
uaccuccaacagaacuaaaugu

SEQ ID NO: 3454023 - RNA, 16 nt, Human
uaccuccaacccugcc

SEQ ID NO: 3454024 - RNA, 17 nt, Human
uaccuccaacccugccg

SEQ ID NO: 3454025 - RNA, 15 nt, Human
uaccucccacacucc

SEQ ID NO: 3454026 - RNA, 20 nt, Human
uaccucccacacucccaagg

SEQ ID NO: 3454027 - RNA, 13 nt, Human
uaccucccaccuu

SEQ ID NO: 3454028 - RNA, 16 nt, Human
uaccucccaccuuugg

SEQ ID NO: 3454029 - RNA, 17 nt, Human
uaccuccccugccuugc

SEQ ID NO: 3454030 - RNA, 18 nt, Human
uaggguacuaaauuuaaa

SEQ ID NO: 3454031 - RNA, 22 nt, Human
uagggugaaccacuucauucug

SEQ ID NO: 3454032 - RNA, 16 nt, Human
uaggguggagagccac

SEQ ID NO: 3454033 - RNA, 15 nt, Human
uaggguucugccucu

SEQ ID NO: 3454034 - RNA, 19 nt, Human
uaggguuuaauccccagua

SEQ ID NO: 3454035 - RNA, 21 nt, Human
uaggguuuaauccccaguaaa

SEQ ID NO: 3454036 - RNA, 19 nt, Human
uaggguuucccuacugaag

SEQ ID NO: 3454037 - RNA, 13 nt, Human
uaggguuucugau

SEQ ID NO: 3454038 - RNA, 15 nt, Human
uagguaaaauguauu

SEQ ID NO: 3454039 - RNA, 16 nt, Human
uagguaaauuacaguu

SEQ ID NO: 3454040 - RNA, 14 nt, Human
uagguagaaaaagg

SEQ ID NO: 3454041 - RNA, 18 nt, Human
uagguagaaaaaggguca

SEQ ID NO: 3454042 - RNA, 20 nt, Human
uagguagaagugagcaaaaa

SEQ ID NO: 3454043 - RNA, 15 nt, Human
uagguagagucugag

SEQ ID NO: 3454044 - RNA, 14 nt, Human
uagguaggaaaugu

SEQ ID NO: 3454045 - RNA, 14 nt, Human
uagguaggguuuaa

SEQ ID NO: 3454046 - RNA, 20 nt, Human
uagguauaucucccagugcu

SEQ ID NO: 3454047 - RNA, 16 nt, Human
uaggucaagaagaaga

SEQ ID NO: 3454048 - RNA, 15 nt, Human
uaggucacuccuggg

SEQ ID NO: 3454049 - RNA, 24 nt, Human
uaggucacuggcucuccaagugcc

SEQ ID NO: 3454050 - RNA, 22 nt, Human
uaggucaguacccaccugagcu

SEQ ID NO: 3454051 - RNA, 15 nt, Human
uagguccucagaaag

SEQ ID NO: 3454052 - RNA, 19 nt, Human
uaggucucggacuaagccu

SEQ ID NO: 3454053 - RNA, 14 nt, Human
uaggucucuucccc

SEQ ID NO: 3454054 - RNA, 17 nt, Human
uaggucucuucucccag

SEQ ID NO: 3454055 - RNA, 18 nt, Human
uaggucugaaauuuuucu

SEQ ID NO: 3454056 - RNA, 17 nt, Human
uaggucugauauucaaa

SEQ ID NO: 3454057 - RNA, 16 nt, Human
uaggugacagagugag

SEQ ID NO: 3454058 - RNA, 17 nt, Human
uaccucugauaccucaa

SEQ ID NO: 3454059 - RNA, 14 nt, Human
uaccucugugugcu

SEQ ID NO: 3454060 - RNA, 14 nt, Human
uaccucuuauugca

SEQ ID NO: 3454061 - RNA, 17 nt, Human
uaccucuuauugcaaaa

SEQ ID NO: 3454062 - RNA, 23 nt, Human
uaccucuugagccuugaacuuug

SEQ ID NO: 3454063 - RNA, 14 nt, Human
uaccucuuuggaaa

SEQ ID NO: 3454064 - RNA, 23 nt, Human
uaccucuuuuagucauuuugcuu

SEQ ID NO: 3454065 - RNA, 20 nt, Human
uaccugaaaacacugugcac

SEQ ID NO: 3454066 - RNA, 21 nt, Human
uaccugaaaacacugugcaca

SEQ ID NO: 3454067 - RNA, 18 nt, Human
uaccugaagggguuuucu

SEQ ID NO: 3454068 - RNA, 19 nt, Human
uaccugaagggguuuucuu

SEQ ID NO: 3454069 - RNA, 16 nt, Human
uaccugaagucuuugu

SEQ ID NO: 3454070 - RNA, 12 nt, Human
uaccugagacca

SEQ ID NO: 3454071 - RNA, 15 nt, Human
uaccugagggucugu

SEQ ID NO: 3454072 - RNA, 16 nt, Human
uaccugaguugaagag

SEQ ID NO: 3454073 - RNA, 19 nt, Human
uaccugaucaaugacagag

SEQ ID NO: 3454074 - RNA, 15 nt, Human
uaccugaucccacuc

SEQ ID NO: 3454075 - RNA, 21 nt, Human
uaccugauuucuucagggcug

SEQ ID NO: 3454076 - RNA, 18 nt, Human
uaccugcaggcugagcca

SEQ ID NO: 3454077 - RNA, 16 nt, Human
uaccugccaggaagcc

SEQ ID NO: 3454078 - RNA, 18 nt, Human
uaccugccaggaagccag

SEQ ID NO: 3454079 - RNA, 20 nt, Human
uaccugccccacuuguccuu

SEQ ID NO: 3454080 - RNA, 16 nt, Human
uaccugcccugacaug

SEQ ID NO: 3454081 - RNA, 16 nt, Human
uaccugcccuggaaca

SEQ ID NO: 3454082 - RNA, 17 nt, Human
uaccugcucagcccugc

SEQ ID NO: 3454083 - RNA, 11 nt, Human
uaccugcugcu

SEQ ID NO: 3454084 - RNA, 19 nt, Human
uaccuggauguucuuuuua

SEQ ID NO: 3454085 - RNA, 20 nt, Human
uaccuggguccccagcccuu

SEQ ID NO: 3454086 - RNA, 19 nt, Human
uaccuguagauucagguaa

SEQ ID NO: 3454087 - RNA, 20 nt, Human
uaccuguauacagugcagag

SEQ ID NO: 3454088 - RNA, 15 nt, Human
uaccuguauucccag

SEQ ID NO: 3454089 - RNA, 21 nt, Human
uaccuguauuuaaaaauagaa

SEQ ID NO: 3454090 - RNA, 17 nt, Human
uaccugucacauugcau

SEQ ID NO: 3454091 - RNA, 14 nt, Human
uaccugucccccug

SEQ ID NO: 3454092 - RNA, 16 nt, Human
uaccugucccccugac

SEQ ID NO: 3454093 - RNA, 16 nt, Human
uaccuguguggacagg

SEQ ID NO: 3454094 - RNA, 13 nt, Human
uaccuguugagca

SEQ ID NO: 3454095 - RNA, 21 nt, Human
uaccuuaaaauuugaaacauu

SEQ ID NO: 3454096 - RNA, 22 nt, Human
uaccuuaaaauuugaaacauug

SEQ ID NO: 3454097 - RNA, 21 nt, Human
uaccuuaaauuaguacagcac

SEQ ID NO: 3454098 - RNA, 22 nt, Human
uaccuuacuguggaggaaggau

SEQ ID NO: 3454099 - RNA, 17 nt, Human
uaccuuauaguuacugu

SEQ ID NO: 3454100 - RNA, 23 nt, Human
uaccuuaucuuacaauauugauu

SEQ ID NO: 3454101 - RNA, 15 nt, Human
uaccuucaaagcuga

SEQ ID NO: 3454102 - RNA, 17 nt, Human
uaccuucaauaaaguau

SEQ ID NO: 3454103 - RNA, 18 nt, Human
uaccuucagauccuaccc

SEQ ID NO: 3454104 - RNA, 16 nt, Human
uaccuuccuucccugg

SEQ ID NO: 3454105 - RNA, 13 nt, Human
uaccuucucccca

SEQ ID NO: 3454106 - RNA, 15 nt, Human
uaccuucuucaggcu

SEQ ID NO: 3454107 - RNA, 22 nt, Human
uaccuugaaaauaagaauagaa

SEQ ID NO: 3454108 - RNA, 18 nt, Human
uaccuugaccuuuguaca

SEQ ID NO: 3454109 - RNA, 21 nt, Human
uaccuugcacacaucaucugu

SEQ ID NO: 3454110 - RNA, 16 nt, Human
uaccuugccccaaccc

SEQ ID NO: 3454111 - RNA, 16 nt, Human
uaccuugcuuuugcuu

SEQ ID NO: 3454112 - RNA, 18 nt, Human
uaccuugcuuuugcuucu

SEQ ID NO: 3454113 - RNA, 21 nt, Human
uaccuugcuuuugcuucuaga

SEQ ID NO: 3454114 - RNA, 22 nt, Human
uaccuugguucccccacugauc

SEQ ID NO: 3454115 - RNA, 14 nt, Human
uaccuuguauacug

SEQ ID NO: 3454116 - RNA, 22 nt, Human
uaccuuguguuuuguuuugauu

SEQ ID NO: 3454117 - RNA, 22 nt, Human
uaccuuguuauuuaacccauuu

SEQ ID NO: 3454118 - RNA, 15 nt, Human
uaccuuucaaagcuu

SEQ ID NO: 3454119 - RNA, 19 nt, Human
uaccuuugacaaagguaaa

SEQ ID NO: 3454120 - RNA, 16 nt, Human
uaccuuugcucuugca

SEQ ID NO: 3454121 - RNA, 20 nt, Human
uaccuuuguauucucuccug

SEQ ID NO: 3454122 - RNA, 23 nt, Human
uaccuuuguucccaaauuucaua

SEQ ID NO: 3454123 - RNA, 17 nt, Human
uaccuuuucagggcugg

SEQ ID NO: 3454124 - RNA, 14 nt, Human
uaccuuuucucuuc

SEQ ID NO: 3454125 - RNA, 21 nt, Human
uaccuuuugaggagccccagc

SEQ ID NO: 3454126 - RNA, 22 nt, Human
uaccuuuuuuagaguugauacu

SEQ ID NO: 3454127 - RNA, 19 nt, Human
uaccuuuuuuauacauaaa

SEQ ID NO: 3454128 - RNA, 20 nt, Human
uaccuuuuuuauacauaaac

SEQ ID NO: 3454129 - RNA, 23 nt, Human
uacgaaaaaaugguagcauuuua

SEQ ID NO: 3454130 - RNA, 17 nt, Human
uacgaaauaauuguugu

SEQ ID NO: 3454131 - RNA, 22 nt, Human
uacgaaccuacaguuuuaacug

SEQ ID NO: 3454132 - RNA, 20 nt, Human
uacgaagaguauuuuugaca

SEQ ID NO: 3454133 - RNA, 17 nt, Human
uacgaaguucaagauca

SEQ ID NO: 3454134 - RNA, 14 nt, Human
uacgaauacuuuug

SEQ ID NO: 3454135 - RNA, 23 nt, Human
uacgacaguacacugucagcagg

SEQ ID NO: 3454136 - RNA, 21 nt, Human
uacgacucuuuuccaaacaca

SEQ ID NO: 3454137 - RNA, 14 nt, Human
uacgauaaggaaga

SEQ ID NO: 3454138 - RNA, 16 nt, Human
uacgauaaggaagaaa

SEQ ID NO: 3454139 - RNA, 23 nt, Human
uacgauacgcuacuauaaagaga

SEQ ID NO: 3454140 - RNA, 13 nt, Human
uacgaugcuucaa

SEQ ID NO: 3454141 - RNA, 16 nt, Human
uacgauggcacccagu

SEQ ID NO: 3454142 - RNA, 20 nt, Human
uacgauuuaagguauuuaaa

SEQ ID NO: 3454143 - RNA, 13 nt, Human
uacgcuaguuauc

SEQ ID NO: 3454144 - RNA, 14 nt, Human
uacgcuggugcuga

SEQ ID NO: 3454145 - RNA, 14 nt, Human
uacgcuuugauuca

SEQ ID NO: 3454146 - RNA, 15 nt, Human
uacgcuuugauucau

SEQ ID NO: 3454147 - RNA, 17 nt, Human
uacgcuuuuaaugaaaa

SEQ ID NO: 3454148 - RNA, 19 nt, Human
uacggaucaucaacaagau

SEQ ID NO: 3454149 - RNA, 23 nt, Human
uacggauccugcacugacucugg

SEQ ID NO: 3454150 - RNA, 15 nt, Human
uacggauuuucaguu

SEQ ID NO: 3454151 - RNA, 12 nt, Human
uacggugggggu

SEQ ID NO: 3454152 - RNA, 16 nt, Human
uacguaauaagguuuu

SEQ ID NO: 3454153 - RNA, 19 nt, Human
uacguaauaagguuuuaau

SEQ ID NO: 3454154 - RNA, 12 nt, Human
uacguacacauu

SEQ ID NO: 3454155 - RNA, 13 nt, Human
uacguaugagacg

SEQ ID NO: 3454156 - RNA, 22 nt, Human
uacguaugucugguucucaauu

SEQ ID NO: 3454157 - RNA, 16 nt, Human
uacgucugacaggcaa

SEQ ID NO: 3454158 - RNA, 17 nt, Human
uacgugacccucugcug

SEQ ID NO: 3454159 - RNA, 18 nt, Human
uacgugcucugugggucu

SEQ ID NO: 3454160 - RNA, 19 nt, Human
uacgugggcauugucuuuu

SEQ ID NO: 3454161 - RNA, 14 nt, Human
uacgugugcaugug

SEQ ID NO: 3454162 - RNA, 15 nt, Human
uacguuauuguugac

SEQ ID NO: 3454163 - RNA, 13 nt, Human
uacguugugcauu

SEQ ID NO: 3454164 - RNA, 16 nt, Human
uacguugugcauuugg

SEQ ID NO: 3454165 - RNA, 16 nt, Human
uacguuugaagacauu

SEQ ID NO: 3454166 - RNA, 22 nt, Human
uacguuugaagacauugcacca

SEQ ID NO: 3454167 - RNA, 16 nt, Human
uacuaaaaagaaggaa

SEQ ID NO: 3454168 - RNA, 16 nt, Human
uacuaaaaaguauaaa

SEQ ID NO: 3454169 - RNA, 21 nt, Human
uacuaaaaaguauaaaauagu

SEQ ID NO: 3454170 - RNA, 18 nt, Human
uacuaaaaauacaaaaaa

SEQ ID NO: 3454171 - RNA, 15 nt, Human
uacuaaaauggacug

SEQ ID NO: 3454172 - RNA, 17 nt, Human
uacuaaaauggacugug

SEQ ID NO: 3454173 - RNA, 23 nt, Human
uacuaaaauggacuguggugacu

SEQ ID NO: 3454174 - RNA, 16 nt, Human
gcccagcucccccggg

SEQ ID NO: 3454175 - RNA, 24 nt, Human
gcccagcugcaccugccagccugg

SEQ ID NO: 3454176 - RNA, 14 nt, Human
gcccagcugcucug

SEQ ID NO: 3454177 - RNA, 15 nt, Human
gcccagcugggcucu

SEQ ID NO: 3454178 - RNA, 19 nt, Human
gcccagcugggcucugcca

SEQ ID NO: 3454179 - RNA, 21 nt, Human
gcccagcugggcucugccacc

SEQ ID NO: 3454180 - RNA, 23 nt, Human
gcccagcugggcucugccacccu

SEQ ID NO: 3454181 - RNA, 19 nt, Human
gcccagcuugggcccagcu

SEQ ID NO: 3454182 - RNA, 20 nt, Human
gcccagcuugggcccagcug

SEQ ID NO: 3454183 - RNA, 22 nt, Human
gcccagcuugggcccagcuggg

SEQ ID NO: 3454184 - RNA, 15 nt, Human
gcccaggaaaggcuc

SEQ ID NO: 3454185 - RNA, 20 nt, Human
gcccaggaaaggcuccagga

SEQ ID NO: 3454186 - RNA, 20 nt, Human
gcccaggaauuugaagcugc

SEQ ID NO: 3454187 - RNA, 15 nt, Human
gcccaggaccagcug

SEQ ID NO: 3454188 - RNA, 16 nt, Human
gcccaggaccagcugg

SEQ ID NO: 3454189 - RNA, 22 nt, Human
gcccaggaccaucuucccgaga

SEQ ID NO: 3454190 - RNA, 21 nt, Human
gcccaggaccccauggcagug

SEQ ID NO: 3454191 - RNA, 20 nt, Human
gcccaggacggggccggcca

SEQ ID NO: 3454192 - RNA, 12 nt, Human
gcccaggagaga

SEQ ID NO: 3454193 - RNA, 17 nt, Human
gcccaggagagagaaag

SEQ ID NO: 3454194 - RNA, 15 nt, Human
gcccaggagcccauu

SEQ ID NO: 3454195 - RNA, 15 nt, Human
gcccaggagcucccc

SEQ ID NO: 3454196 - RNA, 21 nt, Human
gcccaggagcuccccucccca

SEQ ID NO: 3454197 - RNA, 22 nt, Human
gcccaggaguuugaggcugcag

SEQ ID NO: 3454198 - RNA, 17 nt, Human
gcccaggaguuuggcca

SEQ ID NO: 3454199 - RNA, 18 nt, Human
gcccaggaguuuggccag

SEQ ID NO: 3454200 - RNA, 15 nt, Human
gcccaggauacuggc

SEQ ID NO: 3454201 - RNA, 20 nt, Human
gcccaggauacuggcacaga

SEQ ID NO: 3454202 - RNA, 16 nt, Human
gcccaggauauauuuu

SEQ ID NO: 3454203 - RNA, 18 nt, Human
gcccaggauauauuuuau

SEQ ID NO: 3454204 - RNA, 15 nt, Human
gcccaggcacugcaa

SEQ ID NO: 3454205 - RNA, 16 nt, Human
gcccaggcacugcaaa

SEQ ID NO: 3454206 - RNA, 14 nt, Human
gcccaggcaggucu

SEQ ID NO: 3454207 - RNA, 11 nt, Human
gcccaggccag

SEQ ID NO: 3454208 - RNA, 19 nt, Human
gcccaggccaucuuccagg

SEQ ID NO: 3454209 - RNA, 15 nt, Human
gcccaggccccugcc

SEQ ID NO: 3454210 - RNA, 20 nt, Human
gcccaggccccugccacccu

SEQ ID NO: 3454211 - RNA, 21 nt, Human
gcccaggccccugccacccug

SEQ ID NO: 3454212 - RNA, 22 nt, Human
gcccaggccccugccacccugg

SEQ ID NO: 3454213 - RNA, 14 nt, Human
gcccaggccggcca

SEQ ID NO: 3454214 - RNA, 15 nt, Human
gcccaggccggccag

SEQ ID NO: 3454215 - RNA, 16 nt, Human
gcccaggccggccagc

SEQ ID NO: 3454216 - RNA, 19 nt, Human
gcccaggccggccagccuc

SEQ ID NO: 3454217 - RNA, 21 nt, Human
gcccaggccgggguggagcau

SEQ ID NO: 3454218 - RNA, 21 nt, Human
gcccaggccuccagcucagca

SEQ ID NO: 3454219 - RNA, 22 nt, Human
gcccaggcgggagcgguggccc

SEQ ID NO: 3454220 - RNA, 18 nt, Human
gcccaggcucggccugcc

SEQ ID NO: 3454221 - RNA, 20 nt, Human
gcccaggcucggccugcccc

SEQ ID NO: 3454222 - RNA, 11 nt, Human
gcccaggcugg

SEQ ID NO: 3454223 - RNA, 12 nt, Human
gcccaggcuggc

SEQ ID NO: 3454224 - RNA, 22 nt, Human
gcccaggcuggcgugcaguggu

SEQ ID NO: 3454225 - RNA, 12 nt, Human
gcccaggcuggu

SEQ ID NO: 3454226 - RNA, 21 nt, Human
gcccagggacaccagccaggc

SEQ ID NO: 3454227 - RNA, 24 nt, Human
gcccagggacaccagccaggcucu

SEQ ID NO: 3454228 - RNA, 18 nt, Human
gcccagggagaggccaug

SEQ ID NO: 3454229 - RNA, 12 nt, Human
gcccagggaggc

SEQ ID NO: 3454230 - RNA, 16 nt, Human
gcccagggcaagcucc

SEQ ID NO: 3454231 - RNA, 23 nt, Human
gcccagggcaagcuccgcaggac

SEQ ID NO: 3454232 - RNA, 20 nt, Human
gcccagggcaucuugcuggc

SEQ ID NO: 3454233 - RNA, 21 nt, Human
gcccagggcaucuugcuggcu

SEQ ID NO: 3454234 - RNA, 20 nt, Human
gcccagggccacucugccuc

SEQ ID NO: 3454235 - RNA, 15 nt, Human
gcccagggcccagag

SEQ ID NO: 3454236 - RNA, 17 nt, Human
gcccagggcccagagcc

SEQ ID NO: 3454237 - RNA, 12 nt, Human
gcccagggcuca

SEQ ID NO: 3454238 - RNA, 15 nt, Human
gcccagggcucagcc

SEQ ID NO: 3454239 - RNA, 16 nt, Human
gcccagggcucagccu

SEQ ID NO: 3454240 - RNA, 17 nt, Human
gcccagggcucagccug

SEQ ID NO: 3454241 - RNA, 18 nt, Human
gcccagggcuccugcacu

SEQ ID NO: 3454242 - RNA, 20 nt, Human
gcccagggcugggaggaagg

SEQ ID NO: 3454243 - RNA, 15 nt, Human
gcccaggggagcccu

SEQ ID NO: 3454244 - RNA, 17 nt, Human
gcccaggggugcccccu

SEQ ID NO: 3454245 - RNA, 18 nt, Human
gcccaggggugcccccuc

SEQ ID NO: 3454246 - RNA, 22 nt, Human
gcccaggggugcccccuccucu

SEQ ID NO: 3454247 - RNA, 15 nt, Human
gcccaggguggccac

SEQ ID NO: 3454248 - RNA, 20 nt, Human
gcccaggguggccacaccuc

SEQ ID NO: 3454249 - RNA, 17 nt, Human
gcccagguuucuggucu

SEQ ID NO: 3454250 - RNA, 23 nt, Human
gcccagguuucuggucucuaggc

SEQ ID NO: 3454251 - RNA, 22 nt, Human
gcccaguacauuuaaauuuuuu

SEQ ID NO: 3454252 - RNA, 22 nt, Human
gcccaguaccuagcuggcucug

SEQ ID NO: 3454253 - RNA, 15 nt, Human
gcccaguagaccuug

SEQ ID NO: 3454254 - RNA, 12 nt, Human
gcccagucccag

SEQ ID NO: 3454255 - RNA, 15 nt, Human
gcccagucccagcag

SEQ ID NO: 3454256 - RNA, 19 nt, Human
gcccagucccagcagccag

SEQ ID NO: 3454257 - RNA, 14 nt, Human
gcccagucccccaa

SEQ ID NO: 3454258 - RNA, 23 nt, Human
gcccaguccucucccaaguccac

SEQ ID NO: 3454259 - RNA, 18 nt, Human
gcccaguccuuccaccuc

SEQ ID NO: 3454260 - RNA, 22 nt, Human
gcccagucuggaaugcaguggu

SEQ ID NO: 3454261 - RNA, 14 nt, Human
gcccagugcauggu

SEQ ID NO: 3454262 - RNA, 22 nt, Human
gcccagugucaaguugugcuug

SEQ ID NO: 3454263 - RNA, 20 nt, Human
uagacaaauagaaaaugguc

SEQ ID NO: 3454264 - RNA, 14 nt, Human
uagacaagauauug

SEQ ID NO: 3454265 - RNA, 21 nt, Human
uagacaagauauuguacauaa

SEQ ID NO: 3454266 - RNA, 15 nt, Human
uagacaagccagaac

SEQ ID NO: 3454267 - RNA, 19 nt, Human
uagacaagccagaacuuga

SEQ ID NO: 3454268 - RNA, 20 nt, Human
uagacaaucauuguuuugaa

SEQ ID NO: 3454269 - RNA, 16 nt, Human
uagacaauuuauuaug

SEQ ID NO: 3454270 - RNA, 15 nt, Human
uagacacacaaagca

SEQ ID NO: 3454271 - RNA, 16 nt, Human
uagacacacaaagcag

SEQ ID NO: 3454272 - RNA, 20 nt, Human
uagacacaggauagauaacu

SEQ ID NO: 3454273 - RNA, 19 nt, Human
uagacacaugaagguaaau

SEQ ID NO: 3454274 - RNA, 21 nt, Human
uagacacaugaagguaaauaa

SEQ ID NO: 3454275 - RNA, 17 nt, Human
uagacaccaaaguucua

SEQ ID NO: 3454276 - RNA, 17 nt, Human
uagacacuggcugccag

SEQ ID NO: 3454277 - RNA, 15 nt, Human
uagacacuuuggaag

SEQ ID NO: 3454278 - RNA, 15 nt, Human
uagacagaggcccuc

SEQ ID NO: 3454279 - RNA, 21 nt, Human
uagacagagucucacuguugc

SEQ ID NO: 3454280 - RNA, 20 nt, Human
uagacagccaaaggcuggcg

SEQ ID NO: 3454281 - RNA, 19 nt, Human
uagacagcuuuucucaacu

SEQ ID NO: 3454282 - RNA, 15 nt, Human
uagacaggagaagaa

SEQ ID NO: 3454283 - RNA, 14 nt, Human
uagacagucccugc

SEQ ID NO: 3454284 - RNA, 16 nt, Human
uagacaguuuugagaa

SEQ ID NO: 3454285 - RNA, 13 nt, Human
uagacauaacaaa

SEQ ID NO: 3454286 - RNA, 12 nt, Human
uagacaugaaag

SEQ ID NO: 3454287 - RNA, 19 nt, Human
uagacauggagguucuaag

SEQ ID NO: 3454288 - RNA, 23 nt, Human
uagacauggagguucuaaggccu

SEQ ID NO: 3454289 - RNA, 15 nt, Human
uagacauugaggacc

SEQ ID NO: 3454290 - RNA, 18 nt, Human
uagacauuucucuuacug

SEQ ID NO: 3454291 - RNA, 16 nt, Human
uagacauuuuaacaag

SEQ ID NO: 3454292 - RNA, 17 nt, Human
uagacauuuuaacaaga

SEQ ID NO: 3454293 - RNA, 13 nt, Human
uagaccaaaauaa

SEQ ID NO: 3454294 - RNA, 14 nt, Human
uagaccaaaauaaa

SEQ ID NO: 3454295 - RNA, 13 nt, Human
uagaccaaggaac

SEQ ID NO: 3454296 - RNA, 14 nt, Human
uagaccaaggaaca

SEQ ID NO: 3454297 - RNA, 15 nt, Human
uagaccaaggaacaa

SEQ ID NO: 3454298 - RNA, 22 nt, Human
uagaccacaaauagugcucgcu

SEQ ID NO: 3454299 - RNA, 16 nt, Human
uagaccaccaagccuu

SEQ ID NO: 3454300 - RNA, 19 nt, Human
uagaccaccaagccuugau

SEQ ID NO: 3454301 - RNA, 20 nt, Human
uagacccacuggacucaccu

SEQ ID NO: 3454302 - RNA, 23 nt, Human
uagacccucaugcugccaauauc

SEQ ID NO: 3454303 - RNA, 13 nt, Human
uagaccuacaggg

SEQ ID NO: 3454304 - RNA, 13 nt, Human
uagaccucagccu

SEQ ID NO: 3454305 - RNA, 20 nt, Human
uagaccucagccugugcugc

SEQ ID NO: 3454306 - RNA, 14 nt, Human
uagaccugucuccu

SEQ ID NO: 3454307 - RNA, 17 nt, Human
uagaccuuguuacuucu

SEQ ID NO: 3454308 - RNA, 23 nt, Human
uagacgagcaggcuucuuccccc

SEQ ID NO: 3454309 - RNA, 22 nt, Human
uagacuauaaauguugcuaugu

SEQ ID NO: 3454310 - RNA, 13 nt, Human
uagacuauauaca

SEQ ID NO: 3454311 - RNA, 12 nt, Human
uagacucuucac

SEQ ID NO: 3454312 - RNA, 21 nt, Human
uagacucuuuuccuucccuuu

SEQ ID NO: 3454313 - RNA, 20 nt, Human
uagacugccacaaggaagaa

SEQ ID NO: 3454314 - RNA, 22 nt, Human
uagacugccacaaggaagaaau

SEQ ID NO: 3454315 - RNA, 23 nt, Human
uagacugccacaaggaagaaauu

SEQ ID NO: 3454316 - RNA, 17 nt, Human
uagacugccgugcauua

SEQ ID NO: 3454317 - RNA, 20 nt, Human
uagacuggccugaaccacag

SEQ ID NO: 3454318 - RNA, 16 nt, Human
uagauccacacacaga

SEQ ID NO: 3454319 - RNA, 20 nt, Human
uagauccauuaauuuaaaug

SEQ ID NO: 3454320 - RNA, 22 nt, Human
uagaucgaugauaugaccagaa

SEQ ID NO: 3454321 - RNA, 12 nt, Human
uagaucuccagc

SEQ ID NO: 3454322 - RNA, 14 nt, Human
uagaucuucugaaa

SEQ ID NO: 3454323 - RNA, 15 nt, Human
uagaucuucugaaau

SEQ ID NO: 3454324 - RNA, 13 nt, Human
uagaugaaaaagc

SEQ ID NO: 3454325 - RNA, 20 nt, Human
uagaugaaaaagcauguaca

SEQ ID NO: 3454326 - RNA, 17 nt, Human
uagaugagcugggccgg

SEQ ID NO: 3454327 - RNA, 20 nt, Human
uagaugauuaaauaagauuc

SEQ ID NO: 3454328 - RNA, 16 nt, Human
uagaugcaguucugaa

SEQ ID NO: 3454329 - RNA, 21 nt, Human
uagaugcaguucugaagaaga

SEQ ID NO: 3454330 - RNA, 20 nt, Human
uagaugcugaugauuuguuu

SEQ ID NO: 3454331 - RNA, 17 nt, Human
uagauggaaaaacuugu

SEQ ID NO: 3454332 - RNA, 18 nt, Human
uagauggccucuuacuaa

SEQ ID NO: 3454333 - RNA, 18 nt, Human
uagaugggaaugaagcuu

SEQ ID NO: 3454334 - RNA, 19 nt, Human
uagaugggaaugaagcuug

SEQ ID NO: 3454335 - RNA, 22 nt, Human
uagaugggaaugaagcuugugu

SEQ ID NO: 3454336 - RNA, 20 nt, Human
uagaugggcauggggugggc

SEQ ID NO: 3454337 - RNA, 15 nt, Human
uagauggugcugaga

SEQ ID NO: 3454338 - RNA, 19 nt, Human
uagauggugcugagaagcu

SEQ ID NO: 3454339 - RNA, 14 nt, Human
uagaugguuacacu

SEQ ID NO: 3454340 - RNA, 21 nt, Human
uagaugguuacacuguuagaa

SEQ ID NO: 3454341 - RNA, 14 nt, Human
uagauguaaauuuu

SEQ ID NO: 3454342 - RNA, 16 nt, Human
uagauguaauuuugug

SEQ ID NO: 3454343 - RNA, 20 nt, Human
uagauguagauaaacucaga

SEQ ID NO: 3454344 - RNA, 16 nt, Human
uagauguauaacuagg

SEQ ID NO: 3454345 - RNA, 20 nt, Human
uagaugucuuuucccauuua

SEQ ID NO: 3454346 - RNA, 15 nt, Human
uagaugugagaaaac

SEQ ID NO: 3454347 - RNA, 15 nt, Human
uagaugugauuuaau

SEQ ID NO: 3454348 - RNA, 23 nt, Human
uagaugugauuuaauaguguuaa

SEQ ID NO: 3454349 - RNA, 17 nt, Human
uagauguucagauugcu

SEQ ID NO: 3454350 - RNA, 14 nt, Human
uagauguucucuau

SEQ ID NO: 3454351 - RNA, 18 nt, Human
uagauguucucuaucauu

SEQ ID NO: 3454352 - RNA, 14 nt, Human
uagauguugccaug

SEQ ID NO: 3454353 - RNA, 15 nt, Human
uagauguugccaugu

SEQ ID NO: 3454354 - RNA, 13 nt, Human
uagauguuucaca

SEQ ID NO: 3454355 - RNA, 13 nt, Human
uagauuaaauaua

SEQ ID NO: 3454356 - RNA, 22 nt, Human
uagauuaaauauagauuagaaa

SEQ ID NO: 3454357 - RNA, 16 nt, Human
uagauuagaaaaauuc

SEQ ID NO: 3454358 - RNA, 14 nt, Human
uagauuagaauucu

SEQ ID NO: 3454359 - RNA, 20 nt, Human
uagauuagaucuuuuaagcc

SEQ ID NO: 3454360 - RNA, 14 nt, Human
uagauuauaucaaa

SEQ ID NO: 3454361 - RNA, 17 nt, Human
uagauuauaucaaagua

SEQ ID NO: 3454362 - RNA, 15 nt, Human
uagauucaaagguuc

SEQ ID NO: 3454363 - RNA, 12 nt, Human
uagauucaccug

SEQ ID NO: 3454364 - RNA, 16 nt, Human
uagauucaccuguaaa

SEQ ID NO: 3454365 - RNA, 22 nt, Human
uagauucucuggcuguaaggcu

SEQ ID NO: 3454366 - RNA, 19 nt, Human
uagauucucugugucuaag

SEQ ID NO: 3454367 - RNA, 20 nt, Human
uagauucucugugucuaaga

SEQ ID NO: 3454368 - RNA, 21 nt, Human
uagauucucugugucuaagau

SEQ ID NO: 3454369 - RNA, 18 nt, Human
uagauugaaaacuuuucu

SEQ ID NO: 3454370 - RNA, 20 nt, Human
uagauugaaaacuuuucuca

SEQ ID NO: 3454371 - RNA, 22 nt, Human
uagauugacuaacucaaauaca

SEQ ID NO: 3454372 - RNA, 12 nt, Human
uagauuguaaac

SEQ ID NO: 3454373 - RNA, 15 nt, Human
uagauuuauuucauc

SEQ ID NO: 3454374 - RNA, 18 nt, Human
uagauuucugauuuuaug

SEQ ID NO: 3454375 - RNA, 13 nt, Human
uagauuuggaaua

SEQ ID NO: 3454376 - RNA, 13 nt, Human
uagauuugggaga

SEQ ID NO: 3454377 - RNA, 19 nt, Human
uagauuuguuuuguguugu

SEQ ID NO: 3454378 - RNA, 16 nt, Human
uagauuuuaaucaaau

SEQ ID NO: 3454379 - RNA, 17 nt, Human
uagauuuuaaucaaauu

SEQ ID NO: 3454380 - RNA, 16 nt, Human
uagauuuuauuuuacu

SEQ ID NO: 3454381 - RNA, 17 nt, Human
uagauuuucauguucuu

SEQ ID NO: 3454382 - RNA, 23 nt, Human
uagauuuuguguuuauucuugau

SEQ ID NO: 3454383 - RNA, 17 nt, Human
uagauuuuguuuugcuu

SEQ ID NO: 3454384 - RNA, 13 nt, Human
uagcaaaaaaagu

SEQ ID NO: 3454385 - RNA, 14 nt, Human
uagcaaaaaaaguu

SEQ ID NO: 3454386 - RNA, 18 nt, Human
uagcaaaaaaaguuguau

SEQ ID NO: 3454387 - RNA, 21 nt, Human
uagcaaaaaaaguuguaugau

SEQ ID NO: 3454388 - RNA, 14 nt, Human
uagcaaaaacaugu

SEQ ID NO: 3454389 - RNA, 21 nt, Human
uagcaaaauaaaacauagcaa

SEQ ID NO: 3454390 - RNA, 22 nt, Human
uagcaaacccugucaaacauua

SEQ ID NO: 3454391 - RNA, 21 nt, Human
uagcaaauguuuugacaugaa

SEQ ID NO: 3454392 - RNA, 21 nt, Human
uagcaacuacagucuaaagcu

SEQ ID NO: 3454393 - RNA, 22 nt, Human
uagcaacuacagucuaaagcug

SEQ ID NO: 3454394 - RNA, 18 nt, Human
uagcaagacacaucccua

SEQ ID NO: 3454395 - RNA, 13 nt, Human
uagcaagcuggcc

SEQ ID NO: 3454396 - RNA, 22 nt, Human
uagcaagugaauuuuucucuaa

SEQ ID NO: 3454397 - RNA, 18 nt, Human
uagcaaguucuagagaag

SEQ ID NO: 3454398 - RNA, 19 nt, Human
uagcaaguucuagagaaga

SEQ ID NO: 3454399 - RNA, 21 nt, Human
uagcaaguucuagagaagagg

SEQ ID NO: 3454400 - RNA, 21 nt, Human
uagcaauccauguuaguuuuu

SEQ ID NO: 3454401 - RNA, 16 nt, Human
uagcaauuccaucacc

SEQ ID NO: 3454402 - RNA, 13 nt, Human
uagcacaaaaaaa

SEQ ID NO: 3454403 - RNA, 21 nt, Human
uagcacagacccugcccugug

SEQ ID NO: 3454404 - RNA, 24 nt, Human
uagcacagacccugcccugugggc

SEQ ID NO: 3454405 - RNA, 17 nt, Human
uagcacagauggccagc

SEQ ID NO: 3454406 - RNA, 19 nt, Human
uagcacagauuuuaauugu

SEQ ID NO: 3454407 - RNA, 12 nt, Human
uagcacagcagc

SEQ ID NO: 3454408 - RNA, 12 nt, Human
uagcacaggcug

SEQ ID NO: 3454409 - RNA, 13 nt, Human
uagcacaggcuga

SEQ ID NO: 3454410 - RNA, 17 nt, Human
uagcacauaaacuuugg

SEQ ID NO: 3454411 - RNA, 16 nt, Human
uagcacaugcuucaau

SEQ ID NO: 3454412 - RNA, 14 nt, Human
uagcacucacaugc

SEQ ID NO: 3454413 - RNA, 15 nt, Human
uagcacucacaugcu

SEQ ID NO: 3454414 - RNA, 16 nt, Human
uagcacuguugaugua

SEQ ID NO: 3454415 - RNA, 17 nt, Human
uagcacuguugauguau

SEQ ID NO: 3454416 - RNA, 19 nt, Human
uagcacuguugauguaucu

SEQ ID NO: 3454417 - RNA, 23 nt, Human
uagcacuguugauguaucugagu

SEQ ID NO: 3454418 - RNA, 20 nt, Human
uagcacuuucauugccagug

SEQ ID NO: 3454419 - RNA, 14 nt, Human
uagcacuuugaaau

SEQ ID NO: 3454420 - RNA, 15 nt, Human
uagcacuuugaaaua

SEQ ID NO: 3454421 - RNA, 16 nt, Human
uagcacuuugggaggc

SEQ ID NO: 3454422 - RNA, 16 nt, Human
uagcagaagaaaggaa

SEQ ID NO: 3454423 - RNA, 19 nt, Human
gcccaguguuguuuguaaa

SEQ ID NO: 3454424 - RNA, 15 nt, Human
gcccaguugggugga

SEQ ID NO: 3454425 - RNA, 19 nt, Human
gcccaguuggguggaugcc

SEQ ID NO: 3454426 - RNA, 21 nt, Human
gcccaguuggguggaugccug

SEQ ID NO: 3454427 - RNA, 16 nt, Human
gcccaguuucagggcu

SEQ ID NO: 3454428 - RNA, 17 nt, Human
gcccaguuucagggcua

SEQ ID NO: 3454429 - RNA, 15 nt, Human
gcccaguuucugccu

SEQ ID NO: 3454430 - RNA, 14 nt, Human
gcccauacucagcc

SEQ ID NO: 3454431 - RNA, 17 nt, Human
gcccauacucagccugc

SEQ ID NO: 3454432 - RNA, 20 nt, Human
gcccauaugcuaccaccagc

SEQ ID NO: 3454433 - RNA, 21 nt, Human
gcccauaugcuaccaccagcu

SEQ ID NO: 3454434 - RNA, 17 nt, Human
gcccaucacaggguugg

SEQ ID NO: 3454435 - RNA, 22 nt, Human
gcccaucacaggguugggccca

SEQ ID NO: 3454436 - RNA, 20 nt, Human
gcccauccauuaggccagca

SEQ ID NO: 3454437 - RNA, 22 nt, Human
gcccauccauuaggccagcaac

SEQ ID NO: 3454438 - RNA, 15 nt, Human
gcccauccccccuca

SEQ ID NO: 3454439 - RNA, 16 nt, Human
gcccauccccccucac

SEQ ID NO: 3454440 - RNA, 17 nt, Human
gcccauccccccucacc

SEQ ID NO: 3454441 - RNA, 18 nt, Human
gcccauccccccucacca

SEQ ID NO: 3454442 - RNA, 16 nt, Human
gcccaucccugccugg

SEQ ID NO: 3454443 - RNA, 21 nt, Human
gcccaucccuggaaggugcug

SEQ ID NO: 3454444 - RNA, 16 nt, Human
gcccauccugaccagc

SEQ ID NO: 3454445 - RNA, 15 nt, Human
gcccauccugacuga

SEQ ID NO: 3454446 - RNA, 18 nt, Human
gcccauccugucuguuca

SEQ ID NO: 3454447 - RNA, 22 nt, Human
gcccaucuaugucccuugcugu

SEQ ID NO: 3454448 - RNA, 14 nt, Human
gcccaucucccugc

SEQ ID NO: 3454449 - RNA, 23 nt, Human
gcccaucucggagcaucccggag

SEQ ID NO: 3454450 - RNA, 21 nt, Human
gcccaucuugccuccauggug

SEQ ID NO: 3454451 - RNA, 18 nt, Human
gcccaugauauaacuuua

SEQ ID NO: 3454452 - RNA, 17 nt, Human
gcccaugcacuggggac

SEQ ID NO: 3454453 - RNA, 20 nt, Human
gcccauggacaggcuggcuc

SEQ ID NO: 3454454 - RNA, 22 nt, Human
gcccauggagauugaccuggau

SEQ ID NO: 3454455 - RNA, 14 nt, Human
gcccaugggaggga

SEQ ID NO: 3454456 - RNA, 15 nt, Human
gcccaugggagggag

SEQ ID NO: 3454457 - RNA, 16 nt, Human
gcccaugggcacugcu

SEQ ID NO: 3454458 - RNA, 17 nt, Human
gcccaugggcacugcug

SEQ ID NO: 3454459 - RNA, 19 nt, Human
gcccaugggcacugcuggg

SEQ ID NO: 3454460 - RNA, 17 nt, Human
gcccauguauggccagg

SEQ ID NO: 3454461 - RNA, 19 nt, Human
gcccauguggagucagccu

SEQ ID NO: 3454462 - RNA, 19 nt, Human
uaguauuuuuuguauaauu

SEQ ID NO: 3454463 - RNA, 18 nt, Human
uagucaaaccauaaacuu

SEQ ID NO: 3454464 - RNA, 16 nt, Human
uagucaaauuauguau

SEQ ID NO: 3454465 - RNA, 18 nt, Human
uagucaaauugugugaaa

SEQ ID NO: 3454466 - RNA, 23 nt, Human
uagucaacaguacccugguugug

SEQ ID NO: 3454467 - RNA, 13 nt, Human
uagucaagcuccu

SEQ ID NO: 3454468 - RNA, 15 nt, Human
uagucaaucaagucu

SEQ ID NO: 3454469 - RNA, 19 nt, Human
uagucaaucaagucuguuu

SEQ ID NO: 3454470 - RNA, 18 nt, Human
uagucaauggcuuguuca

SEQ ID NO: 3454471 - RNA, 20 nt, Human
uagucaccuuuuaaauccug

SEQ ID NO: 3454472 - RNA, 20 nt, Human
uagucacugagacagcccgg

SEQ ID NO: 3454473 - RNA, 20 nt, Human
uaugcauggaaaccugaaaa

SEQ ID NO: 3454474 - RNA, 23 nt, Human
uaugcauggugccccaggaccag

SEQ ID NO: 3454475 - RNA, 17 nt, Human
uaugcaugguuucagca

SEQ ID NO: 3454476 - RNA, 18 nt, Human
uaugcaugguuucagcac

SEQ ID NO: 3454477 - RNA, 19 nt, Human
uaugcaugguuucagcacu

SEQ ID NO: 3454478 - RNA, 20 nt, Human
uaugcaugguuucagcacua

SEQ ID NO: 3454479 - RNA, 15 nt, Human
uaugcaugugaagaa

SEQ ID NO: 3454480 - RNA, 22 nt, Human
uaugcauguugucuaagaaauu

SEQ ID NO: 3454481 - RNA, 14 nt, Human
uaugcauuauauca

SEQ ID NO: 3454482 - RNA, 17 nt, Human
uaugcauuauuaaauug

SEQ ID NO: 3454483 - RNA, 12 nt, Human
uaugcauucaca

SEQ ID NO: 3454484 - RNA, 23 nt, Human
uaugcauuugaaaauuuugaugu

SEQ ID NO: 3454485 - RNA, 17 nt, Human
uaugccaaagaucacuu

SEQ ID NO: 3454486 - RNA, 19 nt, Human
uaugccacccccgcuggag

SEQ ID NO: 3454487 - RNA, 20 nt, Human
uaugccaccugaauaaagaa

SEQ ID NO: 3454488 - RNA, 22 nt, Human
uaugccacgggaaguuuagaga

SEQ ID NO: 3454489 - RNA, 22 nt, Human
uaugccauagcaagauugcuua

SEQ ID NO: 3454490 - RNA, 17 nt, Human
uaugccauauaauucac

SEQ ID NO: 3454491 - RNA, 14 nt, Human
uaugccaugaugga

SEQ ID NO: 3454492 - RNA, 19 nt, Human
uaugccauugggguaguug

SEQ ID NO: 3454493 - RNA, 23 nt, Human
uaugccauuuguuuauuuuuaua

SEQ ID NO: 3454494 - RNA, 18 nt, Human
uaugcccaguuucugccu

SEQ ID NO: 3454495 - RNA, 19 nt, Human
uaugccccaccaaggcuga

SEQ ID NO: 3454496 - RNA, 15 nt, Human
uaugccccauucaac

SEQ ID NO: 3454497 - RNA, 16 nt, Human
uaugccggaugugcuu

SEQ ID NO: 3454498 - RNA, 22 nt, Human
uaugccguuacuuuucauauuu

SEQ ID NO: 3454499 - RNA, 14 nt, Human
uaugccucuccuuu

SEQ ID NO: 3454500 - RNA, 18 nt, Human
uaugccugcuauuugaag

SEQ ID NO: 3454501 - RNA, 16 nt, Human
uaugccugcucuuugg

SEQ ID NO: 3454502 - RNA, 16 nt, Human
uaugccuuuaaaucug

SEQ ID NO: 3454503 - RNA, 16 nt, Human
uaugcuaagaauuuuu

SEQ ID NO: 3454504 - RNA, 15 nt, Human
uaugcuaccaccagc

SEQ ID NO: 3454505 - RNA, 18 nt, Human
uaugcuaccaccagcugu

SEQ ID NO: 3454506 - RNA, 16 nt, Human
uaugcuacuacaaaaa

SEQ ID NO: 3454507 - RNA, 14 nt, Human
uaugcuauuucuau

SEQ ID NO: 3454508 - RNA, 19 nt, Human
uaugcucucgcaccuuucc

SEQ ID NO: 3454509 - RNA, 18 nt, Human
uaugcucugcauguuaca

SEQ ID NO: 3454510 - RNA, 16 nt, Human
uaugcucuuaauugcc

SEQ ID NO: 3454511 - RNA, 17 nt, Human
uaugcucuuaauugcca

SEQ ID NO: 3454512 - RNA, 18 nt, Human
uaugcucuuaauugccac

SEQ ID NO: 3454513 - RNA, 20 nt, Human
uaugcugccaaauuuuggcc

SEQ ID NO: 3454514 - RNA, 22 nt, Human
uaugcugccaaauuuuggccaa

SEQ ID NO: 3454515 - RNA, 22 nt, Human
uaugcuggaagucucaaauaau

SEQ ID NO: 3454516 - RNA, 15 nt, Human
uaugcuuacugauau

SEQ ID NO: 3454517 - RNA, 16 nt, Human
uaugcuuacugauaua

SEQ ID NO: 3454518 - RNA, 22 nt, Human
uaugcuuauacacuuacacuuu

SEQ ID NO: 3454519 - RNA, 20 nt, Human
uaugcuuauauuguucacuu

SEQ ID NO: 3454520 - RNA, 16 nt, Human
uaugcuugcaaaaacu

SEQ ID NO: 3454521 - RNA, 19 nt, Human
uaugcuugcauauauuuca

SEQ ID NO: 3454522 - RNA, 18 nt, Human
uaugcuuguaacuaaaau

SEQ ID NO: 3454523 - RNA, 14 nt, Human
uaugcuuuccuucu

SEQ ID NO: 3454524 - RNA, 12 nt, Human
uaugcuuugaau

SEQ ID NO: 3454525 - RNA, 14 nt, Human
uaugcuuuucucaa

SEQ ID NO: 3454526 - RNA, 15 nt, Human
uauggaaaacugugu

SEQ ID NO: 3454527 - RNA, 14 nt, Human
uauggaaacccgag

SEQ ID NO: 3454528 - RNA, 21 nt, Human
uauggaaacuguugccagaga

SEQ ID NO: 3454529 - RNA, 16 nt, Human
uauggaaauaaaugua

SEQ ID NO: 3454530 - RNA, 13 nt, Human
uauggaaauauau

SEQ ID NO: 3454531 - RNA, 16 nt, Human
uauggaaaugcaaacu

SEQ ID NO: 3454532 - RNA, 15 nt, Human
uauggaacuucuaau

SEQ ID NO: 3454533 - RNA, 20 nt, Human
uauggaacuucuaauauauu

SEQ ID NO: 3454534 - RNA, 13 nt, Human
uauggaagaaagu

SEQ ID NO: 3454535 - RNA, 16 nt, Human
uauggaagcacccauu

SEQ ID NO: 3454536 - RNA, 16 nt, Human
uauggaagguggagcg

SEQ ID NO: 3454537 - RNA, 19 nt, Human
uauggaagguggagcguuc

SEQ ID NO: 3454538 - RNA, 24 nt, Human
uauggaauacaguguuauuuucuu

SEQ ID NO: 3454539 - RNA, 15 nt, Human
uauggaauuuugcaa

SEQ ID NO: 3454540 - RNA, 21 nt, Human
uauggacggugcuccaggcag

SEQ ID NO: 3454541 - RNA, 15 nt, Human
uauggacucugcaca

SEQ ID NO: 3454542 - RNA, 18 nt, Human
uauggagaauugcugaag

SEQ ID NO: 3454543 - RNA, 16 nt, Human
uauggagagcccuggg

SEQ ID NO: 3454544 - RNA, 18 nt, Human
uauggagcccuguaauuu

SEQ ID NO: 3454545 - RNA, 18 nt, Human
uauggagcucagagaggg

SEQ ID NO: 3454546 - RNA, 16 nt, Human
uauggagucauuuuua

SEQ ID NO: 3454547 - RNA, 22 nt, Human
uauggagucauuuuuacaaugu

SEQ ID NO: 3454548 - RNA, 18 nt, Human
uauggaugauuuaagugu

SEQ ID NO: 3454549 - RNA, 11 nt, Human
uauggaugugg

SEQ ID NO: 3454550 - RNA, 15 nt, Human
uauggauguuacucu

SEQ ID NO: 3454551 - RNA, 23 nt, Human
uauggauugggggggccaaaagg

SEQ ID NO: 3454552 - RNA, 15 nt, Human
uauggauuuucuaag

SEQ ID NO: 3454553 - RNA, 21 nt, Human
uauggauuuucuauuguuacu

SEQ ID NO: 3454554 - RNA, 20 nt, Human
uauggcaaccauuauaaccu

SEQ ID NO: 3454555 - RNA, 22 nt, Human
uauggcagaaaaaaugucugua

SEQ ID NO: 3454556 - RNA, 12 nt, Human
uauggcagaaga

SEQ ID NO: 3454557 - RNA, 13 nt, Human
uauggcagaagac

SEQ ID NO: 3454558 - RNA, 19 nt, Human
uauggcagaguuguaaaua

SEQ ID NO: 3454559 - RNA, 23 nt, Human
uauggccaggaaguagcacaggc

SEQ ID NO: 3454560 - RNA, 16 nt, Human
uauggccgggcagggu

SEQ ID NO: 3454561 - RNA, 22 nt, Human
uauggccugugagcuaggaauu

SEQ ID NO: 3454562 - RNA, 18 nt, Human
uauggcguaaguacagag

SEQ ID NO: 3454563 - RNA, 17 nt, Human
uauggcuagaauauccu

SEQ ID NO: 3454564 - RNA, 16 nt, Human
uauggcuauaggugcu

SEQ ID NO: 3454565 - RNA, 16 nt, Human
uauggcugcaguccuc

SEQ ID NO: 3454566 - RNA, 17 nt, Human
uauggcuggccacugca

SEQ ID NO: 3454567 - RNA, 16 nt, Human
uaugggaaucaagauu

SEQ ID NO: 3454568 - RNA, 10 nt, Human
uaugggagag

SEQ ID NO: 3454569 - RNA, 17 nt, Human
uaugggcauuguaguua

SEQ ID NO: 3454570 - RNA, 23 nt, Human
uaugggcuuuuggggagccagaa

SEQ ID NO: 3454571 - RNA, 18 nt, Human
uauggggauagaugugug

SEQ ID NO: 3454572 - RNA, 19 nt, Human
uauggggauagaugugugg

SEQ ID NO: 3454573 - RNA, 17 nt, Human
uauggggaugguaguuu

SEQ ID NO: 3454574 - RNA, 20 nt, Human
uauggggcugaacggggaga

SEQ ID NO: 3454575 - RNA, 19 nt, Human
uauggggggccaacaccag

SEQ ID NO: 3454576 - RNA, 23 nt, Human
uauggggggccaacaccagggau

SEQ ID NO: 3454577 - RNA, 13 nt, Human
uaugggucacagg

SEQ ID NO: 3454578 - RNA, 14 nt, Human
uaugggucacagga

SEQ ID NO: 3454579 - RNA, 15 nt, Human
uaugggucacaggaa

SEQ ID NO: 3454580 - RNA, 19 nt, Human
uaugguaacugcuuucugu

SEQ ID NO: 3454581 - RNA, 16 nt, Human
uaugguaaucauauua

SEQ ID NO: 3454582 - RNA, 17 nt, Human
uaugguaccagaugcag

SEQ ID NO: 3454583 - RNA, 18 nt, Human
uaugguagaaaaauuuca

SEQ ID NO: 3454584 - RNA, 19 nt, Human
uaugguagaaaaauuucac

SEQ ID NO: 3454585 - RNA, 21 nt, Human
uaugguauuuauuuuuucuuu

SEQ ID NO: 3454586 - RNA, 21 nt, Human
uauggucaaucccaaaaguca

SEQ ID NO: 3454587 - RNA, 20 nt, Human
uauggugagaugcagcugga

SEQ ID NO: 3454588 - RNA, 18 nt, Human
uauggugccuaguauuga

SEQ ID NO: 3454589 - RNA, 23 nt, Human
uauggugcucugucuacuugcuc

SEQ ID NO: 3454590 - RNA, 20 nt, Human
uaugguugauaguuuaccug

SEQ ID NO: 3454591 - RNA, 15 nt, Human
uauguaaaacauuua

SEQ ID NO: 3454592 - RNA, 22 nt, Human
uauguaaaaggccaaaccucug

SEQ ID NO: 3454593 - RNA, 15 nt, Human
uauguaaaauguuuu

SEQ ID NO: 3454594 - RNA, 16 nt, Human
uauguaaacaaaucuu

SEQ ID NO: 3454595 - RNA, 17 nt, Human
uauguaaacaaaucuuu

SEQ ID NO: 3454596 - RNA, 23 nt, Human
uauguaaacaaaucuuuccauau

SEQ ID NO: 3454597 - RNA, 23 nt, Human
uauguaaacugcauuagaaauua

SEQ ID NO: 3454598 - RNA, 14 nt, Human
uauguaaaguaugu

SEQ ID NO: 3454599 - RNA, 18 nt, Human
uauguaaaguauguaaac

SEQ ID NO: 3454600 - RNA, 19 nt, Human
uauguaaaguauguaaaca

SEQ ID NO: 3454601 - RNA, 13 nt, Human
uauguaaauaauu

SEQ ID NO: 3454602 - RNA, 14 nt, Human
uauguaaauaauuc

SEQ ID NO: 3454603 - RNA, 17 nt, Human
uauguaaauaauucuuu

SEQ ID NO: 3454604 - RNA, 21 nt, Human
uauguaaaucccauuauucaa

SEQ ID NO: 3454605 - RNA, 13 nt, Human
uauguaaauguau

SEQ ID NO: 3454606 - RNA, 14 nt, Human
uauuaaaaauauaa

SEQ ID NO: 3454607 - RNA, 15 nt, Human
uauuaaaaauauaaa

SEQ ID NO: 3454608 - RNA, 12 nt, Human
uauuaaaaaugg

SEQ ID NO: 3454609 - RNA, 14 nt, Human
uauuaaaaauggua

SEQ ID NO: 3454610 - RNA, 15 nt, Human
uauuaaaaaugguaa

SEQ ID NO: 3454611 - RNA, 20 nt, Human
uauuaaaaaugguaaaauug

SEQ ID NO: 3454612 - RNA, 14 nt, Human
uauuaaaacuaaau

SEQ ID NO: 3454613 - RNA, 12 nt, Human
uauuaaaacuca

SEQ ID NO: 3454614 - RNA, 15 nt, Human
uauuaaaacucuuuu

SEQ ID NO: 3454615 - RNA, 14 nt, Human
uauuaaaagacuca

SEQ ID NO: 3454616 - RNA, 22 nt, Human
uauuaaaauauggcuauaaaua

SEQ ID NO: 3454617 - RNA, 10 nt, Human
uauuaaaauc

SEQ ID NO: 3454618 - RNA, 18 nt, Human
uauuaaaaugauuguaaa

SEQ ID NO: 3454619 - RNA, 12 nt, Human
uauuaaaaugua

SEQ ID NO: 3454620 - RNA, 16 nt, Human
uauuaaaauguaugca

SEQ ID NO: 3454621 - RNA, 20 nt, Human
uauuaaaccauaagauggca

SEQ ID NO: 3454622 - RNA, 21 nt, Human
uauuaaacguaugcaugugaa

SEQ ID NO: 3454623 - RNA, 21 nt, Human
uauuaaagaaaaaaauguauu

SEQ ID NO: 3454624 - RNA, 13 nt, Human
uauuaaagccaug

SEQ ID NO: 3454625 - RNA, 14 nt, Human
uauuaaagugcuaa

SEQ ID NO: 3454626 - RNA, 18 nt, Human
uauuaaagugcuaagguu

SEQ ID NO: 3454627 - RNA, 24 nt, Human
uauuaaagugcuaagguucuaagg

SEQ ID NO: 3454628 - RNA, 14 nt, Human
uauuaaauaaaauc

SEQ ID NO: 3454629 - RNA, 18 nt, Human
uauuaaauacaaaacuuc

SEQ ID NO: 3454630 - RNA, 12 nt, Human
uauuaaaugcca

SEQ ID NO: 3454631 - RNA, 15 nt, Human
uauuaaaugcccagc

SEQ ID NO: 3454632 - RNA, 17 nt, Human
uauuaaaugcccagccc

SEQ ID NO: 3454633 - RNA, 23 nt, Human
uauuaaaugcuucauuuguaugu

SEQ ID NO: 3454634 - RNA, 14 nt, Human
uauuaaauuacauu

SEQ ID NO: 3454635 - RNA, 22 nt, Human
uauuaaauuacauuuguaauuu

SEQ ID NO: 3454636 - RNA, 16 nt, Human
uauuaacaaauuaugu

SEQ ID NO: 3454637 - RNA, 18 nt, Human
uauuaacaaauuauguua

SEQ ID NO: 3454638 - RNA, 20 nt, Human
uaguucccucugcucagcca

SEQ ID NO: 3454639 - RNA, 19 nt, Human
uaguuccuaagaagcuucu

SEQ ID NO: 3454640 - RNA, 21 nt, Human
uaguuccuaagaagcuucuaa

SEQ ID NO: 3454641 - RNA, 12 nt, Human
uaguuccugcua

SEQ ID NO: 3454642 - RNA, 16 nt, Human
uaguuccugcuacaac

SEQ ID NO: 3454643 - RNA, 17 nt, Human
uaguuccugugcacagc

SEQ ID NO: 3454644 - RNA, 15 nt, Human
uaguucuaagacuca

SEQ ID NO: 3454645 - RNA, 13 nt, Human
uaguucuagaaaa

SEQ ID NO: 3454646 - RNA, 23 nt, Human
uaguucuagacauggagguucua

SEQ ID NO: 3454647 - RNA, 23 nt, Human
uaguucuagugcagcugaaauug

SEQ ID NO: 3454648 - RNA, 19 nt, Human
uaguucucagcucuucuga

SEQ ID NO: 3454649 - RNA, 13 nt, Human
uaguucugccagg

SEQ ID NO: 3454650 - RNA, 13 nt, Human
uaguucuguagaa

SEQ ID NO: 3454651 - RNA, 14 nt, Human
uaguucuguauuug

SEQ ID NO: 3454652 - RNA, 16 nt, Human
uaguucuguauuugaa

SEQ ID NO: 3454653 - RNA, 19 nt, Human
uaguucuguauuugaaagu

SEQ ID NO: 3454654 - RNA, 15 nt, Human
uaguucuuuaaacug

SEQ ID NO: 3454655 - RNA, 20 nt, Human
uaguucuuuaaacugucgug

SEQ ID NO: 3454656 - RNA, 17 nt, Human
uaguugaaaauaaagug

SEQ ID NO: 3454657 - RNA, 17 nt, Human
uaguugaaccuauuucu

SEQ ID NO: 3454658 - RNA, 14 nt, Human
uaguugaacugaua

SEQ ID NO: 3454659 - RNA, 18 nt, Human
uaguugaacugauaguua

SEQ ID NO: 3454660 - RNA, 22 nt, Human
uaguugaauuuuuuuuaacauu

SEQ ID NO: 3454661 - RNA, 23 nt, Human
uaguugaauuuuuuuuaacauuc

SEQ ID NO: 3454662 - RNA, 16 nt, Human
uaguugagccagcaga

SEQ ID NO: 3454663 - RNA, 19 nt, Human
uaguugagccagcagacau

SEQ ID NO: 3454664 - RNA, 16 nt, Human
uaguugcaauugaauu

SEQ ID NO: 3454665 - RNA, 23 nt, Human
uaguugcagacucaguuugucag

SEQ ID NO: 3454666 - RNA, 21 nt, Human
uaguugccaaaucuggcuccu

SEQ ID NO: 3454667 - RNA, 17 nt, Human
uaguugcguuacacccu

SEQ ID NO: 3454668 - RNA, 13 nt, Human
uaguugcuugccu

SEQ ID NO: 3454669 - RNA, 17 nt, Human
uaguugcuuuugaagga

SEQ ID NO: 3454670 - RNA, 21 nt, Human
uaguugcuuuugaaggaauac

SEQ ID NO: 3454671 - RNA, 18 nt, Human
uaguuggcagaaauacag

SEQ ID NO: 3454672 - RNA, 15 nt, Human
uaguuggugagaaac

SEQ ID NO: 3454673 - RNA, 20 nt, Human
uaguuguagacaaaguacau

SEQ ID NO: 3454674 - RNA, 17 nt, Human
uaguugucuuuccuggc

SEQ ID NO: 3454675 - RNA, 22 nt, Human
uaguugugaccuuaguguuucu

SEQ ID NO: 3454676 - RNA, 17 nt, Human
uaguugugggugggaga

SEQ ID NO: 3454677 - RNA, 17 nt, Human
uaguuguuguagagaaa

SEQ ID NO: 3454678 - RNA, 17 nt, Human
uaguuuaccucuuuaaa

SEQ ID NO: 3454679 - RNA, 22 nt, Human
uaguuuaccugaauaaauggua

SEQ ID NO: 3454680 - RNA, 22 nt, Human
uaguuuagugugguuuucuguu

SEQ ID NO: 3454681 - RNA, 17 nt, Human
uaguuuauuuuaaaaca

SEQ ID NO: 3454682 - RNA, 21 nt, Human
uaguuucaguagauugcagaa

SEQ ID NO: 3454683 - RNA, 20 nt, Human
uaguuucauauaaaguauca

SEQ ID NO: 3454684 - RNA, 14 nt, Human
uaguuucugugguu

SEQ ID NO: 3454685 - RNA, 17 nt, Human
uaguuucuguucugugg

SEQ ID NO: 3454686 - RNA, 20 nt, Human
uaguuucuguucuguggaaa

SEQ ID NO: 3454687 - RNA, 13 nt, Human
uaguuugaggaaa

SEQ ID NO: 3454688 - RNA, 15 nt, Human
uaguuugauuaaauu

SEQ ID NO: 3454689 - RNA, 11 nt, Human
uaguuugcauu

SEQ ID NO: 3454690 - RNA, 15 nt, Human
uaguuugcauuuaag

SEQ ID NO: 3454691 - RNA, 13 nt, Human
uaguuugcauuuc

SEQ ID NO: 3454692 - RNA, 16 nt, Human
uaguuugcauuucaga

SEQ ID NO: 3454693 - RNA, 13 nt, Human
uaguuugguucac

SEQ ID NO: 3454694 - RNA, 17 nt, Human
uaguuuguauaacuucu

SEQ ID NO: 3454695 - RNA, 18 nt, Human
uaguuugucuauuuuaaa

SEQ ID NO: 3454696 - RNA, 22 nt, Human
uaguuugucuauuuuaaaauaa

SEQ ID NO: 3454697 - RNA, 13 nt, Human
uaguuugugagaa

SEQ ID NO: 3454698 - RNA, 19 nt, Human
uaguuuguguguugucucu

SEQ ID NO: 3454699 - RNA, 16 nt, Human
uaguuuuaaacucauu

SEQ ID NO: 3454700 - RNA, 19 nt, Human
uaguuuuacccuauaucua

SEQ ID NO: 3454701 - RNA, 20 nt, Human
uaguuuuacuuuuaaacugu

SEQ ID NO: 3454702 - RNA, 22 nt, Human
uaguuuuacuuuuaaacugugu

SEQ ID NO: 3454703 - RNA, 14 nt, Human
uaguuuuaguugca

SEQ ID NO: 3454704 - RNA, 16 nt, Human
uaguuuuaguugcaga

SEQ ID NO: 3454705 - RNA, 20 nt, Human
uaguuuuaucacauguaugu

SEQ ID NO: 3454706 - RNA, 13 nt, Human
uaguuuuauucuu

SEQ ID NO: 3454707 - RNA, 21 nt, Human
uaguuuuauuuauauuuauug

SEQ ID NO: 3454708 - RNA, 22 nt, Human
uaguuuuauuuauauuuauuga

SEQ ID NO: 3454709 - RNA, 15 nt, Human
uaguuuuauuuucua

SEQ ID NO: 3454710 - RNA, 19 nt, Human
uaguuuuauuuucuaaagu

SEQ ID NO: 3454711 - RNA, 19 nt, Human
uaguuuucuuguugcuuug

SEQ ID NO: 3454712 - RNA, 12 nt, Human
uaguuuugcaua

SEQ ID NO: 3454713 - RNA, 13 nt, Human
uaguuuugcuuuu

SEQ ID NO: 3454714 - RNA, 13 nt, Human
uaguuuugucaaa

SEQ ID NO: 3454715 - RNA, 18 nt, Human
uaguuuugucacaauuau

SEQ ID NO: 3454716 - RNA, 21 nt, Human
uaguuuuuaaaauaucuuuug

SEQ ID NO: 3454717 - RNA, 22 nt, Human
uaguuuuuaaaauaucuuuuga

SEQ ID NO: 3454718 - RNA, 21 nt, Human
uaguuuuuccuaucauguuaa

SEQ ID NO: 3454719 - RNA, 13 nt, Human
uaguuuuuguucu

SEQ ID NO: 3454720 - RNA, 13 nt, Human
uaguuuuuucauc

SEQ ID NO: 3454721 - RNA, 14 nt, Human
uaguuuuuucaucu

SEQ ID NO: 3454722 - RNA, 15 nt, Human
uaguuuuuucaucuu

SEQ ID NO: 3454723 - RNA, 20 nt, Human
uaguuuuuucuuccuuuuca

SEQ ID NO: 3454724 - RNA, 15 nt, Human
uauaaaaaaaaugaa

SEQ ID NO: 3454725 - RNA, 16 nt, Human
uauaaaaaaaaugaaa

SEQ ID NO: 3454726 - RNA, 15 nt, Human
uauaaaaaauaugua

SEQ ID NO: 3454727 - RNA, 13 nt, Human
uauaaaaacaaaa

SEQ ID NO: 3454728 - RNA, 21 nt, Human
uauaaaaagaaaagauaaaga

SEQ ID NO: 3454729 - RNA, 14 nt, Human
uauaaaaagauaau

SEQ ID NO: 3454730 - RNA, 12 nt, Human
uauaaaaagcca

SEQ ID NO: 3454731 - RNA, 14 nt, Human
uauaaaaagccacu

SEQ ID NO: 3454732 - RNA, 22 nt, Human
uauaaaaauaaaaaagauccca

SEQ ID NO: 3454733 - RNA, 13 nt, Human
uauaaaaauauau

SEQ ID NO: 3454734 - RNA, 14 nt, Human
uauaaaaauggcuu

SEQ ID NO: 3454735 - RNA, 10 nt, Human
uauaaaacaa

SEQ ID NO: 3454736 - RNA, 21 nt, Human
uauaaaagauggggucuguaa

SEQ ID NO: 3454737 - RNA, 15 nt, Human
uauaaaagcuuucug

SEQ ID NO: 3454738 - RNA, 19 nt, Human
uauaaaaggcaaaugugua

SEQ ID NO: 3454739 - RNA, 13 nt, Human
uauaaaagugauu

SEQ ID NO: 3454740 - RNA, 15 nt, Human
uauaaaauaaauaua

SEQ ID NO: 3454741 - RNA, 16 nt, Human
uauaaaauaaauauau

SEQ ID NO: 3454742 - RNA, 17 nt, Human
uauaaaauaaauauaua

SEQ ID NO: 3454743 - RNA, 22 nt, Human
uauaaaauaaauauauauaaac

SEQ ID NO: 3454744 - RNA, 12 nt, Human
uauaaaauaacu

SEQ ID NO: 3454745 - RNA, 12 nt, Human
uauaaaauaaug

SEQ ID NO: 3454746 - RNA, 22 nt, Human
uauaaaauaauuuuuauauuug

SEQ ID NO: 3454747 - RNA, 19 nt, Human
uauaaaauagacaaauaga

SEQ ID NO: 3454748 - RNA, 19 nt, Human
uauaaaauauaaacaaaga

SEQ ID NO: 3454749 - RNA, 17 nt, Human
uauaaaaucagccaauu

SEQ ID NO: 3454750 - RNA, 19 nt, Human
uauaaaaucagccaauuau

SEQ ID NO: 3454751 - RNA, 21 nt, Human
uauaaaauccugugcaauaga

SEQ ID NO: 3454752 - RNA, 12 nt, Human
gccgucucugga

SEQ ID NO: 3454753 - RNA, 15 nt, Human
gccgugaacugugca

SEQ ID NO: 3454754 - RNA, 20 nt, Human
gccgugaguucucagggcuc

SEQ ID NO: 3454755 - RNA, 21 nt, Human
gccgugaguucucagggcucc

SEQ ID NO: 3454756 - RNA, 12 nt, Human
gccgugcccagg

SEQ ID NO: 3454757 - RNA, 14 nt, Human
gccgugcccagggg

SEQ ID NO: 3454758 - RNA, 19 nt, Human
gccgugccuucagcucuac

SEQ ID NO: 3454759 - RNA, 17 nt, Human
gccgugcucgccccagc

SEQ ID NO: 3454760 - RNA, 20 nt, Human
gccgugcucgccccagcagg

SEQ ID NO: 3454761 - RNA, 15 nt, Human
gccgugcugggcagc

SEQ ID NO: 3454762 - RNA, 16 nt, Human
gccgugcugggcagcc

SEQ ID NO: 3454763 - RNA, 17 nt, Human
gccgugcugggcagccc

SEQ ID NO: 3454764 - RNA, 13 nt, Human
gccguggauggcc

SEQ ID NO: 3454765 - RNA, 14 nt, Human
gccguggcugcggc

SEQ ID NO: 3454766 - RNA, 15 nt, Human
gccguggcugcggca

SEQ ID NO: 3454767 - RNA, 16 nt, Human
gccguggcugcugugg

SEQ ID NO: 3454768 - RNA, 13 nt, Human
gccguggcuuccc

SEQ ID NO: 3454769 - RNA, 19 nt, Human
gccguggcuucccgcucag

SEQ ID NO: 3454770 - RNA, 21 nt, Human
gccguggcuucccgcucagcc

SEQ ID NO: 3454771 - RNA, 17 nt, Human
gccgugggccccacccu

SEQ ID NO: 3454772 - RNA, 23 nt, Human
gccgugggccccacccucgggga

SEQ ID NO: 3454773 - RNA, 15 nt, Human
gccgugggccugggg

SEQ ID NO: 3454774 - RNA, 16 nt, Human
gccgugguccuuuggg

SEQ ID NO: 3454775 - RNA, 20 nt, Human
gccguguaaccauggaccca

SEQ ID NO: 3454776 - RNA, 23 nt, Human
gccgugugagugugacagggcca

SEQ ID NO: 3454777 - RNA, 14 nt, Human
gccguuacucucca

SEQ ID NO: 3454778 - RNA, 15 nt, Human
gccguuacucuccaa

SEQ ID NO: 3454779 - RNA, 17 nt, Human
gccguugauguuggcug

SEQ ID NO: 3454780 - RNA, 20 nt, Human
gccguugauguuggcuggga

SEQ ID NO: 3454781 - RNA, 18 nt, Human
gccguugccgcugauguu

SEQ ID NO: 3454782 - RNA, 17 nt, Human
gccguugcugacuuaga

SEQ ID NO: 3454783 - RNA, 19 nt, Human
gccguugcugacuuagaau

SEQ ID NO: 3454784 - RNA, 14 nt, Human
gccguuggccacgu

SEQ ID NO: 3454785 - RNA, 16 nt, Human
gccuaaaaguaaacau

SEQ ID NO: 3454786 - RNA, 12 nt, Human
gccuaaaaucuu

SEQ ID NO: 3454787 - RNA, 13 nt, Human
gccuaaaaucuug

SEQ ID NO: 3454788 - RNA, 11 nt, Human
gccuaaaucca

SEQ ID NO: 3454789 - RNA, 12 nt, Human
gccuaaauccau

SEQ ID NO: 3454790 - RNA, 19 nt, Human
gccuaaauccauuuggaaa

SEQ ID NO: 3454791 - RNA, 21 nt, Human
gccuaaauccauuuggaaauc

SEQ ID NO: 3454792 - RNA, 19 nt, Human
gccuaaauuuaaugcugcc

SEQ ID NO: 3454793 - RNA, 17 nt, Human
gccuaaccugccgagag

SEQ ID NO: 3454794 - RNA, 18 nt, Human
gccuaacuacuaguuuuu

SEQ ID NO: 3454795 - RNA, 18 nt, Human
gccuaagaauaaacauuu

SEQ ID NO: 3454796 - RNA, 21 nt, Human
gccuaagaggcugcccuccug

SEQ ID NO: 3454797 - RNA, 21 nt, Human
gccuaagauauacuuguuuuu

SEQ ID NO: 3454798 - RNA, 21 nt, Human
gccuaagcauugccuggccuu

SEQ ID NO: 3454799 - RNA, 14 nt, Human
gccuaaguauuaaa

SEQ ID NO: 3454800 - RNA, 18 nt, Human
gccuaaguauuaaaacau

SEQ ID NO: 3454801 - RNA, 17 nt, Human
gccuaagugcagccccg

SEQ ID NO: 3454802 - RNA, 12 nt, Human
gccuaauaaaac

SEQ ID NO: 3454803 - RNA, 13 nt, Human
gccuaauaaaacu

SEQ ID NO: 3454804 - RNA, 16 nt, Human
gccuaauaaaacugau

SEQ ID NO: 3454805 - RNA, 17 nt, Human
gccuaauaaaacugaug

SEQ ID NO: 3454806 - RNA, 19 nt, Human
gccuaauaaaacugaugug

SEQ ID NO: 3454807 - RNA, 23 nt, Human
gccuaauaaaacugaugugaaac

SEQ ID NO: 3454808 - RNA, 17 nt, Human
gccuaauacauuaaagc

SEQ ID NO: 3454809 - RNA, 18 nt, Human
gccuaauacauuaaagca

SEQ ID NO: 3454810 - RNA, 18 nt, Human
gccuaauaugaugacugu

SEQ ID NO: 3454811 - RNA, 16 nt, Human
gccuacaaaucaguaa

SEQ ID NO: 3454812 - RNA, 17 nt, Human
gccuacaaaucaguaau

SEQ ID NO: 3454813 - RNA, 21 nt, Human
gccuacagaacuucagaaaga

SEQ ID NO: 3454814 - RNA, 14 nt, Human
gccuacauuaucua

SEQ ID NO: 3454815 - RNA, 22 nt, Human
gccuaccggcaauuuccggcca

SEQ ID NO: 3454816 - RNA, 13 nt, Human
gccuacuccuguc

SEQ ID NO: 3454817 - RNA, 15 nt, Human
gccuacuccugucuu

SEQ ID NO: 3454818 - RNA, 16 nt, Human
gccuacuccugucuuc

SEQ ID NO: 3454819 - RNA, 18 nt, Human
gccuagaaacaacacugu

SEQ ID NO: 3454820 - RNA, 17 nt, Human
gccuagaagcugguggc

SEQ ID NO: 3454821 - RNA, 23 nt, Human
gccuagauccacacacagaggaa

SEQ ID NO: 3454822 - RNA, 15 nt, Human
gccuagcaagcuggc

SEQ ID NO: 3454823 - RNA, 19 nt, Human
gccuagcaagcuggccucu

SEQ ID NO: 3454824 - RNA, 17 nt, Human
gccuagcacucacaugc

SEQ ID NO: 3454825 - RNA, 22 nt, Human
gccuagcccacccugcugccuu

SEQ ID NO: 3454826 - RNA, 18 nt, Human
gccuagccgaccucagcc

SEQ ID NO: 3454827 - RNA, 14 nt, Human
gccuagcugcuaca

SEQ ID NO: 3454828 - RNA, 15 nt, Human
gccuagcugcuacaa

SEQ ID NO: 3454829 - RNA, 19 nt, Human
gccuagcugcuacaaagaa

SEQ ID NO: 3454830 - RNA, 17 nt, Human
gccuaggaauucccagc

SEQ ID NO: 3454831 - RNA, 11 nt, Human
gccuaggagau

SEQ ID NO: 3454832 - RNA, 18 nt, Human
gccuaggauucacacccc

SEQ ID NO: 3454833 - RNA, 21 nt, Human
gccuaggauucacaccccacc

SEQ ID NO: 3454834 - RNA, 12 nt, Human
gccuaggauucu

SEQ ID NO: 3454835 - RNA, 14 nt, Human
gccuaggauucuaa

SEQ ID NO: 3454836 - RNA, 16 nt, Human
gccuaggauucuaaaa

SEQ ID NO: 3454837 - RNA, 14 nt, Human
gccuaggccaggug

SEQ ID NO: 3454838 - RNA, 18 nt, Human
gccuaggccucagccaga

SEQ ID NO: 3454839 - RNA, 16 nt, Human
gccuaggccugggcag

SEQ ID NO: 3454840 - RNA, 17 nt, Human
gccuaggccugggcagu

SEQ ID NO: 3454841 - RNA, 17 nt, Human
gccuagggcccccacag

SEQ ID NO: 3454842 - RNA, 17 nt, Human
gccuagggccuggucca

SEQ ID NO: 3454843 - RNA, 13 nt, Human
uauuucuauuauu

SEQ ID NO: 3454844 - RNA, 11 nt, Human
uauuucuauug

SEQ ID NO: 3454845 - RNA, 19 nt, Human
uauuucucaacaaagcaca

SEQ ID NO: 3454846 - RNA, 12 nt, Human
uauuucuccuuu

SEQ ID NO: 3454847 - RNA, 15 nt, Human
uauuucucuaguagu

SEQ ID NO: 3454848 - RNA, 13 nt, Human
uauuucucuuucu

SEQ ID NO: 3454849 - RNA, 15 nt, Human
uauuucucuuucuuu

SEQ ID NO: 3454850 - RNA, 16 nt, Human
uauuucucuuucuuua

SEQ ID NO: 3454851 - RNA, 14 nt, Human
uauuucugaaggua

SEQ ID NO: 3454852 - RNA, 14 nt, Human
uauuucugccuccc

SEQ ID NO: 3454853 - RNA, 13 nt, Human
uauuucugcugaa

SEQ ID NO: 3454854 - RNA, 22 nt, Human
uauuucugcugaauuuucacau

SEQ ID NO: 3454855 - RNA, 22 nt, Human
uauuucuguaauuauaucuaaa

SEQ ID NO: 3454856 - RNA, 16 nt, Human
uauuucuguuucucau

SEQ ID NO: 3454857 - RNA, 13 nt, Human
uauuucuuaaaca

SEQ ID NO: 3454858 - RNA, 23 nt, Human
uauuucuuaauuauuauaaaaau

SEQ ID NO: 3454859 - RNA, 22 nt, Human
uauuucuucaaauccuuccaaa

SEQ ID NO: 3454860 - RNA, 22 nt, Human
uauuugaaaacagaaauuggua

SEQ ID NO: 3454861 - RNA, 20 nt, Human
uauuugaaaacauguuuauu

SEQ ID NO: 3454862 - RNA, 20 nt, Human
uauuugaaagugccuuugca

SEQ ID NO: 3454863 - RNA, 15 nt, Human
uauuugaacaagugg

SEQ ID NO: 3454864 - RNA, 19 nt, Human
uauuugaagguuuuaagug

SEQ ID NO: 3454865 - RNA, 14 nt, Human
uauuugaaucuugu

SEQ ID NO: 3454866 - RNA, 21 nt, Human
uauuugaauguaugcuucaua

SEQ ID NO: 3454867 - RNA, 22 nt, Human
uauuugaauguaugcuucauac

SEQ ID NO: 3454868 - RNA, 15 nt, Human
uauuugaauuaaaac

SEQ ID NO: 3454869 - RNA, 17 nt, Human
uauuugaauuaaaacuu

SEQ ID NO: 3454870 - RNA, 19 nt, Human
uauuugacuugcaugaaga

SEQ ID NO: 3454871 - RNA, 22 nt, Human
uauuugacuugcaugaagagaa

SEQ ID NO: 3454872 - RNA, 14 nt, Human
uauuugagacauuc

SEQ ID NO: 3454873 - RNA, 16 nt, Human
uauuugagacuaguuu

SEQ ID NO: 3454874 - RNA, 23 nt, Human
uauuugaguggaguuacugaaca

SEQ ID NO: 3454875 - RNA, 14 nt, Human
uauuugauguaaua

SEQ ID NO: 3454876 - RNA, 19 nt, Human
uauuugauguaauacuucu

SEQ ID NO: 3454877 - RNA, 13 nt, Human
uauuugauuauuu

SEQ ID NO: 3454878 - RNA, 15 nt, Human
uauuugauucaaaau

SEQ ID NO: 3454879 - RNA, 16 nt, Human
uauuugauucaaaaua

SEQ ID NO: 3454880 - RNA, 23 nt, Human
uauuugauuuauuaacuuaauaa

SEQ ID NO: 3454881 - RNA, 11 nt, Human
uauuugcaguc

SEQ ID NO: 3454882 - RNA, 18 nt, Human
uauuugcaguucaccugc

SEQ ID NO: 3454883 - RNA, 15 nt, Human
uauuugcauguuacc

SEQ ID NO: 3454884 - RNA, 16 nt, Human
uauuugcauguuaugu

SEQ ID NO: 3454885 - RNA, 17 nt, Human
uauuugccaugggcuuc

SEQ ID NO: 3454886 - RNA, 23 nt, Human
uauuugcuaauuaaaaaguuaau

SEQ ID NO: 3454887 - RNA, 18 nt, Human
uauuugcugacaaccauu

SEQ ID NO: 3454888 - RNA, 15 nt, Human
uauuugcuucauugu

SEQ ID NO: 3454889 - RNA, 19 nt, Human
uauuuggaaauaaagucag

SEQ ID NO: 3454890 - RNA, 16 nt, Human
uauuuggaauuagaac

SEQ ID NO: 3454891 - RNA, 14 nt, Human
uauuuggaauuuau

SEQ ID NO: 3454892 - RNA, 16 nt, Human
uauuugggaaacuugu

SEQ ID NO: 3454893 - RNA, 15 nt, Human
uauuugggaagugaa

SEQ ID NO: 3454894 - RNA, 23 nt, Human
uauuugggccugcuccagaccug

SEQ ID NO: 3454895 - RNA, 17 nt, Human
uauuugguacuguauuu

SEQ ID NO: 3454896 - RNA, 17 nt, Human
uauuuggugauuacauu

SEQ ID NO: 3454897 - RNA, 14 nt, Human
uauuuguaaagcua

SEQ ID NO: 3454898 - RNA, 18 nt, Human
gccucaaccuccugggcu

SEQ ID NO: 3454899 - RNA, 19 nt, Human
gccucaaccuccugggcua

SEQ ID NO: 3454900 - RNA, 18 nt, Human
gccucaacuccucccaua

SEQ ID NO: 3454901 - RNA, 20 nt, Human
gccucaacucugcugagggu

SEQ ID NO: 3454902 - RNA, 23 nt, Human
gccucaacucugcugagggucca

SEQ ID NO: 3454903 - RNA, 18 nt, Human
gccucaagaggaaugaaa

SEQ ID NO: 3454904 - RNA, 22 nt, Human
gccucaagguuuuagguucuaa

SEQ ID NO: 3454905 - RNA, 18 nt, Human
gccucaagucacucccaa

SEQ ID NO: 3454906 - RNA, 22 nt, Human
gccucaagugauucuccugccu

SEQ ID NO: 3454907 - RNA, 24 nt, Human
gccucaagugauucuccugccuca

SEQ ID NO: 3454908 - RNA, 18 nt, Human
gccucaauaagccuuguc

SEQ ID NO: 3454909 - RNA, 22 nt, Human
gccucaaugugaaucagacccu

SEQ ID NO: 3454910 - RNA, 17 nt, Human
gccucaaugugaccagg

SEQ ID NO: 3454911 - RNA, 17 nt, Human
gccucacaguccuuacc

SEQ ID NO: 3454912 - RNA, 21 nt, Human
gccucacaguccuuaccagca

SEQ ID NO: 3454913 - RNA, 15 nt, Human
gccucacccccucgg

SEQ ID NO: 3454914 - RNA, 17 nt, Human
gccucaccucuacccaa

SEQ ID NO: 3454915 - RNA, 13 nt, Human
gccucacuccagg

SEQ ID NO: 3454916 - RNA, 14 nt, Human
gccucacuggggca

SEQ ID NO: 3454917 - RNA, 19 nt, Human
gccucacuuggucugccag

SEQ ID NO: 3454918 - RNA, 20 nt, Human
gccucacuuggucugccagg

SEQ ID NO: 3454919 - RNA, 17 nt, Human
gccucagacugcaccca

SEQ ID NO: 3454920 - RNA, 18 nt, Human
gccucagacugcacccag

SEQ ID NO: 3454921 - RNA, 12 nt, Human
gccucagacugg

SEQ ID NO: 3454922 - RNA, 21 nt, Human
gccucagacuggagggcaagg

SEQ ID NO: 3454923 - RNA, 15 nt, Human
gccucagagaccagg

SEQ ID NO: 3454924 - RNA, 17 nt, Human
gccucagagaccagggc

SEQ ID NO: 3454925 - RNA, 17 nt, Human
gccucagcauccuggca

SEQ ID NO: 3454926 - RNA, 18 nt, Human
gccucagcauccuggcac

SEQ ID NO: 3454927 - RNA, 16 nt, Human
gccucagccagagaag

SEQ ID NO: 3454928 - RNA, 16 nt, Human
gccucagccauucacu

SEQ ID NO: 3454929 - RNA, 12 nt, Human
gccucagccucc

SEQ ID NO: 3454930 - RNA, 16 nt, Human
gccucagccucccaag

SEQ ID NO: 3454931 - RNA, 16 nt, Human
gccucagccucccgag

SEQ ID NO: 3454932 - RNA, 18 nt, Human
gccucagcgcggcccucc

SEQ ID NO: 3454933 - RNA, 23 nt, Human
gccucagcuacccacuauccuuc

SEQ ID NO: 3454934 - RNA, 17 nt, Human
gccucagcucccacaag

SEQ ID NO: 3454935 - RNA, 15 nt, Human
gccucagcugccuca

SEQ ID NO: 3454936 - RNA, 15 nt, Human
gccucaggacuggga

SEQ ID NO: 3454937 - RNA, 18 nt, Human
gccucaggacugggagcc

SEQ ID NO: 3454938 - RNA, 14 nt, Human
gccucagggcuccu

SEQ ID NO: 3454939 - RNA, 15 nt, Human
gccucaggugcuguc

SEQ ID NO: 3454940 - RNA, 17 nt, Human
gccucaggugcugucca

SEQ ID NO: 3454941 - RNA, 20 nt, Human
gccucaggugcuguccaugg

SEQ ID NO: 3454942 - RNA, 16 nt, Human
gccucaguauauuuaa

SEQ ID NO: 3454943 - RNA, 17 nt, Human
gccucagugacccuggc

SEQ ID NO: 3454944 - RNA, 20 nt, Human
gccucagugacccuggcucc

SEQ ID NO: 3454945 - RNA, 14 nt, Human
gccucagugccacu

SEQ ID NO: 3454946 - RNA, 21 nt, Human
gccucaguggacuuuccaccc

SEQ ID NO: 3454947 - RNA, 15 nt, Human
gccucauauuuaaag

SEQ ID NO: 3454948 - RNA, 18 nt, Human
gccucauccgaggcaggg

SEQ ID NO: 3454949 - RNA, 19 nt, Human
gccucaugucaaauauuua

SEQ ID NO: 3454950 - RNA, 14 nt, Human
gccucauguggcug

SEQ ID NO: 3454951 - RNA, 17 nt, Human
gccuccaaaugccaacu

SEQ ID NO: 3454952 - RNA, 20 nt, Human
gccuccaaccccucgcccag

SEQ ID NO: 3454953 - RNA, 22 nt, Human
gccuccaaccccucgcccaguc

SEQ ID NO: 3454954 - RNA, 16 nt, Human
gccuccaacccuagca

SEQ ID NO: 3454955 - RNA, 22 nt, Human
gccuccaauuuuuuaagugaaa

SEQ ID NO: 3454956 - RNA, 15 nt, Human
gccuccacagcgagg

SEQ ID NO: 3454957 - RNA, 20 nt, Human
gccuccacagcgagggcagc

SEQ ID NO: 3454958 - RNA, 14 nt, Human
gccuccaccaccac

SEQ ID NO: 3454959 - RNA, 23 nt, Human
gccuccaccaccacuggccacca

SEQ ID NO: 3454960 - RNA, 12 nt, Human
gccuccacccuc

SEQ ID NO: 3454961 - RNA, 14 nt, Human
gccuccacccucug

SEQ ID NO: 3454962 - RNA, 17 nt, Human
gccuccagaacucacug

SEQ ID NO: 3454963 - RNA, 14 nt, Human
gccuccagcccucu

SEQ ID NO: 3454964 - RNA, 16 nt, Human
gccuccagcucagcag

SEQ ID NO: 3454965 - RNA, 18 nt, Human
gccuccagcugccccggg

SEQ ID NO: 3454966 - RNA, 12 nt, Human
gccuccaggcca

SEQ ID NO: 3454967 - RNA, 20 nt, Human
gccuccaggcccgucugucc

SEQ ID NO: 3454968 - RNA, 17 nt, Human
gccuccagggcuggacu

SEQ ID NO: 3454969 - RNA, 18 nt, Human
gccuccagggcuggacug

SEQ ID NO: 3454970 - RNA, 21 nt, Human
gccuccagggcuggacugagg

SEQ ID NO: 3454971 - RNA, 13 nt, Human
gccuccaggugug

SEQ ID NO: 3454972 - RNA, 16 nt, Human
gccuccaggugugcac

SEQ ID NO: 3454973 - RNA, 16 nt, Human
gccuccauccaaggcc

SEQ ID NO: 3454974 - RNA, 14 nt, Human
gccuccauccuagu

SEQ ID NO: 3454975 - RNA, 20 nt, Human
gccuccauccugaggcucca

SEQ ID NO: 3454976 - RNA, 11 nt, Human
gccuccaugcu

SEQ ID NO: 3454977 - RNA, 15 nt, Human
gccuccaugggcccc

SEQ ID NO: 3454978 - RNA, 19 nt, Human
gccuccaugggccccaggg

SEQ ID NO: 3454979 - RNA, 17 nt, Human
gccuccauggugccucu

SEQ ID NO: 3454980 - RNA, 23 nt, Human
gccuccauuccuggagcccgagg

SEQ ID NO: 3454981 - RNA, 17 nt, Human
gccuccauuuaguucuu

SEQ ID NO: 3454982 - RNA, 16 nt, Human
gccucccaaagugcug

SEQ ID NO: 3454983 - RNA, 15 nt, Human
gccucccaaaugagc

SEQ ID NO: 3454984 - RNA, 22 nt, Human
gccucccaacucaccccagccc

SEQ ID NO: 3454985 - RNA, 13 nt, Human
gccucccacagac

SEQ ID NO: 3454986 - RNA, 13 nt, Human
gccucccacagug

SEQ ID NO: 3454987 - RNA, 16 nt, Human
gccucccacagugacu

SEQ ID NO: 3454988 - RNA, 19 nt, Human
gccucccacccgaugcugc

SEQ ID NO: 3454989 - RNA, 14 nt, Human
gccucccacgacug

SEQ ID NO: 3454990 - RNA, 21 nt, Human
gccucccacgacugcccggca

SEQ ID NO: 3454991 - RNA, 12 nt, Human
gccucccacugg

SEQ ID NO: 3454992 - RNA, 13 nt, Human
gccucccagccug

SEQ ID NO: 3454993 - RNA, 14 nt, Human
gccucccagguuca

SEQ ID NO: 3454994 - RNA, 17 nt, Human
gccuccccaacccugcc

SEQ ID NO: 3454995 - RNA, 19 nt, Human
gccuccccaacccugcccc

SEQ ID NO: 3454996 - RNA, 21 nt, Human
gccuccccaacccugccccug

SEQ ID NO: 3454997 - RNA, 12 nt, Human
gccuccccaccu

SEQ ID NO: 3454998 - RNA, 13 nt, Human
gccuccccauuuc

SEQ ID NO: 3454999 - RNA, 19 nt, Human
gccuccccauuucccaucu

SEQ ID NO: 3455000 - RNA, 17 nt, Human
gccuccccuccucugcu

SEQ ID NO: 3455001 - RNA, 18 nt, Human
gccuccccucuccuuccu

SEQ ID NO: 3455002 - RNA, 21 nt, Human
gccuccccucuccuuccugug

SEQ ID NO: 3455003 - RNA, 15 nt, Human
gccuccccugccacc

SEQ ID NO: 3455004 - RNA, 20 nt, Human
gccuccccugcugaaggugg

SEQ ID NO: 3455005 - RNA, 21 nt, Human
gccucccgaauagcugggacu

SEQ ID NO: 3455006 - RNA, 23 nt, Human
gccucccgaauagcugggacuac

SEQ ID NO: 3455007 - RNA, 15 nt, Human
gccucccgaguagcu

SEQ ID NO: 3455008 - RNA, 17 nt, Human
gccucccgaguagcugg

SEQ ID NO: 3455009 - RNA, 18 nt, Human
gccucccgaguagcuggg

SEQ ID NO: 3455010 - RNA, 20 nt, Human
gccucccgaguagcugggac

SEQ ID NO: 3455011 - RNA, 16 nt, Human
gccucccuagccagca

SEQ ID NO: 3455012 - RNA, 14 nt, Human
gccucccuccaccc

SEQ ID NO: 3455013 - RNA, 19 nt, Human
gccucccuccaccccagga

SEQ ID NO: 3455014 - RNA, 16 nt, Human
gccucccuccccugcc

SEQ ID NO: 3455015 - RNA, 14 nt, Human
ucaaacaaugacaa

SEQ ID NO: 3455016 - RNA, 20 nt, Human
ucaaacaaugacaaagcaga

SEQ ID NO: 3455017 - RNA, 16 nt, Human
ucaaacacaaaugcag

SEQ ID NO: 3455018 - RNA, 17 nt, Human
ucaaacacaguuacacu

SEQ ID NO: 3455019 - RNA, 12 nt, Human
ucaaacacugca

SEQ ID NO: 3455020 - RNA, 18 nt, Human
ucaaacacuugugacuuu

SEQ ID NO: 3455021 - RNA, 16 nt, Human
ucaaacagaauuuuaa

SEQ ID NO: 3455022 - RNA, 16 nt, Human
ucaaacaucuggaaaa

SEQ ID NO: 3455023 - RNA, 16 nt, Human
ucaaacauuaguacuu

SEQ ID NO: 3455024 - RNA, 18 nt, Human
ucaaacauuaguacuuua

SEQ ID NO: 3455025 - RNA, 20 nt, Human
ucaaaccaaaucacugaacu

SEQ ID NO: 3455026 - RNA, 18 nt, Human
ucaaaccauaaacuucau

SEQ ID NO: 3455027 - RNA, 21 nt, Human
ucaaaccauaaacuucauggu

SEQ ID NO: 3455028 - RNA, 20 nt, Human
ucaaaccccgaccaccugcc

SEQ ID NO: 3455029 - RNA, 14 nt, Human
ucaaaccccugacc

SEQ ID NO: 3455030 - RNA, 16 nt, Human
ucaaacccuagccuug

SEQ ID NO: 3455031 - RNA, 18 nt, Human
ucaaaccuguuuaaauau

SEQ ID NO: 3455032 - RNA, 15 nt, Human
ucaaacgugaaaaug

SEQ ID NO: 3455033 - RNA, 18 nt, Human
ucaaacuacauauuguaa

SEQ ID NO: 3455034 - RNA, 16 nt, Human
ucaaacuacuuugcug

SEQ ID NO: 3455035 - RNA, 16 nt, Human
ucaaacucaaugcuuu

SEQ ID NO: 3455036 - RNA, 18 nt, Human
ucaaacuccugaccucag

SEQ ID NO: 3455037 - RNA, 21 nt, Human
ucaaacugaaaagcugagacc

SEQ ID NO: 3455038 - RNA, 15 nt, Human
ucaaacugaggaauu

SEQ ID NO: 3455039 - RNA, 19 nt, Human
ucaaacugaggaauuucac

SEQ ID NO: 3455040 - RNA, 23 nt, Human
ucaaacuggggccuccagaacuc

SEQ ID NO: 3455041 - RNA, 19 nt, Human
ucaaacuggggccucccug

SEQ ID NO: 3455042 - RNA, 12 nt, Human
ucaaacuguaaa

SEQ ID NO: 3455043 - RNA, 19 nt, Human
uauuauucaccauguaaaa

SEQ ID NO: 3455044 - RNA, 15 nt, Human
uauuauucugcagca

SEQ ID NO: 3455045 - RNA, 15 nt, Human
uauuauuguguguua

SEQ ID NO: 3455046 - RNA, 22 nt, Human
uauuauuuauuuuuuuuaauug

SEQ ID NO: 3455047 - RNA, 16 nt, Human
uauuauuucaauguga

SEQ ID NO: 3455048 - RNA, 14 nt, Human
uauuauuucuauua

SEQ ID NO: 3455049 - RNA, 12 nt, Human
uauuauuugcag

SEQ ID NO: 3455050 - RNA, 14 nt, Human
uauuauuuguguuu

SEQ ID NO: 3455051 - RNA, 12 nt, Human
uauuauuuucca

SEQ ID NO: 3455052 - RNA, 14 nt, Human
uauuauuuuccaaa

SEQ ID NO: 3455053 - RNA, 21 nt, Human
uauuauuuuggggucucuuuu

SEQ ID NO: 3455054 - RNA, 15 nt, Human
uauucaaacagucuc

SEQ ID NO: 3455055 - RNA, 16 nt, Human
uauucaaagagaaaac

SEQ ID NO: 3455056 - RNA, 22 nt, Human
uauucaaaguugccuaaaucca

SEQ ID NO: 3455057 - RNA, 14 nt, Human
uauucaaccaugga

SEQ ID NO: 3455058 - RNA, 16 nt, Human
uauucaaccauggacu

SEQ ID NO: 3455059 - RNA, 14 nt, Human
uauucaauaaagcu

SEQ ID NO: 3455060 - RNA, 15 nt, Human
uauucaauaaaguau

SEQ ID NO: 3455061 - RNA, 17 nt, Human
uauucaauaaaguauuu

SEQ ID NO: 3455062 - RNA, 21 nt, Human
uauucaauaaaguauuuaauu

SEQ ID NO: 3455063 - RNA, 14 nt, Human
uauucaauuccucu

SEQ ID NO: 3455064 - RNA, 15 nt, Human
uauucaauuccucug

SEQ ID NO: 3455065 - RNA, 20 nt, Human
ucacaggcgaggccuggagu

SEQ ID NO: 3455066 - RNA, 18 nt, Human
ucacaggcugggcugggc

SEQ ID NO: 3455067 - RNA, 15 nt, Human
ucacagggcagagcc

SEQ ID NO: 3455068 - RNA, 16 nt, Human
ucacagggcaguaccu

SEQ ID NO: 3455069 - RNA, 16 nt, Human
ucacagggugggccuc

SEQ ID NO: 3455070 - RNA, 19 nt, Human
ucacagggugggccucggc

SEQ ID NO: 3455071 - RNA, 24 nt, Human
ucacaggguugggcccagaucugg

SEQ ID NO: 3455072 - RNA, 15 nt, Human
ucacaggucccaaau

SEQ ID NO: 3455073 - RNA, 22 nt, Human
ucacagguuggaagagaaucac

SEQ ID NO: 3455074 - RNA, 20 nt, Human
ucacaguacagcaugugccu

SEQ ID NO: 3455075 - RNA, 15 nt, Human
ucacaguagagccag

SEQ ID NO: 3455076 - RNA, 17 nt, Human
ucacaguagagccagcu

SEQ ID NO: 3455077 - RNA, 14 nt, Human
ucacaguauugcuc

SEQ ID NO: 3455078 - RNA, 18 nt, Human
ucacagucccacugugca

SEQ ID NO: 3455079 - RNA, 15 nt, Human
ucacagucuaauuuu

SEQ ID NO: 3455080 - RNA, 13 nt, Human
ucacagucucaca

SEQ ID NO: 3455081 - RNA, 16 nt, Human
ucacagugacccuucc

SEQ ID NO: 3455082 - RNA, 18 nt, Human
ucacagugacccuuccca

SEQ ID NO: 3455083 - RNA, 18 nt, Human
ucacagugcucuuuucuc

SEQ ID NO: 3455084 - RNA, 18 nt, Human
ucacagugcuuuuaagug

SEQ ID NO: 3455085 - RNA, 14 nt, Human
ucacaguguuugca

SEQ ID NO: 3455086 - RNA, 14 nt, Human
ucacaguuccucgc

SEQ ID NO: 3455087 - RNA, 16 nt, Human
ucacaguuccucgccc

SEQ ID NO: 3455088 - RNA, 19 nt, Human
ucacaguuccucgcccugg

SEQ ID NO: 3455089 - RNA, 20 nt, Human
ucacaguucuuugggccaga

SEQ ID NO: 3455090 - RNA, 17 nt, Human
ucacaguuuuuccugga

SEQ ID NO: 3455091 - RNA, 17 nt, Human
ucacauaaaugcagccc

SEQ ID NO: 3455092 - RNA, 19 nt, Human
ucacauaagcucagaaucc

SEQ ID NO: 3455093 - RNA, 18 nt, Human
ucacauagagaucauccu

SEQ ID NO: 3455094 - RNA, 15 nt, Human
ucacauagauguccc

SEQ ID NO: 3455095 - RNA, 17 nt, Human
ucacauagcuacccaaa

SEQ ID NO: 3455096 - RNA, 21 nt, Human
ucacauagcuacccaaaagag

SEQ ID NO: 3455097 - RNA, 14 nt, Human
ucacauagugaaag

SEQ ID NO: 3455098 - RNA, 17 nt, Human
ucacauaucuaguauga

SEQ ID NO: 3455099 - RNA, 22 nt, Human
ucacauaucuaguaugaaauua

SEQ ID NO: 3455100 - RNA, 13 nt, Human
ucacaucagauaa

SEQ ID NO: 3455101 - RNA, 11 nt, Human
ucacauccugg

SEQ ID NO: 3455102 - RNA, 17 nt, Human
ucacauccuguguuucu

SEQ ID NO: 3455103 - RNA, 19 nt, Human
ucacaucuuuuaagacaaa

SEQ ID NO: 3455104 - RNA, 21 nt, Human
ucacaugaacauacuggcugg

SEQ ID NO: 3455105 - RNA, 18 nt, Human
ucacaugaauuauuacag

SEQ ID NO: 3455106 - RNA, 22 nt, Human
ucacaugaauuauuacaguguu

SEQ ID NO: 3455107 - RNA, 20 nt, Human
ucacaugaccacauagcaug

SEQ ID NO: 3455108 - RNA, 20 nt, Human
ucacaugaccugaucacuag

SEQ ID NO: 3455109 - RNA, 21 nt, Human
ucacaugaucuguuuuucacc

SEQ ID NO: 3455110 - RNA, 20 nt, Human
ucacaugauuccagccauca

SEQ ID NO: 3455111 - RNA, 18 nt, Human
ucacauggugccccuagc

SEQ ID NO: 3455112 - RNA, 21 nt, Human
ucacauggugcuacgccugca

SEQ ID NO: 3455113 - RNA, 21 nt, Human
ucacaugucaguaccuucaaa

SEQ ID NO: 3455114 - RNA, 23 nt, Human
ucacauguggggagguuaaucua

SEQ ID NO: 3455115 - RNA, 14 nt, Human
ucacauuagaagac

SEQ ID NO: 3455116 - RNA, 16 nt, Human
ucacauuauuugcaug

SEQ ID NO: 3455117 - RNA, 22 nt, Human
ucacauuccucugcccuuccug

SEQ ID NO: 3455118 - RNA, 19 nt, Human
ucacauuccugaacaggau

SEQ ID NO: 3455119 - RNA, 19 nt, Human
ucacauucuuauaaauaug

SEQ ID NO: 3455120 - RNA, 14 nt, Human
ucacauucuuggcu

SEQ ID NO: 3455121 - RNA, 17 nt, Human
ucacauugcauucuauu

SEQ ID NO: 3455122 - RNA, 14 nt, Human
ucacauuggaaaca

SEQ ID NO: 3455123 - RNA, 23 nt, Human
ucacauuguaacugaacuucagg

SEQ ID NO: 3455124 - RNA, 16 nt, Human
ucacauuguuaagaaa

SEQ ID NO: 3455125 - RNA, 19 nt, Human
ucacauuguuugcugcuau

SEQ ID NO: 3455126 - RNA, 14 nt, Human
ucacauuuauucug

SEQ ID NO: 3455127 - RNA, 17 nt, Human
ucacauuuauucugcuc

SEQ ID NO: 3455128 - RNA, 20 nt, Human
ucacauuuuuauaccuguuu

SEQ ID NO: 3455129 - RNA, 17 nt, Human
ucaccaacgucugugcc

SEQ ID NO: 3455130 - RNA, 18 nt, Human
ucaccaacgucugugcca

SEQ ID NO: 3455131 - RNA, 14 nt, Human
ucaccaagcccagu

SEQ ID NO: 3455132 - RNA, 12 nt, Human
ucaccaagcuca

SEQ ID NO: 3455133 - RNA, 20 nt, Human
ucaccaagcucacaguuccu

SEQ ID NO: 3455134 - RNA, 22 nt, Human
ucaccaagcucacaguuccucg

SEQ ID NO: 3455135 - RNA, 14 nt, Human
ucaccaaggcugau

SEQ ID NO: 3455136 - RNA, 22 nt, Human
ucaccacaaacuguaauacaau

SEQ ID NO: 3455137 - RNA, 10 nt, Human
ucaccaccac

SEQ ID NO: 3455138 - RNA, 15 nt, Human
ucaccaccuucccag

SEQ ID NO: 3455139 - RNA, 18 nt, Human
ucaccacgacuggccagg

SEQ ID NO: 3455140 - RNA, 20 nt, Human
ucaccacucaaaggccagac

SEQ ID NO: 3455141 - RNA, 16 nt, Human
ucaccagagagggacu

SEQ ID NO: 3455142 - RNA, 19 nt, Human
ucaccagcaccaacaccac

SEQ ID NO: 3455143 - RNA, 15 nt, Human
ucaccagccccacug

SEQ ID NO: 3455144 - RNA, 23 nt, Human
ucaccagccccacugccagcagc

SEQ ID NO: 3455145 - RNA, 19 nt, Human
ucaccagcccggccugcuc

SEQ ID NO: 3455146 - RNA, 18 nt, Human
ucaccagcugcaaagugu

SEQ ID NO: 3455147 - RNA, 17 nt, Human
ucaccaggcagccucug

SEQ ID NO: 3455148 - RNA, 19 nt, Human
ucaccaggcagccucuggg

SEQ ID NO: 3455149 - RNA, 20 nt, Human
ucaccaggcagccucugggg

SEQ ID NO: 3455150 - RNA, 22 nt, Human
ucaccaggcagccucugggggg

SEQ ID NO: 3455151 - RNA, 18 nt, Human
ucaccaggggcaggcaca

SEQ ID NO: 3455152 - RNA, 15 nt, Human
ucaccaguacauucu

SEQ ID NO: 3455153 - RNA, 17 nt, Human
ucaccaguacauucuca

SEQ ID NO: 3455154 - RNA, 19 nt, Human
ucaccagugcgauucugga

SEQ ID NO: 3455155 - RNA, 18 nt, Human
ucaccaguguguggcuuu

SEQ ID NO: 3455156 - RNA, 19 nt, Human
ucaccaucaauccugauuc

SEQ ID NO: 3455157 - RNA, 17 nt, Human
ucaccaucucaggccac

SEQ ID NO: 3455158 - RNA, 21 nt, Human
ucaccaucucaggccaccugc

SEQ ID NO: 3455159 - RNA, 23 nt, Human
ucaccaucucaggccaccugccc

SEQ ID NO: 3455160 - RNA, 15 nt, Human
ucaccaucuuggcca

SEQ ID NO: 3455161 - RNA, 16 nt, Human
ucaccaugaucacuua

SEQ ID NO: 3455162 - RNA, 16 nt, Human
ucaccaugcuuccagc

SEQ ID NO: 3455163 - RNA, 16 nt, Human
ucaccauguaaaacaa

SEQ ID NO: 3455164 - RNA, 17 nt, Human
ucaccauguuggccagg

SEQ ID NO: 3455165 - RNA, 16 nt, Human
ucaccauuuccccagg

SEQ ID NO: 3455166 - RNA, 16 nt, Human
ucaccauuuggauccu

SEQ ID NO: 3455167 - RNA, 15 nt, Human
ucacccacagggcua

SEQ ID NO: 3455168 - RNA, 13 nt, Human
ucacccaccccug

SEQ ID NO: 3455169 - RNA, 14 nt, Human
ucacccaccccugc

SEQ ID NO: 3455170 - RNA, 17 nt, Human
ucacccagacagcuccc

SEQ ID NO: 3455171 - RNA, 15 nt, Human
ucacccagacauaaa

SEQ ID NO: 3455172 - RNA, 16 nt, Human
ucacccagccccaggg

SEQ ID NO: 3455173 - RNA, 17 nt, Human
ucacccaggccuauguu

SEQ ID NO: 3455174 - RNA, 19 nt, Human
ucacccagguuggagugca

SEQ ID NO: 3455175 - RNA, 19 nt, Human
ucacccaugcaagcagagg

SEQ ID NO: 3455176 - RNA, 22 nt, Human
ucaccccaaguagucugcucac

SEQ ID NO: 3455177 - RNA, 23 nt, Human
ucaccccaaguagucugcucaca

SEQ ID NO: 3455178 - RNA, 13 nt, Human
ucaccccagagcc

SEQ ID NO: 3455179 - RNA, 18 nt, Human
ucaccccagagccacaca

SEQ ID NO: 3455180 - RNA, 19 nt, Human
ucaccccagagccacacau

SEQ ID NO: 3455181 - RNA, 12 nt, Human
ucaccccauccc

SEQ ID NO: 3455182 - RNA, 19 nt, Human
ucacccccaaggggcaguc

SEQ ID NO: 3455183 - RNA, 13 nt, Human
ucaccccccacuc

SEQ ID NO: 3455184 - RNA, 18 nt, Human
ucaccccccacucaccag

SEQ ID NO: 3455185 - RNA, 15 nt, Human
ucacccccucccacc

SEQ ID NO: 3455186 - RNA, 15 nt, Human
ucacccccuccuuca

SEQ ID NO: 3455187 - RNA, 14 nt, Human
ucacccccugagau

SEQ ID NO: 3455188 - RNA, 13 nt, Human
uauuguuucugca

SEQ ID NO: 3455189 - RNA, 17 nt, Human
uauuguuucuuuaucac

SEQ ID NO: 3455190 - RNA, 17 nt, Human
uauuguuugguaaaugu

SEQ ID NO: 3455191 - RNA, 15 nt, Human
uauuguuuuacaaua

SEQ ID NO: 3455192 - RNA, 12 nt, Human
uauuguuuucag

SEQ ID NO: 3455193 - RNA, 18 nt, Human
uauuguuuucaguguaca

SEQ ID NO: 3455194 - RNA, 16 nt, Human
uauuuaaaaaacuaaa

SEQ ID NO: 3455195 - RNA, 18 nt, Human
uauuuaaaaauauuuuug

SEQ ID NO: 3455196 - RNA, 12 nt, Human
uauuuaaaaaug

SEQ ID NO: 3455197 - RNA, 15 nt, Human
uauuuaaaaaugucu

SEQ ID NO: 3455198 - RNA, 16 nt, Human
uauuuaaaaaugucuu

SEQ ID NO: 3455199 - RNA, 12 nt, Human
uauuuaaaacuu

SEQ ID NO: 3455200 - RNA, 21 nt, Human
uauuuaaaauagcaaaagaag

SEQ ID NO: 3455201 - RNA, 13 nt, Human
uauuuaaaaugua

SEQ ID NO: 3455202 - RNA, 19 nt, Human
uauuuaaaauuuauugcuu

SEQ ID NO: 3455203 - RNA, 14 nt, Human
uauuuaaacauggu

SEQ ID NO: 3455204 - RNA, 19 nt, Human
uauuuaaaccgcuaaaaga

SEQ ID NO: 3455205 - RNA, 20 nt, Human
uauuuaaacuuauaaaucau

SEQ ID NO: 3455206 - RNA, 13 nt, Human
uauuuaaagaaau

SEQ ID NO: 3455207 - RNA, 19 nt, Human
uauuuaaagaaauauguau

SEQ ID NO: 3455208 - RNA, 13 nt, Human
uauuuaaagacaa

SEQ ID NO: 3455209 - RNA, 22 nt, Human
uauuuaaagacagggaagagca

SEQ ID NO: 3455210 - RNA, 22 nt, Human
uauuuaaauauuaaauauguua

SEQ ID NO: 3455211 - RNA, 16 nt, Human
uauuuaaaugggaaua

SEQ ID NO: 3455212 - RNA, 20 nt, Human
uauuuaaaugucuaauguau

SEQ ID NO: 3455213 - RNA, 16 nt, Human
uauuuaaauucuuuuu

SEQ ID NO: 3455214 - RNA, 14 nt, Human
uauuuaacagaaau

SEQ ID NO: 3455215 - RNA, 21 nt, Human
uauuuaacagcugaauuaucu

SEQ ID NO: 3455216 - RNA, 16 nt, Human
uauuuaacucucuuua

SEQ ID NO: 3455217 - RNA, 23 nt, Human
uauuuaacucucuuuaugucugu

SEQ ID NO: 3455218 - RNA, 15 nt, Human
uauuuaacuggugca

SEQ ID NO: 3455219 - RNA, 16 nt, Human
uauuuaacuggugcac

SEQ ID NO: 3455220 - RNA, 23 nt, Human
uauuuaacuggugcacuuuguaa

SEQ ID NO: 3455221 - RNA, 13 nt, Human
uauuuaacuugag

SEQ ID NO: 3455222 - RNA, 21 nt, Human
uauuuaacuugaggguaauaa

SEQ ID NO: 3455223 - RNA, 13 nt, Human
uauuuaagaaaau

SEQ ID NO: 3455224 - RNA, 20 nt, Human
uauuuaagauaauuauaaua

SEQ ID NO: 3455225 - RNA, 20 nt, Human
uauuuaagauaguuuugcca

SEQ ID NO: 3455226 - RNA, 12 nt, Human
uauuuaagcaaa

SEQ ID NO: 3455227 - RNA, 14 nt, Human
uauuuaagcaaaua

SEQ ID NO: 3455228 - RNA, 18 nt, Human
uauuuaagcaacaucuuu

SEQ ID NO: 3455229 - RNA, 20 nt, Human
uauuuaagcaacaucuuuuu

SEQ ID NO: 3455230 - RNA, 21 nt, Human
uauuuaagcaacaucuuuuua

SEQ ID NO: 3455231 - RNA, 17 nt, Human
uauuuaagccuaaagau

SEQ ID NO: 3455232 - RNA, 22 nt, Human
uauuuaagccuaaagauuuuga

SEQ ID NO: 3455233 - RNA, 24 nt, Human
uauuuaagccuaaagauuuugauc

SEQ ID NO: 3455234 - RNA, 20 nt, Human
uauuuaagccucauauuuaa

SEQ ID NO: 3455235 - RNA, 21 nt, Human
ucacucuaagucauguauguu

SEQ ID NO: 3455236 - RNA, 21 nt, Human
ucacucuaauuaauuguaauc

SEQ ID NO: 3455237 - RNA, 19 nt, Human
ucacucuacuuagcauguc

SEQ ID NO: 3455238 - RNA, 17 nt, Human
ucacucugaguguuuua

SEQ ID NO: 3455239 - RNA, 22 nt, Human
ucacucugcuaccuugccccaa

SEQ ID NO: 3455240 - RNA, 22 nt, Human
ucacucuggcagcucagagagg

SEQ ID NO: 3455241 - RNA, 14 nt, Human
ucacucuggccuca

SEQ ID NO: 3455242 - RNA, 22 nt, Human
ucacucugggcacacucugcca

SEQ ID NO: 3455243 - RNA, 16 nt, Human
ucacucugucgcccag

SEQ ID NO: 3455244 - RNA, 19 nt, Human
ucacucugucgcccagucu

SEQ ID NO: 3455245 - RNA, 20 nt, Human
ucacucuguucauuccucca

SEQ ID NO: 3455246 - RNA, 22 nt, Human
ucacucuguucauuccuccagg

SEQ ID NO: 3455247 - RNA, 15 nt, Human
ucacucuuaugcugu

SEQ ID NO: 3455248 - RNA, 17 nt, Human
ucacucuuauugcccac

SEQ ID NO: 3455249 - RNA, 21 nt, Human
ucacucuuauugcccacgcug

SEQ ID NO: 3455250 - RNA, 15 nt, Human
ucacucuuccagaau

SEQ ID NO: 3455251 - RNA, 18 nt, Human
ucacucuucucagccacu

SEQ ID NO: 3455252 - RNA, 16 nt, Human
ucacucuugccaaccu

SEQ ID NO: 3455253 - RNA, 14 nt, Human
ucacucuuggagcc

SEQ ID NO: 3455254 - RNA, 16 nt, Human
ucacucuuggagccug

SEQ ID NO: 3455255 - RNA, 20 nt, Human
ucacucuuguggauguuuua

SEQ ID NO: 3455256 - RNA, 21 nt, Human
ucacugaaaccuuuaagaaaa

SEQ ID NO: 3455257 - RNA, 23 nt, Human
ucacugaacaaacuaaaggugca

SEQ ID NO: 3455258 - RNA, 14 nt, Human
ucacugaagacgcc

SEQ ID NO: 3455259 - RNA, 14 nt, Human
ucacugaagccugc

SEQ ID NO: 3455260 - RNA, 16 nt, Human
ucacugaagcuuuuua

SEQ ID NO: 3455261 - RNA, 16 nt, Human
ucacugaaggccuggc

SEQ ID NO: 3455262 - RNA, 14 nt, Human
ucacugaauuuaua

SEQ ID NO: 3455263 - RNA, 12 nt, Human
ucacugacacaa

SEQ ID NO: 3455264 - RNA, 17 nt, Human
ucacugacacaaaggaa

SEQ ID NO: 3455265 - RNA, 13 nt, Human
ucacugagacagc

SEQ ID NO: 3455266 - RNA, 14 nt, Human
ucacugagacagcc

SEQ ID NO: 3455267 - RNA, 16 nt, Human
ucacugagacagcccg

SEQ ID NO: 3455268 - RNA, 23 nt, Human
ucacugagacagcccgggcucug

SEQ ID NO: 3455269 - RNA, 19 nt, Human
ucacugagcacuguuuucu

SEQ ID NO: 3455270 - RNA, 23 nt, Human
ucacugaggccugagacccagga

SEQ ID NO: 3455271 - RNA, 20 nt, Human
ucacugcaacaugaugaggu

SEQ ID NO: 3455272 - RNA, 18 nt, Human
ucacugcaagcuccgccu

SEQ ID NO: 3455273 - RNA, 14 nt, Human
ucacugcagccuca

SEQ ID NO: 3455274 - RNA, 21 nt, Human
ucacugcaggcacucaaugca

SEQ ID NO: 3455275 - RNA, 17 nt, Human
ucacugcauuauucucu

SEQ ID NO: 3455276 - RNA, 20 nt, Human
ucacugccacacucuccauc

SEQ ID NO: 3455277 - RNA, 15 nt, Human
ucacugccacuuugc

SEQ ID NO: 3455278 - RNA, 17 nt, Human
ucacugccacuuugcac

SEQ ID NO: 3455279 - RNA, 20 nt, Human
ucacugccagagauaaacua

SEQ ID NO: 3455280 - RNA, 14 nt, Human
ucacugccaggcca

SEQ ID NO: 3455281 - RNA, 13 nt, Human
ucacugccauaua

SEQ ID NO: 3455282 - RNA, 18 nt, Human
ucacugccaucaaacugu

SEQ ID NO: 3455283 - RNA, 18 nt, Human
ucacugccaugccagcuu

SEQ ID NO: 3455284 - RNA, 12 nt, Human
ucacugcccgca

SEQ ID NO: 3455285 - RNA, 22 nt, Human
ucacugcccgcacacccucacu

SEQ ID NO: 3455286 - RNA, 12 nt, Human
ucacugccucuc

SEQ ID NO: 3455287 - RNA, 19 nt, Human
ucacugccucucccuggcc

SEQ ID NO: 3455288 - RNA, 21 nt, Human
ucacugccucucccuggcccu

SEQ ID NO: 3455289 - RNA, 22 nt, Human
ucacugccugcagaggucugug

SEQ ID NO: 3455290 - RNA, 18 nt, Human
ucacugcgaagacccucu

SEQ ID NO: 3455291 - RNA, 19 nt, Human
ucacugcuaagaauauuug

SEQ ID NO: 3455292 - RNA, 23 nt, Human
ucacugcucccugaagccagccu

SEQ ID NO: 3455293 - RNA, 22 nt, Human
ucacugcugcaaggccuuucug

SEQ ID NO: 3455294 - RNA, 15 nt, Human
ucacugcuggcugcc

SEQ ID NO: 3455295 - RNA, 17 nt, Human
ucacugcuggcugccuu

SEQ ID NO: 3455296 - RNA, 13 nt, Human
ucacugcugucau

SEQ ID NO: 3455297 - RNA, 15 nt, Human
ucacugcugucauca

SEQ ID NO: 3455298 - RNA, 14 nt, Human
ucacugcuuaacuu

SEQ ID NO: 3455299 - RNA, 11 nt, Human
ucacugcuuca

SEQ ID NO: 3455300 - RNA, 16 nt, Human
ucacugcuuuuggccu

SEQ ID NO: 3455301 - RNA, 23 nt, Human
ucacugcuuuuggccuggaguuu

SEQ ID NO: 3455302 - RNA, 18 nt, Human
ucacuggaaaggggagag

SEQ ID NO: 3455303 - RNA, 14 nt, Human
ucacuggaacucag

SEQ ID NO: 3455304 - RNA, 13 nt, Human
ucacuggagcaca

SEQ ID NO: 3455305 - RNA, 22 nt, Human
ucacuggagcaccaggcacgaa

SEQ ID NO: 3455306 - RNA, 12 nt, Human
ucacuggagccc

SEQ ID NO: 3455307 - RNA, 13 nt, Human
ucacuggagccca

SEQ ID NO: 3455308 - RNA, 17 nt, Human
ucacuggagcccaggag

SEQ ID NO: 3455309 - RNA, 15 nt, Human
ucacuggcagcccca

SEQ ID NO: 3455310 - RNA, 16 nt, Human
ucacuggcaucuuugc

SEQ ID NO: 3455311 - RNA, 20 nt, Human
ucacuggcgacacguagcag

SEQ ID NO: 3455312 - RNA, 17 nt, Human
ucacuggcucuccaagu

SEQ ID NO: 3455313 - RNA, 19 nt, Human
ucacuggcucuccaagugc

SEQ ID NO: 3455314 - RNA, 17 nt, Human
ucacuggcucuccuggc

SEQ ID NO: 3455315 - RNA, 20 nt, Human
ucacuggcugccuccacucc

SEQ ID NO: 3455316 - RNA, 14 nt, Human
ucacuggggcagac

SEQ ID NO: 3455317 - RNA, 17 nt, Human
ucacuggggccuacagc

SEQ ID NO: 3455318 - RNA, 19 nt, Human
ucacugggguccuggggcc

SEQ ID NO: 3455319 - RNA, 20 nt, Human
ucacugggguccuggggccu

SEQ ID NO: 3455320 - RNA, 11 nt, Human
ucacugggugg

SEQ ID NO: 3455321 - RNA, 23 nt, Human
ucacuguaagacucauucccuag

SEQ ID NO: 3455322 - RNA, 21 nt, Human
ucacuguagaaugauuucaug

SEQ ID NO: 3455323 - RNA, 24 nt, Human
ucacuguauaaauaggagaggaug

SEQ ID NO: 3455324 - RNA, 18 nt, Human
ucacugucccucaaauga

SEQ ID NO: 3455325 - RNA, 14 nt, Human
ucacugucccuccu

SEQ ID NO: 3455326 - RNA, 20 nt, Human
ucacugucuuuaauucugua

SEQ ID NO: 3455327 - RNA, 14 nt, Human
ucacugucuuuccu

SEQ ID NO: 3455328 - RNA, 16 nt, Human
ucacugucuuuccuag

SEQ ID NO: 3455329 - RNA, 19 nt, Human
ucacugugcuguuguuaug

SEQ ID NO: 3455330 - RNA, 21 nt, Human
ucacugugggaaggccagcug

SEQ ID NO: 3455331 - RNA, 22 nt, Human
ucacugugguaaaugccacaca

SEQ ID NO: 3455332 - RNA, 19 nt, Human
gcggcuggggucccagcag

SEQ ID NO: 3455333 - RNA, 21 nt, Human
gcggcuggggucccagcagcu

SEQ ID NO: 3455334 - RNA, 17 nt, Human
gcgggaaagccagugac

SEQ ID NO: 3455335 - RNA, 19 nt, Human
gcgggaauggcagcugcca

SEQ ID NO: 3455336 - RNA, 14 nt, Human
gcgggacccaggca

SEQ ID NO: 3455337 - RNA, 20 nt, Human
gcgggaccgguacagaaagg

SEQ ID NO: 3455338 - RNA, 21 nt, Human
gcgggagccaugcgcccccuc

SEQ ID NO: 3455339 - RNA, 16 nt, Human
gcgggaugguccuggg

SEQ ID NO: 3455340 - RNA, 17 nt, Human
gcgggaugguccugggg

SEQ ID NO: 3455341 - RNA, 19 nt, Human
gcgggcacaccuccuccca

SEQ ID NO: 3455342 - RNA, 22 nt, Human
gcgggcacaccuccucccacug

SEQ ID NO: 3455343 - RNA, 20 nt, Human
gcgggcaccuauagucccag

SEQ ID NO: 3455344 - RNA, 17 nt, Human
gcgggcaccuguagucc

SEQ ID NO: 3455345 - RNA, 16 nt, Human
gcgggcagagggcugg

SEQ ID NO: 3455346 - RNA, 18 nt, Human
gcgggcaggggaggguca

SEQ ID NO: 3455347 - RNA, 20 nt, Human
gcgggccaaggacugccgac

SEQ ID NO: 3455348 - RNA, 21 nt, Human
gcgggccagccaggcgggcuc

SEQ ID NO: 3455349 - RNA, 17 nt, Human
gcgggcgcacugccucu

SEQ ID NO: 3455350 - RNA, 22 nt, Human
gcgggcgcacugccucucacag

SEQ ID NO: 3455351 - RNA, 16 nt, Human
gcgggcugggcagcug

SEQ ID NO: 3455352 - RNA, 12 nt, Human
gcggggacagcu

SEQ ID NO: 3455353 - RNA, 13 nt, Human
gcggggacagcuc

SEQ ID NO: 3455354 - RNA, 16 nt, Human
gcggggaguacaaggc

SEQ ID NO: 3455355 - RNA, 17 nt, Human
gcggggcgaagcccagg

SEQ ID NO: 3455356 - RNA, 18 nt, Human
gcggggcgaagcccaggc

SEQ ID NO: 3455357 - RNA, 18 nt, Human
gcggggcugucggcgcug

SEQ ID NO: 3455358 - RNA, 21 nt, Human
gcggggcuugccuucuggugu

SEQ ID NO: 3455359 - RNA, 20 nt, Human
gcgggucacaggagggaggg

SEQ ID NO: 3455360 - RNA, 19 nt, Human
gcggguggaucacgagguc

SEQ ID NO: 3455361 - RNA, 19 nt, Human
gcggguuauaaugaaugac

SEQ ID NO: 3455362 - RNA, 16 nt, Human
gcgguacaaaggaaaa

SEQ ID NO: 3455363 - RNA, 13 nt, Human
gcgguccacccag

SEQ ID NO: 3455364 - RNA, 13 nt, Human
gcggucccagcuc

SEQ ID NO: 3455365 - RNA, 22 nt, Human
gcggucccagcucccuggcucc

SEQ ID NO: 3455366 - RNA, 19 nt, Human
gcgguccccuccgccaggc

SEQ ID NO: 3455367 - RNA, 22 nt, Human
gcggucucaggcuggugggagg

SEQ ID NO: 3455368 - RNA, 17 nt, Human
gcggugcuugauagaaa

SEQ ID NO: 3455369 - RNA, 14 nt, Human
gcggugggccuggu

SEQ ID NO: 3455370 - RNA, 16 nt, Human
gcgguggggagagaug

SEQ ID NO: 3455371 - RNA, 20 nt, Human
gcgguuuacucacugcugca

SEQ ID NO: 3455372 - RNA, 15 nt, Human
gcguaaguacagaga

SEQ ID NO: 3455373 - RNA, 18 nt, Human
gcguaaguacagagaagc

SEQ ID NO: 3455374 - RNA, 21 nt, Human
gcguaaguacagagaagccau

SEQ ID NO: 3455375 - RNA, 18 nt, Human
gcguagagggugcugccc

SEQ ID NO: 3455376 - RNA, 16 nt, Human
gcguagcagaguuaaa

SEQ ID NO: 3455377 - RNA, 13 nt, Human
gcguaugucuguu

SEQ ID NO: 3455378 - RNA, 12 nt, Human
gcgucagccucc

SEQ ID NO: 3455379 - RNA, 18 nt, Human
gcgucagucuuuuucugu

SEQ ID NO: 3455380 - RNA, 16 nt, Human
gcgucauuacagggca

SEQ ID NO: 3455381 - RNA, 19 nt, Human
gcgucccuagcagugaacu

SEQ ID NO: 3455382 - RNA, 12 nt, Human
gcgucccuggcg

SEQ ID NO: 3455383 - RNA, 18 nt, Human
gcgucccuggcgcaggug

SEQ ID NO: 3455384 - RNA, 16 nt, Human
gcguccgcgcgccagc

SEQ ID NO: 3455385 - RNA, 20 nt, Human
gcguccgcgcgccagcacag

SEQ ID NO: 3455386 - RNA, 18 nt, Human
gcguccguggguugcuaa

SEQ ID NO: 3455387 - RNA, 20 nt, Human
gcguccuccucaccucaugc

SEQ ID NO: 3455388 - RNA, 17 nt, Human
gcguccugacggcgccc

SEQ ID NO: 3455389 - RNA, 19 nt, Human
gcguccuguccacacccag

SEQ ID NO: 3455390 - RNA, 21 nt, Human
gcguccuguccacacccagcu

SEQ ID NO: 3455391 - RNA, 14 nt, Human
gcgucuacccuggg

SEQ ID NO: 3455392 - RNA, 15 nt, Human
gcgucuacccuggga

SEQ ID NO: 3455393 - RNA, 16 nt, Human
gcgucuacccugggau

SEQ ID NO: 3455394 - RNA, 15 nt, Human
gcgucuauccugugu

SEQ ID NO: 3455395 - RNA, 18 nt, Human
gcgucucccaucuuaacu

SEQ ID NO: 3455396 - RNA, 11 nt, Human
gcgucuccugu

SEQ ID NO: 3455397 - RNA, 21 nt, Human
gcgucuccuguuuuucugggu

SEQ ID NO: 3455398 - RNA, 20 nt, Human
gcgucuggaggggccccugc

SEQ ID NO: 3455399 - RNA, 23 nt, Human
gcgucuggaggggccccugcuuc

SEQ ID NO: 3455400 - RNA, 18 nt, Human
gcgucuuccgccccugcc

SEQ ID NO: 3455401 - RNA, 23 nt, Human
gcgugaacccgggaggcggagcu

SEQ ID NO: 3455402 - RNA, 19 nt, Human
gcgugacacucuccuugca

SEQ ID NO: 3455403 - RNA, 19 nt, Human
gcgugacccgaccuggccg

SEQ ID NO: 3455404 - RNA, 13 nt, Human
gcgugacucaccc

SEQ ID NO: 3455405 - RNA, 14 nt, Human
gcgugagccacugc

SEQ ID NO: 3455406 - RNA, 15 nt, Human
gcgugagccacugca

SEQ ID NO: 3455407 - RNA, 16 nt, Human
gcgugagccacugcac

SEQ ID NO: 3455408 - RNA, 18 nt, Human
gcgugaggaugggaagga

SEQ ID NO: 3455409 - RNA, 19 nt, Human
gcgugaucaaagccacacu

SEQ ID NO: 3455410 - RNA, 16 nt, Human
gcgugaucucagcuca

SEQ ID NO: 3455411 - RNA, 19 nt, Human
gcgugcacacaccagagcc

SEQ ID NO: 3455412 - RNA, 23 nt, Human
gcgugcacacaccagagcccacc

SEQ ID NO: 3455413 - RNA, 23 nt, Human
gcgugccagucaagaagaaaaag

SEQ ID NO: 3455414 - RNA, 16 nt, Human
gcgugccccugcugcu

SEQ ID NO: 3455415 - RNA, 15 nt, Human
gcgugccguggcacc

SEQ ID NO: 3455416 - RNA, 14 nt, Human
gcgugccgugugag

SEQ ID NO: 3455417 - RNA, 22 nt, Human
gcgugccgugugagugugacag

SEQ ID NO: 3455418 - RNA, 24 nt, Human
gcgugccgugugagugugacaggg

SEQ ID NO: 3455419 - RNA, 22 nt, Human
gcgugcgcaucuugccuccagg

SEQ ID NO: 3455420 - RNA, 21 nt, Human
gcgugcucaguucagaaucac

SEQ ID NO: 3455421 - RNA, 17 nt, Human
gcguggacucugcacau

SEQ ID NO: 3455422 - RNA, 18 nt, Human
gcguggacucugcacaug

SEQ ID NO: 3455423 - RNA, 14 nt, Human
gcguggagcaggcg

SEQ ID NO: 3455424 - RNA, 15 nt, Human
gcguggagcugccug

SEQ ID NO: 3455425 - RNA, 22 nt, Human
gcguggagggaggccccagggg

SEQ ID NO: 3455426 - RNA, 16 nt, Human
gcguggagggcguggg

SEQ ID NO: 3455427 - RNA, 20 nt, Human
gcguggauuaaacuuaugaa

SEQ ID NO: 3455428 - RNA, 22 nt, Human
gcguggcccaccaggccccccu

SEQ ID NO: 3455429 - RNA, 21 nt, Human
gcguggccuuguucugucacc

SEQ ID NO: 3455430 - RNA, 13 nt, Human
gcguggggagggc

SEQ ID NO: 3455431 - RNA, 13 nt, Human
gcguggggcuccc

SEQ ID NO: 3455432 - RNA, 18 nt, Human
gcguggggcucccgccuc

SEQ ID NO: 3455433 - RNA, 16 nt, Human
gcguggucacugcugu

SEQ ID NO: 3455434 - RNA, 17 nt, Human
gcguggucacugcuguc

SEQ ID NO: 3455435 - RNA, 21 nt, Human
gcgugguggaagaggggacag

SEQ ID NO: 3455436 - RNA, 16 nt, Human
gcgugguggucccugg

SEQ ID NO: 3455437 - RNA, 17 nt, Human
gcgugucaccugugcuu

SEQ ID NO: 3455438 - RNA, 20 nt, Human
gcguguccccggggcccagg

SEQ ID NO: 3455439 - RNA, 16 nt, Human
gcgugugccugugugc

SEQ ID NO: 3455440 - RNA, 22 nt, Human
ucaaccagggauuguuucuguu

SEQ ID NO: 3455441 - RNA, 17 nt, Human
ucaaccauggacuuuau

SEQ ID NO: 3455442 - RNA, 20 nt, Human
ucaaccccaccauaugaauu

SEQ ID NO: 3455443 - RNA, 18 nt, Human
ucaaccccagacacuggu

SEQ ID NO: 3455444 - RNA, 14 nt, Human
ucaacccucccuca

SEQ ID NO: 3455445 - RNA, 15 nt, Human
ucaacccucccucag

SEQ ID NO: 3455446 - RNA, 18 nt, Human
ucaacccucccucagccc

SEQ ID NO: 3455447 - RNA, 19 nt, Human
ucaacccucccucagcccc

SEQ ID NO: 3455448 - RNA, 21 nt, Human
ucaacccucccucagccccuc

SEQ ID NO: 3455449 - RNA, 23 nt, Human
ucaacccucccucagccccucuu

SEQ ID NO: 3455450 - RNA, 18 nt, Human
ucaacccucucaggugac

SEQ ID NO: 3455451 - RNA, 15 nt, Human
ucaaccuaccacccc

SEQ ID NO: 3455452 - RNA, 12 nt, Human
ucaaccuccugg

SEQ ID NO: 3455453 - RNA, 13 nt, Human
ucaaccuccuggg

SEQ ID NO: 3455454 - RNA, 18 nt, Human
ucaaccucgcgcuugcug

SEQ ID NO: 3455455 - RNA, 16 nt, Human
ucaaccuguaaauuau

SEQ ID NO: 3455456 - RNA, 14 nt, Human
ucaacgcagcccug

SEQ ID NO: 3455457 - RNA, 15 nt, Human
ucaacgcagcccugc

SEQ ID NO: 3455458 - RNA, 23 nt, Human
ucaacgccucacugaaacauggc

SEQ ID NO: 3455459 - RNA, 21 nt, Human
ucaacggaaagugcugucuua

SEQ ID NO: 3455460 - RNA, 14 nt, Human
ucaacguuguacug

SEQ ID NO: 3455461 - RNA, 20 nt, Human
ucaacuaaaaaaaaaaaagu

SEQ ID NO: 3455462 - RNA, 20 nt, Human
ucaacuaaaguuguacuuua

SEQ ID NO: 3455463 - RNA, 22 nt, Human
ucaacuagugggguuuccuggc

SEQ ID NO: 3455464 - RNA, 19 nt, Human
ucaacucaccuaauguuua

SEQ ID NO: 3455465 - RNA, 19 nt, Human
ucaacuccaaacugacucu

SEQ ID NO: 3455466 - RNA, 15 nt, Human
ucaacucccugcccc

SEQ ID NO: 3455467 - RNA, 22 nt, Human
ucaacucccugccccccagccc

SEQ ID NO: 3455468 - RNA, 24 nt, Human
ucaacucucuuauugccucacuuc

SEQ ID NO: 3455469 - RNA, 18 nt, Human
ucaacucugcugaggguc

SEQ ID NO: 3455470 - RNA, 16 nt, Human
ucaacucuucgaagcc

SEQ ID NO: 3455471 - RNA, 19 nt, Human
ucaacucuugaguuuuuca

SEQ ID NO: 3455472 - RNA, 23 nt, Human
ucaacugaaaagacucaguguuc

SEQ ID NO: 3455473 - RNA, 24 nt, Human
ucaacugaccagccuccaugcugc

SEQ ID NO: 3455474 - RNA, 20 nt, Human
ucaacugcaucaagauguga

SEQ ID NO: 3455475 - RNA, 22 nt, Human
ucaaguggcaaagcuguucuuc

SEQ ID NO: 3455476 - RNA, 18 nt, Human
ucaagugggaucugucac

SEQ ID NO: 3455477 - RNA, 15 nt, Human
ucaagugucauaugu

SEQ ID NO: 3455478 - RNA, 16 nt, Human
ucaagugucucagucc

SEQ ID NO: 3455479 - RNA, 13 nt, Human
ucaaguuauugua

SEQ ID NO: 3455480 - RNA, 13 nt, Human
ucaaguucaagga

SEQ ID NO: 3455481 - RNA, 13 nt, Human
ucaaguucuaaga

SEQ ID NO: 3455482 - RNA, 17 nt, Human
ucaaguucuaagauucu

SEQ ID NO: 3455483 - RNA, 17 nt, Human
ucaaguugaggggcuuc

SEQ ID NO: 3455484 - RNA, 16 nt, Human
ucaaguugauuagaaa

SEQ ID NO: 3455485 - RNA, 13 nt, Human
ucaaguugugcca

SEQ ID NO: 3455486 - RNA, 22 nt, Human
ucaaguugugcuuguuuacagc

SEQ ID NO: 3455487 - RNA, 21 nt, Human
ucaaguuuuaagugaaaguga

SEQ ID NO: 3455488 - RNA, 21 nt, Human
ucaaguuuuggguauguuuaa

SEQ ID NO: 3455489 - RNA, 19 nt, Human
ucaauaaaaaaaagaaaug

SEQ ID NO: 3455490 - RNA, 18 nt, Human
ucaauaaaaucauguaca

SEQ ID NO: 3455491 - RNA, 13 nt, Human
ucaauaaaaugug

SEQ ID NO: 3455492 - RNA, 15 nt, Human
ucaauaaaaugugau

SEQ ID NO: 3455493 - RNA, 18 nt, Human
ucaauaaaaugugauuuu

SEQ ID NO: 3455494 - RNA, 15 nt, Human
ucaauaaaauuauag

SEQ ID NO: 3455495 - RNA, 19 nt, Human
ucaauaaaauuauagcucu

SEQ ID NO: 3455496 - RNA, 12 nt, Human
ucaauaaacagc

SEQ ID NO: 3455497 - RNA, 14 nt, Human
ucaauaaacagcuu

SEQ ID NO: 3455498 - RNA, 18 nt, Human
ucaauaaacgauuuaauu

SEQ ID NO: 3455499 - RNA, 23 nt, Human
ucaauaaacgauuuaauucucuu

SEQ ID NO: 3455500 - RNA, 14 nt, Human
ucaauaaagaaaac

SEQ ID NO: 3455501 - RNA, 18 nt, Human
ucaauaaagcacugagca

SEQ ID NO: 3455502 - RNA, 12 nt, Human
ucaauaaagcau

SEQ ID NO: 3455503 - RNA, 15 nt, Human
ucaauaaagcauuua

SEQ ID NO: 3455504 - RNA, 19 nt, Human
ucaauaaagcauuuauaaa

SEQ ID NO: 3455505 - RNA, 15 nt, Human
ucaauaaaguauuua

SEQ ID NO: 3455506 - RNA, 17 nt, Human
ucaauaaaguauuuaau

SEQ ID NO: 3455507 - RNA, 18 nt, Human
ucaauaaaguauuuaauu

SEQ ID NO: 3455508 - RNA, 20 nt, Human
ucaauaaaguauuuaauuag

SEQ ID NO: 3455509 - RNA, 24 nt, Human
ucaauaacagccgcuccagaguca

SEQ ID NO: 3455510 - RNA, 13 nt, Human
ucaauaagaaggu

SEQ ID NO: 3455511 - RNA, 22 nt, Human
ucaauaagaagguagaaugagu

SEQ ID NO: 3455512 - RNA, 12 nt, Human
ucaauaauaaaa

SEQ ID NO: 3455513 - RNA, 18 nt, Human
ucaauaauauauuuucug

SEQ ID NO: 3455514 - RNA, 19 nt, Human
ucaauaauauauuuucugu

SEQ ID NO: 3455515 - RNA, 19 nt, Human
ucaauacagauauauuuuc

SEQ ID NO: 3455516 - RNA, 18 nt, Human
ucaauacaguacaggcag

SEQ ID NO: 3455517 - RNA, 19 nt, Human
ucaauacaguacaggcagc

SEQ ID NO: 3455518 - RNA, 23 nt, Human
ucaauagccacuaaccuugccug

SEQ ID NO: 3455519 - RNA, 19 nt, Human
ucaauaggaaaaacugauu

SEQ ID NO: 3455520 - RNA, 19 nt, Human
ucaauaguaaaagauaaca

SEQ ID NO: 3455521 - RNA, 14 nt, Human
ucaauagucaagaa

SEQ ID NO: 3455522 - RNA, 20 nt, Human
ucaauaguguccuaugcaau

SEQ ID NO: 3455523 - RNA, 17 nt, Human
ucaauaguucaaggaac

SEQ ID NO: 3455524 - RNA, 12 nt, Human
ucaauaguugaa

SEQ ID NO: 3455525 - RNA, 13 nt, Human
ucaauaguugaau

SEQ ID NO: 3455526 - RNA, 15 nt, Human
ucaauauauuuguau

SEQ ID NO: 3455527 - RNA, 13 nt, Human
ucaauaugcuuac

SEQ ID NO: 3455528 - RNA, 15 nt, Human
ucaauauuaaauaca

SEQ ID NO: 3455529 - RNA, 12 nt, Human
ucaauauugaau

SEQ ID NO: 3455530 - RNA, 19 nt, Human
ucaauauugaauuuuuccu

SEQ ID NO: 3455531 - RNA, 13 nt, Human
ucaauauugacau

SEQ ID NO: 3455532 - RNA, 17 nt, Human
ucaauauugacauuugu

SEQ ID NO: 3455533 - RNA, 18 nt, Human
ucaauauugucauuccug

SEQ ID NO: 3455534 - RNA, 11 nt, Human
ucaauauuuau

SEQ ID NO: 3455535 - RNA, 21 nt, Human
ucaaucaaauaaguauuuaua

SEQ ID NO: 3455536 - RNA, 12 nt, Human
ucaaucacuguc

SEQ ID NO: 3455537 - RNA, 22 nt, Human
ucaaucagucucagaaugucau

SEQ ID NO: 3455538 - RNA, 15 nt, Human
ucaaucaucugugug

SEQ ID NO: 3455539 - RNA, 16 nt, Human
ucaaucaucuguguga

SEQ ID NO: 3455540 - RNA, 19 nt, Human
ucaaucaucugugugaaaa

SEQ ID NO: 3455541 - RNA, 14 nt, Human
ucaaucauuguaca

SEQ ID NO: 3455542 - RNA, 16 nt, Human
ucaaucauuguacagu

SEQ ID NO: 3455543 - RNA, 13 nt, Human
ucaaucauuucuc

SEQ ID NO: 3455544 - RNA, 19 nt, Human
ucaaucauuucucacugug

SEQ ID NO: 3455545 - RNA, 16 nt, Human
ucaaucccaaaaguca

SEQ ID NO: 3455546 - RNA, 21 nt, Human
ucaauccuaauuucuccuccc

SEQ ID NO: 3455547 - RNA, 20 nt, Human
ucaauccugauuccucucua

SEQ ID NO: 3455548 - RNA, 17 nt, Human
ucaaucucguauagaag

SEQ ID NO: 3455549 - RNA, 19 nt, Human
ucaaucucugggggcugag

SEQ ID NO: 3455550 - RNA, 21 nt, Human
ucaaucugaagauacaugucu

SEQ ID NO: 3455551 - RNA, 16 nt, Human
ucaaucuguaaacugu

SEQ ID NO: 3455552 - RNA, 20 nt, Human
ucaaucuugcauguaacgca

SEQ ID NO: 3455553 - RNA, 18 nt, Human
ucaaucuuuaaaccaauu

SEQ ID NO: 3455554 - RNA, 22 nt, Human
ucaaugaaaaauagugucuuug

SEQ ID NO: 3455555 - RNA, 16 nt, Human
ucaaugaaccauaaau

SEQ ID NO: 3455556 - RNA, 17 nt, Human
ucaaugaaccauaaauu

SEQ ID NO: 3455557 - RNA, 16 nt, Human
ucaaugaagccagcuc

SEQ ID NO: 3455558 - RNA, 21 nt, Human
ucaaugaauuuuauaaucugc

SEQ ID NO: 3455559 - RNA, 15 nt, Human
ucaaugacaugaauu

SEQ ID NO: 3455560 - RNA, 21 nt, Human
ucaaugacaugaauuuuagcu

SEQ ID NO: 3455561 - RNA, 23 nt, Human
ucaaugacaugaauuuuagcuuu

SEQ ID NO: 3455562 - RNA, 14 nt, Human
ucaaugagagcaua

SEQ ID NO: 3455563 - RNA, 13 nt, Human
ucaaugagcaugu

SEQ ID NO: 3455564 - RNA, 14 nt, Human
ucaaugagcauguu

SEQ ID NO: 3455565 - RNA, 17 nt, Human
ucaaugagcauguuuag

SEQ ID NO: 3455566 - RNA, 19 nt, Human
ucaaugagcauguuuagac

SEQ ID NO: 3455567 - RNA, 21 nt, Human
ucaaugagcauguuuagacuu

SEQ ID NO: 3455568 - RNA, 10 nt, Human
ucaaugaucu

SEQ ID NO: 3455569 - RNA, 19 nt, Human
ucaaugaucuagguuuaac

SEQ ID NO: 3455570 - RNA, 22 nt, Human
ucaaugaucuagguuuaacuca

SEQ ID NO: 3455571 - RNA, 16 nt, Human
ucaaugauuauuuuca

SEQ ID NO: 3455572 - RNA, 18 nt, Human
ucaaugcaguugucucug

SEQ ID NO: 3455573 - RNA, 19 nt, Human
ucaaugcaguugucucugu

SEQ ID NO: 3455574 - RNA, 20 nt, Human
ucaaugccccugaauuuaaa

SEQ ID NO: 3455575 - RNA, 14 nt, Human
ucaaugcucauaac

SEQ ID NO: 3455576 - RNA, 17 nt, Human
ucaaugcuggagaaaaa

SEQ ID NO: 3455577 - RNA, 15 nt, Human
ucaaugcuguuuggg

SEQ ID NO: 3455578 - RNA, 22 nt, Human
ucaaugcuguuuggguuuccaa

SEQ ID NO: 3455579 - RNA, 21 nt, Human
ucaauggaguaugucugaugg

SEQ ID NO: 3455580 - RNA, 23 nt, Human
ucaauguacuaggauacugcugc

SEQ ID NO: 3455581 - RNA, 15 nt, Human
ucaaugugaaucaga

SEQ ID NO: 3455582 - RNA, 21 nt, Human
ucaaugugauauaaacagcuu

SEQ ID NO: 3455583 - RNA, 17 nt, Human
ucaaugugauucuaaug

SEQ ID NO: 3455584 - RNA, 21 nt, Human
ucaaugugauucuaaugucuu

SEQ ID NO: 3455585 - RNA, 14 nt, Human
ucaauguguauaaa

SEQ ID NO: 3455586 - RNA, 17 nt, Human
ucaaugugucuuucuaa

SEQ ID NO: 3455587 - RNA, 20 nt, Human
ucaaugugucuuucuaagaa

SEQ ID NO: 3455588 - RNA, 15 nt, Human
ucaauguuuucaguu

SEQ ID NO: 3455589 - RNA, 21 nt, Human
ucaauuaaacggauuauuuuu

SEQ ID NO: 3455590 - RNA, 13 nt, Human
ucaauuaaaugua

SEQ ID NO: 3455591 - RNA, 20 nt, Human
ucaauuacaggaaguacugg

SEQ ID NO: 3455592 - RNA, 13 nt, Human
ucaauuaccacac

SEQ ID NO: 3455593 - RNA, 15 nt, Human
ucaauuacucuauaa

SEQ ID NO: 3455594 - RNA, 19 nt, Human
ucaauuagaauaguguucu

SEQ ID NO: 3455595 - RNA, 22 nt, Human
ucaauucaaagcuguguguuug

SEQ ID NO: 3455596 - RNA, 17 nt, Human
ucaauucauaucuauuu

SEQ ID NO: 3455597 - RNA, 22 nt, Human
ucaauuccguagccagcugcuc

SEQ ID NO: 3455598 - RNA, 17 nt, Human
ucaauuccugggcccca

SEQ ID NO: 3455599 - RNA, 23 nt, Human
ucaauucuguagguuaaaaaaau

SEQ ID NO: 3455600 - RNA, 23 nt, Human
ucaauucuucccuaucuuugcca

SEQ ID NO: 3455601 - RNA, 15 nt, Human
ucaauucuugccaaa

SEQ ID NO: 3455602 - RNA, 16 nt, Human
ucaauugcaucuccca

SEQ ID NO: 3455603 - RNA, 17 nt, Human
ucaauugcaucucccag

SEQ ID NO: 3455604 - RNA, 18 nt, Human
ucaguaaaauuauacugu

SEQ ID NO: 3455605 - RNA, 21 nt, Human
ucaguaaaauuauacugugug

SEQ ID NO: 3455606 - RNA, 16 nt, Human
ucaguaaaccugucug

SEQ ID NO: 3455607 - RNA, 17 nt, Human
ucaguaaaccugucuga

SEQ ID NO: 3455608 - RNA, 22 nt, Human
ucaguaaauaacaggcauuugu

SEQ ID NO: 3455609 - RNA, 15 nt, Human
ucaguaacugucagg

SEQ ID NO: 3455610 - RNA, 21 nt, Human
ucaguaacuuacccuuaggga

SEQ ID NO: 3455611 - RNA, 21 nt, Human
ucaguaagacgacaaggaaag

SEQ ID NO: 3455612 - RNA, 22 nt, Human
ucaguaagacgacaaggaaagg

SEQ ID NO: 3455613 - RNA, 14 nt, Human
ucaguaaguuaucu

SEQ ID NO: 3455614 - RNA, 19 nt, Human
ucaguaauaaacuguguuu

SEQ ID NO: 3455615 - RNA, 14 nt, Human
ucaguaauuugagg

SEQ ID NO: 3455616 - RNA, 18 nt, Human
ucaguaauuugaggacaa

SEQ ID NO: 3455617 - RNA, 13 nt, Human
ucaguacccaccu

SEQ ID NO: 3455618 - RNA, 15 nt, Human
ucaguacccaccuga

SEQ ID NO: 3455619 - RNA, 17 nt, Human
ucaguacccucucagcu

SEQ ID NO: 3455620 - RNA, 18 nt, Human
gcucccagccaggcccuu

SEQ ID NO: 3455621 - RNA, 15 nt, Human
gcucccagccucagc

SEQ ID NO: 3455622 - RNA, 17 nt, Human
gcucccagccucagcgc

SEQ ID NO: 3455623 - RNA, 12 nt, Human
gcucccaggaac

SEQ ID NO: 3455624 - RNA, 12 nt, Human
gcucccaggaca

SEQ ID NO: 3455625 - RNA, 20 nt, Human
gcucccaggagccugcccag

SEQ ID NO: 3455626 - RNA, 20 nt, Human
gcucccaggcauuccccagg

SEQ ID NO: 3455627 - RNA, 22 nt, Human
gcucccaggccgagaagccagu

SEQ ID NO: 3455628 - RNA, 23 nt, Human
gcucccaggccgagaagccagug

SEQ ID NO: 3455629 - RNA, 12 nt, Human
gcucccagggca

SEQ ID NO: 3455630 - RNA, 20 nt, Human
gcucccaggggcucccuccg

SEQ ID NO: 3455631 - RNA, 21 nt, Human
gcucccaggggcucccuccgc

SEQ ID NO: 3455632 - RNA, 21 nt, Human
gcucccaggggucucccuggc

SEQ ID NO: 3455633 - RNA, 22 nt, Human
gcucccaggggucucccuggcu

SEQ ID NO: 3455634 - RNA, 22 nt, Human
gcucccaggugcagccagaggc

SEQ ID NO: 3455635 - RNA, 19 nt, Human
gcucccagugucuuccugu

SEQ ID NO: 3455636 - RNA, 21 nt, Human
gcucccauucacucuuccaga

SEQ ID NO: 3455637 - RNA, 20 nt, Human
gcuccccacagcgucccugg

SEQ ID NO: 3455638 - RNA, 21 nt, Human
gcuccccacagcgucccuggc

SEQ ID NO: 3455639 - RNA, 16 nt, Human
gcuccccacucugcuc

SEQ ID NO: 3455640 - RNA, 22 nt, Human
gcuccccacucugcucugaugc

SEQ ID NO: 3455641 - RNA, 20 nt, Human
gcuccccacugccuacugca

SEQ ID NO: 3455642 - RNA, 15 nt, Human
gcuccccagcccagg

SEQ ID NO: 3455643 - RNA, 14 nt, Human
gcuccccagcccug

SEQ ID NO: 3455644 - RNA, 15 nt, Human
gcuccccagcccugg

SEQ ID NO: 3455645 - RNA, 19 nt, Human
gcuccccagcccuggcucu

SEQ ID NO: 3455646 - RNA, 20 nt, Human
gcuccccagcccuggcucug

SEQ ID NO: 3455647 - RNA, 12 nt, Human
gcuccccaugug

SEQ ID NO: 3455648 - RNA, 14 nt, Human
gcucccccaccccc

SEQ ID NO: 3455649 - RNA, 13 nt, Human
gcucccccagcuc

SEQ ID NO: 3455650 - RNA, 17 nt, Human
gcucccccauccucccc

SEQ ID NO: 3455651 - RNA, 20 nt, Human
gcucccccauccuccccuuc

SEQ ID NO: 3455652 - RNA, 15 nt, Human
gcucccccgggaggg

SEQ ID NO: 3455653 - RNA, 18 nt, Human
gcucccccuccaccugcu

SEQ ID NO: 3455654 - RNA, 13 nt, Human
gcucccccugucc

SEQ ID NO: 3455655 - RNA, 13 nt, Human
gcucccccuuuuc

SEQ ID NO: 3455656 - RNA, 16 nt, Human
gcuccccgccuguucc

SEQ ID NO: 3455657 - RNA, 17 nt, Human
gcuccccgccuguuccc

SEQ ID NO: 3455658 - RNA, 20 nt, Human
gcuccccgccuguucccccg

SEQ ID NO: 3455659 - RNA, 14 nt, Human
gcuccccuccccaa

SEQ ID NO: 3455660 - RNA, 15 nt, Human
gcuccccucccuccu

SEQ ID NO: 3455661 - RNA, 18 nt, Human
gcuccccuccucuccccu

SEQ ID NO: 3455662 - RNA, 15 nt, Human
gcuccccucuuccuc

SEQ ID NO: 3455663 - RNA, 16 nt, Human
gcuccccucuuccucu

SEQ ID NO: 3455664 - RNA, 16 nt, Human
gcuccccuuccccuuc

SEQ ID NO: 3455665 - RNA, 12 nt, Human
gcucccgcccgu

SEQ ID NO: 3455666 - RNA, 14 nt, Human
gcucccucacucuc

SEQ ID NO: 3455667 - RNA, 19 nt, Human
ucacugacacaaaggaagu

SEQ ID NO: 3455668 - RNA, 22 nt, Human
ucacugagacagcccgggcucu

SEQ ID NO: 3455669 - RNA, 22 nt, Human
ucacugaggccugagacccagg

SEQ ID NO: 3455670 - RNA, 21 nt, Human
ucacugaguuuuccauggcag

SEQ ID NO: 3455671 - RNA, 23 nt, Human
ucacugaguuuuccauggcagga

SEQ ID NO: 3455672 - RNA, 20 nt, Human
ucacugauauuuuuuauaca

SEQ ID NO: 3455673 - RNA, 16 nt, Human
ucacugaugggaaaac

SEQ ID NO: 3455674 - RNA, 18 nt, Human
ucacugaugggaaaacug

SEQ ID NO: 3455675 - RNA, 14 nt, Human
ucacugauguacaa

SEQ ID NO: 3455676 - RNA, 18 nt, Human
ucacugcaaccuccgccu

SEQ ID NO: 3455677 - RNA, 18 nt, Human
ucacugcaaccucugccu

SEQ ID NO: 3455678 - RNA, 16 nt, Human
ucacugcaaccuucac

SEQ ID NO: 3455679 - RNA, 17 nt, Human
ucacugcaacuucugcc

SEQ ID NO: 3455680 - RNA, 18 nt, Human
ucacugcaacuucugccu

SEQ ID NO: 3455681 - RNA, 15 nt, Human
ucacugcagccucaa

SEQ ID NO: 3455682 - RNA, 22 nt, Human
ucacugcagccuccuucuccug

SEQ ID NO: 3455683 - RNA, 13 nt, Human
ucacugcaggcac

SEQ ID NO: 3455684 - RNA, 19 nt, Human
ucacugccacacucuccau

SEQ ID NO: 3455685 - RNA, 16 nt, Human
ucacugccacuuugca

SEQ ID NO: 3455686 - RNA, 22 nt, Human
ucacugccacuuugcacauuuu

SEQ ID NO: 3455687 - RNA, 23 nt, Human
ucacugccacuuugcacauuuug

SEQ ID NO: 3455688 - RNA, 16 nt, Human
ucacugccaggccagc

SEQ ID NO: 3455689 - RNA, 19 nt, Human
ucacugcccgcacacccuc

SEQ ID NO: 3455690 - RNA, 20 nt, Human
ucacugcccgcacacccuca

SEQ ID NO: 3455691 - RNA, 11 nt, Human
ucacugccucu

SEQ ID NO: 3455692 - RNA, 14 nt, Human
ucacugccuuugcu

SEQ ID NO: 3455693 - RNA, 19 nt, Human
ucacugcucccugaagcca

SEQ ID NO: 3455694 - RNA, 21 nt, Human
ucacugcucccugaagccagc

SEQ ID NO: 3455695 - RNA, 18 nt, Human
ucacugcugcaaggccuu

SEQ ID NO: 3455696 - RNA, 16 nt, Human
ucacugcuggcugccu

SEQ ID NO: 3455697 - RNA, 11 nt, Human
ucacugcuguc

SEQ ID NO: 3455698 - RNA, 23 nt, Human
ucacugcuguuauauuucaucau

SEQ ID NO: 3455699 - RNA, 18 nt, Human
ucacugcuuaacuucaca

SEQ ID NO: 3455700 - RNA, 20 nt, Human
ucacugcuuaacuucacaua

SEQ ID NO: 3455701 - RNA, 15 nt, Human
ucacugcuugaugaa

SEQ ID NO: 3455702 - RNA, 21 nt, Human
ucacuggaaaggggagagccu

SEQ ID NO: 3455703 - RNA, 18 nt, Human
ucacuggaccacugggca

SEQ ID NO: 3455704 - RNA, 15 nt, Human
ucacuggagcacaau

SEQ ID NO: 3455705 - RNA, 18 nt, Human
ucacuggagcaccaggca

SEQ ID NO: 3455706 - RNA, 11 nt, Human
ucacuggagcc

SEQ ID NO: 3455707 - RNA, 22 nt, Human
ucacuggaguuacauuaauguu

SEQ ID NO: 3455708 - RNA, 13 nt, Human
ucacuggaugaaa

SEQ ID NO: 3455709 - RNA, 14 nt, Human
ucacuggaugaaga

SEQ ID NO: 3455710 - RNA, 19 nt, Human
ucacuggaugaagauucuc

SEQ ID NO: 3455711 - RNA, 16 nt, Human
ucacuggcaaugaaaa

SEQ ID NO: 3455712 - RNA, 18 nt, Human
ucacuggcagccccagca

SEQ ID NO: 3455713 - RNA, 19 nt, Human
ucacuggcagccccagcac

SEQ ID NO: 3455714 - RNA, 15 nt, Human
ucacuggcaucuuug

SEQ ID NO: 3455715 - RNA, 13 nt, Human
ucacuggcauggu

SEQ ID NO: 3455716 - RNA, 22 nt, Human
ucacuggcgacacguagcagcu

SEQ ID NO: 3455717 - RNA, 12 nt, Human
ucacuggcucuc

SEQ ID NO: 3455718 - RNA, 14 nt, Human
ucacuggcucucca

SEQ ID NO: 3455719 - RNA, 17 nt, Human
ucacuggcugccuccac

SEQ ID NO: 3455720 - RNA, 13 nt, Human
ucacuggggcaga

SEQ ID NO: 3455721 - RNA, 16 nt, Human
ucacugggguccuggg

SEQ ID NO: 3455722 - RNA, 18 nt, Human
ucacuggguggggugagg

SEQ ID NO: 3455723 - RNA, 20 nt, Human
ucacuggguggggugaggac

SEQ ID NO: 3455724 - RNA, 19 nt, Human
ucacugguagaccaaaaua

SEQ ID NO: 3455725 - RNA, 20 nt, Human
ucacugguagaccaaaauaa

SEQ ID NO: 3455726 - RNA, 23 nt, Human
ucacuguauaaauaggagaggau

SEQ ID NO: 3455727 - RNA, 23 nt, Human
ucacugucaaugauuauuuucau

SEQ ID NO: 3455728 - RNA, 19 nt, Human
ucacuguccuccaagccag

SEQ ID NO: 3455729 - RNA, 19 nt, Human
ucacugucuuuaauucugu

SEQ ID NO: 3455730 - RNA, 17 nt, Human
ucacugucuuuccuaga

SEQ ID NO: 3455731 - RNA, 16 nt, Human
ucacugugagcuccca

SEQ ID NO: 3455732 - RNA, 20 nt, Human
ucacugugcuguuguuauga

SEQ ID NO: 3455733 - RNA, 23 nt, Human
ucacugugcuguuguuaugaugu

SEQ ID NO: 3455734 - RNA, 18 nt, Human
ucacugugggaaggccag

SEQ ID NO: 3455735 - RNA, 15 nt, Human
ucacuguguauauuu

SEQ ID NO: 3455736 - RNA, 19 nt, Human
ucacuguguauauuugauu

SEQ ID NO: 3455737 - RNA, 17 nt, Human
ucacugugucacccagg

SEQ ID NO: 3455738 - RNA, 22 nt, Human
ucacuguuagcuuuuuaaaaca

SEQ ID NO: 3455739 - RNA, 18 nt, Human
ucacuguucccucugcuc

SEQ ID NO: 3455740 - RNA, 19 nt, Human
ucacuguucccucugcucc

SEQ ID NO: 3455741 - RNA, 20 nt, Human
ucacuguugaaaauuauuuu

SEQ ID NO: 3455742 - RNA, 16 nt, Human
ucacuguugcccaggc

SEQ ID NO: 3455743 - RNA, 20 nt, Human
ucacuguuuagaacacacac

SEQ ID NO: 3455744 - RNA, 18 nt, Human
ucacuguuucucugcugu

SEQ ID NO: 3455745 - RNA, 17 nt, Human
ucacuguuuuuagacac

SEQ ID NO: 3455746 - RNA, 21 nt, Human
ucacuguuuuuagacaccuuc

SEQ ID NO: 3455747 - RNA, 15 nt, Human
ucacuuaacaaacaa

SEQ ID NO: 3455748 - RNA, 20 nt, Human
ucacuuaacauuccuaaaau

SEQ ID NO: 3455749 - RNA, 22 nt, Human
ucacuuaacauuccuaaaaugc

SEQ ID NO: 3455750 - RNA, 16 nt, Human
ucacuuaauugcuaca

SEQ ID NO: 3455751 - RNA, 16 nt, Human
ucacuuacuguuucug

SEQ ID NO: 3455752 - RNA, 13 nt, Human
ucacuuauaccug

SEQ ID NO: 3455753 - RNA, 17 nt, Human
ucacuuauauguucuaa

SEQ ID NO: 3455754 - RNA, 13 nt, Human
ucacuuaucaguu

SEQ ID NO: 3455755 - RNA, 22 nt, Human
ucacuuaugaaugauuugcaua

SEQ ID NO: 3455756 - RNA, 15 nt, Human
ucacuucacccugga

SEQ ID NO: 3455757 - RNA, 21 nt, Human
ucacuucacugugcuguuguu

SEQ ID NO: 3455758 - RNA, 21 nt, Human
ucacuucagguauaccucacu

SEQ ID NO: 3455759 - RNA, 14 nt, Human
ucacuucaucuucu

SEQ ID NO: 3455760 - RNA, 18 nt, Human
ucacuucggccagagcug

SEQ ID NO: 3455761 - RNA, 17 nt, Human
ucacuucugagaacuca

SEQ ID NO: 3455762 - RNA, 13 nt, Human
ucacuugaaugug

SEQ ID NO: 3455763 - RNA, 14 nt, Human
ucacuugagacaaa

SEQ ID NO: 3455764 - RNA, 12 nt, Human
uccacaguugcc

SEQ ID NO: 3455765 - RNA, 21 nt, Human
uccacaguugccaccaccucu

SEQ ID NO: 3455766 - RNA, 16 nt, Human
uccacauagguuuaga

SEQ ID NO: 3455767 - RNA, 14 nt, Human
uccacaucugccuu

SEQ ID NO: 3455768 - RNA, 18 nt, Human
uccacaucugccuuaaaa

SEQ ID NO: 3455769 - RNA, 13 nt, Human
uccacaugcucug

SEQ ID NO: 3455770 - RNA, 13 nt, Human
uccacauuucuaa

SEQ ID NO: 3455771 - RNA, 16 nt, Human
uccaccaacccaucag

SEQ ID NO: 3455772 - RNA, 23 nt, Human
uccaccaagccuggucagcccaa

SEQ ID NO: 3455773 - RNA, 13 nt, Human
uccaccaccacug

SEQ ID NO: 3455774 - RNA, 17 nt, Human
uccaccacccaaaaguc

SEQ ID NO: 3455775 - RNA, 14 nt, Human
uccaccaccucccu

SEQ ID NO: 3455776 - RNA, 19 nt, Human
uccaccagcaucaccugcc

SEQ ID NO: 3455777 - RNA, 21 nt, Human
uccaccaggaaccucuucaga

SEQ ID NO: 3455778 - RNA, 15 nt, Human
uccaccagucauuuu

SEQ ID NO: 3455779 - RNA, 18 nt, Human
uccaccagucauuuuuca

SEQ ID NO: 3455780 - RNA, 24 nt, Human
uccaccauggcuaaggcaccagcc

SEQ ID NO: 3455781 - RNA, 13 nt, Human
uccacccaccuca

SEQ ID NO: 3455782 - RNA, 17 nt, Human
uccacccaccucagccu

SEQ ID NO: 3455783 - RNA, 18 nt, Human
uccacccaccucagccuc

SEQ ID NO: 3455784 - RNA, 12 nt, Human
uccacccagccc

SEQ ID NO: 3455785 - RNA, 14 nt, Human
uccacccagcccau

SEQ ID NO: 3455786 - RNA, 17 nt, Human
uccacccaggagccccg

SEQ ID NO: 3455787 - RNA, 20 nt, Human
uccacccaggagccccgagg

SEQ ID NO: 3455788 - RNA, 22 nt, Human
uccacccaggggcagccccagg

SEQ ID NO: 3455789 - RNA, 12 nt, Human
uccaccccagga

SEQ ID NO: 3455790 - RNA, 23 nt, Human
uccaccccagugcacccacucug

SEQ ID NO: 3455791 - RNA, 23 nt, Human
uccacccccgccucccuccccug

SEQ ID NO: 3455792 - RNA, 18 nt, Human
uccacccccucccuggcc

SEQ ID NO: 3455793 - RNA, 12 nt, Human
uccacccucuga

SEQ ID NO: 3455794 - RNA, 12 nt, Human
uccacccugcuc

SEQ ID NO: 3455795 - RNA, 13 nt, Human
uccacccugcucu

SEQ ID NO: 3455796 - RNA, 18 nt, Human
uccacccugucccccagc

SEQ ID NO: 3455797 - RNA, 20 nt, Human
uccacccuuggccugucuca

SEQ ID NO: 3455798 - RNA, 16 nt, Human
uccaccgcagaaggaa

SEQ ID NO: 3455799 - RNA, 15 nt, Human
uccaccgcugcucca

SEQ ID NO: 3455800 - RNA, 14 nt, Human
uccaccguccccuc

SEQ ID NO: 3455801 - RNA, 12 nt, Human
uccaccucagcc

SEQ ID NO: 3455802 - RNA, 16 nt, Human
uccaccucagccuugg

SEQ ID NO: 3455803 - RNA, 13 nt, Human
uccaccucccucc

SEQ ID NO: 3455804 - RNA, 13 nt, Human
uccaccucccugc

SEQ ID NO: 3455805 - RNA, 12 nt, Human
uccaccuccuuc

SEQ ID NO: 3455806 - RNA, 16 nt, Human
uccaccuccuucucug

SEQ ID NO: 3455807 - RNA, 13 nt, Human
uccaccucuggga

SEQ ID NO: 3455808 - RNA, 17 nt, Human
uccaccugccagggaca

SEQ ID NO: 3455809 - RNA, 20 nt, Human
uccaccugucucagccuccc

SEQ ID NO: 3455810 - RNA, 17 nt, Human
uccaccuuaaauuaaac

SEQ ID NO: 3455811 - RNA, 23 nt, Human
uccaccuuccauuuucccccacu

SEQ ID NO: 3455812 - RNA, 12 nt, Human
uccaccuucuca

SEQ ID NO: 3455813 - RNA, 14 nt, Human
uccaccuucucaca

SEQ ID NO: 3455814 - RNA, 15 nt, Human
uccaccuucucacau

SEQ ID NO: 3455815 - RNA, 18 nt, Human
uccaccuuucagcccacg

SEQ ID NO: 3455816 - RNA, 14 nt, Human
uccaccuuucccaa

SEQ ID NO: 3455817 - RNA, 17 nt, Human
uccacgagagcgcagca

SEQ ID NO: 3455818 - RNA, 22 nt, Human
uccacgagcuguuuacuaggga

SEQ ID NO: 3455819 - RNA, 19 nt, Human
uccacgcugucuccagacc

SEQ ID NO: 3455820 - RNA, 20 nt, Human
uccacgcugucuccagaccc

SEQ ID NO: 3455821 - RNA, 15 nt, Human
uccacggagccacuc

SEQ ID NO: 3455822 - RNA, 16 nt, Human
uccacggucuguucuu

SEQ ID NO: 3455823 - RNA, 18 nt, Human
uccacggucuguucuuga

SEQ ID NO: 3455824 - RNA, 15 nt, Human
uccacguacugcagc

SEQ ID NO: 3455825 - RNA, 20 nt, Human
uccacguauuccccuuccca

SEQ ID NO: 3455826 - RNA, 18 nt, Human
uccacgucccccuggggc

SEQ ID NO: 3455827 - RNA, 20 nt, Human
uccacguucugcucaucauu

SEQ ID NO: 3455828 - RNA, 21 nt, Human
uccacguucugcucaucauuc

SEQ ID NO: 3455829 - RNA, 14 nt, Human
uccacuaaaaauau

SEQ ID NO: 3455830 - RNA, 16 nt, Human
uccacuaaccccgggc

SEQ ID NO: 3455831 - RNA, 17 nt, Human
uccacuacaccuggcug

SEQ ID NO: 3455832 - RNA, 18 nt, Human
uccacuacaccuggcuga

SEQ ID NO: 3455833 - RNA, 20 nt, Human
ucagaaacccucauuguguu

SEQ ID NO: 3455834 - RNA, 21 nt, Human
ucagaaacccucauuguguuu

SEQ ID NO: 3455835 - RNA, 12 nt, Human
ucagaaacuguu

SEQ ID NO: 3455836 - RNA, 12 nt, Human
ucagaaagaagu

SEQ ID NO: 3455837 - RNA, 14 nt, Human
ucagaaagagcaag

SEQ ID NO: 3455838 - RNA, 23 nt, Human
ucagaaagagcaagucuggaucu

SEQ ID NO: 3455839 - RNA, 17 nt, Human
ucagaaaggaaaaacaa

SEQ ID NO: 3455840 - RNA, 20 nt, Human
ucagaaaggaaaaacaaacu

SEQ ID NO: 3455841 - RNA, 18 nt, Human
ucagaaagggagggcucu

SEQ ID NO: 3455842 - RNA, 22 nt, Human
ucagaaauaauaaaaaauuuca

SEQ ID NO: 3455843 - RNA, 22 nt, Human
ucagaaauacagauaaaugauu

SEQ ID NO: 3455844 - RNA, 20 nt, Human
ucagaaauauaacacauuuu

SEQ ID NO: 3455845 - RNA, 17 nt, Human
ucagaaaugacuuuuug

SEQ ID NO: 3455846 - RNA, 21 nt, Human
ucagaaaugucuggagaauaa

SEQ ID NO: 3455847 - RNA, 17 nt, Human
ucagaaauuuuuaucag

SEQ ID NO: 3455848 - RNA, 19 nt, Human
ucagaaauuuuuaucaguu

SEQ ID NO: 3455849 - RNA, 14 nt, Human
ucagaacaaauuca

SEQ ID NO: 3455850 - RNA, 19 nt, Human
ucagaacaccaagacuuga

SEQ ID NO: 3455851 - RNA, 16 nt, Human
ucagaacagagccuuu

SEQ ID NO: 3455852 - RNA, 16 nt, Human
ucagaacagcuguuga

SEQ ID NO: 3455853 - RNA, 15 nt, Human
ucagaacaguaucuu

SEQ ID NO: 3455854 - RNA, 22 nt, Human
ucagaaccauccauaguaguau

SEQ ID NO: 3455855 - RNA, 16 nt, Human
ucagaacccagggcuc

SEQ ID NO: 3455856 - RNA, 20 nt, Human
ucagaaccucuuccccagaa

SEQ ID NO: 3455857 - RNA, 15 nt, Human
ucagaacugugccac

SEQ ID NO: 3455858 - RNA, 17 nt, Human
ucagaagaaaaagaagc

SEQ ID NO: 3455859 - RNA, 18 nt, Human
ucagaagaaaaagaagca

SEQ ID NO: 3455860 - RNA, 12 nt, Human
ucagaagaaaga

SEQ ID NO: 3455861 - RNA, 16 nt, Human
ucagaagaaauaaaua

SEQ ID NO: 3455862 - RNA, 17 nt, Human
ucagaagagaggggaag

SEQ ID NO: 3455863 - RNA, 20 nt, Human
ucagaagcacagaauauuuu

SEQ ID NO: 3455864 - RNA, 16 nt, Human
ucagaagccucugggu

SEQ ID NO: 3455865 - RNA, 15 nt, Human
ucagaagccugaggc

SEQ ID NO: 3455866 - RNA, 20 nt, Human
ucagaagccugaggcuggga

SEQ ID NO: 3455867 - RNA, 15 nt, Human
ucagaagccuggggg

SEQ ID NO: 3455868 - RNA, 20 nt, Human
ucagaagccugggggccugg

SEQ ID NO: 3455869 - RNA, 21 nt, Human
ucagaagccugggggccuggc

SEQ ID NO: 3455870 - RNA, 12 nt, Human
ucagaaggagaa

SEQ ID NO: 3455871 - RNA, 16 nt, Human
ucagaaggagaaggaa

SEQ ID NO: 3455872 - RNA, 18 nt, Human
ucagaaggagaaggaagg

SEQ ID NO: 3455873 - RNA, 19 nt, Human
ucagaaggagaaggaagga

SEQ ID NO: 3455874 - RNA, 23 nt, Human
ucagaaggagaaggaaggagacu

SEQ ID NO: 3455875 - RNA, 18 nt, Human
ucagaaggcaaaugacuu

SEQ ID NO: 3455876 - RNA, 14 nt, Human
ucagaaggcuucau

SEQ ID NO: 3455877 - RNA, 21 nt, Human
ucagaagggagcuagccagag

SEQ ID NO: 3455878 - RNA, 16 nt, Human
ucagaagggaggcugg

SEQ ID NO: 3455879 - RNA, 15 nt, Human
ucagaaguccagagu

SEQ ID NO: 3455880 - RNA, 19 nt, Human
ucagaagugagcuuugcug

SEQ ID NO: 3455881 - RNA, 17 nt, Human
ucagaaguuuaaauauu

SEQ ID NO: 3455882 - RNA, 23 nt, Human
ucagaaguuuaaauauuaagcau

SEQ ID NO: 3455883 - RNA, 22 nt, Human
ucagaaguuucugccgcagccc

SEQ ID NO: 3455884 - RNA, 17 nt, Human
ucagaaucugaauguaa

SEQ ID NO: 3455885 - RNA, 14 nt, Human
ucagaaucuuuccu

SEQ ID NO: 3455886 - RNA, 21 nt, Human
ucagaaucuuuccuuccucuc

SEQ ID NO: 3455887 - RNA, 16 nt, Human
ucagaaucuuuguuaa

SEQ ID NO: 3455888 - RNA, 17 nt, Human
ucagaaucuuuguuaag

SEQ ID NO: 3455889 - RNA, 14 nt, Human
ucagaaugucauuu

SEQ ID NO: 3455890 - RNA, 16 nt, Human
ucagaauuauuuuuaa

SEQ ID NO: 3455891 - RNA, 10 nt, Human
ucagaauucu

SEQ ID NO: 3455892 - RNA, 14 nt, Human
ucagaauuuagugu

SEQ ID NO: 3455893 - RNA, 13 nt, Human
ucagacacaaaca

SEQ ID NO: 3455894 - RNA, 13 nt, Human
ucagacacagauu

SEQ ID NO: 3455895 - RNA, 16 nt, Human
ucagacagaacuugaa

SEQ ID NO: 3455896 - RNA, 18 nt, Human
ucagacagcugccuggga

SEQ ID NO: 3455897 - RNA, 16 nt, Human
ucagacauaaagccau

SEQ ID NO: 3455898 - RNA, 19 nt, Human
ucagacauagaauuaacac

SEQ ID NO: 3455899 - RNA, 22 nt, Human
ucagacauccauguuuguaaaa

SEQ ID NO: 3455900 - RNA, 22 nt, Human
ucagacaucugagguuuuauuu

SEQ ID NO: 3455901 - RNA, 14 nt, Human
ucagaccacggcuc

SEQ ID NO: 3455902 - RNA, 14 nt, Human
ucagaccagcucuu

SEQ ID NO: 3455903 - RNA, 23 nt, Human
ucagaccauaauguuacauuauu

SEQ ID NO: 3455904 - RNA, 13 nt, Human
ucagaccccagcg

SEQ ID NO: 3455905 - RNA, 13 nt, Human
ucagacccuaccc

SEQ ID NO: 3455906 - RNA, 20 nt, Human
ucagaccuuggaucagauga

SEQ ID NO: 3455907 - RNA, 21 nt, Human
ucagacuaagaaauauuccaa

SEQ ID NO: 3455908 - RNA, 14 nt, Human
ucagacuagugaca

SEQ ID NO: 3455909 - RNA, 17 nt, Human
ucagacucuaagaaaga

SEQ ID NO: 3455910 - RNA, 17 nt, Human
ucaggcuggugggaggg

SEQ ID NO: 3455911 - RNA, 23 nt, Human
ucaggcugucaguguuuggugca

SEQ ID NO: 3455912 - RNA, 14 nt, Human
ucaggcuuccuugg

SEQ ID NO: 3455913 - RNA, 15 nt, Human
ucaggcuuccuuggc

SEQ ID NO: 3455914 - RNA, 21 nt, Human
ucaggcuuucacuauuuccuu

SEQ ID NO: 3455915 - RNA, 19 nt, Human
ucagggaaacuaagauucu

SEQ ID NO: 3455916 - RNA, 16 nt, Human
ucagggaagauaaguu

SEQ ID NO: 3455917 - RNA, 17 nt, Human
ucagggaaggaggagcc

SEQ ID NO: 3455918 - RNA, 21 nt, Human
ucagggaaggaggagccuguc

SEQ ID NO: 3455919 - RNA, 15 nt, Human
ucagggaccaaggac

SEQ ID NO: 3455920 - RNA, 12 nt, Human
ucagggaccccu

SEQ ID NO: 3455921 - RNA, 17 nt, Human
ucagggaccccugcccu

SEQ ID NO: 3455922 - RNA, 15 nt, Human
ucagggaggcccugu

SEQ ID NO: 3455923 - RNA, 22 nt, Human
ucagggaggcccugugccccuu

SEQ ID NO: 3455924 - RNA, 13 nt, Human
ucagggagugcug

SEQ ID NO: 3455925 - RNA, 23 nt, Human
ucagggauagcacugagcaaagc

SEQ ID NO: 3455926 - RNA, 21 nt, Human
ucagggcaaagccaggucccu

SEQ ID NO: 3455927 - RNA, 22 nt, Human
ucagggcaaagccaggucccuc

SEQ ID NO: 3455928 - RNA, 18 nt, Human
ucagggcagauuuuaguu

SEQ ID NO: 3455929 - RNA, 15 nt, Human
ucagggcagcgccag

SEQ ID NO: 3455930 - RNA, 14 nt, Human
ucagggcagguggg

SEQ ID NO: 3455931 - RNA, 17 nt, Human
ucagggccaugcugagg

SEQ ID NO: 3455932 - RNA, 19 nt, Human
ucagggccaugcugaggcc

SEQ ID NO: 3455933 - RNA, 21 nt, Human
ucagggccaugcugaggccug

SEQ ID NO: 3455934 - RNA, 14 nt, Human
ucagggcccaaguc

SEQ ID NO: 3455935 - RNA, 18 nt, Human
ucagggcccagaggcuga

SEQ ID NO: 3455936 - RNA, 14 nt, Human
ucagggccuggcuc

SEQ ID NO: 3455937 - RNA, 21 nt, Human
ucagggccuggggccugagag

SEQ ID NO: 3455938 - RNA, 23 nt, Human
ucagggcgcacagcaugagaggc

SEQ ID NO: 3455939 - RNA, 13 nt, Human
ucagggcuccucc

SEQ ID NO: 3455940 - RNA, 15 nt, Human
ucagggcuccuccca

SEQ ID NO: 3455941 - RNA, 16 nt, Human
ucagggcuccucccag

SEQ ID NO: 3455942 - RNA, 17 nt, Human
ucagggcuccucccagc

SEQ ID NO: 3455943 - RNA, 18 nt, Human
ucagggcuccucccagcu

SEQ ID NO: 3455944 - RNA, 13 nt, Human
ucagggcuccugc

SEQ ID NO: 3455945 - RNA, 15 nt, Human
ucagggcuccugccu

SEQ ID NO: 3455946 - RNA, 23 nt, Human
ucagggcuccugccuucuguccu

SEQ ID NO: 3455947 - RNA, 23 nt, Human
ucagggcuccuugugggccuggg

SEQ ID NO: 3455948 - RNA, 14 nt, Human
ucaggggagaaaaa

SEQ ID NO: 3455949 - RNA, 20 nt, Human
ucaggggagucccgucagga

SEQ ID NO: 3455950 - RNA, 12 nt, Human
ucaggggccaga

SEQ ID NO: 3455951 - RNA, 16 nt, Human
ucaggggccagaggaa

SEQ ID NO: 3455952 - RNA, 20 nt, Human
ucaggggcccuggagcagcc

SEQ ID NO: 3455953 - RNA, 16 nt, Human
ucaggggcugcccgcu

SEQ ID NO: 3455954 - RNA, 16 nt, Human
ucagggggaagaagca

SEQ ID NO: 3455955 - RNA, 17 nt, Human
ucagggggaagaagcag

SEQ ID NO: 3455956 - RNA, 19 nt, Human
ucagggggaagaagcagag

SEQ ID NO: 3455957 - RNA, 22 nt, Human
ucagggggaagaagcagagaga

SEQ ID NO: 3455958 - RNA, 20 nt, Human
ucaggggucugagcuccagc

SEQ ID NO: 3455959 - RNA, 15 nt, Human
ucaggggugacacag

SEQ ID NO: 3455960 - RNA, 16 nt, Human
ucaggggugacacaga

SEQ ID NO: 3455961 - RNA, 20 nt, Human
ucaggggugacacagacuca

SEQ ID NO: 3455962 - RNA, 22 nt, Human
ucagggguucgagaccagucug

SEQ ID NO: 3455963 - RNA, 17 nt, Human
ucaggguaaauaggaau

SEQ ID NO: 3455964 - RNA, 14 nt, Human
ucaggguauugcuu

SEQ ID NO: 3455965 - RNA, 14 nt, Human
ucagggucccuggu

SEQ ID NO: 3455966 - RNA, 18 nt, Human
ucagggucucugcugccg

SEQ ID NO: 3455967 - RNA, 16 nt, Human
ucagggugaugccagg

SEQ ID NO: 3455968 - RNA, 21 nt, Human
ucaggguucuccucuccccuc

SEQ ID NO: 3455969 - RNA, 17 nt, Human
ucaggguuggccccugc

SEQ ID NO: 3455970 - RNA, 19 nt, Human
ucaggguuggccccugccc

SEQ ID NO: 3455971 - RNA, 21 nt, Human
ucagguaacaggcagauacag

SEQ ID NO: 3455972 - RNA, 22 nt, Human
ucagguaacaggcagauacagg

SEQ ID NO: 3455973 - RNA, 19 nt, Human
ucagguacagagaaggaau

SEQ ID NO: 3455974 - RNA, 16 nt, Human
ucagguaggggggaaa

SEQ ID NO: 3455975 - RNA, 23 nt, Human
ucaggucacauaaaacuuuguau

SEQ ID NO: 3455976 - RNA, 12 nt, Human
ucaggucccugc

SEQ ID NO: 3455977 - RNA, 14 nt, Human
ucaggugaaaaugu

SEQ ID NO: 3455978 - RNA, 21 nt, Human
ucaggugaaacuccagaugcc

SEQ ID NO: 3455979 - RNA, 16 nt, Human
ucaggugaaaggaaau

SEQ ID NO: 3455980 - RNA, 15 nt, Human
ucaggugacauguga

SEQ ID NO: 3455981 - RNA, 15 nt, Human
ucaggugagaagcag

SEQ ID NO: 3455982 - RNA, 21 nt, Human
ucaggugagaagcagaggaag

SEQ ID NO: 3455983 - RNA, 21 nt, Human
ucaggugcccaucccuggaag

SEQ ID NO: 3455984 - RNA, 20 nt, Human
ucaggugcugccauccaggu

SEQ ID NO: 3455985 - RNA, 16 nt, Human
ucaggugcuguccaug

SEQ ID NO: 3455986 - RNA, 11 nt, Human
ucagguggcca

SEQ ID NO: 3455987 - RNA, 15 nt, Human
ucagguggggcagcu

SEQ ID NO: 3455988 - RNA, 20 nt, Human
ucagguggggcagcuugagg

SEQ ID NO: 3455989 - RNA, 20 nt, Human
ucagguggggucacucuggc

SEQ ID NO: 3455990 - RNA, 23 nt, Human
ucagguggggucacucuggcagc

SEQ ID NO: 3455991 - RNA, 17 nt, Human
ucaggugucccugcacu

SEQ ID NO: 3455992 - RNA, 14 nt, Human
ucagguguugccaa

SEQ ID NO: 3455993 - RNA, 19 nt, Human
ucagguuaggcaguauaaa

SEQ ID NO: 3455994 - RNA, 20 nt, Human
ucagguuauuuauuuuauaa

SEQ ID NO: 3455995 - RNA, 18 nt, Human
ucagguucuuagugucac

SEQ ID NO: 3455996 - RNA, 21 nt, Human
ucagguugcugguugcugugu

SEQ ID NO: 3455997 - RNA, 17 nt, Human
ucagguuguaguaaaga

SEQ ID NO: 3455998 - RNA, 22 nt, Human
ucagguugucugaagucacugc

SEQ ID NO: 3455999 - RNA, 14 nt, Human
ucagguuguuggug

SEQ ID NO: 3456000 - RNA, 17 nt, Human
ucagguuuaacauuugc

SEQ ID NO: 3456001 - RNA, 13 nt, Human
ucagguuuggggu

SEQ ID NO: 3456002 - RNA, 19 nt, Human
ucagguuugucaucagaug

SEQ ID NO: 3456003 - RNA, 15 nt, Human
ucagguuuguuuugu

SEQ ID NO: 3456004 - RNA, 23 nt, Human
ucagguuuucuuuuaagaaucaa

SEQ ID NO: 3456005 - RNA, 14 nt, Human
ucagguuuuguaaa

SEQ ID NO: 3456006 - RNA, 14 nt, Human
ucaguaaacacugu

SEQ ID NO: 3456007 - RNA, 15 nt, Human
ucaguaacagggccu

SEQ ID NO: 3456008 - RNA, 22 nt, Human
ucaguaacccccuuaaauuuaa

SEQ ID NO: 3456009 - RNA, 23 nt, Human
ucaguaacccccuuaaauuuaau

SEQ ID NO: 3456010 - RNA, 13 nt, Human
ucaguaagacgac

SEQ ID NO: 3456011 - RNA, 18 nt, Human
ucaguaauuuagaaauca

SEQ ID NO: 3456012 - RNA, 22 nt, Human
ucaguacccaccugagcuuugg

SEQ ID NO: 3456013 - RNA, 16 nt, Human
ucaguacccucucagc

SEQ ID NO: 3456014 - RNA, 17 nt, Human
ucaguacuucagcaaga

SEQ ID NO: 3456015 - RNA, 21 nt, Human
ucaguacuucagcaagagaga

SEQ ID NO: 3456016 - RNA, 22 nt, Human
ucaguacuugugaaacacagcu

SEQ ID NO: 3456017 - RNA, 14 nt, Human
ucaguagccagcau

SEQ ID NO: 3456018 - RNA, 18 nt, Human
ucaguaggacuccuuauu

SEQ ID NO: 3456019 - RNA, 23 nt, Human
ucaguaggugcccagaauaaguu

SEQ ID NO: 3456020 - RNA, 14 nt, Human
ucaguaguuugcau

SEQ ID NO: 3456021 - RNA, 20 nt, Human
ucaguauaauucuguacuga

SEQ ID NO: 3456022 - RNA, 18 nt, Human
ucaguaucuguaucucuc

SEQ ID NO: 3456023 - RNA, 24 nt, Human
ucaguaucuguaucucucucucuu

SEQ ID NO: 3456024 - RNA, 23 nt, Human
ucaguaugcugccccugucuugc

SEQ ID NO: 3456025 - RNA, 15 nt, Human
ucaguauguugucaa

SEQ ID NO: 3456026 - RNA, 16 nt, Human
ucaguauguugucaaa

SEQ ID NO: 3456027 - RNA, 17 nt, Human
ucaguauguugucaaag

SEQ ID NO: 3456028 - RNA, 17 nt, Human
ucaguauguuuuacacu

SEQ ID NO: 3456029 - RNA, 16 nt, Human
ucaguauuaauacuaa

SEQ ID NO: 3456030 - RNA, 17 nt, Human
ucaguauuauguaguug

SEQ ID NO: 3456031 - RNA, 19 nt, Human
ucaguauugaagcauuuua

SEQ ID NO: 3456032 - RNA, 14 nt, Human
ucaguauuguuuug

SEQ ID NO: 3456033 - RNA, 15 nt, Human
ucaguauuuaacuaa

SEQ ID NO: 3456034 - RNA, 15 nt, Human
ucaguauuucagugu

SEQ ID NO: 3456035 - RNA, 20 nt, Human
ucaguauuuuggagaaauua

SEQ ID NO: 3456036 - RNA, 13 nt, Human
ucagucaaaacuu

SEQ ID NO: 3456037 - RNA, 16 nt, Human
ucagucaauauuuuua

SEQ ID NO: 3456038 - RNA, 14 nt, Human
ucagucacagccac

SEQ ID NO: 3456039 - RNA, 20 nt, Human
ucagucacuaaaaggaagac

SEQ ID NO: 3456040 - RNA, 20 nt, Human
ucagucagaaaacuuuaaaa

SEQ ID NO: 3456041 - RNA, 23 nt, Human
ucaguccaagggguccccuccag

SEQ ID NO: 3456042 - RNA, 16 nt, Human
aagaaacucaccccca

SEQ ID NO: 3456043 - RNA, 21 nt, Human
aagaaacucuauggucuuaua

SEQ ID NO: 3456044 - RNA, 16 nt, Human
aagaaacugaggaauu

SEQ ID NO: 3456045 - RNA, 19 nt, Human
aagaaacugaggaauuuuc

SEQ ID NO: 3456046 - RNA, 11 nt, Human
aagaaacuuuc

SEQ ID NO: 3456047 - RNA, 16 nt, Human
aagaaacuuuuguaaa

SEQ ID NO: 3456048 - RNA, 14 nt, Human
aagaaagaacggaa

SEQ ID NO: 3456049 - RNA, 16 nt, Human
aagaaagaacggaaga

SEQ ID NO: 3456050 - RNA, 13 nt, Human
aagaaagaaggaa

SEQ ID NO: 3456051 - RNA, 14 nt, Human
aagaaagaaggaag

SEQ ID NO: 3456052 - RNA, 16 nt, Human
aagaaagacucuauuc

SEQ ID NO: 3456053 - RNA, 22 nt, Human
aagaaagacucuauucucaaag

SEQ ID NO: 3456054 - RNA, 16 nt, Human
gcugcugauuuaaaca

SEQ ID NO: 3456055 - RNA, 12 nt, Human
gcugcugcccag

SEQ ID NO: 3456056 - RNA, 18 nt, Human
gcugcugcccauguuuca

SEQ ID NO: 3456057 - RNA, 18 nt, Human
ucccacugcacccccucc

SEQ ID NO: 3456058 - RNA, 13 nt, Human
ucccacugcccac

SEQ ID NO: 3456059 - RNA, 14 nt, Human
ucccacugccucag

SEQ ID NO: 3456060 - RNA, 20 nt, Human
ucccacugccucagguuccu

SEQ ID NO: 3456061 - RNA, 23 nt, Human
ucccacugccucagguuccuaug

SEQ ID NO: 3456062 - RNA, 13 nt, Human
ucccacuguauga

SEQ ID NO: 3456063 - RNA, 18 nt, Human
ucccacuguaugauuuau

SEQ ID NO: 3456064 - RNA, 17 nt, Human
ucccacuucccugacac

SEQ ID NO: 3456065 - RNA, 16 nt, Human
ucccacuucugccaga

SEQ ID NO: 3456066 - RNA, 21 nt, Human
ucccacuuggcaucagcuggc

SEQ ID NO: 3456067 - RNA, 14 nt, Human
ucccacuuggccaa

SEQ ID NO: 3456068 - RNA, 12 nt, Human
ucccagaaauua

SEQ ID NO: 3456069 - RNA, 17 nt, Human
ucccagaacacacucca

SEQ ID NO: 3456070 - RNA, 20 nt, Human
ucccagaagaugacugaggg

SEQ ID NO: 3456071 - RNA, 14 nt, Human
ucccagaaucccag

SEQ ID NO: 3456072 - RNA, 16 nt, Human
ucccagacuacuauuu

SEQ ID NO: 3456073 - RNA, 23 nt, Human
ucccagacuacuauuuucuuuuu

SEQ ID NO: 3456074 - RNA, 16 nt, Human
ucccagagacaggaaa

SEQ ID NO: 3456075 - RNA, 18 nt, Human
ucccagagacaggaaaau

SEQ ID NO: 3456076 - RNA, 20 nt, Human
ucccagagacaggaaaaucc

SEQ ID NO: 3456077 - RNA, 17 nt, Human
ucccagagcaggaggcc

SEQ ID NO: 3456078 - RNA, 18 nt, Human
ucccagagcaggaggccc

SEQ ID NO: 3456079 - RNA, 16 nt, Human
ucccagaggagccacc

SEQ ID NO: 3456080 - RNA, 21 nt, Human
ucccagaggagccaccaguuc

SEQ ID NO: 3456081 - RNA, 23 nt, Human
ucccagaggagccaccaguucuc

SEQ ID NO: 3456082 - RNA, 16 nt, Human
ucccagaggggccugc

SEQ ID NO: 3456083 - RNA, 14 nt, Human
ucccagagguccag

SEQ ID NO: 3456084 - RNA, 15 nt, Human
ucccagaguccucug

SEQ ID NO: 3456085 - RNA, 23 nt, Human
ucccagcacaugaaaccuuauuu

SEQ ID NO: 3456086 - RNA, 12 nt, Human
ucccagcaccug

SEQ ID NO: 3456087 - RNA, 21 nt, Human
ucccagcacuuugggaggccg

SEQ ID NO: 3456088 - RNA, 22 nt, Human
ucccagcacuuugggaggccua

SEQ ID NO: 3456089 - RNA, 22 nt, Human
ucccagcacuuugggaggcuga

SEQ ID NO: 3456090 - RNA, 13 nt, Human
ucccagcagccag

SEQ ID NO: 3456091 - RNA, 18 nt, Human
ucccagcagggccacucc

SEQ ID NO: 3456092 - RNA, 14 nt, Human
ucccagccaccccg

SEQ ID NO: 3456093 - RNA, 20 nt, Human
ucccagccaccccgggcucu

SEQ ID NO: 3456094 - RNA, 24 nt, Human
ucccagccaccccgggcucucugc

SEQ ID NO: 3456095 - RNA, 14 nt, Human
ucccagccaggccc

SEQ ID NO: 3456096 - RNA, 11 nt, Human
ucccagcccaa

SEQ ID NO: 3456097 - RNA, 17 nt, Human
ucccagcccccugacca

SEQ ID NO: 3456098 - RNA, 13 nt, Human
ucccagccccugc

SEQ ID NO: 3456099 - RNA, 19 nt, Human
ucccagccccugccccuca

SEQ ID NO: 3456100 - RNA, 15 nt, Human
ucccagcccuaugga

SEQ ID NO: 3456101 - RNA, 22 nt, Human
ucccagcccuuugggaggcuga

SEQ ID NO: 3456102 - RNA, 13 nt, Human
ucccagccggcca

SEQ ID NO: 3456103 - RNA, 19 nt, Human
ucccagccggccaauggaa

SEQ ID NO: 3456104 - RNA, 22 nt, Human
ucccagccggccaauggaaacc

SEQ ID NO: 3456105 - RNA, 23 nt, Human
ucccagccggccaauggaaaccu

SEQ ID NO: 3456106 - RNA, 10 nt, Human
ucccagccug

SEQ ID NO: 3456107 - RNA, 18 nt, Human
ucccagcggcuggugcag

SEQ ID NO: 3456108 - RNA, 23 nt, Human
ucccagcggcuggugcagggccu

SEQ ID NO: 3456109 - RNA, 16 nt, Human
ucccagcuacaccuuu

SEQ ID NO: 3456110 - RNA, 22 nt, Human
ucccagcuacucaagaggcuga

SEQ ID NO: 3456111 - RNA, 23 nt, Human
ucccagcuacucagaagccugag

SEQ ID NO: 3456112 - RNA, 22 nt, Human
ucccagcuacucgggaggcuga

SEQ ID NO: 3456113 - RNA, 16 nt, Human
ucccagcuacuuggga

SEQ ID NO: 3456114 - RNA, 23 nt, Human
ucccagcuaggaagagcaggacu

SEQ ID NO: 3456115 - RNA, 16 nt, Human
ucccagcucacgucac

SEQ ID NO: 3456116 - RNA, 19 nt, Human
ucccagcucucccucuggc

SEQ ID NO: 3456117 - RNA, 21 nt, Human
ucccagcucucccucuggccc

SEQ ID NO: 3456118 - RNA, 24 nt, Human
ucccagcugacaguccucuccacc

SEQ ID NO: 3456119 - RNA, 22 nt, Human
ucccagcugugcucuggacagg

SEQ ID NO: 3456120 - RNA, 19 nt, Human
ucccagcuucggcauuuga

SEQ ID NO: 3456121 - RNA, 19 nt, Human
ucccagcuuguaggagcug

SEQ ID NO: 3456122 - RNA, 16 nt, Human
ucccaggaagcccagg

SEQ ID NO: 3456123 - RNA, 11 nt, Human
ucccaggacac

SEQ ID NO: 3456124 - RNA, 18 nt, Human
ucccaggacaccacaccc

SEQ ID NO: 3456125 - RNA, 17 nt, Human
ucccaggaccacaggcu

SEQ ID NO: 3456126 - RNA, 15 nt, Human
ucccaggagacaguu

SEQ ID NO: 3456127 - RNA, 16 nt, Human
ucccaggagacaguuc

SEQ ID NO: 3456128 - RNA, 17 nt, Human
ucccaggagcugcccag

SEQ ID NO: 3456129 - RNA, 18 nt, Human
ucccaggagcugcccaga

SEQ ID NO: 3456130 - RNA, 23 nt, Human
ucccaggagcugcccagaguugc

SEQ ID NO: 3456131 - RNA, 15 nt, Human
ucccaggcaaauaaa

SEQ ID NO: 3456132 - RNA, 20 nt, Human
ucccaggcaaauaaaauucc

SEQ ID NO: 3456133 - RNA, 13 nt, Human
ucccaggcaaggc

SEQ ID NO: 3456134 - RNA, 15 nt, Human
ucccaggcaaggcug

SEQ ID NO: 3456135 - RNA, 16 nt, Human
ucccaggcaaggcugu

SEQ ID NO: 3456136 - RNA, 18 nt, Human
ucccaggcacuguacuaa

SEQ ID NO: 3456137 - RNA, 23 nt, Human
ucccaggcauuccccaggaggcc

SEQ ID NO: 3456138 - RNA, 21 nt, Human
ucccaggccaggcuccuuccu

SEQ ID NO: 3456139 - RNA, 20 nt, Human
ucccaggcccacugugccuc

SEQ ID NO: 3456140 - RNA, 21 nt, Human
ucccaggccccuggaggcugc

SEQ ID NO: 3456141 - RNA, 22 nt, Human
ucccaggccccuggaggcugcc

SEQ ID NO: 3456142 - RNA, 15 nt, Human
ucccaggcugagccu

SEQ ID NO: 3456143 - RNA, 16 nt, Human
ucccagggacaccugg

SEQ ID NO: 3456144 - RNA, 16 nt, Human
ucccagggagcaaggg

SEQ ID NO: 3456145 - RNA, 21 nt, Human
ucccagggccagggcccugca

SEQ ID NO: 3456146 - RNA, 18 nt, Human
ucccaggggucucccugg

SEQ ID NO: 3456147 - RNA, 18 nt, Human
ucccaggguagcccgccu

SEQ ID NO: 3456148 - RNA, 21 nt, Human
ucccaggguagcccgccugcc

SEQ ID NO: 3456149 - RNA, 19 nt, Human
ucccagguaagcaggagga

SEQ ID NO: 3456150 - RNA, 17 nt, Human
ucccagguaccagcugc

SEQ ID NO: 3456151 - RNA, 18 nt, Human
ucccagguaccagcugcg

SEQ ID NO: 3456152 - RNA, 21 nt, Human
ucccagguaccagcugcgcuu

SEQ ID NO: 3456153 - RNA, 21 nt, Human
ucccagguagcugggauuaca

SEQ ID NO: 3456154 - RNA, 22 nt, Human
ucccagguguuaacauuccaag

SEQ ID NO: 3456155 - RNA, 15 nt, Human
ucccagguuggcucu

SEQ ID NO: 3456156 - RNA, 20 nt, Human
ucccagguuggcucugccag

SEQ ID NO: 3456157 - RNA, 23 nt, Human
ucccaguaccuccugucucuggc

SEQ ID NO: 3456158 - RNA, 23 nt, Human
ucccaguccaccugaggaacugu

SEQ ID NO: 3456159 - RNA, 17 nt, Human
ucccagucuacccagag

SEQ ID NO: 3456160 - RNA, 18 nt, Human
ucccagucuacccagaga

SEQ ID NO: 3456161 - RNA, 22 nt, Human
ucccagucuacccagagaagcc

SEQ ID NO: 3456162 - RNA, 22 nt, Human
ucccagugacacuucagagagc

SEQ ID NO: 3456163 - RNA, 19 nt, Human
ucccagugagucucugggg

SEQ ID NO: 3456164 - RNA, 19 nt, Human
ucccagugccgagaaggaa

SEQ ID NO: 3456165 - RNA, 22 nt, Human
ucccagugccgagaaggaagcc

SEQ ID NO: 3456166 - RNA, 14 nt, Human
ucccaguggccuca

SEQ ID NO: 3456167 - RNA, 19 nt, Human
ucccaguggccucaacccu

SEQ ID NO: 3456168 - RNA, 21 nt, Human
ucccaguggcugcugcccagg

SEQ ID NO: 3456169 - RNA, 10 nt, Human
ucccaguggg

SEQ ID NO: 3456170 - RNA, 20 nt, Human
ucccagugggaggggcaggc

SEQ ID NO: 3456171 - RNA, 22 nt, Human
ucccagugggaggggcaggcug

SEQ ID NO: 3456172 - RNA, 15 nt, Human
ucccaguucaggagu

SEQ ID NO: 3456173 - RNA, 17 nt, Human
ucccaguucucuaggga

SEQ ID NO: 3456174 - RNA, 21 nt, Human
ucccaguuggagcuccagccu

SEQ ID NO: 3456175 - RNA, 15 nt, Human
ucccauaagcuauag

SEQ ID NO: 3456176 - RNA, 17 nt, Human
ucccauagccaggaaac

SEQ ID NO: 3456177 - RNA, 14 nt, Human
ucccaucacuggag

SEQ ID NO: 3456178 - RNA, 22 nt, Human
ucccaucacuggagcaccaggc

SEQ ID NO: 3456179 - RNA, 13 nt, Human
ucccauccaggca

SEQ ID NO: 3456180 - RNA, 15 nt, Human
ucccauccaggcagu

SEQ ID NO: 3456181 - RNA, 13 nt, Human
ucccauccagggc

SEQ ID NO: 3456182 - RNA, 14 nt, Human
ucccaucccauccc

SEQ ID NO: 3456183 - RNA, 16 nt, Human
ucccaucccaucccau

SEQ ID NO: 3456184 - RNA, 20 nt, Human
ucccaucccaucccauccca

SEQ ID NO: 3456185 - RNA, 13 nt, Human
ucccaucccccug

SEQ ID NO: 3456186 - RNA, 20 nt, Human
ucccauccuacccucgggcc

SEQ ID NO: 3456187 - RNA, 14 nt, Human
ucccauccugugug

SEQ ID NO: 3456188 - RNA, 22 nt, Human
ucccaucgucucggccuucaca

SEQ ID NO: 3456189 - RNA, 19 nt, Human
ucccaucuaagcugcagcu

SEQ ID NO: 3456190 - RNA, 22 nt, Human
ucccaucuaagcugcagcuucc

SEQ ID NO: 3456191 - RNA, 13 nt, Human
ucccaucucacac

SEQ ID NO: 3456192 - RNA, 14 nt, Human
ucccaucucacaca

SEQ ID NO: 3456193 - RNA, 16 nt, Human
ucccaucuccacuguu

SEQ ID NO: 3456194 - RNA, 13 nt, Human
ucccaucugggag

SEQ ID NO: 3456195 - RNA, 17 nt, Human
ucccaucugggaguccc

SEQ ID NO: 3456196 - RNA, 17 nt, Human
ucccaugaacacacugu

SEQ ID NO: 3456197 - RNA, 18 nt, Human
uccaaugagcuuucugaa

SEQ ID NO: 3456198 - RNA, 19 nt, Human
uccaaugagcuuucugaac

SEQ ID NO: 3456199 - RNA, 21 nt, Human
uccaaugagcuuucugaacag

SEQ ID NO: 3456200 - RNA, 17 nt, Human
uccaaugccucuugucu

SEQ ID NO: 3456201 - RNA, 18 nt, Human
uccaaugucuggagacca

SEQ ID NO: 3456202 - RNA, 20 nt, Human
uccaauguuagagacuuuuu

SEQ ID NO: 3456203 - RNA, 17 nt, Human
uccaauuaaggauuuua

SEQ ID NO: 3456204 - RNA, 20 nt, Human
uccaauuagcuuauguuaac

SEQ ID NO: 3456205 - RNA, 15 nt, Human
uccaauuaguuuccu

SEQ ID NO: 3456206 - RNA, 21 nt, Human
uccaauuguugacaguucuga

SEQ ID NO: 3456207 - RNA, 22 nt, Human
uccaauuguugacaguucugaa

SEQ ID NO: 3456208 - RNA, 18 nt, Human
uccaauuuaguuguugua

SEQ ID NO: 3456209 - RNA, 22 nt, Human
uccaauuuguaaaaacagcauu

SEQ ID NO: 3456210 - RNA, 15 nt, Human
uccaauuuuaauuua

SEQ ID NO: 3456211 - RNA, 13 nt, Human
uccaauuuuccuu

SEQ ID NO: 3456212 - RNA, 12 nt, Human
uccacaaaauaa

SEQ ID NO: 3456213 - RNA, 20 nt, Human
uccacaaagaaaauuccuau

SEQ ID NO: 3456214 - RNA, 21 nt, Human
uccacaaagaaaauuccuaua

SEQ ID NO: 3456215 - RNA, 20 nt, Human
uccacaaauuauuaaugaaa

SEQ ID NO: 3456216 - RNA, 22 nt, Human
uccacaaccucuuccccccaaa

SEQ ID NO: 3456217 - RNA, 17 nt, Human
uccacaagagcccaggc

SEQ ID NO: 3456218 - RNA, 18 nt, Human
uccacaagagcccaggcc

SEQ ID NO: 3456219 - RNA, 18 nt, Human
uccacaagauucccagag

SEQ ID NO: 3456220 - RNA, 20 nt, Human
uccacaagauucccagagac

SEQ ID NO: 3456221 - RNA, 21 nt, Human
uccacaagauucccagagaca

SEQ ID NO: 3456222 - RNA, 23 nt, Human
uccacaagauucccagagacagg

SEQ ID NO: 3456223 - RNA, 23 nt, Human
uccacacaagggaaggacagaaa

SEQ ID NO: 3456224 - RNA, 14 nt, Human
uccacacacagagg

SEQ ID NO: 3456225 - RNA, 21 nt, Human
uccacacacagcugggcugug

SEQ ID NO: 3456226 - RNA, 19 nt, Human
uccacacacgcaggaacuc

SEQ ID NO: 3456227 - RNA, 18 nt, Human
uccacacccaauuccacu

SEQ ID NO: 3456228 - RNA, 22 nt, Human
uccacacccaggcauagccugg

SEQ ID NO: 3456229 - RNA, 12 nt, Human
uccacaccccca

SEQ ID NO: 3456230 - RNA, 15 nt, Human
uccacacccccaccc

SEQ ID NO: 3456231 - RNA, 13 nt, Human
uccacaccugcgg

SEQ ID NO: 3456232 - RNA, 15 nt, Human
uccacaccugcggcc

SEQ ID NO: 3456233 - RNA, 21 nt, Human
uccacaccuuuuauugacaca

SEQ ID NO: 3456234 - RNA, 13 nt, Human
uccacacugcaca

SEQ ID NO: 3456235 - RNA, 19 nt, Human
uccacagaagcuccaggua

SEQ ID NO: 3456236 - RNA, 15 nt, Human
uccacagaggacaca

SEQ ID NO: 3456237 - RNA, 17 nt, Human
uccacagaggacacaga

SEQ ID NO: 3456238 - RNA, 17 nt, Human
uccacagcaaccccagg

SEQ ID NO: 3456239 - RNA, 19 nt, Human
uccacagcaaccccaggcu

SEQ ID NO: 3456240 - RNA, 17 nt, Human
uccacagccgcagccuc

SEQ ID NO: 3456241 - RNA, 18 nt, Human
uccacagccgcagccucc

SEQ ID NO: 3456242 - RNA, 18 nt, Human
uccacagccugcaaguca

SEQ ID NO: 3456243 - RNA, 17 nt, Human
uccacagcgagggcagc

SEQ ID NO: 3456244 - RNA, 18 nt, Human
uccacagcgagggcagcu

SEQ ID NO: 3456245 - RNA, 20 nt, Human
uccacagcgagggcagcugc

SEQ ID NO: 3456246 - RNA, 15 nt, Human
uccacagcuuccugu

SEQ ID NO: 3456247 - RNA, 17 nt, Human
uccacagggucccacag

SEQ ID NO: 3456248 - RNA, 14 nt, Human
uccacagugacucc

SEQ ID NO: 3456249 - RNA, 16 nt, Human
uccacaguggaaccag

SEQ ID NO: 3456250 - RNA, 15 nt, Human
uccacaguucagugg

SEQ ID NO: 3456251 - RNA, 16 nt, Human
uccacaguucaguggc

SEQ ID NO: 3456252 - RNA, 22 nt, Human
uccacaguucgaccugcggcug

SEQ ID NO: 3456253 - RNA, 14 nt, Human
uccacaguugccac

SEQ ID NO: 3456254 - RNA, 22 nt, Human
gcugguucaggguuggccccug

SEQ ID NO: 3456255 - RNA, 16 nt, Human
gcugguuggagagcua

SEQ ID NO: 3456256 - RNA, 24 nt, Human
gcugguugucauuuuugcaguaga

SEQ ID NO: 3456257 - RNA, 21 nt, Human
gcugguuuuggcaucucuguc

SEQ ID NO: 3456258 - RNA, 20 nt, Human
gcugguuuuguaagaugcug

SEQ ID NO: 3456259 - RNA, 14 nt, Human
gcugguuuuucagu

SEQ ID NO: 3456260 - RNA, 20 nt, Human
gcuguaaaagcaaguccugc

SEQ ID NO: 3456261 - RNA, 14 nt, Human
gcuguaaauaaaug

SEQ ID NO: 3456262 - RNA, 15 nt, Human
gcuguaaauaaaugc

SEQ ID NO: 3456263 - RNA, 18 nt, Human
gcuguaaauuuggcuucu

SEQ ID NO: 3456264 - RNA, 16 nt, Human
gcuguaaggcucuaga

SEQ ID NO: 3456265 - RNA, 23 nt, Human
gcuguaaggcucuagaucauaag

SEQ ID NO: 3456266 - RNA, 15 nt, Human
gcuguacauacuuuu

SEQ ID NO: 3456267 - RNA, 16 nt, Human
gcuguacauacuuuuu

SEQ ID NO: 3456268 - RNA, 22 nt, Human
gcuguacauacuuuuuggguuu

SEQ ID NO: 3456269 - RNA, 22 nt, Human
gcuguacaucuauuuuggauug

SEQ ID NO: 3456270 - RNA, 20 nt, Human
gcuguacugaaguaaaacaa

SEQ ID NO: 3456271 - RNA, 18 nt, Human
gcuguacuucuugaauau

SEQ ID NO: 3456272 - RNA, 20 nt, Human
gcuguagacauuugcuauga

SEQ ID NO: 3456273 - RNA, 20 nt, Human
gcuguaguagcccuuucugu

SEQ ID NO: 3456274 - RNA, 21 nt, Human
gcuguaguagcccuuucugug

SEQ ID NO: 3456275 - RNA, 23 nt, Human
gcuguaguaggcauuuuuaccau

SEQ ID NO: 3456276 - RNA, 14 nt, Human
gcuguauaaaauca

SEQ ID NO: 3456277 - RNA, 20 nt, Human
gcuguaucccaugagccuca

SEQ ID NO: 3456278 - RNA, 19 nt, Human
gcuguauuagucacagaga

SEQ ID NO: 3456279 - RNA, 18 nt, Human
gcuguauugaaucaugua

SEQ ID NO: 3456280 - RNA, 12 nt, Human
gcuguauugucu

SEQ ID NO: 3456281 - RNA, 21 nt, Human
gcugucaagccauuuuuacau

SEQ ID NO: 3456282 - RNA, 14 nt, Human
gcugucaaggcuca

SEQ ID NO: 3456283 - RNA, 17 nt, Human
gcugucaccaaggaaac

SEQ ID NO: 3456284 - RNA, 13 nt, Human
gcugucaccucuc

SEQ ID NO: 3456285 - RNA, 21 nt, Human
gcugucaccucucccacggga

SEQ ID NO: 3456286 - RNA, 18 nt, Human
gcugucaggauugcgaga

SEQ ID NO: 3456287 - RNA, 15 nt, Human
gcugucaguguuugg

SEQ ID NO: 3456288 - RNA, 14 nt, Human
gcugucaucugugc

SEQ ID NO: 3456289 - RNA, 22 nt, Human
gcugucaucugugcacugccca

SEQ ID NO: 3456290 - RNA, 13 nt, Human
gcuguccagacag

SEQ ID NO: 3456291 - RNA, 14 nt, Human
gcuguccagacagc

SEQ ID NO: 3456292 - RNA, 22 nt, Human
gcuguccagacagccuguaucu

SEQ ID NO: 3456293 - RNA, 15 nt, Human
gcuguccagugccca

SEQ ID NO: 3456294 - RNA, 23 nt, Human
gcuguccagugcccauuccucac

SEQ ID NO: 3456295 - RNA, 16 nt, Human
gcuguccaugcuucuc

SEQ ID NO: 3456296 - RNA, 12 nt, Human
gcuguccccucu

SEQ ID NO: 3456297 - RNA, 16 nt, Human
gcuguccccucuugcc

SEQ ID NO: 3456298 - RNA, 23 nt, Human
gcuguccccuuggcagguccugg

SEQ ID NO: 3456299 - RNA, 18 nt, Human
gcugucccugucaccaag

SEQ ID NO: 3456300 - RNA, 23 nt, Human
gcugucccuuacgugaguccugg

SEQ ID NO: 3456301 - RNA, 20 nt, Human
gcugucccuuggaacucuug

SEQ ID NO: 3456302 - RNA, 13 nt, Human
gcuguccuaggcc

SEQ ID NO: 3456303 - RNA, 18 nt, Human
gcuguccucagguggcca

SEQ ID NO: 3456304 - RNA, 16 nt, Human
gcuguccuggaggggc

SEQ ID NO: 3456305 - RNA, 23 nt, Human
gcuguccuggaggggcuggggac

SEQ ID NO: 3456306 - RNA, 14 nt, Human
gcuguccuuuuucc

SEQ ID NO: 3456307 - RNA, 15 nt, Human
gcugucggcgcugcc

SEQ ID NO: 3456308 - RNA, 22 nt, Human
gcugucuccagacccccacccc

SEQ ID NO: 3456309 - RNA, 12 nt, Human
gcugucucugcu

SEQ ID NO: 3456310 - RNA, 13 nt, Human
gcugucucugcuc

SEQ ID NO: 3456311 - RNA, 12 nt, Human
gcugucugcagc

SEQ ID NO: 3456312 - RNA, 20 nt, Human
gcugucugggugcuacuggg

SEQ ID NO: 3456313 - RNA, 22 nt, Human
gcugucugggugcuacugggga

SEQ ID NO: 3456314 - RNA, 21 nt, Human
gcugucuuuucuuugccaucu

SEQ ID NO: 3456315 - RNA, 22 nt, Human
gcugucuuuucuuugccaucuc

SEQ ID NO: 3456316 - RNA, 13 nt, Human
gcugugaacaggc

SEQ ID NO: 3456317 - RNA, 23 nt, Human
gcugugaacccuggggccugacu

SEQ ID NO: 3456318 - RNA, 12 nt, Human
gcugugaccugc

SEQ ID NO: 3456319 - RNA, 19 nt, Human
gcugugaccugcugagcuc

SEQ ID NO: 3456320 - RNA, 17 nt, Human
gcugugacuucuccagg

SEQ ID NO: 3456321 - RNA, 12 nt, Human
gcugugagcccc

SEQ ID NO: 3456322 - RNA, 16 nt, Human
gcugugaggccccugg

SEQ ID NO: 3456323 - RNA, 13 nt, Human
gcugugagggagg

SEQ ID NO: 3456324 - RNA, 20 nt, Human
gcugugagucuuugguucua

SEQ ID NO: 3456325 - RNA, 18 nt, Human
gcugugaguucucccugu

SEQ ID NO: 3456326 - RNA, 22 nt, Human
gcugugauuuuuguugauuaaa

SEQ ID NO: 3456327 - RNA, 19 nt, Human
gcugugcaacgccgugggc

SEQ ID NO: 3456328 - RNA, 23 nt, Human
gcugugcaacgccgugggcugcg

SEQ ID NO: 3456329 - RNA, 21 nt, Human
gcugugcacccagaagaagau

SEQ ID NO: 3456330 - RNA, 14 nt, Human
gcugugccacaggc

SEQ ID NO: 3456331 - RNA, 13 nt, Human
gcugugccacccu

SEQ ID NO: 3456332 - RNA, 17 nt, Human
gcugugccacccugggc

SEQ ID NO: 3456333 - RNA, 21 nt, Human
gcugugccacccugggcucug

SEQ ID NO: 3456334 - RNA, 14 nt, Human
gcugugccucugcc

SEQ ID NO: 3456335 - RNA, 15 nt, Human
gcugugccucugccu

SEQ ID NO: 3456336 - RNA, 16 nt, Human
gcugugccucugccug

SEQ ID NO: 3456337 - RNA, 14 nt, Human
gcugugcucagaga

SEQ ID NO: 3456338 - RNA, 16 nt, Human
gcugugcucuggacag

SEQ ID NO: 3456339 - RNA, 13 nt, Human
gcugugcugcccu

SEQ ID NO: 3456340 - RNA, 14 nt, Human
gcugugcugcccug

SEQ ID NO: 3456341 - RNA, 22 nt, Human
gcuuaggaugugugcaugugug

SEQ ID NO: 3456342 - RNA, 12 nt, Human
gcuuaggauguu

SEQ ID NO: 3456343 - RNA, 12 nt, Human
gcuuagggcccu

SEQ ID NO: 3456344 - RNA, 15 nt, Human
gcuuagggcccugga

SEQ ID NO: 3456345 - RNA, 16 nt, Human
gcuuagggcccuggag

SEQ ID NO: 3456346 - RNA, 15 nt, Human
gcuuaguaaaauuua

SEQ ID NO: 3456347 - RNA, 23 nt, Human
gcuuaguaucucaucaacaaaga

SEQ ID NO: 3456348 - RNA, 15 nt, Human
gcuuagucacugccu

SEQ ID NO: 3456349 - RNA, 16 nt, Human
gcuuaguuuguguguu

SEQ ID NO: 3456350 - RNA, 20 nt, Human
gcuuaguuuguguguugucu

SEQ ID NO: 3456351 - RNA, 21 nt, Human
gcuuaguuuguguguugucuc

SEQ ID NO: 3456352 - RNA, 18 nt, Human
gcuuauaaccuaguuaaa

SEQ ID NO: 3456353 - RNA, 17 nt, Human
gcuuauaauaaaggacu

SEQ ID NO: 3456354 - RNA, 16 nt, Human
gcuuauaauucuuuca

SEQ ID NO: 3456355 - RNA, 12 nt, Human
gcuuauacacuu

SEQ ID NO: 3456356 - RNA, 20 nt, Human
gcuuauacacuuacacuuua

SEQ ID NO: 3456357 - RNA, 18 nt, Human
gcuuauacgaaauaauug

SEQ ID NO: 3456358 - RNA, 15 nt, Human
gcuuauagguggccu

SEQ ID NO: 3456359 - RNA, 13 nt, Human
gcuuauauucaac

SEQ ID NO: 3456360 - RNA, 23 nt, Human
gcuuauauucaaccauggacuuu

SEQ ID NO: 3456361 - RNA, 15 nt, Human
gcuuauauuugugua

SEQ ID NO: 3456362 - RNA, 17 nt, Human
gcuuaucaauaaaccug

SEQ ID NO: 3456363 - RNA, 13 nt, Human
gcuuaucaauuug

SEQ ID NO: 3456364 - RNA, 15 nt, Human
gcuuaucucuuuuau

SEQ ID NO: 3456365 - RNA, 17 nt, Human
gcuuaugaauauauuua

SEQ ID NO: 3456366 - RNA, 16 nt, Human
gcuuaugaauauuuau

SEQ ID NO: 3456367 - RNA, 22 nt, Human
gcuuaugacaucacuuguacaa

SEQ ID NO: 3456368 - RNA, 15 nt, Human
gcuuaugcucuuaau

SEQ ID NO: 3456369 - RNA, 18 nt, Human
gcuuaugcuuaaauucaa

SEQ ID NO: 3456370 - RNA, 15 nt, Human
gcuuaugguaccaga

SEQ ID NO: 3456371 - RNA, 16 nt, Human
gcuuaugguaccagau

SEQ ID NO: 3456372 - RNA, 12 nt, Human
gcuuauguuaac

SEQ ID NO: 3456373 - RNA, 15 nt, Human
gcuuauuacauuuua

SEQ ID NO: 3456374 - RNA, 20 nt, Human
gcuuauucaucuguuuuucu

SEQ ID NO: 3456375 - RNA, 19 nt, Human
gcuuauuccaugacugcuu

SEQ ID NO: 3456376 - RNA, 17 nt, Human
gcuuauugcuuaguaaa

SEQ ID NO: 3456377 - RNA, 14 nt, Human
gcuuauuguuccaa

SEQ ID NO: 3456378 - RNA, 15 nt, Human
gcuuauuguuccaag

SEQ ID NO: 3456379 - RNA, 16 nt, Human
gcuuauuguuucucug

SEQ ID NO: 3456380 - RNA, 14 nt, Human
gcuuauuuaauaaa

SEQ ID NO: 3456381 - RNA, 15 nt, Human
gcuuauuuauuguau

SEQ ID NO: 3456382 - RNA, 17 nt, Human
gcuuauuuauuguauuc

SEQ ID NO: 3456383 - RNA, 12 nt, Human
gcuuauuuuaaa

SEQ ID NO: 3456384 - RNA, 15 nt, Human
gcuuauuuuaaugug

SEQ ID NO: 3456385 - RNA, 22 nt, Human
gcuuauuuuaaugugaugaugu

SEQ ID NO: 3456386 - RNA, 18 nt, Human
gcuucaaggauccugagc

SEQ ID NO: 3456387 - RNA, 16 nt, Human
gcuucaauaaaucuuu

SEQ ID NO: 3456388 - RNA, 19 nt, Human
gcuucaauaguucaaggaa

SEQ ID NO: 3456389 - RNA, 15 nt, Human
gcuucaauuaauaaa

SEQ ID NO: 3456390 - RNA, 15 nt, Human
gcuucaccagagcau

SEQ ID NO: 3456391 - RNA, 19 nt, Human
gcuucaccccaaucccagc

SEQ ID NO: 3456392 - RNA, 19 nt, Human
gcuucacggaagagccuug

SEQ ID NO: 3456393 - RNA, 16 nt, Human
gcuucacuccugcugu

SEQ ID NO: 3456394 - RNA, 17 nt, Human
gcuucacuguauaaaua

SEQ ID NO: 3456395 - RNA, 12 nt, Human
gcuucacuucug

SEQ ID NO: 3456396 - RNA, 18 nt, Human
gcuucagauguggagcca

SEQ ID NO: 3456397 - RNA, 17 nt, Human
gcuucagcauauuuaua

SEQ ID NO: 3456398 - RNA, 15 nt, Human
gcuucagccaggagc

SEQ ID NO: 3456399 - RNA, 19 nt, Human
gcuucagccaggagcuggg

SEQ ID NO: 3456400 - RNA, 12 nt, Human
gcuucagccucc

SEQ ID NO: 3456401 - RNA, 14 nt, Human
gcuucagccuccca

SEQ ID NO: 3456402 - RNA, 14 nt, Human
gcuucagccugagg

SEQ ID NO: 3456403 - RNA, 20 nt, Human
gcuucagccugaggcugaga

SEQ ID NO: 3456404 - RNA, 12 nt, Human
gcuucagcucca

SEQ ID NO: 3456405 - RNA, 13 nt, Human
gcuucagcuccag

SEQ ID NO: 3456406 - RNA, 15 nt, Human
gcuucagcugccagu

SEQ ID NO: 3456407 - RNA, 20 nt, Human
gcuucagguuaucgaaauaa

SEQ ID NO: 3456408 - RNA, 15 nt, Human
gcuucaguggcagcu

SEQ ID NO: 3456409 - RNA, 23 nt, Human
gcuucauacuucaugaaauccug

SEQ ID NO: 3456410 - RNA, 17 nt, Human
gcuucaucauucccucu

SEQ ID NO: 3456411 - RNA, 13 nt, Human
gcuucaucuguca

SEQ ID NO: 3456412 - RNA, 20 nt, Human
gcuucaugaaaauccuacca

SEQ ID NO: 3456413 - RNA, 14 nt, Human
gcuucaugccagcu

SEQ ID NO: 3456414 - RNA, 17 nt, Human
gcuucaugugucccaga

SEQ ID NO: 3456415 - RNA, 22 nt, Human
gcuucauucaagucagcucuuc

SEQ ID NO: 3456416 - RNA, 22 nt, Human
gcuucauucaauauugacauuu

SEQ ID NO: 3456417 - RNA, 17 nt, Human
gcuucauucuuugcagg

SEQ ID NO: 3456418 - RNA, 16 nt, Human
gcuucauuuccugugu

SEQ ID NO: 3456419 - RNA, 15 nt, Human
ucccuucccuccucc

SEQ ID NO: 3456420 - RNA, 20 nt, Human
ucccuuccgacccucuggga

SEQ ID NO: 3456421 - RNA, 22 nt, Human
ucccuuccgacccucugggaac

SEQ ID NO: 3456422 - RNA, 13 nt, Human
ucccuuccuccau

SEQ ID NO: 3456423 - RNA, 17 nt, Human
ucccuuccucuucggcc

SEQ ID NO: 3456424 - RNA, 16 nt, Human
ucccuuccucuuucca

SEQ ID NO: 3456425 - RNA, 17 nt, Human
ucccuuccuuuucccug

SEQ ID NO: 3456426 - RNA, 20 nt, Human
ucccuucgguggaagagcuc

SEQ ID NO: 3456427 - RNA, 15 nt, Human
ucccuucuaccugcc

SEQ ID NO: 3456428 - RNA, 19 nt, Human
ucccuucuacugcuucuac

SEQ ID NO: 3456429 - RNA, 21 nt, Human
ucccuucuccaucucucuggc

SEQ ID NO: 3456430 - RNA, 22 nt, Human
ucccuucuccaucucucuggcc

SEQ ID NO: 3456431 - RNA, 14 nt, Human
ucccuucucccugg

SEQ ID NO: 3456432 - RNA, 15 nt, Human
ucccuucucccugga

SEQ ID NO: 3456433 - RNA, 20 nt, Human
ucccuucuccuugauaacag

SEQ ID NO: 3456434 - RNA, 16 nt, Human
ucccuucucuuccagg

SEQ ID NO: 3456435 - RNA, 20 nt, Human
ucccuucucuuccaggcagc

SEQ ID NO: 3456436 - RNA, 16 nt, Human
ucccuucugucccuca

SEQ ID NO: 3456437 - RNA, 22 nt, Human
ucccuucugucccucacagcac

SEQ ID NO: 3456438 - RNA, 16 nt, Human
ucccuucuugcauccu

SEQ ID NO: 3456439 - RNA, 14 nt, Human
ucccuugaccuuaa

SEQ ID NO: 3456440 - RNA, 13 nt, Human
ucccuugagaccu

SEQ ID NO: 3456441 - RNA, 18 nt, Human
ucccuugagaccucagcc

SEQ ID NO: 3456442 - RNA, 19 nt, Human
ucccuugagaccucagcca

SEQ ID NO: 3456443 - RNA, 14 nt, Human
ucccuugagcccuc

SEQ ID NO: 3456444 - RNA, 15 nt, Human
ucccuugagggcugc

SEQ ID NO: 3456445 - RNA, 16 nt, Human
ucccuugaugaagaag

SEQ ID NO: 3456446 - RNA, 18 nt, Human
ucccuugccccccuggcc

SEQ ID NO: 3456447 - RNA, 12 nt, Human
ucccuugccuca

SEQ ID NO: 3456448 - RNA, 21 nt, Human
ucccuugccuuucgaggccug

SEQ ID NO: 3456449 - RNA, 16 nt, Human
ucccuugcuggcccca

SEQ ID NO: 3456450 - RNA, 21 nt, Human
ucccuugcuggccccagcccu

SEQ ID NO: 3456451 - RNA, 18 nt, Human
ucccuugcuuuucccucu

SEQ ID NO: 3456452 - RNA, 19 nt, Human
ucccuugcuuuucccucuu

SEQ ID NO: 3456453 - RNA, 20 nt, Human
ucccuuggaaaccugcccug

SEQ ID NO: 3456454 - RNA, 16 nt, Human
ucccuuggacauuuua

SEQ ID NO: 3456455 - RNA, 13 nt, Human
ucccuugggcucu

SEQ ID NO: 3456456 - RNA, 14 nt, Human
ucccuugggcucug

SEQ ID NO: 3456457 - RNA, 16 nt, Human
ucccuugggcucugau

SEQ ID NO: 3456458 - RNA, 21 nt, Human
ucccuugggcucugaugaaaa

SEQ ID NO: 3456459 - RNA, 19 nt, Human
ucccuugguggcaagagcc

SEQ ID NO: 3456460 - RNA, 15 nt, Human
ucccuuguagcuccu

SEQ ID NO: 3456461 - RNA, 16 nt, Human
ucccuuguauccccug

SEQ ID NO: 3456462 - RNA, 21 nt, Human
ucccuuguauccccugcaggc

SEQ ID NO: 3456463 - RNA, 13 nt, Human
ucccuugugugug

SEQ ID NO: 3456464 - RNA, 20 nt, Human
ucccuuuagcacguuuaaag

SEQ ID NO: 3456465 - RNA, 17 nt, Human
ucccuuuagcuguguua

SEQ ID NO: 3456466 - RNA, 21 nt, Human
ucccuuucacaaaauuuuauu

SEQ ID NO: 3456467 - RNA, 15 nt, Human
ucccuuucccuuggu

SEQ ID NO: 3456468 - RNA, 18 nt, Human
ucccuuuccuuccauccc

SEQ ID NO: 3456469 - RNA, 23 nt, Human
ucccuuuccuuccaucccuaccc

SEQ ID NO: 3456470 - RNA, 14 nt, Human
ucccuuucuccccu

SEQ ID NO: 3456471 - RNA, 16 nt, Human
ucccuuucuccccugc

SEQ ID NO: 3456472 - RNA, 21 nt, Human
ucccuuucuuggccaguuauc

SEQ ID NO: 3456473 - RNA, 16 nt, Human
ucccuuugacgccauc

SEQ ID NO: 3456474 - RNA, 11 nt, Human
ucccuuugcuc

SEQ ID NO: 3456475 - RNA, 16 nt, Human
ucccuuugcuccaccc

SEQ ID NO: 3456476 - RNA, 19 nt, Human
ucccuuugcuccaccccac

SEQ ID NO: 3456477 - RNA, 14 nt, Human
ucccuuugucuuuc

SEQ ID NO: 3456478 - RNA, 16 nt, Human
ucccuuugucuuucaa

SEQ ID NO: 3456479 - RNA, 18 nt, Human
ucccuuuuaauccuggcu

SEQ ID NO: 3456480 - RNA, 14 nt, Human
ucccuuuuccauga

SEQ ID NO: 3456481 - RNA, 14 nt, Human
ucccuuuucuguuc

SEQ ID NO: 3456482 - RNA, 20 nt, Human
ucccuuuuuauaucccauuu

SEQ ID NO: 3456483 - RNA, 16 nt, Human
ucccuuuuuccuuguc

SEQ ID NO: 3456484 - RNA, 20 nt, Human
ucccuuuuuuggcugcugaa

SEQ ID NO: 3456485 - RNA, 21 nt, Human
ucccuuuuuuuaaguaaggaa

SEQ ID NO: 3456486 - RNA, 22 nt, Human
uccgaaaaauccucuuccucug

SEQ ID NO: 3456487 - RNA, 13 nt, Human
ggaaagcaaagca

SEQ ID NO: 3456488 - RNA, 17 nt, Human
ggaaagcaaagcacaga

SEQ ID NO: 3456489 - RNA, 20 nt, Human
ggaaagcaaagcacagagag

SEQ ID NO: 3456490 - RNA, 21 nt, Human
ggaaagcaaagcacagagagu

SEQ ID NO: 3456491 - RNA, 14 nt, Human
ggaaagcagcucaa

SEQ ID NO: 3456492 - RNA, 18 nt, Human
ggaaagccaccucucccu

SEQ ID NO: 3456493 - RNA, 23 nt, Human
ggaaagccaccucucccucaaca

SEQ ID NO: 3456494 - RNA, 18 nt, Human
ggaaagccagugacucca

SEQ ID NO: 3456495 - RNA, 21 nt, Human
ggaaagccagugacuccagga

SEQ ID NO: 3456496 - RNA, 20 nt, Human
ggaaagcccauaugcuacca

SEQ ID NO: 3456497 - RNA, 23 nt, Human
ggaaagcgccuccaacccuagca

SEQ ID NO: 3456498 - RNA, 19 nt, Human
ggaaaggagccuaggccag

SEQ ID NO: 3456499 - RNA, 21 nt, Human
ggaaaggaugaucaaaaauaa

SEQ ID NO: 3456500 - RNA, 15 nt, Human
ggaaaggccagcugg

SEQ ID NO: 3456501 - RNA, 19 nt, Human
ggaaaggcucagucucagg

SEQ ID NO: 3456502 - RNA, 20 nt, Human
ggaaaggcucagucucagga

SEQ ID NO: 3456503 - RNA, 12 nt, Human
ggaaaggcucca

SEQ ID NO: 3456504 - RNA, 13 nt, Human
ggaaaggcuccag

SEQ ID NO: 3456505 - RNA, 14 nt, Human
ggaaaggcuccagg

SEQ ID NO: 3456506 - RNA, 19 nt, Human
ggaaaggcuccaggagcag

SEQ ID NO: 3456507 - RNA, 20 nt, Human
ggaaagggcccuccuuccua

SEQ ID NO: 3456508 - RNA, 22 nt, Human
ggaaagggcccuccuuccuaaa

SEQ ID NO: 3456509 - RNA, 18 nt, Human
ggaaaggggagagccugc

SEQ ID NO: 3456510 - RNA, 21 nt, Human
ggaaaggggagagccugcugg

SEQ ID NO: 3456511 - RNA, 18 nt, Human
ggaaaggggggagcuggg

SEQ ID NO: 3456512 - RNA, 15 nt, Human
ggaaagggugcugcu

SEQ ID NO: 3456513 - RNA, 23 nt, Human
ggaaaguaagggaagcagaagga

SEQ ID NO: 3456514 - RNA, 19 nt, Human
ggaaaguacacucugcugu

SEQ ID NO: 3456515 - RNA, 23 nt, Human
ggaaaguauucucuuuucaagaa

SEQ ID NO: 3456516 - RNA, 11 nt, Human
ggaaagucaga

SEQ ID NO: 3456517 - RNA, 18 nt, Human
ggaaagucagaaucagaa

SEQ ID NO: 3456518 - RNA, 14 nt, Human
ggaaagugaauuug

SEQ ID NO: 3456519 - RNA, 22 nt, Human
ggaaagugaauuugaaugaaaa

SEQ ID NO: 3456520 - RNA, 19 nt, Human
ggaaagugcugucuuaaac

SEQ ID NO: 3456521 - RNA, 20 nt, Human
ggaaaguggcaccugucugc

SEQ ID NO: 3456522 - RNA, 14 nt, Human
ggaaaguguaaagc

SEQ ID NO: 3456523 - RNA, 17 nt, Human
ggaaaguguaaagcauu

SEQ ID NO: 3456524 - RNA, 18 nt, Human
ggaaaguguaaagcauuc

SEQ ID NO: 3456525 - RNA, 15 nt, Human
ggaaauaaaaccuuu

SEQ ID NO: 3456526 - RNA, 18 nt, Human
ggaaauaaaaccuuucaa

SEQ ID NO: 3456527 - RNA, 20 nt, Human
ggaaauaaaaccuuucaaau

SEQ ID NO: 3456528 - RNA, 17 nt, Human
ggaaauaagaaaaauca

SEQ ID NO: 3456529 - RNA, 18 nt, Human
ggaaauacccuucuuuua

SEQ ID NO: 3456530 - RNA, 18 nt, Human
ggaaauacuguaugguuu

SEQ ID NO: 3456531 - RNA, 14 nt, Human
ggaaauagcuaaua

SEQ ID NO: 3456532 - RNA, 23 nt, Human
ggaaauauauauuauacuuguaa

SEQ ID NO: 3456533 - RNA, 16 nt, Human
ggaaauaucaguuacu

SEQ ID NO: 3456534 - RNA, 22 nt, Human
ggaaauaucaguuacucagccc

SEQ ID NO: 3456535 - RNA, 14 nt, Human
ggaaauauuaugca

SEQ ID NO: 3456536 - RNA, 17 nt, Human
ggaaauauugcuggggu

SEQ ID NO: 3456537 - RNA, 17 nt, Human
ggaaauauuuauuuuaa

SEQ ID NO: 3456538 - RNA, 22 nt, Human
ggaaaucaaaagggccaaagaa

SEQ ID NO: 3456539 - RNA, 17 nt, Human
ggaaaucaaagugcuau

SEQ ID NO: 3456540 - RNA, 21 nt, Human
ggaaaucaccgaaaacguggc

SEQ ID NO: 3456541 - RNA, 23 nt, Human
ggaaaucaccgaaaacguggcug

SEQ ID NO: 3456542 - RNA, 15 nt, Human
ggaaaugaagcaggg

SEQ ID NO: 3456543 - RNA, 17 nt, Human
ggaaaugaauuucucua

SEQ ID NO: 3456544 - RNA, 14 nt, Human
ggaaaugagcaggg

SEQ ID NO: 3456545 - RNA, 15 nt, Human
ggaaauggaauacug

SEQ ID NO: 3456546 - RNA, 22 nt, Human
ggaaaugggcagagcagagacc

SEQ ID NO: 3456547 - RNA, 19 nt, Human
ggaaaugguaugagcugag

SEQ ID NO: 3456548 - RNA, 14 nt, Human
ggaaauuaagaaga

SEQ ID NO: 3456549 - RNA, 23 nt, Human
ggaaauugagauuagagggaggu

SEQ ID NO: 3456550 - RNA, 21 nt, Human
ggaaauuuaaagcagguucuu

SEQ ID NO: 3456551 - RNA, 17 nt, Human
ggaaauuuagcauugua

SEQ ID NO: 3456552 - RNA, 17 nt, Human
ggaacaaaaaaaccaca

SEQ ID NO: 3456553 - RNA, 21 nt, Human
ggaacaaaaaaaccacaaagg

SEQ ID NO: 3456554 - RNA, 23 nt, Human
ggaacaaguugagcuaugacuua

SEQ ID NO: 3456555 - RNA, 19 nt, Human
ggaacaauugaaguaaacu

SEQ ID NO: 3456556 - RNA, 21 nt, Human
ggaacacuagacaagccagaa

SEQ ID NO: 3456557 - RNA, 12 nt, Human
ggaacacucuga

SEQ ID NO: 3456558 - RNA, 12 nt, Human
ggaacacugccc

SEQ ID NO: 3456559 - RNA, 14 nt, Human
ggaacacuggcaga

SEQ ID NO: 3456560 - RNA, 15 nt, Human
ggaacacuggcagac

SEQ ID NO: 3456561 - RNA, 12 nt, Human
ggaacagaagga

SEQ ID NO: 3456562 - RNA, 18 nt, Human
ggaacagacaacagaagu

SEQ ID NO: 3456563 - RNA, 20 nt, Human
ggaacagacaacagaaguca

SEQ ID NO: 3456564 - RNA, 19 nt, Human
ggaacagacuggaagcaca

SEQ ID NO: 3456565 - RNA, 20 nt, Human
ggaacagacuggaagcacag

SEQ ID NO: 3456566 - RNA, 19 nt, Human
ggaacagcuaugggagccc

SEQ ID NO: 3456567 - RNA, 16 nt, Human
ggaacaggaaacugau

SEQ ID NO: 3456568 - RNA, 23 nt, Human
ggaacaguguuucccauaauuuu

SEQ ID NO: 3456569 - RNA, 14 nt, Human
ggaacauacuguuc

SEQ ID NO: 3456570 - RNA, 15 nt, Human
ggaacauccuuugca

SEQ ID NO: 3456571 - RNA, 21 nt, Human
ggaacauccuuugcagggcag

SEQ ID NO: 3456572 - RNA, 16 nt, Human
ggaacauuuauuuuau

SEQ ID NO: 3456573 - RNA, 15 nt, Human
ggaaccaagcaggag

SEQ ID NO: 3456574 - RNA, 11 nt, Human
ggaaccagacu

SEQ ID NO: 3456575 - RNA, 13 nt, Human
ggaaccagacucu

SEQ ID NO: 3456576 - RNA, 12 nt, Human
ggaaccagagcc

SEQ ID NO: 3456577 - RNA, 19 nt, Human
ggaaccagagccauggacu

SEQ ID NO: 3456578 - RNA, 22 nt, Human
ggaaccccccucccacccaccg

SEQ ID NO: 3456579 - RNA, 21 nt, Human
ggaaccccggggugcccacag

SEQ ID NO: 3456580 - RNA, 19 nt, Human
ggaaccccuuucccacccc

SEQ ID NO: 3456581 - RNA, 24 nt, Human
ggaacccuuacaguaggagcccag

SEQ ID NO: 3456582 - RNA, 20 nt, Human
ggaaccgaggcagggaagga

SEQ ID NO: 3456583 - RNA, 15 nt, Human
ggaaccgcaggaagc

SEQ ID NO: 3456584 - RNA, 17 nt, Human
ggaaccgcaggaagcug

SEQ ID NO: 3456585 - RNA, 14 nt, Human
ggaaccgcucaccu

SEQ ID NO: 3456586 - RNA, 20 nt, Human
ggaaccgcucaccuagagcc

SEQ ID NO: 3456587 - RNA, 18 nt, Human
ggaaccucacucuugcca

SEQ ID NO: 3456588 - RNA, 15 nt, Human
ggaaccucagccugg

SEQ ID NO: 3456589 - RNA, 16 nt, Human
ggaaccucagccuggc

SEQ ID NO: 3456590 - RNA, 23 nt, Human
ggaaccucagccuggccagacac

SEQ ID NO: 3456591 - RNA, 18 nt, Human
ggaaccuccccagccugc

SEQ ID NO: 3456592 - RNA, 19 nt, Human
ggaaccuccccagccugcg

SEQ ID NO: 3456593 - RNA, 14 nt, Human
ggaaccucugucuc

SEQ ID NO: 3456594 - RNA, 15 nt, Human
ggaaccucugucuca

SEQ ID NO: 3456595 - RNA, 16 nt, Human
ggaaccugcaaaaaau

SEQ ID NO: 3456596 - RNA, 13 nt, Human
ggaaccugccaug

SEQ ID NO: 3456597 - RNA, 18 nt, Human
ggaaccuggaccaaagcu

SEQ ID NO: 3456598 - RNA, 16 nt, Human
ggaaccuuccuuccug

SEQ ID NO: 3456599 - RNA, 21 nt, Human
ggaaccuuccuuccugcuuga

SEQ ID NO: 3456600 - RNA, 14 nt, Human
ggaacgagagggga

SEQ ID NO: 3456601 - RNA, 16 nt, Human
ggaacgugacugcccc

SEQ ID NO: 3456602 - RNA, 15 nt, Human
ggaacguuggacuuu

SEQ ID NO: 3456603 - RNA, 20 nt, Human
ggaacuagacugccuggguu

SEQ ID NO: 3456604 - RNA, 22 nt, Human
ggaacuagagggauacacugaa

SEQ ID NO: 3456605 - RNA, 13 nt, Human
ggaacucagaucc

SEQ ID NO: 3456606 - RNA, 17 nt, Human
ggaacucagauccaggg

SEQ ID NO: 3456607 - RNA, 19 nt, Human
ggaacucagauccagggac

SEQ ID NO: 3456608 - RNA, 21 nt, Human
ggaacucauuccugccugucu

SEQ ID NO: 3456609 - RNA, 21 nt, Human
ggaacuccuaaaccuuugccc

SEQ ID NO: 3456610 - RNA, 15 nt, Human
ggaacuccuggaaau

SEQ ID NO: 3456611 - RNA, 15 nt, Human
ggaacuccuuggccu

SEQ ID NO: 3456612 - RNA, 16 nt, Human
ggaacuccuuggccua

SEQ ID NO: 3456613 - RNA, 23 nt, Human
ggaacucuaucugggccugggcu

SEQ ID NO: 3456614 - RNA, 19 nt, Human
ggaacucugacaagggcug

SEQ ID NO: 3456615 - RNA, 17 nt, Human
ggaacugaacauuccag

SEQ ID NO: 3456616 - RNA, 20 nt, Human
ggaacugaagggggcggccu

SEQ ID NO: 3456617 - RNA, 13 nt, Human
ggaacugcagacc

SEQ ID NO: 3456618 - RNA, 17 nt, Human
ggaacugcagaccuguc

SEQ ID NO: 3456619 - RNA, 17 nt, Human
ggaacuggaauccuuuc

SEQ ID NO: 3456620 - RNA, 15 nt, Human
ggaacuggaggcagg

SEQ ID NO: 3456621 - RNA, 17 nt, Human
ggaacuggccaagcuga

SEQ ID NO: 3456622 - RNA, 17 nt, Human
ggaacuguccagagagc

SEQ ID NO: 3456623 - RNA, 21 nt, Human
ucccaagugagucucucuggg

SEQ ID NO: 3456624 - RNA, 17 nt, Human
ucccaagugccagucuu

SEQ ID NO: 3456625 - RNA, 22 nt, Human
ucccaaguuuccauagcaacag

SEQ ID NO: 3456626 - RNA, 18 nt, Human
ucccaaguuuuaggacaa

SEQ ID NO: 3456627 - RNA, 22 nt, Human
ucccaauagcaacguagcuucu

SEQ ID NO: 3456628 - RNA, 14 nt, Human
ucccaaucagcacu

SEQ ID NO: 3456629 - RNA, 17 nt, Human
ucccaaucagcacugaa

SEQ ID NO: 3456630 - RNA, 19 nt, Human
ucccaaucagcacugaaaa

SEQ ID NO: 3456631 - RNA, 14 nt, Human
uccccacacuccua

SEQ ID NO: 3456632 - RNA, 15 nt, Human
uccccaccagaugcu

SEQ ID NO: 3456633 - RNA, 19 nt, Human
uccccaccccuaccccugg

SEQ ID NO: 3456634 - RNA, 15 nt, Human
uccccaccccugccc

SEQ ID NO: 3456635 - RNA, 22 nt, Human
uccccaccccugcccccagccc

SEQ ID NO: 3456636 - RNA, 14 nt, Human
uccccacccuccac

SEQ ID NO: 3456637 - RNA, 12 nt, Human
uccccacccuga

SEQ ID NO: 3456638 - RNA, 16 nt, Human
ggaacuguccuuuccu

SEQ ID NO: 3456639 - RNA, 15 nt, Human
ggaacuucuaauaua

SEQ ID NO: 3456640 - RNA, 16 nt, Human
ggaacuugaacugauu

SEQ ID NO: 3456641 - RNA, 21 nt, Human
ggaacuugagcgugaaucugu

SEQ ID NO: 3456642 - RNA, 15 nt, Human
ggaagaaagaagaca

SEQ ID NO: 3456643 - RNA, 16 nt, Human
ggaagaaagagaagga

SEQ ID NO: 3456644 - RNA, 19 nt, Human
ggaagaaagagaaggagcc

SEQ ID NO: 3456645 - RNA, 19 nt, Human
ggaagaaauuccuguagca

SEQ ID NO: 3456646 - RNA, 21 nt, Human
ggaagaagagaucaggaagag

SEQ ID NO: 3456647 - RNA, 16 nt, Human
ggaagaagagggagag

SEQ ID NO: 3456648 - RNA, 16 nt, Human
ggaagaagcagagaga

SEQ ID NO: 3456649 - RNA, 14 nt, Human
ggaagaaggaggaa

SEQ ID NO: 3456650 - RNA, 11 nt, Human
ggaagaaugaa

SEQ ID NO: 3456651 - RNA, 14 nt, Human
ggaagaauuuuaaa

SEQ ID NO: 3456652 - RNA, 13 nt, Human
ggaagacauuucu

SEQ ID NO: 3456653 - RNA, 23 nt, Human
ggaagacauuucuuuucuuuuua

SEQ ID NO: 3456654 - RNA, 21 nt, Human
ggaagaccagcuuugcaguga

SEQ ID NO: 3456655 - RNA, 18 nt, Human
ggaagacccaacacaugg

SEQ ID NO: 3456656 - RNA, 14 nt, Human
ggaagaccuggcaa

SEQ ID NO: 3456657 - RNA, 17 nt, Human
ggaagacuucaucccuc

SEQ ID NO: 3456658 - RNA, 20 nt, Human
ggaagacuucaucccucugg

SEQ ID NO: 3456659 - RNA, 13 nt, Human
ggaagacuuugga

SEQ ID NO: 3456660 - RNA, 12 nt, Human
ggaagagaaaca

SEQ ID NO: 3456661 - RNA, 13 nt, Human
ggaagagaaacca

SEQ ID NO: 3456662 - RNA, 12 nt, Human
ggaagagaaauc

SEQ ID NO: 3456663 - RNA, 12 nt, Human
ggaagagaagga

SEQ ID NO: 3456664 - RNA, 16 nt, Human
ggaagagacagcccag

SEQ ID NO: 3456665 - RNA, 21 nt, Human
ggaagagaggaguucaaugau

SEQ ID NO: 3456666 - RNA, 23 nt, Human
ggaagagaggaguucaaugaucu

SEQ ID NO: 3456667 - RNA, 14 nt, Human
ggaagagauccaaa

SEQ ID NO: 3456668 - RNA, 16 nt, Human
ggaagagauccaaaga

SEQ ID NO: 3456669 - RNA, 20 nt, Human
ggaagagauccaaagacucu

SEQ ID NO: 3456670 - RNA, 16 nt, Human
ggaagagcacagcccu

SEQ ID NO: 3456671 - RNA, 14 nt, Human
ggaagagcaggcac

SEQ ID NO: 3456672 - RNA, 15 nt, Human
ggaagagcaggcaca

SEQ ID NO: 3456673 - RNA, 17 nt, Human
ggaagagccuuccaccc

SEQ ID NO: 3456674 - RNA, 19 nt, Human
ggaagagccuuccacccag

SEQ ID NO: 3456675 - RNA, 22 nt, Human
ggaagagcucaagggacaagga

SEQ ID NO: 3456676 - RNA, 15 nt, Human
ggaagagggacagau

SEQ ID NO: 3456677 - RNA, 20 nt, Human
ggaagaggggacaggucccu

SEQ ID NO: 3456678 - RNA, 14 nt, Human
ggaagauauacaug

SEQ ID NO: 3456679 - RNA, 15 nt, Human
ggaagaucauuuuga

SEQ ID NO: 3456680 - RNA, 18 nt, Human
ggaagaucccccagaaaa

SEQ ID NO: 3456681 - RNA, 12 nt, Human
ggaagauccugc

SEQ ID NO: 3456682 - RNA, 20 nt, Human
ggaagaucucugcagggccg

SEQ ID NO: 3456683 - RNA, 23 nt, Human
ggaagaucuuaaauuuugugaua

SEQ ID NO: 3456684 - RNA, 22 nt, Human
ggaagaugggggcaagaagauc

SEQ ID NO: 3456685 - RNA, 17 nt, Human
ggaagauuuggaagcuc

SEQ ID NO: 3456686 - RNA, 17 nt, Human
ggaagcacaugccucuc

SEQ ID NO: 3456687 - RNA, 15 nt, Human
ggaagcaccccaugc

SEQ ID NO: 3456688 - RNA, 16 nt, Human
ggaagcagaauaaagc

SEQ ID NO: 3456689 - RNA, 17 nt, Human
ggaagcagaauaaagca

SEQ ID NO: 3456690 - RNA, 19 nt, Human
ggaagcagaauaaagcaau

SEQ ID NO: 3456691 - RNA, 20 nt, Human
ggaagcagaauaaagcaauu

SEQ ID NO: 3456692 - RNA, 14 nt, Human
ggaagcagcagccu

SEQ ID NO: 3456693 - RNA, 15 nt, Human
ggaagcagcagccuc

SEQ ID NO: 3456694 - RNA, 12 nt, Human
ggaagcagcuuu

SEQ ID NO: 3456695 - RNA, 16 nt, Human
ggaagcagugcccagg

SEQ ID NO: 3456696 - RNA, 18 nt, Human
ggaagcagugcccaggug

SEQ ID NO: 3456697 - RNA, 20 nt, Human
ggaagcauauuguuauuaua

SEQ ID NO: 3456698 - RNA, 17 nt, Human
ggaagcauguaggagaa

SEQ ID NO: 3456699 - RNA, 20 nt, Human
ggaagcauucagagagcagc

SEQ ID NO: 3456700 - RNA, 22 nt, Human
ggaagcauuguaaaauaauucu

SEQ ID NO: 3456701 - RNA, 18 nt, Human
ggaagccagcaggcucuc

SEQ ID NO: 3456702 - RNA, 14 nt, Human
ggaagcccaggagc

SEQ ID NO: 3456703 - RNA, 18 nt, Human
ggaagcccauccugacca

SEQ ID NO: 3456704 - RNA, 13 nt, Human
ggaagccccuggg

SEQ ID NO: 3456705 - RNA, 14 nt, Human
ggaagccccugggc

SEQ ID NO: 3456706 - RNA, 17 nt, Human
ggaagcccuccuuccac

SEQ ID NO: 3456707 - RNA, 11 nt, Human
ggaagcccugg

SEQ ID NO: 3456708 - RNA, 15 nt, Human
ggaagcccuggauuu

SEQ ID NO: 3456709 - RNA, 15 nt, Human
ggaagccguccuggc

SEQ ID NO: 3456710 - RNA, 13 nt, Human
ggaagccucagau

SEQ ID NO: 3456711 - RNA, 15 nt, Human
ggaagccugauuaaa

SEQ ID NO: 3456712 - RNA, 23 nt, Human
ggaagcgaugaauuuggagacuc

SEQ ID NO: 3456713 - RNA, 16 nt, Human
ggaagcgcucagaaca

SEQ ID NO: 3456714 - RNA, 20 nt, Human
ggaagcggagguugcaggga

SEQ ID NO: 3456715 - RNA, 21 nt, Human
ggaagcggcccuaagggagug

SEQ ID NO: 3456716 - RNA, 22 nt, Human
ggaagcuacagguuacaacaga

SEQ ID NO: 3456717 - RNA, 18 nt, Human
ggaagcuagacacaugaa

SEQ ID NO: 3456718 - RNA, 19 nt, Human
ggaagcuagacacaugaag

SEQ ID NO: 3456719 - RNA, 16 nt, Human
ggaagcuagcuccccu

SEQ ID NO: 3456720 - RNA, 17 nt, Human
ggaagcuagcuccccuc

SEQ ID NO: 3456721 - RNA, 19 nt, Human
ggaagcuagcuccccuccu

SEQ ID NO: 3456722 - RNA, 20 nt, Human
ggaagcuagcuccccuccuc

SEQ ID NO: 3456723 - RNA, 15 nt, Human
ggaagcuagucuuuu

SEQ ID NO: 3456724 - RNA, 16 nt, Human
ggaagcucagggccug

SEQ ID NO: 3456725 - RNA, 21 nt, Human
ggaagcucagggccuggcuca

SEQ ID NO: 3456726 - RNA, 20 nt, Human
ggaagcuccaguccugcucu

SEQ ID NO: 3456727 - RNA, 11 nt, Human
ggaagcuccgc

SEQ ID NO: 3456728 - RNA, 13 nt, Human
ggaagcucuucuu

SEQ ID NO: 3456729 - RNA, 10 nt, Human
ggaagcugca

SEQ ID NO: 3456730 - RNA, 13 nt, Human
ggaagcugcagcu

SEQ ID NO: 3456731 - RNA, 18 nt, Human
ggaagcugcagcuuggga

SEQ ID NO: 3456732 - RNA, 20 nt, Human
ggaagcugugcgugugugug

SEQ ID NO: 3456733 - RNA, 13 nt, Human
ggaagcuucuguc

SEQ ID NO: 3456734 - RNA, 19 nt, Human
ggaagcuucuuaaaugaga

SEQ ID NO: 3456735 - RNA, 14 nt, Human
ggaagcuuggggaa

SEQ ID NO: 3456736 - RNA, 20 nt, Human
ggaagcuuuggugagaaccu

SEQ ID NO: 3456737 - RNA, 19 nt, Human
ggaaggaccuauguuugcu

SEQ ID NO: 3456738 - RNA, 16 nt, Human
ggaaggagaaguaaga

SEQ ID NO: 3456739 - RNA, 16 nt, Human
ggaaggagacacagau

SEQ ID NO: 3456740 - RNA, 21 nt, Human
ggaaggagacucaccucugcc

SEQ ID NO: 3456741 - RNA, 13 nt, Human
ggaaggagccagu

SEQ ID NO: 3456742 - RNA, 21 nt, Human
ggaaggagccaguuugccgga

SEQ ID NO: 3456743 - RNA, 17 nt, Human
ggaaggagcugccugga

SEQ ID NO: 3456744 - RNA, 13 nt, Human
ggaaggaggaaga

SEQ ID NO: 3456745 - RNA, 19 nt, Human
ggaaggaggacccaggaca

SEQ ID NO: 3456746 - RNA, 16 nt, Human
ggaaggaggagccugu

SEQ ID NO: 3456747 - RNA, 13 nt, Human
ggaaggagggagg

SEQ ID NO: 3456748 - RNA, 16 nt, Human
ggaaggauucugcugg

SEQ ID NO: 3456749 - RNA, 19 nt, Human
ggaaggauucugcuggccu

SEQ ID NO: 3456750 - RNA, 20 nt, Human
ggaaggauucugcuggccuc

SEQ ID NO: 3456751 - RNA, 13 nt, Human
ggaaggcagacag

SEQ ID NO: 3456752 - RNA, 15 nt, Human
ggaaggcagagaaau

SEQ ID NO: 3456753 - RNA, 16 nt, Human
ggaaggcaggaagaga

SEQ ID NO: 3456754 - RNA, 16 nt, Human
ggaaggcaggcagggc

SEQ ID NO: 3456755 - RNA, 14 nt, Human
ggaaggcagggagg

SEQ ID NO: 3456756 - RNA, 19 nt, Human
ggaaggcaugccuggacaa

SEQ ID NO: 3456757 - RNA, 18 nt, Human
ggaaggccaccugcaggu

SEQ ID NO: 3456758 - RNA, 23 nt, Human
ggaaggccaccugcaggucacug

SEQ ID NO: 3456759 - RNA, 22 nt, Human
ggaaggccucuuggagaccuua

SEQ ID NO: 3456760 - RNA, 12 nt, Human
ggaaggccuggg

SEQ ID NO: 3456761 - RNA, 13 nt, Human
ggaaggccugggu

SEQ ID NO: 3456762 - RNA, 19 nt, Human
ggaaggcggggcuucaacc

SEQ ID NO: 3456763 - RNA, 23 nt, Human
ggaaggcuacuucggggcuggga

SEQ ID NO: 3456764 - RNA, 17 nt, Human
ggaagggaaaguuuuuu

SEQ ID NO: 3456765 - RNA, 23 nt, Human
ggaagggacaccaagccuuggcu

SEQ ID NO: 3456766 - RNA, 20 nt, Human
ggaagggaccaaggcaaggc

SEQ ID NO: 3456767 - RNA, 22 nt, Human
ggaagggaccaaggcaaggcag

SEQ ID NO: 3456768 - RNA, 11 nt, Human
ggaagggagcc

SEQ ID NO: 3456769 - RNA, 13 nt, Human
ggaagggagccaa

SEQ ID NO: 3456770 - RNA, 12 nt, Human
ggaagggcagga

SEQ ID NO: 3456771 - RNA, 12 nt, Human
ggaagggccagu

SEQ ID NO: 3456772 - RNA, 23 nt, Human
ggaaggggagauaaggguaucug

SEQ ID NO: 3456773 - RNA, 15 nt, Human
ggaaggggccagagg

SEQ ID NO: 3456774 - RNA, 17 nt, Human
ggaaggggcuggacugg

SEQ ID NO: 3456775 - RNA, 19 nt, Human
ggaagggggggcuacauua

SEQ ID NO: 3456776 - RNA, 20 nt, Human
ggaagggggggcuacauuau

SEQ ID NO: 3456777 - RNA, 11 nt, Human
ggagaggagac

SEQ ID NO: 3456778 - RNA, 14 nt, Human
ggagaggagagagg

SEQ ID NO: 3456779 - RNA, 15 nt, Human
ggagaggagagaggc

SEQ ID NO: 3456780 - RNA, 14 nt, Human
ggagaggagagcca

SEQ ID NO: 3456781 - RNA, 12 nt, Human
ggagaggagccc

SEQ ID NO: 3456782 - RNA, 13 nt, Human
ggagaggaugaga

SEQ ID NO: 3456783 - RNA, 20 nt, Human
ggagaggaugagagcccaga

SEQ ID NO: 3456784 - RNA, 22 nt, Human
ggagaggcccucuggaguggcc

SEQ ID NO: 3456785 - RNA, 14 nt, Human
ggagagggaaugug

SEQ ID NO: 3456786 - RNA, 22 nt, Human
ggagagggacagcccacugaga

SEQ ID NO: 3456787 - RNA, 13 nt, Human
ggagagggagguc

SEQ ID NO: 3456788 - RNA, 17 nt, Human
ggagagggaggucacug

SEQ ID NO: 3456789 - RNA, 21 nt, Human
ggagagggaugaggugcuggg

SEQ ID NO: 3456790 - RNA, 22 nt, Human
ggagaggggaagggccagucug

SEQ ID NO: 3456791 - RNA, 14 nt, Human
ggagaggggcagaa

SEQ ID NO: 3456792 - RNA, 14 nt, Human
ggagagggucugga

SEQ ID NO: 3456793 - RNA, 11 nt, Human
ggagaggucuu

SEQ ID NO: 3456794 - RNA, 16 nt, Human
ggagaggugccagcaa

SEQ ID NO: 3456795 - RNA, 17 nt, Human
ggagaguacagugagcc

SEQ ID NO: 3456796 - RNA, 20 nt, Human
ggagaguacagugagccaag

SEQ ID NO: 3456797 - RNA, 18 nt, Human
ggagaguggccauucuuu

SEQ ID NO: 3456798 - RNA, 19 nt, Human
ggagagugucaaccagaca

SEQ ID NO: 3456799 - RNA, 20 nt, Human
ggagagugucaaccagacag

SEQ ID NO: 3456800 - RNA, 23 nt, Human
ggagaguucaauggcugcugaag

SEQ ID NO: 3456801 - RNA, 18 nt, Human
ggagaguuuccugaaaca

SEQ ID NO: 3456802 - RNA, 22 nt, Human
ggagauaucugagggaggaggc

SEQ ID NO: 3456803 - RNA, 23 nt, Human
ggagauauuuauggggggagaac

SEQ ID NO: 3456804 - RNA, 21 nt, Human
ggagaucagaaaaauggagca

SEQ ID NO: 3456805 - RNA, 13 nt, Human
ggagauccuccug

SEQ ID NO: 3456806 - RNA, 17 nt, Human
ggagaucggggccagag

SEQ ID NO: 3456807 - RNA, 23 nt, Human
ggagaugaaaucuuacagcuggg

SEQ ID NO: 3456808 - RNA, 16 nt, Human
ggagaugaggccagac

SEQ ID NO: 3456809 - RNA, 17 nt, Human
ggagaugccauccucuu

SEQ ID NO: 3456810 - RNA, 15 nt, Human
ggagaugcuccuugg

SEQ ID NO: 3456811 - RNA, 19 nt, Human
ggagauggaggaaagugau

SEQ ID NO: 3456812 - RNA, 13 nt, Human
ggagauggaguuc

SEQ ID NO: 3456813 - RNA, 16 nt, Human
ggagauggggagaaac

SEQ ID NO: 3456814 - RNA, 22 nt, Human
ggagaugucuucguacaguucu

SEQ ID NO: 3456815 - RNA, 14 nt, Human
ggagauucagacug

SEQ ID NO: 3456816 - RNA, 13 nt, Human
ggagauucugccu

SEQ ID NO: 3456817 - RNA, 20 nt, Human
ggagauuuacaacuggggga

SEQ ID NO: 3456818 - RNA, 16 nt, Human
ggagauuuuagguguu

SEQ ID NO: 3456819 - RNA, 16 nt, Human
ggagauuuuccuuccu

SEQ ID NO: 3456820 - RNA, 20 nt, Human
ggagcaaaaucgaugcagug

SEQ ID NO: 3456821 - RNA, 23 nt, Human
ggagcaaacugcaugcccagaga

SEQ ID NO: 3456822 - RNA, 22 nt, Human
ggagcaaagccuguucauggca

SEQ ID NO: 3456823 - RNA, 23 nt, Human
ggagcaaagccuguucauggcag

SEQ ID NO: 3456824 - RNA, 15 nt, Human
ggagcaaagugaggg

SEQ ID NO: 3456825 - RNA, 16 nt, Human
ggagcaaauguuucug

SEQ ID NO: 3456826 - RNA, 18 nt, Human
ggagcaaauguuucugca

SEQ ID NO: 3456827 - RNA, 22 nt, Human
ggagcaacuuguucguggguca

SEQ ID NO: 3456828 - RNA, 18 nt, Human
ggagcacaaaagccucuc

SEQ ID NO: 3456829 - RNA, 18 nt, Human
ggagcacaaagacccugg

SEQ ID NO: 3456830 - RNA, 20 nt, Human
ggagcacaaagacccuggcu

SEQ ID NO: 3456831 - RNA, 22 nt, Human
ggagcacaaagacccuggcuuu

SEQ ID NO: 3456832 - RNA, 14 nt, Human
ggagcacacccagc

SEQ ID NO: 3456833 - RNA, 14 nt, Human
ggagcacaggcagc

SEQ ID NO: 3456834 - RNA, 12 nt, Human
ggagcagagaag

SEQ ID NO: 3456835 - RNA, 21 nt, Human
ggagcagaggggcagaggccc

SEQ ID NO: 3456836 - RNA, 18 nt, Human
ggagcagccuggagaccc

SEQ ID NO: 3456837 - RNA, 13 nt, Human
ggagcaggcagcc

SEQ ID NO: 3456838 - RNA, 21 nt, Human
ggagcaggcggugggcaccca

SEQ ID NO: 3456839 - RNA, 19 nt, Human
ggagcauccaccuccuucu

SEQ ID NO: 3456840 - RNA, 14 nt, Human
ggagcaucugacuc

SEQ ID NO: 3456841 - RNA, 16 nt, Human
ggagcaucugacucac

SEQ ID NO: 3456842 - RNA, 18 nt, Human
ggagcaugagaggaggca

SEQ ID NO: 3456843 - RNA, 20 nt, Human
ucccuggguuagacugccag

SEQ ID NO: 3456844 - RNA, 21 nt, Human
ucccuggguuagacugccagc

SEQ ID NO: 3456845 - RNA, 23 nt, Human
ucccuggguuagacugccagcuc

SEQ ID NO: 3456846 - RNA, 21 nt, Human
ucccugguaauaaguacugug

SEQ ID NO: 3456847 - RNA, 21 nt, Human
ucccuggugagagggccgggc

SEQ ID NO: 3456848 - RNA, 11 nt, Human
ucccuggugcu

SEQ ID NO: 3456849 - RNA, 15 nt, Human
ucccugguggcagcu

SEQ ID NO: 3456850 - RNA, 16 nt, Human
ucccugguggcagcuc

SEQ ID NO: 3456851 - RNA, 23 nt, Human
ucccugguggcagcucaccucuc

SEQ ID NO: 3456852 - RNA, 16 nt, Human
ucccugguucugauga

SEQ ID NO: 3456853 - RNA, 18 nt, Human
ucccuguaaccucuucag

SEQ ID NO: 3456854 - RNA, 20 nt, Human
ucccuguaauuguuguuugu

SEQ ID NO: 3456855 - RNA, 13 nt, Human
ucccugucaccuc

SEQ ID NO: 3456856 - RNA, 14 nt, Human
ucccugucaccucu

SEQ ID NO: 3456857 - RNA, 14 nt, Human
ucccuguccacccc

SEQ ID NO: 3456858 - RNA, 23 nt, Human
ucccugucuuuacuccucacacu

SEQ ID NO: 3456859 - RNA, 14 nt, Human
ucccugugccuccu

SEQ ID NO: 3456860 - RNA, 20 nt, Human
ucccugugcugacggaagcc

SEQ ID NO: 3456861 - RNA, 17 nt, Human
ucccugugucauuucaa

SEQ ID NO: 3456862 - RNA, 20 nt, Human
ucccuguguuaauuuaaguu

SEQ ID NO: 3456863 - RNA, 16 nt, Human
ucccuguuauuuucaa

SEQ ID NO: 3456864 - RNA, 12 nt, Human
ucccuguucauu

SEQ ID NO: 3456865 - RNA, 15 nt, Human
ucccuguuccccaga

SEQ ID NO: 3456866 - RNA, 17 nt, Human
ucccuguucuuccucca

SEQ ID NO: 3456867 - RNA, 14 nt, Human
ucccuguugaagcu

SEQ ID NO: 3456868 - RNA, 20 nt, Human
ucccuguugacgaagucucu

SEQ ID NO: 3456869 - RNA, 22 nt, Human
ucccuguuucuuccacagugcc

SEQ ID NO: 3456870 - RNA, 21 nt, Human
ucccuguuuucugagcccggg

SEQ ID NO: 3456871 - RNA, 22 nt, Human
ucccuguuuucugagcccgggc

SEQ ID NO: 3456872 - RNA, 23 nt, Human
ucccuguuuucugagcccgggcu

SEQ ID NO: 3456873 - RNA, 15 nt, Human
ucccuuaaacaaaaa

SEQ ID NO: 3456874 - RNA, 22 nt, Human
ucccuuaaacaaaaauuaaaau

SEQ ID NO: 3456875 - RNA, 22 nt, Human
ucccuuaacaguuguauuuaac

SEQ ID NO: 3456876 - RNA, 18 nt, Human
ucccuuacgugaguccug

SEQ ID NO: 3456877 - RNA, 20 nt, Human
ucccuucacaaacccagugu

SEQ ID NO: 3456878 - RNA, 18 nt, Human
ucccuucagcccccagcc

SEQ ID NO: 3456879 - RNA, 21 nt, Human
ucccuucagcccccagccccu

SEQ ID NO: 3456880 - RNA, 18 nt, Human
ucccuucaguacccucuc

SEQ ID NO: 3456881 - RNA, 20 nt, Human
ucccuucaguacccucucag

SEQ ID NO: 3456882 - RNA, 18 nt, Human
ucccuuccacacccccac

SEQ ID NO: 3456883 - RNA, 17 nt, Human
ucccuuccaccugcucu

SEQ ID NO: 3456884 - RNA, 19 nt, Human
ucccuuccaccugcucugc

SEQ ID NO: 3456885 - RNA, 13 nt, Human
ucccuuccacugc

SEQ ID NO: 3456886 - RNA, 23 nt, Human
ucccuuccaguuuauuccagagc

SEQ ID NO: 3456887 - RNA, 14 nt, Human
ucccuucccaccuc

SEQ ID NO: 3456888 - RNA, 11 nt, Human
ucccuucccuc

SEQ ID NO: 3456889 - RNA, 15 nt, Human
ucccuuccucuuucc

SEQ ID NO: 3456890 - RNA, 22 nt, Human
ucccuucgguggaagagcucaa

SEQ ID NO: 3456891 - RNA, 17 nt, Human
ucccuucuacugcuucu

SEQ ID NO: 3456892 - RNA, 22 nt, Human
ucccuucuaggguuauugcauu

SEQ ID NO: 3456893 - RNA, 15 nt, Human
ucccuucucacagca

SEQ ID NO: 3456894 - RNA, 16 nt, Human
ucccuucuccaucucu

SEQ ID NO: 3456895 - RNA, 16 nt, Human
ucccuucucccuggau

SEQ ID NO: 3456896 - RNA, 21 nt, Human
ucccuucuccuugauaacagc

SEQ ID NO: 3456897 - RNA, 21 nt, Human
ucccuucucuuccaggcagcc

SEQ ID NO: 3456898 - RNA, 14 nt, Human
ucccuucugcuacu

SEQ ID NO: 3456899 - RNA, 17 nt, Human
ucccuucugucccucac

SEQ ID NO: 3456900 - RNA, 17 nt, Human
ucccuugaaauuuuaaa

SEQ ID NO: 3456901 - RNA, 17 nt, Human
ucccuugaccaggccug

SEQ ID NO: 3456902 - RNA, 16 nt, Human
ucccuugagaccucag

SEQ ID NO: 3456903 - RNA, 17 nt, Human
ucccuugagaccucagc

SEQ ID NO: 3456904 - RNA, 17 nt, Human
ucccuugagggcugcag

SEQ ID NO: 3456905 - RNA, 19 nt, Human
ucccuugagggcugcaguu

SEQ ID NO: 3456906 - RNA, 16 nt, Human
ucccuugaugcacaga

SEQ ID NO: 3456907 - RNA, 17 nt, Human
ucccuugccacuuugca

SEQ ID NO: 3456908 - RNA, 14 nt, Human
ucccuugccccccu

SEQ ID NO: 3456909 - RNA, 19 nt, Human
ucccuugcuggccccagcc

SEQ ID NO: 3456910 - RNA, 15 nt, Human
ucccuugcuuuuccc

SEQ ID NO: 3456911 - RNA, 23 nt, Human
ucccuugcuuuucccucuuuucu

SEQ ID NO: 3456912 - RNA, 18 nt, Human
ucccuuggaaaccugccc

SEQ ID NO: 3456913 - RNA, 12 nt, Human
ucccuuggagcu

SEQ ID NO: 3456914 - RNA, 20 nt, Human
ucccuuggauuguccccgac

SEQ ID NO: 3456915 - RNA, 17 nt, Human
ucccuuggguucugaua

SEQ ID NO: 3456916 - RNA, 15 nt, Human
ucccuugugugugug

SEQ ID NO: 3456917 - RNA, 14 nt, Human
ucccuuguucucua

SEQ ID NO: 3456918 - RNA, 17 nt, Human
ucccuuucauuugcuau

SEQ ID NO: 3456919 - RNA, 22 nt, Human
ucccuuuccaaaugcccagcuu

SEQ ID NO: 3456920 - RNA, 13 nt, Human
ucccuuucccuuc

SEQ ID NO: 3456921 - RNA, 15 nt, Human
uccuaaaugcaguga

SEQ ID NO: 3456922 - RNA, 18 nt, Human
uccuaaauuuuccugucc

SEQ ID NO: 3456923 - RNA, 18 nt, Human
uccuaacugaagagacag

SEQ ID NO: 3456924 - RNA, 14 nt, Human
uccuaacuuuucaa

SEQ ID NO: 3456925 - RNA, 13 nt, Human
uccuaagaaauau

SEQ ID NO: 3456926 - RNA, 19 nt, Human
uccuaagaaauaugugaga

SEQ ID NO: 3456927 - RNA, 13 nt, Human
uccuaagaagcuu

SEQ ID NO: 3456928 - RNA, 16 nt, Human
uccuaagaccuggggu

SEQ ID NO: 3456929 - RNA, 21 nt, Human
uccuaagcaacuaggccuuca

SEQ ID NO: 3456930 - RNA, 14 nt, Human
uccuaagcaucuaa

SEQ ID NO: 3456931 - RNA, 14 nt, Human
uccuaagccugugg

SEQ ID NO: 3456932 - RNA, 13 nt, Human
uccuaaggaaccu

SEQ ID NO: 3456933 - RNA, 21 nt, Human
uccuaaggcacccacaaauaa

SEQ ID NO: 3456934 - RNA, 18 nt, Human
uccuaagggucgaaagcu

SEQ ID NO: 3456935 - RNA, 20 nt, Human
uccuaaguucuuagauaucu

SEQ ID NO: 3456936 - RNA, 14 nt, Human
uccuaauaaaaagg

SEQ ID NO: 3456937 - RNA, 17 nt, Human
uccuaauaaaaagguga

SEQ ID NO: 3456938 - RNA, 22 nt, Human
uccuaauaauaucccacuggga

SEQ ID NO: 3456939 - RNA, 14 nt, Human
uccuaauaucaaau

SEQ ID NO: 3456940 - RNA, 15 nt, Human
uccuaaucacucaga

SEQ ID NO: 3456941 - RNA, 16 nt, Human
uccuaaucacucagag

SEQ ID NO: 3456942 - RNA, 14 nt, Human
uccuaaucauccaa

SEQ ID NO: 3456943 - RNA, 15 nt, Human
uccuaaucauccaau

SEQ ID NO: 3456944 - RNA, 22 nt, Human
uccuaaugaaugcauaaaaugu

SEQ ID NO: 3456945 - RNA, 15 nt, Human
uccuacaagacacag

SEQ ID NO: 3456946 - RNA, 19 nt, Human
uccuacaagagcagccugu

SEQ ID NO: 3456947 - RNA, 19 nt, Human
uccuacaagauuuagaaaa

SEQ ID NO: 3456948 - RNA, 21 nt, Human
uccuacaagauuuagaaaaaa

SEQ ID NO: 3456949 - RNA, 16 nt, Human
uccuacacaggacagg

SEQ ID NO: 3456950 - RNA, 19 nt, Human
uccuacacuugagagaaaa

SEQ ID NO: 3456951 - RNA, 15 nt, Human
uccuacagaaaaacc

SEQ ID NO: 3456952 - RNA, 15 nt, Human
uccuacagcacuacu

SEQ ID NO: 3456953 - RNA, 22 nt, Human
uccuacaggcagucucucucuu

SEQ ID NO: 3456954 - RNA, 21 nt, Human
uccuacaguuggaaauccauc

SEQ ID NO: 3456955 - RNA, 20 nt, Human
uccuacauaucccuuccaga

SEQ ID NO: 3456956 - RNA, 14 nt, Human
uccuaccaaccucu

SEQ ID NO: 3456957 - RNA, 16 nt, Human
uccuacccacaccucu

SEQ ID NO: 3456958 - RNA, 22 nt, Human
uccuacccacaccucugccaga

SEQ ID NO: 3456959 - RNA, 19 nt, Human
uccuaccccaauuccuugu

SEQ ID NO: 3456960 - RNA, 15 nt, Human
uccuacccccugugc

SEQ ID NO: 3456961 - RNA, 15 nt, Human
uccuacccugcgccc

SEQ ID NO: 3456962 - RNA, 20 nt, Human
uccuaccgaaaccuugccuu

SEQ ID NO: 3456963 - RNA, 16 nt, Human
uccuaccucagccuag

SEQ ID NO: 3456964 - RNA, 14 nt, Human
uccuaccuugcuuu

SEQ ID NO: 3456965 - RNA, 23 nt, Human
uccuacgaguaauugcauuugcu

SEQ ID NO: 3456966 - RNA, 13 nt, Human
uccuacuccugac

SEQ ID NO: 3456967 - RNA, 16 nt, Human
uccuacucuucucucu

SEQ ID NO: 3456968 - RNA, 20 nt, Human
uccuacucuucucucugcuc

SEQ ID NO: 3456969 - RNA, 17 nt, Human
uccuacuggucucucua

SEQ ID NO: 3456970 - RNA, 18 nt, Human
uccuacuuauaaaguaga

SEQ ID NO: 3456971 - RNA, 16 nt, Human
uccuagaaauucccca

SEQ ID NO: 3456972 - RNA, 18 nt, Human
uccuagacagguguuuau

SEQ ID NO: 3456973 - RNA, 17 nt, Human
uccuagagaacgcagcc

SEQ ID NO: 3456974 - RNA, 14 nt, Human
uccuagagaacugu

SEQ ID NO: 3456975 - RNA, 18 nt, Human
uccuagagaagacaggcu

SEQ ID NO: 3456976 - RNA, 19 nt, Human
uccuagagaagacaggcug

SEQ ID NO: 3456977 - RNA, 20 nt, Human
uccuagagaagacaggcugg

SEQ ID NO: 3456978 - RNA, 19 nt, Human
uccuagaggcccuuugcug

SEQ ID NO: 3456979 - RNA, 21 nt, Human
uccuagaggcccuuugcuguc

SEQ ID NO: 3456980 - RNA, 15 nt, Human
uccuagauaaaaaga

SEQ ID NO: 3456981 - RNA, 17 nt, Human
uccuagauaaaaagaug

SEQ ID NO: 3456982 - RNA, 14 nt, Human
uccuagauccuaag

SEQ ID NO: 3456983 - RNA, 23 nt, Human
uccuagauccuaagggucgaaag

SEQ ID NO: 3456984 - RNA, 13 nt, Human
uccuagaugcucu

SEQ ID NO: 3456985 - RNA, 18 nt, Human
uccuagauggcagucacu

SEQ ID NO: 3456986 - RNA, 16 nt, Human
uccuagcacagauggc

SEQ ID NO: 3456987 - RNA, 19 nt, Human
uccuagcacaugcuucaau

SEQ ID NO: 3456988 - RNA, 14 nt, Human
uccuagcagagaga

SEQ ID NO: 3456989 - RNA, 21 nt, Human
uccuagccaccgccuccuaca

SEQ ID NO: 3456990 - RNA, 14 nt, Human
uccuagccuguuuc

SEQ ID NO: 3456991 - RNA, 15 nt, Human
uccuagccuguuucu

SEQ ID NO: 3456992 - RNA, 18 nt, Human
uccuagccuuauccucug

SEQ ID NO: 3456993 - RNA, 22 nt, Human
uccuagccuuauccucugaucu

SEQ ID NO: 3456994 - RNA, 22 nt, Human
uccuagcuggagaggagcccug

SEQ ID NO: 3456995 - RNA, 24 nt, Human
uccuagcuggagaggagcccugcc

SEQ ID NO: 3456996 - RNA, 15 nt, Human
uccuagcuguccuuu

SEQ ID NO: 3456997 - RNA, 22 nt, Human
uccuagcuugggaggcuucccc

SEQ ID NO: 3456998 - RNA, 14 nt, Human
uccuaggaaaauac

SEQ ID NO: 3456999 - RNA, 18 nt, Human
uccuaggaguauccucau

SEQ ID NO: 3457000 - RNA, 14 nt, Human
uccuaggcauuugc

SEQ ID NO: 3457001 - RNA, 17 nt, Human
uccuaggccucaacucc

SEQ ID NO: 3457002 - RNA, 22 nt, Human
uccuaggcuccaccccauccag

SEQ ID NO: 3457003 - RNA, 18 nt, Human
uccuagguaggguuuaau

SEQ ID NO: 3457004 - RNA, 13 nt, Human
uccuaguaagaag

SEQ ID NO: 3457005 - RNA, 13 nt, Human
uccuagugaaccu

SEQ ID NO: 3457006 - RNA, 20 nt, Human
uccuagugaaccucaccccg

SEQ ID NO: 3457007 - RNA, 20 nt, Human
ucuaagguccgguguucuaa

SEQ ID NO: 3457008 - RNA, 19 nt, Human
ucuaaguaaaaccacagca

SEQ ID NO: 3457009 - RNA, 23 nt, Human
ucuaaguaaaaccacagcaguug

SEQ ID NO: 3457010 - RNA, 20 nt, Human
ucuaaguaaauacaauuuuu

SEQ ID NO: 3457011 - RNA, 16 nt, Human
ucuaaguauuugaaac

SEQ ID NO: 3457012 - RNA, 23 nt, Human
ucuaagucaaacacuugugacuu

SEQ ID NO: 3457013 - RNA, 21 nt, Human
ucuaagucaguacccaccacc

SEQ ID NO: 3457014 - RNA, 18 nt, Human
ucuaagucauguauguuu

SEQ ID NO: 3457015 - RNA, 14 nt, Human
ucuaagucuuucca

SEQ ID NO: 3457016 - RNA, 13 nt, Human
ucuaagugauaua

SEQ ID NO: 3457017 - RNA, 21 nt, Human
ucuaagugggcauugccaugu

SEQ ID NO: 3457018 - RNA, 18 nt, Human
ucuaaguguuucauaaau

SEQ ID NO: 3457019 - RNA, 16 nt, Human
ucuaaguuaauuuaaa

SEQ ID NO: 3457020 - RNA, 20 nt, Human
ucuaaguuaauuuaaaguug

SEQ ID NO: 3457021 - RNA, 17 nt, Human
ucuaaguuauaagacuc

SEQ ID NO: 3457022 - RNA, 15 nt, Human
ucuaaguuucuaaga

SEQ ID NO: 3457023 - RNA, 17 nt, Human
ucuaaguuucuaagauu

SEQ ID NO: 3457024 - RNA, 22 nt, Human
ucuaauaaaacagcugucucua

SEQ ID NO: 3457025 - RNA, 11 nt, Human
ucuaauaauaa

SEQ ID NO: 3457026 - RNA, 20 nt, Human
ucuaauagcgaggcucuaac

SEQ ID NO: 3457027 - RNA, 22 nt, Human
ucuaauagcgaggcucuaacca

SEQ ID NO: 3457028 - RNA, 12 nt, Human
ucuaauaguaua

SEQ ID NO: 3457029 - RNA, 12 nt, Human
ucuaauagucuu

SEQ ID NO: 3457030 - RNA, 15 nt, Human
ucuaauauauaugaa

SEQ ID NO: 3457031 - RNA, 19 nt, Human
ucuaauauauaugaauaaa

SEQ ID NO: 3457032 - RNA, 15 nt, Human
ucuaauauauuuuua

SEQ ID NO: 3457033 - RNA, 14 nt, Human
ucuaauauguaaca

SEQ ID NO: 3457034 - RNA, 18 nt, Human
ucuaauauuaaaaauaug

SEQ ID NO: 3457035 - RNA, 17 nt, Human
ucuaaugacauucaaua

SEQ ID NO: 3457036 - RNA, 18 nt, Human
ucuaaugacauucaauaa

SEQ ID NO: 3457037 - RNA, 24 nt, Human
ucuaaugaggagagaaaauauaug

SEQ ID NO: 3457038 - RNA, 22 nt, Human
ucuaaugauggcccauucuacu

SEQ ID NO: 3457039 - RNA, 23 nt, Human
ucuaaugauggcccauucuacuu

SEQ ID NO: 3457040 - RNA, 21 nt, Human
ucuaauggauuauaaucagaa

SEQ ID NO: 3457041 - RNA, 20 nt, Human
ucuaauggcacuuaucauua

SEQ ID NO: 3457042 - RNA, 15 nt, Human
ucuaauguauuuuau

SEQ ID NO: 3457043 - RNA, 24 nt, Human
ucuaauguauuuuauuguaacaga

SEQ ID NO: 3457044 - RNA, 14 nt, Human
ucuaaugucuucau

SEQ ID NO: 3457045 - RNA, 11 nt, Human
ucuaauguggu

SEQ ID NO: 3457046 - RNA, 19 nt, Human
ucuaaugugguuauuucuc

SEQ ID NO: 3457047 - RNA, 11 nt, Human
ucuaauguuua

SEQ ID NO: 3457048 - RNA, 18 nt, Human
ucuaauguuuaagcagaa

SEQ ID NO: 3457049 - RNA, 13 nt, Human
ucuaauguuugca

SEQ ID NO: 3457050 - RNA, 18 nt, Human
ucuaauguuugcauauaa

SEQ ID NO: 3457051 - RNA, 15 nt, Human
ucuaauuaauuguaa

SEQ ID NO: 3457052 - RNA, 17 nt, Human
ucuaauuaauuguaauc

SEQ ID NO: 3457053 - RNA, 19 nt, Human
ucuaauucccauuuugcaa

SEQ ID NO: 3457054 - RNA, 11 nt, Human
ucuaauucuaa

SEQ ID NO: 3457055 - RNA, 20 nt, Human
ucuaauucuaaggaauauga

SEQ ID NO: 3457056 - RNA, 16 nt, Human
ucuaauugcugugugu

SEQ ID NO: 3457057 - RNA, 20 nt, Human
ucuaauuggaagaaauuccu

SEQ ID NO: 3457058 - RNA, 19 nt, Human
ucuaauuucaaaaauauaa

SEQ ID NO: 3457059 - RNA, 15 nt, Human
ucuaauuuuggaugg

SEQ ID NO: 3457060 - RNA, 18 nt, Human
ucuacaaaacauuaaacu

SEQ ID NO: 3457061 - RNA, 17 nt, Human
ucuacaaauuuuucugu

SEQ ID NO: 3457062 - RNA, 21 nt, Human
ucuacaacucauacacucgua

SEQ ID NO: 3457063 - RNA, 14 nt, Human
ucuacaaucucuuu

SEQ ID NO: 3457064 - RNA, 19 nt, Human
ucuacaaucucuuuuuguu

SEQ ID NO: 3457065 - RNA, 15 nt, Human
ggaugcccuggaggu

SEQ ID NO: 3457066 - RNA, 18 nt, Human
ggaugcccuggagguggc

SEQ ID NO: 3457067 - RNA, 11 nt, Human
ggaugccuccu

SEQ ID NO: 3457068 - RNA, 21 nt, Human
ggaugccugguggcagcugcg

SEQ ID NO: 3457069 - RNA, 14 nt, Human
ggaugcgcagugcc

SEQ ID NO: 3457070 - RNA, 16 nt, Human
ggaugcuaacaucuaa

SEQ ID NO: 3457071 - RNA, 17 nt, Human
ggaugcugcugccccug

SEQ ID NO: 3457072 - RNA, 21 nt, Human
ggaugcuugccuagggccugg

SEQ ID NO: 3457073 - RNA, 17 nt, Human
ggauggaaugauggguc

SEQ ID NO: 3457074 - RNA, 14 nt, Human
ggauggacaucuug

SEQ ID NO: 3457075 - RNA, 21 nt, Human
ggauggagcccaggcgggagc

SEQ ID NO: 3457076 - RNA, 18 nt, Human
ggauggaggaagaacuga

SEQ ID NO: 3457077 - RNA, 18 nt, Human
ggauggauuuccagccaa

SEQ ID NO: 3457078 - RNA, 12 nt, Human
ggauggcaagau

SEQ ID NO: 3457079 - RNA, 15 nt, Human
ggauggcaccagagg

SEQ ID NO: 3457080 - RNA, 21 nt, Human
ggauggcaggacgugggcugg

SEQ ID NO: 3457081 - RNA, 15 nt, Human
ggauggcccagggug

SEQ ID NO: 3457082 - RNA, 15 nt, Human
ggauggcccuuccuc

SEQ ID NO: 3457083 - RNA, 15 nt, Human
ggauggcgggugggg

SEQ ID NO: 3457084 - RNA, 15 nt, Human
ggaugggagugagac

SEQ ID NO: 3457085 - RNA, 15 nt, Human
ggaugggggaacuca

SEQ ID NO: 3457086 - RNA, 14 nt, Human
ggauggguuuuaug

SEQ ID NO: 3457087 - RNA, 23 nt, Human
ggaugguacuagggggaagugac

SEQ ID NO: 3457088 - RNA, 14 nt, Human
ggaugguccugggg

SEQ ID NO: 3457089 - RNA, 17 nt, Human
ggauggugggcuucagg

SEQ ID NO: 3457090 - RNA, 12 nt, Human
ggauggugucuc

SEQ ID NO: 3457091 - RNA, 15 nt, Human
ggaugguguucaaaa

SEQ ID NO: 3457092 - RNA, 22 nt, Human
ggaugguucccuugaugaagaa

SEQ ID NO: 3457093 - RNA, 23 nt, Human
ggaugguucccuugaugaagaag

SEQ ID NO: 3457094 - RNA, 16 nt, Human
ggauguaaacagugcc

SEQ ID NO: 3457095 - RNA, 16 nt, Human
ggauguacauuuccaa

SEQ ID NO: 3457096 - RNA, 23 nt, Human
ggauguauccaugggggcagggc

SEQ ID NO: 3457097 - RNA, 18 nt, Human
ggauguccacagaugccu

SEQ ID NO: 3457098 - RNA, 14 nt, Human
ggauguccccagca

SEQ ID NO: 3457099 - RNA, 14 nt, Human
ggaugucccugggc

SEQ ID NO: 3457100 - RNA, 19 nt, Human
ggaugucccugggccaggg

SEQ ID NO: 3457101 - RNA, 23 nt, Human
ggaugucccugggccagggucug

SEQ ID NO: 3457102 - RNA, 13 nt, Human
ggaugucuuccuu

SEQ ID NO: 3457103 - RNA, 16 nt, Human
ggaugugcugcagugc

SEQ ID NO: 3457104 - RNA, 14 nt, Human
ggaugugggcagcu

SEQ ID NO: 3457105 - RNA, 16 nt, Human
ggaugugguggcagug

SEQ ID NO: 3457106 - RNA, 18 nt, Human
ggaugugguuuucuuaag

SEQ ID NO: 3457107 - RNA, 14 nt, Human
ggauguguccugac

SEQ ID NO: 3457108 - RNA, 23 nt, Human
ggauguucagcacugucccuugc

SEQ ID NO: 3457109 - RNA, 23 nt, Human
ggauguuggccaccaggugccuu

SEQ ID NO: 3457110 - RNA, 16 nt, Human
ggauuaaccucugcac

SEQ ID NO: 3457111 - RNA, 16 nt, Human
ggauuaauaugaaaac

SEQ ID NO: 3457112 - RNA, 22 nt, Human
ggauuaaugguccugugaugcu

SEQ ID NO: 3457113 - RNA, 19 nt, Human
ggauuacaggcuccugcca

SEQ ID NO: 3457114 - RNA, 21 nt, Human
ggauuacagggaugagccacc

SEQ ID NO: 3457115 - RNA, 14 nt, Human
ggauuaguuuagaa

SEQ ID NO: 3457116 - RNA, 22 nt, Human
ggauuauucauuuaaaaugauu

SEQ ID NO: 3457117 - RNA, 16 nt, Human
ggauuauuuuuucaga

SEQ ID NO: 3457118 - RNA, 17 nt, Human
ggauuauuuuuucagac

SEQ ID NO: 3457119 - RNA, 20 nt, Human
ggauuauuuuuucagaccga

SEQ ID NO: 3457120 - RNA, 17 nt, Human
ggauucacaccccaccu

SEQ ID NO: 3457121 - RNA, 13 nt, Human
ggauucagccuuc

SEQ ID NO: 3457122 - RNA, 16 nt, Human
ggauucagccuucuuu

SEQ ID NO: 3457123 - RNA, 13 nt, Human
ggauucaggcugc

SEQ ID NO: 3457124 - RNA, 14 nt, Human
ggauucauuuccug

SEQ ID NO: 3457125 - RNA, 12 nt, Human
ggauuccaugcu

SEQ ID NO: 3457126 - RNA, 23 nt, Human
ggauucccaccaaggucuucagc

SEQ ID NO: 3457127 - RNA, 14 nt, Human
ggauuccugaccca

SEQ ID NO: 3457128 - RNA, 20 nt, Human
ggauuccugacccaggccgc

SEQ ID NO: 3457129 - RNA, 15 nt, Human
ggauucgcuugaguu

SEQ ID NO: 3457130 - RNA, 19 nt, Human
ggauucuaaauacaugcca

SEQ ID NO: 3457131 - RNA, 20 nt, Human
ggauucugaggcccugccca

SEQ ID NO: 3457132 - RNA, 18 nt, Human
ggauucugcuggccucug

SEQ ID NO: 3457133 - RNA, 19 nt, Human
ggauucugggaggaagcag

SEQ ID NO: 3457134 - RNA, 13 nt, Human
ggauucuuggccc

SEQ ID NO: 3457135 - RNA, 18 nt, Human
ggauucuuguuuugcuuc

SEQ ID NO: 3457136 - RNA, 16 nt, Human
ggauugaagcccucca

SEQ ID NO: 3457137 - RNA, 22 nt, Human
ggauugaucuucagggcuguuu

SEQ ID NO: 3457138 - RNA, 18 nt, Human
ggauugauuuuaaaaugu

SEQ ID NO: 3457139 - RNA, 19 nt, Human
ggauugcaauaucugaagc

SEQ ID NO: 3457140 - RNA, 14 nt, Human
ggauuggacaaaau

SEQ ID NO: 3457141 - RNA, 16 nt, Human
ggauuggauuauuuaa

SEQ ID NO: 3457142 - RNA, 18 nt, Human
ggauuggauuauuuaaua

SEQ ID NO: 3457143 - RNA, 18 nt, Human
ggauugggccccugccag

SEQ ID NO: 3457144 - RNA, 18 nt, Human
ggauuggggaagacugug

SEQ ID NO: 3457145 - RNA, 16 nt, Human
ggauuggggucccucu

SEQ ID NO: 3457146 - RNA, 14 nt, Human
ggauuguaguccca

SEQ ID NO: 3457147 - RNA, 20 nt, Human
ggauuguaucaaguggcaug

SEQ ID NO: 3457148 - RNA, 13 nt, Human
ggauuguccccga

SEQ ID NO: 3457149 - RNA, 15 nt, Human
ggauuguuccuguca

SEQ ID NO: 3457150 - RNA, 13 nt, Human
ggauuguuuauac

SEQ ID NO: 3457151 - RNA, 16 nt, Human
ggauuuaauuugauau

SEQ ID NO: 3457152 - RNA, 16 nt, Human
ggauuuauaaaugcua

SEQ ID NO: 3457153 - RNA, 18 nt, Human
ggauuuauaaaugcuauu

SEQ ID NO: 3457154 - RNA, 20 nt, Human
ggauuucaugauuucauuuc

SEQ ID NO: 3457155 - RNA, 14 nt, Human
ggauuucguggguc

SEQ ID NO: 3457156 - RNA, 13 nt, Human
ggauuucuuaggg

SEQ ID NO: 3457157 - RNA, 19 nt, Human
ggauuuggguuggaaguga

SEQ ID NO: 3457158 - RNA, 15 nt, Human
ggauuuguucucugu

SEQ ID NO: 3457159 - RNA, 15 nt, Human
ggauuuuaaacuaga

SEQ ID NO: 3457160 - RNA, 23 nt, Human
ggauuuuaaacuagaugaccuca

SEQ ID NO: 3457161 - RNA, 22 nt, Human
ggauuuuaacaaaagcaagacu

SEQ ID NO: 3457162 - RNA, 16 nt, Human
ggauuuuauguugaca

SEQ ID NO: 3457163 - RNA, 12 nt, Human
ggauuuuuacca

SEQ ID NO: 3457164 - RNA, 13 nt, Human
ggauuuuugaguc

SEQ ID NO: 3457165 - RNA, 14 nt, Human
ggauuuuugucuug

SEQ ID NO: 3457166 - RNA, 16 nt, Human
ggauuuuugucuugug

SEQ ID NO: 3457167 - RNA, 12 nt, Human
ggcaaaacucua

SEQ ID NO: 3457168 - RNA, 11 nt, Human
ggcaaaagcuu

SEQ ID NO: 3457169 - RNA, 23 nt, Human
ggcaaaaggaucuuuguggccaa

SEQ ID NO: 3457170 - RNA, 16 nt, Human
ggcaaaauccuugcuu

SEQ ID NO: 3457171 - RNA, 23 nt, Human
ggcaaaaugagagggcaguguuu

SEQ ID NO: 3457172 - RNA, 13 nt, Human
ggcaaaauugcaa

SEQ ID NO: 3457173 - RNA, 16 nt, Human
ggcaaaggaaggugga

SEQ ID NO: 3457174 - RNA, 17 nt, Human
ggcaaaggaagguggau

SEQ ID NO: 3457175 - RNA, 21 nt, Human
ggcaaagggagcagaacugaa

SEQ ID NO: 3457176 - RNA, 16 nt, Human
ggcaaaucaguuacua

SEQ ID NO: 3457177 - RNA, 11 nt, Human
ggcaaaucugc

SEQ ID NO: 3457178 - RNA, 21 nt, Human
ggcaaaugacaugcacugacc

SEQ ID NO: 3457179 - RNA, 13 nt, Human
ggcaaaugacuuu

SEQ ID NO: 3457180 - RNA, 17 nt, Human
ggcaaaugccagggccc

SEQ ID NO: 3457181 - RNA, 18 nt, Human
ggcaaauucuuuugaauu

SEQ ID NO: 3457182 - RNA, 20 nt, Human
ggcaacaaagugagacucca

SEQ ID NO: 3457183 - RNA, 20 nt, Human
ggcaacacagcgagacuccg

SEQ ID NO: 3457184 - RNA, 19 nt, Human
ggcaacagaucuggaaccu

SEQ ID NO: 3457185 - RNA, 20 nt, Human
ggcaaccacaggcagcauuu

SEQ ID NO: 3457186 - RNA, 22 nt, Human
ggcaaccccaguucugcuccuc

SEQ ID NO: 3457187 - RNA, 15 nt, Human
ggcaaccuugucucu

SEQ ID NO: 3457188 - RNA, 17 nt, Human
ggcaacgaagaaaaaaa

SEQ ID NO: 3457189 - RNA, 18 nt, Human
ggcaacuaagcagucccu

SEQ ID NO: 3457190 - RNA, 19 nt, Human
ggcaacuaagcagucccug

SEQ ID NO: 3457191 - RNA, 13 nt, Human
ggcaacugaggca

SEQ ID NO: 3457192 - RNA, 15 nt, Human
ggcaacugaggcaga

SEQ ID NO: 3457193 - RNA, 20 nt, Human
ggcaacugaggcagacagca

SEQ ID NO: 3457194 - RNA, 18 nt, Human
ggcaacugcauuggcuuu

SEQ ID NO: 3457195 - RNA, 19 nt, Human
ggcaacugcauuggcuuug

SEQ ID NO: 3457196 - RNA, 13 nt, Human
ggcaacugcugau

SEQ ID NO: 3457197 - RNA, 21 nt, Human
ggcaacuucaguccugggaga

SEQ ID NO: 3457198 - RNA, 19 nt, Human
ggcaagaaaagaguuaagg

SEQ ID NO: 3457199 - RNA, 17 nt, Human
ggcaagacuuuucuuug

SEQ ID NO: 3457200 - RNA, 23 nt, Human
ggcaagagaaucgcuugaaccca

SEQ ID NO: 3457201 - RNA, 12 nt, Human
ggcaagauuuuc

SEQ ID NO: 3457202 - RNA, 19 nt, Human
ggcaagauuuuccuuuuuu

SEQ ID NO: 3457203 - RNA, 12 nt, Human
ggcaaggaaaaa

SEQ ID NO: 3457204 - RNA, 12 nt, Human
ggcaaggcaggu

SEQ ID NO: 3457205 - RNA, 15 nt, Human
ggcaaggggugccug

SEQ ID NO: 3457206 - RNA, 23 nt, Human
ggcaagucccugacucucuguga

SEQ ID NO: 3457207 - RNA, 13 nt, Human
ggcaagugauuga

SEQ ID NO: 3457208 - RNA, 13 nt, Human
ggcaagugugggc

SEQ ID NO: 3457209 - RNA, 17 nt, Human
ggcaauaaaagcccagg

SEQ ID NO: 3457210 - RNA, 19 nt, Human
ucuccaccugccagggaca

SEQ ID NO: 3457211 - RNA, 19 nt, Human
ggcagacagcagcucaggc

SEQ ID NO: 3457212 - RNA, 18 nt, Human
ggcagacucuuuaugcuu

SEQ ID NO: 3457213 - RNA, 20 nt, Human
ggcagacucuuuaugcuugc

SEQ ID NO: 3457214 - RNA, 22 nt, Human
ggcagacucuuuaugcuugcaa

SEQ ID NO: 3457215 - RNA, 19 nt, Human
ggcagagagcggucucagg

SEQ ID NO: 3457216 - RNA, 13 nt, Human
ggcagagcacagc

SEQ ID NO: 3457217 - RNA, 12 nt, Human
ggcagagcagag

SEQ ID NO: 3457218 - RNA, 15 nt, Human
ggcagagcagagacc

SEQ ID NO: 3457219 - RNA, 13 nt, Human
ggcagagccagga

SEQ ID NO: 3457220 - RNA, 16 nt, Human
ggcagagcccaaggga

SEQ ID NO: 3457221 - RNA, 11 nt, Human
ggcagagcugg

SEQ ID NO: 3457222 - RNA, 13 nt, Human
ggcagagcuggug

SEQ ID NO: 3457223 - RNA, 18 nt, Human
ggcagagcuggugcggcu

SEQ ID NO: 3457224 - RNA, 15 nt, Human
ggcagaggacagauc

SEQ ID NO: 3457225 - RNA, 15 nt, Human
ggcagaggcaguacc

SEQ ID NO: 3457226 - RNA, 14 nt, Human
ucuccugacuuuua

SEQ ID NO: 3457227 - RNA, 15 nt, Human
ucuccugauuauuua

SEQ ID NO: 3457228 - RNA, 13 nt, Human
ucuccugcaugca

SEQ ID NO: 3457229 - RNA, 18 nt, Human
ucuccugccucagccucc

SEQ ID NO: 3457230 - RNA, 22 nt, Human
ucuccugccucagccucccaaa

SEQ ID NO: 3457231 - RNA, 20 nt, Human
ucuccugccuguagcaguga

SEQ ID NO: 3457232 - RNA, 22 nt, Human
ucuccugccuguagcagugaga

SEQ ID NO: 3457233 - RNA, 18 nt, Human
ucuccugccuuccuccug

SEQ ID NO: 3457234 - RNA, 21 nt, Human
ucuccugcguguucucagagg

SEQ ID NO: 3457235 - RNA, 20 nt, Human
ucuccugcugcucccucaga

SEQ ID NO: 3457236 - RNA, 13 nt, Human
ucuccuggcuucc

SEQ ID NO: 3457237 - RNA, 14 nt, Human
ucuccugggcagcu

SEQ ID NO: 3457238 - RNA, 18 nt, Human
ucuccugggcagcugccu

SEQ ID NO: 3457239 - RNA, 21 nt, Human
ucuccugggcagcugccuccc

SEQ ID NO: 3457240 - RNA, 13 nt, Human
ucuccugggcccc

SEQ ID NO: 3457241 - RNA, 23 nt, Human
ucuccugggccccucccuaccuc

SEQ ID NO: 3457242 - RNA, 19 nt, Human
ucuccuguaagccaaagaa

SEQ ID NO: 3457243 - RNA, 13 nt, Human
ucuccuguaccuc

SEQ ID NO: 3457244 - RNA, 17 nt, Human
ucuccuguaccucuuga

SEQ ID NO: 3457245 - RNA, 15 nt, Human
ucuccuguccucccu

SEQ ID NO: 3457246 - RNA, 18 nt, Human
ucuccugugcccacaucc

SEQ ID NO: 3457247 - RNA, 17 nt, Human
ucuccuguuuuucuggg

SEQ ID NO: 3457248 - RNA, 19 nt, Human
ucuccuguuuuucugggug

SEQ ID NO: 3457249 - RNA, 22 nt, Human
ucuccuuaagcugcagagauuu

SEQ ID NO: 3457250 - RNA, 21 nt, Human
ucuccuuagaaguggaaguag

SEQ ID NO: 3457251 - RNA, 17 nt, Human
ucuccuuagucuucuca

SEQ ID NO: 3457252 - RNA, 15 nt, Human
ucuccuucaccuuug

SEQ ID NO: 3457253 - RNA, 16 nt, Human
ucuccuucaccuuugu

SEQ ID NO: 3457254 - RNA, 18 nt, Human
ucuccuucaccuuugucc

SEQ ID NO: 3457255 - RNA, 22 nt, Human
ucuccuuccaacugcugcccca

SEQ ID NO: 3457256 - RNA, 22 nt, Human
ucuccuuccaguauaaccagcu

SEQ ID NO: 3457257 - RNA, 13 nt, Human
ucuccuuccugug

SEQ ID NO: 3457258 - RNA, 16 nt, Human
ucuccuugaguguaug

SEQ ID NO: 3457259 - RNA, 18 nt, Human
ucuccuugauaacagcua

SEQ ID NO: 3457260 - RNA, 17 nt, Human
ucuccuugguuauauuu

SEQ ID NO: 3457261 - RNA, 14 nt, Human
ucuccuuguggccu

SEQ ID NO: 3457262 - RNA, 17 nt, Human
ucuccuuuaauuguaaa

SEQ ID NO: 3457263 - RNA, 15 nt, Human
ucuccuuucuuucua

SEQ ID NO: 3457264 - RNA, 17 nt, Human
ucuccuuugauaaaaua

SEQ ID NO: 3457265 - RNA, 16 nt, Human
ucuccuuugcacugag

SEQ ID NO: 3457266 - RNA, 22 nt, Human
ucuccuuugcugaggccuccag

SEQ ID NO: 3457267 - RNA, 15 nt, Human
ucuccuuuguauucu

SEQ ID NO: 3457268 - RNA, 17 nt, Human
ucuccuuuuccucucuc

SEQ ID NO: 3457269 - RNA, 12 nt, Human
ucuccuuuucuu

SEQ ID NO: 3457270 - RNA, 14 nt, Human
ucuccuuuucuuuu

SEQ ID NO: 3457271 - RNA, 19 nt, Human
ucuccuuuucuuuuguuac

SEQ ID NO: 3457272 - RNA, 14 nt, Human
ucucgagcgcccug

SEQ ID NO: 3457273 - RNA, 17 nt, Human
ucucgagcgcccugcag

SEQ ID NO: 3457274 - RNA, 19 nt, Human
ucucgagcgcccugcagac

SEQ ID NO: 3457275 - RNA, 18 nt, Human
ucucgcugaugcugggcu

SEQ ID NO: 3457276 - RNA, 19 nt, Human
ucucgcugaugcugggcug

SEQ ID NO: 3457277 - RNA, 20 nt, Human
ucucgcugaugcugggcugg

SEQ ID NO: 3457278 - RNA, 22 nt, Human
ucucgcugaugcugggcugggu

SEQ ID NO: 3457279 - RNA, 20 nt, Human
ucucggaucaggcucccagg

SEQ ID NO: 3457280 - RNA, 18 nt, Human
ucucggccuucacaaucu

SEQ ID NO: 3457281 - RNA, 16 nt, Human
ucucggcucagugcaa

SEQ ID NO: 3457282 - RNA, 17 nt, Human
ucucgguuccacguccc

SEQ ID NO: 3457283 - RNA, 14 nt, Human
ucucguauagaagu

SEQ ID NO: 3457284 - RNA, 23 nt, Human
ucucguguuauuuuaaucucaga

SEQ ID NO: 3457285 - RNA, 14 nt, Human
ucucguuugugauu

SEQ ID NO: 3457286 - RNA, 19 nt, Human
ucucuaaagaguuuauuuu

SEQ ID NO: 3457287 - RNA, 14 nt, Human
ucucuaaccuccuu

SEQ ID NO: 3457288 - RNA, 15 nt, Human
ucucuaagugggcau

SEQ ID NO: 3457289 - RNA, 18 nt, Human
ucucuaaguuccacugag

SEQ ID NO: 3457290 - RNA, 14 nt, Human
ucucuaauaauaaa

SEQ ID NO: 3457291 - RNA, 17 nt, Human
ucucuaauaauaaauag

SEQ ID NO: 3457292 - RNA, 15 nt, Human
ucucuaauucuauua

SEQ ID NO: 3457293 - RNA, 18 nt, Human
ucucuaauucuuccuuug

SEQ ID NO: 3457294 - RNA, 15 nt, Human
ucucuacaaaaagca

SEQ ID NO: 3457295 - RNA, 20 nt, Human
ucucuacagacuucuccaga

SEQ ID NO: 3457296 - RNA, 19 nt, Human
ucucuacagaugucccauu

SEQ ID NO: 3457297 - RNA, 12 nt, Human
ucucuacccagc

SEQ ID NO: 3457298 - RNA, 19 nt, Human
ucucuacccaucuuaaaaa

SEQ ID NO: 3457299 - RNA, 16 nt, Human
ucucuaccuucucccc

SEQ ID NO: 3457300 - RNA, 18 nt, Human
ucucuaccuucuccccag

SEQ ID NO: 3457301 - RNA, 19 nt, Human
ucucuaccuucuccccagc

SEQ ID NO: 3457302 - RNA, 20 nt, Human
ucucuacuccuaccucagcc

SEQ ID NO: 3457303 - RNA, 21 nt, Human
ucucuacuccuaccucagccu

SEQ ID NO: 3457304 - RNA, 24 nt, Human
ucucuagcuggugguuucacggug

SEQ ID NO: 3457305 - RNA, 22 nt, Human
ucucuaggaccaugguuaagag

SEQ ID NO: 3457306 - RNA, 14 nt, Human
ucucuaggcugggg

SEQ ID NO: 3457307 - RNA, 19 nt, Human
ucucuagggaaggccaccu

SEQ ID NO: 3457308 - RNA, 20 nt, Human
ucucuagggaaggccaccug

SEQ ID NO: 3457309 - RNA, 15 nt, Human
ucucuaguaguuaaa

SEQ ID NO: 3457310 - RNA, 16 nt, Human
ucucuauaaaaaauau

SEQ ID NO: 3457311 - RNA, 16 nt, Human
ucucuauagcaccagg

SEQ ID NO: 3457312 - RNA, 15 nt, Human
ucucuaucauuaaag

SEQ ID NO: 3457313 - RNA, 13 nt, Human
ucucuaucauuua

SEQ ID NO: 3457314 - RNA, 15 nt, Human
ucucuauguaucaaa

SEQ ID NO: 3457315 - RNA, 14 nt, Human
ucucuauuccccac

SEQ ID NO: 3457316 - RNA, 14 nt, Human
ucucuauuuaaauu

SEQ ID NO: 3457317 - RNA, 15 nt, Human
ucucuauuuaaauuc

SEQ ID NO: 3457318 - RNA, 13 nt, Human
ucucucaacacca

SEQ ID NO: 3457319 - RNA, 20 nt, Human
ucucucaauaugcuuacaaa

SEQ ID NO: 3457320 - RNA, 17 nt, Human
ucucucacagacaggac

SEQ ID NO: 3457321 - RNA, 13 nt, Human
ucucucacuccuu

SEQ ID NO: 3457322 - RNA, 22 nt, Human
ucucucacuuguuuuauuuaac

SEQ ID NO: 3457323 - RNA, 20 nt, Human
ucucucagaagggaggcugg

SEQ ID NO: 3457324 - RNA, 14 nt, Human
ucucucaucucuua

SEQ ID NO: 3457325 - RNA, 22 nt, Human
ucucucaucucuuagcuccccu

SEQ ID NO: 3457326 - RNA, 14 nt, Human
ucucucauuugugu

SEQ ID NO: 3457327 - RNA, 18 nt, Human
ucucuccaaggugugccc

SEQ ID NO: 3457328 - RNA, 17 nt, Human
ucucuccacuuucagcu

SEQ ID NO: 3457329 - RNA, 13 nt, Human
ucucuccagcccc

SEQ ID NO: 3457330 - RNA, 15 nt, Human
ucucuccagccccug

SEQ ID NO: 3457331 - RNA, 19 nt, Human
ucucuccagccccuggaug

SEQ ID NO: 3457332 - RNA, 15 nt, Human
ucucuccagcugacu

SEQ ID NO: 3457333 - RNA, 11 nt, Human
ucucuccagga

SEQ ID NO: 3457334 - RNA, 13 nt, Human
ucucuccaggauc

SEQ ID NO: 3457335 - RNA, 20 nt, Human
ucucuccaucagaggacacc

SEQ ID NO: 3457336 - RNA, 22 nt, Human
ucucucccaggggcuggcuuca

SEQ ID NO: 3457337 - RNA, 21 nt, Human
ucucucccauggagccccagc

SEQ ID NO: 3457338 - RNA, 20 nt, Human
ucucuccccucaaagucugc

SEQ ID NO: 3457339 - RNA, 21 nt, Human
ucucuccccucaaagucugca

SEQ ID NO: 3457340 - RNA, 21 nt, Human
ucucucccuccccugccauuu

SEQ ID NO: 3457341 - RNA, 20 nt, Human
ucucucccucccuuugaaau

SEQ ID NO: 3457342 - RNA, 14 nt, Human
ucucuccucagacu

SEQ ID NO: 3457343 - RNA, 16 nt, Human
ucucuccuguaccucu

SEQ ID NO: 3457344 - RNA, 20 nt, Human
ucucuccuguaccucuugag

SEQ ID NO: 3457345 - RNA, 13 nt, Human
ucucuccugucca

SEQ ID NO: 3457346 - RNA, 14 nt, Human
ucucuccuguccuc

SEQ ID NO: 3457347 - RNA, 15 nt, Human
ucucuccuguccucc

SEQ ID NO: 3457348 - RNA, 13 nt, Human
ucucuccuuuucu

SEQ ID NO: 3457349 - RNA, 15 nt, Human
ucucucggcucccca

SEQ ID NO: 3457350 - RNA, 20 nt, Human
ucucucuacuccuaccucag

SEQ ID NO: 3457351 - RNA, 22 nt, Human
ucucucuacuccuaccucagcc

SEQ ID NO: 3457352 - RNA, 13 nt, Human
ucucucuaugccu

SEQ ID NO: 3457353 - RNA, 14 nt, Human
ucucucuauuacca

SEQ ID NO: 3457354 - RNA, 22 nt, Human
ucucucucacucccucccuuuc

SEQ ID NO: 3457355 - RNA, 14 nt, Human
ucucucuccagucu

SEQ ID NO: 3457356 - RNA, 14 nt, Human
ucuagaugauuuuu

SEQ ID NO: 3457357 - RNA, 21 nt, Human
ucuagauguuuauucuucuag

SEQ ID NO: 3457358 - RNA, 23 nt, Human
ucuagauguuuauucuucuagag

SEQ ID NO: 3457359 - RNA, 16 nt, Human
ucuagauuaauacucu

SEQ ID NO: 3457360 - RNA, 17 nt, Human
ucuagauuaccaugaag

SEQ ID NO: 3457361 - RNA, 13 nt, Human
ucuagauucaaag

SEQ ID NO: 3457362 - RNA, 18 nt, Human
ucuagauucaaagguucu

SEQ ID NO: 3457363 - RNA, 23 nt, Human
ucuagauucaaagguucuagguu

SEQ ID NO: 3457364 - RNA, 11 nt, Human
ucuagauucuc

SEQ ID NO: 3457365 - RNA, 21 nt, Human
ucuagauucucuggcuguaag

SEQ ID NO: 3457366 - RNA, 15 nt, Human
ucuagauugagagaa

SEQ ID NO: 3457367 - RNA, 19 nt, Human
ucuagauuuuguuuugcuu

SEQ ID NO: 3457368 - RNA, 18 nt, Human
ucuagcacucauuuucua

SEQ ID NO: 3457369 - RNA, 15 nt, Human
ucuagcacuggccug

SEQ ID NO: 3457370 - RNA, 18 nt, Human
ucuagcacuuccuugcca

SEQ ID NO: 3457371 - RNA, 16 nt, Human
ucuagcagcaccuccu

SEQ ID NO: 3457372 - RNA, 12 nt, Human
ucuagcaugaag

SEQ ID NO: 3457373 - RNA, 20 nt, Human
ucuagcaugccaacaagaau

SEQ ID NO: 3457374 - RNA, 22 nt, Human
ucuagcaugccaacaagaaugc

SEQ ID NO: 3457375 - RNA, 19 nt, Human
ucuagcauuagguauaucu

SEQ ID NO: 3457376 - RNA, 16 nt, Human
ucuagccaaaugguuu

SEQ ID NO: 3457377 - RNA, 13 nt, Human
ucuagcccaugga

SEQ ID NO: 3457378 - RNA, 23 nt, Human
ucuagcgcaguuuuuuuuuucuu

SEQ ID NO: 3457379 - RNA, 11 nt, Human
ucuagcuguug

SEQ ID NO: 3457380 - RNA, 18 nt, Human
ucuagcuguugagcuguu

SEQ ID NO: 3457381 - RNA, 14 nt, Human
ucuagcuuaucuac

SEQ ID NO: 3457382 - RNA, 22 nt, Human
ucuagcuuuuuaauuaagcaaa

SEQ ID NO: 3457383 - RNA, 22 nt, Human
ucuaggaaauauacuuuuacaa

SEQ ID NO: 3457384 - RNA, 23 nt, Human
ucuaggaagaauuuuaaaaauga

SEQ ID NO: 3457385 - RNA, 16 nt, Human
ucuaggaagacuuugg

SEQ ID NO: 3457386 - RNA, 19 nt, Human
ucuaggaagacuuuggaaa

SEQ ID NO: 3457387 - RNA, 21 nt, Human
ucuaggaagacuuuggaaaga

SEQ ID NO: 3457388 - RNA, 21 nt, Human
ucuaggacacaguuccuggga

SEQ ID NO: 3457389 - RNA, 23 nt, Human
ucuaggacugaauuaugaaacuu

SEQ ID NO: 3457390 - RNA, 23 nt, Human
ucuaggauagcuaacuguaaauc

SEQ ID NO: 3457391 - RNA, 21 nt, Human
ucuaggcacuguaguucuaag

SEQ ID NO: 3457392 - RNA, 24 nt, Human
ucuaggcacuguaguucuaagacu

SEQ ID NO: 3457393 - RNA, 20 nt, Human
ucuaggccuccuggcccagg

SEQ ID NO: 3457394 - RNA, 14 nt, Human
ucuaggccucucca

SEQ ID NO: 3457395 - RNA, 17 nt, Human
ucuaggcucugccuucg

SEQ ID NO: 3457396 - RNA, 13 nt, Human
ucuagggaaauga

SEQ ID NO: 3457397 - RNA, 22 nt, Human
ucuagggaaggccaccugcagg

SEQ ID NO: 3457398 - RNA, 16 nt, Human
ucuagggaccccuccu

SEQ ID NO: 3457399 - RNA, 23 nt, Human
ucuagggauagucaccuuuuaaa

SEQ ID NO: 3457400 - RNA, 23 nt, Human
ucuaggguacauggugcugggag

SEQ ID NO: 3457401 - RNA, 18 nt, Human
ucuaggguugcuggagcc

SEQ ID NO: 3457402 - RNA, 15 nt, Human
ucuagguaaauuaca

SEQ ID NO: 3457403 - RNA, 20 nt, Human
ucuaggucaaggccuguccc

SEQ ID NO: 3457404 - RNA, 23 nt, Human
ucuaggugcccuuggaggccagc

SEQ ID NO: 3457405 - RNA, 17 nt, Human
ucuagguggaguugaaa

SEQ ID NO: 3457406 - RNA, 20 nt, Human
ucuagguggcaaggcugugc

SEQ ID NO: 3457407 - RNA, 23 nt, Human
ucuagguucuaaaaauugugauc

SEQ ID NO: 3457408 - RNA, 15 nt, Human
ucuagguuucaaaga

SEQ ID NO: 3457409 - RNA, 17 nt, Human
ucuagguuucaaagaug

SEQ ID NO: 3457410 - RNA, 20 nt, Human
ucuagguuucaaagaugcug

SEQ ID NO: 3457411 - RNA, 17 nt, Human
ucuagguuuuacagauu

SEQ ID NO: 3457412 - RNA, 19 nt, Human
ucuaguaauaaagacucua

SEQ ID NO: 3457413 - RNA, 21 nt, Human
ucuaguaauauauuuaaaggg

SEQ ID NO: 3457414 - RNA, 16 nt, Human
ucuaguagcugaaaug

SEQ ID NO: 3457415 - RNA, 19 nt, Human
ucuaguagcugaaaugcaa

SEQ ID NO: 3457416 - RNA, 15 nt, Human
ucuaguaguuaaaaa

SEQ ID NO: 3457417 - RNA, 19 nt, Human
ucuaguaguuguucugaaa

SEQ ID NO: 3457418 - RNA, 17 nt, Human
ucuaguaugaaauuaua

SEQ ID NO: 3457419 - RNA, 14 nt, Human
ucuagucaaugaca

SEQ ID NO: 3457420 - RNA, 22 nt, Human
ucuagucuccuuugcacugagg

SEQ ID NO: 3457421 - RNA, 18 nt, Human
ucuagucucucuggggcc

SEQ ID NO: 3457422 - RNA, 14 nt, Human
ucuagucuuggcca

SEQ ID NO: 3457423 - RNA, 11 nt, Human
ucuagugaaug

SEQ ID NO: 3457424 - RNA, 14 nt, Human
ucuagugcagcuga

SEQ ID NO: 3457425 - RNA, 18 nt, Human
ucuagugccuucuaaagg

SEQ ID NO: 3457426 - RNA, 13 nt, Human
ucuagugcugcug

SEQ ID NO: 3457427 - RNA, 22 nt, Human
ucuaguggucuuuguaagagug

SEQ ID NO: 3457428 - RNA, 13 nt, Human
ucuaguguaucaa

SEQ ID NO: 3457429 - RNA, 14 nt, Human
ucuaguguuuucaa

SEQ ID NO: 3457430 - RNA, 18 nt, Human
ucuaguguuuucaauuuu

SEQ ID NO: 3457431 - RNA, 14 nt, Human
ucuaguuauuuauu

SEQ ID NO: 3457432 - RNA, 21 nt, Human
ucuaguuccugaugacccagg

SEQ ID NO: 3457433 - RNA, 14 nt, Human
ucuaguucugccag

SEQ ID NO: 3457434 - RNA, 18 nt, Human
ucuaguugcuuguaaaau

SEQ ID NO: 3457435 - RNA, 23 nt, Human
ucuaguuguuugauucagacagc

SEQ ID NO: 3457436 - RNA, 23 nt, Human
ggccauccggcccccagagcgcc

SEQ ID NO: 3457437 - RNA, 15 nt, Human
ggccauccuguccca

SEQ ID NO: 3457438 - RNA, 17 nt, Human
ggccaucgguccugucu

SEQ ID NO: 3457439 - RNA, 19 nt, Human
ggccaucucuggaugccug

SEQ ID NO: 3457440 - RNA, 13 nt, Human
ggccaucugcucc

SEQ ID NO: 3457441 - RNA, 17 nt, Human
ggccaucugcuccugga

SEQ ID NO: 3457442 - RNA, 16 nt, Human
ggccaucuggagagcc

SEQ ID NO: 3457443 - RNA, 22 nt, Human
ggccaucugggcuccuccaggg

SEQ ID NO: 3457444 - RNA, 17 nt, Human
ggccaugaacuuugucc

SEQ ID NO: 3457445 - RNA, 16 nt, Human
ggccaugacccugccu

SEQ ID NO: 3457446 - RNA, 22 nt, Human
ggccaugagcuccagaccccca

SEQ ID NO: 3457447 - RNA, 14 nt, Human
ggccaugccucagc

SEQ ID NO: 3457448 - RNA, 13 nt, Human
ggccaugcuccuc

SEQ ID NO: 3457449 - RNA, 17 nt, Human
ggccaugcuccucuucc

SEQ ID NO: 3457450 - RNA, 21 nt, Human
ggccaugcuccucuuccccag

SEQ ID NO: 3457451 - RNA, 13 nt, Human
ggccaugcugagg

SEQ ID NO: 3457452 - RNA, 22 nt, Human
ggccaugcugaggccugggccg

SEQ ID NO: 3457453 - RNA, 21 nt, Human
ggccauggagaaagcugacuu

SEQ ID NO: 3457454 - RNA, 17 nt, Human
ggccauggagagcugga

SEQ ID NO: 3457455 - RNA, 21 nt, Human
ggccauggagagcuggagccu

SEQ ID NO: 3457456 - RNA, 13 nt, Human
ggccauggcagaa

SEQ ID NO: 3457457 - RNA, 14 nt, Human
ggccauggccugca

SEQ ID NO: 3457458 - RNA, 22 nt, Human
ggccaugggacagggaggacgc

SEQ ID NO: 3457459 - RNA, 22 nt, Human
ggccaugggaggccuuucccua

SEQ ID NO: 3457460 - RNA, 13 nt, Human
ggccauguccaaa

SEQ ID NO: 3457461 - RNA, 16 nt, Human
ggccauguccaaagag

SEQ ID NO: 3457462 - RNA, 13 nt, Human
ggccauguccuua

SEQ ID NO: 3457463 - RNA, 23 nt, Human
ggccaugugcauaguuucuuuau

SEQ ID NO: 3457464 - RNA, 13 nt, Human
ggccauguuccaa

SEQ ID NO: 3457465 - RNA, 16 nt, Human
ggccauguugugccuc

SEQ ID NO: 3457466 - RNA, 21 nt, Human
ggccauguugugccucccugg

SEQ ID NO: 3457467 - RNA, 22 nt, Human
ggccauguugugccucccuggu

SEQ ID NO: 3457468 - RNA, 20 nt, Human
ggccauucugccgcccccuc

SEQ ID NO: 3457469 - RNA, 20 nt, Human
ggccauucuuucccaacacc

SEQ ID NO: 3457470 - RNA, 20 nt, Human
ggccauuugcaauaacagcu

SEQ ID NO: 3457471 - RNA, 21 nt, Human
ggcccaaaggccuuggacaac

SEQ ID NO: 3457472 - RNA, 23 nt, Human
ggcccaacacaauucuucuucca

SEQ ID NO: 3457473 - RNA, 20 nt, Human
ggcccaaccaccagaugaga

SEQ ID NO: 3457474 - RNA, 17 nt, Human
ggcccaacccugucugu

SEQ ID NO: 3457475 - RNA, 13 nt, Human
ggcccaaggcggc

SEQ ID NO: 3457476 - RNA, 21 nt, Human
ggcccaauccaagguggggug

SEQ ID NO: 3457477 - RNA, 13 nt, Human
ggcccacacacag

SEQ ID NO: 3457478 - RNA, 14 nt, Human
ggcccacagcuccc

SEQ ID NO: 3457479 - RNA, 15 nt, Human
ggcccacagcuccca

SEQ ID NO: 3457480 - RNA, 19 nt, Human
ggcccacagcucccacccc

SEQ ID NO: 3457481 - RNA, 20 nt, Human
ggcccacagcucccacccca

SEQ ID NO: 3457482 - RNA, 23 nt, Human
ggcccacaggaggcaagcaagcu

SEQ ID NO: 3457483 - RNA, 14 nt, Human
ggcccaccaggguc

SEQ ID NO: 3457484 - RNA, 20 nt, Human
ggcccacccaagcaggaggc

SEQ ID NO: 3457485 - RNA, 18 nt, Human
ggcccaccccacccacuu

SEQ ID NO: 3457486 - RNA, 21 nt, Human
ggcccacccugcuuggcccag

SEQ ID NO: 3457487 - RNA, 23 nt, Human
ggcccacccugcuuggcccaggg

SEQ ID NO: 3457488 - RNA, 12 nt, Human
ggcccaccuggc

SEQ ID NO: 3457489 - RNA, 15 nt, Human
ggcccaccuggccac

SEQ ID NO: 3457490 - RNA, 22 nt, Human
ggcccacgccuguaaucccagc

SEQ ID NO: 3457491 - RNA, 22 nt, Human
ggcccacguagggcggcacuca

SEQ ID NO: 3457492 - RNA, 23 nt, Human
ggcccacugugccucagagacca

SEQ ID NO: 3457493 - RNA, 11 nt, Human
ggcccagagag

SEQ ID NO: 3457494 - RNA, 22 nt, Human
ggcccagagagaagagccccac

SEQ ID NO: 3457495 - RNA, 16 nt, Human
ggcccagagcccagcu

SEQ ID NO: 3457496 - RNA, 18 nt, Human
ggcccagagcccagcucc

SEQ ID NO: 3457497 - RNA, 22 nt, Human
ggcccagaggagcugggagccg

SEQ ID NO: 3457498 - RNA, 19 nt, Human
ggcccagagggccugcaag

SEQ ID NO: 3457499 - RNA, 20 nt, Human
ucuggacugaagccugcagg

SEQ ID NO: 3457500 - RNA, 14 nt, Human
ucuggacugacagc

SEQ ID NO: 3457501 - RNA, 14 nt, Human
ucuggacuggcuag

SEQ ID NO: 3457502 - RNA, 15 nt, Human
ucuggacuggcuaga

SEQ ID NO: 3457503 - RNA, 22 nt, Human
ucuggacuguggguuugugggg

SEQ ID NO: 3457504 - RNA, 22 nt, Human
ucuggacuuucucuaauaauaa

SEQ ID NO: 3457505 - RNA, 22 nt, Human
ucuggagaagcagugagccgca

SEQ ID NO: 3457506 - RNA, 19 nt, Human
ucuggagaagcucccagga

SEQ ID NO: 3457507 - RNA, 20 nt, Human
ucuggagaagcucccaggaa

SEQ ID NO: 3457508 - RNA, 12 nt, Human
ucuggagacagc

SEQ ID NO: 3457509 - RNA, 16 nt, Human
ucuggagacagcccca

SEQ ID NO: 3457510 - RNA, 18 nt, Human
ucuggagacagccccaga

SEQ ID NO: 3457511 - RNA, 24 nt, Human
ucuggagacagccccagagcaggg

SEQ ID NO: 3457512 - RNA, 20 nt, Human
ucuggagaccagggagccuu

SEQ ID NO: 3457513 - RNA, 14 nt, Human
ucuggagagaacag

SEQ ID NO: 3457514 - RNA, 14 nt, Human
ucuggagagcuaga

SEQ ID NO: 3457515 - RNA, 22 nt, Human
ucuggagagcuagaaccuggag

SEQ ID NO: 3457516 - RNA, 20 nt, Human
ucuggagagguuauagguca

SEQ ID NO: 3457517 - RNA, 12 nt, Human
ucuggagcccuu

SEQ ID NO: 3457518 - RNA, 13 nt, Human
ucuggagcccuug

SEQ ID NO: 3457519 - RNA, 14 nt, Human
ucuggagcuguccg

SEQ ID NO: 3457520 - RNA, 17 nt, Human
ucuggaggaccugcccg

SEQ ID NO: 3457521 - RNA, 16 nt, Human
ucuggaggccucuggg

SEQ ID NO: 3457522 - RNA, 17 nt, Human
ucuggaggccucugggc

SEQ ID NO: 3457523 - RNA, 21 nt, Human
ucuggaggccuuccagcugcu

SEQ ID NO: 3457524 - RNA, 22 nt, Human
ucuggaggccuuccagcugcug

SEQ ID NO: 3457525 - RNA, 16 nt, Human
ucuggagggaaacacc

SEQ ID NO: 3457526 - RNA, 19 nt, Human
ucuggagucuccagugguu

SEQ ID NO: 3457527 - RNA, 23 nt, Human
ucuggauaacuuccacagggucc

SEQ ID NO: 3457528 - RNA, 21 nt, Human
ucuggauaggagccugcuggu

SEQ ID NO: 3457529 - RNA, 18 nt, Human
ucuggaugcauuucucug

SEQ ID NO: 3457530 - RNA, 18 nt, Human
ucuggauggcaccagagg

SEQ ID NO: 3457531 - RNA, 19 nt, Human
ucuggauggcaccagaggc

SEQ ID NO: 3457532 - RNA, 18 nt, Human
ucuggauggugugccuuc

SEQ ID NO: 3457533 - RNA, 22 nt, Human
ucuggauggugugccuuccaga

SEQ ID NO: 3457534 - RNA, 12 nt, Human
ucuggauuauau

SEQ ID NO: 3457535 - RNA, 13 nt, Human
ucuggauucaaau

SEQ ID NO: 3457536 - RNA, 21 nt, Human
ucuggauucccaggaugagca

SEQ ID NO: 3457537 - RNA, 21 nt, Human
ucuggauucugaaucucaaga

SEQ ID NO: 3457538 - RNA, 21 nt, Human
ucuggcaaagcuuuuagaaau

SEQ ID NO: 3457539 - RNA, 16 nt, Human
ucuggcaacaucuuua

SEQ ID NO: 3457540 - RNA, 12 nt, Human
ucuggcaaggac

SEQ ID NO: 3457541 - RNA, 16 nt, Human
ucuggcaaugccacag

SEQ ID NO: 3457542 - RNA, 23 nt, Human
ucuggcaaugccacagcccuguc

SEQ ID NO: 3457543 - RNA, 17 nt, Human
ucuggcacagccugcac

SEQ ID NO: 3457544 - RNA, 13 nt, Human
ucuggcagccaca

SEQ ID NO: 3457545 - RNA, 16 nt, Human
ucuggcagcucagaga

SEQ ID NO: 3457546 - RNA, 19 nt, Human
ucuggcagggugggaugga

SEQ ID NO: 3457547 - RNA, 18 nt, Human
ucuggcauuagaauuauu

SEQ ID NO: 3457548 - RNA, 19 nt, Human
ucuggccaggauggagggg

SEQ ID NO: 3457549 - RNA, 21 nt, Human
ucuggccaguguuuaaaacuu

SEQ ID NO: 3457550 - RNA, 21 nt, Human
ucuggccauauuuacuaccuu

SEQ ID NO: 3457551 - RNA, 22 nt, Human
ucuggccccccugguccccucc

SEQ ID NO: 3457552 - RNA, 11 nt, Human
ucuggcccuau

SEQ ID NO: 3457553 - RNA, 19 nt, Human
ucuggcccucaccccugcc

SEQ ID NO: 3457554 - RNA, 23 nt, Human
ucuggcccucaccccugcccugg

SEQ ID NO: 3457555 - RNA, 21 nt, Human
ucuggcccucuaccccugauc

SEQ ID NO: 3457556 - RNA, 23 nt, Human
ucuggcccuugcuuaccucucag

SEQ ID NO: 3457557 - RNA, 13 nt, Human
ucuggccucaggu

SEQ ID NO: 3457558 - RNA, 23 nt, Human
ucuggccucccacccgaugcugc

SEQ ID NO: 3457559 - RNA, 17 nt, Human
ucuggccuggccagugc

SEQ ID NO: 3457560 - RNA, 14 nt, Human
ucuggccuggccug

SEQ ID NO: 3457561 - RNA, 19 nt, Human
ucuggccuggccuggcccu

SEQ ID NO: 3457562 - RNA, 21 nt, Human
ucuggccuggccuggcccugc

SEQ ID NO: 3457563 - RNA, 22 nt, Human
ucuggccuggccuggcccugcc

SEQ ID NO: 3457564 - RNA, 23 nt, Human
ucuggccuggccuggcccugccc

SEQ ID NO: 3457565 - RNA, 18 nt, Human
ucuggccuucggccucca

SEQ ID NO: 3457566 - RNA, 17 nt, Human
ucuggcuagaggccagc

SEQ ID NO: 3457567 - RNA, 14 nt, Human
ucuggcuaugcauu

SEQ ID NO: 3457568 - RNA, 19 nt, Human
ucuggcuaugcauuugaaa

SEQ ID NO: 3457569 - RNA, 12 nt, Human
ucuggcucuaau

SEQ ID NO: 3457570 - RNA, 20 nt, Human
ucuggcucuaauucacagug

SEQ ID NO: 3457571 - RNA, 15 nt, Human
ucuggcucuccccaa

SEQ ID NO: 3457572 - RNA, 16 nt, Human
ucuggcugaacccugu

SEQ ID NO: 3457573 - RNA, 18 nt, Human
ucuggcugaacccugugc

SEQ ID NO: 3457574 - RNA, 19 nt, Human
ucuggcugaacccugugcu

SEQ ID NO: 3457575 - RNA, 22 nt, Human
ucuggcugacuaaauuugggga

SEQ ID NO: 3457576 - RNA, 23 nt, Human
ucuggcugauaaaagauacauuu

SEQ ID NO: 3457577 - RNA, 15 nt, Human
ucuggcugcagagca

SEQ ID NO: 3457578 - RNA, 18 nt, Human
ucuggcugguguuaacag

SEQ ID NO: 3457579 - RNA, 18 nt, Human
ucuggcuguaaggcucua

SEQ ID NO: 3457580 - RNA, 16 nt, Human
ucuggcuuauuuuaau

SEQ ID NO: 3457581 - RNA, 22 nt, Human
ucuggcuuccagguaucuccag

SEQ ID NO: 3457582 - RNA, 15 nt, Human
ucuggcuucuggcca

SEQ ID NO: 3457583 - RNA, 18 nt, Human
ucuggcuucuggccagga

SEQ ID NO: 3457584 - RNA, 20 nt, Human
ucuggcuucuggccaggaag

SEQ ID NO: 3457585 - RNA, 22 nt, Human
ucuggcuugggcagggucuguu

SEQ ID NO: 3457586 - RNA, 17 nt, Human
ucuggcuuuaagccuuc

SEQ ID NO: 3457587 - RNA, 18 nt, Human
ucugggaacugugccuuu

SEQ ID NO: 3457588 - RNA, 12 nt, Human
ucugggacacag

SEQ ID NO: 3457589 - RNA, 14 nt, Human
ucugggacacaguu

SEQ ID NO: 3457590 - RNA, 13 nt, Human
ucugggaccucag

SEQ ID NO: 3457591 - RNA, 21 nt, Human
ucugggaccugccaggcaggg

SEQ ID NO: 3457592 - RNA, 13 nt, Human
ucugggacuuccu

SEQ ID NO: 3457593 - RNA, 13 nt, Human
ucugggagaggau

SEQ ID NO: 3457594 - RNA, 15 nt, Human
ucugggagaggauuu

SEQ ID NO: 3457595 - RNA, 16 nt, Human
ucugggagaggauuuu

SEQ ID NO: 3457596 - RNA, 23 nt, Human
ucugggaggaauggacagacaga

SEQ ID NO: 3457597 - RNA, 16 nt, Human
ucugggagucacacag

SEQ ID NO: 3457598 - RNA, 14 nt, Human
ggccccucccuacc

SEQ ID NO: 3457599 - RNA, 16 nt, Human
ggccccucccuaccuc

SEQ ID NO: 3457600 - RNA, 14 nt, Human
ggccccucucagcc

SEQ ID NO: 3457601 - RNA, 15 nt, Human
ggccccucucagccc

SEQ ID NO: 3457602 - RNA, 12 nt, Human
ggccccucuccc

SEQ ID NO: 3457603 - RNA, 24 nt, Human
ggccccucugacucccaaagagcu

SEQ ID NO: 3457604 - RNA, 14 nt, Human
ggccccucugccca

SEQ ID NO: 3457605 - RNA, 15 nt, Human
ggccccucugcccag

SEQ ID NO: 3457606 - RNA, 19 nt, Human
ggccccucugcccagcuug

SEQ ID NO: 3457607 - RNA, 21 nt, Human
ggccccugagaucucugcagg

SEQ ID NO: 3457608 - RNA, 17 nt, Human
ggccccugcauccccuu

SEQ ID NO: 3457609 - RNA, 12 nt, Human
ggccccugccac

SEQ ID NO: 3457610 - RNA, 17 nt, Human
ggccccugccacccugg

SEQ ID NO: 3457611 - RNA, 20 nt, Human
ggccccugccaccuccugcc

SEQ ID NO: 3457612 - RNA, 16 nt, Human
ggccccugccucucug

SEQ ID NO: 3457613 - RNA, 19 nt, Human
ggccccugccucucugcag

SEQ ID NO: 3457614 - RNA, 21 nt, Human
ggccccugccucucugcaggu

SEQ ID NO: 3457615 - RNA, 20 nt, Human
ggccccugcuucuccagccu

SEQ ID NO: 3457616 - RNA, 14 nt, Human
ggccccuggcccag

SEQ ID NO: 3457617 - RNA, 20 nt, Human
ggccccuggcccagcggccc

SEQ ID NO: 3457618 - RNA, 20 nt, Human
ggccccugggcuuggccugc

SEQ ID NO: 3457619 - RNA, 23 nt, Human
ggccccugggcuuggccugcugu

SEQ ID NO: 3457620 - RNA, 20 nt, Human
ggccccuuugggcccugcau

SEQ ID NO: 3457621 - RNA, 16 nt, Human
ggccccuuuucacucc

SEQ ID NO: 3457622 - RNA, 19 nt, Human
ggccccuuuuuacuccccu

SEQ ID NO: 3457623 - RNA, 14 nt, Human
ggcccgagcagcug

SEQ ID NO: 3457624 - RNA, 15 nt, Human
ggcccgagcagcuga

SEQ ID NO: 3457625 - RNA, 18 nt, Human
ggcccgagcagcugagca

SEQ ID NO: 3457626 - RNA, 20 nt, Human
ggcccgagcagcugagcagg

SEQ ID NO: 3457627 - RNA, 23 nt, Human
ggcccgagcagcugagcagggcc

SEQ ID NO: 3457628 - RNA, 19 nt, Human
ggcccgccucuccucgguu

SEQ ID NO: 3457629 - RNA, 21 nt, Human
ggcccgcuugccucggcuccu

SEQ ID NO: 3457630 - RNA, 15 nt, Human
ggcccggaugcugcu

SEQ ID NO: 3457631 - RNA, 14 nt, Human
ggcccggcagggcg

SEQ ID NO: 3457632 - RNA, 18 nt, Human
ggcccggcagggcgggca

SEQ ID NO: 3457633 - RNA, 13 nt, Human
ggcccggcuccag

SEQ ID NO: 3457634 - RNA, 22 nt, Human
ggcccggggcuggcggcuacuc

SEQ ID NO: 3457635 - RNA, 13 nt, Human
ggcccgugacaga

SEQ ID NO: 3457636 - RNA, 17 nt, Human
ggcccguugucucccug

SEQ ID NO: 3457637 - RNA, 21 nt, Human
ggcccuaauucagccauguac

SEQ ID NO: 3457638 - RNA, 21 nt, Human
ggcccuaggggucacuguacu

SEQ ID NO: 3457639 - RNA, 20 nt, Human
ggcccucaaggccucccaca

SEQ ID NO: 3457640 - RNA, 15 nt, Human
ggcccucaccccugc

SEQ ID NO: 3457641 - RNA, 12 nt, Human
ggcccucagcau

SEQ ID NO: 3457642 - RNA, 20 nt, Human
ggcccucagcauauuuguau

SEQ ID NO: 3457643 - RNA, 15 nt, Human
ggcuaacuggaagca

SEQ ID NO: 3457644 - RNA, 15 nt, Human
ggcuaacuuggguua

SEQ ID NO: 3457645 - RNA, 15 nt, Human
ggcuaagacuuccua

SEQ ID NO: 3457646 - RNA, 20 nt, Human
ggcuaagagcuagcgcugcc

SEQ ID NO: 3457647 - RNA, 14 nt, Human
ggcuaagaggcugc

SEQ ID NO: 3457648 - RNA, 16 nt, Human
ggcuaaggcaccagcc

SEQ ID NO: 3457649 - RNA, 22 nt, Human
ucuuauggaauugauuugcauu

SEQ ID NO: 3457650 - RNA, 18 nt, Human
ucuuauggauguccccag

SEQ ID NO: 3457651 - RNA, 18 nt, Human
ucuuauguaugugaaagu

SEQ ID NO: 3457652 - RNA, 12 nt, Human
ucuuaugugaca

SEQ ID NO: 3457653 - RNA, 19 nt, Human
ucuuaugugacauuaacaa

SEQ ID NO: 3457654 - RNA, 15 nt, Human
ucuuauuaaaguuuc

SEQ ID NO: 3457655 - RNA, 16 nt, Human
ucuuauuaaaguuuca

SEQ ID NO: 3457656 - RNA, 15 nt, Human
ucuuauuauauauau

SEQ ID NO: 3457657 - RNA, 15 nt, Human
ucuuauucauuuucu

SEQ ID NO: 3457658 - RNA, 16 nt, Human
ucuuauuucauuucuu

SEQ ID NO: 3457659 - RNA, 17 nt, Human
ucuuauuuuuuaaaaag

SEQ ID NO: 3457660 - RNA, 15 nt, Human
ucuucaaaaacuguu

SEQ ID NO: 3457661 - RNA, 20 nt, Human
ucuucaaaaguaaugccucu

SEQ ID NO: 3457662 - RNA, 16 nt, Human
ucuucaaaauaucaag

SEQ ID NO: 3457663 - RNA, 17 nt, Human
ucuucaaaaugagcccu

SEQ ID NO: 3457664 - RNA, 20 nt, Human
ucuucaaaauguauauauuu

SEQ ID NO: 3457665 - RNA, 14 nt, Human
ucuucaaagccuuc

SEQ ID NO: 3457666 - RNA, 17 nt, Human
ucuucaaagccuucucc

SEQ ID NO: 3457667 - RNA, 17 nt, Human
ucuucaaauccuuccaa

SEQ ID NO: 3457668 - RNA, 16 nt, Human
ucuucaaauuagaaga

SEQ ID NO: 3457669 - RNA, 18 nt, Human
ucuucaacaggagaauuu

SEQ ID NO: 3457670 - RNA, 22 nt, Human
ucuucaacauaacccacuuguc

SEQ ID NO: 3457671 - RNA, 20 nt, Human
ucuucaacaucaauguucau

SEQ ID NO: 3457672 - RNA, 21 nt, Human
ucuucaacaucaauguucauu

SEQ ID NO: 3457673 - RNA, 15 nt, Human
ucuucaacucccugc

SEQ ID NO: 3457674 - RNA, 19 nt, Human
ucuucaacugaccagccuc

SEQ ID NO: 3457675 - RNA, 14 nt, Human
ucuucaagaaaucu

SEQ ID NO: 3457676 - RNA, 11 nt, Human
ucuucaagaga

SEQ ID NO: 3457677 - RNA, 18 nt, Human
ucuucaagggcugcuuca

SEQ ID NO: 3457678 - RNA, 18 nt, Human
ucuucaauuuguauaaaa

SEQ ID NO: 3457679 - RNA, 13 nt, Human
ucuucacaaaauc

SEQ ID NO: 3457680 - RNA, 15 nt, Human
ucuucacaacagauu

SEQ ID NO: 3457681 - RNA, 18 nt, Human
ucuucacagcucuguguu

SEQ ID NO: 3457682 - RNA, 23 nt, Human
ucuucaccugauucaacuaaaaa

SEQ ID NO: 3457683 - RNA, 14 nt, Human
ucuucacucccccu

SEQ ID NO: 3457684 - RNA, 21 nt, Human
ucuucacucuuaggcacuuug

SEQ ID NO: 3457685 - RNA, 23 nt, Human
ucuucagaaagugugcuuuaugc

SEQ ID NO: 3457686 - RNA, 18 nt, Human
ucuucagaagacacugca

SEQ ID NO: 3457687 - RNA, 18 nt, Human
ucuucagacucucagccc

SEQ ID NO: 3457688 - RNA, 23 nt, Human
ucuucagacucucagcccagaag

SEQ ID NO: 3457689 - RNA, 13 nt, Human
ucuucagagcuga

SEQ ID NO: 3457690 - RNA, 14 nt, Human
ucuucagaggcccu

SEQ ID NO: 3457691 - RNA, 12 nt, Human
ucuucagccuag

SEQ ID NO: 3457692 - RNA, 22 nt, Human
ucuucagccuagccgaccucag

SEQ ID NO: 3457693 - RNA, 16 nt, Human
ucuucagcguaaaaug

SEQ ID NO: 3457694 - RNA, 13 nt, Human
ucuucagcuucuu

SEQ ID NO: 3457695 - RNA, 15 nt, Human
ucuucaggccucccu

SEQ ID NO: 3457696 - RNA, 18 nt, Human
ucuucaggccucccucuc

SEQ ID NO: 3457697 - RNA, 15 nt, Human
ucuucagggcacugc

SEQ ID NO: 3457698 - RNA, 22 nt, Human
ucuucagggccugguugaagaa

SEQ ID NO: 3457699 - RNA, 21 nt, Human
ucuucaggguccugagauuua

SEQ ID NO: 3457700 - RNA, 23 nt, Human
ucuucagguggaaaaacaucuga

SEQ ID NO: 3457701 - RNA, 14 nt, Human
ucuucagguucuua

SEQ ID NO: 3457702 - RNA, 15 nt, Human
ucuucaguaagccgu

SEQ ID NO: 3457703 - RNA, 16 nt, Human
ucuucagucagaaaac

SEQ ID NO: 3457704 - RNA, 19 nt, Human
ucuucagugggagaaaaca

SEQ ID NO: 3457705 - RNA, 20 nt, Human
ucuucaguuaagccuuugga

SEQ ID NO: 3457706 - RNA, 22 nt, Human
ucuucaguuaagccuuuggaaa

SEQ ID NO: 3457707 - RNA, 20 nt, Human
ucuucaguugguguguuuuu

SEQ ID NO: 3457708 - RNA, 16 nt, Human
ucuucaguugucucug

SEQ ID NO: 3457709 - RNA, 15 nt, Human
ucuucauaauucuaa

SEQ ID NO: 3457710 - RNA, 15 nt, Human
ucuucauacuuuuuu

SEQ ID NO: 3457711 - RNA, 23 nt, Human
ucuucauaucaucacaacauuau

SEQ ID NO: 3457712 - RNA, 21 nt, Human
ucuucauauucuaaaaccauu

SEQ ID NO: 3457713 - RNA, 15 nt, Human
ucuucaucccacucc

SEQ ID NO: 3457714 - RNA, 17 nt, Human
ucuucaucccauuccag

SEQ ID NO: 3457715 - RNA, 18 nt, Human
ucuucauccggcagccug

SEQ ID NO: 3457716 - RNA, 19 nt, Human
ucuucauccggcagccugg

SEQ ID NO: 3457717 - RNA, 20 nt, Human
ucuucauccggcagccugga

SEQ ID NO: 3457718 - RNA, 16 nt, Human
ucuucauccuuagcaa

SEQ ID NO: 3457719 - RNA, 18 nt, Human
ucuucaucuucaccagag

SEQ ID NO: 3457720 - RNA, 23 nt, Human
ucuucauguaaauugacuguacu

SEQ ID NO: 3457721 - RNA, 16 nt, Human
ucuucauguuucagga

SEQ ID NO: 3457722 - RNA, 21 nt, Human
ucuucauuucauuguaugaug

SEQ ID NO: 3457723 - RNA, 22 nt, Human
ucuucauuucauuguaugaugu

SEQ ID NO: 3457724 - RNA, 20 nt, Human
ucuucauuugaaugucuucu

SEQ ID NO: 3457725 - RNA, 14 nt, Human
ucuuccaaagcaca

SEQ ID NO: 3457726 - RNA, 18 nt, Human
ucuuccaagcaaagguga

SEQ ID NO: 3457727 - RNA, 13 nt, Human
ucuuccacacaug

SEQ ID NO: 3457728 - RNA, 14 nt, Human
ucuuccaccuggaa

SEQ ID NO: 3457729 - RNA, 11 nt, Human
ucuuccagaag

SEQ ID NO: 3457730 - RNA, 17 nt, Human
ucuuccagaagugugau

SEQ ID NO: 3457731 - RNA, 20 nt, Human
ucuuccagaagugugauugg

SEQ ID NO: 3457732 - RNA, 16 nt, Human
ucuuccagaugugaug

SEQ ID NO: 3457733 - RNA, 15 nt, Human
ucuuccaggcuggga

SEQ ID NO: 3457734 - RNA, 20 nt, Human
ucuuccaggcugggagagcc

SEQ ID NO: 3457735 - RNA, 21 nt, Human
ucuuccaggcugggagagccu

SEQ ID NO: 3457736 - RNA, 21 nt, Human
ucuuccagucuuccugacacu

SEQ ID NO: 3457737 - RNA, 20 nt, Human
ucuuccaguuugcuuugccc

SEQ ID NO: 3457738 - RNA, 12 nt, Human
ucuuccauaaug

SEQ ID NO: 3457739 - RNA, 18 nt, Human
ucuuccaucauggauuca

SEQ ID NO: 3457740 - RNA, 16 nt, Human
ucuuccaucccaggac

SEQ ID NO: 3457741 - RNA, 14 nt, Human
ucuuccaugauuuu

SEQ ID NO: 3457742 - RNA, 21 nt, Human
ucuucccaacuugccuuugaa

SEQ ID NO: 3457743 - RNA, 14 nt, Human
ucuucccaggguag

SEQ ID NO: 3457744 - RNA, 16 nt, Human
ucuucccaucacugga

SEQ ID NO: 3457745 - RNA, 17 nt, Human
ucuucccaucacuggag

SEQ ID NO: 3457746 - RNA, 13 nt, Human
ucuuccccagacg

SEQ ID NO: 3457747 - RNA, 21 nt, Human
ucuuccccagacgccuggcug

SEQ ID NO: 3457748 - RNA, 17 nt, Human
ucuucccccucucccag

SEQ ID NO: 3457749 - RNA, 21 nt, Human
ucuucccccucucccaguugu

SEQ ID NO: 3457750 - RNA, 16 nt, Human
ucuuccccuugcccuu

SEQ ID NO: 3457751 - RNA, 17 nt, Human
ucuucccgaaccccaag

SEQ ID NO: 3457752 - RNA, 22 nt, Human
ucuucccuacaguugaaaaaca

SEQ ID NO: 3457753 - RNA, 13 nt, Human
ucuucccuaccuc

SEQ ID NO: 3457754 - RNA, 20 nt, Human
ucuucccuagaggguuccug

SEQ ID NO: 3457755 - RNA, 16 nt, Human
ucuucccucucugcag

SEQ ID NO: 3457756 - RNA, 21 nt, Human
ucuucccuuuuacauacugcu

SEQ ID NO: 3457757 - RNA, 17 nt, Human
ucuuccgccccugccug

SEQ ID NO: 3457758 - RNA, 19 nt, Human
ucuuccgccccugccugcc

SEQ ID NO: 3457759 - RNA, 15 nt, Human
ucuuccggagaugua

SEQ ID NO: 3457760 - RNA, 19 nt, Human
ucuuccggagauguagcaa

SEQ ID NO: 3457761 - RNA, 21 nt, Human
ucuuccuaccaagucaaacuu

SEQ ID NO: 3457762 - RNA, 18 nt, Human
ucuuccuacccugccucc

SEQ ID NO: 3457763 - RNA, 17 nt, Human
ucuuccuaccuauccca

SEQ ID NO: 3457764 - RNA, 22 nt, Human
ucuuccuacucuucucucugcu

SEQ ID NO: 3457765 - RNA, 21 nt, Human
ucuuccuaguuuucuccuccc

SEQ ID NO: 3457766 - RNA, 15 nt, Human
ucuuccuaucccauc

SEQ ID NO: 3457767 - RNA, 17 nt, Human
ucuuccuaucccucucc

SEQ ID NO: 3457768 - RNA, 20 nt, Human
ucuuccuauuucagaaguuu

SEQ ID NO: 3457769 - RNA, 22 nt, Human
ucuuccucacagucccacugug

SEQ ID NO: 3457770 - RNA, 16 nt, Human
ucuuccucagccagcc

SEQ ID NO: 3457771 - RNA, 17 nt, Human
ucuuccucagccagccu

SEQ ID NO: 3457772 - RNA, 16 nt, Human
ucuuccuccaaggaca

SEQ ID NO: 3457773 - RNA, 14 nt, Human
ucuuccuccagcug

SEQ ID NO: 3457774 - RNA, 19 nt, Human
ucuuccuccagcugcacca

SEQ ID NO: 3457775 - RNA, 14 nt, Human
ucuuccucccaagu

SEQ ID NO: 3457776 - RNA, 14 nt, Human
ucuuccucccuccc

SEQ ID NO: 3457777 - RNA, 14 nt, Human
ucuuccuccugaca

SEQ ID NO: 3457778 - RNA, 19 nt, Human
ucuuccucugcuaaauuga

SEQ ID NO: 3457779 - RNA, 15 nt, Human
ucuuccucuugaccc

SEQ ID NO: 3457780 - RNA, 20 nt, Human
ucuuccucuugacccugcac

SEQ ID NO: 3457781 - RNA, 13 nt, Human
ucuuccugacacu

SEQ ID NO: 3457782 - RNA, 14 nt, Human
ucuuccugaguggu

SEQ ID NO: 3457783 - RNA, 18 nt, Human
ucuuccugcaaggacuac

SEQ ID NO: 3457784 - RNA, 11 nt, Human
ucuuccugccc

SEQ ID NO: 3457785 - RNA, 18 nt, Human
ucuuccugccccucuuuc

SEQ ID NO: 3457786 - RNA, 21 nt, Human
ucuuccugccccucuuucucu

SEQ ID NO: 3457787 - RNA, 20 nt, Human
ucuuccuggucgaaaguuag

SEQ ID NO: 3457788 - RNA, 20 nt, Human
ggcuccuuucuccagccagc

SEQ ID NO: 3457789 - RNA, 21 nt, Human
ggcuccuuucuccagccagca

SEQ ID NO: 3457790 - RNA, 13 nt, Human
ggcucgaaucucu

SEQ ID NO: 3457791 - RNA, 18 nt, Human
ggcucgagcaugccugga

SEQ ID NO: 3457792 - RNA, 14 nt, Human
ggcucgccuucccu

SEQ ID NO: 3457793 - RNA, 19 nt, Human
ggcucguggacugaguggg

SEQ ID NO: 3457794 - RNA, 18 nt, Human
ggcucuaacgccugagcc

SEQ ID NO: 3457795 - RNA, 13 nt, Human
ggcucuaauuucc

SEQ ID NO: 3457796 - RNA, 17 nt, Human
ggcucuacuuccccaug

SEQ ID NO: 3457797 - RNA, 19 nt, Human
ggcucuaggguugcuggag

SEQ ID NO: 3457798 - RNA, 22 nt, Human
ggcucuaggguugcuggagccu

SEQ ID NO: 3457799 - RNA, 23 nt, Human
ggcucuaugagucuagauguuua

SEQ ID NO: 3457800 - RNA, 14 nt, Human
ggcucucaggccag

SEQ ID NO: 3457801 - RNA, 15 nt, Human
ggcucucaggccagc

SEQ ID NO: 3457802 - RNA, 16 nt, Human
ggcucucaggccagcu

SEQ ID NO: 3457803 - RNA, 20 nt, Human
ggcucucaggccagcugcuu

SEQ ID NO: 3457804 - RNA, 23 nt, Human
ggcucucauguuuucaacugcca

SEQ ID NO: 3457805 - RNA, 13 nt, Human
ggcucuccaccuc

SEQ ID NO: 3457806 - RNA, 19 nt, Human
ggcucuccaccucagccuu

SEQ ID NO: 3457807 - RNA, 20 nt, Human
ggcucuccaccucagccuug

SEQ ID NO: 3457808 - RNA, 21 nt, Human
ggcucuccaccucagccuugg

SEQ ID NO: 3457809 - RNA, 17 nt, Human
ggcucuccuggcuuccc

SEQ ID NO: 3457810 - RNA, 22 nt, Human
ggcucucuauagcaccagggcu

SEQ ID NO: 3457811 - RNA, 13 nt, Human
ggcucucuccagg

SEQ ID NO: 3457812 - RNA, 20 nt, Human
ggcucucugaguccuggccc

SEQ ID NO: 3457813 - RNA, 16 nt, Human
ggcucucugggcugac

SEQ ID NO: 3457814 - RNA, 14 nt, Human
ggcucugaaagcca

SEQ ID NO: 3457815 - RNA, 14 nt, Human
ucuugcucuuucua

SEQ ID NO: 3457816 - RNA, 19 nt, Human
ucuugcucuuucuacucug

SEQ ID NO: 3457817 - RNA, 21 nt, Human
ucuugcucuuucuacucugaa

SEQ ID NO: 3457818 - RNA, 18 nt, Human
ucuugcugcccugcccca

SEQ ID NO: 3457819 - RNA, 14 nt, Human
ucuugcugcuagaa

SEQ ID NO: 3457820 - RNA, 15 nt, Human
ucuugcugcuagaac

SEQ ID NO: 3457821 - RNA, 22 nt, Human
ucuugcugguugucauuuuugc

SEQ ID NO: 3457822 - RNA, 14 nt, Human
ucuugcugucucug

SEQ ID NO: 3457823 - RNA, 17 nt, Human
ucuugcugucucugcuc

SEQ ID NO: 3457824 - RNA, 15 nt, Human
ucuugcuguugacau

SEQ ID NO: 3457825 - RNA, 16 nt, Human
ucuugcuucuuucuag

SEQ ID NO: 3457826 - RNA, 18 nt, Human
ucuugcuucuuucuagaa

SEQ ID NO: 3457827 - RNA, 15 nt, Human
ucuugcuuguaccuc

SEQ ID NO: 3457828 - RNA, 14 nt, Human
ucuugcuuucuuug

SEQ ID NO: 3457829 - RNA, 21 nt, Human
ucuuggaacauuggaauguuc

SEQ ID NO: 3457830 - RNA, 17 nt, Human
ucuuggaauccugggga

SEQ ID NO: 3457831 - RNA, 14 nt, Human
ucuuggaccucugc

SEQ ID NO: 3457832 - RNA, 18 nt, Human
ucuuggaccucugcucug

SEQ ID NO: 3457833 - RNA, 23 nt, Human
ucuuggaccucugcucugaggcu

SEQ ID NO: 3457834 - RNA, 17 nt, Human
ucuuggagaccuuaccc

SEQ ID NO: 3457835 - RNA, 15 nt, Human
ucuuggagccugcag

SEQ ID NO: 3457836 - RNA, 19 nt, Human
ucuuggagccugcagagcu

SEQ ID NO: 3457837 - RNA, 16 nt, Human
ucuuggagcugagccu

SEQ ID NO: 3457838 - RNA, 21 nt, Human
ucuuggagcugagccucucac

SEQ ID NO: 3457839 - RNA, 23 nt, Human
ucuuggagcugugaguucucccu

SEQ ID NO: 3457840 - RNA, 14 nt, Human
ucuuggagucuucc

SEQ ID NO: 3457841 - RNA, 16 nt, Human
ucuuggcaauaaauuu

SEQ ID NO: 3457842 - RNA, 22 nt, Human
ucuuggcacauuuaagagacag

SEQ ID NO: 3457843 - RNA, 18 nt, Human
ucuuggcagcaccugucu

SEQ ID NO: 3457844 - RNA, 14 nt, Human
ucuuggccagccaa

SEQ ID NO: 3457845 - RNA, 16 nt, Human
ucuuggccuuacugua

SEQ ID NO: 3457846 - RNA, 15 nt, Human
ucuuggcggcagcag

SEQ ID NO: 3457847 - RNA, 17 nt, Human
ucuuggcuggacccagc

SEQ ID NO: 3457848 - RNA, 18 nt, Human
ucuuggcuggacccagcc

SEQ ID NO: 3457849 - RNA, 20 nt, Human
ucuuggcuggacccagccag

SEQ ID NO: 3457850 - RNA, 16 nt, Human
ucuuggcuggcuuccu

SEQ ID NO: 3457851 - RNA, 18 nt, Human
ucuuggcuuaaucauuuu

SEQ ID NO: 3457852 - RNA, 16 nt, Human
ucuuggcuuucauguu

SEQ ID NO: 3457853 - RNA, 18 nt, Human
ucuuggcuuuguuuuguu

SEQ ID NO: 3457854 - RNA, 16 nt, Human
ucuugggacuggguuu

SEQ ID NO: 3457855 - RNA, 24 nt, Human
ucuugggcaauauucucuguacau

SEQ ID NO: 3457856 - RNA, 22 nt, Human
ucuuggggaguuuagggugggg

SEQ ID NO: 3457857 - RNA, 18 nt, Human
ucuuggggcccagugcau

SEQ ID NO: 3457858 - RNA, 20 nt, Human
ucuugggggacagggcuggc

SEQ ID NO: 3457859 - RNA, 19 nt, Human
ucuuggggggguggccgcu

SEQ ID NO: 3457860 - RNA, 14 nt, Human
ucuugguaagaagc

SEQ ID NO: 3457861 - RNA, 15 nt, Human
ucuugguagagauuc

SEQ ID NO: 3457862 - RNA, 14 nt, Human
ucuugguauucuua

SEQ ID NO: 3457863 - RNA, 14 nt, Human
ucuugguauuugga

SEQ ID NO: 3457864 - RNA, 22 nt, Human
ucuugguauuuggauaucuguu

SEQ ID NO: 3457865 - RNA, 19 nt, Human
ucuugguccugcugcaguu

SEQ ID NO: 3457866 - RNA, 17 nt, Human
ucuugguuccagccugc

SEQ ID NO: 3457867 - RNA, 15 nt, Human
ucuugguugaggaaa

SEQ ID NO: 3457868 - RNA, 14 nt, Human
ucuugguuuccaaa

SEQ ID NO: 3457869 - RNA, 13 nt, Human
ucuuguaaauaaa

SEQ ID NO: 3457870 - RNA, 17 nt, Human
ucuuguaaauguguugg

SEQ ID NO: 3457871 - RNA, 20 nt, Human
ucuuguaagagcuauacagu

SEQ ID NO: 3457872 - RNA, 19 nt, Human
ucuuguaagauuuugaaaa

SEQ ID NO: 3457873 - RNA, 11 nt, Human
ucuuguaauuu

SEQ ID NO: 3457874 - RNA, 14 nt, Human
ucuuguaauuucca

SEQ ID NO: 3457875 - RNA, 21 nt, Human
ucuuguaauuuccagcuuucu

SEQ ID NO: 3457876 - RNA, 14 nt, Human
ucuuguacaugugu

SEQ ID NO: 3457877 - RNA, 20 nt, Human
ucuuguauaagauccuagau

SEQ ID NO: 3457878 - RNA, 20 nt, Human
ucuuguaucuggauucaaau

SEQ ID NO: 3457879 - RNA, 15 nt, Human
ucuuguauuuauugg

SEQ ID NO: 3457880 - RNA, 15 nt, Human
ucuugucacaauaaa

SEQ ID NO: 3457881 - RNA, 13 nt, Human
ucuugucagacau

SEQ ID NO: 3457882 - RNA, 18 nt, Human
ucuugucagacauaaagc

SEQ ID NO: 3457883 - RNA, 17 nt, Human
ucuugucauguguauaa

SEQ ID NO: 3457884 - RNA, 20 nt, Human
ucuugucccacgugucuucc

SEQ ID NO: 3457885 - RNA, 17 nt, Human
ucuuguccucaguccau

SEQ ID NO: 3457886 - RNA, 19 nt, Human
ucuuguccucaguccauuu

SEQ ID NO: 3457887 - RNA, 13 nt, Human
ucuugucuauaaa

SEQ ID NO: 3457888 - RNA, 20 nt, Human
ucuugucucaaugcucauaa

SEQ ID NO: 3457889 - RNA, 21 nt, Human
ucuugucucaaugcucauaac

SEQ ID NO: 3457890 - RNA, 14 nt, Human
ucuugucucagauu

SEQ ID NO: 3457891 - RNA, 19 nt, Human
ucuugucucagauuuuauu

SEQ ID NO: 3457892 - RNA, 11 nt, Human
ucuugucuccc

SEQ ID NO: 3457893 - RNA, 13 nt, Human
ucuugucuccccu

SEQ ID NO: 3457894 - RNA, 14 nt, Human
ucuugucucugggc

SEQ ID NO: 3457895 - RNA, 12 nt, Human
ucuugucuuuau

SEQ ID NO: 3457896 - RNA, 22 nt, Human
ucuugugaauauguacauaggc

SEQ ID NO: 3457897 - RNA, 21 nt, Human
ucuugugacauauuaugucuu

SEQ ID NO: 3457898 - RNA, 11 nt, Human
ucuugugacua

SEQ ID NO: 3457899 - RNA, 23 nt, Human
ucuugugacuagugcugaagcuu

SEQ ID NO: 3457900 - RNA, 13 nt, Human
ucuugugaggaaa

SEQ ID NO: 3457901 - RNA, 14 nt, Human
ucuugugcacuggc

SEQ ID NO: 3457902 - RNA, 19 nt, Human
ucuugugcuagaauacuuu

SEQ ID NO: 3457903 - RNA, 23 nt, Human
ucuugugcuagaauacuuuuuaa

SEQ ID NO: 3457904 - RNA, 23 nt, Human
ucuuguggaagugcaucuacuug

SEQ ID NO: 3457905 - RNA, 17 nt, Human
ucuuguguauuucaguu

SEQ ID NO: 3457906 - RNA, 13 nt, Human
ucuuguguguuua

SEQ ID NO: 3457907 - RNA, 21 nt, Human
ucuuguguguuuauugucaaa

SEQ ID NO: 3457908 - RNA, 15 nt, Human
ucuuguguuguccuu

SEQ ID NO: 3457909 - RNA, 13 nt, Human
ucuuguuaauauu

SEQ ID NO: 3457910 - RNA, 17 nt, Human
ucuuguuaauauucuuu

SEQ ID NO: 3457911 - RNA, 13 nt, Human
ucuuguucuguuu

SEQ ID NO: 3457912 - RNA, 16 nt, Human
ucuuguucuguuuugu

SEQ ID NO: 3457913 - RNA, 14 nt, Human
ucuuguugauaaaa

SEQ ID NO: 3457914 - RNA, 18 nt, Human
ucuuguugcuguacaaaa

SEQ ID NO: 3457915 - RNA, 11 nt, Human
ucuuguugguu

SEQ ID NO: 3457916 - RNA, 21 nt, Human
ucuuguuucuccagauuuuua

SEQ ID NO: 3457917 - RNA, 16 nt, Human
ucuuguuuugaaaaua

SEQ ID NO: 3457918 - RNA, 13 nt, Human
ucuuguuuugcuu

SEQ ID NO: 3457919 - RNA, 14 nt, Human
ucuuguuuuguuug

SEQ ID NO: 3457920 - RNA, 23 nt, Human
ucuuguuuuguuugucucuccuu

SEQ ID NO: 3457921 - RNA, 23 nt, Human
ucuuguuuuuaaguuugcacuca

SEQ ID NO: 3457922 - RNA, 20 nt, Human
ucuuguuuuuccacuacugc

SEQ ID NO: 3457923 - RNA, 21 nt, Human
ucuuguuuuuccacuacugcu

SEQ ID NO: 3457924 - RNA, 22 nt, Human
ucuuguuuuuccacuacugcua

SEQ ID NO: 3457925 - RNA, 21 nt, Human
ucuuguuuuuuuuuuccacuu

SEQ ID NO: 3457926 - RNA, 14 nt, Human
ucuuuaaaaacugu

SEQ ID NO: 3457927 - RNA, 12 nt, Human
ucuuuaaaacaa

SEQ ID NO: 3457928 - RNA, 13 nt, Human
ucuuuaaaacaaa

SEQ ID NO: 3457929 - RNA, 15 nt, Human
ucuuuaaaacaaaac

SEQ ID NO: 3457930 - RNA, 17 nt, Human
ucuuuaaaagagagaga

SEQ ID NO: 3457931 - RNA, 15 nt, Human
ucuuuaaaauuacaa

SEQ ID NO: 3457932 - RNA, 23 nt, Human
ucuuuaaaggcccagccccuaga

SEQ ID NO: 3457933 - RNA, 23 nt, Human
ugaaauaagccagacaucaacag

SEQ ID NO: 3457934 - RNA, 22 nt, Human
ugaaauaagcuauuugauguaa

SEQ ID NO: 3457935 - RNA, 14 nt, Human
ugaaauaaggaaug

SEQ ID NO: 3457936 - RNA, 18 nt, Human
ugaaauaaggaaugauau

SEQ ID NO: 3457937 - RNA, 14 nt, Human
ugaaauaaugugua

SEQ ID NO: 3457938 - RNA, 16 nt, Human
ugaaauaauguguagu

SEQ ID NO: 3457939 - RNA, 23 nt, Human
ugaaauaccagugaaccaaagag

SEQ ID NO: 3457940 - RNA, 16 nt, Human
ugaaauaccagugugg

SEQ ID NO: 3457941 - RNA, 14 nt, Human
ugaaauacuguuug

SEQ ID NO: 3457942 - RNA, 15 nt, Human
ugaaauaggaaacaa

SEQ ID NO: 3457943 - RNA, 22 nt, Human
ugaaauaggagggaaaccuuug

SEQ ID NO: 3457944 - RNA, 13 nt, Human
ugaaauagucugu

SEQ ID NO: 3457945 - RNA, 15 nt, Human
ugaaauauacacaca

SEQ ID NO: 3457946 - RNA, 17 nt, Human
ugaaauauacacacagc

SEQ ID NO: 3457947 - RNA, 17 nt, Human
ugaaauauaugugaaag

SEQ ID NO: 3457948 - RNA, 14 nt, Human
ugaaauauauuuaa

SEQ ID NO: 3457949 - RNA, 17 nt, Human
ugaaauauugcuguaua

SEQ ID NO: 3457950 - RNA, 11 nt, Human
ugaaauauuuu

SEQ ID NO: 3457951 - RNA, 22 nt, Human
ugaaaucaaugcaagagugauu

SEQ ID NO: 3457952 - RNA, 19 nt, Human
ugaaaucaguaaacacugu

SEQ ID NO: 3457953 - RNA, 17 nt, Human
ugaaaucaguuacucuu

SEQ ID NO: 3457954 - RNA, 15 nt, Human
ugaaaucauucauuu

SEQ ID NO: 3457955 - RNA, 16 nt, Human
ugaaauccugguuccu

SEQ ID NO: 3457956 - RNA, 18 nt, Human
ugaaauccuugacuggac

SEQ ID NO: 3457957 - RNA, 20 nt, Human
ugaaauccuugacuggaccu

SEQ ID NO: 3457958 - RNA, 15 nt, Human
ugaaaucugucaaga

SEQ ID NO: 3457959 - RNA, 18 nt, Human
ugaaaucuucccaugcau

SEQ ID NO: 3457960 - RNA, 19 nt, Human
ugaaaucuucccaugcauu

SEQ ID NO: 3457961 - RNA, 22 nt, Human
ugaaaucuucccaugcauucug

SEQ ID NO: 3457962 - RNA, 17 nt, Human
ugaaaucuuuuugcuuu

SEQ ID NO: 3457963 - RNA, 22 nt, Human
ugaaaucuuuuuuguucaaaga

SEQ ID NO: 3457964 - RNA, 20 nt, Human
ugaaaugaaaacauguaaua

SEQ ID NO: 3457965 - RNA, 13 nt, Human
ugaaaugaacaca

SEQ ID NO: 3457966 - RNA, 16 nt, Human
ugaaaugaauauuuaa

SEQ ID NO: 3457967 - RNA, 23 nt, Human
ugaaaugaggucuguuuaaagug

SEQ ID NO: 3457968 - RNA, 24 nt, Human
ugaaaugccuuacuuuguaugaua

SEQ ID NO: 3457969 - RNA, 20 nt, Human
ugaaaugcuaugucauuuca

SEQ ID NO: 3457970 - RNA, 21 nt, Human
ugaaaugcuaugucauuucau

SEQ ID NO: 3457971 - RNA, 16 nt, Human
ugaaaugcucuccuuu

SEQ ID NO: 3457972 - RNA, 15 nt, Human
ugaaaugcugcauuu

SEQ ID NO: 3457973 - RNA, 17 nt, Human
ugaaauggauacuuaua

SEQ ID NO: 3457974 - RNA, 12 nt, Human
ugaaauguaagg

SEQ ID NO: 3457975 - RNA, 13 nt, Human
ugaaaugucaacc

SEQ ID NO: 3457976 - RNA, 21 nt, Human
ugaaaugugugugaugugaca

SEQ ID NO: 3457977 - RNA, 24 nt, Human
ugaaaugugugugaugugacauuu

SEQ ID NO: 3457978 - RNA, 15 nt, Human
ugaaauguuaacaau

SEQ ID NO: 3457979 - RNA, 13 nt, Human
ugaaauguuacaa

SEQ ID NO: 3457980 - RNA, 22 nt, Human
ugaaauguuacaaaaauaaacu

SEQ ID NO: 3457981 - RNA, 14 nt, Human
ugaaauuaaccucu

SEQ ID NO: 3457982 - RNA, 20 nt, Human
ugaaauuacggguaccugaa

SEQ ID NO: 3457983 - RNA, 15 nt, Human
ugaaauuauguaaau

SEQ ID NO: 3457984 - RNA, 23 nt, Human
ugaaauuauguauguuuacauau

SEQ ID NO: 3457985 - RNA, 22 nt, Human
ugaaauuaugugacauuuuaca

SEQ ID NO: 3457986 - RNA, 12 nt, Human
ugaaauuccaaa

SEQ ID NO: 3457987 - RNA, 15 nt, Human
ugaaauucuccugga

SEQ ID NO: 3457988 - RNA, 18 nt, Human
ugaaauucugaauuugca

SEQ ID NO: 3457989 - RNA, 22 nt, Human
ugaaauucugaauuugcaaagu

SEQ ID NO: 3457990 - RNA, 13 nt, Human
ugaaauugaaccu

SEQ ID NO: 3457991 - RNA, 17 nt, Human
ugaaauugaaccuuugu

SEQ ID NO: 3457992 - RNA, 16 nt, Human
ugaaauuguaauuaua

SEQ ID NO: 3457993 - RNA, 19 nt, Human
ugaaauuguaauuauaucu

SEQ ID NO: 3457994 - RNA, 20 nt, Human
ugaaauuguaauuauaucug

SEQ ID NO: 3457995 - RNA, 14 nt, Human
ugaaauuguacaua

SEQ ID NO: 3457996 - RNA, 15 nt, Human
ugaaauuguauuaca

SEQ ID NO: 3457997 - RNA, 20 nt, Human
ugaaauuuauuaguuaauau

SEQ ID NO: 3457998 - RNA, 21 nt, Human
ugaaauuuauuaguuaauaua

SEQ ID NO: 3457999 - RNA, 22 nt, Human
ugaaauuuauuaguuaauauau

SEQ ID NO: 3458000 - RNA, 22 nt, Human
ugaaauuuauugaggaaaaaua

SEQ ID NO: 3458001 - RNA, 14 nt, Human
ugaaauuucuagcc

SEQ ID NO: 3458002 - RNA, 15 nt, Human
ugaaauuugaauuuu

SEQ ID NO: 3458003 - RNA, 17 nt, Human
ugaaauuuuaaacuaua

SEQ ID NO: 3458004 - RNA, 20 nt, Human
ugaaauuuuaaccuaugaua

SEQ ID NO: 3458005 - RNA, 22 nt, Human
ugaaauuuuaaccuaugauauu

SEQ ID NO: 3458006 - RNA, 19 nt, Human
ugaaauuuuaccaaguuau

SEQ ID NO: 3458007 - RNA, 14 nt, Human
ugaaauuuuagaaa

SEQ ID NO: 3458008 - RNA, 16 nt, Human
ugaaauuuuagaaaua

SEQ ID NO: 3458009 - RNA, 22 nt, Human
ugaaauuuuauaugcuuacuga

SEQ ID NO: 3458010 - RNA, 19 nt, Human
ugaaauuuuccaaugucug

SEQ ID NO: 3458011 - RNA, 18 nt, Human
ugaaauuuucuagacuuu

SEQ ID NO: 3458012 - RNA, 19 nt, Human
ugaaauuuucuagacuuuc

SEQ ID NO: 3458013 - RNA, 16 nt, Human
ugaaauuuugcaaaua

SEQ ID NO: 3458014 - RNA, 22 nt, Human
ugaaauuuugcaaauauaaaca

SEQ ID NO: 3458015 - RNA, 15 nt, Human
ugaaauuuuuauuaa

SEQ ID NO: 3458016 - RNA, 12 nt, Human
ugaaauuuuuca

SEQ ID NO: 3458017 - RNA, 16 nt, Human
ugaaauuuuucauauu

SEQ ID NO: 3458018 - RNA, 17 nt, Human
ugaaauuuuucauauuu

SEQ ID NO: 3458019 - RNA, 18 nt, Human
ugaaauuuuucauauuuu

SEQ ID NO: 3458020 - RNA, 20 nt, Human
ugaaauuuuugguuauaaau

SEQ ID NO: 3458021 - RNA, 15 nt, Human
ugaaauuuuuguaaa

SEQ ID NO: 3458022 - RNA, 18 nt, Human
ugaaauuuuuguaaauca

SEQ ID NO: 3458023 - RNA, 13 nt, Human
ucuggcugguguu

SEQ ID NO: 3458024 - RNA, 17 nt, Human
ucuggcugguguuaaca

SEQ ID NO: 3458025 - RNA, 22 nt, Human
ucuggcugguuuggaaugcuuc

SEQ ID NO: 3458026 - RNA, 21 nt, Human
ucuggcuguaaggcucuagau

SEQ ID NO: 3458027 - RNA, 22 nt, Human
ucuggcuguaaggcucuagauc

SEQ ID NO: 3458028 - RNA, 17 nt, Human
ucuggcuuauuuuaaug

SEQ ID NO: 3458029 - RNA, 20 nt, Human
ucuggcuuauuuuaauguga

SEQ ID NO: 3458030 - RNA, 21 nt, Human
ucuggcuuauuuuaaugugau

SEQ ID NO: 3458031 - RNA, 15 nt, Human
ucuggcuuccaggua

SEQ ID NO: 3458032 - RNA, 24 nt, Human
ucuggcuuccagguaucuccagga

SEQ ID NO: 3458033 - RNA, 21 nt, Human
ucuggcuuggccacagccagg

SEQ ID NO: 3458034 - RNA, 14 nt, Human
ucuggcuuggccua

SEQ ID NO: 3458035 - RNA, 14 nt, Human
ucuggcuuuaagcc

SEQ ID NO: 3458036 - RNA, 16 nt, Human
ucugggaaccucccag

SEQ ID NO: 3458037 - RNA, 17 nt, Human
ucugggaaccucccaga

SEQ ID NO: 3458038 - RNA, 20 nt, Human
ucugggaaccucccagaggu

SEQ ID NO: 3458039 - RNA, 22 nt, Human
ucugggaaccucccagaggucc

SEQ ID NO: 3458040 - RNA, 14 nt, Human
ucugggaagggaag

SEQ ID NO: 3458041 - RNA, 14 nt, Human
ucugggaauguaua

SEQ ID NO: 3458042 - RNA, 13 nt, Human
ucugggacacagu

SEQ ID NO: 3458043 - RNA, 19 nt, Human
ucugggacccuuuccuucc

SEQ ID NO: 3458044 - RNA, 20 nt, Human
ucugggaccugccaggcagg

SEQ ID NO: 3458045 - RNA, 21 nt, Human
ucugggacuuccuugcucucc

SEQ ID NO: 3458046 - RNA, 13 nt, Human
ucugggagaaaau

SEQ ID NO: 3458047 - RNA, 20 nt, Human
ucugggagaaaaucaucaag

SEQ ID NO: 3458048 - RNA, 16 nt, Human
ucugggaguccccuuu

SEQ ID NO: 3458049 - RNA, 18 nt, Human
ucugggauaaguaaguuu

SEQ ID NO: 3458050 - RNA, 19 nt, Human
ucugggauucuacuuuaag

SEQ ID NO: 3458051 - RNA, 20 nt, Human
ucugggcacacucugccagc

SEQ ID NO: 3458052 - RNA, 21 nt, Human
ucugggcacugguaaucccaa

SEQ ID NO: 3458053 - RNA, 18 nt, Human
ucugggcaucuguucugg

SEQ ID NO: 3458054 - RNA, 18 nt, Human
ucugggccaagucaaaga

SEQ ID NO: 3458055 - RNA, 23 nt, Human
ucugggccaaguuccucuagugc

SEQ ID NO: 3458056 - RNA, 19 nt, Human
ucugggccaccaggaucag

SEQ ID NO: 3458057 - RNA, 14 nt, Human
ucugggccagaauu

SEQ ID NO: 3458058 - RNA, 18 nt, Human
ucugggcccccuccuccc

SEQ ID NO: 3458059 - RNA, 12 nt, Human
ucugggccugac

SEQ ID NO: 3458060 - RNA, 13 nt, Human
ucugggccugggc

SEQ ID NO: 3458061 - RNA, 18 nt, Human
ucugggccugggcuaggg

SEQ ID NO: 3458062 - RNA, 15 nt, Human
ucugggccuuggccu

SEQ ID NO: 3458063 - RNA, 21 nt, Human
ucugggccuuggccuggagca

SEQ ID NO: 3458064 - RNA, 22 nt, Human
ucugggccuuggccuggagcac

SEQ ID NO: 3458065 - RNA, 20 nt, Human
ucugggcggcgggcggcugg

SEQ ID NO: 3458066 - RNA, 20 nt, Human
ucugggcuagguagaaaaag

SEQ ID NO: 3458067 - RNA, 13 nt, Human
ucugggcuccaga

SEQ ID NO: 3458068 - RNA, 11 nt, Human
ucugggcugga

SEQ ID NO: 3458069 - RNA, 21 nt, Human
ucugggcuguaacguggcacu

SEQ ID NO: 3458070 - RNA, 17 nt, Human
ucugggcuuccuggagc

SEQ ID NO: 3458071 - RNA, 18 nt, Human
ucugggcuuccuggagca

SEQ ID NO: 3458072 - RNA, 19 nt, Human
ucugggcuuccuggagcag

SEQ ID NO: 3458073 - RNA, 21 nt, Human
ucugggcuuggggcuuccuaa

SEQ ID NO: 3458074 - RNA, 17 nt, Human
ucuggggcaggcugggc

SEQ ID NO: 3458075 - RNA, 18 nt, Human
ucuggggcaggcugggcc

SEQ ID NO: 3458076 - RNA, 19 nt, Human
ucuggggcaggcugggcca

SEQ ID NO: 3458077 - RNA, 22 nt, Human
ugaagaggaaaaugaauaauac

SEQ ID NO: 3458078 - RNA, 13 nt, Human
ugaagaggaaggg

SEQ ID NO: 3458079 - RNA, 15 nt, Human
ugaagaggaggagga

SEQ ID NO: 3458080 - RNA, 18 nt, Human
ugaagaggaggaggaggg

SEQ ID NO: 3458081 - RNA, 15 nt, Human
ugaagaggcgggcca

SEQ ID NO: 3458082 - RNA, 18 nt, Human
ugaagaggcgggccagcc

SEQ ID NO: 3458083 - RNA, 17 nt, Human
ugaagagggagaaggga

SEQ ID NO: 3458084 - RNA, 12 nt, Human
ugaagaggggca

SEQ ID NO: 3458085 - RNA, 14 nt, Human
ugaagaggggcagc

SEQ ID NO: 3458086 - RNA, 23 nt, Human
ugaagaguaagucaaccugccug

SEQ ID NO: 3458087 - RNA, 17 nt, Human
ugaagaguccucugaau

SEQ ID NO: 3458088 - RNA, 19 nt, Human
ugaagaguggguuucacaa

SEQ ID NO: 3458089 - RNA, 21 nt, Human
ugaagauaaguguauuuuuca

SEQ ID NO: 3458090 - RNA, 23 nt, Human
ugaagauaccaucagcaaagaau

SEQ ID NO: 3458091 - RNA, 17 nt, Human
ugaagauacuuuguauu

SEQ ID NO: 3458092 - RNA, 16 nt, Human
ugaagauagaagaaaa

SEQ ID NO: 3458093 - RNA, 16 nt, Human
ugaagauaucuugaaa

SEQ ID NO: 3458094 - RNA, 15 nt, Human
ugaagauauuuuucc

SEQ ID NO: 3458095 - RNA, 14 nt, Human
ugaagaucuaaaua

SEQ ID NO: 3458096 - RNA, 22 nt, Human
ugaagaucuaaauaaaaugcua

SEQ ID NO: 3458097 - RNA, 13 nt, Human
ugaagaugaucau

SEQ ID NO: 3458098 - RNA, 21 nt, Human
ugaagauggcauccugugaag

SEQ ID NO: 3458099 - RNA, 22 nt, Human
ugaagauggcauccugugaagu

SEQ ID NO: 3458100 - RNA, 18 nt, Human
ugaagauguagaggagaa

SEQ ID NO: 3458101 - RNA, 21 nt, Human
ugaagauucuauguuaauauu

SEQ ID NO: 3458102 - RNA, 22 nt, Human
ugaagcagaugcaaagaggcaa

SEQ ID NO: 3458103 - RNA, 17 nt, Human
ugaagcaggguuucuuu

SEQ ID NO: 3458104 - RNA, 15 nt, Human
ugaagcauccaggca

SEQ ID NO: 3458105 - RNA, 19 nt, Human
ugaagcauguuucauguuu

SEQ ID NO: 3458106 - RNA, 20 nt, Human
ugaagcauguuucauguuuu

SEQ ID NO: 3458107 - RNA, 16 nt, Human
ugaagcauuuuauaaa

SEQ ID NO: 3458108 - RNA, 17 nt, Human
ugaagcauuuuauaaau

SEQ ID NO: 3458109 - RNA, 11 nt, Human
ugaagccaaag

SEQ ID NO: 3458110 - RNA, 12 nt, Human
ugaagccaaaga

SEQ ID NO: 3458111 - RNA, 15 nt, Human
ugaagccaaagccaa

SEQ ID NO: 3458112 - RNA, 23 nt, Human
ugaagccaaguggggugcuggga

SEQ ID NO: 3458113 - RNA, 19 nt, Human
ugaagccacagcccaggcc

SEQ ID NO: 3458114 - RNA, 19 nt, Human
ugaagccacugaagcuggg

SEQ ID NO: 3458115 - RNA, 12 nt, Human
ugaagccagccu

SEQ ID NO: 3458116 - RNA, 13 nt, Human
ugaagccagccuu

SEQ ID NO: 3458117 - RNA, 23 nt, Human
ugaagccagcucacagugcugug

SEQ ID NO: 3458118 - RNA, 16 nt, Human
ugaagcccaagugaaa

SEQ ID NO: 3458119 - RNA, 17 nt, Human
ugaagcccauuucuccg

SEQ ID NO: 3458120 - RNA, 16 nt, Human
ugaagcccuccaaaag

SEQ ID NO: 3458121 - RNA, 17 nt, Human
ugaagccugcuccuucc

SEQ ID NO: 3458122 - RNA, 13 nt, Human
ugaagccuuucuu

SEQ ID NO: 3458123 - RNA, 12 nt, Human
ugaagccuuugu

SEQ ID NO: 3458124 - RNA, 15 nt, Human
ugaagccuuuugaaa

SEQ ID NO: 3458125 - RNA, 17 nt, Human
ugaagcgugauuuuaaa

SEQ ID NO: 3458126 - RNA, 14 nt, Human
ugaagcuaauuauu

SEQ ID NO: 3458127 - RNA, 14 nt, Human
ugaagcuacugugu

SEQ ID NO: 3458128 - RNA, 22 nt, Human
ugaagcuacugugugugugaau

SEQ ID NO: 3458129 - RNA, 23 nt, Human
ugaagcucaccuguugcuuacaa

SEQ ID NO: 3458130 - RNA, 18 nt, Human
ugaagcugcccuaauaaa

SEQ ID NO: 3458131 - RNA, 15 nt, Human
ugaagcuguugugug

SEQ ID NO: 3458132 - RNA, 18 nt, Human
ugaagcuugacucccaag

SEQ ID NO: 3458133 - RNA, 14 nt, Human
ugaagcuuguguau

SEQ ID NO: 3458134 - RNA, 23 nt, Human
ugaagcuuguguauccauuauca

SEQ ID NO: 3458135 - RNA, 13 nt, Human
ugaagcuuuacca

SEQ ID NO: 3458136 - RNA, 13 nt, Human
ugaaggaaaaauu

SEQ ID NO: 3458137 - RNA, 14 nt, Human
ugaaggaaacaguu

SEQ ID NO: 3458138 - RNA, 23 nt, Human
ugaaggaagccaaauuuaucaaa

SEQ ID NO: 3458139 - RNA, 14 nt, Human
ugaaggaauauaug

SEQ ID NO: 3458140 - RNA, 20 nt, Human
ugaaggaauauauggcagag

SEQ ID NO: 3458141 - RNA, 21 nt, Human
ugaaggaauauauggcagagu

SEQ ID NO: 3458142 - RNA, 23 nt, Human
ugaaggaauauauggcagaguug

SEQ ID NO: 3458143 - RNA, 19 nt, Human
ugaaggacauugcggacag

SEQ ID NO: 3458144 - RNA, 20 nt, Human
ugaaggacuaauagaaaagu

SEQ ID NO: 3458145 - RNA, 16 nt, Human
ugaaggagagcccuuc

SEQ ID NO: 3458146 - RNA, 22 nt, Human
ugaaggagccccauuccuggga

SEQ ID NO: 3458147 - RNA, 14 nt, Human
ugaaggaggccacc

SEQ ID NO: 3458148 - RNA, 16 nt, Human
ugaaggaggccaccuc

SEQ ID NO: 3458149 - RNA, 20 nt, Human
ugaaggaggccaccuccuaa

SEQ ID NO: 3458150 - RNA, 19 nt, Human
ugaaggaggcuccaggcag

SEQ ID NO: 3458151 - RNA, 21 nt, Human
ugaaggaggcuccaggcagca

SEQ ID NO: 3458152 - RNA, 14 nt, Human
ugaaggcaaaauug

SEQ ID NO: 3458153 - RNA, 14 nt, Human
ugaaggcaaugcca

SEQ ID NO: 3458154 - RNA, 16 nt, Human
ugaaggccacuugagu

SEQ ID NO: 3458155 - RNA, 14 nt, Human
ugaaggccccgccc

SEQ ID NO: 3458156 - RNA, 16 nt, Human
ugaaggccucgcagga

SEQ ID NO: 3458157 - RNA, 18 nt, Human
ugaaggccuggcccacag

SEQ ID NO: 3458158 - RNA, 17 nt, Human
ugaaggcuaaaaagcaa

SEQ ID NO: 3458159 - RNA, 13 nt, Human
ugaaggcuggcau

SEQ ID NO: 3458160 - RNA, 16 nt, Human
ugaaggcuggcaugau

SEQ ID NO: 3458161 - RNA, 20 nt, Human
ugaaggcuggcaugauccaa

SEQ ID NO: 3458162 - RNA, 20 nt, Human
ugaaggcuggguucugaucc

SEQ ID NO: 3458163 - RNA, 21 nt, Human
ugaaggcuggguucugauccu

SEQ ID NO: 3458164 - RNA, 15 nt, Human
ugaaggcuucucucu

SEQ ID NO: 3458165 - RNA, 21 nt, Human
ugaagggaaaggauauuuucu

SEQ ID NO: 3458166 - RNA, 22 nt, Human
ugaagggaaaggauauuuucuu

SEQ ID NO: 3458167 - RNA, 15 nt, Human
ugaagggaagagaca

SEQ ID NO: 3458168 - RNA, 14 nt, Human
ugaagggagagcca

SEQ ID NO: 3458169 - RNA, 16 nt, Human
ugaagggagagccagc

SEQ ID NO: 3458170 - RNA, 14 nt, Human
ugaagggcccgaga

SEQ ID NO: 3458171 - RNA, 22 nt, Human
ugaaggggccaaggagggugag

SEQ ID NO: 3458172 - RNA, 22 nt, Human
ugaaggguaauuauauaguuac

SEQ ID NO: 3458173 - RNA, 23 nt, Human
ugaagguagcauucuuuggaguu

SEQ ID NO: 3458174 - RNA, 15 nt, Human
ugaagguauaucuag

SEQ ID NO: 3458175 - RNA, 16 nt, Human
ugaaggucuugauuug

SEQ ID NO: 3458176 - RNA, 15 nt, Human
ugaaggugacagcag

SEQ ID NO: 3458177 - RNA, 19 nt, Human
ugaaggugcugacggccag

SEQ ID NO: 3458178 - RNA, 18 nt, Human
ugaagguggaaauaaacu

SEQ ID NO: 3458179 - RNA, 15 nt, Human
ugaagguuguggccu

SEQ ID NO: 3458180 - RNA, 18 nt, Human
ugaagguuguggccuuug

SEQ ID NO: 3458181 - RNA, 21 nt, Human
ugaagguuuacaauuuacaaa

SEQ ID NO: 3458182 - RNA, 22 nt, Human
ugaagguuuacaauuuacaaag

SEQ ID NO: 3458183 - RNA, 23 nt, Human
ugaagguuuacaauuuacaaagu

SEQ ID NO: 3458184 - RNA, 13 nt, Human
ugaagguuuuuga

SEQ ID NO: 3458185 - RNA, 18 nt, Human
ugaagguuuuugauagca

SEQ ID NO: 3458186 - RNA, 19 nt, Human
ugaagguuuuugauagcau

SEQ ID NO: 3458187 - RNA, 16 nt, Human
ugaagguuuuuguaaa

SEQ ID NO: 3458188 - RNA, 18 nt, Human
ugaaguaacuugucuuaa

SEQ ID NO: 3458189 - RNA, 13 nt, Human
ugaaguaagcaaa

SEQ ID NO: 3458190 - RNA, 15 nt, Human
ugaaguaauaugcac

SEQ ID NO: 3458191 - RNA, 20 nt, Human
ugaaguaaugaauuuuuaug

SEQ ID NO: 3458192 - RNA, 17 nt, Human
ugaaguacucauacaug

SEQ ID NO: 3458193 - RNA, 17 nt, Human
ucuguuaacugaauacc

SEQ ID NO: 3458194 - RNA, 20 nt, Human
ucuguuaacugaauaccacu

SEQ ID NO: 3458195 - RNA, 19 nt, Human
ucuguuacaaaauguaacu

SEQ ID NO: 3458196 - RNA, 20 nt, Human
ucuguuacaaaauguaacug

SEQ ID NO: 3458197 - RNA, 20 nt, Human
ucuguuacacaaagaaccac

SEQ ID NO: 3458198 - RNA, 19 nt, Human
ucuguuaccaugucacugu

SEQ ID NO: 3458199 - RNA, 23 nt, Human
ucuguuauagguccuuuagaaac

SEQ ID NO: 3458200 - RNA, 18 nt, Human
ucuguuauauaaaugguu

SEQ ID NO: 3458201 - RNA, 15 nt, Human
ucuguuauguacugu

SEQ ID NO: 3458202 - RNA, 18 nt, Human
ucuguuauguacuguacu

SEQ ID NO: 3458203 - RNA, 22 nt, Human
ucuguuauguacuguacuaauu

SEQ ID NO: 3458204 - RNA, 15 nt, Human
ucuguuauuaacaaa

SEQ ID NO: 3458205 - RNA, 20 nt, Human
ucuguucaaagcugccuguc

SEQ ID NO: 3458206 - RNA, 21 nt, Human
ucuguucacuuuuccucccuc

SEQ ID NO: 3458207 - RNA, 14 nt, Human
ucuguucaggaagu

SEQ ID NO: 3458208 - RNA, 12 nt, Human
ucuguucagugu

SEQ ID NO: 3458209 - RNA, 16 nt, Human
ucuguucauuccucca

SEQ ID NO: 3458210 - RNA, 18 nt, Human
ucuguucauuuccucaaa

SEQ ID NO: 3458211 - RNA, 13 nt, Human
ucuguuccaaaug

SEQ ID NO: 3458212 - RNA, 23 nt, Human
ucuguuccaaauucaguuucaua

SEQ ID NO: 3458213 - RNA, 12 nt, Human
ucuguuccacau

SEQ ID NO: 3458214 - RNA, 17 nt, Human
ucuguuccauaguuaaa

SEQ ID NO: 3458215 - RNA, 24 nt, Human
ucuguuccauaguuaaagaagaca

SEQ ID NO: 3458216 - RNA, 13 nt, Human
ucuguuccuggcu

SEQ ID NO: 3458217 - RNA, 15 nt, Human
ucuguuccuucacau

SEQ ID NO: 3458218 - RNA, 15 nt, Human
ucuguucuaacaugu

SEQ ID NO: 3458219 - RNA, 13 nt, Human
ucuguucuaguuu

SEQ ID NO: 3458220 - RNA, 20 nt, Human
ucuguucuaguuuuuuacuu

SEQ ID NO: 3458221 - RNA, 20 nt, Human
ggggcaggaguagcugagcu

SEQ ID NO: 3458222 - RNA, 13 nt, Human
ggggcaggcccug

SEQ ID NO: 3458223 - RNA, 15 nt, Human
ggggcaggcccugca

SEQ ID NO: 3458224 - RNA, 16 nt, Human
ggggcaggcccugcac

SEQ ID NO: 3458225 - RNA, 18 nt, Human
ggggcaggcccugcacug

SEQ ID NO: 3458226 - RNA, 12 nt, Human
ggggcaggcuga

SEQ ID NO: 3458227 - RNA, 15 nt, Human
ggggcaggcugggcc

SEQ ID NO: 3458228 - RNA, 12 nt, Human
ggggcagggcug

SEQ ID NO: 3458229 - RNA, 19 nt, Human
ggggcaggggaggccaucu

SEQ ID NO: 3458230 - RNA, 15 nt, Human
ggggcagucugagag

SEQ ID NO: 3458231 - RNA, 20 nt, Human
ggggcaucugccccuccccc

SEQ ID NO: 3458232 - RNA, 18 nt, Human
ggggcauguauuggccug

SEQ ID NO: 3458233 - RNA, 16 nt, Human
ggggccaaaaggaaaa

SEQ ID NO: 3458234 - RNA, 21 nt, Human
ggggccacagccagaaccccg

SEQ ID NO: 3458235 - RNA, 13 nt, Human
ggggccagaggcu

SEQ ID NO: 3458236 - RNA, 17 nt, Human
ggggccaguuggucccc

SEQ ID NO: 3458237 - RNA, 18 nt, Human
ggggccauauucuuccug

SEQ ID NO: 3458238 - RNA, 16 nt, Human
ggggccaugaggccuc

SEQ ID NO: 3458239 - RNA, 19 nt, Human
ggggcccagggcaagcucc

SEQ ID NO: 3458240 - RNA, 12 nt, Human
ggggcccagggg

SEQ ID NO: 3458241 - RNA, 17 nt, Human
ggggcccaggggaggcg

SEQ ID NO: 3458242 - RNA, 14 nt, Human
ggggcccagugcau

SEQ ID NO: 3458243 - RNA, 18 nt, Human
ggggccccagucagccuc

SEQ ID NO: 3458244 - RNA, 15 nt, Human
ggggccccucucagc

SEQ ID NO: 3458245 - RNA, 21 nt, Human
ggggccccuuuuuacuccccu

SEQ ID NO: 3458246 - RNA, 15 nt, Human
ggggcccgcuugccu

SEQ ID NO: 3458247 - RNA, 13 nt, Human
ggggcccggccag

SEQ ID NO: 3458248 - RNA, 19 nt, Human
ggggcccguugucucccug

SEQ ID NO: 3458249 - RNA, 16 nt, Human
ucuugcaauggcagcc

SEQ ID NO: 3458250 - RNA, 17 nt, Human
ucuugcaauggcagccu

SEQ ID NO: 3458251 - RNA, 22 nt, Human
ucuugcaccaaauuaucuugau

SEQ ID NO: 3458252 - RNA, 22 nt, Human
ucuugcaccccaaagcuuuccu

SEQ ID NO: 3458253 - RNA, 14 nt, Human
ucuugcacccgccu

SEQ ID NO: 3458254 - RNA, 15 nt, Human
ucuugcacccgccuc

SEQ ID NO: 3458255 - RNA, 19 nt, Human
ucuugcacccgccucuccc

SEQ ID NO: 3458256 - RNA, 18 nt, Human
ucuugcagagaagccuug

SEQ ID NO: 3458257 - RNA, 20 nt, Human
ucuugcaggucucaacccuu

SEQ ID NO: 3458258 - RNA, 20 nt, Human
ucuugcaguaucggcacugu

SEQ ID NO: 3458259 - RNA, 17 nt, Human
ucuugcauauuuuguaa

SEQ ID NO: 3458260 - RNA, 18 nt, Human
ucuugcauccuuccuaua

SEQ ID NO: 3458261 - RNA, 21 nt, Human
ucuugcauccuuccuauaacu

SEQ ID NO: 3458262 - RNA, 22 nt, Human
ucuugcauccuuccuauaacuu

SEQ ID NO: 3458263 - RNA, 15 nt, Human
ucuugcaugaggcua

SEQ ID NO: 3458264 - RNA, 23 nt, Human
ucuugcauggcaaggacugcagg

SEQ ID NO: 3458265 - RNA, 12 nt, Human
ucuugcauguaa

SEQ ID NO: 3458266 - RNA, 15 nt, Human
ucuugcccauccuga

SEQ ID NO: 3458267 - RNA, 18 nt, Human
ucuugccccaacccccag

SEQ ID NO: 3458268 - RNA, 22 nt, Human
ucuugccccaacccccagcacc

SEQ ID NO: 3458269 - RNA, 21 nt, Human
ucuugccccaucacugcgcca

SEQ ID NO: 3458270 - RNA, 12 nt, Human
ucuugcccccca

SEQ ID NO: 3458271 - RNA, 21 nt, Human
ucuugccccccaccccagccu

SEQ ID NO: 3458272 - RNA, 14 nt, Human
ucuugcccugggga

SEQ ID NO: 3458273 - RNA, 18 nt, Human
ucuugcccuucccugucc

SEQ ID NO: 3458274 - RNA, 21 nt, Human
ucuugcccuucccugucccuc

SEQ ID NO: 3458275 - RNA, 12 nt, Human
ucuugccucugu

SEQ ID NO: 3458276 - RNA, 22 nt, Human
ucuugccucuguccccuucucu

SEQ ID NO: 3458277 - RNA, 16 nt, Human
ucuugccuguuuccca

SEQ ID NO: 3458278 - RNA, 23 nt, Human
ucuugccuguuucccaggcccac

SEQ ID NO: 3458279 - RNA, 15 nt, Human
ucuugccuuuuucau

SEQ ID NO: 3458280 - RNA, 19 nt, Human
ucuugccuuuuucauuauu

SEQ ID NO: 3458281 - RNA, 19 nt, Human
ucuugcuauauugcccagg

SEQ ID NO: 3458282 - RNA, 18 nt, Human
ucuugcucccuucagccc

SEQ ID NO: 3458283 - RNA, 18 nt, Human
ucuugcucuaucucucaa

SEQ ID NO: 3458284 - RNA, 12 nt, Human
ucuugcucuccu

SEQ ID NO: 3458285 - RNA, 14 nt, Human
ucuugcugcccugc

SEQ ID NO: 3458286 - RNA, 15 nt, Human
ucuugcugcccugcc

SEQ ID NO: 3458287 - RNA, 10 nt, Human
ucuugcugcu

SEQ ID NO: 3458288 - RNA, 22 nt, Human
ucuugcugcuagaacuuuuuua

SEQ ID NO: 3458289 - RNA, 11 nt, Human
ucuugcuggcu

SEQ ID NO: 3458290 - RNA, 23 nt, Human
ucuugcuggcuacgccucuucug

SEQ ID NO: 3458291 - RNA, 13 nt, Human
ucuugcugucucu

SEQ ID NO: 3458292 - RNA, 19 nt, Human
ucuugcugucucugcucgc

SEQ ID NO: 3458293 - RNA, 13 nt, Human
ucuugcugugguc

SEQ ID NO: 3458294 - RNA, 18 nt, Human
ucuugcuucccuaaucua

SEQ ID NO: 3458295 - RNA, 23 nt, Human
ucuugcuucccuaaucuaugguc

SEQ ID NO: 3458296 - RNA, 17 nt, Human
ucuugcuucuuucuaga

SEQ ID NO: 3458297 - RNA, 13 nt, Human
ucuugcuugggaa

SEQ ID NO: 3458298 - RNA, 20 nt, Human
ucuugcuuggggaacuugug

SEQ ID NO: 3458299 - RNA, 18 nt, Human
ucuugcuuguaccucugg

SEQ ID NO: 3458300 - RNA, 16 nt, Human
ucuuggaacuugccug

SEQ ID NO: 3458301 - RNA, 16 nt, Human
ucuuggaccucugcuc

SEQ ID NO: 3458302 - RNA, 21 nt, Human
ucuuggaccucugcucugagg

SEQ ID NO: 3458303 - RNA, 16 nt, Human
ucuuggagaagucuca

SEQ ID NO: 3458304 - RNA, 17 nt, Human
ucuuggagaagucucag

SEQ ID NO: 3458305 - RNA, 14 nt, Human
ucuuggagcuguga

SEQ ID NO: 3458306 - RNA, 15 nt, Human
ucuuggagcugugag

SEQ ID NO: 3458307 - RNA, 17 nt, Human
ucuuggcaaaagccuug

SEQ ID NO: 3458308 - RNA, 20 nt, Human
ucuuggcaaaagccuugugu

SEQ ID NO: 3458309 - RNA, 17 nt, Human
ucuuggcaauaaauuuu

SEQ ID NO: 3458310 - RNA, 22 nt, Human
ucuuggcaauaaauuuugaaaa

SEQ ID NO: 3458311 - RNA, 24 nt, Human
ucuuggcaauaaauuuugaaaagu

SEQ ID NO: 3458312 - RNA, 21 nt, Human
ucuuggcacauuuaagagaca

SEQ ID NO: 3458313 - RNA, 19 nt, Human
ucuuggcagcaccugucuc

SEQ ID NO: 3458314 - RNA, 21 nt, Human
ucuuggcccgcacagagcugg

SEQ ID NO: 3458315 - RNA, 19 nt, Human
ucuuggcuggacccagcca

SEQ ID NO: 3458316 - RNA, 15 nt, Human
ucuuggcuuaaucau

SEQ ID NO: 3458317 - RNA, 21 nt, Human
ucuuggcuuaaucauuuucau

SEQ ID NO: 3458318 - RNA, 17 nt, Human
ucuuggcuuggugagga

SEQ ID NO: 3458319 - RNA, 13 nt, Human
ucuuggcuuuguu

SEQ ID NO: 3458320 - RNA, 13 nt, Human
ucuugggaacuga

SEQ ID NO: 3458321 - RNA, 14 nt, Human
ucuugggaacugaa

SEQ ID NO: 3458322 - RNA, 17 nt, Human
ucuugggcaauauucuc

SEQ ID NO: 3458323 - RNA, 21 nt, Human
ucuugggcaauauucucugua

SEQ ID NO: 3458324 - RNA, 22 nt, Human
ucuugggcaauauucucuguac

SEQ ID NO: 3458325 - RNA, 20 nt, Human
ucuugggcagagcuggcucu

SEQ ID NO: 3458326 - RNA, 21 nt, Human
ucuugggcagagcuggcucug

SEQ ID NO: 3458327 - RNA, 13 nt, Human
ucuugggcccucc

SEQ ID NO: 3458328 - RNA, 21 nt, Human
ucuuggggacaucucuuugaa

SEQ ID NO: 3458329 - RNA, 23 nt, Human
ucuuggggaguuuaggguggggg

SEQ ID NO: 3458330 - RNA, 13 nt, Human
ucuuggggcccag

SEQ ID NO: 3458331 - RNA, 24 nt, Human
ucuugggggacagggcuggcccag

SEQ ID NO: 3458332 - RNA, 16 nt, Human
ucuuggguaggcggga

SEQ ID NO: 3458333 - RNA, 16 nt, Human
ucuugggucuaugccu

SEQ ID NO: 3458334 - RNA, 14 nt, Human
ucuugguagagauu

SEQ ID NO: 3458335 - RNA, 15 nt, Human
ucuuggucuucccag

SEQ ID NO: 3458336 - RNA, 13 nt, Human
ucuugguugagga

SEQ ID NO: 3458337 - RNA, 14 nt, Human
ucuugguuuguaaa

SEQ ID NO: 3458338 - RNA, 13 nt, Human
ucuuguaaagacu

SEQ ID NO: 3458339 - RNA, 17 nt, Human
ucuuguaaauaaagccc

SEQ ID NO: 3458340 - RNA, 16 nt, Human
ucuuguaagauuuuga

SEQ ID NO: 3458341 - RNA, 17 nt, Human
ucuuguaagauuuugaa

SEQ ID NO: 3458342 - RNA, 18 nt, Human
ucuuguaagauuuugaaa

SEQ ID NO: 3458343 - RNA, 16 nt, Human
ucuuguaauuuggauc

SEQ ID NO: 3458344 - RNA, 13 nt, Human
ucuuguaauuuua

SEQ ID NO: 3458345 - RNA, 15 nt, Human
ucuuguaauuuuaca

SEQ ID NO: 3458346 - RNA, 24 nt, Human
ucuuguacauguguagccugugca

SEQ ID NO: 3458347 - RNA, 17 nt, Human
ucuuguagcccaggcug

SEQ ID NO: 3458348 - RNA, 23 nt, Human
ucuuguagcggaugauucuucaa

SEQ ID NO: 3458349 - RNA, 16 nt, Human
ucuuguauuaaacucu

SEQ ID NO: 3458350 - RNA, 14 nt, Human
ucuuguauuaagaa

SEQ ID NO: 3458351 - RNA, 22 nt, Human
ucuuguauuaagaaugaaauac

SEQ ID NO: 3458352 - RNA, 22 nt, Human
ucuuguauuaaguuguuaauaa

SEQ ID NO: 3458353 - RNA, 22 nt, Human
ucuuguauuuauugguuuugca

SEQ ID NO: 3458354 - RNA, 21 nt, Human
ucuugucagacauaaagccau

SEQ ID NO: 3458355 - RNA, 23 nt, Human
ucuugucagacauaaagccaugu

SEQ ID NO: 3458356 - RNA, 11 nt, Human
ucuugucaugu

SEQ ID NO: 3458357 - RNA, 13 nt, Human
ucuugucaugugu

SEQ ID NO: 3458358 - RNA, 23 nt, Human
ucuugucccacgugucuuccacu

SEQ ID NO: 3458359 - RNA, 23 nt, Human
ucuuguccccucuugacccaucu

SEQ ID NO: 3458360 - RNA, 20 nt, Human
ucuuguccucauucuugccu

SEQ ID NO: 3458361 - RNA, 15 nt, Human
ucuugucucaaugcu

SEQ ID NO: 3458362 - RNA, 17 nt, Human
ucuugucucaaugcuca

SEQ ID NO: 3458363 - RNA, 12 nt, Human
ucuugucucaga

SEQ ID NO: 3458364 - RNA, 17 nt, Human
ucuugucucagauuuua

SEQ ID NO: 3458365 - RNA, 15 nt, Human
ucuugucuccccugu

SEQ ID NO: 3458366 - RNA, 17 nt, Human
ugagaaaacuucuuuua

SEQ ID NO: 3458367 - RNA, 19 nt, Human
ugagaaaagcuuugaaccc

SEQ ID NO: 3458368 - RNA, 22 nt, Human
ugagaaaccuguaucuuucuau

SEQ ID NO: 3458369 - RNA, 24 nt, Human
ugagaaaccuguaucuuucuaugc

SEQ ID NO: 3458370 - RNA, 21 nt, Human
ugagaaacuggcaaagcagaa

SEQ ID NO: 3458371 - RNA, 18 nt, Human
ugagaaacuuaaauguua

SEQ ID NO: 3458372 - RNA, 15 nt, Human
ugagaaagacuauuc

SEQ ID NO: 3458373 - RNA, 16 nt, Human
ugagaaagacuauuca

SEQ ID NO: 3458374 - RNA, 14 nt, Human
ugagaaagagcacu

SEQ ID NO: 3458375 - RNA, 13 nt, Human
ugagaaagcccug

SEQ ID NO: 3458376 - RNA, 14 nt, Human
ugagaaagccuucu

SEQ ID NO: 3458377 - RNA, 21 nt, Human
ugagaaagucagauucuugca

SEQ ID NO: 3458378 - RNA, 21 nt, Human
ugagaaauauggacacuuaau

SEQ ID NO: 3458379 - RNA, 13 nt, Human
ugagaaauuuaaa

SEQ ID NO: 3458380 - RNA, 14 nt, Human
ugagaaauuuaaac

SEQ ID NO: 3458381 - RNA, 15 nt, Human
ugagaaauuuaaacu

SEQ ID NO: 3458382 - RNA, 17 nt, Human
ugagaaauuuauaaacu

SEQ ID NO: 3458383 - RNA, 16 nt, Human
ugagaaauuucuguga

SEQ ID NO: 3458384 - RNA, 20 nt, Human
ugagaacaaagcuguuaaac

SEQ ID NO: 3458385 - RNA, 22 nt, Human
ugagaacaaagcuguuaaacug

SEQ ID NO: 3458386 - RNA, 19 nt, Human
ugagaacaaccaaaaucuu

SEQ ID NO: 3458387 - RNA, 12 nt, Human
ugagaacacugu

SEQ ID NO: 3458388 - RNA, 16 nt, Human
ugagaacacugugaaa

SEQ ID NO: 3458389 - RNA, 16 nt, Human
ugagaacccugcgugg

SEQ ID NO: 3458390 - RNA, 21 nt, Human
ugagaacccugcguggggaca

SEQ ID NO: 3458391 - RNA, 21 nt, Human
ugagaacguaaagaacuuuuu

SEQ ID NO: 3458392 - RNA, 13 nt, Human
ugagaacuccuga

SEQ ID NO: 3458393 - RNA, 20 nt, Human
ugagaacugcauauguuucg

SEQ ID NO: 3458394 - RNA, 18 nt, Human
ugagaacuuaaguggcua

SEQ ID NO: 3458395 - RNA, 17 nt, Human
ugagaacuuuauuucca

SEQ ID NO: 3458396 - RNA, 14 nt, Human
ugagaagaaaacau

SEQ ID NO: 3458397 - RNA, 20 nt, Human
ugagaagaaaauggaaccag

SEQ ID NO: 3458398 - RNA, 22 nt, Human
ugagaagaaaauggaaccaggc

SEQ ID NO: 3458399 - RNA, 14 nt, Human
ugagaagaauauug

SEQ ID NO: 3458400 - RNA, 20 nt, Human
ugagaagagggccuguggga

SEQ ID NO: 3458401 - RNA, 23 nt, Human
ugagaagauucuucccauucucc

SEQ ID NO: 3458402 - RNA, 15 nt, Human
ugagaagccuucagc

SEQ ID NO: 3458403 - RNA, 19 nt, Human
ugagaagccuucagcucca

SEQ ID NO: 3458404 - RNA, 14 nt, Human
ugagaagcugcuca

SEQ ID NO: 3458405 - RNA, 16 nt, Human
ugagaagcugcucaac

SEQ ID NO: 3458406 - RNA, 20 nt, Human
ugagaagcugcuccaggccu

SEQ ID NO: 3458407 - RNA, 20 nt, Human
ggggcccguugucucccugg

SEQ ID NO: 3458408 - RNA, 14 nt, Human
ggggcccugcccug

SEQ ID NO: 3458409 - RNA, 16 nt, Human
ggggcccuggagcagc

SEQ ID NO: 3458410 - RNA, 21 nt, Human
ggggccgaugcccagagacac

SEQ ID NO: 3458411 - RNA, 18 nt, Human
ggggccguggggguugag

SEQ ID NO: 3458412 - RNA, 23 nt, Human
ggggccuaauaaaacugauguga

SEQ ID NO: 3458413 - RNA, 21 nt, Human
ggggccuagcgaucucuccug

SEQ ID NO: 3458414 - RNA, 19 nt, Human
ggggccuaucagugugccc

SEQ ID NO: 3458415 - RNA, 23 nt, Human
ggggccuaucagugugcccccca

SEQ ID NO: 3458416 - RNA, 12 nt, Human
ggggccucccug

SEQ ID NO: 3458417 - RNA, 21 nt, Human
ggggccugaccucccccuccu

SEQ ID NO: 3458418 - RNA, 12 nt, Human
ggggccugagag

SEQ ID NO: 3458419 - RNA, 15 nt, Human
ggggccugagagaau

SEQ ID NO: 3458420 - RNA, 23 nt, Human
ggggccugagcaguccuuggccu

SEQ ID NO: 3458421 - RNA, 12 nt, Human
ggggccugccac

SEQ ID NO: 3458422 - RNA, 16 nt, Human
ggggccuggaccugcc

SEQ ID NO: 3458423 - RNA, 12 nt, Human
ggggccuggaug

SEQ ID NO: 3458424 - RNA, 13 nt, Human
ggggccuggcagg

SEQ ID NO: 3458425 - RNA, 18 nt, Human
ggggccuguacugccugc

SEQ ID NO: 3458426 - RNA, 19 nt, Human
ggggccuguacugccugcu

SEQ ID NO: 3458427 - RNA, 23 nt, Human
ggggccuuagggcacugggcugu

SEQ ID NO: 3458428 - RNA, 20 nt, Human
ggggccuuugggugcuguuu

SEQ ID NO: 3458429 - RNA, 14 nt, Human
ggggcgaggcaggc

SEQ ID NO: 3458430 - RNA, 14 nt, Human
ggggcgcccaccuc

SEQ ID NO: 3458431 - RNA, 19 nt, Human
ggggcgcccaccuccccac

SEQ ID NO: 3458432 - RNA, 18 nt, Human
ggggcgcuggcccagccg

SEQ ID NO: 3458433 - RNA, 23 nt, Human
ggggcgcuggcccagccggccuc

SEQ ID NO: 3458434 - RNA, 14 nt, Human
ggggcuacaagagg

SEQ ID NO: 3458435 - RNA, 15 nt, Human
ggggcuacaagaggg

SEQ ID NO: 3458436 - RNA, 17 nt, Human
ggggcuacaagagggaa

SEQ ID NO: 3458437 - RNA, 21 nt, Human
ggggcuagaaccuagagaagc

SEQ ID NO: 3458438 - RNA, 20 nt, Human
ggggcucagcaaggccaccu

SEQ ID NO: 3458439 - RNA, 12 nt, Human
ggggcucccagc

SEQ ID NO: 3458440 - RNA, 13 nt, Human
ggggcucccagcc

SEQ ID NO: 3458441 - RNA, 20 nt, Human
ggggcucccagccaggcccu

SEQ ID NO: 3458442 - RNA, 20 nt, Human
ggggcucccgccuccaaccc

SEQ ID NO: 3458443 - RNA, 19 nt, Human
ggggcucccuccgccccca

SEQ ID NO: 3458444 - RNA, 21 nt, Human
ggggcucuaacgccugagccc

SEQ ID NO: 3458445 - RNA, 22 nt, Human
ggggcucuaacgccugagccca

SEQ ID NO: 3458446 - RNA, 14 nt, Human
ggggcucuggagag

SEQ ID NO: 3458447 - RNA, 17 nt, Human
ggggcucuggagagaaa

SEQ ID NO: 3458448 - RNA, 18 nt, Human
ggggcucuggagagaaac

SEQ ID NO: 3458449 - RNA, 12 nt, Human
ggggcucuggga

SEQ ID NO: 3458450 - RNA, 14 nt, Human
ggggcugaggggca

SEQ ID NO: 3458451 - RNA, 20 nt, Human
ggggcugaucucagggaagc

SEQ ID NO: 3458452 - RNA, 23 nt, Human
ggggcugcaccggcuggccuggc

SEQ ID NO: 3458453 - RNA, 13 nt, Human
ggggcugcagcau

SEQ ID NO: 3458454 - RNA, 15 nt, Human
ggggcugcccgcucc

SEQ ID NO: 3458455 - RNA, 12 nt, Human
ggggcugcugcu

SEQ ID NO: 3458456 - RNA, 21 nt, Human
ggggcuggaggagcccaggcc

SEQ ID NO: 3458457 - RNA, 16 nt, Human
ggggcugggcagagga

SEQ ID NO: 3458458 - RNA, 22 nt, Human
ggggcuggguuggcgcacccuc

SEQ ID NO: 3458459 - RNA, 18 nt, Human
ggggcuguugaagucacc

SEQ ID NO: 3458460 - RNA, 12 nt, Human
ggggcuuauuuu

SEQ ID NO: 3458461 - RNA, 11 nt, Human
ggggcuuccug

SEQ ID NO: 3458462 - RNA, 19 nt, Human
ggggcuucugugcaccugg

SEQ ID NO: 3458463 - RNA, 19 nt, Human
ggggcuuggcguggagcag

SEQ ID NO: 3458464 - RNA, 21 nt, Human
ggggcuuucguccacagcuuc

SEQ ID NO: 3458465 - RNA, 15 nt, Human
ggggcuuucuggaga

SEQ ID NO: 3458466 - RNA, 21 nt, Human
gggggaaacagguugggaugg

SEQ ID NO: 3458467 - RNA, 12 nt, Human
gggggaaagcac

SEQ ID NO: 3458468 - RNA, 17 nt, Human
gggggaacgaugugucu

SEQ ID NO: 3458469 - RNA, 22 nt, Human
gggggacagggcuggcccagcc

SEQ ID NO: 3458470 - RNA, 20 nt, Human
gggggacucugagcgggagg

SEQ ID NO: 3458471 - RNA, 19 nt, Human
gggggacugcugcugccug

SEQ ID NO: 3458472 - RNA, 18 nt, Human
gggggagcacccugaggg

SEQ ID NO: 3458473 - RNA, 17 nt, Human
gggggagucugaagcag

SEQ ID NO: 3458474 - RNA, 22 nt, Human
gggggaugccacuccucccucc

SEQ ID NO: 3458475 - RNA, 23 nt, Human
gggggcaagaagaucacgcuccc

SEQ ID NO: 3458476 - RNA, 15 nt, Human
gggggcacaagacug

SEQ ID NO: 3458477 - RNA, 15 nt, Human
gggggcacaggaggc

SEQ ID NO: 3458478 - RNA, 13 nt, Human
gggggcagagggc

SEQ ID NO: 3458479 - RNA, 14 nt, Human
gggggcagggcaug

SEQ ID NO: 3458480 - RNA, 14 nt, Human
gggggcaggugcug

SEQ ID NO: 3458481 - RNA, 14 nt, Human
gggggccaaaagga

SEQ ID NO: 3458482 - RNA, 17 nt, Human
gggggccaccuccccag

SEQ ID NO: 3458483 - RNA, 14 nt, Human
gggggccaggugca

SEQ ID NO: 3458484 - RNA, 21 nt, Human
gggggccucagggcagccugc

SEQ ID NO: 3458485 - RNA, 12 nt, Human
gggggccucagu

SEQ ID NO: 3458486 - RNA, 15 nt, Human
gggggccucagugcc

SEQ ID NO: 3458487 - RNA, 15 nt, Human
gggggccuggaugcc

SEQ ID NO: 3458488 - RNA, 12 nt, Human
gggggccuggcu

SEQ ID NO: 3458489 - RNA, 15 nt, Human
gggggccuggcuggc

SEQ ID NO: 3458490 - RNA, 17 nt, Human
gggggccuggcuggcug

SEQ ID NO: 3458491 - RNA, 22 nt, Human
gggggcuauagcuacaggaagc

SEQ ID NO: 3458492 - RNA, 20 nt, Human
gggggcucaguucuggacug

SEQ ID NO: 3458493 - RNA, 19 nt, Human
gggggcucccguggccugu

SEQ ID NO: 3458494 - RNA, 16 nt, Human
gggggcuggaggagcc

SEQ ID NO: 3458495 - RNA, 13 nt, Human
gggggcuggggca

SEQ ID NO: 3458496 - RNA, 13 nt, Human
gggggcuggugcc

SEQ ID NO: 3458497 - RNA, 21 nt, Human
gggggcuggugccagccuucc

SEQ ID NO: 3458498 - RNA, 10 nt, Human
ggggggaggc

SEQ ID NO: 3458499 - RNA, 15 nt, Human
ggggguagagcugau

SEQ ID NO: 3458500 - RNA, 19 nt, Human
ggggguccuccuccaggga

SEQ ID NO: 3458501 - RNA, 20 nt, Human
ggggguccuccuccagggac

SEQ ID NO: 3458502 - RNA, 17 nt, Human
gggggucuggcuggugu

SEQ ID NO: 3458503 - RNA, 20 nt, Human
gggggugaugagggcagcag

SEQ ID NO: 3458504 - RNA, 13 nt, Human
ggggguggccagg

SEQ ID NO: 3458505 - RNA, 13 nt, Human
ggggguggccucc

SEQ ID NO: 3458506 - RNA, 19 nt, Human
ggggguugcaguggagagg

SEQ ID NO: 3458507 - RNA, 18 nt, Human
ggggguugcggggggagg

SEQ ID NO: 3458508 - RNA, 20 nt, Human
gggguauuucaauuaccuuc

SEQ ID NO: 3458509 - RNA, 18 nt, Human
gggguauuuuaggcaggg

SEQ ID NO: 3458510 - RNA, 17 nt, Human
ggggucaaagcaaggau

SEQ ID NO: 3458511 - RNA, 15 nt, Human
ugaacauugcaauag

SEQ ID NO: 3458512 - RNA, 18 nt, Human
ugaacauugcaauagaaa

SEQ ID NO: 3458513 - RNA, 20 nt, Human
ugaacauugguucuuucauu

SEQ ID NO: 3458514 - RNA, 15 nt, Human
ugaacauuuacuaca

SEQ ID NO: 3458515 - RNA, 19 nt, Human
ugaacauuuggguaaauca

SEQ ID NO: 3458516 - RNA, 22 nt, Human
ugaacauuuggguuacuauuuc

SEQ ID NO: 3458517 - RNA, 17 nt, Human
ugaaccaaaacauuccg

SEQ ID NO: 3458518 - RNA, 18 nt, Human
ugaaccaagaucuauaaa

SEQ ID NO: 3458519 - RNA, 15 nt, Human
ugaaccaaucuggau

SEQ ID NO: 3458520 - RNA, 19 nt, Human
ugaaccacaucuugcucug

SEQ ID NO: 3458521 - RNA, 23 nt, Human
ugaaccacaucuugcucugcuga

SEQ ID NO: 3458522 - RNA, 15 nt, Human
ugaaccacuucauuc

SEQ ID NO: 3458523 - RNA, 14 nt, Human
ugaaccacuucccu

SEQ ID NO: 3458524 - RNA, 23 nt, Human
ugaaccacuucccucaucucucc

SEQ ID NO: 3458525 - RNA, 14 nt, Human
ugaaccacuuguag

SEQ ID NO: 3458526 - RNA, 21 nt, Human
ugaaccacuuguagauuugau

SEQ ID NO: 3458527 - RNA, 22 nt, Human
ugaaccauaaauucaacuuugu

SEQ ID NO: 3458528 - RNA, 18 nt, Human
ugaaccauaguuacugua

SEQ ID NO: 3458529 - RNA, 13 nt, Human
ugaacccaggaca

SEQ ID NO: 3458530 - RNA, 21 nt, Human
ugaacccaggacgcuucugaa

SEQ ID NO: 3458531 - RNA, 22 nt, Human
ugaacccaggacgcuucugaau

SEQ ID NO: 3458532 - RNA, 14 nt, Human
ugaacccaggaggu

SEQ ID NO: 3458533 - RNA, 19 nt, Human
ugaacccaggagguggagg

SEQ ID NO: 3458534 - RNA, 15 nt, Human
ugaacccuggggccu

SEQ ID NO: 3458535 - RNA, 15 nt, Human
ugaacccugugcugg

SEQ ID NO: 3458536 - RNA, 14 nt, Human
ugaaccgcacagcu

SEQ ID NO: 3458537 - RNA, 16 nt, Human
ugaaccgcugaauaug

SEQ ID NO: 3458538 - RNA, 20 nt, Human
ugaaccuaccuucauuucag

SEQ ID NO: 3458539 - RNA, 17 nt, Human
ugaaccuaugaagcaau

SEQ ID NO: 3458540 - RNA, 14 nt, Human
ugaaccugggaggu

SEQ ID NO: 3458541 - RNA, 13 nt, Human
ugaaccugugagu

SEQ ID NO: 3458542 - RNA, 19 nt, Human
ugaaccugugaguaaauau

SEQ ID NO: 3458543 - RNA, 23 nt, Human
ugaaccugugaguaaauauugag

SEQ ID NO: 3458544 - RNA, 17 nt, Human
ugaaccuuugugcccua

SEQ ID NO: 3458545 - RNA, 18 nt, Human
ugaaccuuugugcccuau

SEQ ID NO: 3458546 - RNA, 13 nt, Human
ugaacggggagaa

SEQ ID NO: 3458547 - RNA, 16 nt, Human
ugaacggggagaaaag

SEQ ID NO: 3458548 - RNA, 17 nt, Human
ugaacguuugguucaaa

SEQ ID NO: 3458549 - RNA, 20 nt, Human
ugaacguuugguucaaaugu

SEQ ID NO: 3458550 - RNA, 21 nt, Human
ugaacuaaagugcugcacuca

SEQ ID NO: 3458551 - RNA, 20 nt, Human
ugaacuaccuugguuccccc

SEQ ID NO: 3458552 - RNA, 23 nt, Human
ugaacuagaguuuagcuggaaaa

SEQ ID NO: 3458553 - RNA, 18 nt, Human
ugaacucaaacugaggaa

SEQ ID NO: 3458554 - RNA, 17 nt, Human
ugaacucaacuuugaca

SEQ ID NO: 3458555 - RNA, 18 nt, Human
ugaacucacuuuccuccu

SEQ ID NO: 3458556 - RNA, 22 nt, Human
ugaacucagaucugucugauag

SEQ ID NO: 3458557 - RNA, 22 nt, Human
ugaacucagccaagcacagugg

SEQ ID NO: 3458558 - RNA, 14 nt, Human
ugaacuccuggccu

SEQ ID NO: 3458559 - RNA, 16 nt, Human
ugaacucugacaacag

SEQ ID NO: 3458560 - RNA, 14 nt, Human
ugaacucugagaga

SEQ ID NO: 3458561 - RNA, 15 nt, Human
ugaacucuuaaucaa

SEQ ID NO: 3458562 - RNA, 12 nt, Human
ugaacucuuaga

SEQ ID NO: 3458563 - RNA, 18 nt, Human
ugaacucuucaaucucuu

SEQ ID NO: 3458564 - RNA, 15 nt, Human
ugaacucuucacucu

SEQ ID NO: 3458565 - RNA, 14 nt, Human
ugaacucuucucau

SEQ ID NO: 3458566 - RNA, 18 nt, Human
ugaacucuucucauuacu

SEQ ID NO: 3458567 - RNA, 17 nt, Human
ugaacucuuugaaugac

SEQ ID NO: 3458568 - RNA, 19 nt, Human
ugaacucuuugaaugacaa

SEQ ID NO: 3458569 - RNA, 14 nt, Human
ugaacugaacacca

SEQ ID NO: 3458570 - RNA, 15 nt, Human
ugaacugaaguuuca

SEQ ID NO: 3458571 - RNA, 17 nt, Human
ugaacugaaguuucaca

SEQ ID NO: 3458572 - RNA, 21 nt, Human
ugaacugacaggcagccugga

SEQ ID NO: 3458573 - RNA, 21 nt, Human
ugaacugauucacaucucauu

SEQ ID NO: 3458574 - RNA, 18 nt, Human
ugaacuggacccuguugc

SEQ ID NO: 3458575 - RNA, 20 nt, Human
ugaacuggacccuguugcua

SEQ ID NO: 3458576 - RNA, 19 nt, Human
ugaacuggguacuugugga

SEQ ID NO: 3458577 - RNA, 17 nt, Human
ugaacuggucuuccuuu

SEQ ID NO: 3458578 - RNA, 13 nt, Human
ugaacuguuagaa

SEQ ID NO: 3458579 - RNA, 16 nt, Human
ugaacuguuagaaugu

SEQ ID NO: 3458580 - RNA, 17 nt, Human
ugaacuguuagaaugua

SEQ ID NO: 3458581 - RNA, 17 nt, Human
ugaacuuaaauaaaugu

SEQ ID NO: 3458582 - RNA, 22 nt, Human
ugaacuuaaauaaaugucauua

SEQ ID NO: 3458583 - RNA, 19 nt, Human
ugaacuuagauuuuacaug

SEQ ID NO: 3458584 - RNA, 16 nt, Human
ugaacuuauucuguag

SEQ ID NO: 3458585 - RNA, 18 nt, Human
ugaacuucagcuagagcu

SEQ ID NO: 3458586 - RNA, 15 nt, Human
ugaacuucucucaga

SEQ ID NO: 3458587 - RNA, 18 nt, Human
ugaacuucucucagacuu

SEQ ID NO: 3458588 - RNA, 22 nt, Human
ugaacuucucucagacuuacuu

SEQ ID NO: 3458589 - RNA, 13 nt, Human
ugaacuugaaauu

SEQ ID NO: 3458590 - RNA, 18 nt, Human
ugaacuugaaauuugaau

SEQ ID NO: 3458591 - RNA, 17 nt, Human
ugaacuugaggacacau

SEQ ID NO: 3458592 - RNA, 18 nt, Human
ugaacuugaggacacaug

SEQ ID NO: 3458593 - RNA, 17 nt, Human
ugaacuugcauugugau

SEQ ID NO: 3458594 - RNA, 16 nt, Human
ugaacuugccucuuuu

SEQ ID NO: 3458595 - RNA, 16 nt, Human
ugaacuuggaagcaca

SEQ ID NO: 3458596 - RNA, 22 nt, Human
ugaacuuguaaaggaauuuaaa

SEQ ID NO: 3458597 - RNA, 13 nt, Human
ugaacuuugaaga

SEQ ID NO: 3458598 - RNA, 11 nt, Human
ugaacuuugac

SEQ ID NO: 3458599 - RNA, 16 nt, Human
ugaacuuugaccucug

SEQ ID NO: 3458600 - RNA, 15 nt, Human
ugaacuuugcugagc

SEQ ID NO: 3458601 - RNA, 16 nt, Human
ugaacuuugcugagcc

SEQ ID NO: 3458602 - RNA, 14 nt, Human
ugaacuuuggagag

SEQ ID NO: 3458603 - RNA, 17 nt, Human
ugaacuuuuuauugauu

SEQ ID NO: 3458604 - RNA, 15 nt, Human
ugaagaaaaaauaca

SEQ ID NO: 3458605 - RNA, 15 nt, Human
ugaagaaaagugggc

SEQ ID NO: 3458606 - RNA, 14 nt, Human
ugaagaaaauacuu

SEQ ID NO: 3458607 - RNA, 16 nt, Human
ugaagaaaauacuuaa

SEQ ID NO: 3458608 - RNA, 18 nt, Human
ugaagaaaauacuuaaau

SEQ ID NO: 3458609 - RNA, 20 nt, Human
ugaagaaaauacuuaaaugu

SEQ ID NO: 3458610 - RNA, 18 nt, Human
ugaagaaacagauaccau

SEQ ID NO: 3458611 - RNA, 16 nt, Human
ugaagaaacagcuaug

SEQ ID NO: 3458612 - RNA, 20 nt, Human
ugaggcuuaacaaugucuug

SEQ ID NO: 3458613 - RNA, 13 nt, Human
ugaggcuugcuga

SEQ ID NO: 3458614 - RNA, 14 nt, Human
ugaggcuugcugag

SEQ ID NO: 3458615 - RNA, 16 nt, Human
ugaggcuugcugagag

SEQ ID NO: 3458616 - RNA, 17 nt, Human
ugaggcuugcugagagg

SEQ ID NO: 3458617 - RNA, 19 nt, Human
ugaggcuuuccaugggacc

SEQ ID NO: 3458618 - RNA, 13 nt, Human
ugaggcuuuggau

SEQ ID NO: 3458619 - RNA, 18 nt, Human
ugaggcuuuggauuugac

SEQ ID NO: 3458620 - RNA, 23 nt, Human
ugaggcuuuggauuugacauugc

SEQ ID NO: 3458621 - RNA, 17 nt, Human
ugaggcuuuguguugua

SEQ ID NO: 3458622 - RNA, 16 nt, Human
ugagggaaauguuuug

SEQ ID NO: 3458623 - RNA, 16 nt, Human
ugagggaacagacagg

SEQ ID NO: 3458624 - RNA, 17 nt, Human
ugagggaacagagaggu

SEQ ID NO: 3458625 - RNA, 22 nt, Human
ugagggacaaauuuaaaacaaa

SEQ ID NO: 3458626 - RNA, 18 nt, Human
ugagggaccagccaagag

SEQ ID NO: 3458627 - RNA, 13 nt, Human
ugagggacucuga

SEQ ID NO: 3458628 - RNA, 20 nt, Human
ugagggaggaccuggggcac

SEQ ID NO: 3458629 - RNA, 18 nt, Human
ugagggaggaggccaccu

SEQ ID NO: 3458630 - RNA, 20 nt, Human
ugagggaggaggccaccucu

SEQ ID NO: 3458631 - RNA, 14 nt, Human
ugagggaggggaaa

SEQ ID NO: 3458632 - RNA, 18 nt, Human
ugagggaucacagggccc

SEQ ID NO: 3458633 - RNA, 17 nt, Human
ugagggaugggccuggc

SEQ ID NO: 3458634 - RNA, 12 nt, Human
ugagggcaaauc

SEQ ID NO: 3458635 - RNA, 18 nt, Human
ugagggcagacuggggca

SEQ ID NO: 3458636 - RNA, 12 nt, Human
ugagggcagcag

SEQ ID NO: 3458637 - RNA, 13 nt, Human
ugagggcagcagc

SEQ ID NO: 3458638 - RNA, 14 nt, Human
ugagggcagcagcc

SEQ ID NO: 3458639 - RNA, 21 nt, Human
ugagggcaguucgcagccacc

SEQ ID NO: 3458640 - RNA, 21 nt, Human
ugagggcaucuugguccagga

SEQ ID NO: 3458641 - RNA, 16 nt, Human
ugagggcccagagcag

SEQ ID NO: 3458642 - RNA, 15 nt, Human
ugagggccugcugga

SEQ ID NO: 3458643 - RNA, 20 nt, Human
ugagggccugcuggaggccu

SEQ ID NO: 3458644 - RNA, 16 nt, Human
ugagggcggggugucu

SEQ ID NO: 3458645 - RNA, 18 nt, Human
ugaggggaagcuagucuu

SEQ ID NO: 3458646 - RNA, 16 nt, Human
ugaggggaccaggagu

SEQ ID NO: 3458647 - RNA, 22 nt, Human
ugaggggaccaggagugggugg

SEQ ID NO: 3458648 - RNA, 16 nt, Human
ugaggggagaggagac

SEQ ID NO: 3458649 - RNA, 15 nt, Human
ugaggggagccagga

SEQ ID NO: 3458650 - RNA, 18 nt, Human
ugaggggagccaggaggg

SEQ ID NO: 3458651 - RNA, 21 nt, Human
ugaggggaggaaacucaccug

SEQ ID NO: 3458652 - RNA, 22 nt, Human
ugaggggaggaucacuggagcc

SEQ ID NO: 3458653 - RNA, 15 nt, Human
ugaggggaggggggc

SEQ ID NO: 3458654 - RNA, 18 nt, Human
ugaggggcagccugccuu

SEQ ID NO: 3458655 - RNA, 17 nt, Human
ugaggggcaucugcccc

SEQ ID NO: 3458656 - RNA, 21 nt, Human
ugaagagacagagacaaguaa

SEQ ID NO: 3458657 - RNA, 21 nt, Human
ugaagagagauauaucugaaa

SEQ ID NO: 3458658 - RNA, 16 nt, Human
ugaagagauccuucug

SEQ ID NO: 3458659 - RNA, 22 nt, Human
ugaagagccagaagugaagagu

SEQ ID NO: 3458660 - RNA, 15 nt, Human
ugaagagcuagagaa

SEQ ID NO: 3458661 - RNA, 17 nt, Human
ugaagagcuggggagaa

SEQ ID NO: 3458662 - RNA, 18 nt, Human
ugaagagcuggggagaau

SEQ ID NO: 3458663 - RNA, 15 nt, Human
ugaagagcuugcuuu

SEQ ID NO: 3458664 - RNA, 18 nt, Human
ugaagagcuugcuuugau

SEQ ID NO: 3458665 - RNA, 12 nt, Human
ugaagaggaaaa

SEQ ID NO: 3458666 - RNA, 23 nt, Human
ugaagaggaggggaagaggccug

SEQ ID NO: 3458667 - RNA, 17 nt, Human
ugaagaggcgggccagc

SEQ ID NO: 3458668 - RNA, 20 nt, Human
ugaagaggcgggccagccag

SEQ ID NO: 3458669 - RNA, 21 nt, Human
ugaagaggcgggccagccagg

SEQ ID NO: 3458670 - RNA, 21 nt, Human
ugaagagggagaagcaugaaa

SEQ ID NO: 3458671 - RNA, 15 nt, Human
ugaagaggggcagcc

SEQ ID NO: 3458672 - RNA, 16 nt, Human
ugaagaggggcagccc

SEQ ID NO: 3458673 - RNA, 17 nt, Human
ugaagaggggcagcccu

SEQ ID NO: 3458674 - RNA, 19 nt, Human
ugaagaggggcagcccuug

SEQ ID NO: 3458675 - RNA, 23 nt, Human
ugaagaguaaucaaucuacucaa

SEQ ID NO: 3458676 - RNA, 23 nt, Human
ugaagaguccucugaaugaaccu

SEQ ID NO: 3458677 - RNA, 18 nt, Human
ugaagagucgauuauuuc

SEQ ID NO: 3458678 - RNA, 16 nt, Human
ugaagagugagagggc

SEQ ID NO: 3458679 - RNA, 17 nt, Human
ugaagagugagagggca

SEQ ID NO: 3458680 - RNA, 23 nt, Human
ugaagaguguuauuuucauucaa

SEQ ID NO: 3458681 - RNA, 14 nt, Human
ugaagauacugaaa

SEQ ID NO: 3458682 - RNA, 15 nt, Human
ugaagauacuuugua

SEQ ID NO: 3458683 - RNA, 19 nt, Human
ugaagauacuuuguauugu

SEQ ID NO: 3458684 - RNA, 15 nt, Human
ugaagauagaagaaa

SEQ ID NO: 3458685 - RNA, 22 nt, Human
ugaagauaucuugaaaugaaag

SEQ ID NO: 3458686 - RNA, 16 nt, Human
ugaagauccagcugcc

SEQ ID NO: 3458687 - RNA, 20 nt, Human
ugaagaucuaaauaaaaugc

SEQ ID NO: 3458688 - RNA, 12 nt, Human
ugaagaugaaca

SEQ ID NO: 3458689 - RNA, 19 nt, Human
ugaagaugcauuguaguuu

SEQ ID NO: 3458690 - RNA, 22 nt, Human
ugaagaugggggccucuuucag

SEQ ID NO: 3458691 - RNA, 17 nt, Human
ugaagauguagaggaga

SEQ ID NO: 3458692 - RNA, 16 nt, Human
ugaagaugucuaauag

SEQ ID NO: 3458693 - RNA, 16 nt, Human
ugaagauguugagaaa

SEQ ID NO: 3458694 - RNA, 19 nt, Human
ugaagauuauuuuuuauga

SEQ ID NO: 3458695 - RNA, 19 nt, Human
ugaagauucuccugugcua

SEQ ID NO: 3458696 - RNA, 16 nt, Human
ugaagauucuuuccca

SEQ ID NO: 3458697 - RNA, 21 nt, Human
ugaagauucuuucccaauuca

SEQ ID NO: 3458698 - RNA, 13 nt, Human
ugaagauuguuua

SEQ ID NO: 3458699 - RNA, 19 nt, Human
ugaagauuuaauauuacag

SEQ ID NO: 3458700 - RNA, 20 nt, Human
ugaagauuuaccacuugugu

SEQ ID NO: 3458701 - RNA, 13 nt, Human
ugaagcaaacaca

SEQ ID NO: 3458702 - RNA, 17 nt, Human
ugaagcaaagcaccagc

SEQ ID NO: 3458703 - RNA, 18 nt, Human
ugaagcaaaucagaaacu

SEQ ID NO: 3458704 - RNA, 22 nt, Human
ugaagcaaaugucaugcugccu

SEQ ID NO: 3458705 - RNA, 14 nt, Human
ugaagcaaggaaga

SEQ ID NO: 3458706 - RNA, 20 nt, Human
ugaagcaaggaagauauaca

SEQ ID NO: 3458707 - RNA, 16 nt, Human
ugaagcagaguggcag

SEQ ID NO: 3458708 - RNA, 19 nt, Human
ugaagcaggagaaucacuu

SEQ ID NO: 3458709 - RNA, 15 nt, Human
ugaagcaguauuuug

SEQ ID NO: 3458710 - RNA, 14 nt, Human
ugaagcauguuuca

SEQ ID NO: 3458711 - RNA, 16 nt, Human
ugaagcauguuucaug

SEQ ID NO: 3458712 - RNA, 14 nt, Human
ugaagcauuuuaua

SEQ ID NO: 3458713 - RNA, 18 nt, Human
ugaagcauuuuauaaauc

SEQ ID NO: 3458714 - RNA, 21 nt, Human
ugaagccaaguggggugcugg

SEQ ID NO: 3458715 - RNA, 19 nt, Human
ugaagccaauucagacagg

SEQ ID NO: 3458716 - RNA, 21 nt, Human
ugaagccaugaguuccagaaa

SEQ ID NO: 3458717 - RNA, 15 nt, Human
ugaagcccaauaaac

SEQ ID NO: 3458718 - RNA, 19 nt, Human
ugaagcccaauaaaccucu

SEQ ID NO: 3458719 - RNA, 22 nt, Human
ugaagcccuccaaaagcacuua

SEQ ID NO: 3458720 - RNA, 16 nt, Human
ugaagccgacucuggc

SEQ ID NO: 3458721 - RNA, 17 nt, Human
ugaagccgacucuggcc

SEQ ID NO: 3458722 - RNA, 19 nt, Human
ugaagccgacucuggcccu

SEQ ID NO: 3458723 - RNA, 13 nt, Human
ugaagccucuggg

SEQ ID NO: 3458724 - RNA, 14 nt, Human
ugaagccucuggga

SEQ ID NO: 3458725 - RNA, 18 nt, Human
ugaagccugaacccaaga

SEQ ID NO: 3458726 - RNA, 23 nt, Human
ugaagccugcguugguccagagc

SEQ ID NO: 3458727 - RNA, 15 nt, Human
ugaagccugcuccuu

SEQ ID NO: 3458728 - RNA, 18 nt, Human
ugaagccugcuccuuccc

SEQ ID NO: 3458729 - RNA, 13 nt, Human
ugaagccugugga

SEQ ID NO: 3458730 - RNA, 15 nt, Human
ugaagccuuagccag

SEQ ID NO: 3458731 - RNA, 18 nt, Human
ugaagccuuucuuuugga

SEQ ID NO: 3458732 - RNA, 20 nt, Human
ugaagcuaauuauuuuaauu

SEQ ID NO: 3458733 - RNA, 19 nt, Human
ugaagcucaccuguugcuu

SEQ ID NO: 3458734 - RNA, 22 nt, Human
ugaagcucuggugacaccagcc

SEQ ID NO: 3458735 - RNA, 14 nt, Human
ugaagcugcaguga

SEQ ID NO: 3458736 - RNA, 16 nt, Human
ugaagcuguuguguga

SEQ ID NO: 3458737 - RNA, 17 nt, Human
ugaagcuuauuaaugcu

SEQ ID NO: 3458738 - RNA, 19 nt, Human
ugaagcuuauuaaugcuaa

SEQ ID NO: 3458739 - RNA, 23 nt, Human
ugaagcuuauuaaugcuaagggc

SEQ ID NO: 3458740 - RNA, 22 nt, Human
ugaagcuucacucacugucaau

SEQ ID NO: 3458741 - RNA, 13 nt, Human
ugaagcuucaugc

SEQ ID NO: 3458742 - RNA, 14 nt, Human
ugaagcuugacucc

SEQ ID NO: 3458743 - RNA, 15 nt, Human
ugaagcuugacuccc

SEQ ID NO: 3458744 - RNA, 23 nt, Human
ugaagcuuuauacguguagcuau

SEQ ID NO: 3458745 - RNA, 16 nt, Human
ugaagcuuuuauguga

SEQ ID NO: 3458746 - RNA, 16 nt, Human
ugaaggaaagauuugu

SEQ ID NO: 3458747 - RNA, 19 nt, Human
ugaaggaacauuccuuagu

SEQ ID NO: 3458748 - RNA, 16 nt, Human
ugaaggaaccaaagcg

SEQ ID NO: 3458749 - RNA, 15 nt, Human
ugaaggaacuugucu

SEQ ID NO: 3458750 - RNA, 20 nt, Human
ugaaggaagccaaauuuauc

SEQ ID NO: 3458751 - RNA, 13 nt, Human
ugaaggaauauau

SEQ ID NO: 3458752 - RNA, 18 nt, Human
ugaaggacacuuccugcc

SEQ ID NO: 3458753 - RNA, 20 nt, Human
ugaaggacauugcggacagc

SEQ ID NO: 3458754 - RNA, 20 nt, Human
ugaaggagauuuuccuuccu

SEQ ID NO: 3458755 - RNA, 23 nt, Human
ugaaggagccccauuccugggaa

SEQ ID NO: 3458756 - RNA, 17 nt, Human
ugaaggaggccaccucc

SEQ ID NO: 3458757 - RNA, 15 nt, Human
ugaaggaugccaaga

SEQ ID NO: 3458758 - RNA, 18 nt, Human
ugaaggcaaaauugcaaa

SEQ ID NO: 3458759 - RNA, 18 nt, Human
ugaaggccccgcccaggc

SEQ ID NO: 3458760 - RNA, 20 nt, Human
ugaaggccuucaacccgaga

SEQ ID NO: 3458761 - RNA, 11 nt, Human
ugaaggcuggc

SEQ ID NO: 3458762 - RNA, 14 nt, Human
ugaaggcuguacac

SEQ ID NO: 3458763 - RNA, 20 nt, Human
ugaaggcuucucuguucuac

SEQ ID NO: 3458764 - RNA, 20 nt, Human
ugaaggcuuuuggucucccu

SEQ ID NO: 3458765 - RNA, 23 nt, Human
ugaagggaaggaagaggaagagu

SEQ ID NO: 3458766 - RNA, 17 nt, Human
ugaagggacccuuuggg

SEQ ID NO: 3458767 - RNA, 20 nt, Human
ugaagggaccuugaagggua

SEQ ID NO: 3458768 - RNA, 11 nt, Human
ugaagggaggu

SEQ ID NO: 3458769 - RNA, 16 nt, Human
ugaagggaggugggga

SEQ ID NO: 3458770 - RNA, 24 nt, Human
ugaagggauuuuagucacacgugg

SEQ ID NO: 3458771 - RNA, 15 nt, Human
ugaagggcaggugcu

SEQ ID NO: 3458772 - RNA, 19 nt, Human
ugaagggcaggugcuucag

SEQ ID NO: 3458773 - RNA, 15 nt, Human
ugaagggccagagcc

SEQ ID NO: 3458774 - RNA, 18 nt, Human
ugaagggccagagccagg

SEQ ID NO: 3458775 - RNA, 14 nt, Human
ugaagggcccagga

SEQ ID NO: 3458776 - RNA, 21 nt, Human
ugauagccccucuccccgcag

SEQ ID NO: 3458777 - RNA, 18 nt, Human
ugauagcuaacauuuuaa

SEQ ID NO: 3458778 - RNA, 13 nt, Human
ugauagcuuuauu

SEQ ID NO: 3458779 - RNA, 22 nt, Human
ugauagguuauuuugauguaaa

SEQ ID NO: 3458780 - RNA, 16 nt, Human
ugauagucuuuugcuu

SEQ ID NO: 3458781 - RNA, 12 nt, Human
ugauaguuacug

SEQ ID NO: 3458782 - RNA, 21 nt, Human
ugauaguuacuguugugaccu

SEQ ID NO: 3458783 - RNA, 17 nt, Human
ugauaguugaauguugc

SEQ ID NO: 3458784 - RNA, 15 nt, Human
ugauauaaacagcuu

SEQ ID NO: 3458785 - RNA, 12 nt, Human
ugauauaaauuc

SEQ ID NO: 3458786 - RNA, 15 nt, Human
ugauauaaauucugu

SEQ ID NO: 3458787 - RNA, 17 nt, Human
ugauauaaauucugugg

SEQ ID NO: 3458788 - RNA, 17 nt, Human
ugauauaacuuuagaaa

SEQ ID NO: 3458789 - RNA, 23 nt, Human
ugauauaaguguguguuuuucau

SEQ ID NO: 3458790 - RNA, 16 nt, Human
ugauauaaucuuucaa

SEQ ID NO: 3458791 - RNA, 14 nt, Human
ugauauagaauuag

SEQ ID NO: 3458792 - RNA, 22 nt, Human
ugauauagaauuagcuuuuuca

SEQ ID NO: 3458793 - RNA, 18 nt, Human
ugauauauaaguguacau

SEQ ID NO: 3458794 - RNA, 16 nt, Human
ugauauaucucaaauu

SEQ ID NO: 3458795 - RNA, 14 nt, Human
ugauauauuuaaaa

SEQ ID NO: 3458796 - RNA, 19 nt, Human
ugauauauuuaaaaauauu

SEQ ID NO: 3458797 - RNA, 18 nt, Human
ugauaucccugauccuaa

SEQ ID NO: 3458798 - RNA, 16 nt, Human
ugauaucuauaaaaua

SEQ ID NO: 3458799 - RNA, 18 nt, Human
ugauaucuauaaaauaga

SEQ ID NO: 3458800 - RNA, 23 nt, Human
ugcacaggcagagcccagacccu

SEQ ID NO: 3458801 - RNA, 16 nt, Human
ugcacagggagacgua

SEQ ID NO: 3458802 - RNA, 18 nt, Human
ugcacagggcagcugggc

SEQ ID NO: 3458803 - RNA, 19 nt, Human
ugcacagggcagcugggcc

SEQ ID NO: 3458804 - RNA, 19 nt, Human
ugcacaguauuuguaauua

SEQ ID NO: 3458805 - RNA, 17 nt, Human
ugcacagucacugcucu

SEQ ID NO: 3458806 - RNA, 17 nt, Human
ugcacagugacuucuga

SEQ ID NO: 3458807 - RNA, 19 nt, Human
ugcacagugacuucugaga

SEQ ID NO: 3458808 - RNA, 21 nt, Human
ugcacagugacuucugagauc

SEQ ID NO: 3458809 - RNA, 18 nt, Human
ugcacagugcaucucagc

SEQ ID NO: 3458810 - RNA, 21 nt, Human
ugcacauaagcuuccauuuua

SEQ ID NO: 3458811 - RNA, 21 nt, Human
ugcacauacgcaccacaucuc

SEQ ID NO: 3458812 - RNA, 15 nt, Human
ugcacauacuugaga

SEQ ID NO: 3458813 - RNA, 20 nt, Human
ugcacauccgcgugugccug

SEQ ID NO: 3458814 - RNA, 22 nt, Human
ugcacauccgcgugugccugug

SEQ ID NO: 3458815 - RNA, 15 nt, Human
ugcacaugaagaaau

SEQ ID NO: 3458816 - RNA, 23 nt, Human
ugcacaugaagaaauacugcacu

SEQ ID NO: 3458817 - RNA, 12 nt, Human
ugcacaugauuu

SEQ ID NO: 3458818 - RNA, 20 nt, Human
ugcacaugauuucacaaaua

SEQ ID NO: 3458819 - RNA, 21 nt, Human
ugcacaugauuucacaaauau

SEQ ID NO: 3458820 - RNA, 17 nt, Human
ugcacauggauucaguu

SEQ ID NO: 3458821 - RNA, 19 nt, Human
ugcacaugucuuguacaug

SEQ ID NO: 3458822 - RNA, 23 nt, Human
ugcacaugucuuguacaugugua

SEQ ID NO: 3458823 - RNA, 13 nt, Human
ugcacauguuucc

SEQ ID NO: 3458824 - RNA, 15 nt, Human
ugcacauuaaaugac

SEQ ID NO: 3458825 - RNA, 13 nt, Human
ugcacauuuauuu

SEQ ID NO: 3458826 - RNA, 15 nt, Human
ugcaccaacccagcc

SEQ ID NO: 3458827 - RNA, 16 nt, Human
ugcaccaacccagccg

SEQ ID NO: 3458828 - RNA, 19 nt, Human
ugcaccaacccagccgcug

SEQ ID NO: 3458829 - RNA, 15 nt, Human
gguuucucucuacag

SEQ ID NO: 3458830 - RNA, 15 nt, Human
gguuucucuguggcu

SEQ ID NO: 3458831 - RNA, 17 nt, Human
gguuucugaguuccugc

SEQ ID NO: 3458832 - RNA, 18 nt, Human
gguuucugcccugcccac

SEQ ID NO: 3458833 - RNA, 15 nt, Human
gguuucuggucucua

SEQ ID NO: 3458834 - RNA, 22 nt, Human
gguuucuucaacaggagaauuu

SEQ ID NO: 3458835 - RNA, 17 nt, Human
gguuugaagccuggaac

SEQ ID NO: 3458836 - RNA, 13 nt, Human
gguuugagggugg

SEQ ID NO: 3458837 - RNA, 15 nt, Human
gguuugaucauuucu

SEQ ID NO: 3458838 - RNA, 15 nt, Human
gguuuggaaugcuuc

SEQ ID NO: 3458839 - RNA, 17 nt, Human
gguuuggcuccugccca

SEQ ID NO: 3458840 - RNA, 14 nt, Human
gguuuggugcuuuu

SEQ ID NO: 3458841 - RNA, 22 nt, Human
gguuugguuugcagcgacuggc

SEQ ID NO: 3458842 - RNA, 16 nt, Human
gguuuguggggggagg

SEQ ID NO: 3458843 - RNA, 12 nt, Human
gguuuuaaaaua

SEQ ID NO: 3458844 - RNA, 20 nt, Human
gguuuuaaaauacuguagau

SEQ ID NO: 3458845 - RNA, 12 nt, Human
gguuuuaaugua

SEQ ID NO: 3458846 - RNA, 21 nt, Human
gguuuuaggucucuuccccuc

SEQ ID NO: 3458847 - RNA, 17 nt, Human
gguuuuauuuauuucuu

SEQ ID NO: 3458848 - RNA, 22 nt, Human
gguuuucacauaaaugcagccc

SEQ ID NO: 3458849 - RNA, 20 nt, Human
gguuuucacauuggaaacaa

SEQ ID NO: 3458850 - RNA, 13 nt, Human
gguuuuccccucc

SEQ ID NO: 3458851 - RNA, 15 nt, Human
gguuuucuggguguc

SEQ ID NO: 3458852 - RNA, 15 nt, Human
gguuuucuguuacuu

SEQ ID NO: 3458853 - RNA, 17 nt, Human
gguuuucuuaaccaucu

SEQ ID NO: 3458854 - RNA, 21 nt, Human
gguuuugcacucuuguuucuc

SEQ ID NO: 3458855 - RNA, 23 nt, Human
gguuuugccauguuggccaggcu

SEQ ID NO: 3458856 - RNA, 11 nt, Human
gguuuuguaca

SEQ ID NO: 3458857 - RNA, 17 nt, Human
gguuuuguauucucuga

SEQ ID NO: 3458858 - RNA, 18 nt, Human
gguuuuguauucucugag

SEQ ID NO: 3458859 - RNA, 19 nt, Human
gguuuuguauucucugagc

SEQ ID NO: 3458860 - RNA, 20 nt, Human
gguuuuuaccugucacauug

SEQ ID NO: 3458861 - RNA, 19 nt, Human
gguuuuuacuuaacuguuu

SEQ ID NO: 3458862 - RNA, 19 nt, Human
gguuuuuauuucuccuuuu

SEQ ID NO: 3458863 - RNA, 12 nt, Human
gguuuuucaauu

SEQ ID NO: 3458864 - RNA, 19 nt, Human
gguuuuucaauuaaacgga

SEQ ID NO: 3458865 - RNA, 23 nt, Human
gguuuuuguuuguuuccuuuguu

SEQ ID NO: 3458866 - RNA, 22 nt, Human
gguuuuuuuucaguuguucuuu

SEQ ID NO: 3458867 - RNA, 23 nt, Human
gguuuuuuuuuuuaaaaaaagaa

SEQ ID NO: 3458868 - RNA, 19 nt, Human
guaaaaaaaaaugccuuug

SEQ ID NO: 3458869 - RNA, 20 nt, Human
guaaaaaaaaaugccuuuga

SEQ ID NO: 3458870 - RNA, 18 nt, Human
guaaaaaaugguguuuua

SEQ ID NO: 3458871 - RNA, 20 nt, Human
guaaaaacaaagaaauuaug

SEQ ID NO: 3458872 - RNA, 21 nt, Human
guaaaaacagcauugcuuucu

SEQ ID NO: 3458873 - RNA, 23 nt, Human
guaaaaacagcauugcuuucuga

SEQ ID NO: 3458874 - RNA, 13 nt, Human
guaaaaacugaag

SEQ ID NO: 3458875 - RNA, 14 nt, Human
guaaaaagaaaaca

SEQ ID NO: 3458876 - RNA, 13 nt, Human
guaaaaaugagaa

SEQ ID NO: 3458877 - RNA, 14 nt, Human
guaaaacaaaauuu

SEQ ID NO: 3458878 - RNA, 15 nt, Human
guaaaaccacagcag

SEQ ID NO: 3458879 - RNA, 16 nt, Human
guaaaaccacagcagu

SEQ ID NO: 3458880 - RNA, 20 nt, Human
guaaaaccuggagauggugg

SEQ ID NO: 3458881 - RNA, 12 nt, Human
guaaaagaaaaa

SEQ ID NO: 3458882 - RNA, 14 nt, Human
guaaaagaaaucau

SEQ ID NO: 3458883 - RNA, 15 nt, Human
guaaaagacuuuuuu

SEQ ID NO: 3458884 - RNA, 17 nt, Human
guaaaagauaacaagau

SEQ ID NO: 3458885 - RNA, 17 nt, Human
guaaaagcaacaucagc

SEQ ID NO: 3458886 - RNA, 20 nt, Human
guaaaagcaacaucagcuug

SEQ ID NO: 3458887 - RNA, 16 nt, Human
guaaaagcauuuugua

SEQ ID NO: 3458888 - RNA, 15 nt, Human
guaaaagugugagca

SEQ ID NO: 3458889 - RNA, 16 nt, Human
guaaaauaaaaggucg

SEQ ID NO: 3458890 - RNA, 12 nt, Human
guaaaauacuuu

SEQ ID NO: 3458891 - RNA, 13 nt, Human
guaaaauacuuuu

SEQ ID NO: 3458892 - RNA, 19 nt, Human
guaaaauauuuugaaucaa

SEQ ID NO: 3458893 - RNA, 12 nt, Human
guaaaaucuugu

SEQ ID NO: 3458894 - RNA, 15 nt, Human
guaaaaucuugucau

SEQ ID NO: 3458895 - RNA, 22 nt, Human
guaaaaugacaaucaugugugu

SEQ ID NO: 3458896 - RNA, 17 nt, Human
guaaaauguauuuuucu

SEQ ID NO: 3458897 - RNA, 18 nt, Human
guaaaaugugggauuaug

SEQ ID NO: 3458898 - RNA, 16 nt, Human
guaaaauguugaauaa

SEQ ID NO: 3458899 - RNA, 14 nt, Human
guaaaauucuaaau

SEQ ID NO: 3458900 - RNA, 12 nt, Human
guaaaauugcau

SEQ ID NO: 3458901 - RNA, 13 nt, Human
guaaaauuuuagg

SEQ ID NO: 3458902 - RNA, 11 nt, Human
guaaacaauau

SEQ ID NO: 3458903 - RNA, 11 nt, Human
guaaacacugu

SEQ ID NO: 3458904 - RNA, 19 nt, Human
guaaacagauggcacuuug

SEQ ID NO: 3458905 - RNA, 14 nt, Human
guaaacagugccug

SEQ ID NO: 3458906 - RNA, 20 nt, Human
guaaacagugccugcugaau

SEQ ID NO: 3458907 - RNA, 16 nt, Human
guaaacauaccaacau

SEQ ID NO: 3458908 - RNA, 14 nt, Human
guaaacauguguuu

SEQ ID NO: 3458909 - RNA, 21 nt, Human
guaaacauuaguucuauuucu

SEQ ID NO: 3458910 - RNA, 13 nt, Human
guaaaccaaagcc

SEQ ID NO: 3458911 - RNA, 19 nt, Human
guaaaccaauuuuuuguuc

SEQ ID NO: 3458912 - RNA, 16 nt, Human
guaaaccacugaaaaa

SEQ ID NO: 3458913 - RNA, 16 nt, Human
guaaacgcugucccua

SEQ ID NO: 3458914 - RNA, 21 nt, Human
guaaacucaaaacuuaacaua

SEQ ID NO: 3458915 - RNA, 16 nt, Human
guaaacucaaaauauu

SEQ ID NO: 3458916 - RNA, 23 nt, Human
guaaacucaaaauauuuguacau

SEQ ID NO: 3458917 - RNA, 19 nt, Human
guaaacucaucugaaaugu

SEQ ID NO: 3458918 - RNA, 12 nt, Human
guaaacuccugu

SEQ ID NO: 3458919 - RNA, 11 nt, Human
guaaacugcca

SEQ ID NO: 3458920 - RNA, 13 nt, Human
guaaacugcccug

SEQ ID NO: 3458921 - RNA, 18 nt, Human
guaaacuggaauuaaaag

SEQ ID NO: 3458922 - RNA, 24 nt, Human
guaaacugugcaccaagcaggaaa

SEQ ID NO: 3458923 - RNA, 15 nt, Human
guaaacuguuucuuu

SEQ ID NO: 3458924 - RNA, 16 nt, Human
guaaacuucugcaaca

SEQ ID NO: 3458925 - RNA, 14 nt, Human
guaaacuuugaaau

SEQ ID NO: 3458926 - RNA, 21 nt, Human
guaaagaaaaauauuuaaugu

SEQ ID NO: 3458927 - RNA, 18 nt, Human
guaaagaaagagagaaaa

SEQ ID NO: 3458928 - RNA, 21 nt, Human
guaaagaaagagagaaaauaa

SEQ ID NO: 3458929 - RNA, 22 nt, Human
guaaagaaagagagaaaauaaa

SEQ ID NO: 3458930 - RNA, 21 nt, Human
guaaagaaauuuaaaagacac

SEQ ID NO: 3458931 - RNA, 15 nt, Human
guaaagaaauuuacu

SEQ ID NO: 3458932 - RNA, 19 nt, Human
guaaagaaauuuacuauau

SEQ ID NO: 3458933 - RNA, 15 nt, Human
guaaagaauuauuuu

SEQ ID NO: 3458934 - RNA, 14 nt, Human
guaaagacugguuu

SEQ ID NO: 3458935 - RNA, 20 nt, Human
guaaagagaaacuuugugcu

SEQ ID NO: 3458936 - RNA, 14 nt, Human
guaaagauauuauu

SEQ ID NO: 3458937 - RNA, 18 nt, Human
guaaagaucuacaugaau

SEQ ID NO: 3458938 - RNA, 21 nt, Human
guaaagauguuuauuucaggc

SEQ ID NO: 3458939 - RNA, 20 nt, Human
guaaagcaaccaaaaagaaa

SEQ ID NO: 3458940 - RNA, 15 nt, Human
guaaagccauuaaau

SEQ ID NO: 3458941 - RNA, 15 nt, Human
guaaagcuaaaauaa

SEQ ID NO: 3458942 - RNA, 16 nt, Human
guaaagcuagaaauga

SEQ ID NO: 3458943 - RNA, 18 nt, Human
guaaagggcaaauaauga

SEQ ID NO: 3458944 - RNA, 17 nt, Human
guaaaguacuuguaguu

SEQ ID NO: 3458945 - RNA, 18 nt, Human
ugaccugcugagcucuga

SEQ ID NO: 3458946 - RNA, 20 nt, Human
ugaccugcugagcucugaga

SEQ ID NO: 3458947 - RNA, 20 nt, Human
ugaccuggaaggcccagcac

SEQ ID NO: 3458948 - RNA, 22 nt, Human
ugaccuggauggggcaggccac

SEQ ID NO: 3458949 - RNA, 22 nt, Human
ugaccuggcaucuaauucugau

SEQ ID NO: 3458950 - RNA, 20 nt, Human
ugaccugguuaaacaaacca

SEQ ID NO: 3458951 - RNA, 15 nt, Human
ugaccugucaugccc

SEQ ID NO: 3458952 - RNA, 20 nt, Human
ugaccugucaugccccccuc

SEQ ID NO: 3458953 - RNA, 15 nt, Human
ugaccugugaccagc

SEQ ID NO: 3458954 - RNA, 23 nt, Human
ugaccuguggggauuucucccag

SEQ ID NO: 3458955 - RNA, 14 nt, Human
ugaccuguggugca

SEQ ID NO: 3458956 - RNA, 14 nt, Human
ugaccuuaaaugca

SEQ ID NO: 3458957 - RNA, 13 nt, Human
ugaccuuacauuu

SEQ ID NO: 3458958 - RNA, 16 nt, Human
ugaccuuaguguuucu

SEQ ID NO: 3458959 - RNA, 22 nt, Human
ugaccuuaguguuucugugcau

SEQ ID NO: 3458960 - RNA, 22 nt, Human
ugaccuuaugagaaacugcaug

SEQ ID NO: 3458961 - RNA, 12 nt, Human
ugaccuucagcu

SEQ ID NO: 3458962 - RNA, 11 nt, Human
ugaccuuccuc

SEQ ID NO: 3458963 - RNA, 23 nt, Human
ugaccuuccucgcagagaggcca

SEQ ID NO: 3458964 - RNA, 15 nt, Human
ugaccuuccucuggg

SEQ ID NO: 3458965 - RNA, 18 nt, Human
ugaccuuccucuggggcu

SEQ ID NO: 3458966 - RNA, 19 nt, Human
ugaccuuccucuggggcuc

SEQ ID NO: 3458967 - RNA, 23 nt, Human
ugaccuuccucuggggcucuagg

SEQ ID NO: 3458968 - RNA, 13 nt, Human
ugaccuucuggga

SEQ ID NO: 3458969 - RNA, 17 nt, Human
ugaccuugaacuccugg

SEQ ID NO: 3458970 - RNA, 18 nt, Human
ugaccuugaacuccuggg

SEQ ID NO: 3458971 - RNA, 20 nt, Human
ugaccuugaggagucuugug

SEQ ID NO: 3458972 - RNA, 17 nt, Human
ugaccuuggagagacac

SEQ ID NO: 3458973 - RNA, 13 nt, Human
ugaccuuucaaua

SEQ ID NO: 3458974 - RNA, 16 nt, Human
ugaccuuucaauagga

SEQ ID NO: 3458975 - RNA, 15 nt, Human
ugaccuuuguacagc

SEQ ID NO: 3458976 - RNA, 19 nt, Human
ugaccuuuguacagcccag

SEQ ID NO: 3458977 - RNA, 20 nt, Human
ugaccuuuguacagcccaga

SEQ ID NO: 3458978 - RNA, 21 nt, Human
ugaccuuuguacagcccagag

SEQ ID NO: 3458979 - RNA, 18 nt, Human
ugacgaaacuggccccgg

SEQ ID NO: 3458980 - RNA, 15 nt, Human
ugacgacaagugcug

SEQ ID NO: 3458981 - RNA, 14 nt, Human
ugacgaugauguac

SEQ ID NO: 3458982 - RNA, 16 nt, Human
ugacgauuccuucucu

SEQ ID NO: 3458983 - RNA, 21 nt, Human
ugacgauuccuucucugaaca

SEQ ID NO: 3458984 - RNA, 14 nt, Human
ugacgcaaugaaaa

SEQ ID NO: 3458985 - RNA, 19 nt, Human
ugacgccugcccuccccag

SEQ ID NO: 3458986 - RNA, 15 nt, Human
ugacgcugaauaaau

SEQ ID NO: 3458987 - RNA, 20 nt, Human
ugacgcugaauaaaugucuu

SEQ ID NO: 3458988 - RNA, 22 nt, Human
ugacggaaggaccuauguuugc

SEQ ID NO: 3458989 - RNA, 14 nt, Human
ugacggcccucauc

SEQ ID NO: 3458990 - RNA, 19 nt, Human
ugacgggacucaggcggga

SEQ ID NO: 3458991 - RNA, 19 nt, Human
ugacgguauuaugcuucuu

SEQ ID NO: 3458992 - RNA, 19 nt, Human
ugacggucccacacuggug

SEQ ID NO: 3458993 - RNA, 21 nt, Human
ugacggucccacacuggugac

SEQ ID NO: 3458994 - RNA, 17 nt, Human
ugacggugcagucuggg

SEQ ID NO: 3458995 - RNA, 18 nt, Human
ugacggugcagucugggu

SEQ ID NO: 3458996 - RNA, 12 nt, Human
ugacgguuccua

SEQ ID NO: 3458997 - RNA, 18 nt, Human
ugacgguuccuacacagg

SEQ ID NO: 3458998 - RNA, 18 nt, Human
ugacguacaaguaguucu

SEQ ID NO: 3458999 - RNA, 18 nt, Human
ugacgugcaccuguacuc

SEQ ID NO: 3459000 - RNA, 23 nt, Human
ugacgugcaccuguacucaggag

SEQ ID NO: 3459001 - RNA, 18 nt, Human
ugacgugccuuuugcacc

SEQ ID NO: 3459002 - RNA, 17 nt, Human
ugacgugucaggaaaac

SEQ ID NO: 3459003 - RNA, 19 nt, Human
ugacuaaaccauugugcau

SEQ ID NO: 3459004 - RNA, 17 nt, Human
ugacuaacaggccaaag

SEQ ID NO: 3459005 - RNA, 15 nt, Human
ugacuaacucaaaua

SEQ ID NO: 3459006 - RNA, 21 nt, Human
ugacuaacucaaauacacauu

SEQ ID NO: 3459007 - RNA, 14 nt, Human
ugacuaauggcaug

SEQ ID NO: 3459008 - RNA, 21 nt, Human
ugacuaauuaggguacauuua

SEQ ID NO: 3459009 - RNA, 22 nt, Human
ugacuaauuaggguacauuuau

SEQ ID NO: 3459010 - RNA, 23 nt, Human
ugacuaauuaggguacauuuaua

SEQ ID NO: 3459011 - RNA, 15 nt, Human
ugacuaauucuugca

SEQ ID NO: 3459012 - RNA, 13 nt, Human
ugacuaauuguau

SEQ ID NO: 3459013 - RNA, 18 nt, Human
ugacuaauuguauaacag

SEQ ID NO: 3459014 - RNA, 21 nt, Human
ugacuaauuguauaacagguu

SEQ ID NO: 3459015 - RNA, 20 nt, Human
ugacuacagacauuaaauaa

SEQ ID NO: 3459016 - RNA, 16 nt, Human
ugacuagaaagugaau

SEQ ID NO: 3459017 - RNA, 21 nt, Human
ugacuagaagggccaguccug

SEQ ID NO: 3459018 - RNA, 21 nt, Human
ugacuagaggcagggagggga

SEQ ID NO: 3459019 - RNA, 18 nt, Human
ugacuagggauucaggcu

SEQ ID NO: 3459020 - RNA, 20 nt, Human
ugacuagggauucaggcugc

SEQ ID NO: 3459021 - RNA, 15 nt, Human
ugacuaguacaaauu

SEQ ID NO: 3459022 - RNA, 17 nt, Human
ugacuaguacaaauuau

SEQ ID NO: 3459023 - RNA, 14 nt, Human
ugacuagugcugaa

SEQ ID NO: 3459024 - RNA, 15 nt, Human
ugacuagugcugaag

SEQ ID NO: 3459025 - RNA, 23 nt, Human
ugacuauauaauuuauuuccacu

SEQ ID NO: 3459026 - RNA, 16 nt, Human
ugacuaucaaacugaa

SEQ ID NO: 3459027 - RNA, 23 nt, Human
ugacuaucccaacagucauguuu

SEQ ID NO: 3459028 - RNA, 20 nt, Human
ugacuauuauauuuccaaga

SEQ ID NO: 3459029 - RNA, 21 nt, Human
ugacuauucugagaugacuau

SEQ ID NO: 3459030 - RNA, 13 nt, Human
ugacuauucugua

SEQ ID NO: 3459031 - RNA, 18 nt, Human
ugacuauucuguaucuuu

SEQ ID NO: 3459032 - RNA, 19 nt, Human
ugacuauucuugauguaaa

SEQ ID NO: 3459033 - RNA, 14 nt, Human
ugacucaaagucug

SEQ ID NO: 3459034 - RNA, 14 nt, Human
ugacucaagaagug

SEQ ID NO: 3459035 - RNA, 18 nt, Human
ugacucaagauucccagg

SEQ ID NO: 3459036 - RNA, 19 nt, Human
ugacucaagauucccagga

SEQ ID NO: 3459037 - RNA, 20 nt, Human
ugacucaagauucccaggag

SEQ ID NO: 3459038 - RNA, 20 nt, Human
ugacucaagugucucagucc

SEQ ID NO: 3459039 - RNA, 19 nt, Human
ugacucacaccugaacuga

SEQ ID NO: 3459040 - RNA, 16 nt, Human
ugacucagaugucucu

SEQ ID NO: 3459041 - RNA, 14 nt, Human
ugacucaggagccu

SEQ ID NO: 3459042 - RNA, 21 nt, Human
ugacucaggagccugugacau

SEQ ID NO: 3459043 - RNA, 23 nt, Human
ugacucaggauuuaaaaacugga

SEQ ID NO: 3459044 - RNA, 15 nt, Human
ugacucagggcuccu

SEQ ID NO: 3459045 - RNA, 15 nt, Human
ugacuccaaccauuc

SEQ ID NO: 3459046 - RNA, 22 nt, Human
ugacuccaaccauucaaaaauu

SEQ ID NO: 3459047 - RNA, 19 nt, Human
ugacuccaagaacaauugu

SEQ ID NO: 3459048 - RNA, 20 nt, Human
ugacuccagaauuucccaaa

SEQ ID NO: 3459049 - RNA, 23 nt, Human
ugacuccaguggggcaagauuuu

SEQ ID NO: 3459050 - RNA, 19 nt, Human
ugacucccccaguccccuu

SEQ ID NO: 3459051 - RNA, 22 nt, Human
ugacucccccaguccccuuccc

SEQ ID NO: 3459052 - RNA, 22 nt, Human
ugacucccuuaaaauagaaaua

SEQ ID NO: 3459053 - RNA, 17 nt, Human
ugacuccuaccugcccu

SEQ ID NO: 3459054 - RNA, 12 nt, Human
ugacuccugguc

SEQ ID NO: 3459055 - RNA, 17 nt, Human
ugacucgggggugggga

SEQ ID NO: 3459056 - RNA, 18 nt, Human
ugacucgguuucuccaaa

SEQ ID NO: 3459057 - RNA, 21 nt, Human
ugacucguauaugucucaggu

SEQ ID NO: 3459058 - RNA, 20 nt, Human
ugacucgucugacugugugu

SEQ ID NO: 3459059 - RNA, 14 nt, Human
ugacucucaaaucu

SEQ ID NO: 3459060 - RNA, 16 nt, Human
ugacucugaaaucuga

SEQ ID NO: 3459061 - RNA, 22 nt, Human
ugacucuggcaaagcuuuuaga

SEQ ID NO: 3459062 - RNA, 11 nt, Human
ugacucugggu

SEQ ID NO: 3459063 - RNA, 17 nt, Human
ugacucuggguccuucc

SEQ ID NO: 3459064 - RNA, 13 nt, Human
ugacucuuaagaa

SEQ ID NO: 3459065 - RNA, 21 nt, Human
ugacucuugaguuguuuuugu

SEQ ID NO: 3459066 - RNA, 23 nt, Human
ugacucuugaguuguuuuuguau

SEQ ID NO: 3459067 - RNA, 16 nt, Human
ugacucuuuauugucu

SEQ ID NO: 3459068 - RNA, 18 nt, Human
ugacucuuuauugucugu

SEQ ID NO: 3459069 - RNA, 21 nt, Human
ugacucuuuauugucuguaaa

SEQ ID NO: 3459070 - RNA, 15 nt, Human
ugacugagcagacug

SEQ ID NO: 3459071 - RNA, 13 nt, Human
ugacugaggcagu

SEQ ID NO: 3459072 - RNA, 18 nt, Human
ugacugaggcaguuugag

SEQ ID NO: 3459073 - RNA, 19 nt, Human
ugacugaggcaguuugagg

SEQ ID NO: 3459074 - RNA, 20 nt, Human
ugacugagggugaguuggcu

SEQ ID NO: 3459075 - RNA, 16 nt, Human
ugacugauucuucagc

SEQ ID NO: 3459076 - RNA, 14 nt, Human
ugacugccaagacu

SEQ ID NO: 3459077 - RNA, 22 nt, Human
ugacugccaagacugcuguggc

SEQ ID NO: 3459078 - RNA, 16 nt, Human
ugacugccaagccaug

SEQ ID NO: 3459079 - RNA, 21 nt, Human
ugacugcccagcauuugggua

SEQ ID NO: 3459080 - RNA, 15 nt, Human
ugacugccccaacuc

SEQ ID NO: 3459081 - RNA, 19 nt, Human
ugacugccccaacuccugg

SEQ ID NO: 3459082 - RNA, 20 nt, Human
ugacugccccaacuccugga

SEQ ID NO: 3459083 - RNA, 21 nt, Human
ugacugcccggcacagaugcu

SEQ ID NO: 3459084 - RNA, 20 nt, Human
ugacugcuccccagcccugg

SEQ ID NO: 3459085 - RNA, 21 nt, Human
ugacugcuccccagcccuggc

SEQ ID NO: 3459086 - RNA, 16 nt, Human
ugacugcuugcccuaa

SEQ ID NO: 3459087 - RNA, 21 nt, Human
ugacuggcauuuuauagacac

SEQ ID NO: 3459088 - RNA, 15 nt, Human
ugccagugucuuucu

SEQ ID NO: 3459089 - RNA, 16 nt, Human
ugccagugucuuucuu

SEQ ID NO: 3459090 - RNA, 22 nt, Human
ugccaguuguccuccuuccggg

SEQ ID NO: 3459091 - RNA, 23 nt, Human
ugccaguuuaaucauugccuggu

SEQ ID NO: 3459092 - RNA, 19 nt, Human
ugccaguuuuguuuccuuu

SEQ ID NO: 3459093 - RNA, 12 nt, Human
ugccauaaaaca

SEQ ID NO: 3459094 - RNA, 16 nt, Human
ugccauaaaacauuaa

SEQ ID NO: 3459095 - RNA, 20 nt, Human
ugccauaaaacauuaagaaa

SEQ ID NO: 3459096 - RNA, 14 nt, Human
ugccauaauacaaa

SEQ ID NO: 3459097 - RNA, 18 nt, Human
ugccauacuguaugcagu

SEQ ID NO: 3459098 - RNA, 15 nt, Human
ugccauacuuugucu

SEQ ID NO: 3459099 - RNA, 17 nt, Human
ugccauacuuugucuga

SEQ ID NO: 3459100 - RNA, 22 nt, Human
ugccauacuuugucugaaaaau

SEQ ID NO: 3459101 - RNA, 14 nt, Human
ugccauagaguaca

SEQ ID NO: 3459102 - RNA, 18 nt, Human
ugccauagaguacacugc

SEQ ID NO: 3459103 - RNA, 17 nt, Human
ugccauagucaaagaga

SEQ ID NO: 3459104 - RNA, 18 nt, Human
ugccauagucaaagagag

SEQ ID NO: 3459105 - RNA, 17 nt, Human
ugccauagucacauggc

SEQ ID NO: 3459106 - RNA, 16 nt, Human
ugccauauucuguugg

SEQ ID NO: 3459107 - RNA, 17 nt, Human
ugccauauucuguuggc

SEQ ID NO: 3459108 - RNA, 20 nt, Human
ugccauauugcacaugucuu

SEQ ID NO: 3459109 - RNA, 21 nt, Human
ugccauauugcacaugucuua

SEQ ID NO: 3459110 - RNA, 15 nt, Human
ugccaucaaaugaau

SEQ ID NO: 3459111 - RNA, 14 nt, Human
ugccaucaauaaaa

SEQ ID NO: 3459112 - RNA, 15 nt, Human
ugccaucagugaaaa

SEQ ID NO: 3459113 - RNA, 16 nt, Human
ugccaucauugcuguc

SEQ ID NO: 3459114 - RNA, 22 nt, Human
ugccaucauugcugucugcagc

SEQ ID NO: 3459115 - RNA, 15 nt, Human
ugccauccagguuca

SEQ ID NO: 3459116 - RNA, 20 nt, Human
ugccauccagguucagcuug

SEQ ID NO: 3459117 - RNA, 14 nt, Human
ugccaucccucccu

SEQ ID NO: 3459118 - RNA, 21 nt, Human
ugccauccuaaaagccacccc

SEQ ID NO: 3459119 - RNA, 11 nt, Human
ugccauccuca

SEQ ID NO: 3459120 - RNA, 13 nt, Human
ugccauccuggcc

SEQ ID NO: 3459121 - RNA, 14 nt, Human
ugccaucgcuguga

SEQ ID NO: 3459122 - RNA, 16 nt, Human
ugccaucuagccagcc

SEQ ID NO: 3459123 - RNA, 17 nt, Human
ugccaucuagccagccc

SEQ ID NO: 3459124 - RNA, 16 nt, Human
ugccaucucugcucca

SEQ ID NO: 3459125 - RNA, 22 nt, Human
ugccaucugcgugacaauaaaa

SEQ ID NO: 3459126 - RNA, 18 nt, Human
ugccaucugugggcacgc

SEQ ID NO: 3459127 - RNA, 20 nt, Human
ugccaucuguguccugguua

SEQ ID NO: 3459128 - RNA, 14 nt, Human
ugccaucuucccag

SEQ ID NO: 3459129 - RNA, 15 nt, Human
ugccaucuucccagc

SEQ ID NO: 3459130 - RNA, 16 nt, Human
ugccaucuucccagca

SEQ ID NO: 3459131 - RNA, 22 nt, Human
ugccaugaacuggaggccagga

SEQ ID NO: 3459132 - RNA, 19 nt, Human
ugccaugagccgcccaagg

SEQ ID NO: 3459133 - RNA, 21 nt, Human
ugccaugagccgcccaaggcc

SEQ ID NO: 3459134 - RNA, 19 nt, Human
ugccaugaugccucugucu

SEQ ID NO: 3459135 - RNA, 21 nt, Human
ugccaugaugccucugucuuc

SEQ ID NO: 3459136 - RNA, 16 nt, Human
ugccaugcagggccuc

SEQ ID NO: 3459137 - RNA, 20 nt, Human
ugccauggaacuguuuccuu

SEQ ID NO: 3459138 - RNA, 18 nt, Human
ugccauggaggcacacag

SEQ ID NO: 3459139 - RNA, 18 nt, Human
ugccaugggcuucacugu

SEQ ID NO: 3459140 - RNA, 18 nt, Human
ugccauguaccuccccug

SEQ ID NO: 3459141 - RNA, 21 nt, Human
ugccauguaccuccccugccu

SEQ ID NO: 3459142 - RNA, 20 nt, Human
ugccauguaggguucccuua

SEQ ID NO: 3459143 - RNA, 20 nt, Human
ugccaugucagcgcucuggu

SEQ ID NO: 3459144 - RNA, 22 nt, Human
ugccaugucugcagugugcccc

SEQ ID NO: 3459145 - RNA, 19 nt, Human
ugccaugugacucuggcuu

SEQ ID NO: 3459146 - RNA, 21 nt, Human
ugccaugugacucuggcuugg

SEQ ID NO: 3459147 - RNA, 14 nt, Human
ugccaugugccagg

SEQ ID NO: 3459148 - RNA, 12 nt, Human
ugccauguuggc

SEQ ID NO: 3459149 - RNA, 20 nt, Human
ugccauguuggccaggcugg

SEQ ID NO: 3459150 - RNA, 16 nt, Human
ugccauuagccaagga

SEQ ID NO: 3459151 - RNA, 16 nt, Human
ugccauucauagagag

SEQ ID NO: 3459152 - RNA, 18 nt, Human
ugccauucccugccuggg

SEQ ID NO: 3459153 - RNA, 19 nt, Human
ugccauugggguaguugug

SEQ ID NO: 3459154 - RNA, 16 nt, Human
ugccauugucuuuaua

SEQ ID NO: 3459155 - RNA, 22 nt, Human
ugccauuuaaagcuuauuaaaa

SEQ ID NO: 3459156 - RNA, 12 nt, Human
ugccauuuauuu

SEQ ID NO: 3459157 - RNA, 14 nt, Human
ugccauuugauacc

SEQ ID NO: 3459158 - RNA, 16 nt, Human
ugccauuugcacccuc

SEQ ID NO: 3459159 - RNA, 19 nt, Human
ugccauuugcacccuccgc

SEQ ID NO: 3459160 - RNA, 22 nt, Human
ugccauuugcacccuccgccuu

SEQ ID NO: 3459161 - RNA, 23 nt, Human
ugccauuuguacugaccccauca

SEQ ID NO: 3459162 - RNA, 17 nt, Human
ugcccaaagaugcagcc

SEQ ID NO: 3459163 - RNA, 18 nt, Human
ugcccaaagucuguguga

SEQ ID NO: 3459164 - RNA, 19 nt, Human
ugcccaaaguuuuauuuuu

SEQ ID NO: 3459165 - RNA, 15 nt, Human
ugcccaaaucugccu

SEQ ID NO: 3459166 - RNA, 14 nt, Human
ugcccaacaccagc

SEQ ID NO: 3459167 - RNA, 17 nt, Human
ugcccaacaccagcccc

SEQ ID NO: 3459168 - RNA, 21 nt, Human
ugcccaacaccagccccugcc

SEQ ID NO: 3459169 - RNA, 13 nt, Human
ugcccaaccucag

SEQ ID NO: 3459170 - RNA, 18 nt, Human
ugcccaaccucagcaacc

SEQ ID NO: 3459171 - RNA, 19 nt, Human
ugcccaaccucagcaaccu

SEQ ID NO: 3459172 - RNA, 18 nt, Human
ugcccaaccugcucuccu

SEQ ID NO: 3459173 - RNA, 14 nt, Human
ugcccaacuguuau

SEQ ID NO: 3459174 - RNA, 14 nt, Human
ugcccaagccagag

SEQ ID NO: 3459175 - RNA, 20 nt, Human
ugcccaagccagaggcuggg

SEQ ID NO: 3459176 - RNA, 23 nt, Human
ugcccaagccagaggcuggguuc

SEQ ID NO: 3459177 - RNA, 18 nt, Human
ugcccaagcccaggccac

SEQ ID NO: 3459178 - RNA, 21 nt, Human
ugcccaagcccaggccacccu

SEQ ID NO: 3459179 - RNA, 18 nt, Human
ugcccaagcccugagagu

SEQ ID NO: 3459180 - RNA, 22 nt, Human
ugcccaauaugcaguucugcag

SEQ ID NO: 3459181 - RNA, 15 nt, Human
ugcccaaugaauaau

SEQ ID NO: 3459182 - RNA, 16 nt, Human
ugcccacacaccccaa

SEQ ID NO: 3459183 - RNA, 11 nt, Human
ugcccacagcc

SEQ ID NO: 3459184 - RNA, 12 nt, Human
ugcccacaggcc

SEQ ID NO: 3459185 - RNA, 16 nt, Human
ugcccacauuuagucu

SEQ ID NO: 3459186 - RNA, 23 nt, Human
ugcccaccaacaucccauugccc

SEQ ID NO: 3459187 - RNA, 13 nt, Human
ugcccacccccuc

SEQ ID NO: 3459188 - RNA, 15 nt, Human
ugcccacccccucaa

SEQ ID NO: 3459189 - RNA, 16 nt, Human
ugcccacccccugccc

SEQ ID NO: 3459190 - RNA, 20 nt, Human
ugcccacccccugcccugca

SEQ ID NO: 3459191 - RNA, 15 nt, Human
ugcccaccugcccau

SEQ ID NO: 3459192 - RNA, 15 nt, Human
ugcccaccugccugg

SEQ ID NO: 3459193 - RNA, 20 nt, Human
ugcccaccugccuggccggc

SEQ ID NO: 3459194 - RNA, 23 nt, Human
ugcccaccugccuggccggccag

SEQ ID NO: 3459195 - RNA, 14 nt, Human
ugcccaccuggccu

SEQ ID NO: 3459196 - RNA, 15 nt, Human
ugcccaccuggccuc

SEQ ID NO: 3459197 - RNA, 19 nt, Human
ugcccaccuggccucugca

SEQ ID NO: 3459198 - RNA, 14 nt, Human
ugcccacucccugc

SEQ ID NO: 3459199 - RNA, 21 nt, Human
ugcccacuguuucucuugagc

SEQ ID NO: 3459200 - RNA, 11 nt, Human
ugcccagaacu

SEQ ID NO: 3459201 - RNA, 21 nt, Human
ugcccagaacuggacucagga

SEQ ID NO: 3459202 - RNA, 16 nt, Human
ugcccagaacuucccu

SEQ ID NO: 3459203 - RNA, 14 nt, Human
ugcccagaauacug

SEQ ID NO: 3459204 - RNA, 19 nt, Human
ugcccagaauacugaugga

SEQ ID NO: 3459205 - RNA, 17 nt, Human
ugcccagaaugaggcug

SEQ ID NO: 3459206 - RNA, 15 nt, Human
ugcccagaccacacg

SEQ ID NO: 3459207 - RNA, 18 nt, Human
ugcccagagacccagcgg

SEQ ID NO: 3459208 - RNA, 15 nt, Human
ugaggagucugaggu

SEQ ID NO: 3459209 - RNA, 15 nt, Human
ugaggagucuugugu

SEQ ID NO: 3459210 - RNA, 16 nt, Human
ugaggaucagaaagua

SEQ ID NO: 3459211 - RNA, 15 nt, Human
ugaggaugagcugga

SEQ ID NO: 3459212 - RNA, 18 nt, Human
ugaggaugggucagagcu

SEQ ID NO: 3459213 - RNA, 13 nt, Human
ugaggauuucaag

SEQ ID NO: 3459214 - RNA, 16 nt, Human
ugaggauuucaagccu

SEQ ID NO: 3459215 - RNA, 12 nt, Human
ugaggcaaaaga

SEQ ID NO: 3459216 - RNA, 14 nt, Human
ugaggcaagagaau

SEQ ID NO: 3459217 - RNA, 22 nt, Human
ugaggcacaagaaucacuugaa

SEQ ID NO: 3459218 - RNA, 17 nt, Human
ugaggcacaugucagca

SEQ ID NO: 3459219 - RNA, 15 nt, Human
ugaggcacuggcgag

SEQ ID NO: 3459220 - RNA, 12 nt, Human
ugaggcagacag

SEQ ID NO: 3459221 - RNA, 20 nt, Human
ugaggcagacagcagcucag

SEQ ID NO: 3459222 - RNA, 14 nt, Human
ugaggcaggagaau

SEQ ID NO: 3459223 - RNA, 15 nt, Human
ugaggcaggcuuugu

SEQ ID NO: 3459224 - RNA, 13 nt, Human
ugaggcagggcaa

SEQ ID NO: 3459225 - RNA, 18 nt, Human
ugaggcagggcaaaugac

SEQ ID NO: 3459226 - RNA, 13 nt, Human
ugaggcagguccc

SEQ ID NO: 3459227 - RNA, 14 nt, Human
ugaggcaggucccc

SEQ ID NO: 3459228 - RNA, 16 nt, Human
ugaggcagguccccag

SEQ ID NO: 3459229 - RNA, 18 nt, Human
ugaggcaggugacaguga

SEQ ID NO: 3459230 - RNA, 23 nt, Human
ugaggcagugggucccacuuccc

SEQ ID NO: 3459231 - RNA, 14 nt, Human
ugaggcaguuugag

SEQ ID NO: 3459232 - RNA, 22 nt, Human
ugaggcaugaguuacugugcau

SEQ ID NO: 3459233 - RNA, 15 nt, Human
guauuaugcuucuug

SEQ ID NO: 3459234 - RNA, 12 nt, Human
guauuauugcug

SEQ ID NO: 3459235 - RNA, 12 nt, Human
guauuauuuaua

SEQ ID NO: 3459236 - RNA, 14 nt, Human
guauucaagaaagc

SEQ ID NO: 3459237 - RNA, 17 nt, Human
guauucaagaaagccag

SEQ ID NO: 3459238 - RNA, 18 nt, Human
guauucaauauccuuugc

SEQ ID NO: 3459239 - RNA, 23 nt, Human
guauucagcaaggcgcuaacuug

SEQ ID NO: 3459240 - RNA, 22 nt, Human
guauucagugagggucuucuua

SEQ ID NO: 3459241 - RNA, 21 nt, Human
guauucauccaaguuaaaugu

SEQ ID NO: 3459242 - RNA, 14 nt, Human
guauuccaccuuaa

SEQ ID NO: 3459243 - RNA, 22 nt, Human
guauuccaccuuaaauuaaaca

SEQ ID NO: 3459244 - RNA, 18 nt, Human
guauuccuuaaauaaacu

SEQ ID NO: 3459245 - RNA, 20 nt, Human
guauuccuuuuguguacagu

SEQ ID NO: 3459246 - RNA, 18 nt, Human
guauucuaguuuugucaa

SEQ ID NO: 3459247 - RNA, 18 nt, Human
guauucucuccuguaccu

SEQ ID NO: 3459248 - RNA, 13 nt, Human
guauucucugagc

SEQ ID NO: 3459249 - RNA, 19 nt, Human
guauucugccuuugcagaa

SEQ ID NO: 3459250 - RNA, 21 nt, Human
guauucugccuuugcagaaac

SEQ ID NO: 3459251 - RNA, 15 nt, Human
guauucugucuucau

SEQ ID NO: 3459252 - RNA, 15 nt, Human
guauucuuauuuaau

SEQ ID NO: 3459253 - RNA, 16 nt, Human
guauucuucucuuccu

SEQ ID NO: 3459254 - RNA, 11 nt, Human
guauucuuuuu

SEQ ID NO: 3459255 - RNA, 17 nt, Human
guauugaagcauuuuau

SEQ ID NO: 3459256 - RNA, 23 nt, Human
guauugaauauuguguuccuuuu

SEQ ID NO: 3459257 - RNA, 14 nt, Human
guauugaaucaugu

SEQ ID NO: 3459258 - RNA, 18 nt, Human
guauugacaaaauguuau

SEQ ID NO: 3459259 - RNA, 23 nt, Human
guauugagauacuuuuucuuuug

SEQ ID NO: 3459260 - RNA, 21 nt, Human
guauugcacauuguaaaaagu

SEQ ID NO: 3459261 - RNA, 15 nt, Human
guauugccaaacauu

SEQ ID NO: 3459262 - RNA, 17 nt, Human
guauugccaaacauuaa

SEQ ID NO: 3459263 - RNA, 23 nt, Human
guauugccaaacauuaauguuga

SEQ ID NO: 3459264 - RNA, 14 nt, Human
guauugcuugccac

SEQ ID NO: 3459265 - RNA, 20 nt, Human
guauugggguuauuuucugg

SEQ ID NO: 3459266 - RNA, 22 nt, Human
guauuguacaaaguauuaagca

SEQ ID NO: 3459267 - RNA, 17 nt, Human
guauuguaggugguguu

SEQ ID NO: 3459268 - RNA, 12 nt, Human
guauuguauuua

SEQ ID NO: 3459269 - RNA, 15 nt, Human
guauuguauuuauuc

SEQ ID NO: 3459270 - RNA, 16 nt, Human
guauugugauuaucaa

SEQ ID NO: 3459271 - RNA, 17 nt, Human
guauugugcaaugugua

SEQ ID NO: 3459272 - RNA, 17 nt, Human
guauugugucuuuugca

SEQ ID NO: 3459273 - RNA, 21 nt, Human
guauugugucuuuugcaugau

SEQ ID NO: 3459274 - RNA, 11 nt, Human
guauuguuccc

SEQ ID NO: 3459275 - RNA, 16 nt, Human
guauuguugaaaaagu

SEQ ID NO: 3459276 - RNA, 13 nt, Human
guauuguuguccu

SEQ ID NO: 3459277 - RNA, 15 nt, Human
guauuguuguccuuu

SEQ ID NO: 3459278 - RNA, 18 nt, Human
guauuguuguccuuuuca

SEQ ID NO: 3459279 - RNA, 19 nt, Human
guauuguuguccuuuucau

SEQ ID NO: 3459280 - RNA, 20 nt, Human
guauuuaaaaauagaaacau

SEQ ID NO: 3459281 - RNA, 21 nt, Human
guauuuaacagaaauuguaua

SEQ ID NO: 3459282 - RNA, 17 nt, Human
guauuuaagccuaaaga

SEQ ID NO: 3459283 - RNA, 19 nt, Human
guauuuaagccuaaagauu

SEQ ID NO: 3459284 - RNA, 20 nt, Human
guauuuaauuguaaacugua

SEQ ID NO: 3459285 - RNA, 21 nt, Human
guauuuaauuguaaacuguac

SEQ ID NO: 3459286 - RNA, 13 nt, Human
guauuuauaaaua

SEQ ID NO: 3459287 - RNA, 21 nt, Human
guauuuauaagaaaaauguga

SEQ ID NO: 3459288 - RNA, 13 nt, Human
guauuuauauauu

SEQ ID NO: 3459289 - RNA, 16 nt, Human
guauuuauauauuuau

SEQ ID NO: 3459290 - RNA, 17 nt, Human
guauuuauauauuuaua

SEQ ID NO: 3459291 - RNA, 19 nt, Human
guauuuaucuauuguaaga

SEQ ID NO: 3459292 - RNA, 22 nt, Human
guauuuauguaaugaaguaaag

SEQ ID NO: 3459293 - RNA, 13 nt, Human
guauuuauucaau

SEQ ID NO: 3459294 - RNA, 16 nt, Human
guauuuauucaauaaa

SEQ ID NO: 3459295 - RNA, 18 nt, Human
guauuuauugaagaaaca

SEQ ID NO: 3459296 - RNA, 13 nt, Human
guauuuauuuugu

SEQ ID NO: 3459297 - RNA, 15 nt, Human
guauuuauuuuguaa

SEQ ID NO: 3459298 - RNA, 11 nt, Human
guauuucagac

SEQ ID NO: 3459299 - RNA, 16 nt, Human
guauuucagaugcuuu

SEQ ID NO: 3459300 - RNA, 16 nt, Human
guauuugaaaaauauu

SEQ ID NO: 3459301 - RNA, 19 nt, Human
guauuugaaaacagaaauu

SEQ ID NO: 3459302 - RNA, 17 nt, Human
guauuugagacauucca

SEQ ID NO: 3459303 - RNA, 19 nt, Human
guauuugagaguucuaaau

SEQ ID NO: 3459304 - RNA, 18 nt, Human
guauuugauucaaaauau

SEQ ID NO: 3459305 - RNA, 11 nt, Human
guauuugcuaa

SEQ ID NO: 3459306 - RNA, 20 nt, Human
guauuuggaaauaaagucag

SEQ ID NO: 3459307 - RNA, 21 nt, Human
guauuuggaaauaaagucaga

SEQ ID NO: 3459308 - RNA, 22 nt, Human
guauuugggaaacuugucacuu

SEQ ID NO: 3459309 - RNA, 13 nt, Human
guauuuguaauua

SEQ ID NO: 3459310 - RNA, 11 nt, Human
guauuugugac

SEQ ID NO: 3459311 - RNA, 18 nt, Human
guauuugugacuaauugu

SEQ ID NO: 3459312 - RNA, 21 nt, Human
guauuugugacuaauuguaua

SEQ ID NO: 3459313 - RNA, 18 nt, Human
guauuuguuaauuuagaa

SEQ ID NO: 3459314 - RNA, 16 nt, Human
guauuuguucauguuu

SEQ ID NO: 3459315 - RNA, 17 nt, Human
guauuuguucauguuug

SEQ ID NO: 3459316 - RNA, 16 nt, Human
guauuuguucccaaga

SEQ ID NO: 3459317 - RNA, 16 nt, Human
guauuuuaaaagaaug

SEQ ID NO: 3459318 - RNA, 18 nt, Human
guauuuuaaaauagcguu

SEQ ID NO: 3459319 - RNA, 21 nt, Human
guauuuuaguaagagauuccu

SEQ ID NO: 3459320 - RNA, 21 nt, Human
guauuuuauaaaauuaaagaa

SEQ ID NO: 3459321 - RNA, 13 nt, Human
guauuuuauugua

SEQ ID NO: 3459322 - RNA, 17 nt, Human
guauuuucaauagccac

SEQ ID NO: 3459323 - RNA, 12 nt, Human
guauuuucaguc

SEQ ID NO: 3459324 - RNA, 22 nt, Human
guauuuucccccuuuucugcau

SEQ ID NO: 3459325 - RNA, 20 nt, Human
guauuuucuucaccucugcu

SEQ ID NO: 3459326 - RNA, 14 nt, Human
guauuuugaaguuu

SEQ ID NO: 3459327 - RNA, 11 nt, Human
guauuuugaau

SEQ ID NO: 3459328 - RNA, 15 nt, Human
guauuuugaauacca

SEQ ID NO: 3459329 - RNA, 14 nt, Human
guauuuuggagaaa

SEQ ID NO: 3459330 - RNA, 24 nt, Human
guauuuuguguccuccaggagcuu

SEQ ID NO: 3459331 - RNA, 12 nt, Human
guauuuugugug

SEQ ID NO: 3459332 - RNA, 19 nt, Human
guauuuuguuuuugucuua

SEQ ID NO: 3459333 - RNA, 22 nt, Human
guauuuuguuuuugucuuaaaa

SEQ ID NO: 3459334 - RNA, 13 nt, Human
guauuuuuaaagg

SEQ ID NO: 3459335 - RNA, 14 nt, Human
guauuuuuaauggg

SEQ ID NO: 3459336 - RNA, 19 nt, Human
guauuuuuaauuaacuuug

SEQ ID NO: 3459337 - RNA, 16 nt, Human
guauuuuugacagaau

SEQ ID NO: 3459338 - RNA, 17 nt, Human
guauuuuugcugcuucu

SEQ ID NO: 3459339 - RNA, 17 nt, Human
guauuuuuguauucaau

SEQ ID NO: 3459340 - RNA, 21 nt, Human
guauuuuuucaaguuguaaau

SEQ ID NO: 3459341 - RNA, 19 nt, Human
guauuuuuucuugcauuga

SEQ ID NO: 3459342 - RNA, 16 nt, Human
guauuuuuuuuucuaa

SEQ ID NO: 3459343 - RNA, 20 nt, Human
gucaaaaaguuugguucugu

SEQ ID NO: 3459344 - RNA, 13 nt, Human
gucaaaacacugu

SEQ ID NO: 3459345 - RNA, 15 nt, Human
gucaaaacacugugg

SEQ ID NO: 3459346 - RNA, 16 nt, Human
gucaaaacacugugga

SEQ ID NO: 3459347 - RNA, 15 nt, Human
gucaaaacagauugu

SEQ ID NO: 3459348 - RNA, 20 nt, Human
gucaaaacagauuguuugca

SEQ ID NO: 3459349 - RNA, 15 nt, Human
gucaaaagcuggauu

SEQ ID NO: 3459350 - RNA, 18 nt, Human
gucaaaauauuuuuaaaa

SEQ ID NO: 3459351 - RNA, 13 nt, Human
gucaaaauuugcu

SEQ ID NO: 3459352 - RNA, 22 nt, Human
gucaaaccgcacucacccaugu

SEQ ID NO: 3459353 - RNA, 16 nt, Human
gucaaagaaaugcuga

SEQ ID NO: 3459354 - RNA, 11 nt, Human
gucaaagaagg

SEQ ID NO: 3459355 - RNA, 23 nt, Human
gucaaagcaggggaguaugcaaa

SEQ ID NO: 3459356 - RNA, 13 nt, Human
gucaaauaaacac

SEQ ID NO: 3459357 - RNA, 17 nt, Human
gucaaauaaacacugug

SEQ ID NO: 3459358 - RNA, 16 nt, Human
gucaaaugcuagaaaa

SEQ ID NO: 3459359 - RNA, 15 nt, Human
gucaaauuauguauu

SEQ ID NO: 3459360 - RNA, 17 nt, Human
gucaacacuaacaugau

SEQ ID NO: 3459361 - RNA, 22 nt, Human
gucaacacuuaaggguuuuaga

SEQ ID NO: 3459362 - RNA, 22 nt, Human
gucaacagagaaggcaggaaug

SEQ ID NO: 3459363 - RNA, 12 nt, Human
gucaacagugaa

SEQ ID NO: 3459364 - RNA, 22 nt, Human
gucaacaguuuuccuaugcuuu

SEQ ID NO: 3459365 - RNA, 16 nt, Human
gucaacaugaaacacc

SEQ ID NO: 3459366 - RNA, 13 nt, Human
gucaaccagacag

SEQ ID NO: 3459367 - RNA, 15 nt, Human
gucaacccuucugga

SEQ ID NO: 3459368 - RNA, 17 nt, Human
gucaacccuucuggaaa

SEQ ID NO: 3459369 - RNA, 13 nt, Human
gucaaccuccugg

SEQ ID NO: 3459370 - RNA, 15 nt, Human
gucaaccuccuggac

SEQ ID NO: 3459371 - RNA, 16 nt, Human
gucaaccuccuggaca

SEQ ID NO: 3459372 - RNA, 21 nt, Human
gucaaccucgcgcuugcuggc

SEQ ID NO: 3459373 - RNA, 19 nt, Human
gucaaccugggcaaagccu

SEQ ID NO: 3459374 - RNA, 16 nt, Human
gucaacguuguacugu

SEQ ID NO: 3459375 - RNA, 11 nt, Human
ugcccagagau

SEQ ID NO: 3459376 - RNA, 16 nt, Human
ugcccagagaugccuc

SEQ ID NO: 3459377 - RNA, 19 nt, Human
ugcccagagaugccuccac

SEQ ID NO: 3459378 - RNA, 11 nt, Human
ugcccagagcu

SEQ ID NO: 3459379 - RNA, 16 nt, Human
ugauuugaaaaauaua

SEQ ID NO: 3459380 - RNA, 23 nt, Human
ugauuugacauagucuggcugua

SEQ ID NO: 3459381 - RNA, 23 nt, Human
ugauuugcaaugggauguaugaa

SEQ ID NO: 3459382 - RNA, 13 nt, Human
ugauuugcauuga

SEQ ID NO: 3459383 - RNA, 14 nt, Human
ugauuugcauugaa

SEQ ID NO: 3459384 - RNA, 17 nt, Human
ugauuugcugcucuuca

SEQ ID NO: 3459385 - RNA, 18 nt, Human
ugauuuggggauucagau

SEQ ID NO: 3459386 - RNA, 21 nt, Human
ugauuuggggauucagauuuc

SEQ ID NO: 3459387 - RNA, 18 nt, Human
ugauuuggguuggggaag

SEQ ID NO: 3459388 - RNA, 23 nt, Human
ugauuuguacagauucuuuauua

SEQ ID NO: 3459389 - RNA, 15 nt, Human
ugauuuguacugaaa

SEQ ID NO: 3459390 - RNA, 18 nt, Human
ugauuuguacugaaaaau

SEQ ID NO: 3459391 - RNA, 18 nt, Human
ugauuuguaguggaaaca

SEQ ID NO: 3459392 - RNA, 15 nt, Human
ugauuugucacugcu

SEQ ID NO: 3459393 - RNA, 19 nt, Human
ugauuuguuuuccucuuaa

SEQ ID NO: 3459394 - RNA, 13 nt, Human
ugauuuuaaaaug

SEQ ID NO: 3459395 - RNA, 17 nt, Human
ugauuuuaaaauguaca

SEQ ID NO: 3459396 - RNA, 13 nt, Human
ugauuuuaaaugu

SEQ ID NO: 3459397 - RNA, 14 nt, Human
ugauuuuaacaaua

SEQ ID NO: 3459398 - RNA, 16 nt, Human
ugauuuuaacaauaac

SEQ ID NO: 3459399 - RNA, 19 nt, Human
ugauuuuaacaauaacuac

SEQ ID NO: 3459400 - RNA, 12 nt, Human
ugauuuuaaugg

SEQ ID NO: 3459401 - RNA, 20 nt, Human
ugauuuuaggagcuaaggcu

SEQ ID NO: 3459402 - RNA, 15 nt, Human
ugauuuuauucuuga

SEQ ID NO: 3459403 - RNA, 16 nt, Human
ugauuuuauucuugau

SEQ ID NO: 3459404 - RNA, 15 nt, Human
ugauuuucauaacuu

SEQ ID NO: 3459405 - RNA, 13 nt, Human
ugauuuucauugc

SEQ ID NO: 3459406 - RNA, 22 nt, Human
ugauuuuccaucuaaaaauaua

SEQ ID NO: 3459407 - RNA, 11 nt, Human
ugauuuugaac

SEQ ID NO: 3459408 - RNA, 17 nt, Human
ugauuuugcuguagaag

SEQ ID NO: 3459409 - RNA, 13 nt, Human
ugauuuuuaucca

SEQ ID NO: 3459410 - RNA, 13 nt, Human
ugauuuuucugga

SEQ ID NO: 3459411 - RNA, 21 nt, Human
ugauuuuugccucuuccaguc

SEQ ID NO: 3459412 - RNA, 17 nt, Human
ugauuuuuuaaaagaaa

SEQ ID NO: 3459413 - RNA, 14 nt, Human
ugauuuuuugaaag

SEQ ID NO: 3459414 - RNA, 18 nt, Human
ugauuuuuugaaaguuaa

SEQ ID NO: 3459415 - RNA, 17 nt, Human
ugauuuuuuuuaauuac

SEQ ID NO: 3459416 - RNA, 22 nt, Human
ugauuuuuuuuuagaacagaaa

SEQ ID NO: 3459417 - RNA, 20 nt, Human
ugauuuuuuuuuccuucagu

SEQ ID NO: 3459418 - RNA, 23 nt, Human
ugauuuuuuuuuccuucagugcc

SEQ ID NO: 3459419 - RNA, 16 nt, Human
ugauuuuuuuuuuuca

SEQ ID NO: 3459420 - RNA, 18 nt, Human
ugcaaaaaaauuaaaaug

SEQ ID NO: 3459421 - RNA, 14 nt, Human
ugcaaaaaaucuua

SEQ ID NO: 3459422 - RNA, 19 nt, Human
ugcaaaaaaucuuaauacu

SEQ ID NO: 3459423 - RNA, 19 nt, Human
ugcaaaaacuacaaccaau

SEQ ID NO: 3459424 - RNA, 15 nt, Human
ugcaaaaagaaauga

SEQ ID NO: 3459425 - RNA, 17 nt, Human
ugcaaaaauaaucauga

SEQ ID NO: 3459426 - RNA, 18 nt, Human
ugcaaaaauauuuauaaa

SEQ ID NO: 3459427 - RNA, 12 nt, Human
ugcaaaaaugua

SEQ ID NO: 3459428 - RNA, 19 nt, Human
ugcaaaacagcguuuaaga

SEQ ID NO: 3459429 - RNA, 13 nt, Human
ugcaaaacauuuc

SEQ ID NO: 3459430 - RNA, 12 nt, Human
ugcaaaauggaa

SEQ ID NO: 3459431 - RNA, 13 nt, Human
ugccuugguuuuu

SEQ ID NO: 3459432 - RNA, 16 nt, Human
ugccuuguauaauauu

SEQ ID NO: 3459433 - RNA, 19 nt, Human
ugccuuguguacaguuauu

SEQ ID NO: 3459434 - RNA, 14 nt, Human
ugccuuguuuggau

SEQ ID NO: 3459435 - RNA, 16 nt, Human
ugccuuguuuuuuguu

SEQ ID NO: 3459436 - RNA, 17 nt, Human
ugccuuuaaaguaugaa

SEQ ID NO: 3459437 - RNA, 18 nt, Human
ugccuuuaaaguaugaau

SEQ ID NO: 3459438 - RNA, 19 nt, Human
ugccuuuaaaucugugaug

SEQ ID NO: 3459439 - RNA, 15 nt, Human
ugccuuuagaaaaua

SEQ ID NO: 3459440 - RNA, 14 nt, Human
ugccuuuauugugu

SEQ ID NO: 3459441 - RNA, 12 nt, Human
ugccuuucaaau

SEQ ID NO: 3459442 - RNA, 13 nt, Human
ugccuuucaaauu

SEQ ID NO: 3459443 - RNA, 19 nt, Human
ugccuuuccuguucagcau

SEQ ID NO: 3459444 - RNA, 11 nt, Human
ugccuuucucg

SEQ ID NO: 3459445 - RNA, 15 nt, Human
ugccuuucugcaguu

SEQ ID NO: 3459446 - RNA, 20 nt, Human
ugccuuucugcaguuuuuca

SEQ ID NO: 3459447 - RNA, 22 nt, Human
ugccuuucugcaguuuuucagg

SEQ ID NO: 3459448 - RNA, 12 nt, Human
ugccuuugaaug

SEQ ID NO: 3459449 - RNA, 23 nt, Human
ugccuuugaccugccucccuuca

SEQ ID NO: 3459450 - RNA, 12 nt, Human
ugccuuugagac

SEQ ID NO: 3459451 - RNA, 15 nt, Human
ugccuuugagacagu

SEQ ID NO: 3459452 - RNA, 15 nt, Human
ugccuuuguaaguua

SEQ ID NO: 3459453 - RNA, 14 nt, Human
ugccuuuuauccca

SEQ ID NO: 3459454 - RNA, 19 nt, Human
ugccuuuucccaacuccag

SEQ ID NO: 3459455 - RNA, 13 nt, Human
ugccuuuuuauuu

SEQ ID NO: 3459456 - RNA, 15 nt, Human
ugccuuuuuauuuau

SEQ ID NO: 3459457 - RNA, 22 nt, Human
ugccuuuuuauuuuuguuuuua

SEQ ID NO: 3459458 - RNA, 16 nt, Human
ugccuuuuucauuauu

SEQ ID NO: 3459459 - RNA, 17 nt, Human
ugccuuuuucauuauuu

SEQ ID NO: 3459460 - RNA, 21 nt, Human
ugccuuuuucauuuuccaaua

SEQ ID NO: 3459461 - RNA, 20 nt, Human
ugccuuuuuucacggaaguu

SEQ ID NO: 3459462 - RNA, 21 nt, Human
ugccuuuuuucacggaaguuu

SEQ ID NO: 3459463 - RNA, 20 nt, Human
ugccuuuuuucuguauaaau

SEQ ID NO: 3459464 - RNA, 22 nt, Human
ugccuuuuuucuguauaaaugu

SEQ ID NO: 3459465 - RNA, 23 nt, Human
ugccuuuuuucuguauaaauguc

SEQ ID NO: 3459466 - RNA, 14 nt, Human
ugccuuuuuugauc

SEQ ID NO: 3459467 - RNA, 19 nt, Human
ugcgaacuagagaugugca

SEQ ID NO: 3459468 - RNA, 16 nt, Human
ugcgaaggggcccugg

SEQ ID NO: 3459469 - RNA, 12 nt, Human
ugcgaaguccua

SEQ ID NO: 3459470 - RNA, 18 nt, Human
ugcgaaguccuauggaaa

SEQ ID NO: 3459471 - RNA, 23 nt, Human
ugcgaaugguagucuaaccaaau

SEQ ID NO: 3459472 - RNA, 22 nt, Human
ugcgaaugguuccauucucucu

SEQ ID NO: 3459473 - RNA, 19 nt, Human
ugcgacacugggaggccag

SEQ ID NO: 3459474 - RNA, 15 nt, Human
ugcgaccccaucugc

SEQ ID NO: 3459475 - RNA, 20 nt, Human
ugcgaccccaucugcccagg

SEQ ID NO: 3459476 - RNA, 13 nt, Human
ugcgacccugggg

SEQ ID NO: 3459477 - RNA, 16 nt, Human
ugcgacggagagaaaa

SEQ ID NO: 3459478 - RNA, 15 nt, Human
ugcgacuuucugccu

SEQ ID NO: 3459479 - RNA, 13 nt, Human
ugcgagagaugug

SEQ ID NO: 3459480 - RNA, 15 nt, Human
ugcgaggcuaugagu

SEQ ID NO: 3459481 - RNA, 22 nt, Human
ugcgagugugugcaugugugug

SEQ ID NO: 3459482 - RNA, 12 nt, Human
ugcgauaagaug

SEQ ID NO: 3459483 - RNA, 15 nt, Human
ugcgaucauggcuca

SEQ ID NO: 3459484 - RNA, 15 nt, Human
ugcgaucuggguuca

SEQ ID NO: 3459485 - RNA, 21 nt, Human
ugcgaucuggguucacugcaa

SEQ ID NO: 3459486 - RNA, 16 nt, Human
ugcgaucuucagagca

SEQ ID NO: 3459487 - RNA, 15 nt, Human
ugcgauucuggauaa

SEQ ID NO: 3459488 - RNA, 16 nt, Human
ugcgauuuuauuacug

SEQ ID NO: 3459489 - RNA, 16 nt, Human
ugcgcagaaaacaaga

SEQ ID NO: 3459490 - RNA, 15 nt, Human
ugcgcagccccaucu

SEQ ID NO: 3459491 - RNA, 20 nt, Human
ugcgcagccccaucugugca

SEQ ID NO: 3459492 - RNA, 21 nt, Human
ugcgcaggcuggcccugcccu

SEQ ID NO: 3459493 - RNA, 22 nt, Human
ugcgcaggcuggcccugcccug

SEQ ID NO: 3459494 - RNA, 15 nt, Human
ugcgcauaggccugc

SEQ ID NO: 3459495 - RNA, 20 nt, Human
ugcgcauaggccugcuuugu

SEQ ID NO: 3459496 - RNA, 21 nt, Human
ugcgcauucuaaccuggaggu

SEQ ID NO: 3459497 - RNA, 17 nt, Human
ugcgccaccgcccagag

SEQ ID NO: 3459498 - RNA, 20 nt, Human
ugcgcccaccccgcucugca

SEQ ID NO: 3459499 - RNA, 18 nt, Human
ugcgcccagggcugggag

SEQ ID NO: 3459500 - RNA, 19 nt, Human
ugcgcccagggcugggagg

SEQ ID NO: 3459501 - RNA, 17 nt, Human
ugcgccgagucugucuc

SEQ ID NO: 3459502 - RNA, 17 nt, Human
ugcgccucaggcugcug

SEQ ID NO: 3459503 - RNA, 19 nt, Human
ugcgccugugaugcugggc

SEQ ID NO: 3459504 - RNA, 20 nt, Human
ugcgcuaaacuuuucugaua

SEQ ID NO: 3459505 - RNA, 21 nt, Human
ugcgcuaaacuuuucugauag

SEQ ID NO: 3459506 - RNA, 14 nt, Human
ugcgcucagggcca

SEQ ID NO: 3459507 - RNA, 23 nt, Human
ugcgcucagggccaugcugaggc

SEQ ID NO: 3459508 - RNA, 17 nt, Human
ugcgcuccuggcccagc

SEQ ID NO: 3459509 - RNA, 14 nt, Human
ugcgcuucacuugg

SEQ ID NO: 3459510 - RNA, 16 nt, Human
ugcgcuucacuugggu

SEQ ID NO: 3459511 - RNA, 22 nt, Human
ugcgcuucacuuggguccaggc

SEQ ID NO: 3459512 - RNA, 19 nt, Human
ugcgcuuguuuuaaagugg

SEQ ID NO: 3459513 - RNA, 18 nt, Human
ugcgcuuuugcuggucac

SEQ ID NO: 3459514 - RNA, 14 nt, Human
ugcggaaagguauu

SEQ ID NO: 3459515 - RNA, 15 nt, Human
ugcggaaagguauuu

SEQ ID NO: 3459516 - RNA, 15 nt, Human
ugcggacaaguuuua

SEQ ID NO: 3459517 - RNA, 20 nt, Human
ugcggacagccacggccagg

SEQ ID NO: 3459518 - RNA, 21 nt, Human
ugcggacagccacggccaggc

SEQ ID NO: 3459519 - RNA, 23 nt, Human
ugcggaggaaggaggacccagga

SEQ ID NO: 3459520 - RNA, 15 nt, Human
ugcggagugaagagg

SEQ ID NO: 3459521 - RNA, 15 nt, Human
ugcggaucucagcuu

SEQ ID NO: 3459522 - RNA, 17 nt, Human
ugcggccuuuggcuuca

SEQ ID NO: 3459523 - RNA, 13 nt, Human
ugcggcgguccca

SEQ ID NO: 3459524 - RNA, 17 nt, Human
ugcaagcagggcucugc

SEQ ID NO: 3459525 - RNA, 15 nt, Human
ugcaagccagauuuu

SEQ ID NO: 3459526 - RNA, 19 nt, Human
ugcaagccccucuuucugu

SEQ ID NO: 3459527 - RNA, 13 nt, Human
ugcaagcuuuucc

SEQ ID NO: 3459528 - RNA, 12 nt, Human
ugcaaggaagga

SEQ ID NO: 3459529 - RNA, 18 nt, Human
ugcaaggacauucuugua

SEQ ID NO: 3459530 - RNA, 11 nt, Human
ugcaaggcacu

SEQ ID NO: 3459531 - RNA, 14 nt, Human
ugcaaggcagccgu

SEQ ID NO: 3459532 - RNA, 24 nt, Human
ugcaaggccgcuguucacccacag

SEQ ID NO: 3459533 - RNA, 11 nt, Human
ugcaagggaaa

SEQ ID NO: 3459534 - RNA, 21 nt, Human
ugcaagggacuguguguugcc

SEQ ID NO: 3459535 - RNA, 21 nt, Human
ugcaagguauuacacucugua

SEQ ID NO: 3459536 - RNA, 15 nt, Human
ugcaaggucauuuuu

SEQ ID NO: 3459537 - RNA, 17 nt, Human
ugcaagguuccacagag

SEQ ID NO: 3459538 - RNA, 17 nt, Human
ugcaagucacaaaggaa

SEQ ID NO: 3459539 - RNA, 21 nt, Human
ugcaagucagaggauggccag

SEQ ID NO: 3459540 - RNA, 14 nt, Human
ugcaagucauggcu

SEQ ID NO: 3459541 - RNA, 17 nt, Human
ugcaaguccuuuuguaa

SEQ ID NO: 3459542 - RNA, 22 nt, Human
ugcaagugagcaaaccugcccc

SEQ ID NO: 3459543 - RNA, 12 nt, Human
ugcaagugcugg

SEQ ID NO: 3459544 - RNA, 15 nt, Human
ugcaagugcuggagu

SEQ ID NO: 3459545 - RNA, 21 nt, Human
ugcaagugguagcaagaagug

SEQ ID NO: 3459546 - RNA, 16 nt, Human
ugcaagugucugugug

SEQ ID NO: 3459547 - RNA, 17 nt, Human
ugcaagugucugugugc

SEQ ID NO: 3459548 - RNA, 23 nt, Human
ugcaagugugugcaugugugcga

SEQ ID NO: 3459549 - RNA, 17 nt, Human
ugcaaguuaugaaauau

SEQ ID NO: 3459550 - RNA, 14 nt, Human
ugcaauaaaauuua

SEQ ID NO: 3459551 - RNA, 15 nt, Human
ugcaauaaaauuuaa

SEQ ID NO: 3459552 - RNA, 15 nt, Human
ugcaauaaaguauaa

SEQ ID NO: 3459553 - RNA, 20 nt, Human
ugcaauaaaucugacccagu

SEQ ID NO: 3459554 - RNA, 14 nt, Human
ugcaauaacagcug

SEQ ID NO: 3459555 - RNA, 15 nt, Human
ugcaauaacagcugc

SEQ ID NO: 3459556 - RNA, 16 nt, Human
ugcaauaacagcugca

SEQ ID NO: 3459557 - RNA, 14 nt, Human
ugcaauaaccuggg

SEQ ID NO: 3459558 - RNA, 15 nt, Human
ugcaauaaugcagua

SEQ ID NO: 3459559 - RNA, 16 nt, Human
ugcaauaaugcaguau

SEQ ID NO: 3459560 - RNA, 16 nt, Human
ugcaauacaaguuuca

SEQ ID NO: 3459561 - RNA, 23 nt, Human
ugcaauacaaguuucauccagaa

SEQ ID NO: 3459562 - RNA, 20 nt, Human
ugcaauagaacagagaaaga

SEQ ID NO: 3459563 - RNA, 14 nt, Human
ugcaauagagacug

SEQ ID NO: 3459564 - RNA, 16 nt, Human
ugcaauagagacugua

SEQ ID NO: 3459565 - RNA, 16 nt, Human
ugcaauauacuggaaa

SEQ ID NO: 3459566 - RNA, 18 nt, Human
ugcaauauaucuaaauug

SEQ ID NO: 3459567 - RNA, 20 nt, Human
ugcaauauaucuaaauugaa

SEQ ID NO: 3459568 - RNA, 21 nt, Human
ugcaauauaucuaaauugaau

SEQ ID NO: 3459569 - RNA, 23 nt, Human
ugcaauauaucuaaauugaauaa

SEQ ID NO: 3459570 - RNA, 20 nt, Human
ugcaauauauuuuguaugca

SEQ ID NO: 3459571 - RNA, 14 nt, Human
ugcaauaucugaag

SEQ ID NO: 3459572 - RNA, 21 nt, Human
ugcaauaucuucguuaguaau

SEQ ID NO: 3459573 - RNA, 14 nt, Human
ugcaauauuccuuu

SEQ ID NO: 3459574 - RNA, 19 nt, Human
ugcaauauuuccucaugug

SEQ ID NO: 3459575 - RNA, 13 nt, Human
ugcaauauuugua

SEQ ID NO: 3459576 - RNA, 12 nt, Human
ugcaauccuuac

SEQ ID NO: 3459577 - RNA, 22 nt, Human
ugcaaucguaauguacagaugg

SEQ ID NO: 3459578 - RNA, 21 nt, Human
ugcaaugaaagguacuauauu

SEQ ID NO: 3459579 - RNA, 15 nt, Human
ugcaaugaaggaaau

SEQ ID NO: 3459580 - RNA, 15 nt, Human
ugcaaugaagucucu

SEQ ID NO: 3459581 - RNA, 16 nt, Human
ugcaaugacaucuuca

SEQ ID NO: 3459582 - RNA, 16 nt, Human
ugcaaugaccuuucaa

SEQ ID NO: 3459583 - RNA, 13 nt, Human
ugcaauggauuuu

SEQ ID NO: 3459584 - RNA, 15 nt, Human
ugcaauggcagccuu

SEQ ID NO: 3459585 - RNA, 17 nt, Human
ugcaaugggauguauga

SEQ ID NO: 3459586 - RNA, 22 nt, Human
ugcaaugggauguaugaauaca

SEQ ID NO: 3459587 - RNA, 22 nt, Human
ugcaauguaaauauuuuaaaga

SEQ ID NO: 3459588 - RNA, 17 nt, Human
ugcaaugugaaaaaucu

SEQ ID NO: 3459589 - RNA, 14 nt, Human
ugcaauguguauaa

SEQ ID NO: 3459590 - RNA, 20 nt, Human
ugcaauguguauaaacaaga

SEQ ID NO: 3459591 - RNA, 20 nt, Human
ugcaauuaaacuuccaaaga

SEQ ID NO: 3459592 - RNA, 17 nt, Human
gucccacuuccccuccu

SEQ ID NO: 3459593 - RNA, 19 nt, Human
gucccacuuggcaucagcu

SEQ ID NO: 3459594 - RNA, 21 nt, Human
gucccagaaugccuccugcag

SEQ ID NO: 3459595 - RNA, 12 nt, Human
gucccagagcag

SEQ ID NO: 3459596 - RNA, 19 nt, Human
gucccagagcaggaggccc

SEQ ID NO: 3459597 - RNA, 22 nt, Human
gucccagauuggcucacacuga

SEQ ID NO: 3459598 - RNA, 15 nt, Human
gucccagcagccagc

SEQ ID NO: 3459599 - RNA, 12 nt, Human
gucccagcagcu

SEQ ID NO: 3459600 - RNA, 14 nt, Human
gucccagcagcugc

SEQ ID NO: 3459601 - RNA, 15 nt, Human
gucccagcagcugcc

SEQ ID NO: 3459602 - RNA, 17 nt, Human
gucccagcagcugccag

SEQ ID NO: 3459603 - RNA, 22 nt, Human
gucccagcagcugccaggagca

SEQ ID NO: 3459604 - RNA, 18 nt, Human
gucccagccaccccgggc

SEQ ID NO: 3459605 - RNA, 21 nt, Human
gucccagccaccccgggcucu

SEQ ID NO: 3459606 - RNA, 22 nt, Human
gucccagcuacucagaagccug

SEQ ID NO: 3459607 - RNA, 15 nt, Human
gucccagcucccugg

SEQ ID NO: 3459608 - RNA, 19 nt, Human
gucccaggaaucaguuuaa

SEQ ID NO: 3459609 - RNA, 17 nt, Human
gucccaggcugagccuc

SEQ ID NO: 3459610 - RNA, 21 nt, Human
gucccaggcugagccucaguc

SEQ ID NO: 3459611 - RNA, 17 nt, Human
gucccagguuaucuggg

SEQ ID NO: 3459612 - RNA, 16 nt, Human
gucccagguuggcucu

SEQ ID NO: 3459613 - RNA, 21 nt, Human
gucccagguuggcucugccag

SEQ ID NO: 3459614 - RNA, 17 nt, Human
gucccagucucuggcag

SEQ ID NO: 3459615 - RNA, 20 nt, Human
gucccagugggaggggcagg

SEQ ID NO: 3459616 - RNA, 15 nt, Human
gucccaguuuuguug

SEQ ID NO: 3459617 - RNA, 23 nt, Human
gucccaguuuuguugccccagaa

SEQ ID NO: 3459618 - RNA, 18 nt, Human
gucccauaggcccaguga

SEQ ID NO: 3459619 - RNA, 18 nt, Human
gucccauauccugccuca

SEQ ID NO: 3459620 - RNA, 21 nt, Human
gucccaucacguguacuggcu

SEQ ID NO: 3459621 - RNA, 17 nt, Human
gucccauccaggcaguc

SEQ ID NO: 3459622 - RNA, 15 nt, Human
gucccaucccugcgu

SEQ ID NO: 3459623 - RNA, 16 nt, Human
gucccaugacccaccc

SEQ ID NO: 3459624 - RNA, 22 nt, Human
gucccauggacacuccagugcc

SEQ ID NO: 3459625 - RNA, 22 nt, Human
gucccaugugagcugcugccau

SEQ ID NO: 3459626 - RNA, 21 nt, Human
gucccauuuuagccaagcuua

SEQ ID NO: 3459627 - RNA, 12 nt, Human
guccccacacuc

SEQ ID NO: 3459628 - RNA, 13 nt, Human
guccccaccaucu

SEQ ID NO: 3459629 - RNA, 20 nt, Human
guccccaccaucugcugucu

SEQ ID NO: 3459630 - RNA, 17 nt, Human
guccccaccccugcccc

SEQ ID NO: 3459631 - RNA, 17 nt, Human
guccccacccuccacuc

SEQ ID NO: 3459632 - RNA, 23 nt, Human
guccccagaacucugccugcccu

SEQ ID NO: 3459633 - RNA, 12 nt, Human
guccccagagaa

SEQ ID NO: 3459634 - RNA, 13 nt, Human
guccccagcccac

SEQ ID NO: 3459635 - RNA, 14 nt, Human
guccccagcccuuc

SEQ ID NO: 3459636 - RNA, 21 nt, Human
guccccaggccccaggaagcc

SEQ ID NO: 3459637 - RNA, 12 nt, Human
guccccaucugu

SEQ ID NO: 3459638 - RNA, 19 nt, Human
guccccauggcacccugcu

SEQ ID NO: 3459639 - RNA, 19 nt, Human
gucccccaacucugagccc

SEQ ID NO: 3459640 - RNA, 12 nt, Human
gucccccagcuc

SEQ ID NO: 3459641 - RNA, 13 nt, Human
gucccccagcucu

SEQ ID NO: 3459642 - RNA, 15 nt, Human
gucccccagcucugg

SEQ ID NO: 3459643 - RNA, 13 nt, Human
guccccccacccu

SEQ ID NO: 3459644 - RNA, 14 nt, Human
guccccccacuccc

SEQ ID NO: 3459645 - RNA, 12 nt, Human
gucccccucugg

SEQ ID NO: 3459646 - RNA, 13 nt, Human
gucccccucuguc

SEQ ID NO: 3459647 - RNA, 13 nt, Human
gucccccugacaa

SEQ ID NO: 3459648 - RNA, 12 nt, Human
gucccccugcag

SEQ ID NO: 3459649 - RNA, 14 nt, Human
gucccccugcagcu

SEQ ID NO: 3459650 - RNA, 14 nt, Human
gucccccuuccaug

SEQ ID NO: 3459651 - RNA, 15 nt, Human
guccccgcacugggc

SEQ ID NO: 3459652 - RNA, 15 nt, Human
guccccgcugcugug

SEQ ID NO: 3459653 - RNA, 16 nt, Human
guccccggggcccagg

SEQ ID NO: 3459654 - RNA, 18 nt, Human
guccccguggccaucccu

SEQ ID NO: 3459655 - RNA, 17 nt, Human
guccccuagagucccag

SEQ ID NO: 3459656 - RNA, 12 nt, Human
guccccucaccu

SEQ ID NO: 3459657 - RNA, 14 nt, Human
guccccucagcucc

SEQ ID NO: 3459658 - RNA, 15 nt, Human
guccccucagcucca

SEQ ID NO: 3459659 - RNA, 16 nt, Human
guccccucccagggag

SEQ ID NO: 3459660 - RNA, 12 nt, Human
guccccuccccc

SEQ ID NO: 3459661 - RNA, 17 nt, Human
guccccuccuucccaag

SEQ ID NO: 3459662 - RNA, 16 nt, Human
guccccucuugcccca

SEQ ID NO: 3459663 - RNA, 23 nt, Human
guccccucuugccccaaccccca

SEQ ID NO: 3459664 - RNA, 18 nt, Human
guccccugcuacaccuau

SEQ ID NO: 3459665 - RNA, 18 nt, Human
guccccuguuuguuucug

SEQ ID NO: 3459666 - RNA, 12 nt, Human
guccccuucccg

SEQ ID NO: 3459667 - RNA, 12 nt, Human
guccccuucucu

SEQ ID NO: 3459668 - RNA, 13 nt, Human
guccccuucucuc

SEQ ID NO: 3459669 - RNA, 14 nt, Human
guccccuucucuca

SEQ ID NO: 3459670 - RNA, 15 nt, Human
uggaaaggaaugcaa

SEQ ID NO: 3459671 - RNA, 22 nt, Human
uggaaaggaaugcaaagaugaa

SEQ ID NO: 3459672 - RNA, 22 nt, Human
uggaaaggagccuaggccaggu

SEQ ID NO: 3459673 - RNA, 20 nt, Human
uggaaaggcucagucucagg

SEQ ID NO: 3459674 - RNA, 13 nt, Human
uggaaaggggaga

SEQ ID NO: 3459675 - RNA, 22 nt, Human
uggaaaggggagagccugcugg

SEQ ID NO: 3459676 - RNA, 17 nt, Human
uggaaaggggggagcug

SEQ ID NO: 3459677 - RNA, 13 nt, Human
uggaaagucagaa

SEQ ID NO: 3459678 - RNA, 14 nt, Human
uggaaagugaauuu

SEQ ID NO: 3459679 - RNA, 23 nt, Human
uggaaagugaauuugaaugaaaa

SEQ ID NO: 3459680 - RNA, 13 nt, Human
uggaaaguguaaa

SEQ ID NO: 3459681 - RNA, 14 nt, Human
uggaaaguguaaag

SEQ ID NO: 3459682 - RNA, 21 nt, Human
uggaaaguguaaagcauucca

SEQ ID NO: 3459683 - RNA, 13 nt, Human
uggaaauaaaugu

SEQ ID NO: 3459684 - RNA, 23 nt, Human
uggaaauaaauguaucauagaaa

SEQ ID NO: 3459685 - RNA, 21 nt, Human
uggaaauagaaauuuccagag

SEQ ID NO: 3459686 - RNA, 13 nt, Human
uggaaauauauau

SEQ ID NO: 3459687 - RNA, 16 nt, Human
uggaaauauuaaaaga

SEQ ID NO: 3459688 - RNA, 15 nt, Human
uggaaauauuaugca

SEQ ID NO: 3459689 - RNA, 14 nt, Human
uggaaauauuuuga

SEQ ID NO: 3459690 - RNA, 17 nt, Human
uggaaauauuuugauaa

SEQ ID NO: 3459691 - RNA, 17 nt, Human
uggaaaucaaauguaaa

SEQ ID NO: 3459692 - RNA, 18 nt, Human
uggaaaucagccaaguuu

SEQ ID NO: 3459693 - RNA, 20 nt, Human
uggaaaucagccaaguuuua

SEQ ID NO: 3459694 - RNA, 20 nt, Human
uggaaaugcugggcugacgg

SEQ ID NO: 3459695 - RNA, 18 nt, Human
uggaaaugggcagagcag

SEQ ID NO: 3459696 - RNA, 19 nt, Human
uggaaauuagguugaaaca

SEQ ID NO: 3459697 - RNA, 21 nt, Human
uggaaauuagguugaaacaua

SEQ ID NO: 3459698 - RNA, 18 nt, Human
uggaaauucccuucaucu

SEQ ID NO: 3459699 - RNA, 17 nt, Human
uggaaauugauuuugaa

SEQ ID NO: 3459700 - RNA, 18 nt, Human
uggaaauuuagcauugua

SEQ ID NO: 3459701 - RNA, 13 nt, Human
uggaaauuucacg

SEQ ID NO: 3459702 - RNA, 20 nt, Human
uggaacaaagugaaggacau

SEQ ID NO: 3459703 - RNA, 20 nt, Human
uggaacacaaacacauuguu

SEQ ID NO: 3459704 - RNA, 14 nt, Human
uggaacaccaggcu

SEQ ID NO: 3459705 - RNA, 15 nt, Human
uggaacaccaggcug

SEQ ID NO: 3459706 - RNA, 12 nt, Human
uggaacacucug

SEQ ID NO: 3459707 - RNA, 18 nt, Human
uggaacauaaaaaggaca

SEQ ID NO: 3459708 - RNA, 20 nt, Human
uggaacauaaaaaggacauc

SEQ ID NO: 3459709 - RNA, 14 nt, Human
uggaacauacuguu

SEQ ID NO: 3459710 - RNA, 21 nt, Human
uggaacaucaucaaggcacug

SEQ ID NO: 3459711 - RNA, 14 nt, Human
uggaacauccuugg

SEQ ID NO: 3459712 - RNA, 20 nt, Human
uggaacauuggaauguucuc

SEQ ID NO: 3459713 - RNA, 13 nt, Human
uggaaccagacuc

SEQ ID NO: 3459714 - RNA, 13 nt, Human
uggaaccaggcuu

SEQ ID NO: 3459715 - RNA, 15 nt, Human
uggaaccaggcuugg

SEQ ID NO: 3459716 - RNA, 14 nt, Human
uggaacccagacuc

SEQ ID NO: 3459717 - RNA, 19 nt, Human
uggaacccuaaauaauaaa

SEQ ID NO: 3459718 - RNA, 15 nt, Human
uggaaccucagccug

SEQ ID NO: 3459719 - RNA, 17 nt, Human
uggaaccucagccuggc

SEQ ID NO: 3459720 - RNA, 16 nt, Human
uggaaccucugucuca

SEQ ID NO: 3459721 - RNA, 16 nt, Human
uggaaccugcaaaaaa

SEQ ID NO: 3459722 - RNA, 19 nt, Human
uggaaccugcaaaaaauac

SEQ ID NO: 3459723 - RNA, 16 nt, Human
uggaaccuugcugucc

SEQ ID NO: 3459724 - RNA, 22 nt, Human
uggaaccuugcuguccugaucu

SEQ ID NO: 3459725 - RNA, 13 nt, Human
uggaaccuuguuu

SEQ ID NO: 3459726 - RNA, 14 nt, Human
uggaacgcguugaa

SEQ ID NO: 3459727 - RNA, 21 nt, Human
uggaacguuuuuccuguucuu

SEQ ID NO: 3459728 - RNA, 17 nt, Human
uggaacuacauuacugu

SEQ ID NO: 3459729 - RNA, 20 nt, Human
uggaacuagguuuuaauaau

SEQ ID NO: 3459730 - RNA, 21 nt, Human
uggaacucauuccugccuguc

SEQ ID NO: 3459731 - RNA, 15 nt, Human
uggaacucuaucugg

SEQ ID NO: 3459732 - RNA, 21 nt, Human
uggaacucuaucugggccugg

SEQ ID NO: 3459733 - RNA, 15 nt, Human
uggaacugaaggggg

SEQ ID NO: 3459734 - RNA, 22 nt, Human
uggaacugaagggggcggccua

SEQ ID NO: 3459735 - RNA, 15 nt, Human
uggaacugcugccac

SEQ ID NO: 3459736 - RNA, 14 nt, Human
uggaacuuagccau

SEQ ID NO: 3459737 - RNA, 16 nt, Human
uggaacuucuaauaua

SEQ ID NO: 3459738 - RNA, 18 nt, Human
uggaacuucuaauauauu

SEQ ID NO: 3459739 - RNA, 21 nt, Human
uggaacuucuaauauauuuuu

SEQ ID NO: 3459740 - RNA, 15 nt, Human
uggaacuugaacuga

SEQ ID NO: 3459741 - RNA, 15 nt, Human
uggaacuugccugcc

SEQ ID NO: 3459742 - RNA, 21 nt, Human
uggaacuugccugccuuucca

SEQ ID NO: 3459743 - RNA, 21 nt, Human
uggaacuuuuauuagauaaca

SEQ ID NO: 3459744 - RNA, 15 nt, Human
uggaagaaaaugguu

SEQ ID NO: 3459745 - RNA, 14 nt, Human
uggaagaaaguaag

SEQ ID NO: 3459746 - RNA, 17 nt, Human
uggaagaaauuccugua

SEQ ID NO: 3459747 - RNA, 11 nt, Human
uggaagacagc

SEQ ID NO: 3459748 - RNA, 16 nt, Human
uggaagacagcucuua

SEQ ID NO: 3459749 - RNA, 21 nt, Human
uggaagacaggaaaguucaga

SEQ ID NO: 3459750 - RNA, 13 nt, Human
uggaagaccccac

SEQ ID NO: 3459751 - RNA, 15 nt, Human
uggaagaccccaccc

SEQ ID NO: 3459752 - RNA, 23 nt, Human
uggaagacgcaagggccugaugg

SEQ ID NO: 3459753 - RNA, 19 nt, Human
uggaagagagaaagcauau

SEQ ID NO: 3459754 - RNA, 20 nt, Human
uggaagagcagcaccuccuc

SEQ ID NO: 3459755 - RNA, 21 nt, Human
uggaagagcccagucuguuga

SEQ ID NO: 3459756 - RNA, 15 nt, Human
uggaagagccugcag

SEQ ID NO: 3459757 - RNA, 23 nt, Human
uggaagagccugcaggugcugcu

SEQ ID NO: 3459758 - RNA, 18 nt, Human
uggaagagcuaggcaggg

SEQ ID NO: 3459759 - RNA, 15 nt, Human
uggaagaggggacag

SEQ ID NO: 3459760 - RNA, 19 nt, Human
uggaagauaguuuucuccu

SEQ ID NO: 3459761 - RNA, 18 nt, Human
uggaagauauuccugagu

SEQ ID NO: 3459762 - RNA, 17 nt, Human
uggaagaucauuuugaa

SEQ ID NO: 3459763 - RNA, 14 nt, Human
uggaagauuuuaaa

SEQ ID NO: 3459764 - RNA, 22 nt, Human
uggaagcacagaaaacuagaau

SEQ ID NO: 3459765 - RNA, 18 nt, Human
uggaagcagguuaaaugu

SEQ ID NO: 3459766 - RNA, 20 nt, Human
uggaagcagguuaaauguuu

SEQ ID NO: 3459767 - RNA, 14 nt, Human
uggaagcagugccc

SEQ ID NO: 3459768 - RNA, 16 nt, Human
uggaagccccugggcc

SEQ ID NO: 3459769 - RNA, 16 nt, Human
uggaagcccuggagac

SEQ ID NO: 3459770 - RNA, 17 nt, Human
uggaagccggcggccca

SEQ ID NO: 3459771 - RNA, 17 nt, Human
uggaagcuaauuugcau

SEQ ID NO: 3459772 - RNA, 18 nt, Human
uggaagcuaauuugcauu

SEQ ID NO: 3459773 - RNA, 23 nt, Human
uggaagcuagacacaugaaggua

SEQ ID NO: 3459774 - RNA, 12 nt, Human
uggaagcuagcu

SEQ ID NO: 3459775 - RNA, 17 nt, Human
uggaagcugcccugccc

SEQ ID NO: 3459776 - RNA, 17 nt, Human
uggaagcuuuguccccu

SEQ ID NO: 3459777 - RNA, 19 nt, Human
uggaagcuuuguccccugc

SEQ ID NO: 3459778 - RNA, 11 nt, Human
uggaaggaaag

SEQ ID NO: 3459779 - RNA, 21 nt, Human
uggaaggagacacagauguuc

SEQ ID NO: 3459780 - RNA, 13 nt, Human
uggaaggagcaga

SEQ ID NO: 3459781 - RNA, 14 nt, Human
uggaaggaggcgca

SEQ ID NO: 3459782 - RNA, 16 nt, Human
uggaaggcagagaaau

SEQ ID NO: 3459783 - RNA, 17 nt, Human
uggaaggcagagaaauc

SEQ ID NO: 3459784 - RNA, 18 nt, Human
uggaaggcagagaaaucu

SEQ ID NO: 3459785 - RNA, 11 nt, Human
uggaaggcaug

SEQ ID NO: 3459786 - RNA, 21 nt, Human
uggaaggcccagcaccacccu

SEQ ID NO: 3459787 - RNA, 17 nt, Human
uggaagggaagaaaagg

SEQ ID NO: 3459788 - RNA, 19 nt, Human
uggaagggauggggugcca

SEQ ID NO: 3459789 - RNA, 16 nt, Human
uggaagggccaagguc

SEQ ID NO: 3459790 - RNA, 23 nt, Human
uggaaggggacacgugacagccg

SEQ ID NO: 3459791 - RNA, 18 nt, Human
uggaaggguucuggcugc

SEQ ID NO: 3459792 - RNA, 15 nt, Human
uggaaggugcuguua

SEQ ID NO: 3459793 - RNA, 21 nt, Human
uggaaggugcuguuauccaug

SEQ ID NO: 3459794 - RNA, 20 nt, Human
uggaagguuuggugugugga

SEQ ID NO: 3459795 - RNA, 21 nt, Human
uggaagguuuguauauuguca

SEQ ID NO: 3459796 - RNA, 20 nt, Human
uggaaguaaccauuugcacu

SEQ ID NO: 3459797 - RNA, 18 nt, Human
uggaaguacuauaauuua

SEQ ID NO: 3459798 - RNA, 20 nt, Human
uggaaguacuauaauuuacc

SEQ ID NO: 3459799 - RNA, 22 nt, Human
uggaaguauguauauuaaaaaa

SEQ ID NO: 3459800 - RNA, 16 nt, Human
uggaagugaggcauug

SEQ ID NO: 3459801 - RNA, 18 nt, Human
uggaagugagggucagag

SEQ ID NO: 3459802 - RNA, 19 nt, Human
uggaagugagggucagaga

SEQ ID NO: 3459803 - RNA, 21 nt, Human
uggaagugagggucagagagg

SEQ ID NO: 3459804 - RNA, 14 nt, Human
uggaagugcuaauu

SEQ ID NO: 3459805 - RNA, 22 nt, Human
ugcaguggccccuuaggccagu

SEQ ID NO: 3459806 - RNA, 21 nt, Human
ugcagugggguuucgcagccu

SEQ ID NO: 3459807 - RNA, 23 nt, Human
ugcagugggguuucgcagccuga

SEQ ID NO: 3459808 - RNA, 23 nt, Human
ugcaguggugcgaucucggcuca

SEQ ID NO: 3459809 - RNA, 14 nt, Human
ugcaguguagauuu

SEQ ID NO: 3459810 - RNA, 14 nt, Human
ugcagugugaaaag

SEQ ID NO: 3459811 - RNA, 21 nt, Human
ugcaguuacacuaaaagguga

SEQ ID NO: 3459812 - RNA, 15 nt, Human
ugcaguucagcacca

SEQ ID NO: 3459813 - RNA, 18 nt, Human
ugcaguucagcaccaccc

SEQ ID NO: 3459814 - RNA, 22 nt, Human
uggaccuaauccaagcaucccu

SEQ ID NO: 3459815 - RNA, 20 nt, Human
uggaccucuacuuuccaggc

SEQ ID NO: 3459816 - RNA, 16 nt, Human
uggaccucugacagca

SEQ ID NO: 3459817 - RNA, 18 nt, Human
uggaccucugacagcagc

SEQ ID NO: 3459818 - RNA, 22 nt, Human
uggaccucugacagcagcaucu

SEQ ID NO: 3459819 - RNA, 16 nt, Human
ugcaugugacucugaa

SEQ ID NO: 3459820 - RNA, 15 nt, Human
ugcauguggcuuuuu

SEQ ID NO: 3459821 - RNA, 22 nt, Human
ugcaugugguuugguuccucuc

SEQ ID NO: 3459822 - RNA, 14 nt, Human
ugcauguguguaua

SEQ ID NO: 3459823 - RNA, 19 nt, Human
ugcauguuacauaagauaa

SEQ ID NO: 3459824 - RNA, 14 nt, Human
ugcauguuaccauc

SEQ ID NO: 3459825 - RNA, 22 nt, Human
ugcauguuaggaaaauuucaca

SEQ ID NO: 3459826 - RNA, 13 nt, Human
ugcauguuauguu

SEQ ID NO: 3459827 - RNA, 16 nt, Human
ugcauguuauguuuaa

SEQ ID NO: 3459828 - RNA, 18 nt, Human
ugcauguugucuaagaaa

SEQ ID NO: 3459829 - RNA, 16 nt, Human
ugcauguuugaaauga

SEQ ID NO: 3459830 - RNA, 23 nt, Human
ugcauguuuguuguauacuuccu

SEQ ID NO: 3459831 - RNA, 17 nt, Human
ugcauuaaaagaaaaua

SEQ ID NO: 3459832 - RNA, 19 nt, Human
ugcauuaaaagaaaauaaa

SEQ ID NO: 3459833 - RNA, 15 nt, Human
ugcauuaaaccuguc

SEQ ID NO: 3459834 - RNA, 21 nt, Human
ugcauuaaaccugucuccacu

SEQ ID NO: 3459835 - RNA, 20 nt, Human
ugcauuaaauucacaaacuu

SEQ ID NO: 3459836 - RNA, 15 nt, Human
ugcauuacagagagg

SEQ ID NO: 3459837 - RNA, 23 nt, Human
ugcauuacagagaggagaaacac

SEQ ID NO: 3459838 - RNA, 19 nt, Human
ugcauuaccgcguuguaaa

SEQ ID NO: 3459839 - RNA, 23 nt, Human
ugcauuaccgcguuguaaaauau

SEQ ID NO: 3459840 - RNA, 23 nt, Human
ugcauuagaaauuagcuguguga

SEQ ID NO: 3459841 - RNA, 21 nt, Human
ugcauuagagcccauuucaau

SEQ ID NO: 3459842 - RNA, 23 nt, Human
ugcauuagcacagauuuuaauug

SEQ ID NO: 3459843 - RNA, 22 nt, Human
ugcauuauaucaaaucuaccac

SEQ ID NO: 3459844 - RNA, 20 nt, Human
ugcauuauauuuauuacugu

SEQ ID NO: 3459845 - RNA, 21 nt, Human
ugcauuauauuuauuacugua

SEQ ID NO: 3459846 - RNA, 12 nt, Human
ugcauuaucuag

SEQ ID NO: 3459847 - RNA, 20 nt, Human
ugcauuaucuagauacugua

SEQ ID NO: 3459848 - RNA, 22 nt, Human
ugcauuaucuagauacuguauc

SEQ ID NO: 3459849 - RNA, 23 nt, Human
ugcauuauucauuuagugaguua

SEQ ID NO: 3459850 - RNA, 15 nt, Human
ugcauuauucucuuu

SEQ ID NO: 3459851 - RNA, 18 nt, Human
ugcauucauuuuuauagc

SEQ ID NO: 3459852 - RNA, 20 nt, Human
ugcauucauuuuuauagcaa

SEQ ID NO: 3459853 - RNA, 14 nt, Human
ugcauucccagcuc

SEQ ID NO: 3459854 - RNA, 16 nt, Human
ugcauuccuuugucuu

SEQ ID NO: 3459855 - RNA, 14 nt, Human
ugcauucuauugcc

SEQ ID NO: 3459856 - RNA, 17 nt, Human
ugcauucuauugccuuc

SEQ ID NO: 3459857 - RNA, 20 nt, Human
ugcauucuauugccuucuuu

SEQ ID NO: 3459858 - RNA, 11 nt, Human
ugcauucuccc

SEQ ID NO: 3459859 - RNA, 15 nt, Human
ugcauucugccucuc

SEQ ID NO: 3459860 - RNA, 15 nt, Human
ugcauucuucucugu

SEQ ID NO: 3459861 - RNA, 13 nt, Human
ugcauugaacaca

SEQ ID NO: 3459862 - RNA, 15 nt, Human
ugcauugaacacaaa

SEQ ID NO: 3459863 - RNA, 18 nt, Human
ugcauugaacacaaacug

SEQ ID NO: 3459864 - RNA, 14 nt, Human
ugcauugaauauau

SEQ ID NO: 3459865 - RNA, 16 nt, Human
ugcauugaauauauua

SEQ ID NO: 3459866 - RNA, 14 nt, Human
ugcauugacauuau

SEQ ID NO: 3459867 - RNA, 22 nt, Human
ugcauugaccgcgacuaauuuc

SEQ ID NO: 3459868 - RNA, 20 nt, Human
ugcauugcccagucuuucau

SEQ ID NO: 3459869 - RNA, 19 nt, Human
ugcauugcugugaauuagc

SEQ ID NO: 3459870 - RNA, 18 nt, Human
ugcauuggaacuggaggc

SEQ ID NO: 3459871 - RNA, 21 nt, Human
ugcauuggaacuggaggcagg

SEQ ID NO: 3459872 - RNA, 12 nt, Human
ugcauuguaaau

SEQ ID NO: 3459873 - RNA, 19 nt, Human
ugcauugugauuggccugu

SEQ ID NO: 3459874 - RNA, 15 nt, Human
ugcauugugcuucuu

SEQ ID NO: 3459875 - RNA, 13 nt, Human
ugcauuguuucug

SEQ ID NO: 3459876 - RNA, 18 nt, Human
ugcauuguuucugugggc

SEQ ID NO: 3459877 - RNA, 19 nt, Human
ugcauuuaaaacagacacu

SEQ ID NO: 3459878 - RNA, 16 nt, Human
ugcauuuaaaagauac

SEQ ID NO: 3459879 - RNA, 22 nt, Human
ugcauuuaaauacagucuucca

SEQ ID NO: 3459880 - RNA, 24 nt, Human
ugcauuuaaauacagucuuccauu

SEQ ID NO: 3459881 - RNA, 19 nt, Human
ugcauuuagggaguauucu

SEQ ID NO: 3459882 - RNA, 20 nt, Human
ugcauuuaugagcucuucau

SEQ ID NO: 3459883 - RNA, 17 nt, Human
ugcauuucagaaagccu

SEQ ID NO: 3459884 - RNA, 20 nt, Human
ugcauuuccucgcagccucu

SEQ ID NO: 3459885 - RNA, 14 nt, Human
ugcauuucucuggg

SEQ ID NO: 3459886 - RNA, 23 nt, Human
ugcauuugaaaauuuugauguuu

SEQ ID NO: 3459887 - RNA, 21 nt, Human
ugcauuugaggucuguucuuu

SEQ ID NO: 3459888 - RNA, 16 nt, Human
ugcauuugauacauuu

SEQ ID NO: 3459889 - RNA, 14 nt, Human
ugcauuugcuuuug

SEQ ID NO: 3459890 - RNA, 21 nt, Human
ugcauuuggaauuuuugcuug

SEQ ID NO: 3459891 - RNA, 16 nt, Human
ugcauuuggguccagg

SEQ ID NO: 3459892 - RNA, 19 nt, Human
ugcauuuggguccaggagg

SEQ ID NO: 3459893 - RNA, 16 nt, Human
ugcauuuguaaaugcu

SEQ ID NO: 3459894 - RNA, 15 nt, Human
ugcauuuguauauuu

SEQ ID NO: 3459895 - RNA, 19 nt, Human
ugcauuugucuauucucca

SEQ ID NO: 3459896 - RNA, 13 nt, Human
ugcauuuguuuau

SEQ ID NO: 3459897 - RNA, 16 nt, Human
ugcauuuuaaaaauga

SEQ ID NO: 3459898 - RNA, 21 nt, Human
ugcauuuuaaaguuaaacauu

SEQ ID NO: 3459899 - RNA, 17 nt, Human
ugcauuuuaauuuuaac

SEQ ID NO: 3459900 - RNA, 19 nt, Human
ugcauuuuaauuuuaacca

SEQ ID NO: 3459901 - RNA, 16 nt, Human
ugcauuuucuggguuc

SEQ ID NO: 3459902 - RNA, 23 nt, Human
ugcauuuucuggguucugggugg

SEQ ID NO: 3459903 - RNA, 18 nt, Human
ugcauuuugcagcaguga

SEQ ID NO: 3459904 - RNA, 17 nt, Human
ugcauuuugcuauugua

SEQ ID NO: 3459905 - RNA, 20 nt, Human
ugcauuuugcuauuguaaau

SEQ ID NO: 3459906 - RNA, 18 nt, Human
ugcauuuuguuugguauu

SEQ ID NO: 3459907 - RNA, 16 nt, Human
ugcauuuuugugaaau

SEQ ID NO: 3459908 - RNA, 17 nt, Human
ugcauuuuugugaaaug

SEQ ID NO: 3459909 - RNA, 20 nt, Human
ugccaaaaaggauacauaau

SEQ ID NO: 3459910 - RNA, 16 nt, Human
ugccaaaacccagcug

SEQ ID NO: 3459911 - RNA, 18 nt, Human
ugccaaaacccagcugca

SEQ ID NO: 3459912 - RNA, 18 nt, Human
ugccaaaauaaugucuug

SEQ ID NO: 3459913 - RNA, 21 nt, Human
ugccaaaauaaugucuuguua

SEQ ID NO: 3459914 - RNA, 19 nt, Human
ugccaaaauucauuucuaa

SEQ ID NO: 3459915 - RNA, 14 nt, Human
ugccaaagggaaau

SEQ ID NO: 3459916 - RNA, 18 nt, Human
ugccaaagggaaauauca

SEQ ID NO: 3459917 - RNA, 19 nt, Human
ugccaaaguacagaauuug

SEQ ID NO: 3459918 - RNA, 17 nt, Human
ugccaaagucucccuuc

SEQ ID NO: 3459919 - RNA, 20 nt, Human
ugccaaauaaaguuaaaagu

SEQ ID NO: 3459920 - RNA, 16 nt, Human
ugccaaauaauaaaaa

SEQ ID NO: 3459921 - RNA, 17 nt, Human
ugccaaauauaaauaaa

SEQ ID NO: 3459922 - RNA, 18 nt, Human
ugccaaauauguccuggg

SEQ ID NO: 3459923 - RNA, 13 nt, Human
ugccaaauuaaaa

SEQ ID NO: 3459924 - RNA, 15 nt, Human
ugccaacaagaaugc

SEQ ID NO: 3459925 - RNA, 16 nt, Human
ugccaacaagaaugca

SEQ ID NO: 3459926 - RNA, 20 nt, Human
ugccaacaagaaugcauuga

SEQ ID NO: 3459927 - RNA, 20 nt, Human
ugccaacaauccuagugcuu

SEQ ID NO: 3459928 - RNA, 21 nt, Human
ugccaacaccacagaaauggg

SEQ ID NO: 3459929 - RNA, 12 nt, Human
ugccaacauugc

SEQ ID NO: 3459930 - RNA, 14 nt, Human
ugccaacauugccu

SEQ ID NO: 3459931 - RNA, 16 nt, Human
ugccaaccuaaaacuc

SEQ ID NO: 3459932 - RNA, 15 nt, Human
ugccaaccucgcucc

SEQ ID NO: 3459933 - RNA, 19 nt, Human
ugccaaccucgcuccaacu

SEQ ID NO: 3459934 - RNA, 21 nt, Human
ugccaaccucgcuccaacucc

SEQ ID NO: 3459935 - RNA, 16 nt, Human
ugccaaccucuggagc

SEQ ID NO: 3459936 - RNA, 22 nt, Human
ugccaaccuguaauaaauauga

SEQ ID NO: 3459937 - RNA, 13 nt, Human
ugccaacuccuca

SEQ ID NO: 3459938 - RNA, 18 nt, Human
ugccaacugaucuguuau

SEQ ID NO: 3459939 - RNA, 14 nt, Human
ugccaacuguggcu

SEQ ID NO: 3459940 - RNA, 21 nt, Human
ugccaagaaaagggcugacau

SEQ ID NO: 3459941 - RNA, 16 nt, Human
ugccaagaacugaaaa

SEQ ID NO: 3459942 - RNA, 19 nt, Human
ugccaagaacugaaaacau

SEQ ID NO: 3459943 - RNA, 14 nt, Human
ugccaagacaaauc

SEQ ID NO: 3459944 - RNA, 17 nt, Human
ugccaagacaaaucaac

SEQ ID NO: 3459945 - RNA, 19 nt, Human
ugccaagacaaaucaacag

SEQ ID NO: 3459946 - RNA, 14 nt, Human
ugccaagacaugau

SEQ ID NO: 3459947 - RNA, 14 nt, Human
ugccaagacugcug

SEQ ID NO: 3459948 - RNA, 12 nt, Human
ugccaagagagg

SEQ ID NO: 3459949 - RNA, 20 nt, Human
ugccaagcaaggaaaacuua

SEQ ID NO: 3459950 - RNA, 23 nt, Human
ugccaagcaaggaaaacuuauuu

SEQ ID NO: 3459951 - RNA, 15 nt, Human
ugccaagcuccaagc

SEQ ID NO: 3459952 - RNA, 18 nt, Human
ugccaaggcagaggccug

SEQ ID NO: 3459953 - RNA, 22 nt, Human
ugccaaggcagaggccugggcu

SEQ ID NO: 3459954 - RNA, 16 nt, Human
ugccaaggccagagug

SEQ ID NO: 3459955 - RNA, 22 nt, Human
ugccaaggccagaguggccugg

SEQ ID NO: 3459956 - RNA, 17 nt, Human
ugccaaggcugaugcag

SEQ ID NO: 3459957 - RNA, 15 nt, Human
ugccaaguccagguc

SEQ ID NO: 3459958 - RNA, 20 nt, Human
uggccauucuuuuuuucuug

SEQ ID NO: 3459959 - RNA, 20 nt, Human
uggcccaacaggggcuccau

SEQ ID NO: 3459960 - RNA, 12 nt, Human
uggcccaaggcu

SEQ ID NO: 3459961 - RNA, 23 nt, Human
uggcccaaggcuggcaggucaac

SEQ ID NO: 3459962 - RNA, 19 nt, Human
uggcccacagcaggugcug

SEQ ID NO: 3459963 - RNA, 22 nt, Human
uggcccaccccacccacuucug

SEQ ID NO: 3459964 - RNA, 13 nt, Human
uggcccacgcacu

SEQ ID NO: 3459965 - RNA, 19 nt, Human
uggcccacgcacuucggga

SEQ ID NO: 3459966 - RNA, 14 nt, Human
uggcccacugcauc

SEQ ID NO: 3459967 - RNA, 12 nt, Human
uggcccagcccu

SEQ ID NO: 3459968 - RNA, 11 nt, Human
uggcccagccg

SEQ ID NO: 3459969 - RNA, 19 nt, Human
uggcccagcggccccuccc

SEQ ID NO: 3459970 - RNA, 22 nt, Human
uggcccagcucccccgggaggg

SEQ ID NO: 3459971 - RNA, 12 nt, Human
uggcccaggagu

SEQ ID NO: 3459972 - RNA, 14 nt, Human
uggcccaggaguuu

SEQ ID NO: 3459973 - RNA, 19 nt, Human
uggcccagggcaucuggga

SEQ ID NO: 3459974 - RNA, 14 nt, Human
uggcccagggccca

SEQ ID NO: 3459975 - RNA, 16 nt, Human
uggcccagggcccaga

SEQ ID NO: 3459976 - RNA, 21 nt, Human
uggcccagggggcuuccugag

SEQ ID NO: 3459977 - RNA, 12 nt, Human
uggcccaguguc

SEQ ID NO: 3459978 - RNA, 24 nt, Human
uggcccauagaaacaugacacuga

SEQ ID NO: 3459979 - RNA, 12 nt, Human
uggcccaucccc

SEQ ID NO: 3459980 - RNA, 15 nt, Human
uggcccauccccccu

SEQ ID NO: 3459981 - RNA, 16 nt, Human
uggcccauccccccuc

SEQ ID NO: 3459982 - RNA, 19 nt, Human
uggcccauccccccucacc

SEQ ID NO: 3459983 - RNA, 18 nt, Human
uggcccauguauggccag

SEQ ID NO: 3459984 - RNA, 17 nt, Human
uggcccauucuacuugc

SEQ ID NO: 3459985 - RNA, 20 nt, Human
uggcccauucuacuugcucu

SEQ ID NO: 3459986 - RNA, 15 nt, Human
uggccccacccuggg

SEQ ID NO: 3459987 - RNA, 22 nt, Human
uggccccacccugggcccuggg

SEQ ID NO: 3459988 - RNA, 13 nt, Human
uggccccaccugg

SEQ ID NO: 3459989 - RNA, 17 nt, Human
uggccccaccuggcccu

SEQ ID NO: 3459990 - RNA, 13 nt, Human
uggccccagcaca

SEQ ID NO: 3459991 - RNA, 17 nt, Human
uggccccagcacagcuu

SEQ ID NO: 3459992 - RNA, 16 nt, Human
uggccccagcccugcu

SEQ ID NO: 3459993 - RNA, 22 nt, Human
uggccccagccuggcccagcuc

SEQ ID NO: 3459994 - RNA, 20 nt, Human
uggccccaggaccuggcugc

SEQ ID NO: 3459995 - RNA, 14 nt, Human
uggcccccgagcug

SEQ ID NO: 3459996 - RNA, 13 nt, Human
uggccccgccgcc

SEQ ID NO: 3459997 - RNA, 16 nt, Human
uggccccguuucuggu

SEQ ID NO: 3459998 - RNA, 15 nt, Human
uggccccuacuuugu

SEQ ID NO: 3459999 - RNA, 23 nt, Human
uggccccuacuuuguggcaaucu

SEQ ID NO: 3460000 - RNA, 13 nt, Human
uggccccucaccu

SEQ ID NO: 3460001 - RNA, 21 nt, Human
uggccccucagggucccuggu

SEQ ID NO: 3460002 - RNA, 10 nt, Human
uggccccucu

SEQ ID NO: 3460003 - RNA, 15 nt, Human
uggccccucucccuu

SEQ ID NO: 3460004 - RNA, 16 nt, Human
uggccccugcccggcu

SEQ ID NO: 3460005 - RNA, 16 nt, Human
uggccccuucacuucu

SEQ ID NO: 3460006 - RNA, 15 nt, Human
uggcccgacagccug

SEQ ID NO: 3460007 - RNA, 18 nt, Human
uggcccgacagccuggca

SEQ ID NO: 3460008 - RNA, 14 nt, Human
uggcccggaugcug

SEQ ID NO: 3460009 - RNA, 15 nt, Human
uggcccgugacagac

SEQ ID NO: 3460010 - RNA, 13 nt, Human
uggcccuagacuc

SEQ ID NO: 3460011 - RNA, 21 nt, Human
uggcccucaaggccucccaca

SEQ ID NO: 3460012 - RNA, 22 nt, Human
uggcccucaaggccucccacag

SEQ ID NO: 3460013 - RNA, 18 nt, Human
uggcccucaccccugccc

SEQ ID NO: 3460014 - RNA, 20 nt, Human
uggcccucaccccugcccug

SEQ ID NO: 3460015 - RNA, 18 nt, Human
uggcccucuccccugccc

SEQ ID NO: 3460016 - RNA, 21 nt, Human
uggcccucuccccugcccccu

SEQ ID NO: 3460017 - RNA, 12 nt, Human
uggcccucuggu

SEQ ID NO: 3460018 - RNA, 15 nt, Human
uggcccucuguguug

SEQ ID NO: 3460019 - RNA, 18 nt, Human
uggcccugcccucuccuu

SEQ ID NO: 3460020 - RNA, 14 nt, Human
uggcccugcuuccu

SEQ ID NO: 3460021 - RNA, 17 nt, Human
uggcccugcuuccugcu

SEQ ID NO: 3460022 - RNA, 13 nt, Human
uggcccuggccug

SEQ ID NO: 3460023 - RNA, 22 nt, Human
ugcccaguguuguuuguaaaua

SEQ ID NO: 3460024 - RNA, 16 nt, Human
ugcccaguuucugccu

SEQ ID NO: 3460025 - RNA, 19 nt, Human
ugcccaguuucugccucug

SEQ ID NO: 3460026 - RNA, 23 nt, Human
ugcccaucacaggguugggccca

SEQ ID NO: 3460027 - RNA, 18 nt, Human
ugcccaucauguggcccc

SEQ ID NO: 3460028 - RNA, 22 nt, Human
ugcccaucauguggccccaccc

SEQ ID NO: 3460029 - RNA, 15 nt, Human
ugcccaugccaccgc

SEQ ID NO: 3460030 - RNA, 24 nt, Human
ugcccauggacaggcuggcuccag

SEQ ID NO: 3460031 - RNA, 16 nt, Human
ugcccaugggcacugc

SEQ ID NO: 3460032 - RNA, 21 nt, Human
ugcccaugucgcgcucagcau

SEQ ID NO: 3460033 - RNA, 19 nt, Human
ugcccauucaccaaaauua

SEQ ID NO: 3460034 - RNA, 19 nt, Human
ugcccauuguuuuucugau

SEQ ID NO: 3460035 - RNA, 14 nt, Human
ugccccaaacaaau

SEQ ID NO: 3460036 - RNA, 20 nt, Human
ugccccaaauaacuucaguc

SEQ ID NO: 3460037 - RNA, 15 nt, Human
ugccccaacccccag

SEQ ID NO: 3460038 - RNA, 20 nt, Human
ugccccaacccccagcaccc

SEQ ID NO: 3460039 - RNA, 16 nt, Human
ugccccaacccuucuu

SEQ ID NO: 3460040 - RNA, 16 nt, Human
ugccccaacuccuucc

SEQ ID NO: 3460041 - RNA, 18 nt, Human
ugccccaacuccuuccag

SEQ ID NO: 3460042 - RNA, 22 nt, Human
ugccccaacuccuuccagcuag

SEQ ID NO: 3460043 - RNA, 22 nt, Human
ugccccaaguuuugugaaauuu

SEQ ID NO: 3460044 - RNA, 14 nt, Human
ugccccaccugcca

SEQ ID NO: 3460045 - RNA, 21 nt, Human
ugccccaccuuuauuaaaauc

SEQ ID NO: 3460046 - RNA, 13 nt, Human
ugccccagaggcc

SEQ ID NO: 3460047 - RNA, 13 nt, Human
ugccccagcccaa

SEQ ID NO: 3460048 - RNA, 14 nt, Human
ugccccagcccaga

SEQ ID NO: 3460049 - RNA, 14 nt, Human
ugccccaggaccag

SEQ ID NO: 3460050 - RNA, 21 nt, Human
ugccccaucagugcucccuca

SEQ ID NO: 3460051 - RNA, 20 nt, Human
ugccccauccuccagcaggg

SEQ ID NO: 3460052 - RNA, 21 nt, Human
ugccccaucuccccucagcuc

SEQ ID NO: 3460053 - RNA, 23 nt, Human
ugccccaugccuguccagccugg

SEQ ID NO: 3460054 - RNA, 12 nt, Human
ugccccauucuu

SEQ ID NO: 3460055 - RNA, 21 nt, Human
ugcccccaaccauuuccucag

SEQ ID NO: 3460056 - RNA, 19 nt, Human
ugcccccacaccuggcccu

SEQ ID NO: 3460057 - RNA, 12 nt, Human
ugcccccacccc

SEQ ID NO: 3460058 - RNA, 22 nt, Human
ugcccccaccccauucccgcag

SEQ ID NO: 3460059 - RNA, 23 nt, Human
ugcccccaccccggggacccugu

SEQ ID NO: 3460060 - RNA, 17 nt, Human
ugcccccacugaccaga

SEQ ID NO: 3460061 - RNA, 14 nt, Human
ugcccccagagcca

SEQ ID NO: 3460062 - RNA, 16 nt, Human
ugcccccagcuggccc

SEQ ID NO: 3460063 - RNA, 15 nt, Human
ugcccccaggacugg

SEQ ID NO: 3460064 - RNA, 16 nt, Human
ugccccccaccccagc

SEQ ID NO: 3460065 - RNA, 18 nt, Human
ugccccccaccccagccu

SEQ ID NO: 3460066 - RNA, 13 nt, Human
ugccccccauccu

SEQ ID NO: 3460067 - RNA, 23 nt, Human
ugccccccaugaggaaggaacag

SEQ ID NO: 3460068 - RNA, 23 nt, Human
ugccccccucaaaccuccucuuc

SEQ ID NO: 3460069 - RNA, 18 nt, Human
ugcccccgcauccccugc

SEQ ID NO: 3460070 - RNA, 21 nt, Human
ugcccccgcauccccugccuc

SEQ ID NO: 3460071 - RNA, 22 nt, Human
ugcccccgcauccccugccucc

SEQ ID NO: 3460072 - RNA, 15 nt, Human
ugcccccggcccccu

SEQ ID NO: 3460073 - RNA, 20 nt, Human
ugcccccuccucucccaucc

SEQ ID NO: 3460074 - RNA, 15 nt, Human
ugcccccucgugcca

SEQ ID NO: 3460075 - RNA, 16 nt, Human
ugcccccucgugccag

SEQ ID NO: 3460076 - RNA, 18 nt, Human
ugcccccugaaacuuauu

SEQ ID NO: 3460077 - RNA, 16 nt, Human
ugcccccugcaggaag

SEQ ID NO: 3460078 - RNA, 17 nt, Human
ugcccccugcaggaagg

SEQ ID NO: 3460079 - RNA, 16 nt, Human
ugcccccugcuggcuc

SEQ ID NO: 3460080 - RNA, 22 nt, Human
ugcccccugcuggcucuucugc

SEQ ID NO: 3460081 - RNA, 13 nt, Human
ugcccccuggugg

SEQ ID NO: 3460082 - RNA, 19 nt, Human
ugcccccuguggaugcugc

SEQ ID NO: 3460083 - RNA, 15 nt, Human
ugcccccuucuccca

SEQ ID NO: 3460084 - RNA, 17 nt, Human
ugcccccuucucccaca

SEQ ID NO: 3460085 - RNA, 20 nt, Human
ugcccccuucucccacacug

SEQ ID NO: 3460086 - RNA, 17 nt, Human
ugccccgcuuugcggac

SEQ ID NO: 3460087 - RNA, 13 nt, Human
ugccccggccacc

SEQ ID NO: 3460088 - RNA, 15 nt, Human
ugccccggccaccuc

SEQ ID NO: 3460089 - RNA, 16 nt, Human
ugccccggccaccucu

SEQ ID NO: 3460090 - RNA, 23 nt, Human
ugccccggccaccucugcggacc

SEQ ID NO: 3460091 - RNA, 19 nt, Human
ugccccggggaggggcgcu

SEQ ID NO: 3460092 - RNA, 18 nt, Human
ugccccgucaccaucuca

SEQ ID NO: 3460093 - RNA, 21 nt, Human
ugccccgucaccaucucaggc

SEQ ID NO: 3460094 - RNA, 17 nt, Human
ugccccuaaucucugua

SEQ ID NO: 3460095 - RNA, 18 nt, Human
ugccccuaaucucuguag

SEQ ID NO: 3460096 - RNA, 19 nt, Human
ugccccucaacucuccucc

SEQ ID NO: 3460097 - RNA, 22 nt, Human
ugccccucaacucuccuccaga

SEQ ID NO: 3460098 - RNA, 23 nt, Human
ugccccucccccaacccccaccc

SEQ ID NO: 3460099 - RNA, 14 nt, Human
ugccccucccccag

SEQ ID NO: 3460100 - RNA, 16 nt, Human
ugccccucccuucaac

SEQ ID NO: 3460101 - RNA, 19 nt, Human
ugccccuccucucugcccu

SEQ ID NO: 3460102 - RNA, 17 nt, Human
gugccuuuccuguucag

SEQ ID NO: 3460103 - RNA, 18 nt, Human
gugccuuuccuguucagc

SEQ ID NO: 3460104 - RNA, 17 nt, Human
gugccuuuugcaccccu

SEQ ID NO: 3460105 - RNA, 18 nt, Human
gugccuuuugcagaagag

SEQ ID NO: 3460106 - RNA, 18 nt, Human
gugccuuuuuucacggaa

SEQ ID NO: 3460107 - RNA, 23 nt, Human
gugcgagugugugcaugugugug

SEQ ID NO: 3460108 - RNA, 15 nt, Human
gugcgauucuggaua

SEQ ID NO: 3460109 - RNA, 12 nt, Human
gugcgcccaggg

SEQ ID NO: 3460110 - RNA, 15 nt, Human
gugcgcccagggcug

SEQ ID NO: 3460111 - RNA, 16 nt, Human
gugcgcccagggcugg

SEQ ID NO: 3460112 - RNA, 17 nt, Human
gugcgcuaaacuuuucu

SEQ ID NO: 3460113 - RNA, 22 nt, Human
gugcgcugacaaccaccgcucc

SEQ ID NO: 3460114 - RNA, 19 nt, Human
gugcgcugggcacuucccu

SEQ ID NO: 3460115 - RNA, 21 nt, Human
gugcgcugggcacuucccugc

SEQ ID NO: 3460116 - RNA, 16 nt, Human
gugcggcagggaagag

SEQ ID NO: 3460117 - RNA, 18 nt, Human
gugcggcggucccagcuc

SEQ ID NO: 3460118 - RNA, 22 nt, Human
gugcggcggucccagcucccug

SEQ ID NO: 3460119 - RNA, 14 nt, Human
gugcggcugugcag

SEQ ID NO: 3460120 - RNA, 13 nt, Human
gugcgggguacac

SEQ ID NO: 3460121 - RNA, 14 nt, Human
gugcgugaaacaca

SEQ ID NO: 3460122 - RNA, 15 nt, Human
gugcgugaaacacac

SEQ ID NO: 3460123 - RNA, 15 nt, Human
gugcguguguagagu

SEQ ID NO: 3460124 - RNA, 17 nt, Human
gugcguguguagaguua

SEQ ID NO: 3460125 - RNA, 14 nt, Human
gugcuaaaaauggg

SEQ ID NO: 3460126 - RNA, 17 nt, Human
gugcuaaacguguaugu

SEQ ID NO: 3460127 - RNA, 13 nt, Human
gugcuaaauuuuc

SEQ ID NO: 3460128 - RNA, 23 nt, Human
gugcuaaccacgucugucuucac

SEQ ID NO: 3460129 - RNA, 15 nt, Human
gugcuaagguucuaa

SEQ ID NO: 3460130 - RNA, 17 nt, Human
gugcuaagguucuaagg

SEQ ID NO: 3460131 - RNA, 20 nt, Human
gugcuaagugugaacuggac

SEQ ID NO: 3460132 - RNA, 21 nt, Human
gugcuaauaacagugcauauu

SEQ ID NO: 3460133 - RNA, 16 nt, Human
gugcuaauuaauaaag

SEQ ID NO: 3460134 - RNA, 13 nt, Human
gugcuaauuuuga

SEQ ID NO: 3460135 - RNA, 11 nt, Human
gugcuacagaa

SEQ ID NO: 3460136 - RNA, 16 nt, Human
gugcuaccuggguccu

SEQ ID NO: 3460137 - RNA, 20 nt, Human
gugcuacguacaugugaggc

SEQ ID NO: 3460138 - RNA, 11 nt, Human
gugcuacuggg

SEQ ID NO: 3460139 - RNA, 13 nt, Human
gugcuacugggga

SEQ ID NO: 3460140 - RNA, 15 nt, Human
gugcuacugucuuug

SEQ ID NO: 3460141 - RNA, 19 nt, Human
gugcuagaauacuuuuuaa

SEQ ID NO: 3460142 - RNA, 21 nt, Human
gugcuagaggauuaguaagau

SEQ ID NO: 3460143 - RNA, 16 nt, Human
gugcuaggaacacucc

SEQ ID NO: 3460144 - RNA, 18 nt, Human
gugcuaggaacacuccuu

SEQ ID NO: 3460145 - RNA, 14 nt, Human
gugcuaggaagagg

SEQ ID NO: 3460146 - RNA, 14 nt, Human
gugcuagugagcug

SEQ ID NO: 3460147 - RNA, 22 nt, Human
gugcuauaaucuguuuuuacgu

SEQ ID NO: 3460148 - RNA, 13 nt, Human
gugcuauaguauu

SEQ ID NO: 3460149 - RNA, 14 nt, Human
gugcuauaguauuu

SEQ ID NO: 3460150 - RNA, 13 nt, Human
gugcuauauauau

SEQ ID NO: 3460151 - RNA, 18 nt, Human
gugcuaucucccccagcc

SEQ ID NO: 3460152 - RNA, 19 nt, Human
gugcuaucucccccagccc

SEQ ID NO: 3460153 - RNA, 21 nt, Human
gugcuaucucccccagcccca

SEQ ID NO: 3460154 - RNA, 13 nt, Human
gugcuaugaauuu

SEQ ID NO: 3460155 - RNA, 14 nt, Human
gugcuauggugcuc

SEQ ID NO: 3460156 - RNA, 13 nt, Human
gugcuauuaauau

SEQ ID NO: 3460157 - RNA, 14 nt, Human
gugcuauuaauauu

SEQ ID NO: 3460158 - RNA, 16 nt, Human
gugcucaaaaugcaaa

SEQ ID NO: 3460159 - RNA, 22 nt, Human
gugcucacguuaccuugacaca

SEQ ID NO: 3460160 - RNA, 23 nt, Human
gugcucacguuaccuugacacau

SEQ ID NO: 3460161 - RNA, 19 nt, Human
gugcucagaauaaggcagg

SEQ ID NO: 3460162 - RNA, 20 nt, Human
gugcucagagaccugaagug

SEQ ID NO: 3460163 - RNA, 13 nt, Human
gugcucagggcug

SEQ ID NO: 3460164 - RNA, 15 nt, Human
gugcucaucagaaac

SEQ ID NO: 3460165 - RNA, 16 nt, Human
gugcucauuucaggau

SEQ ID NO: 3460166 - RNA, 16 nt, Human
gugcuccagccuggcu

SEQ ID NO: 3460167 - RNA, 18 nt, Human
gugcucccuaccaccucc

SEQ ID NO: 3460168 - RNA, 21 nt, Human
gugcucgagacacagugaagc

SEQ ID NO: 3460169 - RNA, 14 nt, Human
gugcucgccccagc

SEQ ID NO: 3460170 - RNA, 16 nt, Human
gugcucgccccagcag

SEQ ID NO: 3460171 - RNA, 18 nt, Human
gugcucgcuguugcugaa

SEQ ID NO: 3460172 - RNA, 19 nt, Human
gugcucgcuguugcugaau

SEQ ID NO: 3460173 - RNA, 21 nt, Human
gugcucggagaagagcgcagu

SEQ ID NO: 3460174 - RNA, 13 nt, Human
gugcucuccauuc

SEQ ID NO: 3460175 - RNA, 22 nt, Human
gugcucuccauucugcuccuuc

SEQ ID NO: 3460176 - RNA, 13 nt, Human
gugcucucugcca

SEQ ID NO: 3460177 - RNA, 13 nt, Human
gugcucuggacag

SEQ ID NO: 3460178 - RNA, 16 nt, Human
gugcucuuuucuccuc

SEQ ID NO: 3460179 - RNA, 20 nt, Human
gugcucuuuucuccucacug

SEQ ID NO: 3460180 - RNA, 15 nt, Human
gugcugaagcuuauu

SEQ ID NO: 3460181 - RNA, 20 nt, Human
gugcugaaugguuuucaaaa

SEQ ID NO: 3460182 - RNA, 19 nt, Human
gugcugaauguugggacug

SEQ ID NO: 3460183 - RNA, 15 nt, Human
gugcugacggccagg

SEQ ID NO: 3460184 - RNA, 21 nt, Human
gugcugacggccagggagaag

SEQ ID NO: 3460185 - RNA, 22 nt, Human
gugcugacgggacccacaugcu

SEQ ID NO: 3460186 - RNA, 13 nt, Human
gugcugagaagcu

SEQ ID NO: 3460187 - RNA, 14 nt, Human
gugcugagaagcuu

SEQ ID NO: 3460188 - RNA, 16 nt, Human
gugcugagucugaagg

SEQ ID NO: 3460189 - RNA, 17 nt, Human
uggcccuggcucugcug

SEQ ID NO: 3460190 - RNA, 23 nt, Human
uggcccugggagaaucgcuccug

SEQ ID NO: 3460191 - RNA, 12 nt, Human
uggcccuggggc

SEQ ID NO: 3460192 - RNA, 15 nt, Human
uggcccuggggccug

SEQ ID NO: 3460193 - RNA, 21 nt, Human
uggcccugggucccaggaccc

SEQ ID NO: 3460194 - RNA, 17 nt, Human
uggcccugucccuccca

SEQ ID NO: 3460195 - RNA, 21 nt, Human
uggcccuuaugacugccaaga

SEQ ID NO: 3460196 - RNA, 23 nt, Human
uggcccuugcaguucagcaccac

SEQ ID NO: 3460197 - RNA, 19 nt, Human
uggcccuugcuuaccucuc

SEQ ID NO: 3460198 - RNA, 13 nt, Human
uggcccuuuuaua

SEQ ID NO: 3460199 - RNA, 19 nt, Human
uggccgaggguccuggcuc

SEQ ID NO: 3460200 - RNA, 21 nt, Human
uggccgcaccuaaagcagcca

SEQ ID NO: 3460201 - RNA, 23 nt, Human
uggccgcaccuaaagcagccagc

SEQ ID NO: 3460202 - RNA, 21 nt, Human
uggccgcccccugccccccag

SEQ ID NO: 3460203 - RNA, 18 nt, Human
uggccgccucacccccuc

SEQ ID NO: 3460204 - RNA, 15 nt, Human
uggccgccugggucc

SEQ ID NO: 3460205 - RNA, 16 nt, Human
uggccgcgcuccgggc

SEQ ID NO: 3460206 - RNA, 17 nt, Human
uggccgcggagccugca

SEQ ID NO: 3460207 - RNA, 20 nt, Human
uggccggccagccagccacu

SEQ ID NO: 3460208 - RNA, 21 nt, Human
uggccggccagccagccacuc

SEQ ID NO: 3460209 - RNA, 13 nt, Human
uggccggcugugc

SEQ ID NO: 3460210 - RNA, 15 nt, Human
uggccggcugugcuc

SEQ ID NO: 3460211 - RNA, 17 nt, Human
uggccggcugugcucag

SEQ ID NO: 3460212 - RNA, 20 nt, Human
uggccggcugugcucagaga

SEQ ID NO: 3460213 - RNA, 15 nt, Human
uggccgggaccccga

SEQ ID NO: 3460214 - RNA, 15 nt, Human
uggccgggcacagcu

SEQ ID NO: 3460215 - RNA, 19 nt, Human
uggccgggcacagcugugg

SEQ ID NO: 3460216 - RNA, 18 nt, Human
uggccggucugcaaguca

SEQ ID NO: 3460217 - RNA, 20 nt, Human
uggccggucugcaagucaga

SEQ ID NO: 3460218 - RNA, 15 nt, Human
uggccuaaaaucuug

SEQ ID NO: 3460219 - RNA, 17 nt, Human
uggccuaaaaucuugga

SEQ ID NO: 3460220 - RNA, 16 nt, Human
uggccuaaccugccga

SEQ ID NO: 3460221 - RNA, 19 nt, Human
uggccuacaaaucaguaau

SEQ ID NO: 3460222 - RNA, 20 nt, Human
uggccuagcauacguacaca

SEQ ID NO: 3460223 - RNA, 14 nt, Human
uggccuagcccacc

SEQ ID NO: 3460224 - RNA, 16 nt, Human
uggccuauccgcugcc

SEQ ID NO: 3460225 - RNA, 17 nt, Human
uggccuaucuccuaggg

SEQ ID NO: 3460226 - RNA, 17 nt, Human
uggccuaugcacauaug

SEQ ID NO: 3460227 - RNA, 16 nt, Human
uggccuauguggucua

SEQ ID NO: 3460228 - RNA, 14 nt, Human
uggccucaacccuc

SEQ ID NO: 3460229 - RNA, 16 nt, Human
uggccucaacccuccc

SEQ ID NO: 3460230 - RNA, 13 nt, Human
uggccucaagauc

SEQ ID NO: 3460231 - RNA, 19 nt, Human
uggccucagacugcaccca

SEQ ID NO: 3460232 - RNA, 19 nt, Human
uggccucagcucccacaag

SEQ ID NO: 3460233 - RNA, 18 nt, Human
uggccucagcugaaugcc

SEQ ID NO: 3460234 - RNA, 13 nt, Human
uggccucaugugg

SEQ ID NO: 3460235 - RNA, 15 nt, Human
uggccucauguggcu

SEQ ID NO: 3460236 - RNA, 21 nt, Human
uggccuccaggcccgucuguc

SEQ ID NO: 3460237 - RNA, 19 nt, Human
uggccuccggcgucagccu

SEQ ID NO: 3460238 - RNA, 18 nt, Human
uggccuccucccuuagcu

SEQ ID NO: 3460239 - RNA, 19 nt, Human
uggccuccucccuuagcuc

SEQ ID NO: 3460240 - RNA, 21 nt, Human
uggccuccugccucuacuggg

SEQ ID NO: 3460241 - RNA, 15 nt, Human
uggccuccuugcuug

SEQ ID NO: 3460242 - RNA, 13 nt, Human
uggccucucuagc

SEQ ID NO: 3460243 - RNA, 14 nt, Human
uggccucucuaucc

SEQ ID NO: 3460244 - RNA, 22 nt, Human
uggccucucucuaggguacaug

SEQ ID NO: 3460245 - RNA, 14 nt, Human
uggccucugcacuc

SEQ ID NO: 3460246 - RNA, 12 nt, Human
uggccucugcuu

SEQ ID NO: 3460247 - RNA, 23 nt, Human
uggccucuguggagccccagcau

SEQ ID NO: 3460248 - RNA, 20 nt, Human
guggcucugggauccugggg

SEQ ID NO: 3460249 - RNA, 14 nt, Human
guggcugacccagu

SEQ ID NO: 3460250 - RNA, 17 nt, Human
guggcugacccaguccc

SEQ ID NO: 3460251 - RNA, 16 nt, Human
guggcugaccccccuc

SEQ ID NO: 3460252 - RNA, 22 nt, Human
guggcugaugguguggccugug

SEQ ID NO: 3460253 - RNA, 13 nt, Human
guggcugcagccu

SEQ ID NO: 3460254 - RNA, 18 nt, Human
guggcugcggcacccuug

SEQ ID NO: 3460255 - RNA, 12 nt, Human
guggcugcuuca

SEQ ID NO: 3460256 - RNA, 14 nt, Human
guggcugcuucaag

SEQ ID NO: 3460257 - RNA, 15 nt, Human
guggcugcuucaagg

SEQ ID NO: 3460258 - RNA, 19 nt, Human
guggcugcuucaaggaucc

SEQ ID NO: 3460259 - RNA, 11 nt, Human
guggcuggggg

SEQ ID NO: 3460260 - RNA, 17 nt, Human
guggcugguccagggcu

SEQ ID NO: 3460261 - RNA, 16 nt, Human
guggcuggugagccgg

SEQ ID NO: 3460262 - RNA, 14 nt, Human
guggcugucagcag

SEQ ID NO: 3460263 - RNA, 23 nt, Human
guggcuucacuccugcuguaaau

SEQ ID NO: 3460264 - RNA, 19 nt, Human
guggcuucagcuccagccc

SEQ ID NO: 3460265 - RNA, 18 nt, Human
guggcuucccaugucuuu

SEQ ID NO: 3460266 - RNA, 19 nt, Human
guggcuucccgcucagccc

SEQ ID NO: 3460267 - RNA, 20 nt, Human
guggcuucccgcucagcccu

SEQ ID NO: 3460268 - RNA, 21 nt, Human
guggcuucccgcucagcccuc

SEQ ID NO: 3460269 - RNA, 22 nt, Human
guggcuugagaaauauggacac

SEQ ID NO: 3460270 - RNA, 21 nt, Human
guggcuuggacucuuucccau

SEQ ID NO: 3460271 - RNA, 18 nt, Human
guggcuuucagccucugg

SEQ ID NO: 3460272 - RNA, 23 nt, Human
guggcuuuccuuguggcagagga

SEQ ID NO: 3460273 - RNA, 23 nt, Human
gugggaacgacugggcacugcca

SEQ ID NO: 3460274 - RNA, 23 nt, Human
gugggaaggacuuggcgcgcccu

SEQ ID NO: 3460275 - RNA, 14 nt, Human
gugggaaggccagc

SEQ ID NO: 3460276 - RNA, 15 nt, Human
gugggacacccugug

SEQ ID NO: 3460277 - RNA, 15 nt, Human
gugggacagagucug

SEQ ID NO: 3460278 - RNA, 13 nt, Human
gugggacagccca

SEQ ID NO: 3460279 - RNA, 22 nt, Human
gugggacccauagaucuucuga

SEQ ID NO: 3460280 - RNA, 15 nt, Human
gugggaccccaggcc

SEQ ID NO: 3460281 - RNA, 15 nt, Human
gugggagaaggcagu

SEQ ID NO: 3460282 - RNA, 23 nt, Human
gugggagaccggccugccaggag

SEQ ID NO: 3460283 - RNA, 19 nt, Human
gugggagcaaacugcaugc

SEQ ID NO: 3460284 - RNA, 19 nt, Human
gugggagcagcgguuuggg

SEQ ID NO: 3460285 - RNA, 22 nt, Human
gugggagcaggagauugagaag

SEQ ID NO: 3460286 - RNA, 12 nt, Human
gugggagccucg

SEQ ID NO: 3460287 - RNA, 13 nt, Human
gugggagccucgc

SEQ ID NO: 3460288 - RNA, 14 nt, Human
gugggagccucgca

SEQ ID NO: 3460289 - RNA, 15 nt, Human
gugggagcugccugu

SEQ ID NO: 3460290 - RNA, 23 nt, Human
gugggaggcuccuguuagcuccu

SEQ ID NO: 3460291 - RNA, 13 nt, Human
gugggagggagca

SEQ ID NO: 3460292 - RNA, 12 nt, Human
gugggaggggca

SEQ ID NO: 3460293 - RNA, 14 nt, Human
gugggaggggcagg

SEQ ID NO: 3460294 - RNA, 16 nt, Human
gugggaggggcaggcu

SEQ ID NO: 3460295 - RNA, 14 nt, Human
gugggagugugugc

SEQ ID NO: 3460296 - RNA, 14 nt, Human
gugggcaaaagagu

SEQ ID NO: 3460297 - RNA, 16 nt, Human
gugggcaaaagagugu

SEQ ID NO: 3460298 - RNA, 17 nt, Human
gugggcaaacaggcagu

SEQ ID NO: 3460299 - RNA, 17 nt, Human
gugggcaccaagagcca

SEQ ID NO: 3460300 - RNA, 20 nt, Human
gugggcacgcugugggcagg

SEQ ID NO: 3460301 - RNA, 21 nt, Human
gugggcacgcugugggcaggu

SEQ ID NO: 3460302 - RNA, 21 nt, Human
gugggcagagcccccaggaag

SEQ ID NO: 3460303 - RNA, 23 nt, Human
gugggcagcuuagggcccuggag

SEQ ID NO: 3460304 - RNA, 17 nt, Human
gugggcaggugguggca

SEQ ID NO: 3460305 - RNA, 12 nt, Human
gugggcccaccc

SEQ ID NO: 3460306 - RNA, 11 nt, Human
gugggcccagg

SEQ ID NO: 3460307 - RNA, 20 nt, Human
gugggcccaggaccagcugg

SEQ ID NO: 3460308 - RNA, 21 nt, Human
gugggcccaggaccagcuggg

SEQ ID NO: 3460309 - RNA, 18 nt, Human
gugggcccuccgacagcc

SEQ ID NO: 3460310 - RNA, 20 nt, Human
gugggccuccucuguccagg

SEQ ID NO: 3460311 - RNA, 14 nt, Human
gugggccucggccc

SEQ ID NO: 3460312 - RNA, 11 nt, Human
gugggccucug

SEQ ID NO: 3460313 - RNA, 22 nt, Human
gugggccucugguuuggggcga

SEQ ID NO: 3460314 - RNA, 23 nt, Human
gugggccucugguuuggggcgag

SEQ ID NO: 3460315 - RNA, 18 nt, Human
gugggcgggcagcacagc

SEQ ID NO: 3460316 - RNA, 17 nt, Human
gugggcguggucacugc

SEQ ID NO: 3460317 - RNA, 16 nt, Human
gugggcuacaugcugg

SEQ ID NO: 3460318 - RNA, 15 nt, Human
gugggcuccccucuu

SEQ ID NO: 3460319 - RNA, 20 nt, Human
gugggcuccccucuuccucu

SEQ ID NO: 3460320 - RNA, 13 nt, Human
gugggcucccuga

SEQ ID NO: 3460321 - RNA, 14 nt, Human
gugggcugagcccu

SEQ ID NO: 3460322 - RNA, 15 nt, Human
gugggcugggcccuc

SEQ ID NO: 3460323 - RNA, 13 nt, Human
gugggcugugagu

SEQ ID NO: 3460324 - RNA, 18 nt, Human
guggggagacaccucaga

SEQ ID NO: 3460325 - RNA, 13 nt, Human
guggggaggggcg

SEQ ID NO: 3460326 - RNA, 13 nt, Human
guggggagguguc

SEQ ID NO: 3460327 - RNA, 19 nt, Human
guggggaucucaggggcug

SEQ ID NO: 3460328 - RNA, 13 nt, Human
guggggcagaggc

SEQ ID NO: 3460329 - RNA, 12 nt, Human
guggggcagcac

SEQ ID NO: 3460330 - RNA, 17 nt, Human
guggggcagcuccucug

SEQ ID NO: 3460331 - RNA, 15 nt, Human
guggggcagggagcu

SEQ ID NO: 3460332 - RNA, 23 nt, Human
guggggcagugcuuggcccagga

SEQ ID NO: 3460333 - RNA, 21 nt, Human
guggggccaugccuccucagg

SEQ ID NO: 3460334 - RNA, 18 nt, Human
guggggcugcuccuccag

SEQ ID NO: 3460335 - RNA, 11 nt, Human
guggggcuggg

SEQ ID NO: 3460336 - RNA, 12 nt, Human
guggggcugggg

SEQ ID NO: 3460337 - RNA, 12 nt, Human
guggggcuuggg

SEQ ID NO: 3460338 - RNA, 19 nt, Human
gugggggaagagcacagcc

SEQ ID NO: 3460339 - RNA, 20 nt, Human
gugggggagagcaggcuggc

SEQ ID NO: 3460340 - RNA, 22 nt, Human
gugggggcagagggcagaggcu

SEQ ID NO: 3460341 - RNA, 19 nt, Human
gugggggccccgucucagg

SEQ ID NO: 3460342 - RNA, 20 nt, Human
gugggggccccgucucaggu

SEQ ID NO: 3460343 - RNA, 15 nt, Human
gugggggggcagagc

SEQ ID NO: 3460344 - RNA, 19 nt, Human
guggggggucccaaagagu

SEQ ID NO: 3460345 - RNA, 12 nt, Human
gugggggugggu

SEQ ID NO: 3460346 - RNA, 15 nt, Human
gugggggugggucag

SEQ ID NO: 3460347 - RNA, 17 nt, Human
guggggucacucuggca

SEQ ID NO: 3460348 - RNA, 20 nt, Human
guggggucacucuggcagcu

SEQ ID NO: 3460349 - RNA, 19 nt, Human
guggggucaugcccuccuc

SEQ ID NO: 3460350 - RNA, 14 nt, Human
guggggucucccuc

SEQ ID NO: 3460351 - RNA, 21 nt, Human
guggggucucccucuccugcc

SEQ ID NO: 3460352 - RNA, 18 nt, Human
guggggugacgggacuca

SEQ ID NO: 3460353 - RNA, 18 nt, Human
gugggguggcugcagccu

SEQ ID NO: 3460354 - RNA, 16 nt, Human
gugggguggugucaga

SEQ ID NO: 3460355 - RNA, 13 nt, Human
guggggugugcug

SEQ ID NO: 3460356 - RNA, 19 nt, Human
guggggugugcugggagcu

SEQ ID NO: 3460357 - RNA, 14 nt, Human
gugggguuuccugg

SEQ ID NO: 3460358 - RNA, 18 nt, Human
gugggguuucgcagccug

SEQ ID NO: 3460359 - RNA, 22 nt, Human
gugggguuucgcagccugaguc

SEQ ID NO: 3460360 - RNA, 13 nt, Human
guggguaaaauua

SEQ ID NO: 3460361 - RNA, 22 nt, Human
guggguaagacuaaaucuguaa

SEQ ID NO: 3460362 - RNA, 15 nt, Human
guggguacagagagg

SEQ ID NO: 3460363 - RNA, 17 nt, Human
guggguacuauucugau

SEQ ID NO: 3460364 - RNA, 20 nt, Human
guggguagaucacgagauca

SEQ ID NO: 3460365 - RNA, 16 nt, Human
guggguauaaaagaug

SEQ ID NO: 3460366 - RNA, 18 nt, Human
guggguccaugggcagag

SEQ ID NO: 3460367 - RNA, 22 nt, Human
guggguccaugggcagagccca

SEQ ID NO: 3460368 - RNA, 13 nt, Human
gugggucugggag

SEQ ID NO: 3460369 - RNA, 13 nt, Human
gugggugaaagaa

SEQ ID NO: 3460370 - RNA, 20 nt, Human
gugggugaaagaaaucaugu

SEQ ID NO: 3460371 - RNA, 21 nt, Human
gugggugaaagaaaucauguu

SEQ ID NO: 3460372 - RNA, 13 nt, Human
gugggugccuagg

SEQ ID NO: 3460373 - RNA, 18 nt, Human
guggguggauauaaauau

SEQ ID NO: 3460374 - RNA, 12 nt, Human
guggguggugga

SEQ ID NO: 3460375 - RNA, 15 nt, Human
gugggugugagcagc

SEQ ID NO: 3460376 - RNA, 16 nt, Human
guggguuauucuggag

SEQ ID NO: 3460377 - RNA, 14 nt, Human
guggguuccacaga

SEQ ID NO: 3460378 - RNA, 18 nt, Human
guggguuuuuuaguugaa

SEQ ID NO: 3460379 - RNA, 22 nt, Human
gugguaaaugccacacaccuuu

SEQ ID NO: 3460380 - RNA, 12 nt, Human
gugguaacccug

SEQ ID NO: 3460381 - RNA, 16 nt, Human
gugguacagagaagcc

SEQ ID NO: 3460382 - RNA, 22 nt, Human
gugguacagagaagccagcuug

SEQ ID NO: 3460383 - RNA, 23 nt, Human
gugguacagagaagccagcuugu

SEQ ID NO: 3460384 - RNA, 12 nt, Human
gugguagaaaca

SEQ ID NO: 3460385 - RNA, 17 nt, Human
gugguagagugugccug

SEQ ID NO: 3460386 - RNA, 22 nt, Human
gugguaggccuuuuaacauuuu

SEQ ID NO: 3460387 - RNA, 23 nt, Human
gugguaggccuuuuaacauuuug

SEQ ID NO: 3460388 - RNA, 23 nt, Human
gugguagguacuuuuugugaaga

SEQ ID NO: 3460389 - RNA, 19 nt, Human
gugguaguaaaacacagag

SEQ ID NO: 3460390 - RNA, 12 nt, Human
gugguaugugug

SEQ ID NO: 3460391 - RNA, 15 nt, Human
gugguaugugugugu

SEQ ID NO: 3460392 - RNA, 16 nt, Human
guggucacagcggagg

SEQ ID NO: 3460393 - RNA, 16 nt, Human
guuacaguaugcuugc

SEQ ID NO: 3460394 - RNA, 17 nt, Human
guuacaguaugcuugcu

SEQ ID NO: 3460395 - RNA, 14 nt, Human
guuacaguucugug

SEQ ID NO: 3460396 - RNA, 20 nt, Human
guuacauauuauauguucua

SEQ ID NO: 3460397 - RNA, 23 nt, Human
guuacaugcauacuucaaaagua

SEQ ID NO: 3460398 - RNA, 16 nt, Human
guuacauguuugcacc

SEQ ID NO: 3460399 - RNA, 14 nt, Human
guuacauuaauguu

SEQ ID NO: 3460400 - RNA, 21 nt, Human
guuacauuuuuaagugcugca

SEQ ID NO: 3460401 - RNA, 23 nt, Human
guuaccacacaucuaugauauaa

SEQ ID NO: 3460402 - RNA, 21 nt, Human
guuaccauauuuauccauuug

SEQ ID NO: 3460403 - RNA, 18 nt, Human
guuaccaugucacugugg

SEQ ID NO: 3460404 - RNA, 16 nt, Human
guuaccauuaaaccau

SEQ ID NO: 3460405 - RNA, 23 nt, Human
guuaccauuuugggguacccacu

SEQ ID NO: 3460406 - RNA, 13 nt, Human
guuacccagagaa

SEQ ID NO: 3460407 - RNA, 16 nt, Human
guuaccuaaaguauuu

SEQ ID NO: 3460408 - RNA, 19 nt, Human
guuaccuaauuagagcaga

SEQ ID NO: 3460409 - RNA, 13 nt, Human
guuaccuacuuug

SEQ ID NO: 3460410 - RNA, 16 nt, Human
guuaccuacuuugacu

SEQ ID NO: 3460411 - RNA, 23 nt, Human
guuaccucugccucagaaaacaa

SEQ ID NO: 3460412 - RNA, 22 nt, Human
guuaccugaaaacacugugcac

SEQ ID NO: 3460413 - RNA, 15 nt, Human
guuaccuuauaguua

SEQ ID NO: 3460414 - RNA, 18 nt, Human
guuaccuuauaguuacug

SEQ ID NO: 3460415 - RNA, 22 nt, Human
guuaccuuauaguuacugugua

SEQ ID NO: 3460416 - RNA, 16 nt, Human
guuacuaacuaaacuc

SEQ ID NO: 3460417 - RNA, 14 nt, Human
guuacuaagaagaa

SEQ ID NO: 3460418 - RNA, 20 nt, Human
guuacuagguaacuucauau

SEQ ID NO: 3460419 - RNA, 13 nt, Human
guuacuauaugcc

SEQ ID NO: 3460420 - RNA, 15 nt, Human
guuacuauccuggcu

SEQ ID NO: 3460421 - RNA, 14 nt, Human
guuacuaucugcuu

SEQ ID NO: 3460422 - RNA, 12 nt, Human
guuacuauuuuc

SEQ ID NO: 3460423 - RNA, 14 nt, Human
guuacucagcccug

SEQ ID NO: 3460424 - RNA, 17 nt, Human
guuacucagcccugggc

SEQ ID NO: 3460425 - RNA, 18 nt, Human
guuacucagcccugggcc

SEQ ID NO: 3460426 - RNA, 16 nt, Human
guuacuccagugccaa

SEQ ID NO: 3460427 - RNA, 22 nt, Human
guuacuccagugccaacaaucc

SEQ ID NO: 3460428 - RNA, 14 nt, Human
guuacucuccaacc

SEQ ID NO: 3460429 - RNA, 21 nt, Human
guuacucucuuccacauguua

SEQ ID NO: 3460430 - RNA, 11 nt, Human
guuacucugaa

SEQ ID NO: 3460431 - RNA, 23 nt, Human
guuacucuucaguuaagccuuug

SEQ ID NO: 3460432 - RNA, 19 nt, Human
guuacugaucaugcauugu

SEQ ID NO: 3460433 - RNA, 21 nt, Human
guuacugccuuaauaaaaaau

SEQ ID NO: 3460434 - RNA, 19 nt, Human
guuacuggauaaauuguuu

SEQ ID NO: 3460435 - RNA, 14 nt, Human
guuacugggcccug

SEQ ID NO: 3460436 - RNA, 17 nt, Human
guuacugggcccugagu

SEQ ID NO: 3460437 - RNA, 14 nt, Human
guuacuguaaaaug

SEQ ID NO: 3460438 - RNA, 17 nt, Human
guuacuguguaaacuca

SEQ ID NO: 3460439 - RNA, 18 nt, Human
guuacuguguaaacucau

SEQ ID NO: 3460440 - RNA, 18 nt, Human
guuacuguuaaccauuua

SEQ ID NO: 3460441 - RNA, 16 nt, Human
guuacuguuauagagg

SEQ ID NO: 3460442 - RNA, 10 nt, Human
guuacuguuc

SEQ ID NO: 3460443 - RNA, 17 nt, Human
guuacuguucuugcugc

SEQ ID NO: 3460444 - RNA, 21 nt, Human
guuacuguucuugcugcuaga

SEQ ID NO: 3460445 - RNA, 23 nt, Human
guuacuguucuugcugcuagaac

SEQ ID NO: 3460446 - RNA, 16 nt, Human
guuacuguugugaccu

SEQ ID NO: 3460447 - RNA, 16 nt, Human
guuacuucacuuuaau

SEQ ID NO: 3460448 - RNA, 13 nt, Human
guuacuuccuauc

SEQ ID NO: 3460449 - RNA, 18 nt, Human
guuacuuuucauauuugc

SEQ ID NO: 3460450 - RNA, 19 nt, Human
guuagaaaugcagaauccu

SEQ ID NO: 3460451 - RNA, 21 nt, Human
guuagaacacuauuuucagaa

SEQ ID NO: 3460452 - RNA, 22 nt, Human
guuagaacacuauuuucagaau

SEQ ID NO: 3460453 - RNA, 12 nt, Human
guuagaauuccu

SEQ ID NO: 3460454 - RNA, 20 nt, Human
guuagaauuccuucagggug

SEQ ID NO: 3460455 - RNA, 14 nt, Human
guuagaccuacagg

SEQ ID NO: 3460456 - RNA, 18 nt, Human
guuagacucuuacuuuuu

SEQ ID NO: 3460457 - RNA, 21 nt, Human
guuagagagggaccauguguc

SEQ ID NO: 3460458 - RNA, 23 nt, Human
guuagagagggaccaugugucac

SEQ ID NO: 3460459 - RNA, 13 nt, Human
guuagagaugccu

SEQ ID NO: 3460460 - RNA, 10 nt, Human
guuagagcac

SEQ ID NO: 3460461 - RNA, 22 nt, Human
guuagagguuuuaaagugauua

SEQ ID NO: 3460462 - RNA, 21 nt, Human
guuagauauagagucauugua

SEQ ID NO: 3460463 - RNA, 14 nt, Human
ugguguccugacca

SEQ ID NO: 3460464 - RNA, 18 nt, Human
uggugucgcgccuucucc

SEQ ID NO: 3460465 - RNA, 17 nt, Human
uggugucucuucuuuag

SEQ ID NO: 3460466 - RNA, 16 nt, Human
uggugugaacccggga

SEQ ID NO: 3460467 - RNA, 23 nt, Human
uggugugaacuaaacuuucacac

SEQ ID NO: 3460468 - RNA, 12 nt, Human
uggugugaaggu

SEQ ID NO: 3460469 - RNA, 23 nt, Human
uggugugaccacugcagaagaca

SEQ ID NO: 3460470 - RNA, 17 nt, Human
uggugugaccugagggc

SEQ ID NO: 3460471 - RNA, 17 nt, Human
uggugugaguaucagaa

SEQ ID NO: 3460472 - RNA, 19 nt, Human
uggugugaguaucagaauu

SEQ ID NO: 3460473 - RNA, 16 nt, Human
uggugugaucgucuga

SEQ ID NO: 3460474 - RNA, 12 nt, Human
uggugugaucuu

SEQ ID NO: 3460475 - RNA, 14 nt, Human
uggugugcugaggu

SEQ ID NO: 3460476 - RNA, 15 nt, Human
ugguguggguguccu

SEQ ID NO: 3460477 - RNA, 17 nt, Human
ugguguggguguccugc

SEQ ID NO: 3460478 - RNA, 16 nt, Human
uggugugguacagaga

SEQ ID NO: 3460479 - RNA, 19 nt, Human
uggugugguacagagaagc

SEQ ID NO: 3460480 - RNA, 23 nt, Human
uggugugguacagagaagccagc

SEQ ID NO: 3460481 - RNA, 21 nt, Human
ugguguguuggacagagaagg

SEQ ID NO: 3460482 - RNA, 22 nt, Human
ugguguucuccugcugcucccu

SEQ ID NO: 3460483 - RNA, 23 nt, Human
ugguguucuccugcugcucccuc

SEQ ID NO: 3460484 - RNA, 22 nt, Human
ugguguugccaguuguccuccu

SEQ ID NO: 3460485 - RNA, 20 nt, Human
ugguguuggacaagcuucug

SEQ ID NO: 3460486 - RNA, 16 nt, Human
ugguguuguaugccuu

SEQ ID NO: 3460487 - RNA, 18 nt, Human
ugguguuucuagcacugg

SEQ ID NO: 3460488 - RNA, 18 nt, Human
ugguguuuuggauuugga

SEQ ID NO: 3460489 - RNA, 20 nt, Human
ugguuaaaaaaaagaauaaa

SEQ ID NO: 3460490 - RNA, 19 nt, Human
ugguuaaauaaggcagggu

SEQ ID NO: 3460491 - RNA, 16 nt, Human
ugguuaagaguccaag

SEQ ID NO: 3460492 - RNA, 18 nt, Human
ugguuaagucuguuuuau

SEQ ID NO: 3460493 - RNA, 21 nt, Human
ugguuaaguuggcuucuguuu

SEQ ID NO: 3460494 - RNA, 17 nt, Human
ugguuaaucuuuccuga

SEQ ID NO: 3460495 - RNA, 14 nt, Human
ugguuacacuguua

SEQ ID NO: 3460496 - RNA, 23 nt, Human
ugguuacacuguuagaacacuau

SEQ ID NO: 3460497 - RNA, 21 nt, Human
ugguuacuucuucucuuagau

SEQ ID NO: 3460498 - RNA, 12 nt, Human
ugguuaggaugg

SEQ ID NO: 3460499 - RNA, 16 nt, Human
ugguuauaacuuaaug

SEQ ID NO: 3460500 - RNA, 21 nt, Human
ugguuauacaugacacugaaa

SEQ ID NO: 3460501 - RNA, 18 nt, Human
ugguuauagugcaauaua

SEQ ID NO: 3460502 - RNA, 19 nt, Human
ugguuauagugcaauauau

SEQ ID NO: 3460503 - RNA, 20 nt, Human
ugguuauagugcaauauauu

SEQ ID NO: 3460504 - RNA, 21 nt, Human
ugguuauagugcaauauauuu

SEQ ID NO: 3460505 - RNA, 14 nt, Human
ugguuaucacacca

SEQ ID NO: 3460506 - RNA, 13 nt, Human
ugguuauuucucu

SEQ ID NO: 3460507 - RNA, 18 nt, Human
ugguuauuuuacuuuuug

SEQ ID NO: 3460508 - RNA, 17 nt, Human
ugguuauuuuuauacag

SEQ ID NO: 3460509 - RNA, 18 nt, Human
ugguuauuuuuauacagu

SEQ ID NO: 3460510 - RNA, 15 nt, Human
ugguucacacugacc

SEQ ID NO: 3460511 - RNA, 17 nt, Human
ugguucacucuuggagc

SEQ ID NO: 3460512 - RNA, 22 nt, Human
ugguucacucuuggagccugca

SEQ ID NO: 3460513 - RNA, 20 nt, Human
ugguucagaauuaaacuuuu

SEQ ID NO: 3460514 - RNA, 16 nt, Human
ugguucagcuaagcua

SEQ ID NO: 3460515 - RNA, 22 nt, Human
ugguucaggguuggccccugcc

SEQ ID NO: 3460516 - RNA, 16 nt, Human
ugguucauuaauucua

SEQ ID NO: 3460517 - RNA, 17 nt, Human
ugguuccaagcccugga

SEQ ID NO: 3460518 - RNA, 15 nt, Human
ugguuccagccugcc

SEQ ID NO: 3460519 - RNA, 12 nt, Human
ugguuccagggu

SEQ ID NO: 3460520 - RNA, 22 nt, Human
ugguuccagggucccucugugu

SEQ ID NO: 3460521 - RNA, 15 nt, Human
ugguuccaugccuga

SEQ ID NO: 3460522 - RNA, 22 nt, Human
ugguuccaugccugagggugga

SEQ ID NO: 3460523 - RNA, 16 nt, Human
ugguuccccaguagag

SEQ ID NO: 3460524 - RNA, 20 nt, Human
ugguuccccuguucacucua

SEQ ID NO: 3460525 - RNA, 16 nt, Human
ugguucccuugaugaa

SEQ ID NO: 3460526 - RNA, 20 nt, Human
ugguucccuugaugaagaag

SEQ ID NO: 3460527 - RNA, 18 nt, Human
ugguuccuccccuccucc

SEQ ID NO: 3460528 - RNA, 15 nt, Human
ugguuccucucuggu

SEQ ID NO: 3460529 - RNA, 13 nt, Human
ugguuccucugcu

SEQ ID NO: 3460530 - RNA, 23 nt, Human
ugguuccuggggugcccuccacu

SEQ ID NO: 3460531 - RNA, 17 nt, Human
ugguuccuuucucagcc

SEQ ID NO: 3460532 - RNA, 14 nt, Human
ugguucuacaaucu

SEQ ID NO: 3460533 - RNA, 16 nt, Human
ugguucuauuuaaugg

SEQ ID NO: 3460534 - RNA, 14 nt, Human
ugguucucaaugaa

SEQ ID NO: 3460535 - RNA, 11 nt, Human
ugguucucauc

SEQ ID NO: 3460536 - RNA, 13 nt, Human
ugguucucaucuu

SEQ ID NO: 3460537 - RNA, 20 nt, Human
uggacccugaggcccagagg

SEQ ID NO: 3460538 - RNA, 23 nt, Human
uggacccuguggaugauaaaaca

SEQ ID NO: 3460539 - RNA, 16 nt, Human
uggacccuuauaaaau

SEQ ID NO: 3460540 - RNA, 13 nt, Human
uggacccuuccau

SEQ ID NO: 3460541 - RNA, 18 nt, Human
uggaccggagaguggggg

SEQ ID NO: 3460542 - RNA, 21 nt, Human
uggaccuaaauggccucaugu

SEQ ID NO: 3460543 - RNA, 13 nt, Human
uggaccuaacauu

SEQ ID NO: 3460544 - RNA, 13 nt, Human
uggaccucugcuc

SEQ ID NO: 3460545 - RNA, 16 nt, Human
uggaccugccuccugc

SEQ ID NO: 3460546 - RNA, 23 nt, Human
uggaccuguauauuuguaaagcu

SEQ ID NO: 3460547 - RNA, 16 nt, Human
uggaccuuaggccuuc

SEQ ID NO: 3460548 - RNA, 12 nt, Human
uggaccuuccug

SEQ ID NO: 3460549 - RNA, 20 nt, Human
uggaccuugaacuggguacu

SEQ ID NO: 3460550 - RNA, 16 nt, Human
uggaccuugagaccac

SEQ ID NO: 3460551 - RNA, 13 nt, Human
uggaccuuuuaaa

SEQ ID NO: 3460552 - RNA, 13 nt, Human
uggacggcaggcu

SEQ ID NO: 3460553 - RNA, 16 nt, Human
uggacggggacugggg

SEQ ID NO: 3460554 - RNA, 16 nt, Human
uggacggugcuccagg

SEQ ID NO: 3460555 - RNA, 14 nt, Human
uggacgucuuucuu

SEQ ID NO: 3460556 - RNA, 23 nt, Human
uggacguguuaugacuccagaau

SEQ ID NO: 3460557 - RNA, 17 nt, Human
uggacguucggggcaug

SEQ ID NO: 3460558 - RNA, 15 nt, Human
uggacuaaaagauau

SEQ ID NO: 3460559 - RNA, 14 nt, Human
uggacuaaaugccu

SEQ ID NO: 3460560 - RNA, 21 nt, Human
uggacuaaccccaacgcacag

SEQ ID NO: 3460561 - RNA, 21 nt, Human
uggacuagagggaccucuccc

SEQ ID NO: 3460562 - RNA, 15 nt, Human
uggacuaucugucug

SEQ ID NO: 3460563 - RNA, 22 nt, Human
uggacuauggagugcaccaaag

SEQ ID NO: 3460564 - RNA, 19 nt, Human
uggacucaaucccuagggc

SEQ ID NO: 3460565 - RNA, 17 nt, Human
uggacucaccuccccca

SEQ ID NO: 3460566 - RNA, 18 nt, Human
uggacucagggcagcgcc

SEQ ID NO: 3460567 - RNA, 19 nt, Human
uggacuccagacucucugu

SEQ ID NO: 3460568 - RNA, 23 nt, Human
uggacuccagccugccuggcagg

SEQ ID NO: 3460569 - RNA, 14 nt, Human
uggacuccggcccu

SEQ ID NO: 3460570 - RNA, 13 nt, Human
uggacuccucugu

SEQ ID NO: 3460571 - RNA, 14 nt, Human
uggacuccucuguc

SEQ ID NO: 3460572 - RNA, 15 nt, Human
uggacuccucugucc

SEQ ID NO: 3460573 - RNA, 21 nt, Human
uggacucuaaagaccaaacuu

SEQ ID NO: 3460574 - RNA, 20 nt, Human
uggacucucagucucugagc

SEQ ID NO: 3460575 - RNA, 22 nt, Human
uggacucucagucucugagcag

SEQ ID NO: 3460576 - RNA, 16 nt, Human
uggacucuccccucuu

SEQ ID NO: 3460577 - RNA, 13 nt, Human
uggacucugcaca

SEQ ID NO: 3460578 - RNA, 18 nt, Human
uggacucugcacaugucu

SEQ ID NO: 3460579 - RNA, 22 nt, Human
uggacucugcacaugucuugua

SEQ ID NO: 3460580 - RNA, 16 nt, Human
uggacucugcauccca

SEQ ID NO: 3460581 - RNA, 13 nt, Human
uggacucuguccu

SEQ ID NO: 3460582 - RNA, 17 nt, Human
uggacucuguccugaag

SEQ ID NO: 3460583 - RNA, 22 nt, Human
uggacucuguccugaaggccug

SEQ ID NO: 3460584 - RNA, 20 nt, Human
uggacucuucaaaaacuguu

SEQ ID NO: 3460585 - RNA, 12 nt, Human
uggacucuugcu

SEQ ID NO: 3460586 - RNA, 14 nt, Human
uggacucuugcucu

SEQ ID NO: 3460587 - RNA, 15 nt, Human
uggacucuugcucuu

SEQ ID NO: 3460588 - RNA, 19 nt, Human
uggacugaagccugcagga

SEQ ID NO: 3460589 - RNA, 14 nt, Human
uggacugacagcau

SEQ ID NO: 3460590 - RNA, 22 nt, Human
uggacugacagcaugugcccuc

SEQ ID NO: 3460591 - RNA, 23 nt, Human
uggacugacagcaugugcccucc

SEQ ID NO: 3460592 - RNA, 20 nt, Human
uggacugagggggccuggau

SEQ ID NO: 3460593 - RNA, 23 nt, Human
uggacugagggggccuggaugcc

SEQ ID NO: 3460594 - RNA, 13 nt, Human
uggacugcagaag

SEQ ID NO: 3460595 - RNA, 23 nt, Human
uggacugcuaccuuucaaagcuu

SEQ ID NO: 3460596 - RNA, 16 nt, Human
uggacuggaguggagc

SEQ ID NO: 3460597 - RNA, 22 nt, Human
uggacuggcuagaguccucacu

SEQ ID NO: 3460598 - RNA, 19 nt, Human
uggacuguggugacuuugg

SEQ ID NO: 3460599 - RNA, 22 nt, Human
uggacuguggugacuuuggaua

SEQ ID NO: 3460600 - RNA, 15 nt, Human
uggacugugugcuca

SEQ ID NO: 3460601 - RNA, 17 nt, Human
uggacuguucccugagg

SEQ ID NO: 3460602 - RNA, 20 nt, Human
uggacuguuuucucucggcu

SEQ ID NO: 3460603 - RNA, 22 nt, Human
uggacuguuuucucucggcucc

SEQ ID NO: 3460604 - RNA, 18 nt, Human
uggacuuagaaagcaggg

SEQ ID NO: 3460605 - RNA, 20 nt, Human
uggacuuagaaagcaggggc

SEQ ID NO: 3460606 - RNA, 13 nt, Human
uggacuuaggaag

SEQ ID NO: 3460607 - RNA, 17 nt, Human
uggacuuauuucuucaa

SEQ ID NO: 3460608 - RNA, 19 nt, Human
uggacuucaaagcaagcug

SEQ ID NO: 3460609 - RNA, 22 nt, Human
uggacuucacauaagcucagaa

SEQ ID NO: 3460610 - RNA, 19 nt, Human
uggacuucuggaugcccau

SEQ ID NO: 3460611 - RNA, 18 nt, Human
uggacuugaggauuuuga

SEQ ID NO: 3460612 - RNA, 14 nt, Human
uggacuuguauauu

SEQ ID NO: 3460613 - RNA, 18 nt, Human
uggacuuguauauuugua

SEQ ID NO: 3460614 - RNA, 21 nt, Human
uggacuuguauauuuguacaa

SEQ ID NO: 3460615 - RNA, 20 nt, Human
uggacuuguccucagcagcu

SEQ ID NO: 3460616 - RNA, 16 nt, Human
uggacuuucaaaauua

SEQ ID NO: 3460617 - RNA, 13 nt, Human
uggacuuuccugc

SEQ ID NO: 3460618 - RNA, 18 nt, Human
uggacuuuccugcaacuc

SEQ ID NO: 3460619 - RNA, 23 nt, Human
uggacuuucucuaauaauaaaua

SEQ ID NO: 3460620 - RNA, 15 nt, Human
uggacuuuggaagca

SEQ ID NO: 3460621 - RNA, 14 nt, Human
uggacuuuguuaca

SEQ ID NO: 3460622 - RNA, 19 nt, Human
uggacuuuucguuaacauu

SEQ ID NO: 3460623 - RNA, 20 nt, Human
uggacuuuucguuaacauug

SEQ ID NO: 3460624 - RNA, 17 nt, Human
uggagaaacccuugaaa

SEQ ID NO: 3460625 - RNA, 14 nt, Human
uggagaaagcacug

SEQ ID NO: 3460626 - RNA, 23 nt, Human
uggagaaagcugacuuggcuggu

SEQ ID NO: 3460627 - RNA, 23 nt, Human
uggagaaauaaaaauaccucuuu

SEQ ID NO: 3460628 - RNA, 13 nt, Human
uguaaaacaggua

SEQ ID NO: 3460629 - RNA, 22 nt, Human
uguaaaacagguagaauuaucu

SEQ ID NO: 3460630 - RNA, 12 nt, Human
uguaaaacgcug

SEQ ID NO: 3460631 - RNA, 13 nt, Human
uguaaaacuuuau

SEQ ID NO: 3460632 - RNA, 14 nt, Human
uguaaaacuuuauu

SEQ ID NO: 3460633 - RNA, 22 nt, Human
uguaaaaggccaaaccucuguu

SEQ ID NO: 3460634 - RNA, 17 nt, Human
uguaaaauagcuuguau

SEQ ID NO: 3460635 - RNA, 19 nt, Human
uguaaaauauagcuguaca

SEQ ID NO: 3460636 - RNA, 20 nt, Human
uguaaaauauuuugaaucaa

SEQ ID NO: 3460637 - RNA, 12 nt, Human
uguaaaaucuug

SEQ ID NO: 3460638 - RNA, 18 nt, Human
uguaaaaucuugucaugu

SEQ ID NO: 3460639 - RNA, 14 nt, Human
uguaaaaucuuucu

SEQ ID NO: 3460640 - RNA, 22 nt, Human
uguaaaaucuuucuuucuuaga

SEQ ID NO: 3460641 - RNA, 13 nt, Human
uguaaaaugcaaa

SEQ ID NO: 3460642 - RNA, 21 nt, Human
uguaaaaugcaaaaaaucuua

SEQ ID NO: 3460643 - RNA, 12 nt, Human
uguaaaauggug

SEQ ID NO: 3460644 - RNA, 14 nt, Human
uguaaaauguaaug

SEQ ID NO: 3460645 - RNA, 13 nt, Human
uguaaaauguauu

SEQ ID NO: 3460646 - RNA, 20 nt, Human
uguaaaaugugaagugaaug

SEQ ID NO: 3460647 - RNA, 17 nt, Human
uguaaaauuucacuuaa

SEQ ID NO: 3460648 - RNA, 14 nt, Human
uguaaacaaaucuu

SEQ ID NO: 3460649 - RNA, 19 nt, Human
uguaaacaaaucuuuccau

SEQ ID NO: 3460650 - RNA, 11 nt, Human
uguaaacacag

SEQ ID NO: 3460651 - RNA, 18 nt, Human
uguaaacacagucaaaau

SEQ ID NO: 3460652 - RNA, 20 nt, Human
uguaaacacaucuaguaguu

SEQ ID NO: 3460653 - RNA, 17 nt, Human
uguaaacacucagcugu

SEQ ID NO: 3460654 - RNA, 20 nt, Human
uguaaacaggagacaggaag

SEQ ID NO: 3460655 - RNA, 14 nt, Human
uguaaacagugccu

SEQ ID NO: 3460656 - RNA, 19 nt, Human
uguaaacagugccugcuga

SEQ ID NO: 3460657 - RNA, 12 nt, Human
uguaaaccaaag

SEQ ID NO: 3460658 - RNA, 13 nt, Human
uguaaaccaaagc

SEQ ID NO: 3460659 - RNA, 14 nt, Human
uguaaaccaaagcc

SEQ ID NO: 3460660 - RNA, 14 nt, Human
uguaaaccaauuuu

SEQ ID NO: 3460661 - RNA, 22 nt, Human
uguaaaccacaaggcuguugca

SEQ ID NO: 3460662 - RNA, 19 nt, Human
uguaaaccgcuuuggccug

SEQ ID NO: 3460663 - RNA, 19 nt, Human
uguaaaccugagucguaca

SEQ ID NO: 3460664 - RNA, 19 nt, Human
uguaaacgacaagaauaau

SEQ ID NO: 3460665 - RNA, 22 nt, Human
uguaaacucaaaacuuaacaua

SEQ ID NO: 3460666 - RNA, 20 nt, Human
uguaaacucaaaauauuugu

SEQ ID NO: 3460667 - RNA, 14 nt, Human
uguaaacugccaua

SEQ ID NO: 3460668 - RNA, 22 nt, Human
uguaaacugccauauauaacag

SEQ ID NO: 3460669 - RNA, 18 nt, Human
uguaaacuguacuagucu

SEQ ID NO: 3460670 - RNA, 22 nt, Human
uguaaacuguacuagucugugu

SEQ ID NO: 3460671 - RNA, 19 nt, Human
uguaaacuguuucuuuaaa

SEQ ID NO: 3460672 - RNA, 22 nt, Human
uguaaacuguuucuuuaaaauu

SEQ ID NO: 3460673 - RNA, 12 nt, Human
uguaaacuuuga

SEQ ID NO: 3460674 - RNA, 13 nt, Human
uguaaacuuugaa

SEQ ID NO: 3460675 - RNA, 15 nt, Human
uguaaacuuugaaau

SEQ ID NO: 3460676 - RNA, 16 nt, Human
uguaaacuuugaaaua

SEQ ID NO: 3460677 - RNA, 13 nt, Human
uguaaacuuuuug

SEQ ID NO: 3460678 - RNA, 13 nt, Human
uguaaagaaaaau

SEQ ID NO: 3460679 - RNA, 15 nt, Human
uguaaagaaaaauau

SEQ ID NO: 3460680 - RNA, 14 nt, Human
uguaaagaaagaga

SEQ ID NO: 3460681 - RNA, 18 nt, Human
uguaaagaaagagagaaa

SEQ ID NO: 3460682 - RNA, 20 nt, Human
guuuaagccaaaacaauguu

SEQ ID NO: 3460683 - RNA, 14 nt, Human
guuuaauauuaaag

SEQ ID NO: 3460684 - RNA, 15 nt, Human
guuuaauauugagaa

SEQ ID NO: 3460685 - RNA, 18 nt, Human
uggcagccgugccuucag

SEQ ID NO: 3460686 - RNA, 21 nt, Human
uggcagccgugccuucagcuc

SEQ ID NO: 3460687 - RNA, 19 nt, Human
uggcagccucccauccagg

SEQ ID NO: 3460688 - RNA, 13 nt, Human
uggcagccuuggc

SEQ ID NO: 3460689 - RNA, 17 nt, Human
uggcagccuuggcaaac

SEQ ID NO: 3460690 - RNA, 21 nt, Human
uggcagcucaccucucccuug

SEQ ID NO: 3460691 - RNA, 15 nt, Human
uggcagcucagagag

SEQ ID NO: 3460692 - RNA, 16 nt, Human
uggcagcucagagagg

SEQ ID NO: 3460693 - RNA, 18 nt, Human
uggcagcucagagagggu

SEQ ID NO: 3460694 - RNA, 16 nt, Human
uggcagcugccacgcc

SEQ ID NO: 3460695 - RNA, 17 nt, Human
uggcagcugccacgccg

SEQ ID NO: 3460696 - RNA, 17 nt, Human
uggcagcugcgguccac

SEQ ID NO: 3460697 - RNA, 23 nt, Human
uggcagcugcgguccacccagga

SEQ ID NO: 3460698 - RNA, 14 nt, Human
uggcagcugucuca

SEQ ID NO: 3460699 - RNA, 15 nt, Human
uggcaggaaggcuug

SEQ ID NO: 3460700 - RNA, 16 nt, Human
uggcaggaccaggacu

SEQ ID NO: 3460701 - RNA, 21 nt, Human
uggcaggcagaggcccaggcu

SEQ ID NO: 3460702 - RNA, 20 nt, Human
uggcaggcaggcucccaggg

SEQ ID NO: 3460703 - RNA, 21 nt, Human
uggcaggcaggggcccugcag

SEQ ID NO: 3460704 - RNA, 12 nt, Human
uggcaggcuggc

SEQ ID NO: 3460705 - RNA, 13 nt, Human
uggcaggcuggcc

SEQ ID NO: 3460706 - RNA, 14 nt, Human
uggcaggcuggcca

SEQ ID NO: 3460707 - RNA, 20 nt, Human
uggcagggaggucaggcccu

SEQ ID NO: 3460708 - RNA, 13 nt, Human
uggcagggcacag

SEQ ID NO: 3460709 - RNA, 19 nt, Human
uggcagggcacagggccug

SEQ ID NO: 3460710 - RNA, 15 nt, Human
uggcagggccuagcu

SEQ ID NO: 3460711 - RNA, 19 nt, Human
uggcagggccuagcugcua

SEQ ID NO: 3460712 - RNA, 18 nt, Human
uggcaggggacaggaguc

SEQ ID NO: 3460713 - RNA, 15 nt, Human
uggcagggggcugcu

SEQ ID NO: 3460714 - RNA, 21 nt, Human
uggcagggguggaggagagcc

SEQ ID NO: 3460715 - RNA, 23 nt, Human
uggcagggguggcugccucauuu

SEQ ID NO: 3460716 - RNA, 17 nt, Human
uggcagguaggaauauu

SEQ ID NO: 3460717 - RNA, 14 nt, Human
uggcaggugagcaa

SEQ ID NO: 3460718 - RNA, 19 nt, Human
uggcagguuggguaacccu

SEQ ID NO: 3460719 - RNA, 17 nt, Human
uggcagucacugaauuc

SEQ ID NO: 3460720 - RNA, 19 nt, Human
uggcagucuauauguuugu

SEQ ID NO: 3460721 - RNA, 19 nt, Human
uggcagugagugagccugg

SEQ ID NO: 3460722 - RNA, 21 nt, Human
uggcagugagugagccuggcu

SEQ ID NO: 3460723 - RNA, 14 nt, Human
uggcagugaugaau

SEQ ID NO: 3460724 - RNA, 23 nt, Human
uggcaguggacucagaaagccaa

SEQ ID NO: 3460725 - RNA, 22 nt, Human
uggcagugggaaaaauguagga

SEQ ID NO: 3460726 - RNA, 13 nt, Human
uggcagugggagc

SEQ ID NO: 3460727 - RNA, 12 nt, Human
uggcagugguuu

SEQ ID NO: 3460728 - RNA, 18 nt, Human
uggcaguguuuugagaac

SEQ ID NO: 3460729 - RNA, 13 nt, Human
uggcaguuauauu

SEQ ID NO: 3460730 - RNA, 16 nt, Human
uggcaguuuauauuua

SEQ ID NO: 3460731 - RNA, 15 nt, Human
uggcauaacauaaau

SEQ ID NO: 3460732 - RNA, 17 nt, Human
uggcauaacauaaaucu

SEQ ID NO: 3460733 - RNA, 22 nt, Human
uggcauaacauaaaucugugaa

SEQ ID NO: 3460734 - RNA, 14 nt, Human
uggcauaguuucau

SEQ ID NO: 3460735 - RNA, 16 nt, Human
uggcauauuuuucaca

SEQ ID NO: 3460736 - RNA, 17 nt, Human
uggcauauuuuucacau

SEQ ID NO: 3460737 - RNA, 20 nt, Human
uggcaucacagggcagagcc

SEQ ID NO: 3460738 - RNA, 22 nt, Human
uggcauccagagucccugccug

SEQ ID NO: 3460739 - RNA, 14 nt, Human
uggcaucccugggc

SEQ ID NO: 3460740 - RNA, 16 nt, Human
uggcauccugugaagu

SEQ ID NO: 3460741 - RNA, 21 nt, Human
uggcaucgcaccauucugacu

SEQ ID NO: 3460742 - RNA, 22 nt, Human
uggcaucgcaccauucugacuc

SEQ ID NO: 3460743 - RNA, 15 nt, Human
uggcaucugacacaa

SEQ ID NO: 3460744 - RNA, 18 nt, Human
uggcaucuuaaaagcuau

SEQ ID NO: 3460745 - RNA, 21 nt, Human
uggcaucuuugccuugggcug

SEQ ID NO: 3460746 - RNA, 21 nt, Human
uggcaugagaaauacaaaaau

SEQ ID NO: 3460747 - RNA, 18 nt, Human
uggcaugcuuaaauuuua

SEQ ID NO: 3460748 - RNA, 16 nt, Human
uggcauggcaccuguc

SEQ ID NO: 3460749 - RNA, 16 nt, Human
uggcauggcuccaguc

SEQ ID NO: 3460750 - RNA, 17 nt, Human
uggcauggcuccagucu

SEQ ID NO: 3460751 - RNA, 22 nt, Human
uggcaugggaaugaaugucagu

SEQ ID NO: 3460752 - RNA, 17 nt, Human
uggcauguaaauguaaa

SEQ ID NO: 3460753 - RNA, 19 nt, Human
uggcauguaaauguaaacu

SEQ ID NO: 3460754 - RNA, 20 nt, Human
uggcaugugcugugaccauu

SEQ ID NO: 3460755 - RNA, 14 nt, Human
uggcauguggccug

SEQ ID NO: 3460756 - RNA, 16 nt, Human
uggcauguggccugug

SEQ ID NO: 3460757 - RNA, 15 nt, Human
uggcauuaaaacuua

SEQ ID NO: 3460758 - RNA, 18 nt, Human
uggcauuauguccacugu

SEQ ID NO: 3460759 - RNA, 20 nt, Human
uggcauuggcagcaggugcu

SEQ ID NO: 3460760 - RNA, 21 nt, Human
uggcauuggcagcaggugcug

SEQ ID NO: 3460761 - RNA, 16 nt, Human
uggcauugucccugug

SEQ ID NO: 3460762 - RNA, 17 nt, Human
uggcauuugcagauuuu

SEQ ID NO: 3460763 - RNA, 14 nt, Human
uggccaaaguguua

SEQ ID NO: 3460764 - RNA, 22 nt, Human
uggccaacaucgugaaacccug

SEQ ID NO: 3460765 - RNA, 18 nt, Human
uggccaagagaaacuucc

SEQ ID NO: 3460766 - RNA, 16 nt, Human
uggccaaggagcugcu

SEQ ID NO: 3460767 - RNA, 16 nt, Human
uggccaaguuccucua

SEQ ID NO: 3460768 - RNA, 19 nt, Human
uggccacaaauucuuugac

SEQ ID NO: 3460769 - RNA, 12 nt, Human
uggccacacugu

SEQ ID NO: 3460770 - RNA, 14 nt, Human
uggccacacuguga

SEQ ID NO: 3460771 - RNA, 18 nt, Human
uggccacacugugacaca

SEQ ID NO: 3460772 - RNA, 18 nt, Human
uggccacagccaggggag

SEQ ID NO: 3460773 - RNA, 20 nt, Human
uggccacagcgccagccuca

SEQ ID NO: 3460774 - RNA, 21 nt, Human
uggccacauuuucagccaaag

SEQ ID NO: 3460775 - RNA, 12 nt, Human
uggccaccaggc

SEQ ID NO: 3460776 - RNA, 13 nt, Human
uggccaccaggcu

SEQ ID NO: 3460777 - RNA, 15 nt, Human
uggccaccaggcugg

SEQ ID NO: 3460778 - RNA, 23 nt, Human
uggccaccaggcuggcgcagcca

SEQ ID NO: 3460779 - RNA, 19 nt, Human
uggccacccguucugcugg

SEQ ID NO: 3460780 - RNA, 20 nt, Human
uggccaccugaggugggccc

SEQ ID NO: 3460781 - RNA, 17 nt, Human
uggccaccuuuucagcg

SEQ ID NO: 3460782 - RNA, 15 nt, Human
uggccacgcagccag

SEQ ID NO: 3460783 - RNA, 12 nt, Human
uggccacuaagc

SEQ ID NO: 3460784 - RNA, 19 nt, Human
uggccacuaagcagaggag

SEQ ID NO: 3460785 - RNA, 22 nt, Human
uggccacucagcuuccuaccca

SEQ ID NO: 3460786 - RNA, 20 nt, Human
uggccacuccagaccccugg

SEQ ID NO: 3460787 - RNA, 23 nt, Human
uggccacuccgagaggugggcca

SEQ ID NO: 3460788 - RNA, 14 nt, Human
uggccacugcacag

SEQ ID NO: 3460789 - RNA, 17 nt, Human
uggccacugcacagagc

SEQ ID NO: 3460790 - RNA, 19 nt, Human
uggccacugcacagagcuc

SEQ ID NO: 3460791 - RNA, 20 nt, Human
uggccacugcacagagcucu

SEQ ID NO: 3460792 - RNA, 16 nt, Human
uggccacugcucccua

SEQ ID NO: 3460793 - RNA, 16 nt, Human
uggccacuuuaagaga

SEQ ID NO: 3460794 - RNA, 17 nt, Human
uggccagaagucaaggc

SEQ ID NO: 3460795 - RNA, 18 nt, Human
uggccagacacaggcccu

SEQ ID NO: 3460796 - RNA, 20 nt, Human
uggccagaccagagcucugg

SEQ ID NO: 3460797 - RNA, 15 nt, Human
uggccagacucgaug

SEQ ID NO: 3460798 - RNA, 15 nt, Human
uggccagagcuggga

SEQ ID NO: 3460799 - RNA, 20 nt, Human
uggccagagcugggaggcau

SEQ ID NO: 3460800 - RNA, 23 nt, Human
uggccagagcugggaggcauggc

SEQ ID NO: 3460801 - RNA, 18 nt, Human
uggccagaggugucaccc

SEQ ID NO: 3460802 - RNA, 19 nt, Human
uggccagaugcaccagccc

SEQ ID NO: 3460803 - RNA, 16 nt, Human
uggccagcagcaccug

SEQ ID NO: 3460804 - RNA, 15 nt, Human
uggccagccccacag

SEQ ID NO: 3460805 - RNA, 22 nt, Human
uggccagccccuuagacagagg

SEQ ID NO: 3460806 - RNA, 12 nt, Human
uggccagcccgg

SEQ ID NO: 3460807 - RNA, 13 nt, Human
uggccagcccggc

SEQ ID NO: 3460808 - RNA, 15 nt, Human
uggccagcccggcug

SEQ ID NO: 3460809 - RNA, 17 nt, Human
uggccagcccggcuggu

SEQ ID NO: 3460810 - RNA, 12 nt, Human
uggccagccgcu

SEQ ID NO: 3460811 - RNA, 20 nt, Human
uggccagccgcucuccugcc

SEQ ID NO: 3460812 - RNA, 23 nt, Human
uggccagccgcucuccugccaca

SEQ ID NO: 3460813 - RNA, 13 nt, Human
uggccagccuaca

SEQ ID NO: 3460814 - RNA, 19 nt, Human
uggccagccuggggccugg

SEQ ID NO: 3460815 - RNA, 23 nt, Human
uggccagccuggggccuggcagg

SEQ ID NO: 3460816 - RNA, 20 nt, Human
uggccaggaaguagcacagg

SEQ ID NO: 3460817 - RNA, 22 nt, Human
uggccaggaaguagcacaggcu

SEQ ID NO: 3460818 - RNA, 14 nt, Human
uggccaggagcucu

SEQ ID NO: 3460819 - RNA, 15 nt, Human
uggccaggagcucuu

SEQ ID NO: 3460820 - RNA, 16 nt, Human
uggccaggagcucuuc

SEQ ID NO: 3460821 - RNA, 20 nt, Human
uggccaggagcucuucaggc

SEQ ID NO: 3460822 - RNA, 11 nt, Human
uggccaggagg

SEQ ID NO: 3460823 - RNA, 12 nt, Human
uggccaggaggu

SEQ ID NO: 3460824 - RNA, 12 nt, Human
uggccaggaugg

SEQ ID NO: 3460825 - RNA, 17 nt, Human
uggccaggcagaucugu

SEQ ID NO: 3460826 - RNA, 20 nt, Human
uggccaggcagaucugugcc

SEQ ID NO: 3460827 - RNA, 21 nt, Human
guuuccuaaauccaaccauuu

SEQ ID NO: 3460828 - RNA, 22 nt, Human
guuuccucaggcugcuggagga

SEQ ID NO: 3460829 - RNA, 13 nt, Human
guuuccucuguuc

SEQ ID NO: 3460830 - RNA, 23 nt, Human
guuuccucuguucaaagcugccu

SEQ ID NO: 3460831 - RNA, 22 nt, Human
guuuccugaaacaacuuggaaa

SEQ ID NO: 3460832 - RNA, 15 nt, Human
guuuccugacauugu

SEQ ID NO: 3460833 - RNA, 14 nt, Human
guuuccugcaggcc

SEQ ID NO: 3460834 - RNA, 17 nt, Human
guuuccuuccagcccag

SEQ ID NO: 3460835 - RNA, 21 nt, Human
guuuccuugaggggagccagg

SEQ ID NO: 3460836 - RNA, 19 nt, Human
guuuccuugggaguuguca

SEQ ID NO: 3460837 - RNA, 20 nt, Human
guuuccuuucauuuacugug

SEQ ID NO: 3460838 - RNA, 14 nt, Human
guuuccuuuuauga

SEQ ID NO: 3460839 - RNA, 18 nt, Human
guuucgaaguugaugcaa

SEQ ID NO: 3460840 - RNA, 13 nt, Human
guuucgagaagcu

SEQ ID NO: 3460841 - RNA, 16 nt, Human
guuucgcagccugagu

SEQ ID NO: 3460842 - RNA, 18 nt, Human
guuucgcagccugagucc

SEQ ID NO: 3460843 - RNA, 16 nt, Human
guuucuaaagcugcca

SEQ ID NO: 3460844 - RNA, 20 nt, Human
guuucuaaagcugccagccg

SEQ ID NO: 3460845 - RNA, 22 nt, Human
guuucuaaaggcuaccuuugua

SEQ ID NO: 3460846 - RNA, 15 nt, Human
guuucuaagauucua

SEQ ID NO: 3460847 - RNA, 23 nt, Human
guuucuaccggagagagaaugua

SEQ ID NO: 3460848 - RNA, 16 nt, Human
guuucuagacuauaaa

SEQ ID NO: 3460849 - RNA, 18 nt, Human
guuucuagggaaaugaaa

SEQ ID NO: 3460850 - RNA, 12 nt, Human
uguauguguuua

SEQ ID NO: 3460851 - RNA, 14 nt, Human
uguauguguuuaga

SEQ ID NO: 3460852 - RNA, 20 nt, Human
uguauguguuuagaauugaa

SEQ ID NO: 3460853 - RNA, 15 nt, Human
uguauguuaaagaga

SEQ ID NO: 3460854 - RNA, 21 nt, Human
uguauguuauuauauuccgua

SEQ ID NO: 3460855 - RNA, 20 nt, Human
uguauguuuacacugucaaa

SEQ ID NO: 3460856 - RNA, 16 nt, Human
uguauguuuacauauc

SEQ ID NO: 3460857 - RNA, 14 nt, Human
uguauguuugcaca

SEQ ID NO: 3460858 - RNA, 16 nt, Human
uguauguuugcacacu

SEQ ID NO: 3460859 - RNA, 13 nt, Human
uguauguuuuuca

SEQ ID NO: 3460860 - RNA, 16 nt, Human
uguauguuuuucaguu

SEQ ID NO: 3460861 - RNA, 17 nt, Human
uguauuaaaaaaaacaa

SEQ ID NO: 3460862 - RNA, 23 nt, Human
uguauuaaauuacauuuguaauu

SEQ ID NO: 3460863 - RNA, 12 nt, Human
uguauuaagagu

SEQ ID NO: 3460864 - RNA, 17 nt, Human
uguauuaagagugaaaa

SEQ ID NO: 3460865 - RNA, 14 nt, Human
uguauuaagccacu

SEQ ID NO: 3460866 - RNA, 16 nt, Human
uguauuaauaaauaga

SEQ ID NO: 3460867 - RNA, 14 nt, Human
uguauuacagaugc

SEQ ID NO: 3460868 - RNA, 21 nt, Human
uguauuacauaaauaaauuaa

SEQ ID NO: 3460869 - RNA, 19 nt, Human
uguauuacuagaagaugaa

SEQ ID NO: 3460870 - RNA, 19 nt, Human
uguauuagauguucucuau

SEQ ID NO: 3460871 - RNA, 19 nt, Human
uguauuaggacuggcuuug

SEQ ID NO: 3460872 - RNA, 18 nt, Human
uguauuagugauauuucu

SEQ ID NO: 3460873 - RNA, 22 nt, Human
uguauuagugauauuucucuag

SEQ ID NO: 3460874 - RNA, 14 nt, Human
uguauuauaacagu

SEQ ID NO: 3460875 - RNA, 20 nt, Human
uguauuauguccugugagau

SEQ ID NO: 3460876 - RNA, 11 nt, Human
uguauuaugug

SEQ ID NO: 3460877 - RNA, 16 nt, Human
uguauuauucugcagc

SEQ ID NO: 3460878 - RNA, 14 nt, Human
uguauuauugcugu

SEQ ID NO: 3460879 - RNA, 18 nt, Human
uguauuauugcuguugcu

SEQ ID NO: 3460880 - RNA, 18 nt, Human
uguauuauuuacauuuaa

SEQ ID NO: 3460881 - RNA, 15 nt, Human
uguauuauuuauaau

SEQ ID NO: 3460882 - RNA, 20 nt, Human
uguauuauuucauuauguaa

SEQ ID NO: 3460883 - RNA, 17 nt, Human
uguauucaauuaaagaa

SEQ ID NO: 3460884 - RNA, 21 nt, Human
uguauucacccguccagaccu

SEQ ID NO: 3460885 - RNA, 14 nt, Human
uguauucagcuuua

SEQ ID NO: 3460886 - RNA, 16 nt, Human
uguauucauauuugua

SEQ ID NO: 3460887 - RNA, 17 nt, Human
uguauucauauuuguac

SEQ ID NO: 3460888 - RNA, 20 nt, Human
uguauuccaagacaugucug

SEQ ID NO: 3460889 - RNA, 21 nt, Human
uguauuccaagacaugucugu

SEQ ID NO: 3460890 - RNA, 19 nt, Human
uguauucucuccuguaccu

SEQ ID NO: 3460891 - RNA, 20 nt, Human
uguauucucuccuguaccuc

SEQ ID NO: 3460892 - RNA, 19 nt, Human
uguauucucugagcugugc

SEQ ID NO: 3460893 - RNA, 13 nt, Human
uguauucuguaaa

SEQ ID NO: 3460894 - RNA, 13 nt, Human
uguauucugucuu

SEQ ID NO: 3460895 - RNA, 14 nt, Human
uguauucuuaaaau

SEQ ID NO: 3460896 - RNA, 21 nt, Human
uguauucuuaaauucauuuua

SEQ ID NO: 3460897 - RNA, 21 nt, Human
uguauucuuugauguuaacac

SEQ ID NO: 3460898 - RNA, 16 nt, Human
uguauucuuuucucag

SEQ ID NO: 3460899 - RNA, 16 nt, Human
uguauugaaucaugua

SEQ ID NO: 3460900 - RNA, 20 nt, Human
uguauugagauuucuuaaau

SEQ ID NO: 3460901 - RNA, 19 nt, Human
uguauugcacauuguaaaa

SEQ ID NO: 3460902 - RNA, 12 nt, Human
uguauugcuguc

SEQ ID NO: 3460903 - RNA, 15 nt, Human
uguauuguaaacaug

SEQ ID NO: 3460904 - RNA, 19 nt, Human
uguauugugcaauguguau

SEQ ID NO: 3460905 - RNA, 16 nt, Human
uguauuguuagauguu

SEQ ID NO: 3460906 - RNA, 12 nt, Human
uguauuguuccc

SEQ ID NO: 3460907 - RNA, 20 nt, Human
uguauuuaaaaauagaaaca

SEQ ID NO: 3460908 - RNA, 14 nt, Human
uguauuuaacagaa

SEQ ID NO: 3460909 - RNA, 12 nt, Human
uguauuuaagca

SEQ ID NO: 3460910 - RNA, 22 nt, Human
uguauuuaauuguaaacuguac

SEQ ID NO: 3460911 - RNA, 21 nt, Human
uguauuuauaaauauauuuaa

SEQ ID NO: 3460912 - RNA, 15 nt, Human
uguauuuauucuuuu

SEQ ID NO: 3460913 - RNA, 20 nt, Human
uguauuuauuuuccucccca

SEQ ID NO: 3460914 - RNA, 12 nt, Human
uguauuugaaag

SEQ ID NO: 3460915 - RNA, 14 nt, Human
uguauuugcuuuuu

SEQ ID NO: 3460916 - RNA, 13 nt, Human
uguauuuggaaau

SEQ ID NO: 3460917 - RNA, 18 nt, Human
uguauuugugacuaauug

SEQ ID NO: 3460918 - RNA, 20 nt, Human
uguauuugugacuaauugua

SEQ ID NO: 3460919 - RNA, 14 nt, Human
uguauuuguucaug

SEQ ID NO: 3460920 - RNA, 17 nt, Human
uguauuuguucauguuu

SEQ ID NO: 3460921 - RNA, 19 nt, Human
uguauuuuauaaaauuaaa

SEQ ID NO: 3460922 - RNA, 18 nt, Human
uguauuuuauguauguuu

SEQ ID NO: 3460923 - RNA, 11 nt, Human
uguauuuuauu

SEQ ID NO: 3460924 - RNA, 18 nt, Human
uguauuuuauuuagacaa

SEQ ID NO: 3460925 - RNA, 22 nt, Human
uguauuuuauuuagacaagaga

SEQ ID NO: 3460926 - RNA, 21 nt, Human
uguauuuuccaagugugcaua

SEQ ID NO: 3460927 - RNA, 16 nt, Human
uguauuuucuuucucu

SEQ ID NO: 3460928 - RNA, 19 nt, Human
uguauuuuguaaauaauaa

SEQ ID NO: 3460929 - RNA, 16 nt, Human
uguauuuugugugacc

SEQ ID NO: 3460930 - RNA, 14 nt, Human
uguauuuuuaaugg

SEQ ID NO: 3460931 - RNA, 17 nt, Human
uguauuuuuaccuuuuu

SEQ ID NO: 3460932 - RNA, 16 nt, Human
uguauuuuuauauaau

SEQ ID NO: 3460933 - RNA, 19 nt, Human
uguauuuuucaauaaagca

SEQ ID NO: 3460934 - RNA, 16 nt, Human
uguauuuuuuaaagcu

SEQ ID NO: 3460935 - RNA, 20 nt, Human
uguauuuuuuugcaagugaa

SEQ ID NO: 3460936 - RNA, 21 nt, Human
uguauuuuuuuuucuaagaga

SEQ ID NO: 3460937 - RNA, 16 nt, Human
ugucaaaaaucaauau

SEQ ID NO: 3460938 - RNA, 15 nt, Human
ugucaaaacacugug

SEQ ID NO: 3460939 - RNA, 21 nt, Human
ugucaaacaaauagucuauca

SEQ ID NO: 3460940 - RNA, 18 nt, Human
ugucaaacuguagaaaug

SEQ ID NO: 3460941 - RNA, 13 nt, Human
ugucaaagcuuug

SEQ ID NO: 3460942 - RNA, 19 nt, Human
ugucaaaguggugagaggc

SEQ ID NO: 3460943 - RNA, 15 nt, Human
ugucaaauaaacacu

SEQ ID NO: 3460944 - RNA, 19 nt, Human
ugucaaauauuuagaugua

SEQ ID NO: 3460945 - RNA, 18 nt, Human
ugucaaaugaugugcaaa

SEQ ID NO: 3460946 - RNA, 19 nt, Human
ugucaaaugaugugcaaaa

SEQ ID NO: 3460947 - RNA, 15 nt, Human
ugucaacauugugau

SEQ ID NO: 3460948 - RNA, 17 nt, Human
ugucaacauuuggaggc

SEQ ID NO: 3460949 - RNA, 17 nt, Human
ugucaaccagacagagg

SEQ ID NO: 3460950 - RNA, 15 nt, Human
ugucaacucuuuguu

SEQ ID NO: 3460951 - RNA, 15 nt, Human
ugucaacugaccuaa

SEQ ID NO: 3460952 - RNA, 14 nt, Human
ugucaacuucuggc

SEQ ID NO: 3460953 - RNA, 15 nt, Human
ugucaacuucuggcu

SEQ ID NO: 3460954 - RNA, 14 nt, Human
ugucaagaaagagc

SEQ ID NO: 3460955 - RNA, 17 nt, Human
ugucaagaguaguuaua

SEQ ID NO: 3460956 - RNA, 15 nt, Human
ugucaagauucagcu

SEQ ID NO: 3460957 - RNA, 15 nt, Human
ugucaagccauaauu

SEQ ID NO: 3460958 - RNA, 20 nt, Human
ugucaagccauuuuuacauc

SEQ ID NO: 3460959 - RNA, 23 nt, Human
ugucaagccauuuuuacaucuaa

SEQ ID NO: 3460960 - RNA, 19 nt, Human
ugucaagcugcucugagcc

SEQ ID NO: 3460961 - RNA, 18 nt, Human
ugucaaggcugcuuagaa

SEQ ID NO: 3460962 - RNA, 22 nt, Human
ugucaagggcagcuuugcucau

SEQ ID NO: 3460963 - RNA, 16 nt, Human
ugucaaggugcuguug

SEQ ID NO: 3460964 - RNA, 17 nt, Human
ugucaaguggcaaagcu

SEQ ID NO: 3460965 - RNA, 19 nt, Human
ugucaagugggaucuguca

SEQ ID NO: 3460966 - RNA, 18 nt, Human
ugucaaguuccuuugggu

SEQ ID NO: 3460967 - RNA, 17 nt, Human
ugucaaguugugcuugu

SEQ ID NO: 3460968 - RNA, 12 nt, Human
ugucaauaaaca

SEQ ID NO: 3460969 - RNA, 16 nt, Human
ugucaauaaacagcuu

SEQ ID NO: 3460970 - RNA, 23 nt, Human
ugucaauauuaaauacagacacu

SEQ ID NO: 3460971 - RNA, 17 nt, Human
ugucaauauuuaaacau

SEQ ID NO: 3460972 - RNA, 20 nt, Human
ugugaguguaagugugagua

SEQ ID NO: 3460973 - RNA, 13 nt, Human
ugugagugugaca

SEQ ID NO: 3460974 - RNA, 16 nt, Human
ugugagugugacaggg

SEQ ID NO: 3460975 - RNA, 17 nt, Human
ugugagugugacagggc

SEQ ID NO: 3460976 - RNA, 18 nt, Human
ugugagugugacagggcc

SEQ ID NO: 3460977 - RNA, 20 nt, Human
ugugaguguguccaagugug

SEQ ID NO: 3460978 - RNA, 22 nt, Human
ugugaguguguguuugugcuga

SEQ ID NO: 3460979 - RNA, 21 nt, Human
ugugaguuuggucuggacuga

SEQ ID NO: 3460980 - RNA, 15 nt, Human
ugugauagcacuuuc

SEQ ID NO: 3460981 - RNA, 17 nt, Human
ugugauauaaacagcuu

SEQ ID NO: 3460982 - RNA, 16 nt, Human
ugugauauauguauua

SEQ ID NO: 3460983 - RNA, 21 nt, Human
ugugauaugcacaauguagau

SEQ ID NO: 3460984 - RNA, 22 nt, Human
ugugauauuucagaaauacaga

SEQ ID NO: 3460985 - RNA, 18 nt, Human
ugugaucauguguggaag

SEQ ID NO: 3460986 - RNA, 20 nt, Human
ugugaucuaucaauagucaa

SEQ ID NO: 3460987 - RNA, 20 nt, Human
ugugaucugucuuguaauau

SEQ ID NO: 3460988 - RNA, 17 nt, Human
ugugaucuuauuuuucu

SEQ ID NO: 3460989 - RNA, 15 nt, Human
ugugaugaacuuucu

SEQ ID NO: 3460990 - RNA, 14 nt, Human
ugugaugaauacug

SEQ ID NO: 3460991 - RNA, 18 nt, Human
ugugaugacaacuggaau

SEQ ID NO: 3460992 - RNA, 18 nt, Human
ugugaugacauucccugc

SEQ ID NO: 3460993 - RNA, 16 nt, Human
ugugaugaggggaggg

SEQ ID NO: 3460994 - RNA, 14 nt, Human
ugugaugauguaau

SEQ ID NO: 3460995 - RNA, 17 nt, Human
ugugaugccacacagag

SEQ ID NO: 3460996 - RNA, 16 nt, Human
ugugaugcccugcccu

SEQ ID NO: 3460997 - RNA, 17 nt, Human
ugugauggagugcuguu

SEQ ID NO: 3460998 - RNA, 20 nt, Human
ugugauggggcccugccucc

SEQ ID NO: 3460999 - RNA, 15 nt, Human
ugugaugugacauuu

SEQ ID NO: 3461000 - RNA, 18 nt, Human
ugugaugugacauuuguc

SEQ ID NO: 3461001 - RNA, 14 nt, Human
ugugauguucuaag

SEQ ID NO: 3461002 - RNA, 17 nt, Human
ugugauguucuaaggcu

SEQ ID NO: 3461003 - RNA, 14 nt, Human
ugugauuaacuuau

SEQ ID NO: 3461004 - RNA, 16 nt, Human
ugugauucaaugccuc

SEQ ID NO: 3461005 - RNA, 20 nt, Human
ugugauucagaaaauguucu

SEQ ID NO: 3461006 - RNA, 23 nt, Human
ugugauucagaaaauguucuguu

SEQ ID NO: 3461007 - RNA, 21 nt, Human
ugugauuccuuugaagaggaa

SEQ ID NO: 3461008 - RNA, 17 nt, Human
ugugauucuaaugucuu

SEQ ID NO: 3461009 - RNA, 21 nt, Human
ugugauucuuccagaugugau

SEQ ID NO: 3461010 - RNA, 13 nt, Human
ugugauugaaucu

SEQ ID NO: 3461011 - RNA, 15 nt, Human
ugugauugaaucuga

SEQ ID NO: 3461012 - RNA, 23 nt, Human
ugugauugacagcuuugcugcug

SEQ ID NO: 3461013 - RNA, 14 nt, Human
ugugauugugccua

SEQ ID NO: 3461014 - RNA, 15 nt, Human
ugugauuuaauagug

SEQ ID NO: 3461015 - RNA, 16 nt, Human
ugugauuuaauagugu

SEQ ID NO: 3461016 - RNA, 20 nt, Human
ugugauuuaauaguguuaau

SEQ ID NO: 3461017 - RNA, 22 nt, Human
ugugauuuaauaguguuaauca

SEQ ID NO: 3461018 - RNA, 19 nt, Human
ugugauuucccguggcccc

SEQ ID NO: 3461019 - RNA, 22 nt, Human
ugugauuucccguggccccagc

SEQ ID NO: 3461020 - RNA, 19 nt, Human
ugugauuucuuuaaaagaa

SEQ ID NO: 3461021 - RNA, 13 nt, Human
ugugauuugacug

SEQ ID NO: 3461022 - RNA, 14 nt, Human
ugugauuugacugu

SEQ ID NO: 3461023 - RNA, 14 nt, Human
ugugauuuuaacuc

SEQ ID NO: 3461024 - RNA, 17 nt, Human
ugugauuuuaacucugu

SEQ ID NO: 3461025 - RNA, 20 nt, Human
ugugauuuuaacucugucuu

SEQ ID NO: 3461026 - RNA, 20 nt, Human
ugugcaaaaaaauuaaaaug

SEQ ID NO: 3461027 - RNA, 23 nt, Human
ugugcaaaaaaauuaaaauggau

SEQ ID NO: 3461028 - RNA, 13 nt, Human
ugugcaaaaauuu

SEQ ID NO: 3461029 - RNA, 21 nt, Human
ugugcaacggucuccugacug

SEQ ID NO: 3461030 - RNA, 14 nt, Human
ugugcaagagaggg

SEQ ID NO: 3461031 - RNA, 23 nt, Human
ugugcaagcgacgacagaugcua

SEQ ID NO: 3461032 - RNA, 17 nt, Human
ugugcaaggcagccgug

SEQ ID NO: 3461033 - RNA, 21 nt, Human
ugugcaaggcagccgugggcc

SEQ ID NO: 3461034 - RNA, 21 nt, Human
ugugcaagugugugcaugugu

SEQ ID NO: 3461035 - RNA, 16 nt, Human
ugugcaauagaaggug

SEQ ID NO: 3461036 - RNA, 20 nt, Human
ugugcaauagacacauacau

SEQ ID NO: 3461037 - RNA, 11 nt, Human
ugugcaaugug

SEQ ID NO: 3461038 - RNA, 14 nt, Human
ugugcacaaagugg

SEQ ID NO: 3461039 - RNA, 20 nt, Human
ugugcacaauucuguuuuag

SEQ ID NO: 3461040 - RNA, 12 nt, Human
ugugcacaggca

SEQ ID NO: 3461041 - RNA, 13 nt, Human
ugugcacaggcag

SEQ ID NO: 3461042 - RNA, 14 nt, Human
ugugcacaggcaga

SEQ ID NO: 3461043 - RNA, 10 nt, Human
ugugcacauc

SEQ ID NO: 3461044 - RNA, 21 nt, Human
ugugcacauccgcgugugccu

SEQ ID NO: 3461045 - RNA, 19 nt, Human
ugugcaccaccacacccgg

SEQ ID NO: 3461046 - RNA, 18 nt, Human
ugugcacccucuauccca

SEQ ID NO: 3461047 - RNA, 17 nt, Human
ugugcaccuaaaacuua

SEQ ID NO: 3461048 - RNA, 15 nt, Human
ugugcaccugggcuc

SEQ ID NO: 3461049 - RNA, 22 nt, Human
ugugcacguaaaguacuuguag

SEQ ID NO: 3461050 - RNA, 14 nt, Human
ugugcacguacaca

SEQ ID NO: 3461051 - RNA, 13 nt, Human
ugugcacugccca

SEQ ID NO: 3461052 - RNA, 17 nt, Human
ugugcacugucacuuug

SEQ ID NO: 3461053 - RNA, 20 nt, Human
ugugcacuuuuuuucuauau

SEQ ID NO: 3461054 - RNA, 14 nt, Human
ugugcagaaaacau

SEQ ID NO: 3461055 - RNA, 15 nt, Human
ugugcagcagauugg

SEQ ID NO: 3461056 - RNA, 19 nt, Human
ugugcagccgcugagcgag

SEQ ID NO: 3461057 - RNA, 14 nt, Human
ugugcagguuccca

SEQ ID NO: 3461058 - RNA, 16 nt, Human
ugugcaguaucuguga

SEQ ID NO: 3461059 - RNA, 17 nt, Human
ugugcaguccugggaug

SEQ ID NO: 3461060 - RNA, 20 nt, Human
ugugcagugaagguugcuga

SEQ ID NO: 3461061 - RNA, 19 nt, Human
ugugcaguucuaguuugca

SEQ ID NO: 3461062 - RNA, 22 nt, Human
ugugcaguucuaguuugcauuc

SEQ ID NO: 3461063 - RNA, 19 nt, Human
ugugcaguugcuguuuacu

SEQ ID NO: 3461064 - RNA, 15 nt, Human
ugugcauaguuucuu

SEQ ID NO: 3461065 - RNA, 16 nt, Human
ugugcauaguuucuuu

SEQ ID NO: 3461066 - RNA, 13 nt, Human
ugugcauauugua

SEQ ID NO: 3461067 - RNA, 13 nt, Human
ugugcaucaggcu

SEQ ID NO: 3461068 - RNA, 16 nt, Human
ugugcauggaggcccu

SEQ ID NO: 3461069 - RNA, 19 nt, Human
ugugcauggaggcccuccu

SEQ ID NO: 3461070 - RNA, 22 nt, Human
ugugcauggaggcccuccugug

SEQ ID NO: 3461071 - RNA, 13 nt, Human
ugugcauggguga

SEQ ID NO: 3461072 - RNA, 20 nt, Human
ugugcauguaugucuuggac

SEQ ID NO: 3461073 - RNA, 18 nt, Human
ugugcaugugucuuuaua

SEQ ID NO: 3461074 - RNA, 14 nt, Human
ugugcaugugugua

SEQ ID NO: 3461075 - RNA, 22 nt, Human
ugugcauguguguaagugugug

SEQ ID NO: 3461076 - RNA, 18 nt, Human
ugugcauguguguauaag

SEQ ID NO: 3461077 - RNA, 15 nt, Human
ugugcaugugugugu

SEQ ID NO: 3461078 - RNA, 20 nt, Human
ugugcauuaucuagauacug

SEQ ID NO: 3461079 - RNA, 21 nt, Human
ugugcauuaucuagauacugu

SEQ ID NO: 3461080 - RNA, 21 nt, Human
ugugcauucuuuuaaaagaca

SEQ ID NO: 3461081 - RNA, 14 nt, Human
ugugcauuuguaaa

SEQ ID NO: 3461082 - RNA, 21 nt, Human
ugugcauuuucuaaacagaga

SEQ ID NO: 3461083 - RNA, 21 nt, Human
ugugcauuuuugugaaaugaa

SEQ ID NO: 3461084 - RNA, 19 nt, Human
ugugccaaacaaaaugaga

SEQ ID NO: 3461085 - RNA, 23 nt, Human
ugugccaaucaauagcaccccua

SEQ ID NO: 3461086 - RNA, 17 nt, Human
ugugccaccaugccuca

SEQ ID NO: 3461087 - RNA, 20 nt, Human
ugugccacccaccagggcga

SEQ ID NO: 3461088 - RNA, 14 nt, Human
ugugccacccuggg

SEQ ID NO: 3461089 - RNA, 16 nt, Human
ugugccacccugggcu

SEQ ID NO: 3461090 - RNA, 18 nt, Human
ugugccagagccuggggc

SEQ ID NO: 3461091 - RNA, 21 nt, Human
ugugccagaggaauccuggca

SEQ ID NO: 3461092 - RNA, 18 nt, Human
ugugccagggcaaugaug

SEQ ID NO: 3461093 - RNA, 18 nt, Human
ugugccauagaguuuaac

SEQ ID NO: 3461094 - RNA, 21 nt, Human
ugugccauagucacauggccu

SEQ ID NO: 3461095 - RNA, 13 nt, Human
ugugccaucugua

SEQ ID NO: 3461096 - RNA, 12 nt, Human
ugugccaugugc

SEQ ID NO: 3461097 - RNA, 16 nt, Human
ugugccaugugccagg

SEQ ID NO: 3461098 - RNA, 16 nt, Human
ugugccauuuugcauu

SEQ ID NO: 3461099 - RNA, 18 nt, Human
ugugcccagaauacugau

SEQ ID NO: 3461100 - RNA, 19 nt, Human
ugugcccagcccggaccuu

SEQ ID NO: 3461101 - RNA, 20 nt, Human
ugugcccaugggcacugcug

SEQ ID NO: 3461102 - RNA, 21 nt, Human
ugugcccaugggcacugcugg

SEQ ID NO: 3461103 - RNA, 19 nt, Human
ugugccccaugccugucca

SEQ ID NO: 3461104 - RNA, 18 nt, Human
ugugcccccaaccauuuc

SEQ ID NO: 3461105 - RNA, 18 nt, Human
ugugccccuuccgccacu

SEQ ID NO: 3461106 - RNA, 20 nt, Human
ugugccccuuccgccacugg

SEQ ID NO: 3461107 - RNA, 21 nt, Human
ugugccccuuccgccacuggg

SEQ ID NO: 3461108 - RNA, 13 nt, Human
ugugcccuaucac

SEQ ID NO: 3461109 - RNA, 13 nt, Human
ugugcccucuggg

SEQ ID NO: 3461110 - RNA, 14 nt, Human
ugugcccucuugau

SEQ ID NO: 3461111 - RNA, 13 nt, Human
ugugcccuggugg

SEQ ID NO: 3461112 - RNA, 14 nt, Human
ugugccgagcccuu

SEQ ID NO: 3461113 - RNA, 16 nt, Human
ugugccucagagacca

SEQ ID NO: 3461114 - RNA, 14 nt, Human
ugugccucccaaaa

SEQ ID NO: 3461115 - RNA, 14 nt, Human
ugugccucccuggu

SEQ ID NO: 3461116 - RNA, 14 nt, Human
ugugccuccucacc

SEQ ID NO: 3461117 - RNA, 19 nt, Human
uguggccccacccugggcc

SEQ ID NO: 3461118 - RNA, 22 nt, Human
uguggccccugaacaagaauug

SEQ ID NO: 3461119 - RNA, 14 nt, Human
uguggcccugccau

SEQ ID NO: 3461120 - RNA, 21 nt, Human
uguggcccugccaucuuccca

SEQ ID NO: 3461121 - RNA, 22 nt, Human
uguggcccugccaucuucccag

SEQ ID NO: 3461122 - RNA, 15 nt, Human
uguggccgaggacuu

SEQ ID NO: 3461123 - RNA, 16 nt, Human
uguggccgaggacuuu

SEQ ID NO: 3461124 - RNA, 19 nt, Human
uguggccuaagaggcugcc

SEQ ID NO: 3461125 - RNA, 10 nt, Human
uguggccuca

SEQ ID NO: 3461126 - RNA, 18 nt, Human
uguggccucuucugagcu

SEQ ID NO: 3461127 - RNA, 15 nt, Human
uguggccuguggccu

SEQ ID NO: 3461128 - RNA, 17 nt, Human
uguggcuacugacauau

SEQ ID NO: 3461129 - RNA, 16 nt, Human
uguggcuagugacaaa

SEQ ID NO: 3461130 - RNA, 16 nt, Human
uguggcucacgugugu

SEQ ID NO: 3461131 - RNA, 20 nt, Human
uguggcuccacacacacaaa

SEQ ID NO: 3461132 - RNA, 14 nt, Human
uguggcuccaggcc

SEQ ID NO: 3461133 - RNA, 20 nt, Human
uguggcuccucccagcccau

SEQ ID NO: 3461134 - RNA, 16 nt, Human
uguggcugaggaggcc

SEQ ID NO: 3461135 - RNA, 16 nt, Human
uguggcugcagcagcg

SEQ ID NO: 3461136 - RNA, 15 nt, Human
uguggcugggggcag

SEQ ID NO: 3461137 - RNA, 18 nt, Human
uguggcugggggcaggag

SEQ ID NO: 3461138 - RNA, 21 nt, Human
uguggcugggggcaggagggc

SEQ ID NO: 3461139 - RNA, 20 nt, Human
uguggcuguagaucccaaga

SEQ ID NO: 3461140 - RNA, 15 nt, Human
uguggcugucagcag

SEQ ID NO: 3461141 - RNA, 19 nt, Human
uguggcugucagcaggaag

SEQ ID NO: 3461142 - RNA, 22 nt, Human
uguggcuucuuaaucuuuucac

SEQ ID NO: 3461143 - RNA, 17 nt, Human
uguggcuuucagccucu

SEQ ID NO: 3461144 - RNA, 18 nt, Human
uguggcuuuuuuaaaaaa

SEQ ID NO: 3461145 - RNA, 19 nt, Human
ugugggaagaaacaaaccc

SEQ ID NO: 3461146 - RNA, 15 nt, Human
ugugggaagggagag

SEQ ID NO: 3461147 - RNA, 15 nt, Human
ugugggaauuuaaga

SEQ ID NO: 3461148 - RNA, 12 nt, Human
ugugggacccca

SEQ ID NO: 3461149 - RNA, 18 nt, Human
ugugggaccccaggccca

SEQ ID NO: 3461150 - RNA, 15 nt, Human
ugugggacuguacac

SEQ ID NO: 3461151 - RNA, 14 nt, Human
ugugggagugugua

SEQ ID NO: 3461152 - RNA, 22 nt, Human
ugugggauguucagcacugucc

SEQ ID NO: 3461153 - RNA, 23 nt, Human
ugugggcacuggcccagguucau

SEQ ID NO: 3461154 - RNA, 13 nt, Human
ugugggccugggc

SEQ ID NO: 3461155 - RNA, 17 nt, Human
ugugggccugggcuccu

SEQ ID NO: 3461156 - RNA, 19 nt, Human
ugugggccugggcuccugg

SEQ ID NO: 3461157 - RNA, 17 nt, Human
ugugggcgggcccagca

SEQ ID NO: 3461158 - RNA, 13 nt, Human
ugugggcucccuu

SEQ ID NO: 3461159 - RNA, 14 nt, Human
ugugggcucccuuc

SEQ ID NO: 3461160 - RNA, 20 nt, Human
uguggggaucucaggggcug

SEQ ID NO: 3461161 - RNA, 16 nt, Human
uguggggauuucuccc

SEQ ID NO: 3461162 - RNA, 16 nt, Human
uguggggauuuucacu

SEQ ID NO: 3461163 - RNA, 21 nt, Human
ugugggggccccgucucaggu

SEQ ID NO: 3461164 - RNA, 13 nt, Human
ugugggggcugca

SEQ ID NO: 3461165 - RNA, 22 nt, Human
uguggggugugcacaucucugc

SEQ ID NO: 3461166 - RNA, 15 nt, Human
uguggguaccuguau

SEQ ID NO: 3461167 - RNA, 14 nt, Human
ugugggucugugug

SEQ ID NO: 3461168 - RNA, 17 nt, Human
uguggguggauauaaau

SEQ ID NO: 3461169 - RNA, 15 nt, Human
uguggguguagccag

SEQ ID NO: 3461170 - RNA, 14 nt, Human
uguggguguuaauu

SEQ ID NO: 3461171 - RNA, 22 nt, Human
uguggguguuaauuuuugauac

SEQ ID NO: 3461172 - RNA, 23 nt, Human
uguggguuucuaaagcugccagc

SEQ ID NO: 3461173 - RNA, 20 nt, Human
ugugguaagcaacauggcuu

SEQ ID NO: 3461174 - RNA, 21 nt, Human
ugugguacaagcauucugucu

SEQ ID NO: 3461175 - RNA, 20 nt, Human
ugugguacagagaagccagc

SEQ ID NO: 3461176 - RNA, 19 nt, Human
ugugguacaugguguuugu

SEQ ID NO: 3461177 - RNA, 20 nt, Human
ugugguagcuuaucuuagaa

SEQ ID NO: 3461178 - RNA, 22 nt, Human
ugugguaggccuuuuaacauuu

SEQ ID NO: 3461179 - RNA, 20 nt, Human
uguggucacaggaaguagag

SEQ ID NO: 3461180 - RNA, 13 nt, Human
uguggucccaccc

SEQ ID NO: 3461181 - RNA, 15 nt, Human
uguggucccacccca

SEQ ID NO: 3461182 - RNA, 13 nt, Human
uguggucucagga

SEQ ID NO: 3461183 - RNA, 16 nt, Human
uguggugacuuuggau

SEQ ID NO: 3461184 - RNA, 16 nt, Human
uguggugagggaagac

SEQ ID NO: 3461185 - RNA, 19 nt, Human
uguggugagguugggcagc

SEQ ID NO: 3461186 - RNA, 15 nt, Human
uguggugaugaugug

SEQ ID NO: 3461187 - RNA, 16 nt, Human
uguggugcugacaaag

SEQ ID NO: 3461188 - RNA, 14 nt, Human
ugugguguaauuua

SEQ ID NO: 3461189 - RNA, 16 nt, Human
ugugguguuuccuggc

SEQ ID NO: 3461190 - RNA, 15 nt, Human
ugugguuaaugccau

SEQ ID NO: 3461191 - RNA, 23 nt, Human
ugugguuauaacuuaaugaaaac

SEQ ID NO: 3461192 - RNA, 18 nt, Human
ugugguuauuuuuauaca

SEQ ID NO: 3461193 - RNA, 19 nt, Human
ugugguuauuuuuauacag

SEQ ID NO: 3461194 - RNA, 13 nt, Human
ugugguuccucug

SEQ ID NO: 3461195 - RNA, 22 nt, Human
ugugguuugguuccucucuggu

SEQ ID NO: 3461196 - RNA, 17 nt, Human
ugugguuuuauggagac

SEQ ID NO: 3461197 - RNA, 18 nt, Human
ugugguuuuccccucccu

SEQ ID NO: 3461198 - RNA, 22 nt, Human
ugugguuuuccccucccugggu

SEQ ID NO: 3461199 - RNA, 18 nt, Human
ugugguuuucgagauuau

SEQ ID NO: 3461200 - RNA, 20 nt, Human
ugugguuuucuuuugccaug

SEQ ID NO: 3461201 - RNA, 15 nt, Human
uguguaaaaagagag

SEQ ID NO: 3461202 - RNA, 21 nt, Human
uguguaaacacagucaaaaua

SEQ ID NO: 3461203 - RNA, 20 nt, Human
uguguaaagaucuacaugaa

SEQ ID NO: 3461204 - RNA, 21 nt, Human
uguguaaaguguaaauccuuu

SEQ ID NO: 3461205 - RNA, 15 nt, Human
uguguaacagcuccu

SEQ ID NO: 3461206 - RNA, 17 nt, Human
uguguaagaaauacaga

SEQ ID NO: 3461207 - RNA, 18 nt, Human
uguguaagagaauguuga

SEQ ID NO: 3461208 - RNA, 13 nt, Human
uguguaagauuug

SEQ ID NO: 3461209 - RNA, 21 nt, Human
uguguaauaaaguguuuucag

SEQ ID NO: 3461210 - RNA, 16 nt, Human
uguguaauagaaaacu

SEQ ID NO: 3461211 - RNA, 23 nt, Human
uguguaauauuacuuuaacaugc

SEQ ID NO: 3461212 - RNA, 21 nt, Human
uguguaaucauuucuugggcc

SEQ ID NO: 3461213 - RNA, 18 nt, Human
uguguaauuuaaaauugu

SEQ ID NO: 3461214 - RNA, 12 nt, Human
uguguaauuuuu

SEQ ID NO: 3461215 - RNA, 15 nt, Human
uguguaauuuuucug

SEQ ID NO: 3461216 - RNA, 13 nt, Human
uguguacacaugg

SEQ ID NO: 3461217 - RNA, 22 nt, Human
uguguacacgggacugacgcaa

SEQ ID NO: 3461218 - RNA, 10 nt, Human
uguguacagg

SEQ ID NO: 3461219 - RNA, 15 nt, Human
uguguacucuggccu

SEQ ID NO: 3461220 - RNA, 21 nt, Human
uguguacuguauagacaguuu

SEQ ID NO: 3461221 - RNA, 15 nt, Human
uguguagauaguaug

SEQ ID NO: 3461222 - RNA, 14 nt, Human
uguguagccuaugu

SEQ ID NO: 3461223 - RNA, 13 nt, Human
uguguagccuuuu

SEQ ID NO: 3461224 - RNA, 13 nt, Human
uaaaagaauuuuu

SEQ ID NO: 3461225 - RNA, 20 nt, Human
uaaaagacaaaucaaagcag

SEQ ID NO: 3461226 - RNA, 23 nt, Human
uaaaagacacuguuuacaagaaa

SEQ ID NO: 3461227 - RNA, 20 nt, Human
uaaaagacagugaaagaaaa

SEQ ID NO: 3461228 - RNA, 18 nt, Human
uaaaagacaguguaugua

SEQ ID NO: 3461229 - RNA, 22 nt, Human
uaaaagacugucuuaauuugca

SEQ ID NO: 3461230 - RNA, 21 nt, Human
uaaaagacuucccuaacacuu

SEQ ID NO: 3461231 - RNA, 17 nt, Human
uaaaagagauuucaaga

SEQ ID NO: 3461232 - RNA, 20 nt, Human
uaaaagagauuucaagagau

SEQ ID NO: 3461233 - RNA, 19 nt, Human
uaaaagagguuuuucuuaa

SEQ ID NO: 3461234 - RNA, 21 nt, Human
uaaaagagguuuuucuuaaau

SEQ ID NO: 3461235 - RNA, 23 nt, Human
uaaaagauaacaagaucuuucag

SEQ ID NO: 3461236 - RNA, 17 nt, Human
uaaaagauacaguuacu

SEQ ID NO: 3461237 - RNA, 16 nt, Human
uaaaagaucuugcaga

SEQ ID NO: 3461238 - RNA, 13 nt, Human
uaaaagaugaaag

SEQ ID NO: 3461239 - RNA, 14 nt, Human
uaaaagaugcuuuu

SEQ ID NO: 3461240 - RNA, 18 nt, Human
uaaaagauggggucugua

SEQ ID NO: 3461241 - RNA, 19 nt, Human
uaaaagauggggucuguaa

SEQ ID NO: 3461242 - RNA, 17 nt, Human
uaaaagcaaaaaagaaa

SEQ ID NO: 3461243 - RNA, 19 nt, Human
uaaaagcaaaaaagaaaac

SEQ ID NO: 3461244 - RNA, 15 nt, Human
uaaaagcaaaauaaa

SEQ ID NO: 3461245 - RNA, 13 nt, Human
uaaaagcaaauca

SEQ ID NO: 3461246 - RNA, 15 nt, Human
uaaaagcaaaucauu

SEQ ID NO: 3461247 - RNA, 20 nt, Human
uaaaagcaacaucagcuuga

SEQ ID NO: 3461248 - RNA, 17 nt, Human
uaaaagcaauuccaacc

SEQ ID NO: 3461249 - RNA, 19 nt, Human
uaaaagcacaaaggaauga

SEQ ID NO: 3461250 - RNA, 13 nt, Human
uaaaagcacgaca

SEQ ID NO: 3461251 - RNA, 17 nt, Human
uaaaagcauaaaugcaa

SEQ ID NO: 3461252 - RNA, 16 nt, Human
uaaaagcauuuuguaa

SEQ ID NO: 3461253 - RNA, 15 nt, Human
uaaaagccaucaugu

SEQ ID NO: 3461254 - RNA, 12 nt, Human
uaaaagcccagg

SEQ ID NO: 3461255 - RNA, 14 nt, Human
uaaaagcccaggag

SEQ ID NO: 3461256 - RNA, 15 nt, Human
uaaaagcccaggagc

SEQ ID NO: 3461257 - RNA, 17 nt, Human
uaaaagcccaggagccc

SEQ ID NO: 3461258 - RNA, 18 nt, Human
uaaaagcccaggagccca

SEQ ID NO: 3461259 - RNA, 12 nt, Human
uaaaagccuugg

SEQ ID NO: 3461260 - RNA, 20 nt, Human
uaaaagcguuggauguagca

SEQ ID NO: 3461261 - RNA, 16 nt, Human
uaaaagcuuucauguc

SEQ ID NO: 3461262 - RNA, 18 nt, Human
ugggccuccucuguccag

SEQ ID NO: 3461263 - RNA, 20 nt, Human
ugggccuccucuguccaggg

SEQ ID NO: 3461264 - RNA, 16 nt, Human
ugggccucugguuugg

SEQ ID NO: 3461265 - RNA, 21 nt, Human
ugggccucugguuuggggcga

SEQ ID NO: 3461266 - RNA, 21 nt, Human
ugggccucuuggaaaaaguga

SEQ ID NO: 3461267 - RNA, 13 nt, Human
ugggccugcagaa

SEQ ID NO: 3461268 - RNA, 14 nt, Human
ugggccugcuccag

SEQ ID NO: 3461269 - RNA, 12 nt, Human
ugggccugcugc

SEQ ID NO: 3461270 - RNA, 13 nt, Human
ugggccugcugcu

SEQ ID NO: 3461271 - RNA, 14 nt, Human
ugggccugcugcug

SEQ ID NO: 3461272 - RNA, 15 nt, Human
ugggccugcugcuga

SEQ ID NO: 3461273 - RNA, 23 nt, Human
ugggccugcugcugagaaccugg

SEQ ID NO: 3461274 - RNA, 14 nt, Human
ugggccugcuuccu

SEQ ID NO: 3461275 - RNA, 21 nt, Human
ugggccuggcucccucacucu

SEQ ID NO: 3461276 - RNA, 18 nt, Human
ugggccugggcuagggga

SEQ ID NO: 3461277 - RNA, 18 nt, Human
ugggccugggcuccugga

SEQ ID NO: 3461278 - RNA, 19 nt, Human
ugggccugggcuccuggac

SEQ ID NO: 3461279 - RNA, 20 nt, Human
ugggccugggcuccuggacc

SEQ ID NO: 3461280 - RNA, 16 nt, Human
ugggccuuagugggcc

SEQ ID NO: 3461281 - RNA, 12 nt, Human
ugggccuugcug

SEQ ID NO: 3461282 - RNA, 15 nt, Human
ugggcgcccuggaag

SEQ ID NO: 3461283 - RNA, 19 nt, Human
ugggcgccgugcugggcag

SEQ ID NO: 3461284 - RNA, 23 nt, Human
ugggcgccgugcugggcagcccg

SEQ ID NO: 3461285 - RNA, 14 nt, Human
ugggcgcugguccu

SEQ ID NO: 3461286 - RNA, 16 nt, Human
ugggcggcucugaagc

SEQ ID NO: 3461287 - RNA, 21 nt, Human
ugggcggcugagagccccagc

SEQ ID NO: 3461288 - RNA, 14 nt, Human
ugggcggcugugcu

SEQ ID NO: 3461289 - RNA, 13 nt, Human
ugggcgggcagca

SEQ ID NO: 3461290 - RNA, 16 nt, Human
ugggcgggcccagcac

SEQ ID NO: 3461291 - RNA, 17 nt, Human
ugggcguacgcuggugc

SEQ ID NO: 3461292 - RNA, 18 nt, Human
ugggcguacgcuggugcu

SEQ ID NO: 3461293 - RNA, 17 nt, Human
ugggcuaauuaaauaaa

SEQ ID NO: 3461294 - RNA, 18 nt, Human
ugggcuauggacacaggg

SEQ ID NO: 3461295 - RNA, 21 nt, Human
ugggcuauggacacaggguga

SEQ ID NO: 3461296 - RNA, 23 nt, Human
ugggcucaagcaauccuccugag

SEQ ID NO: 3461297 - RNA, 16 nt, Human
ugggcuccccucuucc

SEQ ID NO: 3461298 - RNA, 19 nt, Human
ugggcucccugacugggag

SEQ ID NO: 3461299 - RNA, 18 nt, Human
ugggcucccuucccaccu

SEQ ID NO: 3461300 - RNA, 19 nt, Human
ugggcucccuucccaccuc

SEQ ID NO: 3461301 - RNA, 18 nt, Human
ugggcuccgugugggaga

SEQ ID NO: 3461302 - RNA, 13 nt, Human
ugggcuccuccag

SEQ ID NO: 3461303 - RNA, 14 nt, Human
ugggcucgcccacc

SEQ ID NO: 3461304 - RNA, 17 nt, Human
ugggcucggaggcugcc

SEQ ID NO: 3461305 - RNA, 17 nt, Human
ugggcucgucuuugcag

SEQ ID NO: 3461306 - RNA, 14 nt, Human
ugggcucuccaccu

SEQ ID NO: 3461307 - RNA, 17 nt, Human
ugggcucuccaccucag

SEQ ID NO: 3461308 - RNA, 13 nt, Human
ugggcucuccggg

SEQ ID NO: 3461309 - RNA, 19 nt, Human
ugggcucugacagaaagca

SEQ ID NO: 3461310 - RNA, 15 nt, Human
ugggcucugaugaaa

SEQ ID NO: 3461311 - RNA, 20 nt, Human
ugggcucugcaauuccccuc

SEQ ID NO: 3461312 - RNA, 18 nt, Human
ugggcucugccacccuac

SEQ ID NO: 3461313 - RNA, 15 nt, Human
ugggcucugccccag

SEQ ID NO: 3461314 - RNA, 17 nt, Human
ugggcucugccccagcu

SEQ ID NO: 3461315 - RNA, 20 nt, Human
ugggcucugccccagcucug

SEQ ID NO: 3461316 - RNA, 23 nt, Human
ugggcucugccccagcucuggcu

SEQ ID NO: 3461317 - RNA, 18 nt, Human
ugggcucugugcagucac

SEQ ID NO: 3461318 - RNA, 15 nt, Human
ugggcugagacugga

SEQ ID NO: 3461319 - RNA, 14 nt, Human
ugggcugagccccu

SEQ ID NO: 3461320 - RNA, 17 nt, Human
ugggcugagccccuacc

SEQ ID NO: 3461321 - RNA, 18 nt, Human
ugggcugagccccuaccc

SEQ ID NO: 3461322 - RNA, 17 nt, Human
ugggcugagcccuggca

SEQ ID NO: 3461323 - RNA, 16 nt, Human
ugggcugagggagccu

SEQ ID NO: 3461324 - RNA, 17 nt, Human
ugggcugcacucugugc

SEQ ID NO: 3461325 - RNA, 21 nt, Human
ugggcugcagcagaggcacug

SEQ ID NO: 3461326 - RNA, 13 nt, Human
ugggcugcccugg

SEQ ID NO: 3461327 - RNA, 14 nt, Human
ugggcugcccuggu

SEQ ID NO: 3461328 - RNA, 16 nt, Human
ugggcugcccuggugc

SEQ ID NO: 3461329 - RNA, 21 nt, Human
ugggcugcccuggugcugcca

SEQ ID NO: 3461330 - RNA, 23 nt, Human
ugggcuggacuucuaccugcccu

SEQ ID NO: 3461331 - RNA, 15 nt, Human
ugggcuggaugagcu

SEQ ID NO: 3461332 - RNA, 12 nt, Human
ugggcugggcac

SEQ ID NO: 3461333 - RNA, 14 nt, Human
ugggcugggcccuc

SEQ ID NO: 3461334 - RNA, 22 nt, Human
ugggcugggcccucucuucuca

SEQ ID NO: 3461335 - RNA, 20 nt, Human
ugggcugggugcgaccccau

SEQ ID NO: 3461336 - RNA, 18 nt, Human
ugggcuggguucuaccca

SEQ ID NO: 3461337 - RNA, 18 nt, Human
ugggcugguaucucagaa

SEQ ID NO: 3461338 - RNA, 21 nt, Human
ugggcugguaucucagaaagu

SEQ ID NO: 3461339 - RNA, 17 nt, Human
ugggcuggugucaccug

SEQ ID NO: 3461340 - RNA, 12 nt, Human
ugggcugugagu

SEQ ID NO: 3461341 - RNA, 15 nt, Human
ugggcugugagugua

SEQ ID NO: 3461342 - RNA, 19 nt, Human
ugggcuguuggcacucaca

SEQ ID NO: 3461343 - RNA, 23 nt, Human
ugggcuguuggcacucacagacc

SEQ ID NO: 3461344 - RNA, 16 nt, Human
ugggcuucacuguaua

SEQ ID NO: 3461345 - RNA, 11 nt, Human
ugggcuucagc

SEQ ID NO: 3461346 - RNA, 18 nt, Human
ugggcuucagggcaggug

SEQ ID NO: 3461347 - RNA, 20 nt, Human
ugggcuucaguggcagcugc

SEQ ID NO: 3461348 - RNA, 19 nt, Human
ugggcuuccauuugugugu

SEQ ID NO: 3461349 - RNA, 23 nt, Human
ugggcuucccaguggcugcugcc

SEQ ID NO: 3461350 - RNA, 14 nt, Human
ugggcuuccuggag

SEQ ID NO: 3461351 - RNA, 17 nt, Human
ugggcuuccuggagcag

SEQ ID NO: 3461352 - RNA, 20 nt, Human
ugggcuuccuggagcagaag

SEQ ID NO: 3461353 - RNA, 12 nt, Human
ugggcuucugug

SEQ ID NO: 3461354 - RNA, 14 nt, Human
ugggcuugaccagg

SEQ ID NO: 3461355 - RNA, 17 nt, Human
ugggcuugcuauucugu

SEQ ID NO: 3461356 - RNA, 19 nt, Human
ugggcuuggccugcuguga

SEQ ID NO: 3461357 - RNA, 19 nt, Human
ugggcuugggccuaggcug

SEQ ID NO: 3461358 - RNA, 19 nt, Human
ugggcuuggggaccagagc

SEQ ID NO: 3461359 - RNA, 17 nt, Human
ugggcuuugauuccauc

SEQ ID NO: 3461360 - RNA, 23 nt, Human
ugggcuuugauuccaucuccuug

SEQ ID NO: 3461361 - RNA, 18 nt, Human
uggggaaacagcaucucc

SEQ ID NO: 3461362 - RNA, 16 nt, Human
uggggaaacuggccau

SEQ ID NO: 3461363 - RNA, 18 nt, Human
uggggaaacuggccaugg

SEQ ID NO: 3461364 - RNA, 19 nt, Human
uggggaacaaggguggcau

SEQ ID NO: 3461365 - RNA, 18 nt, Human
uggggaacauuucuguaa

SEQ ID NO: 3461366 - RNA, 18 nt, Human
uggggaagacaguggccc

SEQ ID NO: 3461367 - RNA, 14 nt, Human
uggggaagacugug

SEQ ID NO: 3461368 - RNA, 17 nt, Human
uggggaagagagccugc

SEQ ID NO: 3461369 - RNA, 22 nt, Human
uggggaagagagccugcaggau

SEQ ID NO: 3461370 - RNA, 15 nt, Human
uggggaaggagccag

SEQ ID NO: 3461371 - RNA, 16 nt, Human
uggggaagggccugcc

SEQ ID NO: 3461372 - RNA, 16 nt, Human
uggggaagugaggaag

SEQ ID NO: 3461373 - RNA, 14 nt, Human
uggggaaugaagau

SEQ ID NO: 3461374 - RNA, 14 nt, Human
uggggaauuuccuc

SEQ ID NO: 3461375 - RNA, 16 nt, Human
uggggaauuuccucua

SEQ ID NO: 3461376 - RNA, 17 nt, Human
uggggacagagcagaac

SEQ ID NO: 3461377 - RNA, 19 nt, Human
uggggacagauucagucuu

SEQ ID NO: 3461378 - RNA, 13 nt, Human
uggggacagggcu

SEQ ID NO: 3461379 - RNA, 16 nt, Human
uguguagcugugaccu

SEQ ID NO: 3461380 - RNA, 14 nt, Human
uguguagcuuugcu

SEQ ID NO: 3461381 - RNA, 12 nt, Human
uguguagggcgg

SEQ ID NO: 3461382 - RNA, 17 nt, Human
uguguaguucauguaaa

SEQ ID NO: 3461383 - RNA, 21 nt, Human
uguguauaaacaagaaaaaua

SEQ ID NO: 3461384 - RNA, 17 nt, Human
uguguauaagugcacac

SEQ ID NO: 3461385 - RNA, 16 nt, Human
uguguauacagcccug

SEQ ID NO: 3461386 - RNA, 15 nt, Human
uguguauacaugcca

SEQ ID NO: 3461387 - RNA, 14 nt, Human
uguguauauauaca

SEQ ID NO: 3461388 - RNA, 19 nt, Human
uguguauauauuuugugug

SEQ ID NO: 3461389 - RNA, 18 nt, Human
uguguauauuauuuggca

SEQ ID NO: 3461390 - RNA, 19 nt, Human
uguguauccauuaucaugu

SEQ ID NO: 3461391 - RNA, 24 nt, Human
uguguauccauuaucauguguaau

SEQ ID NO: 3461392 - RNA, 17 nt, Human
uguguaucucuuucaca

SEQ ID NO: 3461393 - RNA, 15 nt, Human
uguguaugcugcuuu

SEQ ID NO: 3461394 - RNA, 14 nt, Human
uguguaugggcaaa

SEQ ID NO: 3461395 - RNA, 11 nt, Human
uguguaugugg

SEQ ID NO: 3461396 - RNA, 14 nt, Human
uguguauguggggg

SEQ ID NO: 3461397 - RNA, 12 nt, Human
uguguaugugua

SEQ ID NO: 3461398 - RNA, 13 nt, Human
uguguaugugugu

SEQ ID NO: 3461399 - RNA, 14 nt, Human
uguguauuaaaaaa

SEQ ID NO: 3461400 - RNA, 14 nt, Human
uguguauucuuaaa

SEQ ID NO: 3461401 - RNA, 14 nt, Human
uguguauuguuccc

SEQ ID NO: 3461402 - RNA, 20 nt, Human
uguguauuguuguaaaaugu

SEQ ID NO: 3461403 - RNA, 13 nt, Human
uguguauuuaaca

SEQ ID NO: 3461404 - RNA, 16 nt, Human
uguguauuucuuauac

SEQ ID NO: 3461405 - RNA, 16 nt, Human
ugugucaaugggcaau

SEQ ID NO: 3461406 - RNA, 18 nt, Human
ugugucacuggcugccuc

SEQ ID NO: 3461407 - RNA, 23 nt, Human
ugugucacuggcugccuccacuc

SEQ ID NO: 3461408 - RNA, 22 nt, Human
ugguggcccucuccccugcccc

SEQ ID NO: 3461409 - RNA, 23 nt, Human
ugguggcccucuccccugccccc

SEQ ID NO: 3461410 - RNA, 17 nt, Human
ugguggcgcaagccugu

SEQ ID NO: 3461411 - RNA, 23 nt, Human
uggugggcuugucauagccagug

SEQ ID NO: 3461412 - RNA, 16 nt, Human
uggugggggccucggu

SEQ ID NO: 3461413 - RNA, 17 nt, Human
ugguggggguagagcug

SEQ ID NO: 3461414 - RNA, 21 nt, Human
ugguggggguagagcugaucc

SEQ ID NO: 3461415 - RNA, 16 nt, Human
ugguggguccaugggc

SEQ ID NO: 3461416 - RNA, 21 nt, Human
uggugggugaaagaaaucaug

SEQ ID NO: 3461417 - RNA, 15 nt, Human
uggugguaucugagu

SEQ ID NO: 3461418 - RNA, 20 nt, Human
uggugguugggacccagugg

SEQ ID NO: 3461419 - RNA, 13 nt, Human
ugguguaauaaga

SEQ ID NO: 3461420 - RNA, 14 nt, Human
ugguguaauaagac

SEQ ID NO: 3461421 - RNA, 16 nt, Human
ugguguaauaagacau

SEQ ID NO: 3461422 - RNA, 19 nt, Human
ugguguaauaagacauaac

SEQ ID NO: 3461423 - RNA, 15 nt, Human
ugguguaauuugaag

SEQ ID NO: 3461424 - RNA, 18 nt, Human
ugguguagcccucccacu

SEQ ID NO: 3461425 - RNA, 19 nt, Human
uggugucaacaugaaacac

SEQ ID NO: 3461426 - RNA, 19 nt, Human
uggugucaccccagagcca

SEQ ID NO: 3461427 - RNA, 12 nt, Human
uggugucacugu

SEQ ID NO: 3461428 - RNA, 14 nt, Human
uggugucacugucc

SEQ ID NO: 3461429 - RNA, 22 nt, Human
uggugucacugucccuccuggu

SEQ ID NO: 3461430 - RNA, 15 nt, Human
ugguguccaccuggc

SEQ ID NO: 3461431 - RNA, 13 nt, Human
ugguguccagcug

SEQ ID NO: 3461432 - RNA, 15 nt, Human
ugguguccugaccac

SEQ ID NO: 3461433 - RNA, 19 nt, Human
ugguguccugaccacccuc

SEQ ID NO: 3461434 - RNA, 19 nt, Human
ugguguccuuucccuccac

SEQ ID NO: 3461435 - RNA, 15 nt, Human
uggugucgggcauga

SEQ ID NO: 3461436 - RNA, 19 nt, Human
uggugucuccaacccccca

SEQ ID NO: 3461437 - RNA, 23 nt, Human
uggugucucuucuuuagaacagg

SEQ ID NO: 3461438 - RNA, 14 nt, Human
uggugucugccugu

SEQ ID NO: 3461439 - RNA, 17 nt, Human
uggugugaacccgggag

SEQ ID NO: 3461440 - RNA, 11 nt, Human
uggugugaagg

SEQ ID NO: 3461441 - RNA, 18 nt, Human
uggugugacccucugaau

SEQ ID NO: 3461442 - RNA, 18 nt, Human
uggugugaucgucugacu

SEQ ID NO: 3461443 - RNA, 22 nt, Human
uggugugaucuuaauauauuug

SEQ ID NO: 3461444 - RNA, 14 nt, Human
ugguguggccugug

SEQ ID NO: 3461445 - RNA, 14 nt, Human
uggugugguacaga

SEQ ID NO: 3461446 - RNA, 15 nt, Human
uggugugguacagag

SEQ ID NO: 3461447 - RNA, 22 nt, Human
uggugugucccauugguguugu

SEQ ID NO: 3461448 - RNA, 15 nt, Human
ugguguguguaugcg

SEQ ID NO: 3461449 - RNA, 11 nt, Human
ugguguuaaca

SEQ ID NO: 3461450 - RNA, 20 nt, Human
ugguguuaacagaagggagg

SEQ ID NO: 3461451 - RNA, 17 nt, Human
ugguguuacugcaguug

SEQ ID NO: 3461452 - RNA, 19 nt, Human
ugguguuauuugaaacuuu

SEQ ID NO: 3461453 - RNA, 22 nt, Human
ugguguucaaaaaacuuguaaa

SEQ ID NO: 3461454 - RNA, 13 nt, Human
ugguguugcagaa

SEQ ID NO: 3461455 - RNA, 17 nt, Human
ugguguugcagaagguu

SEQ ID NO: 3461456 - RNA, 21 nt, Human
ugguguuucuagcacuggccu

SEQ ID NO: 3461457 - RNA, 16 nt, Human
ugguguuucucccucu

SEQ ID NO: 3461458 - RNA, 17 nt, Human
ugguguuuuaaagagaa

SEQ ID NO: 3461459 - RNA, 20 nt, Human
ugguguuuuggggaugagag

SEQ ID NO: 3461460 - RNA, 18 nt, Human
ugguguuuuucuuguaaa

SEQ ID NO: 3461461 - RNA, 22 nt, Human
ugguguuuuuuucuaugggugu

SEQ ID NO: 3461462 - RNA, 17 nt, Human
ugguuaaaaaaaagaau

SEQ ID NO: 3461463 - RNA, 22 nt, Human
ugguuaaaacuguacauuuaaa

SEQ ID NO: 3461464 - RNA, 13 nt, Human
ugguuacacuguu

SEQ ID NO: 3461465 - RNA, 21 nt, Human
ugguuacacuguuagaacacu

SEQ ID NO: 3461466 - RNA, 22 nt, Human
ugguuacacuguuagaacacua

SEQ ID NO: 3461467 - RNA, 15 nt, Human
ugguuaccaugucuu

SEQ ID NO: 3461468 - RNA, 15 nt, Human
ugguuacuucuucuc

SEQ ID NO: 3461469 - RNA, 18 nt, Human
ugguuacuucuucucuua

SEQ ID NO: 3461470 - RNA, 13 nt, Human
ugguuagaaaaca

SEQ ID NO: 3461471 - RNA, 13 nt, Human
ugguuagcucagc

SEQ ID NO: 3461472 - RNA, 16 nt, Human
ugguuagcucagcccc

SEQ ID NO: 3461473 - RNA, 19 nt, Human
ugguuagcucagccccagc

SEQ ID NO: 3461474 - RNA, 20 nt, Human
ugguuagcucagccccagcc

SEQ ID NO: 3461475 - RNA, 22 nt, Human
ugguuagcucagccccagccca

SEQ ID NO: 3461476 - RNA, 16 nt, Human
ugguuauaaaagugau

SEQ ID NO: 3461477 - RNA, 13 nt, Human
ugguuauacauga

SEQ ID NO: 3461478 - RNA, 17 nt, Human
ugguuauacaugacacu

SEQ ID NO: 3461479 - RNA, 13 nt, Human
ugguuaugaaaga

SEQ ID NO: 3461480 - RNA, 13 nt, Human
ugguuauguuuuu

SEQ ID NO: 3461481 - RNA, 19 nt, Human
ugguuauguuuuucugugu

SEQ ID NO: 3461482 - RNA, 15 nt, Human
ugguuauuucucuga

SEQ ID NO: 3461483 - RNA, 15 nt, Human
ugguuauuuuacuuu

SEQ ID NO: 3461484 - RNA, 20 nt, Human
ugguucacucuuggagccug

SEQ ID NO: 3461485 - RNA, 21 nt, Human
ugguucagaauuaaacuuuua

SEQ ID NO: 3461486 - RNA, 20 nt, Human
ugguucaggguuggccccug

SEQ ID NO: 3461487 - RNA, 16 nt, Human
ugguucaucaguguua

SEQ ID NO: 3461488 - RNA, 19 nt, Human
ugguuccaugccugagggu

SEQ ID NO: 3461489 - RNA, 17 nt, Human
ugguucccuugaugaag

SEQ ID NO: 3461490 - RNA, 12 nt, Human
ugguuccucccc

SEQ ID NO: 3461491 - RNA, 12 nt, Human
ugguuccucugc

SEQ ID NO: 3461492 - RNA, 12 nt, Human
ugguuccugggg

SEQ ID NO: 3461493 - RNA, 14 nt, Human
ugguuccuggggca

SEQ ID NO: 3461494 - RNA, 15 nt, Human
ugguucucaaugaaa

SEQ ID NO: 3461495 - RNA, 18 nt, Human
ugguucucaauuccaaca

SEQ ID NO: 3461496 - RNA, 23 nt, Human
ugguucucaauuccaacaguuua

SEQ ID NO: 3461497 - RNA, 14 nt, Human
ugguucucaucuuu

SEQ ID NO: 3461498 - RNA, 15 nt, Human
ugguucucaucuuuc

SEQ ID NO: 3461499 - RNA, 12 nt, Human
ugguucuggggc

SEQ ID NO: 3461500 - RNA, 12 nt, Human
ugguucuucuca

SEQ ID NO: 3461501 - RNA, 19 nt, Human
ugguucuucucaaaagaac

SEQ ID NO: 3461502 - RNA, 21 nt, Human
ugguucuugguagagauucau

SEQ ID NO: 3461503 - RNA, 18 nt, Human
ugguucuuguauuaagaa

SEQ ID NO: 3461504 - RNA, 23 nt, Human
ugguugaacucugguggcacagg

SEQ ID NO: 3461505 - RNA, 12 nt, Human
ugguugaauaaa

SEQ ID NO: 3461506 - RNA, 12 nt, Human
ugguugaggaaa

SEQ ID NO: 3461507 - RNA, 13 nt, Human
ugguugcauccua

SEQ ID NO: 3461508 - RNA, 11 nt, Human
ugguugcaugg

SEQ ID NO: 3461509 - RNA, 17 nt, Human
ugguugccuuaaagaaa

SEQ ID NO: 3461510 - RNA, 13 nt, Human
ugguugcugugug

SEQ ID NO: 3461511 - RNA, 19 nt, Human
ugguugcuguuuuccuccc

SEQ ID NO: 3461512 - RNA, 18 nt, Human
ugguugcuuuaauaucau

SEQ ID NO: 3461513 - RNA, 14 nt, Human
ugguugggacccag

SEQ ID NO: 3461514 - RNA, 15 nt, Human
ugguuggguccucac

SEQ ID NO: 3461515 - RNA, 17 nt, Human
ugguugguuuucuucuu

SEQ ID NO: 3461516 - RNA, 20 nt, Human
ugguuguacauauaagugau

SEQ ID NO: 3461517 - RNA, 11 nt, Human
ugguuguauuc

SEQ ID NO: 3461518 - RNA, 17 nt, Human
ugguuguauucuuugau

SEQ ID NO: 3461519 - RNA, 15 nt, Human
ugguugucaauauua

SEQ ID NO: 3461520 - RNA, 21 nt, Human
ugguuguuaguuauagauguc

SEQ ID NO: 3461521 - RNA, 15 nt, Human
ugguuuaaaagaaaa

SEQ ID NO: 3461522 - RNA, 19 nt, Human
ugguuuaaagaaaguguau

SEQ ID NO: 3461523 - RNA, 23 nt, Human
ugguuuaaugcaauagaagugcu

SEQ ID NO: 3461524 - RNA, 15 nt, Human
ugguuuacaggcccu

SEQ ID NO: 3461525 - RNA, 22 nt, Human
ugguuuacaggcccugcuccug

SEQ ID NO: 3461526 - RNA, 23 nt, Human
ugguuuacauuuaaagcauugcu

SEQ ID NO: 3461527 - RNA, 21 nt, Human
ugguuuaguguaaaaaugaga

SEQ ID NO: 3461528 - RNA, 18 nt, Human
ugguuuaucagcaaaaaa

SEQ ID NO: 3461529 - RNA, 12 nt, Human
ugguuuauguca

SEQ ID NO: 3461530 - RNA, 22 nt, Human
ugguuuauuuuguauuguggua

SEQ ID NO: 3461531 - RNA, 18 nt, Human
ugguuucacuggcccaag

SEQ ID NO: 3461532 - RNA, 14 nt, Human
ugguuucagaaaug

SEQ ID NO: 3461533 - RNA, 15 nt, Human
ugguuucagaaaugu

SEQ ID NO: 3461534 - RNA, 13 nt, Human
ugguuucagcaau

SEQ ID NO: 3461535 - RNA, 23 nt, Human
ugguuucagcacuagccaaaccu

SEQ ID NO: 3461536 - RNA, 22 nt, Human
ugguuuccaaggagcugagaau

SEQ ID NO: 3461537 - RNA, 21 nt, Human
ugguuuccacgaugaaaaacu

SEQ ID NO: 3461538 - RNA, 13 nt, Human
ugguuuccugccc

SEQ ID NO: 3461539 - RNA, 15 nt, Human
ugguuucgaacuccu

SEQ ID NO: 3461540 - RNA, 12 nt, Human
ugguuucuccag

SEQ ID NO: 3461541 - RNA, 15 nt, Human
ugguuucuuuuugaa

SEQ ID NO: 3461542 - RNA, 23 nt, Human
ugguuugaaaauauuuucauuau

SEQ ID NO: 3461543 - RNA, 23 nt, Human
ugguuugagcuuagugaaauuac

SEQ ID NO: 3461544 - RNA, 15 nt, Human
ugguuugcaaggaag

SEQ ID NO: 3461545 - RNA, 17 nt, Human
ugguuugcaaggaagcc

SEQ ID NO: 3461546 - RNA, 14 nt, Human
ugguuugcagauga

SEQ ID NO: 3461547 - RNA, 17 nt, Human
ugguuugcagaugacaa

SEQ ID NO: 3461548 - RNA, 19 nt, Human
ugguuugcagcgacuggca

SEQ ID NO: 3461549 - RNA, 15 nt, Human
ugguuugcagguggc

SEQ ID NO: 3461550 - RNA, 16 nt, Human
ugguuugccuuccaga

SEQ ID NO: 3461551 - RNA, 17 nt, Human
ugguuugccuuccagaa

SEQ ID NO: 3461552 - RNA, 14 nt, Human
ugguuugcuacuuc

SEQ ID NO: 3461553 - RNA, 16 nt, Human
ugguuuggaaugcuuc

SEQ ID NO: 3461554 - RNA, 18 nt, Human
uguaacuacuuuauaacu

SEQ ID NO: 3461555 - RNA, 21 nt, Human
uguaacuaggcucagagaugu

SEQ ID NO: 3461556 - RNA, 19 nt, Human
uguaacuauaguccagcuu

SEQ ID NO: 3461557 - RNA, 17 nt, Human
uguaacuauguuuuauc

SEQ ID NO: 3461558 - RNA, 12 nt, Human
uguaacuccacc

SEQ ID NO: 3461559 - RNA, 12 nt, Human
uguaacucuaaa

SEQ ID NO: 3461560 - RNA, 17 nt, Human
uguaacucuaaaagauc

SEQ ID NO: 3461561 - RNA, 23 nt, Human
uguaacugcauugagaacugcau

SEQ ID NO: 3461562 - RNA, 18 nt, Human
uguaacugcccaaagcag

SEQ ID NO: 3461563 - RNA, 22 nt, Human
uguaacugcucuugggcaauau

SEQ ID NO: 3461564 - RNA, 21 nt, Human
uguaacuguuaccauuggaaa

SEQ ID NO: 3461565 - RNA, 13 nt, Human
uguaacuuaugua

SEQ ID NO: 3461566 - RNA, 20 nt, Human
uguaacuuauguagauauuu

SEQ ID NO: 3461567 - RNA, 21 nt, Human
uguaacuuccaaauaaauaau

SEQ ID NO: 3461568 - RNA, 24 nt, Human
uguaacuugaaccuaugaagcaau

SEQ ID NO: 3461569 - RNA, 23 nt, Human
uguaacuugauccauuucuaauu

SEQ ID NO: 3461570 - RNA, 18 nt, Human
uguaacuuucucuaugaa

SEQ ID NO: 3461571 - RNA, 22 nt, Human
uguaagaaacacacugaggcag

SEQ ID NO: 3461572 - RNA, 18 nt, Human
uguaagaaaccaaucaag

SEQ ID NO: 3461573 - RNA, 15 nt, Human
uguaagaacuaaaga

SEQ ID NO: 3461574 - RNA, 22 nt, Human
uguaagaacuaaagaagaucug

SEQ ID NO: 3461575 - RNA, 16 nt, Human
uguaagaauaauuuau

SEQ ID NO: 3461576 - RNA, 20 nt, Human
uguaagacaaagguuuuccu

SEQ ID NO: 3461577 - RNA, 21 nt, Human
uguaagacaaagguuuuccuc

SEQ ID NO: 3461578 - RNA, 12 nt, Human
uguaagaugcug

SEQ ID NO: 3461579 - RNA, 13 nt, Human
uguaagaugucug

SEQ ID NO: 3461580 - RNA, 19 nt, Human
uguaagauuauagauucua

SEQ ID NO: 3461581 - RNA, 23 nt, Human
uguaagauuauagauucuaaaga

SEQ ID NO: 3461582 - RNA, 14 nt, Human
uguaagauuuugaa

SEQ ID NO: 3461583 - RNA, 15 nt, Human
uguaagauuuugaaa

SEQ ID NO: 3461584 - RNA, 16 nt, Human
uguaagauuuugaaaa

SEQ ID NO: 3461585 - RNA, 18 nt, Human
uguaagccaaagaaauga

SEQ ID NO: 3461586 - RNA, 22 nt, Human
uguaagccaaagaaaugaacau

SEQ ID NO: 3461587 - RNA, 14 nt, Human
uguaagccugcaag

SEQ ID NO: 3461588 - RNA, 21 nt, Human
uguaagcguauggcuuuauuu

SEQ ID NO: 3461589 - RNA, 14 nt, Human
uguaagcugaaaau

SEQ ID NO: 3461590 - RNA, 13 nt, Human
uguaagcugaagu

SEQ ID NO: 3461591 - RNA, 23 nt, Human
uguaagcuguuugguuuuaaaau

SEQ ID NO: 3461592 - RNA, 14 nt, Human
uguaaggaaugauu

SEQ ID NO: 3461593 - RNA, 19 nt, Human
uguaaggaaugcuuggaau

SEQ ID NO: 3461594 - RNA, 15 nt, Human
uguaaggcaaucaug

SEQ ID NO: 3461595 - RNA, 18 nt, Human
uguaagggaaacugccag

SEQ ID NO: 3461596 - RNA, 18 nt, Human
uguaagggccagaaauau

SEQ ID NO: 3461597 - RNA, 19 nt, Human
uguaagucaguguugagau

SEQ ID NO: 3461598 - RNA, 18 nt, Human
uguaagugagagagacaa

SEQ ID NO: 3461599 - RNA, 17 nt, Human
uguaagugugaguaaga

SEQ ID NO: 3461600 - RNA, 16 nt, Human
uguaaguuauuucuug

SEQ ID NO: 3461601 - RNA, 22 nt, Human
uguaaguuauuucuuguuuguu

SEQ ID NO: 3461602 - RNA, 14 nt, Human
uguaaguucacaac

SEQ ID NO: 3461603 - RNA, 19 nt, Human
uguaaguugggcuugcuau

SEQ ID NO: 3461604 - RNA, 21 nt, Human
uguaaguugggcuugcuauuc

SEQ ID NO: 3461605 - RNA, 20 nt, Human
uguaaguuuaccuauguaac

SEQ ID NO: 3461606 - RNA, 13 nt, Human
uguaaguuucagg

SEQ ID NO: 3461607 - RNA, 14 nt, Human
uguuuguguauuua

SEQ ID NO: 3461608 - RNA, 11 nt, Human
uguuugugugu

SEQ ID NO: 3461609 - RNA, 17 nt, Human
uguuuguugcuggcuug

SEQ ID NO: 3461610 - RNA, 17 nt, Human
uguuuguugucagcuga

SEQ ID NO: 3461611 - RNA, 13 nt, Human
uguuuguuuaauu

SEQ ID NO: 3461612 - RNA, 12 nt, Human
uguuuguuuagu

SEQ ID NO: 3461613 - RNA, 17 nt, Human
uguuuguuuccuuuguu

SEQ ID NO: 3461614 - RNA, 13 nt, Human
uguuuguuucuuu

SEQ ID NO: 3461615 - RNA, 17 nt, Human
uguuuuaaaaaccuguu

SEQ ID NO: 3461616 - RNA, 12 nt, Human
uguuuuaaaaag

SEQ ID NO: 3461617 - RNA, 21 nt, Human
uguuuuaaaaaggaacugcag

SEQ ID NO: 3461618 - RNA, 23 nt, Human
uguuuuaaaaaggaacugcagca

SEQ ID NO: 3461619 - RNA, 20 nt, Human
uguuuuaaacauagaaaguu

SEQ ID NO: 3461620 - RNA, 22 nt, Human
uguuuuaaauacgcacuacaug

SEQ ID NO: 3461621 - RNA, 14 nt, Human
uguuuuaacaaaaa

SEQ ID NO: 3461622 - RNA, 23 nt, Human
uguuuuaagaaauguaguugaug

SEQ ID NO: 3461623 - RNA, 23 nt, Human
uguuuuaaggaugcuuguacaua

SEQ ID NO: 3461624 - RNA, 22 nt, Human
uguuuuaauuuauacuggcaug

SEQ ID NO: 3461625 - RNA, 13 nt, Human
uguuuuacaauag

SEQ ID NO: 3461626 - RNA, 13 nt, Human
uguuuuacaaugu

SEQ ID NO: 3461627 - RNA, 15 nt, Human
uguuuuacacuguac

SEQ ID NO: 3461628 - RNA, 16 nt, Human
uguuuuacugcuuuua

SEQ ID NO: 3461629 - RNA, 19 nt, Human
uguuuuagaaugaugcaca

SEQ ID NO: 3461630 - RNA, 19 nt, Human
uguuuuagacaaauacuca

SEQ ID NO: 3461631 - RNA, 19 nt, Human
uguuuuagaguuaacaaug

SEQ ID NO: 3461632 - RNA, 23 nt, Human
uguuuuagguuaaaaaaaggcau

SEQ ID NO: 3461633 - RNA, 15 nt, Human
uguuuuauaaguuca

SEQ ID NO: 3461634 - RNA, 13 nt, Human
uguuuuauaauuu

SEQ ID NO: 3461635 - RNA, 14 nt, Human
uguuuuaugagaaa

SEQ ID NO: 3461636 - RNA, 18 nt, Human
uguuuuauuuuuuauugu

SEQ ID NO: 3461637 - RNA, 23 nt, Human
uguuuucaaaccaguauacaaga

SEQ ID NO: 3461638 - RNA, 14 nt, Human
uguuuucaaaugga

SEQ ID NO: 3461639 - RNA, 18 nt, Human
uguuuucaauuuuaaaca

SEQ ID NO: 3461640 - RNA, 15 nt, Human
uguuuucauaauaaa

SEQ ID NO: 3461641 - RNA, 20 nt, Human
uguuuucauggugaaaaugu

SEQ ID NO: 3461642 - RNA, 19 nt, Human
uguuuucauguaaauaaau

SEQ ID NO: 3461643 - RNA, 15 nt, Human
uguuuuccagcuccu

SEQ ID NO: 3461644 - RNA, 23 nt, Human
uguuuucccgagcaaagucuaaa

SEQ ID NO: 3461645 - RNA, 19 nt, Human
uguuuuccgugaaaacgga

SEQ ID NO: 3461646 - RNA, 14 nt, Human
uguuuuccucccuu

SEQ ID NO: 3461647 - RNA, 23 nt, Human
uguuuuccucccuucugcuacug

SEQ ID NO: 3461648 - RNA, 19 nt, Human
uguuuucuaguguaucaaa

SEQ ID NO: 3461649 - RNA, 16 nt, Human
uguuuucugacuaauu

SEQ ID NO: 3461650 - RNA, 14 nt, Human
uguuuucuguguaa

SEQ ID NO: 3461651 - RNA, 15 nt, Human
uguuuucuguguaac

SEQ ID NO: 3461652 - RNA, 11 nt, Human
uguuuucuucu

SEQ ID NO: 3461653 - RNA, 21 nt, Human
uguuuucuuuaaagauguaau

SEQ ID NO: 3461654 - RNA, 20 nt, Human
uguuuucuuucuuuaaaugu

SEQ ID NO: 3461655 - RNA, 21 nt, Human
uguuuucuuucuuuaaauguu

SEQ ID NO: 3461656 - RNA, 17 nt, Human
uguuuugaaaucaaugc

SEQ ID NO: 3461657 - RNA, 16 nt, Human
uguuuugagcuuucca

SEQ ID NO: 3461658 - RNA, 11 nt, Human
uguuuugcaag

SEQ ID NO: 3461659 - RNA, 12 nt, Human
uguuuugcacuu

SEQ ID NO: 3461660 - RNA, 13 nt, Human
uguuuugcacuuu

SEQ ID NO: 3461661 - RNA, 16 nt, Human
uguuuugccaacauug

SEQ ID NO: 3461662 - RNA, 22 nt, Human
uguuuugccaauuugcacauua

SEQ ID NO: 3461663 - RNA, 14 nt, Human
uguuuugcuaaagg

SEQ ID NO: 3461664 - RNA, 21 nt, Human
uguuuuggauuuggagagaaa

SEQ ID NO: 3461665 - RNA, 20 nt, Human
uguuuuggggaugagagggu

SEQ ID NO: 3461666 - RNA, 19 nt, Human
uguuuuggguagcugccac

SEQ ID NO: 3461667 - RNA, 22 nt, Human
uguuuugguaucuguucuuuaa

SEQ ID NO: 3461668 - RNA, 22 nt, Human
uguuuuguaaacuuugaaauau

SEQ ID NO: 3461669 - RNA, 12 nt, Human
uguuuuguaaag

SEQ ID NO: 3461670 - RNA, 13 nt, Human
uguuuuguaccag

SEQ ID NO: 3461671 - RNA, 14 nt, Human
uguuuuguaccagu

SEQ ID NO: 3461672 - RNA, 17 nt, Human
uguuuugugaauuuucu

SEQ ID NO: 3461673 - RNA, 15 nt, Human
uguuuugugcauuug

SEQ ID NO: 3461674 - RNA, 19 nt, Human
uguuuugugguuuggaaua

SEQ ID NO: 3461675 - RNA, 12 nt, Human
uguuuuguugac

SEQ ID NO: 3461676 - RNA, 22 nt, Human
uguuuuguugcacugaaguuug

SEQ ID NO: 3461677 - RNA, 14 nt, Human
uguuuuguuuauua

SEQ ID NO: 3461678 - RNA, 16 nt, Human
uguuuuguuugucucu

SEQ ID NO: 3461679 - RNA, 16 nt, Human
uguuuuguuuuuacaa

SEQ ID NO: 3461680 - RNA, 16 nt, Human
uguuuuuaaaaaucau

SEQ ID NO: 3461681 - RNA, 19 nt, Human
uguuuuuaaaaguuucaau

SEQ ID NO: 3461682 - RNA, 23 nt, Human
uguuuuuaaacuguacagugucu

SEQ ID NO: 3461683 - RNA, 15 nt, Human
uguuuuuaagcuguu

SEQ ID NO: 3461684 - RNA, 17 nt, Human
uguuuuuaagcuguuuc

SEQ ID NO: 3461685 - RNA, 13 nt, Human
uguuuuuaaugcu

SEQ ID NO: 3461686 - RNA, 20 nt, Human
uguuuuuaaugcuuugauau

SEQ ID NO: 3461687 - RNA, 18 nt, Human
uguuuuuacaaauguuaa

SEQ ID NO: 3461688 - RNA, 18 nt, Human
uguuuuuauuauuaacaa

SEQ ID NO: 3461689 - RNA, 17 nt, Human
uguuuuuauuguuuucu

SEQ ID NO: 3461690 - RNA, 13 nt, Human
uguuuuucaguuc

SEQ ID NO: 3461691 - RNA, 15 nt, Human
uguuuuucaguucaa

SEQ ID NO: 3461692 - RNA, 13 nt, Human
uguuuuucaugaa

SEQ ID NO: 3461693 - RNA, 17 nt, Human
uguuuuucgucauucca

SEQ ID NO: 3461694 - RNA, 13 nt, Human
uguuuuucuauua

SEQ ID NO: 3461695 - RNA, 21 nt, Human
uguuuuucuauuaaaagacuc

SEQ ID NO: 3461696 - RNA, 12 nt, Human
uguuuuucucca

SEQ ID NO: 3461697 - RNA, 14 nt, Human
uguuuuucugcuuu

SEQ ID NO: 3461698 - RNA, 16 nt, Human
uguuuuugaaggcaga

SEQ ID NO: 3461699 - RNA, 15 nt, Human
uguauggccaggaag

SEQ ID NO: 3461700 - RNA, 15 nt, Human
uguaugggcaaaaaa

SEQ ID NO: 3461701 - RNA, 12 nt, Human
uguauguauaau

SEQ ID NO: 3461702 - RNA, 22 nt, Human
uguaugucaauaaacaacagcu

SEQ ID NO: 3461703 - RNA, 14 nt, Human
uguaugugagagau

SEQ ID NO: 3461704 - RNA, 18 nt, Human
uguaugugagagauucug

SEQ ID NO: 3461705 - RNA, 11 nt, Human
uguaugugcac

SEQ ID NO: 3461706 - RNA, 17 nt, Human
uguaugugcacugucac

SEQ ID NO: 3461707 - RNA, 21 nt, Human
uguaugugggggucugugugu

SEQ ID NO: 3461708 - RNA, 13 nt, Human
uguaugugugaag

SEQ ID NO: 3461709 - RNA, 15 nt, Human
uguauguguuuagaa

SEQ ID NO: 3461710 - RNA, 19 nt, Human
uguauguucagaagaaauu

SEQ ID NO: 3461711 - RNA, 19 nt, Human
uguauguugugaagauguu

SEQ ID NO: 3461712 - RNA, 23 nt, Human
uguauguugugaagauguuugca

SEQ ID NO: 3461713 - RNA, 11 nt, Human
uguauguuuac

SEQ ID NO: 3461714 - RNA, 17 nt, Human
uguauguuuacacuguc

SEQ ID NO: 3461715 - RNA, 13 nt, Human
uguauguuucucu

SEQ ID NO: 3461716 - RNA, 22 nt, Human
uguauguuugcacacuugugug

SEQ ID NO: 3461717 - RNA, 19 nt, Human
uguauguuuugguaucugu

SEQ ID NO: 3461718 - RNA, 15 nt, Human
uguauguuuuucagu

SEQ ID NO: 3461719 - RNA, 20 nt, Human
uguauguuuuucaguucaaa

SEQ ID NO: 3461720 - RNA, 21 nt, Human
uguauguuuuucaguucaaag

SEQ ID NO: 3461721 - RNA, 17 nt, Human
uguauguuuuuuuucug

SEQ ID NO: 3461722 - RNA, 19 nt, Human
uguauuaaaaaaaacaaaa

SEQ ID NO: 3461723 - RNA, 20 nt, Human
uguauuaaaaaaaacaaaaa

SEQ ID NO: 3461724 - RNA, 21 nt, Human
uguauuaaaaaaaacaaaaag

SEQ ID NO: 3461725 - RNA, 22 nt, Human
uguauuaaaaaaaacaaaaaga

SEQ ID NO: 3461726 - RNA, 21 nt, Human
uguauuaaauuacauuuguaa

SEQ ID NO: 3461727 - RNA, 13 nt, Human
uguauuaacaaaa

SEQ ID NO: 3461728 - RNA, 15 nt, Human
uguauuaacaaaagu

SEQ ID NO: 3461729 - RNA, 20 nt, Human
uguauuaagaaaggaagcau

SEQ ID NO: 3461730 - RNA, 12 nt, Human
uguauuaagaau

SEQ ID NO: 3461731 - RNA, 16 nt, Human
uguauuaagagugaaa

SEQ ID NO: 3461732 - RNA, 17 nt, Human
uguauuaauaaauagag

SEQ ID NO: 3461733 - RNA, 20 nt, Human
uguauuaauaaauagagcaa

SEQ ID NO: 3461734 - RNA, 16 nt, Human
uguauuacuagaagau

SEQ ID NO: 3461735 - RNA, 23 nt, Human
uguauuacuagaagaugaauaca

SEQ ID NO: 3461736 - RNA, 23 nt, Human
uguauuaggacuggcuuuguccc

SEQ ID NO: 3461737 - RNA, 21 nt, Human
uguauuaggugucauuuccau

SEQ ID NO: 3461738 - RNA, 20 nt, Human
uguauuagugauauuucucu

SEQ ID NO: 3461739 - RNA, 15 nt, Human
uguauuauaacagug

SEQ ID NO: 3461740 - RNA, 17 nt, Human
uguauuauauguaacua

SEQ ID NO: 3461741 - RNA, 15 nt, Human
uguauuauugcuguu

SEQ ID NO: 3461742 - RNA, 14 nt, Human
uguauucagacaga

SEQ ID NO: 3461743 - RNA, 17 nt, Human
uguauucagugaggguc

SEQ ID NO: 3461744 - RNA, 13 nt, Human
uguauuccaagac

SEQ ID NO: 3461745 - RNA, 15 nt, Human
uguauuccaagacau

SEQ ID NO: 3461746 - RNA, 18 nt, Human
uguauuccaagcauauaa

SEQ ID NO: 3461747 - RNA, 18 nt, Human
uguauucccaccccugga

SEQ ID NO: 3461748 - RNA, 22 nt, Human
uguauucuagcuaauguaauaa

SEQ ID NO: 3461749 - RNA, 13 nt, Human
uguauucucugag

SEQ ID NO: 3461750 - RNA, 14 nt, Human
uguauucucugagc

SEQ ID NO: 3461751 - RNA, 14 nt, Human
uguauucuguaaaa

SEQ ID NO: 3461752 - RNA, 16 nt, Human
uguauucugucuucau

SEQ ID NO: 3461753 - RNA, 22 nt, Human
uguauucuuaaaaugcaauauu

SEQ ID NO: 3461754 - RNA, 16 nt, Human
uguauucuuaaauuca

SEQ ID NO: 3461755 - RNA, 19 nt, Human
uguauucuuugauguuaac

SEQ ID NO: 3461756 - RNA, 19 nt, Human
uguauucuuuucucagugu

SEQ ID NO: 3461757 - RNA, 22 nt, Human
uguauugaacuuggaaagaaau

SEQ ID NO: 3461758 - RNA, 15 nt, Human
uguauugaaucaugu

SEQ ID NO: 3461759 - RNA, 19 nt, Human
uguauugcauauauacaua

SEQ ID NO: 3461760 - RNA, 16 nt, Human
uguauuguauauuaca

SEQ ID NO: 3461761 - RNA, 21 nt, Human
uguauuguauauuacaaugau

SEQ ID NO: 3461762 - RNA, 20 nt, Human
uguauugugcaauguguaua

SEQ ID NO: 3461763 - RNA, 21 nt, Human
uguauugugcgcuaaacuuuu

SEQ ID NO: 3461764 - RNA, 13 nt, Human
uguauugugguau

SEQ ID NO: 3461765 - RNA, 19 nt, Human
uguauugugucuuuugcau

SEQ ID NO: 3461766 - RNA, 19 nt, Human
uguauuguuagauguuugu

SEQ ID NO: 3461767 - RNA, 23 nt, Human
uguauuguugaaaaaguuuguuu

SEQ ID NO: 3461768 - RNA, 18 nt, Human
uguauuguuguaaaaugu

SEQ ID NO: 3461769 - RNA, 19 nt, Human
uguauuguuuucugacagu

SEQ ID NO: 3461770 - RNA, 21 nt, Human
uguauuuaacaaaaagugcuu

SEQ ID NO: 3461771 - RNA, 13 nt, Human
uguauuuaagcaa

SEQ ID NO: 3461772 - RNA, 19 nt, Human
uguauuuaagcaaauacuu

SEQ ID NO: 3461773 - RNA, 17 nt, Human
uguauuuaauuguaaac

SEQ ID NO: 3461774 - RNA, 23 nt, Human
uguauuuaauuguaaacuguacu

SEQ ID NO: 3461775 - RNA, 15 nt, Human
uguauuuaauuuuga

SEQ ID NO: 3461776 - RNA, 13 nt, Human
uguauuuaccaaa

SEQ ID NO: 3461777 - RNA, 13 nt, Human
uguauuuauguaa

SEQ ID NO: 3461778 - RNA, 17 nt, Human
uguauuuauucaauaaa

SEQ ID NO: 3461779 - RNA, 14 nt, Human
uguauuuauuccau

SEQ ID NO: 3461780 - RNA, 23 nt, Human
uguauuuauugaagaaacagaua

SEQ ID NO: 3461781 - RNA, 15 nt, Human
uguauuuauuuaaaa

SEQ ID NO: 3461782 - RNA, 18 nt, Human
uguauuuauuuaaaagau

SEQ ID NO: 3461783 - RNA, 19 nt, Human
uguauuuauuuuccucccc

SEQ ID NO: 3461784 - RNA, 13 nt, Human
uguauuucuuaua

SEQ ID NO: 3461785 - RNA, 13 nt, Human
uguauuugaaagu

SEQ ID NO: 3461786 - RNA, 17 nt, Human
uguauuugaaauaagaa

SEQ ID NO: 3461787 - RNA, 12 nt, Human
uguauuugcuaa

SEQ ID NO: 3461788 - RNA, 17 nt, Human
uguauuugcuaauuuuu

SEQ ID NO: 3461789 - RNA, 12 nt, Human
uguauuuggaaa

SEQ ID NO: 3461790 - RNA, 14 nt, Human
uguauuuguagugu

SEQ ID NO: 3461791 - RNA, 15 nt, Human
uguauuuguuugcau

SEQ ID NO: 3461792 - RNA, 18 nt, Human
uguauuuuaaaagaauga

SEQ ID NO: 3461793 - RNA, 19 nt, Human
uguauuuuacuaauaaaau

SEQ ID NO: 3461794 - RNA, 16 nt, Human
uguauuuuagcagaga

SEQ ID NO: 3461795 - RNA, 14 nt, Human
uguauuuuauguau

SEQ ID NO: 3461796 - RNA, 16 nt, Human
uguauuuuauguaugu

SEQ ID NO: 3461797 - RNA, 17 nt, Human
uguauuuuauguuauau

SEQ ID NO: 3461798 - RNA, 13 nt, Human
uguauuuuauugu

SEQ ID NO: 3461799 - RNA, 14 nt, Human
uguauuuuauugua

SEQ ID NO: 3461800 - RNA, 21 nt, Human
uguauuuuauuguaacagaca

SEQ ID NO: 3461801 - RNA, 15 nt, Human
uguauuuuauuuuuu

SEQ ID NO: 3461802 - RNA, 14 nt, Human
uguauuuucagagc

SEQ ID NO: 3461803 - RNA, 23 nt, Human
uguauuuuccaagugugcauauu

SEQ ID NO: 3461804 - RNA, 14 nt, Human
uguauuuucuuuuu

SEQ ID NO: 3461805 - RNA, 14 nt, Human
uguauuuugauuau

SEQ ID NO: 3461806 - RNA, 22 nt, Human
uguauuuuguaaauaauaaaau

SEQ ID NO: 3461807 - RNA, 14 nt, Human
uguauuuuguauug

SEQ ID NO: 3461808 - RNA, 22 nt, Human
uguauuuugugaguuuguuucu

SEQ ID NO: 3461809 - RNA, 13 nt, Human
uuaagggaaaaau

SEQ ID NO: 3461810 - RNA, 18 nt, Human
uuaagggaagaauuccag

SEQ ID NO: 3461811 - RNA, 13 nt, Human
uuaaggguaugau

SEQ ID NO: 3461812 - RNA, 15 nt, Human
uuaaggguuaagaaa

SEQ ID NO: 3461813 - RNA, 20 nt, Human
uuaaggugagcauaaaucaa

SEQ ID NO: 3461814 - RNA, 22 nt, Human
uuaagguuauuuauuuaaaugu

SEQ ID NO: 3461815 - RNA, 19 nt, Human
uuaaguaaacuaaugaguu

SEQ ID NO: 3461816 - RNA, 18 nt, Human
uuaaguaaggaauuuuau

SEQ ID NO: 3461817 - RNA, 17 nt, Human
uuaaguauaucauguaa

SEQ ID NO: 3461818 - RNA, 17 nt, Human
uuaaguaucugacaucu

SEQ ID NO: 3461819 - RNA, 14 nt, Human
uuaaguauguguaa

SEQ ID NO: 3461820 - RNA, 17 nt, Human
uuaaguauuuauauauu

SEQ ID NO: 3461821 - RNA, 20 nt, Human
uuaaguccuacuuuuaaaga

SEQ ID NO: 3461822 - RNA, 17 nt, Human
uuaagucuaucugguau

SEQ ID NO: 3461823 - RNA, 15 nt, Human
uuaagucuguuuuau

SEQ ID NO: 3461824 - RNA, 13 nt, Human
uuaagugaauguc

SEQ ID NO: 3461825 - RNA, 16 nt, Human
uuaagugaggaaauca

SEQ ID NO: 3461826 - RNA, 17 nt, Human
uuaagugaggaaaucaa

SEQ ID NO: 3461827 - RNA, 19 nt, Human
uuaagugaggaaaucaaag

SEQ ID NO: 3461828 - RNA, 20 nt, Human
uuaagugaggaaaucaaagu

SEQ ID NO: 3461829 - RNA, 19 nt, Human
uuaagugcguguguagagu

SEQ ID NO: 3461830 - RNA, 21 nt, Human
uuaagugcguguguagaguua

SEQ ID NO: 3461831 - RNA, 12 nt, Human
uuaaguucuuau

SEQ ID NO: 3461832 - RNA, 23 nt, Human
uuaaguugagauaguuuucaucc

SEQ ID NO: 3461833 - RNA, 15 nt, Human
uuaaguuucaaacuu

SEQ ID NO: 3461834 - RNA, 15 nt, Human
uuaaguuucaggaua

SEQ ID NO: 3461835 - RNA, 15 nt, Human
uuaaguuucucagcu

SEQ ID NO: 3461836 - RNA, 20 nt, Human
uuaauaaaaaaacaaucauu

SEQ ID NO: 3461837 - RNA, 21 nt, Human
uuaauaaaaacuuacacucuu

SEQ ID NO: 3461838 - RNA, 21 nt, Human
uuaauaaaaagcuuuuuccuc

SEQ ID NO: 3461839 - RNA, 15 nt, Human
uuaauaaaaaggcac

SEQ ID NO: 3461840 - RNA, 11 nt, Human
uuaauaaaaga

SEQ ID NO: 3461841 - RNA, 14 nt, Human
uuaauaaaagaaaa

SEQ ID NO: 3461842 - RNA, 17 nt, Human
uuaauaaaagaaaauua

SEQ ID NO: 3461843 - RNA, 20 nt, Human
uuaauaaaauaauucuaaag

SEQ ID NO: 3461844 - RNA, 20 nt, Human
uuaauuaauuuggagcacaa

SEQ ID NO: 3461845 - RNA, 13 nt, Human
uuaauuacaccau

SEQ ID NO: 3461846 - RNA, 16 nt, Human
uuaauuaccaaccugu

SEQ ID NO: 3461847 - RNA, 18 nt, Human
uuaauuagcauucuggca

SEQ ID NO: 3461848 - RNA, 14 nt, Human
uuaauuagugcuaa

SEQ ID NO: 3461849 - RNA, 14 nt, Human
uuaauuauuauucu

SEQ ID NO: 3461850 - RNA, 21 nt, Human
uuaauuauuauuuguguuuua

SEQ ID NO: 3461851 - RNA, 14 nt, Human
uuaauuauuguaca

SEQ ID NO: 3461852 - RNA, 13 nt, Human
uuaauuauuguuu

SEQ ID NO: 3461853 - RNA, 14 nt, Human
uuaauucauguuuc

SEQ ID NO: 3461854 - RNA, 17 nt, Human
uuaauuccaauuauaug

SEQ ID NO: 3461855 - RNA, 14 nt, Human
uuaauucucuugaa

SEQ ID NO: 3461856 - RNA, 22 nt, Human
uuaauucuucagcguaaaaugg

SEQ ID NO: 3461857 - RNA, 23 nt, Human
uuaauugaaaagaaguagugucu

SEQ ID NO: 3461858 - RNA, 16 nt, Human
uuaauugaaagaaugu

SEQ ID NO: 3461859 - RNA, 14 nt, Human
uuaauugaaggaaa

SEQ ID NO: 3461860 - RNA, 12 nt, Human
uuaauugcuuug

SEQ ID NO: 3461861 - RNA, 13 nt, Human
uuaauugcuuuga

SEQ ID NO: 3461862 - RNA, 16 nt, Human
uuaauuggcagcagau

SEQ ID NO: 3461863 - RNA, 18 nt, Human
uuaauugggcacuauuua

SEQ ID NO: 3461864 - RNA, 21 nt, Human
uuaauugggccagcuuuucaa

SEQ ID NO: 3461865 - RNA, 14 nt, Human
uuaauuguaaacug

SEQ ID NO: 3461866 - RNA, 14 nt, Human
uuaauuguaaagua

SEQ ID NO: 3461867 - RNA, 18 nt, Human
uuaauuguuuugcacuuu

SEQ ID NO: 3461868 - RNA, 14 nt, Human
uuaauuuaaagcca

SEQ ID NO: 3461869 - RNA, 16 nt, Human
uuaauuuaaaugauuu

SEQ ID NO: 3461870 - RNA, 15 nt, Human
uuaauuuaaguuuug

SEQ ID NO: 3461871 - RNA, 23 nt, Human
uuaauuuacaaaaauauaaaaua

SEQ ID NO: 3461872 - RNA, 17 nt, Human
uuaauuuaguaaauguu

SEQ ID NO: 3461873 - RNA, 13 nt, Human
uuaauuuaucaga

SEQ ID NO: 3461874 - RNA, 14 nt, Human
uuaauuucaagcuu

SEQ ID NO: 3461875 - RNA, 17 nt, Human
uuaauuucaguccugua

SEQ ID NO: 3461876 - RNA, 11 nt, Human
uuaauuuccag

SEQ ID NO: 3461877 - RNA, 12 nt, Human
uuaauuuccuuu

SEQ ID NO: 3461878 - RNA, 20 nt, Human
uuaauuuccuuuuugacacu

SEQ ID NO: 3461879 - RNA, 17 nt, Human
uuaauuucuucaaaaug

SEQ ID NO: 3461880 - RNA, 23 nt, Human
uuaauuucuucaaaauguauaua

SEQ ID NO: 3461881 - RNA, 18 nt, Human
uuaauuugcaucugaaau

SEQ ID NO: 3461882 - RNA, 18 nt, Human
uuaauuugccaaaauaau

SEQ ID NO: 3461883 - RNA, 20 nt, Human
uuaauuugccaaaauaaugu

SEQ ID NO: 3461884 - RNA, 14 nt, Human
uuaauuuggaaacu

SEQ ID NO: 3461885 - RNA, 13 nt, Human
uuaauuuggacca

SEQ ID NO: 3461886 - RNA, 16 nt, Human
uuaauuuuaaagugca

SEQ ID NO: 3461887 - RNA, 17 nt, Human
uuaauuuuacuccauaa

SEQ ID NO: 3461888 - RNA, 15 nt, Human
uuaauuuuaguuuuu

SEQ ID NO: 3461889 - RNA, 23 nt, Human
uuaauuuuauuuuuuauaaaaua

SEQ ID NO: 3461890 - RNA, 12 nt, Human
uuaauuuucacu

SEQ ID NO: 3461891 - RNA, 19 nt, Human
uuaauuuugaagugcuguu

SEQ ID NO: 3461892 - RNA, 19 nt, Human
uuaauuuugacacugaaau

SEQ ID NO: 3461893 - RNA, 13 nt, Human
uuaauuuuggaau

SEQ ID NO: 3461894 - RNA, 14 nt, Human
uuaauuuuggaauu

SEQ ID NO: 3461895 - RNA, 17 nt, Human
uuaauuuugguuguauu

SEQ ID NO: 3461896 - RNA, 14 nt, Human
uuaauuuuguauuu

SEQ ID NO: 3461897 - RNA, 16 nt, Human
uuaauuuuguauuuuc

SEQ ID NO: 3461898 - RNA, 18 nt, Human
uuaauuuuguauuuucca

SEQ ID NO: 3461899 - RNA, 15 nt, Human
uuaauuuuuaaaugc

SEQ ID NO: 3461900 - RNA, 16 nt, Human
uuaauuuuuaaaugca

SEQ ID NO: 3461901 - RNA, 13 nt, Human
uuaauuuuuccaa

SEQ ID NO: 3461902 - RNA, 22 nt, Human
uuaauuuuugcuuuuagaaaag

SEQ ID NO: 3461903 - RNA, 17 nt, Human
uuaauuuuuugguacaa

SEQ ID NO: 3461904 - RNA, 15 nt, Human
uuaauuuuuuuauug

SEQ ID NO: 3461905 - RNA, 17 nt, Human
uuaauuuuuuuauuguu

SEQ ID NO: 3461906 - RNA, 22 nt, Human
uuacaaaaacaaaauaaaauaa

SEQ ID NO: 3461907 - RNA, 20 nt, Human
uuacaaaacuacaugagaac

SEQ ID NO: 3461908 - RNA, 15 nt, Human
uuacaaaauguaacu

SEQ ID NO: 3461909 - RNA, 14 nt, Human
uuacaaacuacaga

SEQ ID NO: 3461910 - RNA, 16 nt, Human
uuacaaacugaagagu

SEQ ID NO: 3461911 - RNA, 13 nt, Human
uuacaaagugugu

SEQ ID NO: 3461912 - RNA, 14 nt, Human
uuacaaagugugua

SEQ ID NO: 3461913 - RNA, 18 nt, Human
uuacaaaguguguauuaa

SEQ ID NO: 3461914 - RNA, 17 nt, Human
uuacaaaugauugcuuu

SEQ ID NO: 3461915 - RNA, 19 nt, Human
uuacaaauguuaaaaugug

SEQ ID NO: 3461916 - RNA, 21 nt, Human
uuacaaauguuaaaauguguu

SEQ ID NO: 3461917 - RNA, 21 nt, Human
uuacaaauuauaauguauuca

SEQ ID NO: 3461918 - RNA, 14 nt, Human
uuacaaauuggagc

SEQ ID NO: 3461919 - RNA, 13 nt, Human
uuacaacagauuu

SEQ ID NO: 3461920 - RNA, 15 nt, Human
uuacaacagauuugu

SEQ ID NO: 3461921 - RNA, 13 nt, Human
uuacaaccuagaa

SEQ ID NO: 3461922 - RNA, 23 nt, Human
uuacaacugccucgaaacacaga

SEQ ID NO: 3461923 - RNA, 17 nt, Human
uuacaagaaaaaaugaa

SEQ ID NO: 3461924 - RNA, 13 nt, Human
uuacaagaagaac

SEQ ID NO: 3461925 - RNA, 13 nt, Human
uuacaagaaguuu

SEQ ID NO: 3461926 - RNA, 18 nt, Human
uuacaagaaguuuauucu

SEQ ID NO: 3461927 - RNA, 16 nt, Human
uuacaagggaagauuu

SEQ ID NO: 3461928 - RNA, 20 nt, Human
uuacaagggcauaaaguaaa

SEQ ID NO: 3461929 - RNA, 17 nt, Human
uuacaaguuuauauaua

SEQ ID NO: 3461930 - RNA, 21 nt, Human
uuacaauaaaacuuugcugcc

SEQ ID NO: 3461931 - RNA, 17 nt, Human
uuacaauaggaguggug

SEQ ID NO: 3461932 - RNA, 15 nt, Human
uuacaauaguucugu

SEQ ID NO: 3461933 - RNA, 21 nt, Human
uuacaauauugauugggaaaa

SEQ ID NO: 3461934 - RNA, 13 nt, Human
uuacaauauuugu

SEQ ID NO: 3461935 - RNA, 16 nt, Human
uuacaauauuugugug

SEQ ID NO: 3461936 - RNA, 14 nt, Human
uuacaauguuuuau

SEQ ID NO: 3461937 - RNA, 13 nt, Human
uuacaauugucau

SEQ ID NO: 3461938 - RNA, 12 nt, Human
uuacaauuuaca

SEQ ID NO: 3461939 - RNA, 19 nt, Human
uuacaauuuacaaagugug

SEQ ID NO: 3461940 - RNA, 18 nt, Human
uuacaauuuuaucuguuu

SEQ ID NO: 3461941 - RNA, 18 nt, Human
uuacaauuuuuuaucaug

SEQ ID NO: 3461942 - RNA, 23 nt, Human
uuacaauuuuuuuaauuuuguau

SEQ ID NO: 3461943 - RNA, 20 nt, Human
uuacacaaaggggaucauaa

SEQ ID NO: 3461944 - RNA, 19 nt, Human
uuacacaaauacuuauuca

SEQ ID NO: 3461945 - RNA, 20 nt, Human
uuacacaauucuuacccugu

SEQ ID NO: 3461946 - RNA, 23 nt, Human
uuacacacgugcaauuuguuugu

SEQ ID NO: 3461947 - RNA, 13 nt, Human
uuacacagaaaca

SEQ ID NO: 3461948 - RNA, 19 nt, Human
uuacacagaaacacugccu

SEQ ID NO: 3461949 - RNA, 23 nt, Human
uuacacagaaaugcugcuggcca

SEQ ID NO: 3461950 - RNA, 14 nt, Human
uuacacauacaguu

SEQ ID NO: 3461951 - RNA, 14 nt, Human
uuacacauuaagua

SEQ ID NO: 3461952 - RNA, 17 nt, Human
uuacacauuuguacaga

SEQ ID NO: 3461953 - RNA, 20 nt, Human
uuacacccuuucuugacaaa

SEQ ID NO: 3461954 - RNA, 18 nt, Human
uuacaccgacuagccagg

SEQ ID NO: 3461955 - RNA, 17 nt, Human
uuacacgcuuuugugau

SEQ ID NO: 3461956 - RNA, 18 nt, Human
uuacacugccuguauacu

SEQ ID NO: 3461957 - RNA, 22 nt, Human
uuacacugccuguauacuuuag

SEQ ID NO: 3461958 - RNA, 23 nt, Human
uuacacuggcaaugguaguuucu

SEQ ID NO: 3461959 - RNA, 20 nt, Human
uuacacuguaccauauagca

SEQ ID NO: 3461960 - RNA, 23 nt, Human
uuacacuguuauuuucagcauga

SEQ ID NO: 3461961 - RNA, 14 nt, Human
uuacacuuacuguu

SEQ ID NO: 3461962 - RNA, 15 nt, Human
uuacacuuacuguug

SEQ ID NO: 3461963 - RNA, 23 nt, Human
uuacacuuuaugccggaugugcu

SEQ ID NO: 3461964 - RNA, 16 nt, Human
uuacacuuuuuggaag

SEQ ID NO: 3461965 - RNA, 22 nt, Human
uuacagaaaguggugcucaguu

SEQ ID NO: 3461966 - RNA, 12 nt, Human
uuacagaagccc

SEQ ID NO: 3461967 - RNA, 19 nt, Human
uuacagaaucuaacuggug

SEQ ID NO: 3461968 - RNA, 20 nt, Human
uuacagaaucuuccuuuuau

SEQ ID NO: 3461969 - RNA, 21 nt, Human
uuacagagguauuaaaacuaa

SEQ ID NO: 3461970 - RNA, 19 nt, Human
uuacagauuuauuccuuug

SEQ ID NO: 3461971 - RNA, 20 nt, Human
uuacagauuuauuccuuugu

SEQ ID NO: 3461972 - RNA, 15 nt, Human
uuacagcacaaaaug

SEQ ID NO: 3461973 - RNA, 11 nt, Human
uuacagcugug

SEQ ID NO: 3461974 - RNA, 14 nt, Human
uuacaggaaguacu

SEQ ID NO: 3461975 - RNA, 18 nt, Human
ugucaucagagcuccucu

SEQ ID NO: 3461976 - RNA, 14 nt, Human
ugucaucagaugga

SEQ ID NO: 3461977 - RNA, 21 nt, Human
ugucaucagccaccauccuau

SEQ ID NO: 3461978 - RNA, 17 nt, Human
ugucaucaucauggcca

SEQ ID NO: 3461979 - RNA, 19 nt, Human
ugucaucaucauggccagc

SEQ ID NO: 3461980 - RNA, 16 nt, Human
ugucaucccauugucu

SEQ ID NO: 3461981 - RNA, 17 nt, Human
ugucaucccauugucuu

SEQ ID NO: 3461982 - RNA, 20 nt, Human
ugucaucuaccuuuucucuu

SEQ ID NO: 3461983 - RNA, 15 nt, Human
ugucaucucagugcu

SEQ ID NO: 3461984 - RNA, 19 nt, Human
ugucaucugagaaugaaca

SEQ ID NO: 3461985 - RNA, 23 nt, Human
ugucaucuuucuucuauuuuauu

SEQ ID NO: 3461986 - RNA, 16 nt, Human
ugucaugaauucuuau

SEQ ID NO: 3461987 - RNA, 19 nt, Human
ugucaugaauucuuaugcu

SEQ ID NO: 3461988 - RNA, 17 nt, Human
ugucaugguuacaaacu

SEQ ID NO: 3461989 - RNA, 19 nt, Human
ugucauguuguaaacauuu

SEQ ID NO: 3461990 - RNA, 18 nt, Human
uuagugugguuuucuguu

SEQ ID NO: 3461991 - RNA, 15 nt, Human
uuaguguuauaugaa

SEQ ID NO: 3461992 - RNA, 17 nt, Human
uuaguguuuuaagaaau

SEQ ID NO: 3461993 - RNA, 19 nt, Human
uuaguuaccuuauaguuac

SEQ ID NO: 3461994 - RNA, 22 nt, Human
uuaguuacuaccuccucuccug

SEQ ID NO: 3461995 - RNA, 12 nt, Human
uuaguucccaac

SEQ ID NO: 3461996 - RNA, 13 nt, Human
uuaguucccuguc

SEQ ID NO: 3461997 - RNA, 19 nt, Human
uuaguucccugucucuuga

SEQ ID NO: 3461998 - RNA, 18 nt, Human
uuaguuccugugcacagc

SEQ ID NO: 3461999 - RNA, 20 nt, Human
uuaguugcaacuuuguauaa

SEQ ID NO: 3462000 - RNA, 13 nt, Human
uuaguugcuguau

SEQ ID NO: 3462001 - RNA, 20 nt, Human
uuaguuguaucucuuuugaa

SEQ ID NO: 3462002 - RNA, 11 nt, Human
uuaguuuccuu

SEQ ID NO: 3462003 - RNA, 13 nt, Human
uuaguuucugagu

SEQ ID NO: 3462004 - RNA, 21 nt, Human
uuaguuucuguucuguggaaa

SEQ ID NO: 3462005 - RNA, 14 nt, Human
uuaguuugcauuua

SEQ ID NO: 3462006 - RNA, 18 nt, Human
uuaguuuggauucuuaug

SEQ ID NO: 3462007 - RNA, 22 nt, Human
uuaguuuguaugccaagugaga

SEQ ID NO: 3462008 - RNA, 16 nt, Human
uuaguuuguguguugu

SEQ ID NO: 3462009 - RNA, 15 nt, Human
uuaguuuuaguugca

SEQ ID NO: 3462010 - RNA, 13 nt, Human
uuaguuuucuugu

SEQ ID NO: 3462011 - RNA, 13 nt, Human
uuaguuuugcaua

SEQ ID NO: 3462012 - RNA, 14 nt, Human
uuaguuuugcuuuu

SEQ ID NO: 3462013 - RNA, 18 nt, Human
uuaguuuugcuuuuaguu

SEQ ID NO: 3462014 - RNA, 15 nt, Human
uuaguuuuucugucc

SEQ ID NO: 3462015 - RNA, 23 nt, Human
uuaguuuuugguugggaaugagg

SEQ ID NO: 3462016 - RNA, 17 nt, Human
uuaguuuuuguaauuua

SEQ ID NO: 3462017 - RNA, 20 nt, Human
uuauaaaaaauggugccuga

SEQ ID NO: 3462018 - RNA, 17 nt, Human
uuauaaaaaaugguuca

SEQ ID NO: 3462019 - RNA, 12 nt, Human
uuauaaaaagau

SEQ ID NO: 3462020 - RNA, 19 nt, Human
uuauaaaaagguguuuuga

SEQ ID NO: 3462021 - RNA, 22 nt, Human
uuauaaaaauaaaaaacacugg

SEQ ID NO: 3462022 - RNA, 17 nt, Human
uuauaaaaauaaauaga

SEQ ID NO: 3462023 - RNA, 19 nt, Human
uuauaaaacagaguaaucu

SEQ ID NO: 3462024 - RNA, 12 nt, Human
uuauaaaacuuc

SEQ ID NO: 3462025 - RNA, 13 nt, Human
uuauaaaauauaa

SEQ ID NO: 3462026 - RNA, 20 nt, Human
uuauaaaauauaaacaaaga

SEQ ID NO: 3462027 - RNA, 15 nt, Human
uuauaaaauuuacug

SEQ ID NO: 3462028 - RNA, 13 nt, Human
uuauaaacaagaa

SEQ ID NO: 3462029 - RNA, 13 nt, Human
uuauaaacagaaa

SEQ ID NO: 3462030 - RNA, 17 nt, Human
uuauaaacagaaaugga

SEQ ID NO: 3462031 - RNA, 18 nt, Human
uuauaaacuuuaccuuuu

SEQ ID NO: 3462032 - RNA, 19 nt, Human
ugugacuucagcucuguuu

SEQ ID NO: 3462033 - RNA, 13 nt, Human
ugugacuuugaaa

SEQ ID NO: 3462034 - RNA, 14 nt, Human
ugugagaaaacguu

SEQ ID NO: 3462035 - RNA, 13 nt, Human
ugugagaagccag

SEQ ID NO: 3462036 - RNA, 21 nt, Human
ugugagaagguuuauuguuaa

SEQ ID NO: 3462037 - RNA, 18 nt, Human
ugugagacagugggaaau

SEQ ID NO: 3462038 - RNA, 19 nt, Human
ugugagacagugggaaaua

SEQ ID NO: 3462039 - RNA, 13 nt, Human
ugugagaccccca

SEQ ID NO: 3462040 - RNA, 16 nt, Human
ugugagacccccacac

SEQ ID NO: 3462041 - RNA, 18 nt, Human
ugugagacccccacaccu

SEQ ID NO: 3462042 - RNA, 15 nt, Human
ugugagacuacuaag

SEQ ID NO: 3462043 - RNA, 19 nt, Human
ugugagaugcuagaacucc

SEQ ID NO: 3462044 - RNA, 18 nt, Human
ugugagauuuuuuauugc

SEQ ID NO: 3462045 - RNA, 19 nt, Human
ugugagcacaaagguagcu

SEQ ID NO: 3462046 - RNA, 22 nt, Human
ugugagccccugguccugaggg

SEQ ID NO: 3462047 - RNA, 15 nt, Human
ugugagcucuuccua

SEQ ID NO: 3462048 - RNA, 12 nt, Human
ugugagcugcac

SEQ ID NO: 3462049 - RNA, 15 nt, Human
ugugagcugcaccag

SEQ ID NO: 3462050 - RNA, 16 nt, Human
ugugaggaaagucauu

SEQ ID NO: 3462051 - RNA, 20 nt, Human
ugugaggaagccgcuggggc

SEQ ID NO: 3462052 - RNA, 14 nt, Human
ugugaggagcugcu

SEQ ID NO: 3462053 - RNA, 20 nt, Human
ugugaggagcugcuggcuug

SEQ ID NO: 3462054 - RNA, 20 nt, Human
ugugaggagguggagagaca

SEQ ID NO: 3462055 - RNA, 16 nt, Human
ugugaggccagggcag

SEQ ID NO: 3462056 - RNA, 17 nt, Human
ugugaggccagggcaga

SEQ ID NO: 3462057 - RNA, 13 nt, Human
ugugaggccccug

SEQ ID NO: 3462058 - RNA, 14 nt, Human
ugugaggccuggcc

SEQ ID NO: 3462059 - RNA, 18 nt, Human
ugugaggccuggccaggc

SEQ ID NO: 3462060 - RNA, 22 nt, Human
ugugagggaaagagcuuuccua

SEQ ID NO: 3462061 - RNA, 15 nt, Human
ugugagggcagugca

SEQ ID NO: 3462062 - RNA, 16 nt, Human
ugugagguuucccaau

SEQ ID NO: 3462063 - RNA, 22 nt, Human
ugugagguuucccaaugguguu

SEQ ID NO: 3462064 - RNA, 19 nt, Human
ugugaguaagagcuggugu

SEQ ID NO: 3462065 - RNA, 15 nt, Human
ugugaguauucucau

SEQ ID NO: 3462066 - RNA, 22 nt, Human
ugugagucuuugguucuaagga

SEQ ID NO: 3462067 - RNA, 17 nt, Human
ugugagugccuuuugca

SEQ ID NO: 3462068 - RNA, 14 nt, Human
ugugagugguugaa

SEQ ID NO: 3462069 - RNA, 16 nt, Human
ugugaguguaagugug

SEQ ID NO: 3462070 - RNA, 22 nt, Human
ugugaguguuuuuaucuuuuua

SEQ ID NO: 3462071 - RNA, 21 nt, Human
ugugaguuuaccuuguauacu

SEQ ID NO: 3462072 - RNA, 23 nt, Human
ugugaguuuaccuuguauacugu

SEQ ID NO: 3462073 - RNA, 21 nt, Human
ugugaguuuguuucuuugaau

SEQ ID NO: 3462074 - RNA, 16 nt, Human
ugugauaaaucaguca

SEQ ID NO: 3462075 - RNA, 13 nt, Human
ugugauaaggaaa

SEQ ID NO: 3462076 - RNA, 13 nt, Human
ugugauaauuuaa

SEQ ID NO: 3462077 - RNA, 21 nt, Human
ugugauacaaugcugugcccu

SEQ ID NO: 3462078 - RNA, 22 nt, Human
ugugauacauuuuuuaagcuuc

SEQ ID NO: 3462079 - RNA, 14 nt, Human
ugugauagcacuuu

SEQ ID NO: 3462080 - RNA, 17 nt, Human
ugugauagcacuuucua

SEQ ID NO: 3462081 - RNA, 16 nt, Human
ugugauauaagugugu

SEQ ID NO: 3462082 - RNA, 15 nt, Human
ugugauauauaagug

SEQ ID NO: 3462083 - RNA, 15 nt, Human
ugugauauucuaaga

SEQ ID NO: 3462084 - RNA, 14 nt, Human
ugugauauuucaga

SEQ ID NO: 3462085 - RNA, 16 nt, Human
ugugauauuucagaaa

SEQ ID NO: 3462086 - RNA, 15 nt, Human
ugugaucagaccaua

SEQ ID NO: 3462087 - RNA, 22 nt, Human
ugugaucagcuuucaaagcauu

SEQ ID NO: 3462088 - RNA, 20 nt, Human
ugugaucaggcuauguaugg

SEQ ID NO: 3462089 - RNA, 18 nt, Human
ugugaucccaagugccag

SEQ ID NO: 3462090 - RNA, 23 nt, Human
ugugaucccaagugccagucuug

SEQ ID NO: 3462091 - RNA, 13 nt, Human
ugugaucgucuga

SEQ ID NO: 3462092 - RNA, 15 nt, Human
ugugaucucauuguu

SEQ ID NO: 3462093 - RNA, 16 nt, Human
ugugaucucauuguuc

SEQ ID NO: 3462094 - RNA, 13 nt, Human
ugugaucugucuu

SEQ ID NO: 3462095 - RNA, 14 nt, Human
ugugaucugucuug

SEQ ID NO: 3462096 - RNA, 16 nt, Human
ugugaucugucuugua

SEQ ID NO: 3462097 - RNA, 19 nt, Human
ugugaucugucuuguaaua

SEQ ID NO: 3462098 - RNA, 16 nt, Human
ugugaucuuuuaaagu

SEQ ID NO: 3462099 - RNA, 16 nt, Human
ugugaugaauacugua

SEQ ID NO: 3462100 - RNA, 19 nt, Human
ugugaugagaggaaaucac

SEQ ID NO: 3462101 - RNA, 22 nt, Human
ugugaugaugaaaugaggucag

SEQ ID NO: 3462102 - RNA, 16 nt, Human
ugugaugauguaauug

SEQ ID NO: 3462103 - RNA, 15 nt, Human
ugugaugccacacag

SEQ ID NO: 3462104 - RNA, 18 nt, Human
ugugauggacacuccagg

SEQ ID NO: 3462105 - RNA, 16 nt, Human
ugugauggggcccugc

SEQ ID NO: 3462106 - RNA, 22 nt, Human
ugugaugguucguucuguuuac

SEQ ID NO: 3462107 - RNA, 22 nt, Human
ugugaugucauacagagaaguc

SEQ ID NO: 3462108 - RNA, 23 nt, Human
ugugaugucauacagagaaguca

SEQ ID NO: 3462109 - RNA, 16 nt, Human
ugugaugugacauuug

SEQ ID NO: 3462110 - RNA, 11 nt, Human
ugugauguguc

SEQ ID NO: 3462111 - RNA, 15 nt, Human
ugugauguucuaagg

SEQ ID NO: 3462112 - RNA, 18 nt, Human
ugugauuauuucacuuua

SEQ ID NO: 3462113 - RNA, 15 nt, Human
ugugauucaaaagau

SEQ ID NO: 3462114 - RNA, 22 nt, Human
ugugauucaaucuguaaacugu

SEQ ID NO: 3462115 - RNA, 14 nt, Human
ugugauucaaugcc

SEQ ID NO: 3462116 - RNA, 21 nt, Human
ugugauucuaaugucuucauu

SEQ ID NO: 3462117 - RNA, 22 nt, Human
ugugauugacagcuuugcugcu

SEQ ID NO: 3462118 - RNA, 14 nt, Human
ugugauuggccugu

SEQ ID NO: 3462119 - RNA, 15 nt, Human
ugugauuggccugua

SEQ ID NO: 3462120 - RNA, 17 nt, Human
ugugauuggccuguaga

SEQ ID NO: 3462121 - RNA, 15 nt, Human
ugugauugggaauaa

SEQ ID NO: 3462122 - RNA, 17 nt, Human
ugugauuguggaaugga

SEQ ID NO: 3462123 - RNA, 17 nt, Human
ugugauuuagaacugua

SEQ ID NO: 3462124 - RNA, 14 nt, Human
ugugauuucuuuaa

SEQ ID NO: 3462125 - RNA, 22 nt, Human
ugugauuucuuuaaaagaauga

SEQ ID NO: 3462126 - RNA, 15 nt, Human
ugugauuugacuguu

SEQ ID NO: 3462127 - RNA, 17 nt, Human
ugugauuugacuguuuu

SEQ ID NO: 3462128 - RNA, 23 nt, Human
ugugauuugacuguuuuuaccca

SEQ ID NO: 3462129 - RNA, 22 nt, Human
ugugauuuggaagggaaacuuu

SEQ ID NO: 3462130 - RNA, 18 nt, Human
ugugauuuuaacucuguc

SEQ ID NO: 3462131 - RNA, 17 nt, Human
ugugcaaaaaaauuaaa

SEQ ID NO: 3462132 - RNA, 18 nt, Human
ugugcaaaaauuuuugga

SEQ ID NO: 3462133 - RNA, 12 nt, Human
ugugcaaauccu

SEQ ID NO: 3462134 - RNA, 15 nt, Human
ugugcaaauuaacag

SEQ ID NO: 3462135 - RNA, 14 nt, Human
ugugcaacagacaa

SEQ ID NO: 3462136 - RNA, 16 nt, Human
ugugcucaucagaaac

SEQ ID NO: 3462137 - RNA, 16 nt, Human
ugugcuccgugccucc

SEQ ID NO: 3462138 - RNA, 20 nt, Human
ugugcuccgugccuccacca

SEQ ID NO: 3462139 - RNA, 14 nt, Human
ugugcucuccaagc

SEQ ID NO: 3462140 - RNA, 21 nt, Human
ugugcucuccauucugcuccu

SEQ ID NO: 3462141 - RNA, 13 nt, Human
ugugcugaaugug

SEQ ID NO: 3462142 - RNA, 23 nt, Human
ugugcugccauuugauuuuucua

SEQ ID NO: 3462143 - RNA, 20 nt, Human
ugugcugcccgucuucagcc

SEQ ID NO: 3462144 - RNA, 13 nt, Human
ugugcugcuucuc

SEQ ID NO: 3462145 - RNA, 18 nt, Human
ugugcuggaauucuaaca

SEQ ID NO: 3462146 - RNA, 14 nt, Human
ugugcuggagccac

SEQ ID NO: 3462147 - RNA, 15 nt, Human
ugugcuggagccacu

SEQ ID NO: 3462148 - RNA, 15 nt, Human
ugugcuggaggacug

SEQ ID NO: 3462149 - RNA, 17 nt, Human
ugugcugggagcuccac

SEQ ID NO: 3462150 - RNA, 21 nt, Human
ugugcugggagcuccacucug

SEQ ID NO: 3462151 - RNA, 20 nt, Human
ugugcugguguaugugugaa

SEQ ID NO: 3462152 - RNA, 23 nt, Human
ugugcugguguccugaccacccu

SEQ ID NO: 3462153 - RNA, 12 nt, Human
ugugcugugacu

SEQ ID NO: 3462154 - RNA, 14 nt, Human
ugugcuguguaaag

SEQ ID NO: 3462155 - RNA, 15 nt, Human
ugugcugugugugac

SEQ ID NO: 3462156 - RNA, 19 nt, Human
ugugcuguguuugcucccc

SEQ ID NO: 3462157 - RNA, 14 nt, Human
ugugcuguuucaaa

SEQ ID NO: 3462158 - RNA, 15 nt, Human
ugugcuuaacaggga

SEQ ID NO: 3462159 - RNA, 19 nt, Human
ugugcuuaugguaccagau

SEQ ID NO: 3462160 - RNA, 22 nt, Human
ugugcuuauguaugagguacaa

SEQ ID NO: 3462161 - RNA, 13 nt, Human
ugugcuuauguuu

SEQ ID NO: 3462162 - RNA, 23 nt, Human
ugugcuucacaguagagccagcu

SEQ ID NO: 3462163 - RNA, 23 nt, Human
ugugcuucuaauauuuauugcuu

SEQ ID NO: 3462164 - RNA, 22 nt, Human
ugugcuugaaggcccugcugag

SEQ ID NO: 3462165 - RNA, 19 nt, Human
ugugcuugagccaggaggc

SEQ ID NO: 3462166 - RNA, 15 nt, Human
ugugcuuggucuguu

SEQ ID NO: 3462167 - RNA, 13 nt, Human
ugugcuuucaaga

SEQ ID NO: 3462168 - RNA, 14 nt, Human
ugugcuuucaagau

SEQ ID NO: 3462169 - RNA, 15 nt, Human
ugugcuuuccagcuc

SEQ ID NO: 3462170 - RNA, 16 nt, Human
ugugcuuucccugaac

SEQ ID NO: 3462171 - RNA, 15 nt, Human
ugugcuuucuauugu

SEQ ID NO: 3462172 - RNA, 13 nt, Human
ugugcuuugcucu

SEQ ID NO: 3462173 - RNA, 22 nt, Human
ugugcuuugcucuugucccacg

SEQ ID NO: 3462174 - RNA, 23 nt, Human
ugugcuuugcucuugucccacgu

SEQ ID NO: 3462175 - RNA, 16 nt, Human
ugugcuuuuccuauuu

SEQ ID NO: 3462176 - RNA, 16 nt, Human
ugugcuuuuuuugugu

SEQ ID NO: 3462177 - RNA, 14 nt, Human
uguggaaaaauauu

SEQ ID NO: 3462178 - RNA, 16 nt, Human
uguggaaaaaugagag

SEQ ID NO: 3462179 - RNA, 19 nt, Human
uguggaaaagccaagaggc

SEQ ID NO: 3462180 - RNA, 23 nt, Human
uguggaaaagccaagaggcugca

SEQ ID NO: 3462181 - RNA, 17 nt, Human
uguggaaaaugaaaauu

SEQ ID NO: 3462182 - RNA, 12 nt, Human
uguggaaagccu

SEQ ID NO: 3462183 - RNA, 15 nt, Human
uguggaaagccucug

SEQ ID NO: 3462184 - RNA, 15 nt, Human
uguggaaaguguaaa

SEQ ID NO: 3462185 - RNA, 16 nt, Human
uguggaacauaaaaag

SEQ ID NO: 3462186 - RNA, 22 nt, Human
uguggaacuaauaaauacauac

SEQ ID NO: 3462187 - RNA, 23 nt, Human
uguggaacuaauaaauacauacg

SEQ ID NO: 3462188 - RNA, 14 nt, Human
uguggaagggacua

SEQ ID NO: 3462189 - RNA, 15 nt, Human
uguggaagugugggu

SEQ ID NO: 3462190 - RNA, 13 nt, Human
uguggaaugagug

SEQ ID NO: 3462191 - RNA, 16 nt, Human
uguggaaugagugugc

SEQ ID NO: 3462192 - RNA, 14 nt, Human
uguggacacagcuc

SEQ ID NO: 3462193 - RNA, 18 nt, Human
uguggacacagcucuucu

SEQ ID NO: 3462194 - RNA, 19 nt, Human
uguggacacagcucuucuc

SEQ ID NO: 3462195 - RNA, 17 nt, Human
uguggaccaauuauuga

SEQ ID NO: 3462196 - RNA, 14 nt, Human
uguggacugugaug

SEQ ID NO: 3462197 - RNA, 15 nt, Human
uguggacugugaugc

SEQ ID NO: 3462198 - RNA, 15 nt, Human
uguggacuuaggaag

SEQ ID NO: 3462199 - RNA, 16 nt, Human
uaauguggaagaaaau

SEQ ID NO: 3462200 - RNA, 13 nt, Human
uaauguggcuucu

SEQ ID NO: 3462201 - RNA, 18 nt, Human
uaauguguaguucaugua

SEQ ID NO: 3462202 - RNA, 20 nt, Human
uaauguguaguucauguaaa

SEQ ID NO: 3462203 - RNA, 23 nt, Human
uaauguguggauugccucugaaa

SEQ ID NO: 3462204 - RNA, 13 nt, Human
uaauguguguaug

SEQ ID NO: 3462205 - RNA, 16 nt, Human
uaauguguguaugugu

SEQ ID NO: 3462206 - RNA, 18 nt, Human
uaauguguguauguguau

SEQ ID NO: 3462207 - RNA, 19 nt, Human
uaauguguguauguguauu

SEQ ID NO: 3462208 - RNA, 17 nt, Human
uaauguguuuuagagua

SEQ ID NO: 3462209 - RNA, 17 nt, Human
uaauguuaaauuuguaa

SEQ ID NO: 3462210 - RNA, 14 nt, Human
uaauguuaaccaag

SEQ ID NO: 3462211 - RNA, 12 nt, Human
uaauguuacuga

SEQ ID NO: 3462212 - RNA, 18 nt, Human
uaauguuauaucauaugu

SEQ ID NO: 3462213 - RNA, 13 nt, Human
uaauguugaacaa

SEQ ID NO: 3462214 - RNA, 21 nt, Human
uaauguuggguagaaagagau

SEQ ID NO: 3462215 - RNA, 18 nt, Human
uaauguugugaauaauua

SEQ ID NO: 3462216 - RNA, 18 nt, Human
uaauguuguuauuuaaag

SEQ ID NO: 3462217 - RNA, 22 nt, Human
uaauguuuaugagccagacaaa

SEQ ID NO: 3462218 - RNA, 15 nt, Human
uaauguuuauuaaau

SEQ ID NO: 3462219 - RNA, 14 nt, Human
uaauguuucaaaca

SEQ ID NO: 3462220 - RNA, 22 nt, Human
uaauguuucuggauuucauacu

SEQ ID NO: 3462221 - RNA, 12 nt, Human
uaauguuugcua

SEQ ID NO: 3462222 - RNA, 18 nt, Human
uaauguuuguuaccucca

SEQ ID NO: 3462223 - RNA, 15 nt, Human
uaauguuuuaaaugu

SEQ ID NO: 3462224 - RNA, 22 nt, Human
uaauguuuucuuugcaaaguau

SEQ ID NO: 3462225 - RNA, 22 nt, Human
uaauguuuuuugccacagcuuu

SEQ ID NO: 3462226 - RNA, 20 nt, Human
uaauuaaaaacuaguaguuc

SEQ ID NO: 3462227 - RNA, 22 nt, Human
uaauuaaaaacuaguaguucuc

SEQ ID NO: 3462228 - RNA, 17 nt, Human
uaauuaaaacacaacau

SEQ ID NO: 3462229 - RNA, 16 nt, Human
uaauuaaaguguccau

SEQ ID NO: 3462230 - RNA, 15 nt, Human
uaauuaaauagcuuu

SEQ ID NO: 3462231 - RNA, 12 nt, Human
uaauuaacaugu

SEQ ID NO: 3462232 - RNA, 15 nt, Human
uaauuaacauguuaa

SEQ ID NO: 3462233 - RNA, 20 nt, Human
uaauuaacauguuaaaccau

SEQ ID NO: 3462234 - RNA, 16 nt, Human
uaauuaacugaaacau

SEQ ID NO: 3462235 - RNA, 19 nt, Human
uaauuaaugaaauaucugu

SEQ ID NO: 3462236 - RNA, 14 nt, Human
uaauuaauuguaau

SEQ ID NO: 3462237 - RNA, 13 nt, Human
uaauuaauuucag

SEQ ID NO: 3462238 - RNA, 16 nt, Human
uaauuaauuugauuaa

SEQ ID NO: 3462239 - RNA, 22 nt, Human
uaauuaauuugauuaacaaaua

SEQ ID NO: 3462240 - RNA, 15 nt, Human
uaauuaauuuggagc

SEQ ID NO: 3462241 - RNA, 16 nt, Human
uaauuacaauauuucu

SEQ ID NO: 3462242 - RNA, 19 nt, Human
uaauuacaauauuucugau

SEQ ID NO: 3462243 - RNA, 16 nt, Human
uaauuaccaaccuguu

SEQ ID NO: 3462244 - RNA, 12 nt, Human
uaauuagagcag

SEQ ID NO: 3462245 - RNA, 13 nt, Human
uaauuagcugugc

SEQ ID NO: 3462246 - RNA, 16 nt, Human
uaauuaggaaaaaaac

SEQ ID NO: 3462247 - RNA, 17 nt, Human
uaauuagggguugcuaa

SEQ ID NO: 3462248 - RNA, 18 nt, Human
uaauuagggguugcuaag

SEQ ID NO: 3462249 - RNA, 22 nt, Human
uaauuaggguacauuuauaauu

SEQ ID NO: 3462250 - RNA, 16 nt, Human
uaauuagguuaacauu

SEQ ID NO: 3462251 - RNA, 16 nt, Human
uaauuagugcuaagug

SEQ ID NO: 3462252 - RNA, 16 nt, Human
uaauuauaucuaaaau

SEQ ID NO: 3462253 - RNA, 23 nt, Human
uaauuauaucugaggaauucugu

SEQ ID NO: 3462254 - RNA, 14 nt, Human
uaauuauaugcuau

SEQ ID NO: 3462255 - RNA, 18 nt, Human
uaauuauaugcuauuucu

SEQ ID NO: 3462256 - RNA, 19 nt, Human
uaauuauaugcuauuucua

SEQ ID NO: 3462257 - RNA, 20 nt, Human
uaauuauaugcuauuucuau

SEQ ID NO: 3462258 - RNA, 16 nt, Human
uaauuauauguuguaa

SEQ ID NO: 3462259 - RNA, 19 nt, Human
uaauuaucggaagcagugc

SEQ ID NO: 3462260 - RNA, 23 nt, Human
uaauuaucgggaacaguguuucc

SEQ ID NO: 3462261 - RNA, 13 nt, Human
uaauuaugacagu

SEQ ID NO: 3462262 - RNA, 18 nt, Human
uaauuauuauaaaaauau

SEQ ID NO: 3462263 - RNA, 13 nt, Human
uaauuauuauuua

SEQ ID NO: 3462264 - RNA, 14 nt, Human
uaauuauuauuuau

SEQ ID NO: 3462265 - RNA, 17 nt, Human
uaauuauuauuuauaua

SEQ ID NO: 3462266 - RNA, 17 nt, Human
uaauuauuauuuguguu

SEQ ID NO: 3462267 - RNA, 14 nt, Human
uaauuauuuaugua

SEQ ID NO: 3462268 - RNA, 13 nt, Human
uaauuauuugaau

SEQ ID NO: 3462269 - RNA, 16 nt, Human
uaauuauuugucucag

SEQ ID NO: 3462270 - RNA, 20 nt, Human
uaauuauuuuaauuagguua

SEQ ID NO: 3462271 - RNA, 13 nt, Human
uaauucaagaaaa

SEQ ID NO: 3462272 - RNA, 18 nt, Human
uaauucaaggaauuucuu

SEQ ID NO: 3462273 - RNA, 19 nt, Human
uaauucaauucaaagcugu

SEQ ID NO: 3462274 - RNA, 16 nt, Human
uaauucaccaaaguau

SEQ ID NO: 3462275 - RNA, 17 nt, Human
uaauucaccaaaguauu

SEQ ID NO: 3462276 - RNA, 12 nt, Human
uaauucacucaa

SEQ ID NO: 3462277 - RNA, 22 nt, Human
uaauucagcacugauuucacaa

SEQ ID NO: 3462278 - RNA, 19 nt, Human
uaauucaggcauauuuuaa

SEQ ID NO: 3462279 - RNA, 16 nt, Human
uaauucagguuuuucc

SEQ ID NO: 3462280 - RNA, 17 nt, Human
uaauucagguuuuuccu

SEQ ID NO: 3462281 - RNA, 19 nt, Human
uaauucagguuuuuccuuu

SEQ ID NO: 3462282 - RNA, 18 nt, Human
uacacugaauauuuauau

SEQ ID NO: 3462283 - RNA, 18 nt, Human
uacacugaauuuuuaugu

SEQ ID NO: 3462284 - RNA, 20 nt, Human
uacacugaauuuuuaugugu

SEQ ID NO: 3462285 - RNA, 23 nt, Human
uacacugaauuuuuaugugugau

SEQ ID NO: 3462286 - RNA, 16 nt, Human
uacacugacaccuuug

SEQ ID NO: 3462287 - RNA, 15 nt, Human
uacacugacuugaga

SEQ ID NO: 3462288 - RNA, 18 nt, Human
uacacuggcaaugguagu

SEQ ID NO: 3462289 - RNA, 22 nt, Human
uacacuggcaaugguaguuucu

SEQ ID NO: 3462290 - RNA, 22 nt, Human
uacacuguauuacauaaauaaa

SEQ ID NO: 3462291 - RNA, 20 nt, Human
uacacugucagcagggacug

SEQ ID NO: 3462292 - RNA, 12 nt, Human
uacacugugaac

SEQ ID NO: 3462293 - RNA, 20 nt, Human
uacacuguuucaaacuuuac

SEQ ID NO: 3462294 - RNA, 18 nt, Human
uacacuuuguugcaagau

SEQ ID NO: 3462295 - RNA, 22 nt, Human
uacacuuuguugcaagauguga

SEQ ID NO: 3462296 - RNA, 18 nt, Human
uacacuuuuuuggggaua

SEQ ID NO: 3462297 - RNA, 15 nt, Human
uacagaaaaaccuug

SEQ ID NO: 3462298 - RNA, 19 nt, Human
uacagaaauacuauaacau

SEQ ID NO: 3462299 - RNA, 23 nt, Human
uacagaaauauaauaaaaugugu

SEQ ID NO: 3462300 - RNA, 18 nt, Human
uacagaaauuagccgggc

SEQ ID NO: 3462301 - RNA, 20 nt, Human
uacagaaauuuaauucagaa

SEQ ID NO: 3462302 - RNA, 11 nt, Human
uacagaacuac

SEQ ID NO: 3462303 - RNA, 17 nt, Human
uacagaacucuuucaaa

SEQ ID NO: 3462304 - RNA, 19 nt, Human
uacagaacucuuucaaaac

SEQ ID NO: 3462305 - RNA, 17 nt, Human
uacagaaucauugcuua

SEQ ID NO: 3462306 - RNA, 18 nt, Human
uacagaaucauugcuuau

SEQ ID NO: 3462307 - RNA, 18 nt, Human
uacagaaucuaacuggug

SEQ ID NO: 3462308 - RNA, 18 nt, Human
uacagaauucugcuaccu

SEQ ID NO: 3462309 - RNA, 18 nt, Human
uacagaauugugucugca

SEQ ID NO: 3462310 - RNA, 19 nt, Human
uacagaauugugucugcag

SEQ ID NO: 3462311 - RNA, 13 nt, Human
uacagaauuuuau

SEQ ID NO: 3462312 - RNA, 19 nt, Human
uacagacaaagcguggugg

SEQ ID NO: 3462313 - RNA, 19 nt, Human
uacagacacuaaguuauag

SEQ ID NO: 3462314 - RNA, 18 nt, Human
uacagaccugcuuuuuga

SEQ ID NO: 3462315 - RNA, 20 nt, Human
uacagaccugcuuuuugaaa

SEQ ID NO: 3462316 - RNA, 17 nt, Human
uacagacguaugcuuau

SEQ ID NO: 3462317 - RNA, 18 nt, Human
uacagacguaugcuuauu

SEQ ID NO: 3462318 - RNA, 14 nt, Human
uacagacuucucca

SEQ ID NO: 3462319 - RNA, 15 nt, Human
uacagacuucuccag

SEQ ID NO: 3462320 - RNA, 22 nt, Human
uacagacuuguugugacuuuga

SEQ ID NO: 3462321 - RNA, 15 nt, Human
uacagagaaaccagc

SEQ ID NO: 3462322 - RNA, 18 nt, Human
uacagagaaaccagcuuc

SEQ ID NO: 3462323 - RNA, 19 nt, Human
uacagagaaaccagcuucc

SEQ ID NO: 3462324 - RNA, 16 nt, Human
uacagagaaagaaauu

SEQ ID NO: 3462325 - RNA, 12 nt, Human
uacagagaagcc

SEQ ID NO: 3462326 - RNA, 19 nt, Human
uacagagaagccagcuugu

SEQ ID NO: 3462327 - RNA, 20 nt, Human
uacagagaagccagcuuguu

SEQ ID NO: 3462328 - RNA, 15 nt, Human
uacagagaagccuuc

SEQ ID NO: 3462329 - RNA, 23 nt, Human
uacagagaagccuucaagcucug

SEQ ID NO: 3462330 - RNA, 24 nt, Human
uacagagaagccuucaagcucuga

SEQ ID NO: 3462331 - RNA, 23 nt, Human
uacagagaagugaauaacugcaa

SEQ ID NO: 3462332 - RNA, 16 nt, Human
uacagagaggagaaac

SEQ ID NO: 3462333 - RNA, 20 nt, Human
uacagagaggagaaacacau

SEQ ID NO: 3462334 - RNA, 21 nt, Human
uacagagaggagaaacacauc

SEQ ID NO: 3462335 - RNA, 22 nt, Human
uacagagaggagaaacacaucu

SEQ ID NO: 3462336 - RNA, 16 nt, Human
uacagagaugucucuu

SEQ ID NO: 3462337 - RNA, 16 nt, Human
uacagagcccacgccc

SEQ ID NO: 3462338 - RNA, 19 nt, Human
uacagagcccacgccccca

SEQ ID NO: 3462339 - RNA, 22 nt, Human
uacagagcccacgcccccacug

SEQ ID NO: 3462340 - RNA, 19 nt, Human
uacagagccguaaaaacug

SEQ ID NO: 3462341 - RNA, 16 nt, Human
uacagagcuucccuga

SEQ ID NO: 3462342 - RNA, 15 nt, Human
uacagaggaaaucug

SEQ ID NO: 3462343 - RNA, 18 nt, Human
uacagaggacaguauuug

SEQ ID NO: 3462344 - RNA, 20 nt, Human
uacagaggucucugccggcu

SEQ ID NO: 3462345 - RNA, 23 nt, Human
uacagaggucucugccggcucuu

SEQ ID NO: 3462346 - RNA, 16 nt, Human
uacagagugauagccu

SEQ ID NO: 3462347 - RNA, 20 nt, Human
uacagaguggaauaagacag

SEQ ID NO: 3462348 - RNA, 19 nt, Human
uacagaguguggacucugg

SEQ ID NO: 3462349 - RNA, 13 nt, Human
uacagauaaauga

SEQ ID NO: 3462350 - RNA, 12 nt, Human
uacagauaacau

SEQ ID NO: 3462351 - RNA, 15 nt, Human
uacagauaacauuag

SEQ ID NO: 3462352 - RNA, 19 nt, Human
uacagauaggccuucuugu

SEQ ID NO: 3462353 - RNA, 19 nt, Human
uacagauagucaaaccaua

SEQ ID NO: 3462354 - RNA, 21 nt, Human
uacagauauauuuucuuucuc

SEQ ID NO: 3462355 - RNA, 18 nt, Human
uacagaugaauguauuua

SEQ ID NO: 3462356 - RNA, 22 nt, Human
uacagaugaauguauuuauuug

SEQ ID NO: 3462357 - RNA, 19 nt, Human
uacagaugucccauuuuca

SEQ ID NO: 3462358 - RNA, 13 nt, Human
uacagauuuaaua

SEQ ID NO: 3462359 - RNA, 16 nt, Human
uacagcacccuguggu

SEQ ID NO: 3462360 - RNA, 18 nt, Human
uacagcacuacugggugu

SEQ ID NO: 3462361 - RNA, 19 nt, Human
uacagcacuacuggguguc

SEQ ID NO: 3462362 - RNA, 13 nt, Human
uacagcagcaaga

SEQ ID NO: 3462363 - RNA, 20 nt, Human
uacagcaguagacauuuuaa

SEQ ID NO: 3462364 - RNA, 21 nt, Human
uacagcauuacaaauugcuua

SEQ ID NO: 3462365 - RNA, 18 nt, Human
uacagccaaagauaaucu

SEQ ID NO: 3462366 - RNA, 20 nt, Human
uacagccaggcccagagcaa

SEQ ID NO: 3462367 - RNA, 15 nt, Human
uacagccucagaaac

SEQ ID NO: 3462368 - RNA, 16 nt, Human
uacagcgagaggcaga

SEQ ID NO: 3462369 - RNA, 19 nt, Human
uacagcgagaggcagagaa

SEQ ID NO: 3462370 - RNA, 16 nt, Human
uacagcuaaucagcau

SEQ ID NO: 3462371 - RNA, 14 nt, Human
uacagcugccugca

SEQ ID NO: 3462372 - RNA, 13 nt, Human
uacagcuggcucu

SEQ ID NO: 3462373 - RNA, 20 nt, Human
uacagcugggcuggggagga

SEQ ID NO: 3462374 - RNA, 19 nt, Human
uacagcuguauugucugaa

SEQ ID NO: 3462375 - RNA, 14 nt, Human
uacagcuguuuaag

SEQ ID NO: 3462376 - RNA, 12 nt, Human
uacagcuuucug

SEQ ID NO: 3462377 - RNA, 19 nt, Human
uacagcuuugaucccugac

SEQ ID NO: 3462378 - RNA, 13 nt, Human
uacaggaacuuca

SEQ ID NO: 3462379 - RNA, 12 nt, Human
uacaggcaccca

SEQ ID NO: 3462380 - RNA, 15 nt, Human
uacaggcagcacaga

SEQ ID NO: 3462381 - RNA, 14 nt, Human
uacaggcccugcuc

SEQ ID NO: 3462382 - RNA, 16 nt, Human
uacaggcccugcuccu

SEQ ID NO: 3462383 - RNA, 20 nt, Human
uacaggcugacguuccgggc

SEQ ID NO: 3462384 - RNA, 22 nt, Human
uacaggcugacguuccgggcaa

SEQ ID NO: 3462385 - RNA, 20 nt, Human
uacagggaaugccugagugc

SEQ ID NO: 3462386 - RNA, 16 nt, Human
uacagggagccuccug

SEQ ID NO: 3462387 - RNA, 18 nt, Human
uacagggagccuccugcc

SEQ ID NO: 3462388 - RNA, 22 nt, Human
uacagggccaaacgcugagcca

SEQ ID NO: 3462389 - RNA, 15 nt, Human
uacaggggccagaag

SEQ ID NO: 3462390 - RNA, 17 nt, Human
uacagggggucuggcug

SEQ ID NO: 3462391 - RNA, 18 nt, Human
uacagggggucuggcugg

SEQ ID NO: 3462392 - RNA, 19 nt, Human
uacaggguaacugugcuga

SEQ ID NO: 3462393 - RNA, 18 nt, Human
uacaggguagcagguacc

SEQ ID NO: 3462394 - RNA, 15 nt, Human
uacaggguuuuuacc

SEQ ID NO: 3462395 - RNA, 17 nt, Human
uacaggguuuuuaccug

SEQ ID NO: 3462396 - RNA, 23 nt, Human
uacaggguuuuuaccugucacau

SEQ ID NO: 3462397 - RNA, 15 nt, Human
uacaguaaauaaauu

SEQ ID NO: 3462398 - RNA, 16 nt, Human
uacaguaaauaaauug

SEQ ID NO: 3462399 - RNA, 21 nt, Human
uacaguaaauaaauuguuuga

SEQ ID NO: 3462400 - RNA, 18 nt, Human
uacaguaacuuuaugugu

SEQ ID NO: 3462401 - RNA, 14 nt, Human
uacaguaagcugcu

SEQ ID NO: 3462402 - RNA, 18 nt, Human
uacaguaagcugcucuau

SEQ ID NO: 3462403 - RNA, 15 nt, Human
uacaguaaugucaua

SEQ ID NO: 3462404 - RNA, 17 nt, Human
uacaguagauuuuccaa

SEQ ID NO: 3462405 - RNA, 21 nt, Human
uguucggaagggguuccucaa

SEQ ID NO: 3462406 - RNA, 19 nt, Human
uguucgggccaaggaccug

SEQ ID NO: 3462407 - RNA, 22 nt, Human
uguucgggccaaggaccugaga

SEQ ID NO: 3462408 - RNA, 15 nt, Human
uguucgggugugggu

SEQ ID NO: 3462409 - RNA, 19 nt, Human
uguucuaaagcucugacau

SEQ ID NO: 3462410 - RNA, 16 nt, Human
uguucuaaccuuuaca

SEQ ID NO: 3462411 - RNA, 16 nt, Human
uguucuaagaugugau

SEQ ID NO: 3462412 - RNA, 22 nt, Human
uguucuaagaugugauauucua

SEQ ID NO: 3462413 - RNA, 14 nt, Human
uguucuaaggcucu

SEQ ID NO: 3462414 - RNA, 19 nt, Human
uguucuaaggcucugagag

SEQ ID NO: 3462415 - RNA, 21 nt, Human
uguucuaguuuuuuacuuuug

SEQ ID NO: 3462416 - RNA, 14 nt, Human
uguucuauccaaac

SEQ ID NO: 3462417 - RNA, 18 nt, Human
uguucuauccaaacaugu

SEQ ID NO: 3462418 - RNA, 19 nt, Human
uguucuauccaaacaugua

SEQ ID NO: 3462419 - RNA, 17 nt, Human
uguucuaugguuaugaa

SEQ ID NO: 3462420 - RNA, 23 nt, Human
uguucucacacuggucugcuguc

SEQ ID NO: 3462421 - RNA, 22 nt, Human
uguucucagaaucccuuaacag

SEQ ID NO: 3462422 - RNA, 15 nt, Human
uguucucagcucccc

SEQ ID NO: 3462423 - RNA, 21 nt, Human
uguucuccagucauuauguua

SEQ ID NO: 3462424 - RNA, 16 nt, Human
uguucuccgucccugc

SEQ ID NO: 3462425 - RNA, 14 nt, Human
uacagucuaaagcu

SEQ ID NO: 3462426 - RNA, 15 nt, Human
uacagucucgucucu

SEQ ID NO: 3462427 - RNA, 17 nt, Human
uacagucucgucucuuu

SEQ ID NO: 3462428 - RNA, 16 nt, Human
uacagucugucaugaa

SEQ ID NO: 3462429 - RNA, 17 nt, Human
uacagucugucuucugu

SEQ ID NO: 3462430 - RNA, 18 nt, Human
uacagucugucuucugua

SEQ ID NO: 3462431 - RNA, 22 nt, Human
uacagucugucuucuguauaua

SEQ ID NO: 3462432 - RNA, 22 nt, Human
uacagucuuccauuugcaaggg

SEQ ID NO: 3462433 - RNA, 17 nt, Human
uacagucuugcagcagg

SEQ ID NO: 3462434 - RNA, 20 nt, Human
uacagugaaaauguaagcug

SEQ ID NO: 3462435 - RNA, 22 nt, Human
uacagugaaaauguaagcuguu

SEQ ID NO: 3462436 - RNA, 12 nt, Human
uacagugagcca

SEQ ID NO: 3462437 - RNA, 22 nt, Human
uacagugcagagccuucucaga

SEQ ID NO: 3462438 - RNA, 16 nt, Human
uacagugccuaaaaua

SEQ ID NO: 3462439 - RNA, 22 nt, Human
uacaguggauugcucaucucag

SEQ ID NO: 3462440 - RNA, 20 nt, Human
uacaguggggaaugaagaua

SEQ ID NO: 3462441 - RNA, 18 nt, Human
uacaguggugccaucauu

SEQ ID NO: 3462442 - RNA, 22 nt, Human
uacaguggugccaucauugcug

SEQ ID NO: 3462443 - RNA, 13 nt, Human
uacagugguucua

SEQ ID NO: 3462444 - RNA, 22 nt, Human
uacagugguuuuauacugaagg

SEQ ID NO: 3462445 - RNA, 15 nt, Human
uacaguguacagucu

SEQ ID NO: 3462446 - RNA, 21 nt, Human
uacagugucuuuuuuuguaua

SEQ ID NO: 3462447 - RNA, 12 nt, Human
uacaguguuacc

SEQ ID NO: 3462448 - RNA, 16 nt, Human
uacaguguuauuuucu

SEQ ID NO: 3462449 - RNA, 12 nt, Human
uacaguguuccg

SEQ ID NO: 3462450 - RNA, 14 nt, Human
uacaguguucuguu

SEQ ID NO: 3462451 - RNA, 15 nt, Human
uacaguguucuguuu

SEQ ID NO: 3462452 - RNA, 18 nt, Human
uacaguuaaggaauauaa

SEQ ID NO: 3462453 - RNA, 13 nt, Human
uacaguuaaguuu

SEQ ID NO: 3462454 - RNA, 14 nt, Human
uacaguuacuuuuc

SEQ ID NO: 3462455 - RNA, 16 nt, Human
uacaguuacuuuuccu

SEQ ID NO: 3462456 - RNA, 21 nt, Human
uacaguuagggcuccuauuca

SEQ ID NO: 3462457 - RNA, 14 nt, Human
uacaguuauaaaau

SEQ ID NO: 3462458 - RNA, 19 nt, Human
uacaguuaucuaaguuaau

SEQ ID NO: 3462459 - RNA, 18 nt, Human
uacaguuccuagguauaa

SEQ ID NO: 3462460 - RNA, 13 nt, Human
uacaguucugcuc

SEQ ID NO: 3462461 - RNA, 19 nt, Human
uacaguugaaauaacugga

SEQ ID NO: 3462462 - RNA, 21 nt, Human
uacaguugggaaaauaugucc

SEQ ID NO: 3462463 - RNA, 20 nt, Human
uacaguuguuuuuugaaaac

SEQ ID NO: 3462464 - RNA, 18 nt, Human
uacaguuuguuaguauga

SEQ ID NO: 3462465 - RNA, 19 nt, Human
uacaguuuguuaguaugag

SEQ ID NO: 3462466 - RNA, 16 nt, Human
uacaguuuuaaagaau

SEQ ID NO: 3462467 - RNA, 19 nt, Human
uacaguuuuaacuguggau

SEQ ID NO: 3462468 - RNA, 18 nt, Human
uacaguuuuaugcucuuu

SEQ ID NO: 3462469 - RNA, 19 nt, Human
uacaguuuuaugcucuuuu

SEQ ID NO: 3462470 - RNA, 19 nt, Human
uacaguuuuccuaaaugua

SEQ ID NO: 3462471 - RNA, 18 nt, Human
uacaguuuugaguagagu

SEQ ID NO: 3462472 - RNA, 16 nt, Human
uacauaaacaaguccu

SEQ ID NO: 3462473 - RNA, 13 nt, Human
uacauaaaggugg

SEQ ID NO: 3462474 - RNA, 12 nt, Human
uacauaaauugg

SEQ ID NO: 3462475 - RNA, 13 nt, Human
uacauaacaagaa

SEQ ID NO: 3462476 - RNA, 18 nt, Human
uacauaacaagaaaauca

SEQ ID NO: 3462477 - RNA, 19 nt, Human
uacauaacaggguaaauua

SEQ ID NO: 3462478 - RNA, 18 nt, Human
uacauaacuaaauuugau

SEQ ID NO: 3462479 - RNA, 13 nt, Human
uacauaacugaaa

SEQ ID NO: 3462480 - RNA, 14 nt, Human
uacauaacugccuu

SEQ ID NO: 3462481 - RNA, 19 nt, Human
uacauaagauaaaugugcu

SEQ ID NO: 3462482 - RNA, 22 nt, Human
uacauaagauaaaugugcugaa

SEQ ID NO: 3462483 - RNA, 22 nt, Human
uacauaagcggcguaaguuuaa

SEQ ID NO: 3462484 - RNA, 22 nt, Human
uacauaauacacuugcccugcu

SEQ ID NO: 3462485 - RNA, 23 nt, Human
uacauaauacugaaccacuugua

SEQ ID NO: 3462486 - RNA, 15 nt, Human
uacauaaucuguaca

SEQ ID NO: 3462487 - RNA, 20 nt, Human
uacauaaucuguacaaugaa

SEQ ID NO: 3462488 - RNA, 13 nt, Human
uacauaaugcuua

SEQ ID NO: 3462489 - RNA, 20 nt, Human
uacauaaugcuuaauuucua

SEQ ID NO: 3462490 - RNA, 21 nt, Human
uacauaaugcuuaauuucuaa

SEQ ID NO: 3462491 - RNA, 19 nt, Human
uacauaaugggccacugaa

SEQ ID NO: 3462492 - RNA, 19 nt, Human
uacauacuaugaaauaugu

SEQ ID NO: 3462493 - RNA, 15 nt, Human
uacauacuuuaucaa

SEQ ID NO: 3462494 - RNA, 23 nt, Human
uacauacuuuaucaaugugucuu

SEQ ID NO: 3462495 - RNA, 12 nt, Human
uacauacuuuuu

SEQ ID NO: 3462496 - RNA, 15 nt, Human
uacauacuuuuuggg

SEQ ID NO: 3462497 - RNA, 21 nt, Human
uacauagauuuauuuuucagu

SEQ ID NO: 3462498 - RNA, 22 nt, Human
uacauagugcugcugugugcuu

SEQ ID NO: 3462499 - RNA, 12 nt, Human
uacauaguguaa

SEQ ID NO: 3462500 - RNA, 17 nt, Human
uacauaguguaggcuuu

SEQ ID NO: 3462501 - RNA, 23 nt, Human
uacauaguguaggcuuuacuuag

SEQ ID NO: 3462502 - RNA, 19 nt, Human
uacauauaagugauugcug

SEQ ID NO: 3462503 - RNA, 23 nt, Human
uacauaucgcugacuucauggaa

SEQ ID NO: 3462504 - RNA, 13 nt, Human
uacauaugaaauu

SEQ ID NO: 3462505 - RNA, 22 nt, Human
uacauaugaguguggaagccgg

SEQ ID NO: 3462506 - RNA, 21 nt, Human
uacauaugcuuuaagaaucga

SEQ ID NO: 3462507 - RNA, 17 nt, Human
uacauauggauguuacu

SEQ ID NO: 3462508 - RNA, 17 nt, Human
uacauauguaaaauaaa

SEQ ID NO: 3462509 - RNA, 20 nt, Human
uacauauguaaaauaaaauu

SEQ ID NO: 3462510 - RNA, 13 nt, Human
uacauauguaaac

SEQ ID NO: 3462511 - RNA, 14 nt, Human
uacauauguaaaca

SEQ ID NO: 3462512 - RNA, 17 nt, Human
uacauauguaaacauaa

SEQ ID NO: 3462513 - RNA, 19 nt, Human
uacauauguagacuauaua

SEQ ID NO: 3462514 - RNA, 20 nt, Human
uacauauguagacuauauac

SEQ ID NO: 3462515 - RNA, 23 nt, Human
uacauauguagacuauauacaug

SEQ ID NO: 3462516 - RNA, 21 nt, Human
uacauauuagcgacaacagau

SEQ ID NO: 3462517 - RNA, 18 nt, Human
uacauauuaggaaaauau

SEQ ID NO: 3462518 - RNA, 23 nt, Human
uacauauuaggaaaauauggguu

SEQ ID NO: 3462519 - RNA, 21 nt, Human
uacauauuugcauauguauga

SEQ ID NO: 3462520 - RNA, 18 nt, Human
uacauauuuuuguagcac

SEQ ID NO: 3462521 - RNA, 16 nt, Human
uacaucacguuaaagu

SEQ ID NO: 3462522 - RNA, 23 nt, Human
uacaucacugcuugaugaagcaa

SEQ ID NO: 3462523 - RNA, 16 nt, Human
uacaucacuugagaca

SEQ ID NO: 3462524 - RNA, 23 nt, Human
uacaucaguuauucauucuguga

SEQ ID NO: 3462525 - RNA, 13 nt, Human
uacaucauuucuu

SEQ ID NO: 3462526 - RNA, 14 nt, Human
uacaucauuucuuu

SEQ ID NO: 3462527 - RNA, 23 nt, Human
uacauccaaagcagacagcucca

SEQ ID NO: 3462528 - RNA, 20 nt, Human
uacaucccauguaacagaaa

SEQ ID NO: 3462529 - RNA, 21 nt, Human
uacaucccauguaacagaaag

SEQ ID NO: 3462530 - RNA, 15 nt, Human
uacauccucaugcag

SEQ ID NO: 3462531 - RNA, 21 nt, Human
uacauccuuguggcacauuuu

SEQ ID NO: 3462532 - RNA, 15 nt, Human
uacaucgcccuccac

SEQ ID NO: 3462533 - RNA, 13 nt, Human
uacaucuggcuua

SEQ ID NO: 3462534 - RNA, 15 nt, Human
uacaucuggcuuauu

SEQ ID NO: 3462535 - RNA, 21 nt, Human
uacaucuggcuuauuuuaaug

SEQ ID NO: 3462536 - RNA, 15 nt, Human
uacaucuuucacauu

SEQ ID NO: 3462537 - RNA, 20 nt, Human
uacaucuuucacauuggcua

SEQ ID NO: 3462538 - RNA, 20 nt, Human
uacaucuuuucaacaaguaa

SEQ ID NO: 3462539 - RNA, 16 nt, Human
uacaugaaaacacauu

SEQ ID NO: 3462540 - RNA, 21 nt, Human
uacaugaaaauuuuaaaaaua

SEQ ID NO: 3462541 - RNA, 21 nt, Human
uacaugaaacagaaacaaaaa

SEQ ID NO: 3462542 - RNA, 20 nt, Human
uacaugaagaauagaaacaa

SEQ ID NO: 3462543 - RNA, 15 nt, Human
uacaugaaguauuuu

SEQ ID NO: 3462544 - RNA, 21 nt, Human
uacaugaaguauuuuuucagu

SEQ ID NO: 3462545 - RNA, 22 nt, Human
uacaugaaguauuuuuucagua

SEQ ID NO: 3462546 - RNA, 15 nt, Human
uacaugacacugaaa

SEQ ID NO: 3462547 - RNA, 17 nt, Human
uacaugacacugaaaug

SEQ ID NO: 3462548 - RNA, 17 nt, Human
uacaugagaacaaacag

SEQ ID NO: 3462549 - RNA, 16 nt, Human
uacaugagaaggaacu

SEQ ID NO: 3462550 - RNA, 19 nt, Human
uacaugaggaacuguagau

SEQ ID NO: 3462551 - RNA, 20 nt, Human
uacaugaggaacuguagaug

SEQ ID NO: 3462552 - RNA, 22 nt, Human
uacaugaugauuucagaaacaa

SEQ ID NO: 3462553 - RNA, 18 nt, Human
uacaugcaaaaagaaaug

SEQ ID NO: 3462554 - RNA, 21 nt, Human
uacaugcacuuggcugcauaa

SEQ ID NO: 3462555 - RNA, 14 nt, Human
uacaugcagcccau

SEQ ID NO: 3462556 - RNA, 11 nt, Human
uacaugcauac

SEQ ID NO: 3462557 - RNA, 20 nt, Human
uacaugcauacacucucaaa

SEQ ID NO: 3462558 - RNA, 17 nt, Human
uacaugcauacuucaaa

SEQ ID NO: 3462559 - RNA, 20 nt, Human
uacaugcauauaaugaauaa

SEQ ID NO: 3462560 - RNA, 19 nt, Human
uacaugccuaccaauauuu

SEQ ID NO: 3462561 - RNA, 16 nt, Human
uacaugcuuauuccau

SEQ ID NO: 3462562 - RNA, 20 nt, Human
uacaugcuuauuccaugacu

SEQ ID NO: 3462563 - RNA, 21 nt, Human
uacaugcuuauuccaugacug

SEQ ID NO: 3462564 - RNA, 22 nt, Human
uacauggacaauacccccaggc

SEQ ID NO: 3462565 - RNA, 16 nt, Human
uacauggacagaauuu

SEQ ID NO: 3462566 - RNA, 16 nt, Human
uacauggcagaguuug

SEQ ID NO: 3462567 - RNA, 19 nt, Human
uacauggcagaguuugugu

SEQ ID NO: 3462568 - RNA, 13 nt, Human
uuaaauagaugac

SEQ ID NO: 3462569 - RNA, 18 nt, Human
uuaaauaguaaaaauaaa

SEQ ID NO: 3462570 - RNA, 13 nt, Human
uuaaauauaauuc

SEQ ID NO: 3462571 - RNA, 19 nt, Human
uuaaauauaauucuguaaa

SEQ ID NO: 3462572 - RNA, 20 nt, Human
uuaaauauaauucuguaaau

SEQ ID NO: 3462573 - RNA, 13 nt, Human
uuaaauauagaau

SEQ ID NO: 3462574 - RNA, 14 nt, Human
uuaaauauagauua

SEQ ID NO: 3462575 - RNA, 18 nt, Human
uuaaauauagauuagaaa

SEQ ID NO: 3462576 - RNA, 16 nt, Human
uuaaauauauguaugu

SEQ ID NO: 3462577 - RNA, 17 nt, Human
uuaaauauauguaugua

SEQ ID NO: 3462578 - RNA, 19 nt, Human
uuaaauauauguauguaaa

SEQ ID NO: 3462579 - RNA, 22 nt, Human
uuaaauauauguauguaaaaau

SEQ ID NO: 3462580 - RNA, 22 nt, Human
uuaaauauauuuucaaaguaca

SEQ ID NO: 3462581 - RNA, 16 nt, Human
uuaaauaucaaucauu

SEQ ID NO: 3462582 - RNA, 17 nt, Human
uuaaauaucaaucauuu

SEQ ID NO: 3462583 - RNA, 17 nt, Human
uuaaauaucugaacauu

SEQ ID NO: 3462584 - RNA, 16 nt, Human
uuaaauaucuuuuaug

SEQ ID NO: 3462585 - RNA, 18 nt, Human
uuaaauauuuacauauga

SEQ ID NO: 3462586 - RNA, 13 nt, Human
uuaaauauuuagu

SEQ ID NO: 3462587 - RNA, 14 nt, Human
uuaaaucaaagaua

SEQ ID NO: 3462588 - RNA, 20 nt, Human
uuaaaucauuuuaggaaagg

SEQ ID NO: 3462589 - RNA, 20 nt, Human
uuaaaucccauucauaacuu

SEQ ID NO: 3462590 - RNA, 16 nt, Human
uuaaauccuguugaaa

SEQ ID NO: 3462591 - RNA, 13 nt, Human
uuaaauccuuuua

SEQ ID NO: 3462592 - RNA, 19 nt, Human
uuaaauccuuuuaccuuuu

SEQ ID NO: 3462593 - RNA, 16 nt, Human
uuaaaucugugaugau

SEQ ID NO: 3462594 - RNA, 12 nt, Human
uuaaaugaaaga

SEQ ID NO: 3462595 - RNA, 14 nt, Human
uuaaaugaaauugu

SEQ ID NO: 3462596 - RNA, 14 nt, Human
uuaaaugaacaaga

SEQ ID NO: 3462597 - RNA, 18 nt, Human
uuaaaugaacaagagaag

SEQ ID NO: 3462598 - RNA, 11 nt, Human
uuaaaugacuc

SEQ ID NO: 3462599 - RNA, 18 nt, Human
uuaaaugacucuucccuc

SEQ ID NO: 3462600 - RNA, 17 nt, Human
uuaaaugcaccuggaau

SEQ ID NO: 3462601 - RNA, 18 nt, Human
uuaaaugcaccuggaaua

SEQ ID NO: 3462602 - RNA, 15 nt, Human
uuaaaugcccagccc

SEQ ID NO: 3462603 - RNA, 16 nt, Human
uuaaaugcccagcccc

SEQ ID NO: 3462604 - RNA, 23 nt, Human
uuaaaugggcuacuuuguccuuu

SEQ ID NO: 3462605 - RNA, 21 nt, Human
uuaaauggguagagaaacacu

SEQ ID NO: 3462606 - RNA, 22 nt, Human
uuaaaugguaauaagcacugua

SEQ ID NO: 3462607 - RNA, 19 nt, Human
uuaaauguacagacauauu

SEQ ID NO: 3462608 - RNA, 14 nt, Human
uuaaauguauacua

SEQ ID NO: 3462609 - RNA, 22 nt, Human
uuaaaugucuaauguauuuuau

SEQ ID NO: 3462610 - RNA, 12 nt, Human
uuaaaugugaau

SEQ ID NO: 3462611 - RNA, 16 nt, Human
uuaaaugugaauuacu

SEQ ID NO: 3462612 - RNA, 16 nt, Human
uuaaauguuaugacua

SEQ ID NO: 3462613 - RNA, 16 nt, Human
uuaaauguuauguaua

SEQ ID NO: 3462614 - RNA, 11 nt, Human
uuaaauguuug

SEQ ID NO: 3462615 - RNA, 12 nt, Human
uuaaauguuuga

SEQ ID NO: 3462616 - RNA, 19 nt, Human
uuaaauguuuuguaaacuu

SEQ ID NO: 3462617 - RNA, 23 nt, Human
uuaaauguuuuuuuuuaaagacu

SEQ ID NO: 3462618 - RNA, 16 nt, Human
uuaaauuacaauuuua

SEQ ID NO: 3462619 - RNA, 18 nt, Human
uuaaauuacaauuuuauc

SEQ ID NO: 3462620 - RNA, 13 nt, Human
uuaaauuacagaa

SEQ ID NO: 3462621 - RNA, 14 nt, Human
uuaaauuagaaaau

SEQ ID NO: 3462622 - RNA, 17 nt, Human
uuaaauuagaaaauauu

SEQ ID NO: 3462623 - RNA, 21 nt, Human
uuaaauuauaacuuaaaauau

SEQ ID NO: 3462624 - RNA, 18 nt, Human
uuaaauuauaaggacugc

SEQ ID NO: 3462625 - RNA, 22 nt, Human
uuaaauucacaauagaaacuca

SEQ ID NO: 3462626 - RNA, 22 nt, Human
uuaaauucccguuuugucacuu

SEQ ID NO: 3462627 - RNA, 20 nt, Human
uucccagcucucccucuggc

SEQ ID NO: 3462628 - RNA, 23 nt, Human
uucccagcucucccucuggcccu

SEQ ID NO: 3462629 - RNA, 13 nt, Human
uucccaggacccu

SEQ ID NO: 3462630 - RNA, 19 nt, Human
uucccaggaguucugcuca

SEQ ID NO: 3462631 - RNA, 20 nt, Human
uucccaggaugagcauccca

SEQ ID NO: 3462632 - RNA, 14 nt, Human
uucccagggaagug

SEQ ID NO: 3462633 - RNA, 22 nt, Human
uucccagggaagugcucugaua

SEQ ID NO: 3462634 - RNA, 10 nt, Human
uucccagggu

SEQ ID NO: 3462635 - RNA, 23 nt, Human
uucccaggguagcccgccugcca

SEQ ID NO: 3462636 - RNA, 17 nt, Human
uucccagugaauucuug

SEQ ID NO: 3462637 - RNA, 14 nt, Human
uucccaguggcugc

SEQ ID NO: 3462638 - RNA, 21 nt, Human
uucccaguggcugcugcccag

SEQ ID NO: 3462639 - RNA, 15 nt, Human
uucccauaauuuucu

SEQ ID NO: 3462640 - RNA, 14 nt, Human
uucccauccccagc

SEQ ID NO: 3462641 - RNA, 14 nt, Human
uucccauccuaccc

SEQ ID NO: 3462642 - RNA, 21 nt, Human
uucccaucuccuuucucuggu

SEQ ID NO: 3462643 - RNA, 23 nt, Human
uucccauggggagggauucuggu

SEQ ID NO: 3462644 - RNA, 13 nt, Human
uucccauguuaaa

SEQ ID NO: 3462645 - RNA, 11 nt, Human
uucccauucca

SEQ ID NO: 3462646 - RNA, 14 nt, Human
uucccauucuugca

SEQ ID NO: 3462647 - RNA, 17 nt, Human
uucccauugaaaaugua

SEQ ID NO: 3462648 - RNA, 13 nt, Human
uucccauuuagaa

SEQ ID NO: 3462649 - RNA, 14 nt, Human
uucccauuucagcu

SEQ ID NO: 3462650 - RNA, 16 nt, Human
uucccauuugcuccuu

SEQ ID NO: 3462651 - RNA, 20 nt, Human
uucccauuugugccagagga

SEQ ID NO: 3462652 - RNA, 19 nt, Human
uuccccaacagugugaagu

SEQ ID NO: 3462653 - RNA, 23 nt, Human
uuccccaacagugugaaguuaga

SEQ ID NO: 3462654 - RNA, 14 nt, Human
uuccccaagacauu

SEQ ID NO: 3462655 - RNA, 13 nt, Human
uuccccaauuaau

SEQ ID NO: 3462656 - RNA, 15 nt, Human
uuccccaccagaugc

SEQ ID NO: 3462657 - RNA, 21 nt, Human
uuccccaccagugaaugaaag

SEQ ID NO: 3462658 - RNA, 21 nt, Human
uuccccacccuccccuuccca

SEQ ID NO: 3462659 - RNA, 22 nt, Human
uuccccacccuccccuucccag

SEQ ID NO: 3462660 - RNA, 22 nt, Human
uuccccagcaugcaccacgggc

SEQ ID NO: 3462661 - RNA, 14 nt, Human
uuccccagcccagg

SEQ ID NO: 3462662 - RNA, 21 nt, Human
uuccccaggaggccagccuug

SEQ ID NO: 3462663 - RNA, 16 nt, Human
uuccccauacucuguc

SEQ ID NO: 3462664 - RNA, 18 nt, Human
uuccccaucuucuaaacc

SEQ ID NO: 3462665 - RNA, 12 nt, Human
uuccccaugaca

SEQ ID NO: 3462666 - RNA, 21 nt, Human
uuccccaugcuuccuugccug

SEQ ID NO: 3462667 - RNA, 19 nt, Human
uuccccaugucucgacuca

SEQ ID NO: 3462668 - RNA, 23 nt, Human
uucccccaaauuuaaagaaguau

SEQ ID NO: 3462669 - RNA, 22 nt, Human
uucccccaccgguccagcuggc

SEQ ID NO: 3462670 - RNA, 23 nt, Human
uucccccaccgguccagcuggcc

SEQ ID NO: 3462671 - RNA, 17 nt, Human
uucccccacuacugcag

SEQ ID NO: 3462672 - RNA, 18 nt, Human
uucccccacuacugcagc

SEQ ID NO: 3462673 - RNA, 14 nt, Human
uucccccagcccug

SEQ ID NO: 3462674 - RNA, 15 nt, Human
uucccccauagccac

SEQ ID NO: 3462675 - RNA, 17 nt, Human
uucccccauagccaccc

SEQ ID NO: 3462676 - RNA, 18 nt, Human
uuccccccacucucccca

SEQ ID NO: 3462677 - RNA, 19 nt, Human
uuccccccacucuccccac

SEQ ID NO: 3462678 - RNA, 13 nt, Human
uucccccgccgcu

SEQ ID NO: 3462679 - RNA, 18 nt, Human
uucccccucucccaguug

SEQ ID NO: 3462680 - RNA, 22 nt, Human
uucccccuguuucagaggcuca

SEQ ID NO: 3462681 - RNA, 17 nt, Human
uucccccuuccaaauaa

SEQ ID NO: 3462682 - RNA, 21 nt, Human
uucccccuuccaaauaauaaa

SEQ ID NO: 3462683 - RNA, 19 nt, Human
uucccccuuuucugcauuu

SEQ ID NO: 3462684 - RNA, 16 nt, Human
uuccccgagggaugau

SEQ ID NO: 3462685 - RNA, 21 nt, Human
uuccccuacccccuccucucu

SEQ ID NO: 3462686 - RNA, 17 nt, Human
uuccccucccuggcucc

SEQ ID NO: 3462687 - RNA, 20 nt, Human
uuccccuccuaccccuccca

SEQ ID NO: 3462688 - RNA, 15 nt, Human
uuccccuccuccacu

SEQ ID NO: 3462689 - RNA, 17 nt, Human
uuccccucuugucuccc

SEQ ID NO: 3462690 - RNA, 18 nt, Human
uuccccucuugucucccc

SEQ ID NO: 3462691 - RNA, 19 nt, Human
uuccccucuugucuccccu

SEQ ID NO: 3462692 - RNA, 13 nt, Human
uuccccuguccug

SEQ ID NO: 3462693 - RNA, 11 nt, Human
uuccccugugu

SEQ ID NO: 3462694 - RNA, 14 nt, Human
uuccccuguucacu

SEQ ID NO: 3462695 - RNA, 17 nt, Human
uuccccuguucacucua

SEQ ID NO: 3462696 - RNA, 19 nt, Human
uuccccuuauccucccugu

SEQ ID NO: 3462697 - RNA, 20 nt, Human
uuccccuuauccucccugua

SEQ ID NO: 3462698 - RNA, 20 nt, Human
uuccccuugcccuugcccug

SEQ ID NO: 3462699 - RNA, 19 nt, Human
uuccccuuuccugucccac

SEQ ID NO: 3462700 - RNA, 22 nt, Human
uucccgagcaaagucuaaaguu

SEQ ID NO: 3462701 - RNA, 19 nt, Human
uucccgccgcccagcccac

SEQ ID NO: 3462702 - RNA, 15 nt, Human
uucccgcucagcccu

SEQ ID NO: 3462703 - RNA, 21 nt, Human
uucccggacugcaagcagggc

SEQ ID NO: 3462704 - RNA, 15 nt, Human
uucccggucccgagu

SEQ ID NO: 3462705 - RNA, 23 nt, Human
uucccguggaacguuuuuccugu

SEQ ID NO: 3462706 - RNA, 16 nt, Human
uucccguggccccagc

SEQ ID NO: 3462707 - RNA, 12 nt, Human
uucccuaagcca

SEQ ID NO: 3462708 - RNA, 17 nt, Human
uucccuacugaagcccu

SEQ ID NO: 3462709 - RNA, 14 nt, Human
uucccuacuuccug

SEQ ID NO: 3462710 - RNA, 22 nt, Human
uucccuagaaacuuccaaaucc

SEQ ID NO: 3462711 - RNA, 19 nt, Human
uucccuagucuauucauua

SEQ ID NO: 3462712 - RNA, 15 nt, Human
uucccuauuagagaa

SEQ ID NO: 3462713 - RNA, 22 nt, Human
uuccuucuuugauaauguuaaa

SEQ ID NO: 3462714 - RNA, 21 nt, Human
uuccuugaccugcauuguaaa

SEQ ID NO: 3462715 - RNA, 17 nt, Human
uuccuugagaaaaacaa

SEQ ID NO: 3462716 - RNA, 24 nt, Human
uuccuugagacacggagcccagcc

SEQ ID NO: 3462717 - RNA, 16 nt, Human
uuccuugaucauuuug

SEQ ID NO: 3462718 - RNA, 13 nt, Human
uuccuugcauaca

SEQ ID NO: 3462719 - RNA, 16 nt, Human
uuccuugcucugcacc

SEQ ID NO: 3462720 - RNA, 18 nt, Human
uuccuuggcaugccuucc

SEQ ID NO: 3462721 - RNA, 21 nt, Human
uuccuuggcaugccuuccagc

SEQ ID NO: 3462722 - RNA, 21 nt, Human
uuccuuggcucccauucacuc

SEQ ID NO: 3462723 - RNA, 20 nt, Human
uuccuuguagccuuuugacu

SEQ ID NO: 3462724 - RNA, 21 nt, Human
uuccuuguccccacacuccua

SEQ ID NO: 3462725 - RNA, 13 nt, Human
uuccuugugcaaa

SEQ ID NO: 3462726 - RNA, 19 nt, Human
uuccuuguuacccaugaaa

SEQ ID NO: 3462727 - RNA, 20 nt, Human
uuccuuguuacccaugaaaa

SEQ ID NO: 3462728 - RNA, 17 nt, Human
uuccuuuaacaacaugu

SEQ ID NO: 3462729 - RNA, 19 nt, Human
uuccuuuaacaacauguuu

SEQ ID NO: 3462730 - RNA, 22 nt, Human
uuccuuuacuuucccuugcuuu

SEQ ID NO: 3462731 - RNA, 22 nt, Human
uuccuuuccaacguuuggaaga

SEQ ID NO: 3462732 - RNA, 16 nt, Human
uuccuuuccccagccc

SEQ ID NO: 3462733 - RNA, 13 nt, Human
uuccuuucccuuc

SEQ ID NO: 3462734 - RNA, 15 nt, Human
uuccuuucccuuccu

SEQ ID NO: 3462735 - RNA, 17 nt, Human
uuccuuucccuuccucu

SEQ ID NO: 3462736 - RNA, 14 nt, Human
uuccuuucuccagg

SEQ ID NO: 3462737 - RNA, 13 nt, Human
uuccuuucucuuu

SEQ ID NO: 3462738 - RNA, 20 nt, Human
uuccuuucuugguucauaaa

SEQ ID NO: 3462739 - RNA, 14 nt, Human
uuccuuugcauauu

SEQ ID NO: 3462740 - RNA, 15 nt, Human
uuccuuuggagcuuu

SEQ ID NO: 3462741 - RNA, 17 nt, Human
uuccuuugggccucugc

SEQ ID NO: 3462742 - RNA, 16 nt, Human
uuccuuugucuucaaa

SEQ ID NO: 3462743 - RNA, 17 nt, Human
uuccuuugucuucaaac

SEQ ID NO: 3462744 - RNA, 13 nt, Human
uuccuuugugugu

SEQ ID NO: 3462745 - RNA, 20 nt, Human
uuccuuuuaaaacacuucca

SEQ ID NO: 3462746 - RNA, 22 nt, Human
uuccuuuuaaaacacuuccaua

SEQ ID NO: 3462747 - RNA, 20 nt, Human
uuccuuuuagccuaguucau

SEQ ID NO: 3462748 - RNA, 12 nt, Human
uuccuuuuauca

SEQ ID NO: 3462749 - RNA, 20 nt, Human
uuccuuuucuauuccuucug

SEQ ID NO: 3462750 - RNA, 14 nt, Human
uuccuuuucuuguu

SEQ ID NO: 3462751 - RNA, 15 nt, Human
uuccuuuugaaagaa

SEQ ID NO: 3462752 - RNA, 20 nt, Human
uuccuuuuuaauaugcuuaa

SEQ ID NO: 3462753 - RNA, 14 nt, Human
uuccuuuuucagau

SEQ ID NO: 3462754 - RNA, 15 nt, Human
uuccuuuuucugauu

SEQ ID NO: 3462755 - RNA, 17 nt, Human
uuccuuuuugacacuga

SEQ ID NO: 3462756 - RNA, 21 nt, Human
uuccuuuuuuaaaaaugcaaa

SEQ ID NO: 3462757 - RNA, 15 nt, Human
uuccuuuuuucccau

SEQ ID NO: 3462758 - RNA, 19 nt, Human
uuccuuuuuucccauaaga

SEQ ID NO: 3462759 - RNA, 13 nt, Human
uucgaagucauua

SEQ ID NO: 3462760 - RNA, 14 nt, Human
uucgaagucauuaa

SEQ ID NO: 3462761 - RNA, 15 nt, Human
uucgacacuguucuu

SEQ ID NO: 3462762 - RNA, 16 nt, Human
uucgacagcauuuucc

SEQ ID NO: 3462763 - RNA, 15 nt, Human
uucgacauauuuccu

SEQ ID NO: 3462764 - RNA, 17 nt, Human
uucgacuugcauuuuug

SEQ ID NO: 3462765 - RNA, 20 nt, Human
uucgagaagcugcucuggaa

SEQ ID NO: 3462766 - RNA, 16 nt, Human
uucgagaccagccugg

SEQ ID NO: 3462767 - RNA, 19 nt, Human
uucgagaccagccuggcca

SEQ ID NO: 3462768 - RNA, 23 nt, Human
uucgagauuaucguuuucuuaaa

SEQ ID NO: 3462769 - RNA, 12 nt, Human
uucgaggccuga

SEQ ID NO: 3462770 - RNA, 18 nt, Human
uucgaucucauucaguau

SEQ ID NO: 3462771 - RNA, 16 nt, Human
uucgaugaaggcugcc

SEQ ID NO: 3462772 - RNA, 18 nt, Human
uucgaugguacgugaccc

SEQ ID NO: 3462773 - RNA, 23 nt, Human
uucgaugguacgugacccucugc

SEQ ID NO: 3462774 - RNA, 14 nt, Human
uucgcacagcaguu

SEQ ID NO: 3462775 - RNA, 20 nt, Human
uucgcagagcuuuucagauu

SEQ ID NO: 3462776 - RNA, 13 nt, Human
uucgcagccaccc

SEQ ID NO: 3462777 - RNA, 18 nt, Human
uucgcagccacccugagg

SEQ ID NO: 3462778 - RNA, 16 nt, Human
uucgcauggucacaca

SEQ ID NO: 3462779 - RNA, 13 nt, Human
uucgccuuuccuc

SEQ ID NO: 3462780 - RNA, 22 nt, Human
uucgcgauggacagacucacaa

SEQ ID NO: 3462781 - RNA, 18 nt, Human
uucggaaaccuuggugua

SEQ ID NO: 3462782 - RNA, 19 nt, Human
uucggaacuguccuuuccu

SEQ ID NO: 3462783 - RNA, 20 nt, Human
uucggacaguuuauuuguug

SEQ ID NO: 3462784 - RNA, 15 nt, Human
uucggaguugggggu

SEQ ID NO: 3462785 - RNA, 18 nt, Human
uucggccccauguaucuc

SEQ ID NO: 3462786 - RNA, 15 nt, Human
uucggccuccauccu

SEQ ID NO: 3462787 - RNA, 18 nt, Human
uucggccuccauccugag

SEQ ID NO: 3462788 - RNA, 20 nt, Human
uucgggaggucgaggcagga

SEQ ID NO: 3462789 - RNA, 20 nt, Human
uucgggccaaggaccugaga

SEQ ID NO: 3462790 - RNA, 14 nt, Human
uucgggcccugccu

SEQ ID NO: 3462791 - RNA, 18 nt, Human
uucgggcgucugugugcg

SEQ ID NO: 3462792 - RNA, 15 nt, Human
uuaagauacaaauua

SEQ ID NO: 3462793 - RNA, 18 nt, Human
uuaagaucacagugaacu

SEQ ID NO: 3462794 - RNA, 11 nt, Human
uuaagauguga

SEQ ID NO: 3462795 - RNA, 14 nt, Human
uuaagaugugaaaa

SEQ ID NO: 3462796 - RNA, 17 nt, Human
uuaagaugugaaaauua

SEQ ID NO: 3462797 - RNA, 21 nt, Human
uuaagaugugucuucaauuug

SEQ ID NO: 3462798 - RNA, 14 nt, Human
uuaagauuauaauu

SEQ ID NO: 3462799 - RNA, 19 nt, Human
uuaagauuccuuuucuugu

SEQ ID NO: 3462800 - RNA, 11 nt, Human
uuaagauuuaa

SEQ ID NO: 3462801 - RNA, 19 nt, Human
uuaagauuuaauuugccaa

SEQ ID NO: 3462802 - RNA, 18 nt, Human
uuaagauuuuacaaaaga

SEQ ID NO: 3462803 - RNA, 14 nt, Human
uuaagauuuuucuc

SEQ ID NO: 3462804 - RNA, 17 nt, Human
uuaagauuuuucucaaa

SEQ ID NO: 3462805 - RNA, 20 nt, Human
uuaagauuuuucucaaaguu

SEQ ID NO: 3462806 - RNA, 19 nt, Human
uuaagcaaaagaaaaagau

SEQ ID NO: 3462807 - RNA, 23 nt, Human
uuaagcaaaggggacagcugugu

SEQ ID NO: 3462808 - RNA, 15 nt, Human
uuaagcaaauacuua

SEQ ID NO: 3462809 - RNA, 20 nt, Human
uuaagcacuacauaaacuga

SEQ ID NO: 3462810 - RNA, 17 nt, Human
uuaagcagaauuggaaa

SEQ ID NO: 3462811 - RNA, 22 nt, Human
uuaagcagaauuggaaaagacu

SEQ ID NO: 3462812 - RNA, 18 nt, Human
uuaagcagcucuugcuaa

SEQ ID NO: 3462813 - RNA, 18 nt, Human
uuaagcaguaaaaacugu

SEQ ID NO: 3462814 - RNA, 14 nt, Human
uuaagcaucacaaa

SEQ ID NO: 3462815 - RNA, 17 nt, Human
uuaagcaugacagaaaa

SEQ ID NO: 3462816 - RNA, 13 nt, Human
uuaagcauuacca

SEQ ID NO: 3462817 - RNA, 14 nt, Human
uuaagcauuacucu

SEQ ID NO: 3462818 - RNA, 21 nt, Human
uuaagcauuacucuuguaaga

SEQ ID NO: 3462819 - RNA, 14 nt, Human
uuaagcauuguuug

SEQ ID NO: 3462820 - RNA, 15 nt, Human
uuaagccacugccuc

SEQ ID NO: 3462821 - RNA, 21 nt, Human
uuaagccacuuaaaauguuca

SEQ ID NO: 3462822 - RNA, 19 nt, Human
uuaagccucaaauuugaac

SEQ ID NO: 3462823 - RNA, 19 nt, Human
uuaagccucauauuuaaag

SEQ ID NO: 3462824 - RNA, 21 nt, Human
uuaagccucauauuuaaagac

SEQ ID NO: 3462825 - RNA, 16 nt, Human
uuaagccuuuggaaac

SEQ ID NO: 3462826 - RNA, 19 nt, Human
uuaagcuaggaaaagaaau

SEQ ID NO: 3462827 - RNA, 22 nt, Human
uuaagcuaggaaaagaaaucua

SEQ ID NO: 3462828 - RNA, 19 nt, Human
uuaagcugcaaaucugaug

SEQ ID NO: 3462829 - RNA, 19 nt, Human
uuaagcugcagagauuucu

SEQ ID NO: 3462830 - RNA, 21 nt, Human
uuaagcuguuccuguucagua

SEQ ID NO: 3462831 - RNA, 13 nt, Human
uuaagcuuuuugg

SEQ ID NO: 3462832 - RNA, 19 nt, Human
uuaaggacaaaaaugaacu

SEQ ID NO: 3462833 - RNA, 16 nt, Human
uuaaggacugacugag

SEQ ID NO: 3462834 - RNA, 18 nt, Human
uuaaggacugacugaggc

SEQ ID NO: 3462835 - RNA, 22 nt, Human
uuaaggauaaaucauaaaguca

SEQ ID NO: 3462836 - RNA, 18 nt, Human
uuaaggaugggguuauga

SEQ ID NO: 3462837 - RNA, 15 nt, Human
uuaaggcaacugaac

SEQ ID NO: 3462838 - RNA, 20 nt, Human
uuaaggcaacugaacaaaaa

SEQ ID NO: 3462839 - RNA, 18 nt, Human
uuaaggcccaacauuaaa

SEQ ID NO: 3462840 - RNA, 15 nt, Human
uuaagggaaaaauau

SEQ ID NO: 3462841 - RNA, 21 nt, Human
uuaagggauggaaaaggaaga

SEQ ID NO: 3462842 - RNA, 24 nt, Human
uuaaggggaggaaccagagugcug

SEQ ID NO: 3462843 - RNA, 18 nt, Human
uuaagggguaucauguau

SEQ ID NO: 3462844 - RNA, 16 nt, Human
uuaaggucuuucagua

SEQ ID NO: 3462845 - RNA, 21 nt, Human
uuaaggugaggccugucugug

SEQ ID NO: 3462846 - RNA, 17 nt, Human
uuaagguguagccacac

SEQ ID NO: 3462847 - RNA, 14 nt, Human
uuaagguguuugaa

SEQ ID NO: 3462848 - RNA, 22 nt, Human
uuaagguguuugaaaauaguuu

SEQ ID NO: 3462849 - RNA, 14 nt, Human
uuaagguuauuuau

SEQ ID NO: 3462850 - RNA, 12 nt, Human
uuaaguaaguuu

SEQ ID NO: 3462851 - RNA, 18 nt, Human
uuaaguaaugauaacugg

SEQ ID NO: 3462852 - RNA, 15 nt, Human
uuaaguaauguggaa

SEQ ID NO: 3462853 - RNA, 14 nt, Human
uuaaguauaucaug

SEQ ID NO: 3462854 - RNA, 15 nt, Human
uuaaguauucaagaa

SEQ ID NO: 3462855 - RNA, 23 nt, Human
uuaaguauugauucugcuugaga

SEQ ID NO: 3462856 - RNA, 13 nt, Human
uuaaguauugcau

SEQ ID NO: 3462857 - RNA, 20 nt, Human
uuaaguauugcaucuguaua

SEQ ID NO: 3462858 - RNA, 14 nt, Human
uuagaaaaagaaca

SEQ ID NO: 3462859 - RNA, 17 nt, Human
uuagaaaaauuccuaag

SEQ ID NO: 3462860 - RNA, 21 nt, Human
uuagaaaacauaaucuucugc

SEQ ID NO: 3462861 - RNA, 16 nt, Human
uuagaaaacuuuaaag

SEQ ID NO: 3462862 - RNA, 14 nt, Human
uuagaaaacuuugu

SEQ ID NO: 3462863 - RNA, 20 nt, Human
uuagaaaagcaaagggugcu

SEQ ID NO: 3462864 - RNA, 13 nt, Human
uuagaaaagugaa

SEQ ID NO: 3462865 - RNA, 19 nt, Human
uuagaaaauguuauuuaac

SEQ ID NO: 3462866 - RNA, 18 nt, Human
uuagaaaccuuaauaugu

SEQ ID NO: 3462867 - RNA, 19 nt, Human
uuagaaacuuaucuuacaa

SEQ ID NO: 3462868 - RNA, 18 nt, Human
uuagaaagcauuugaaug

SEQ ID NO: 3462869 - RNA, 19 nt, Human
uuagaaagcauuugaaugc

SEQ ID NO: 3462870 - RNA, 21 nt, Human
uuagaaaguagccacguaugg

SEQ ID NO: 3462871 - RNA, 22 nt, Human
uuagaaauaaagcaucucauuu

SEQ ID NO: 3462872 - RNA, 19 nt, Human
uuagaaauaaauguaccug

SEQ ID NO: 3462873 - RNA, 13 nt, Human
uuagaaauagaca

SEQ ID NO: 3462874 - RNA, 11 nt, Human
uuagaaauaua

SEQ ID NO: 3462875 - RNA, 12 nt, Human
uuagaaauauaa

SEQ ID NO: 3462876 - RNA, 13 nt, Human
uuagaaauauuca

SEQ ID NO: 3462877 - RNA, 15 nt, Human
uuagaaauauucaca

SEQ ID NO: 3462878 - RNA, 13 nt, Human
uuagaaauauuuu

SEQ ID NO: 3462879 - RNA, 17 nt, Human
uuagaaaugaccaauau

SEQ ID NO: 3462880 - RNA, 13 nt, Human
uuagaaaugcaaa

SEQ ID NO: 3462881 - RNA, 19 nt, Human
uuagaaauuaccuguggau

SEQ ID NO: 3462882 - RNA, 23 nt, Human
uuagaaauuaccuguggauauuu

SEQ ID NO: 3462883 - RNA, 17 nt, Human
uuagaaauugcauuucc

SEQ ID NO: 3462884 - RNA, 18 nt, Human
uuagaacaauuuucuugu

SEQ ID NO: 3462885 - RNA, 12 nt, Human
uuagaacacuau

SEQ ID NO: 3462886 - RNA, 19 nt, Human
uuagaacacuauuuucaga

SEQ ID NO: 3462887 - RNA, 17 nt, Human
uuagaacagaaaacaac

SEQ ID NO: 3462888 - RNA, 22 nt, Human
uuagaacagaaaacaacaaaaa

SEQ ID NO: 3462889 - RNA, 14 nt, Human
uuagaagaagugug

SEQ ID NO: 3462890 - RNA, 17 nt, Human
uuagaagacaauugaca

SEQ ID NO: 3462891 - RNA, 18 nt, Human
uuagaagauagaugcacu

SEQ ID NO: 3462892 - RNA, 23 nt, Human
uuagaagauauuagucuuggggc

SEQ ID NO: 3462893 - RNA, 23 nt, Human
uuagaagcacuacaccuugccuu

SEQ ID NO: 3462894 - RNA, 23 nt, Human
uuagaagccugcauaauguuucu

SEQ ID NO: 3462895 - RNA, 13 nt, Human
uuagaagguauua

SEQ ID NO: 3462896 - RNA, 18 nt, Human
uuagaagguauuaagauu

SEQ ID NO: 3462897 - RNA, 18 nt, Human
uuagaagguucucuccuc

SEQ ID NO: 3462898 - RNA, 13 nt, Human
uuagaagugucau

SEQ ID NO: 3462899 - RNA, 14 nt, Human
uuagaagugucaug

SEQ ID NO: 3462900 - RNA, 13 nt, Human
uuagaaguguuaa

SEQ ID NO: 3462901 - RNA, 15 nt, Human
uuagaauaaaauugu

SEQ ID NO: 3462902 - RNA, 16 nt, Human
uuagaauaagaauuug

SEQ ID NO: 3462903 - RNA, 18 nt, Human
uuagaauaagaauuugca

SEQ ID NO: 3462904 - RNA, 19 nt, Human
uuagaauaauaaauauuua

SEQ ID NO: 3462905 - RNA, 17 nt, Human
uuagaaucaaacauuuu

SEQ ID NO: 3462906 - RNA, 20 nt, Human
uuagaaucaaacauuuugaa

SEQ ID NO: 3462907 - RNA, 20 nt, Human
uuagaaucauuaccuuuuac

SEQ ID NO: 3462908 - RNA, 21 nt, Human
uuagaauccacguauuccccu

SEQ ID NO: 3462909 - RNA, 14 nt, Human
uuagaaucuauuuu

SEQ ID NO: 3462910 - RNA, 18 nt, Human
uuagaauggugauuuuaa

SEQ ID NO: 3462911 - RNA, 19 nt, Human
uuagaauggugauuuuaaa

SEQ ID NO: 3462912 - RNA, 21 nt, Human
uuagaauggugauuuuaaaug

SEQ ID NO: 3462913 - RNA, 16 nt, Human
uuagaauguuuuccuu

SEQ ID NO: 3462914 - RNA, 17 nt, Human
uuagaauuaaaaaagca

SEQ ID NO: 3462915 - RNA, 16 nt, Human
uuagaauuaaaaguug

SEQ ID NO: 3462916 - RNA, 13 nt, Human
uuagaauugaagg

SEQ ID NO: 3462917 - RNA, 14 nt, Human
uuagaauugaaggu

SEQ ID NO: 3462918 - RNA, 16 nt, Human
uuagaauugaagguuu

SEQ ID NO: 3462919 - RNA, 15 nt, Human
uuagacaaauacuca

SEQ ID NO: 3462920 - RNA, 18 nt, Human
uuagacaaauacucaugu

SEQ ID NO: 3462921 - RNA, 22 nt, Human
uuagacaaauacucauguguau

SEQ ID NO: 3462922 - RNA, 23 nt, Human
uuagacaaauacucauguguaug

SEQ ID NO: 3462923 - RNA, 22 nt, Human
uuagacaaaucuaagggaaaaa

SEQ ID NO: 3462924 - RNA, 23 nt, Human
uuagacacuggcugccagcuauu

SEQ ID NO: 3462925 - RNA, 14 nt, Human
uuagacagaacacc

SEQ ID NO: 3462926 - RNA, 13 nt, Human
uuagacagucccu

SEQ ID NO: 3462927 - RNA, 17 nt, Human
uuagacagucccugcca

SEQ ID NO: 3462928 - RNA, 19 nt, Human
uuagaccagaggucuagau

SEQ ID NO: 3462929 - RNA, 20 nt, Human
uuagacccucaugcugccaa

SEQ ID NO: 3462930 - RNA, 18 nt, Human
uuagaccgcucucuuuuc

SEQ ID NO: 3462931 - RNA, 13 nt, Human
uuagaccuacagg

SEQ ID NO: 3462932 - RNA, 14 nt, Human
uuagaccucagccu

SEQ ID NO: 3462933 - RNA, 15 nt, Human
uuagaccucagccug

SEQ ID NO: 3462934 - RNA, 18 nt, Human
uuagacuacauuuagaga

SEQ ID NO: 3462935 - RNA, 22 nt, Human
uuagacucaugguguguuacac

SEQ ID NO: 3462936 - RNA, 13 nt, Human
uuagacugccagc

SEQ ID NO: 3462937 - RNA, 16 nt, Human
uuagacuggaacuuga

SEQ ID NO: 3462938 - RNA, 22 nt, Human
uuagacuggaacuugaacugau

SEQ ID NO: 3462939 - RNA, 17 nt, Human
uuagacuggacagcuug

SEQ ID NO: 3462940 - RNA, 19 nt, Human
uuagacuggacagcuugug

SEQ ID NO: 3462941 - RNA, 14 nt, Human
uuagacuguagccu

SEQ ID NO: 3462942 - RNA, 20 nt, Human
uuagacuguuggggugggua

SEQ ID NO: 3462943 - RNA, 21 nt, Human
uuagacuucgacucaggaucc

SEQ ID NO: 3462944 - RNA, 12 nt, Human
uuagacuugaaa

SEQ ID NO: 3462945 - RNA, 15 nt, Human
uuagacuuuaacaua

SEQ ID NO: 3462946 - RNA, 16 nt, Human
uuagacuuuaacauaa

SEQ ID NO: 3462947 - RNA, 21 nt, Human
uuagacuuuaacauaagcuau

SEQ ID NO: 3462948 - RNA, 21 nt, Human
uuagacuuuuccaauauguga

SEQ ID NO: 3462949 - RNA, 21 nt, Human
uuagagaacugaaaagagagc

SEQ ID NO: 3462950 - RNA, 21 nt, Human
uuagagaaguauacauaaguu

SEQ ID NO: 3462951 - RNA, 16 nt, Human
uuagagaaugagaaau

SEQ ID NO: 3462952 - RNA, 12 nt, Human
uuagagauuuuu

SEQ ID NO: 3462953 - RNA, 13 nt, Human
uuagagccucccu

SEQ ID NO: 3462954 - RNA, 21 nt, Human
uuagagcuuccgagaauagcu

SEQ ID NO: 3462955 - RNA, 17 nt, Human
uuagaggaaaaaaauga

SEQ ID NO: 3462956 - RNA, 22 nt, Human
uuagaggaaauaagaaaaauca

SEQ ID NO: 3462957 - RNA, 23 nt, Human
uuagaggaaauaagaaaaaucau

SEQ ID NO: 3462958 - RNA, 19 nt, Human
uuagagguuuuaaagugau

SEQ ID NO: 3462959 - RNA, 19 nt, Human
uuagaguaagaaauuucag

SEQ ID NO: 3462960 - RNA, 14 nt, Human
uuagaguagcauga

SEQ ID NO: 3462961 - RNA, 14 nt, Human
uuagagucagccuu

SEQ ID NO: 3462962 - RNA, 17 nt, Human
uuagaguuagacuguug

SEQ ID NO: 3462963 - RNA, 14 nt, Human
uuagaguugauacu

SEQ ID NO: 3462964 - RNA, 15 nt, Human
uuagaguuucuguuu

SEQ ID NO: 3462965 - RNA, 22 nt, Human
uuagauaauacaccacuacauu

SEQ ID NO: 3462966 - RNA, 17 nt, Human
uuagauagcccuguccu

SEQ ID NO: 3462967 - RNA, 17 nt, Human
uuagauagcugcaugug

SEQ ID NO: 3462968 - RNA, 13 nt, Human
uuagauaucuuuu

SEQ ID NO: 3462969 - RNA, 16 nt, Human
uuagauaucuuuuuau

SEQ ID NO: 3462970 - RNA, 23 nt, Human
uuagaucaaauacuuuaaaggaa

SEQ ID NO: 3462971 - RNA, 17 nt, Human
uuagaucauaguuuuau

SEQ ID NO: 3462972 - RNA, 14 nt, Human
uuagauccauuaau

SEQ ID NO: 3462973 - RNA, 14 nt, Human
uuagaucuaguuca

SEQ ID NO: 3462974 - RNA, 22 nt, Human
uuagaugcaguucugaagaaga

SEQ ID NO: 3462975 - RNA, 17 nt, Human
uuagaugcuacuaagaa

SEQ ID NO: 3462976 - RNA, 17 nt, Human
uuagauggauucuccac

SEQ ID NO: 3462977 - RNA, 13 nt, Human
uuagaugguuaca

SEQ ID NO: 3462978 - RNA, 18 nt, Human
uuagaugguuacacuguu

SEQ ID NO: 3462979 - RNA, 16 nt, Human
uuagauguaauuuugu

SEQ ID NO: 3462980 - RNA, 18 nt, Human
uuagaugugcugcuuuga

SEQ ID NO: 3462981 - RNA, 21 nt, Human
uuagauguuccaguaaucuaa

SEQ ID NO: 3462982 - RNA, 13 nt, Human
uuagauguucuaa

SEQ ID NO: 3462983 - RNA, 20 nt, Human
uuagauguucuaagucuuuc

SEQ ID NO: 3462984 - RNA, 19 nt, Human
uuagauguucucuaucauu

SEQ ID NO: 3462985 - RNA, 22 nt, Human
uuagauguugccauguguuuua

SEQ ID NO: 3462986 - RNA, 15 nt, Human
uuagauguuucacac

SEQ ID NO: 3462987 - RNA, 15 nt, Human
uuagauuaagaaaua

SEQ ID NO: 3462988 - RNA, 16 nt, Human
uuagauuagcucugga

SEQ ID NO: 3462989 - RNA, 14 nt, Human
uuagauuauauuga

SEQ ID NO: 3462990 - RNA, 20 nt, Human
uuagauucuuaauucaugag

SEQ ID NO: 3462991 - RNA, 15 nt, Human
uuagauugagaaaug

SEQ ID NO: 3462992 - RNA, 14 nt, Human
uuagauuucauagu

SEQ ID NO: 3462993 - RNA, 19 nt, Human
uucugcauucauuuuuaua

SEQ ID NO: 3462994 - RNA, 18 nt, Human
uucugcauuuugcuauug

SEQ ID NO: 3462995 - RNA, 21 nt, Human
uucugcauuuugcuauuguaa

SEQ ID NO: 3462996 - RNA, 17 nt, Human
uucugccaccccuaaac

SEQ ID NO: 3462997 - RNA, 13 nt, Human
uucugccaggaga

SEQ ID NO: 3462998 - RNA, 15 nt, Human
uucugccauauucug

SEQ ID NO: 3462999 - RNA, 21 nt, Human
uucugccaucuagccagcccc

SEQ ID NO: 3463000 - RNA, 19 nt, Human
uucugcccaauuggaggaa

SEQ ID NO: 3463001 - RNA, 19 nt, Human
uucugcccacauuggaccc

SEQ ID NO: 3463002 - RNA, 14 nt, Human
uucugcccccagcc

SEQ ID NO: 3463003 - RNA, 17 nt, Human
uuaguauucauucugca

SEQ ID NO: 3463004 - RNA, 13 nt, Human
uuaguauugcaaa

SEQ ID NO: 3463005 - RNA, 18 nt, Human
uuaguauuguuguccuuu

SEQ ID NO: 3463006 - RNA, 22 nt, Human
uuaguauuguuguccuuuucau

SEQ ID NO: 3463007 - RNA, 13 nt, Human
uuaguauuugcau

SEQ ID NO: 3463008 - RNA, 16 nt, Human
uucuguucauuuguua

SEQ ID NO: 3463009 - RNA, 17 nt, Human
uucuguuccaaauucag

SEQ ID NO: 3463010 - RNA, 14 nt, Human
uucuguucuaguuu

SEQ ID NO: 3463011 - RNA, 13 nt, Human
uucuguucugaua

SEQ ID NO: 3463012 - RNA, 15 nt, Human
uucuguucuggagga

SEQ ID NO: 3463013 - RNA, 22 nt, Human
uucuguuguaacuuauguagau

SEQ ID NO: 3463014 - RNA, 14 nt, Human
uucuguuuaauuuu

SEQ ID NO: 3463015 - RNA, 23 nt, Human
uucuguuucaaggcacucuagau

SEQ ID NO: 3463016 - RNA, 18 nt, Human
uucuguuuccuguaccag

SEQ ID NO: 3463017 - RNA, 14 nt, Human
uucuguuucuaguu

SEQ ID NO: 3463018 - RNA, 15 nt, Human
uucuguuucuaguug

SEQ ID NO: 3463019 - RNA, 13 nt, Human
uucuguuugcugu

SEQ ID NO: 3463020 - RNA, 13 nt, Human
uucuguuuuuaau

SEQ ID NO: 3463021 - RNA, 21 nt, Human
uucuuaaaauauauuucagau

SEQ ID NO: 3463022 - RNA, 23 nt, Human
uucuuaaaaugcaauauuuguaa

SEQ ID NO: 3463023 - RNA, 20 nt, Human
uucuuaaagugccaguauuu

SEQ ID NO: 3463024 - RNA, 19 nt, Human
uucuuaaauaucuuuuaug

SEQ ID NO: 3463025 - RNA, 13 nt, Human
uucuuaacaaccg

SEQ ID NO: 3463026 - RNA, 14 nt, Human
uucuuaacaaccga

SEQ ID NO: 3463027 - RNA, 23 nt, Human
uucuuaaccagaucauugugaaa

SEQ ID NO: 3463028 - RNA, 18 nt, Human
uucuuaagacauguauca

SEQ ID NO: 3463029 - RNA, 22 nt, Human
uucuuaagaccaccucaaauuu

SEQ ID NO: 3463030 - RNA, 20 nt, Human
uucuuaaucuuuucacaaau

SEQ ID NO: 3463031 - RNA, 22 nt, Human
uucuuaaucuuuucacaaauaa

SEQ ID NO: 3463032 - RNA, 23 nt, Human
uucuuaaucuuuucacaaauaaa

SEQ ID NO: 3463033 - RNA, 14 nt, Human
uucuuaauguacau

SEQ ID NO: 3463034 - RNA, 14 nt, Human
uucuuaauuaauuu

SEQ ID NO: 3463035 - RNA, 21 nt, Human
uucuuaauuauuauaaaaaua

SEQ ID NO: 3463036 - RNA, 15 nt, Human
uucuuacaaacaugu

SEQ ID NO: 3463037 - RNA, 12 nt, Human
uucuuacaagga

SEQ ID NO: 3463038 - RNA, 18 nt, Human
uucuuacacugccuguau

SEQ ID NO: 3463039 - RNA, 13 nt, Human
uucuuacauguuu

SEQ ID NO: 3463040 - RNA, 14 nt, Human
uucuuacauguuuu

SEQ ID NO: 3463041 - RNA, 15 nt, Human
uucuuaccuguaugu

SEQ ID NO: 3463042 - RNA, 15 nt, Human
uucuuacuaaaaagu

SEQ ID NO: 3463043 - RNA, 18 nt, Human
uucuuacuaaaaaguaua

SEQ ID NO: 3463044 - RNA, 15 nt, Human
uucuuacuaaacauu

SEQ ID NO: 3463045 - RNA, 15 nt, Human
uucuuacuccuccuc

SEQ ID NO: 3463046 - RNA, 17 nt, Human
uucuuacuccuccucuu

SEQ ID NO: 3463047 - RNA, 20 nt, Human
uucuuacugauaauuuugcu

SEQ ID NO: 3463048 - RNA, 14 nt, Human
uucuuacugcuugg

SEQ ID NO: 3463049 - RNA, 20 nt, Human
uucuuagaacaguggaaacu

SEQ ID NO: 3463050 - RNA, 21 nt, Human
uucuuagacuacauuuagaga

SEQ ID NO: 3463051 - RNA, 23 nt, Human
uucuuagccuguggcaguaaaga

SEQ ID NO: 3463052 - RNA, 17 nt, Human
uucuuagggaaggauac

SEQ ID NO: 3463053 - RNA, 19 nt, Human
uucuuaggguuaugauuaa

SEQ ID NO: 3463054 - RNA, 15 nt, Human
uucuuaguugcugua

SEQ ID NO: 3463055 - RNA, 23 nt, Human
uucuuaguugcuguaugucucgu

SEQ ID NO: 3463056 - RNA, 14 nt, Human
uucuuauaaauaug

SEQ ID NO: 3463057 - RNA, 15 nt, Human
uucuuauaaauauga

SEQ ID NO: 3463058 - RNA, 22 nt, Human
uucuuauaaauaugaagcucac

SEQ ID NO: 3463059 - RNA, 17 nt, Human
uucuuauaauacucugu

SEQ ID NO: 3463060 - RNA, 14 nt, Human
uucuuauacacauu

SEQ ID NO: 3463061 - RNA, 17 nt, Human
uucuuauacagauaaaa

SEQ ID NO: 3463062 - RNA, 21 nt, Human
uucuuauacagauaaaacaug

SEQ ID NO: 3463063 - RNA, 21 nt, Human
uucuuauacauuugauaaagu

SEQ ID NO: 3463064 - RNA, 16 nt, Human
uucuuauacgcuuuuc

SEQ ID NO: 3463065 - RNA, 17 nt, Human
uucuuauacgcuuuucu

SEQ ID NO: 3463066 - RNA, 20 nt, Human
uucuuauacgcuuuucuuug

SEQ ID NO: 3463067 - RNA, 16 nt, Human
uucuuaucuucugcaa

SEQ ID NO: 3463068 - RNA, 22 nt, Human
uucuuauggaauugauuugcau

SEQ ID NO: 3463069 - RNA, 21 nt, Human
uucuuauguaugugaaaguua

SEQ ID NO: 3463070 - RNA, 19 nt, Human
uucuuaugugacauuaaca

SEQ ID NO: 3463071 - RNA, 17 nt, Human
uucuuauguugcccagu

SEQ ID NO: 3463072 - RNA, 17 nt, Human
uucuuauuccauauuag

SEQ ID NO: 3463073 - RNA, 18 nt, Human
uucuuauuuaaucuuuuc

SEQ ID NO: 3463074 - RNA, 23 nt, Human
uucuuauuuaaugaaagacugua

SEQ ID NO: 3463075 - RNA, 16 nt, Human
uucuuauuucaugaaa

SEQ ID NO: 3463076 - RNA, 17 nt, Human
uucuuauuuuuguacuu

SEQ ID NO: 3463077 - RNA, 14 nt, Human
uucuucaaaaugua

SEQ ID NO: 3463078 - RNA, 19 nt, Human
uucuucaaaauguauauau

SEQ ID NO: 3463079 - RNA, 20 nt, Human
uucuucaaaauguauauauu

SEQ ID NO: 3463080 - RNA, 23 nt, Human
uucuucaaaauguauauauuuag

SEQ ID NO: 3463081 - RNA, 19 nt, Human
uucuucaaauccuuccaaa

SEQ ID NO: 3463082 - RNA, 19 nt, Human
uucuucaacaggagaauuu

SEQ ID NO: 3463083 - RNA, 14 nt, Human
uucuucaacucccu

SEQ ID NO: 3463084 - RNA, 18 nt, Human
uucuucaagaucccauuu

SEQ ID NO: 3463085 - RNA, 21 nt, Human
uucuucacccagcuaaucugu

SEQ ID NO: 3463086 - RNA, 22 nt, Human
uucuucaccuaagucucuguga

SEQ ID NO: 3463087 - RNA, 18 nt, Human
uucuucacucaaauuuug

SEQ ID NO: 3463088 - RNA, 22 nt, Human
uucuucacuguccuccaagcca

SEQ ID NO: 3463089 - RNA, 17 nt, Human
uucuucagaagacacug

SEQ ID NO: 3463090 - RNA, 11 nt, Human
uucuucagaga

SEQ ID NO: 3463091 - RNA, 14 nt, Human
uucuucagagauca

SEQ ID NO: 3463092 - RNA, 18 nt, Human
uucuucagcguaaaaugg

SEQ ID NO: 3463093 - RNA, 19 nt, Human
uucuucagcguaaaauggu

SEQ ID NO: 3463094 - RNA, 14 nt, Human
uucuucaugcaaug

SEQ ID NO: 3463095 - RNA, 18 nt, Human
uucuucaugcaaugacau

SEQ ID NO: 3463096 - RNA, 20 nt, Human
uucuucauucaauacaagug

SEQ ID NO: 3463097 - RNA, 21 nt, Human
uucuucauucaauacaagugu

SEQ ID NO: 3463098 - RNA, 22 nt, Human
uucuucauucuaucaagcccag

SEQ ID NO: 3463099 - RNA, 19 nt, Human
uucuuccaggugcccagcu

SEQ ID NO: 3463100 - RNA, 12 nt, Human
uucuuccaguua

SEQ ID NO: 3463101 - RNA, 16 nt, Human
uucuuccaucccagga

SEQ ID NO: 3463102 - RNA, 17 nt, Human
uucuuccaucccaggac

SEQ ID NO: 3463103 - RNA, 13 nt, Human
uucuuccaucuga

SEQ ID NO: 3463104 - RNA, 21 nt, Human
uucuucccacccccuugcccu

SEQ ID NO: 3463105 - RNA, 13 nt, Human
uucuucccauucu

SEQ ID NO: 3463106 - RNA, 21 nt, Human
uucuuccuauuugccaugggc

SEQ ID NO: 3463107 - RNA, 23 nt, Human
uucuuccucccucccucuuuccc

SEQ ID NO: 3463108 - RNA, 11 nt, Human
uucuuccuggu

SEQ ID NO: 3463109 - RNA, 18 nt, Human
uucuuccuuuacuuuccc

SEQ ID NO: 3463110 - RNA, 13 nt, Human
uucuuccuuucuc

SEQ ID NO: 3463111 - RNA, 21 nt, Human
uucuuccuuuucacugcuguu

SEQ ID NO: 3463112 - RNA, 15 nt, Human
uucuucgggaagaga

SEQ ID NO: 3463113 - RNA, 20 nt, Human
uucuucggggaacuccugga

SEQ ID NO: 3463114 - RNA, 18 nt, Human
uucuucguucuuuuuaag

SEQ ID NO: 3463115 - RNA, 22 nt, Human
uucuucuacaacucauacacuc

SEQ ID NO: 3463116 - RNA, 18 nt, Human
uucuucuauugccucuga

SEQ ID NO: 3463117 - RNA, 18 nt, Human
uucuucuccuauguguaa

SEQ ID NO: 3463118 - RNA, 22 nt, Human
uucuucucugugagaagguuua

SEQ ID NO: 3463119 - RNA, 19 nt, Human
uucuugaaagaauuuuccu

SEQ ID NO: 3463120 - RNA, 16 nt, Human
uucuugaauauaaaaa

SEQ ID NO: 3463121 - RNA, 20 nt, Human
uucuugacaaaaccuaacuu

SEQ ID NO: 3463122 - RNA, 20 nt, Human
uucuugaggggaccaggagu

SEQ ID NO: 3463123 - RNA, 20 nt, Human
uucuugaucaguaguuugca

SEQ ID NO: 3463124 - RNA, 22 nt, Human
uucuugaucaguaguuugcauu

SEQ ID NO: 3463125 - RNA, 19 nt, Human
uucuugauguaaaaucuug

SEQ ID NO: 3463126 - RNA, 15 nt, Human
uucuugcaagcaugc

SEQ ID NO: 3463127 - RNA, 18 nt, Human
uucuugcagucaucagaa

SEQ ID NO: 3463128 - RNA, 19 nt, Human
uucuugcagucaucagaag

SEQ ID NO: 3463129 - RNA, 17 nt, Human
uucuugcauauuuugua

SEQ ID NO: 3463130 - RNA, 12 nt, Human
uucuugcauuga

SEQ ID NO: 3463131 - RNA, 16 nt, Human
uucuugccaaugaggu

SEQ ID NO: 3463132 - RNA, 21 nt, Human
uucuugccuacuaugccagau

SEQ ID NO: 3463133 - RNA, 15 nt, Human
uucuugccucugugc

SEQ ID NO: 3463134 - RNA, 17 nt, Human
uucuugccucugugcug

SEQ ID NO: 3463135 - RNA, 12 nt, Human
uucuugccuuca

SEQ ID NO: 3463136 - RNA, 14 nt, Human
uucuugcugcuaga

SEQ ID NO: 3463137 - RNA, 18 nt, Human
uucuugcugcuagaacuu

SEQ ID NO: 3463138 - RNA, 14 nt, Human
uucuugcugguugu

SEQ ID NO: 3463139 - RNA, 20 nt, Human
uucuugcuuaccuugacugu

SEQ ID NO: 3463140 - RNA, 21 nt, Human
uucuuggacacuuaauucugu

SEQ ID NO: 3463141 - RNA, 22 nt, Human
uucuuggcaaaagccuugugua

SEQ ID NO: 3463142 - RNA, 22 nt, Human
uucuuggcaauaaauuuugaaa

SEQ ID NO: 3463143 - RNA, 14 nt, Human
uucuuggcuuuguu

SEQ ID NO: 3463144 - RNA, 19 nt, Human
uucuuggggcccagugcau

SEQ ID NO: 3463145 - RNA, 20 nt, Human
uucuuggggcccuacaccuu

SEQ ID NO: 3463146 - RNA, 18 nt, Human
uucuugguuuguaaauua

SEQ ID NO: 3463147 - RNA, 21 nt, Human
uugauuaaauucuugcaaagu

SEQ ID NO: 3463148 - RNA, 16 nt, Human
uugauuaacaaauaug

SEQ ID NO: 3463149 - RNA, 17 nt, Human
uugauuaagauuuuaca

SEQ ID NO: 3463150 - RNA, 18 nt, Human
uugauuaagauuuuacaa

SEQ ID NO: 3463151 - RNA, 14 nt, Human
uugauuauuugcau

SEQ ID NO: 3463152 - RNA, 15 nt, Human
uugauuauuugcaug

SEQ ID NO: 3463153 - RNA, 16 nt, Human
uugauuauuugcaugu

SEQ ID NO: 3463154 - RNA, 19 nt, Human
uugauucacauguuuucaa

SEQ ID NO: 3463155 - RNA, 20 nt, Human
uugauucaccuccuaaaaca

SEQ ID NO: 3463156 - RNA, 22 nt, Human
uugauucaccuccuaaaacaac

SEQ ID NO: 3463157 - RNA, 13 nt, Human
uugauucauaaug

SEQ ID NO: 3463158 - RNA, 17 nt, Human
uugauucauaaugacuu

SEQ ID NO: 3463159 - RNA, 12 nt, Human
uugauucuccuu

SEQ ID NO: 3463160 - RNA, 20 nt, Human
uugauucuccuucagcccuc

SEQ ID NO: 3463161 - RNA, 19 nt, Human
uugauugacugcccauuca

SEQ ID NO: 3463162 - RNA, 12 nt, Human
uugauugcuaaa

SEQ ID NO: 3463163 - RNA, 13 nt, Human
uugauugcugugu

SEQ ID NO: 3463164 - RNA, 17 nt, Human
uugauugggaaaacauu

SEQ ID NO: 3463165 - RNA, 16 nt, Human
uugauugggcacauca

SEQ ID NO: 3463166 - RNA, 21 nt, Human
uugauuggggaauuaaaaguc

SEQ ID NO: 3463167 - RNA, 20 nt, Human
uugauuguucgggugugcaa

SEQ ID NO: 3463168 - RNA, 22 nt, Human
uugauuuacagcaaguagauaa

SEQ ID NO: 3463169 - RNA, 20 nt, Human
uugauuuauuaacuuaauaa

SEQ ID NO: 3463170 - RNA, 21 nt, Human
uugauuuauuaacuuaauaau

SEQ ID NO: 3463171 - RNA, 18 nt, Human
uugauuuccguuaaaaua

SEQ ID NO: 3463172 - RNA, 16 nt, Human
uugauuuccuguguca

SEQ ID NO: 3463173 - RNA, 14 nt, Human
uugauuugaagaac

SEQ ID NO: 3463174 - RNA, 13 nt, Human
uugauuugagauu

SEQ ID NO: 3463175 - RNA, 17 nt, Human
uugauuugcauugaaca

SEQ ID NO: 3463176 - RNA, 18 nt, Human
uugauuuuaaaauguaca

SEQ ID NO: 3463177 - RNA, 20 nt, Human
uugauuuuagccuucucugu

SEQ ID NO: 3463178 - RNA, 18 nt, Human
uugauuuuccaucuaaaa

SEQ ID NO: 3463179 - RNA, 22 nt, Human
uugauuuuccaucuaaaaauau

SEQ ID NO: 3463180 - RNA, 16 nt, Human
uugauuuucuguugua

SEQ ID NO: 3463181 - RNA, 16 nt, Human
uugauuuuuacugugu

SEQ ID NO: 3463182 - RNA, 17 nt, Human
uugauuuuuacuguguu

SEQ ID NO: 3463183 - RNA, 21 nt, Human
uugcaaaauuuccaguaccuu

SEQ ID NO: 3463184 - RNA, 14 nt, Human
uugcaaaguacugu

SEQ ID NO: 3463185 - RNA, 21 nt, Human
uugcaaaguaucccuacugua

SEQ ID NO: 3463186 - RNA, 18 nt, Human
uugcaaaguauuguaaau

SEQ ID NO: 3463187 - RNA, 20 nt, Human
uugcaaaguauuguaaauua

SEQ ID NO: 3463188 - RNA, 12 nt, Human
uugcaaauauaa

SEQ ID NO: 3463189 - RNA, 23 nt, Human
uugcaaaugcccuuacacuuacu

SEQ ID NO: 3463190 - RNA, 12 nt, Human
uugcaacaaaau

SEQ ID NO: 3463191 - RNA, 17 nt, Human
uugcaacaaaauacauu

SEQ ID NO: 3463192 - RNA, 11 nt, Human
uugcaacaaca

SEQ ID NO: 3463193 - RNA, 15 nt, Human
uugcaacacacagac

SEQ ID NO: 3463194 - RNA, 14 nt, Human
uugcaaccucgcug

SEQ ID NO: 3463195 - RNA, 22 nt, Human
uugcaacuucaugucaacuucu

SEQ ID NO: 3463196 - RNA, 16 nt, Human
uugcaacuuuguauaa

SEQ ID NO: 3463197 - RNA, 15 nt, Human
uugcaagaugugaau

SEQ ID NO: 3463198 - RNA, 21 nt, Human
uugcaagaugugaauuauuga

SEQ ID NO: 3463199 - RNA, 19 nt, Human
uugcaagcaugcuugugaa

SEQ ID NO: 3463200 - RNA, 16 nt, Human
uugcaaggcaaauguu

SEQ ID NO: 3463201 - RNA, 13 nt, Human
uugcaagggaaaa

SEQ ID NO: 3463202 - RNA, 21 nt, Human
uugcaagggcggccuuuccca

SEQ ID NO: 3463203 - RNA, 22 nt, Human
uugcaaguauguuuuagcaugu

SEQ ID NO: 3463204 - RNA, 15 nt, Human
uugcaauaaugcagu

SEQ ID NO: 3463205 - RNA, 16 nt, Human
uugcaauaaugcagua

SEQ ID NO: 3463206 - RNA, 21 nt, Human
uugcaauaaugcaguauggua

SEQ ID NO: 3463207 - RNA, 15 nt, Human
uugcaauagaaaucc

SEQ ID NO: 3463208 - RNA, 18 nt, Human
uugcaaucccuuaauauc

SEQ ID NO: 3463209 - RNA, 16 nt, Human
uugcaaucuauaauau

SEQ ID NO: 3463210 - RNA, 13 nt, Human
uugcaaugaagga

SEQ ID NO: 3463211 - RNA, 17 nt, Human
uugcaauggcagccuug

SEQ ID NO: 3463212 - RNA, 17 nt, Human
uuauuguuccaagacau

SEQ ID NO: 3463213 - RNA, 18 nt, Human
uuauuguuccaagacauu

SEQ ID NO: 3463214 - RNA, 22 nt, Human
uuauuguuccaagacauuguca

SEQ ID NO: 3463215 - RNA, 23 nt, Human
uuauuguuccaagacauugucaa

SEQ ID NO: 3463216 - RNA, 22 nt, Human
uuauuguuuaaagcaacugucu

SEQ ID NO: 3463217 - RNA, 18 nt, Human
uuauuuaaaagauucauu

SEQ ID NO: 3463218 - RNA, 16 nt, Human
uuauuuaaaauagcaa

SEQ ID NO: 3463219 - RNA, 21 nt, Human
uuauuuaaaauagcaaaagaa

SEQ ID NO: 3463220 - RNA, 14 nt, Human
uuauuuaaaucugu

SEQ ID NO: 3463221 - RNA, 12 nt, Human
uuauuuaaauga

SEQ ID NO: 3463222 - RNA, 13 nt, Human
uuauuuaauaaca

SEQ ID NO: 3463223 - RNA, 14 nt, Human
uuauuuaauaacau

SEQ ID NO: 3463224 - RNA, 15 nt, Human
uuauuuaaugugagu

SEQ ID NO: 3463225 - RNA, 13 nt, Human
uuauuuacauuua

SEQ ID NO: 3463226 - RNA, 17 nt, Human
uuauuuaccccuccccu

SEQ ID NO: 3463227 - RNA, 17 nt, Human
uuauuuacugagcuucu

SEQ ID NO: 3463228 - RNA, 21 nt, Human
uuauuuacugagcuucucugu

SEQ ID NO: 3463229 - RNA, 14 nt, Human
uuauuuagacaaga

SEQ ID NO: 3463230 - RNA, 18 nt, Human
uuauuuagacaagagaug

SEQ ID NO: 3463231 - RNA, 18 nt, Human
uuauuuagacucaucuua

SEQ ID NO: 3463232 - RNA, 17 nt, Human
uuauuuagcaccaggga

SEQ ID NO: 3463233 - RNA, 16 nt, Human
uuauuuaggcuuugua

SEQ ID NO: 3463234 - RNA, 17 nt, Human
uuauuuagggaacugcu

SEQ ID NO: 3463235 - RNA, 21 nt, Human
uuauuuauauggggaauauau

SEQ ID NO: 3463236 - RNA, 14 nt, Human
uuauuuauauguau

SEQ ID NO: 3463237 - RNA, 15 nt, Human
uuauuuauauguaug

SEQ ID NO: 3463238 - RNA, 18 nt, Human
uuauuuaucagugacaga

SEQ ID NO: 3463239 - RNA, 23 nt, Human
uuauuuauccagaaaacugugau

SEQ ID NO: 3463240 - RNA, 14 nt, Human
uuauuuaugccucu

SEQ ID NO: 3463241 - RNA, 15 nt, Human
uuauuuauguauugu

SEQ ID NO: 3463242 - RNA, 15 nt, Human
uuauuuauuaagaug

SEQ ID NO: 3463243 - RNA, 22 nt, Human
uuauuuauucagcuucauuugu

SEQ ID NO: 3463244 - RNA, 12 nt, Human
uuauuuauucug

SEQ ID NO: 3463245 - RNA, 11 nt, Human
uuauuuauuga

SEQ ID NO: 3463246 - RNA, 12 nt, Human
uuauuucaaugu

SEQ ID NO: 3463247 - RNA, 15 nt, Human
uuauuucaauguaau

SEQ ID NO: 3463248 - RNA, 18 nt, Human
uuauuucacaaauaauag

SEQ ID NO: 3463249 - RNA, 14 nt, Human
uuauuucacuugau

SEQ ID NO: 3463250 - RNA, 17 nt, Human
uuauuucagaaauguac

SEQ ID NO: 3463251 - RNA, 19 nt, Human
uuauuucccuacauuaaac

SEQ ID NO: 3463252 - RNA, 17 nt, Human
uuauuuccuaugaugua

SEQ ID NO: 3463253 - RNA, 22 nt, Human
uuauuuccuaugauguauacug

SEQ ID NO: 3463254 - RNA, 19 nt, Human
uuauuucuaggaagaauuu

SEQ ID NO: 3463255 - RNA, 12 nt, Human
uuauuucuccuu

SEQ ID NO: 3463256 - RNA, 21 nt, Human
uuauuucucucaucuguuaca

SEQ ID NO: 3463257 - RNA, 14 nt, Human
uuauuucucugauu

SEQ ID NO: 3463258 - RNA, 12 nt, Human
uuauuucugcau

SEQ ID NO: 3463259 - RNA, 22 nt, Human
uuauuucugcauauguugaaua

SEQ ID NO: 3463260 - RNA, 20 nt, Human
uuauuugaacaaugaaguug

SEQ ID NO: 3463261 - RNA, 18 nt, Human
uuauuugagaagcugcuc

SEQ ID NO: 3463262 - RNA, 19 nt, Human
uuauuugauuauuuaagac

SEQ ID NO: 3463263 - RNA, 20 nt, Human
uuauuugauuauuuaagacu

SEQ ID NO: 3463264 - RNA, 13 nt, Human
uuauuugcaugug

SEQ ID NO: 3463265 - RNA, 14 nt, Human
uuauuugcauguua

SEQ ID NO: 3463266 - RNA, 16 nt, Human
uuauuugcauguuaug

SEQ ID NO: 3463267 - RNA, 18 nt, Human
uuauuuggaaccuuguuu

SEQ ID NO: 3463268 - RNA, 23 nt, Human
uuauuuggaaccuuguuuuggac

SEQ ID NO: 3463269 - RNA, 21 nt, Human
uuauuugggguugcaucagaa

SEQ ID NO: 3463270 - RNA, 12 nt, Human
uuauuuguaaua

SEQ ID NO: 3463271 - RNA, 18 nt, Human
uuauuuguaauagauguu

SEQ ID NO: 3463272 - RNA, 13 nt, Human
uuauuuguacagu

SEQ ID NO: 3463273 - RNA, 18 nt, Human
uuauuuguuauuuucagu

SEQ ID NO: 3463274 - RNA, 19 nt, Human
uuauuuguuuuucauucau

SEQ ID NO: 3463275 - RNA, 13 nt, Human
uuauuuuaaaaga

SEQ ID NO: 3463276 - RNA, 16 nt, Human
uuauuuuaaaauuuca

SEQ ID NO: 3463277 - RNA, 16 nt, Human
uuauuuuaaacaaaau

SEQ ID NO: 3463278 - RNA, 23 nt, Human
uuauuuuaaauuauaaggacugc

SEQ ID NO: 3463279 - RNA, 20 nt, Human
uuauuuuaagcauugugagu

SEQ ID NO: 3463280 - RNA, 16 nt, Human
uuauuuuaaugugaug

SEQ ID NO: 3463281 - RNA, 16 nt, Human
uuauuuuacacagaaa

SEQ ID NO: 3463282 - RNA, 20 nt, Human
uuauuuuacagcucauuaaa

SEQ ID NO: 3463283 - RNA, 12 nt, Human
uuauuuuaugag

SEQ ID NO: 3463284 - RNA, 14 nt, Human
uuauuuuaugagaa

SEQ ID NO: 3463285 - RNA, 16 nt, Human
uuauuuuaugagaaau

SEQ ID NO: 3463286 - RNA, 20 nt, Human
uuauuuuaugagaaauguaa

SEQ ID NO: 3463287 - RNA, 14 nt, Human
uuauuuuauguuua

SEQ ID NO: 3463288 - RNA, 18 nt, Human
uuauuuuauuaugcauga

SEQ ID NO: 3463289 - RNA, 13 nt, Human
uuauuuuauuugu

SEQ ID NO: 3463290 - RNA, 15 nt, Human
uuauuuucacccucu

SEQ ID NO: 3463291 - RNA, 14 nt, Human
uuauuuucauuaca

SEQ ID NO: 3463292 - RNA, 22 nt, Human
uuauuuuccccuaucauuuauu

SEQ ID NO: 3463293 - RNA, 20 nt, Human
uucaagucugugccuggagc

SEQ ID NO: 3463294 - RNA, 21 nt, Human
uucaagucugugccuggagcu

SEQ ID NO: 3463295 - RNA, 17 nt, Human
uucaagugauucucaug

SEQ ID NO: 3463296 - RNA, 22 nt, Human
uucaagugauucucaugccuca

SEQ ID NO: 3463297 - RNA, 13 nt, Human
uucaaguuaaagu

SEQ ID NO: 3463298 - RNA, 17 nt, Human
uucaaguuauuguacag

SEQ ID NO: 3463299 - RNA, 18 nt, Human
uucaaguuuuaaaguuca

SEQ ID NO: 3463300 - RNA, 20 nt, Human
uucaaguuuuggguauguuu

SEQ ID NO: 3463301 - RNA, 22 nt, Human
uucaaguuuuggguauguuuaa

SEQ ID NO: 3463302 - RNA, 21 nt, Human
uucaauaaaaaaaagaaauga

SEQ ID NO: 3463303 - RNA, 13 nt, Human
uucaauaaagcug

SEQ ID NO: 3463304 - RNA, 14 nt, Human
uucaauaaaguauu

SEQ ID NO: 3463305 - RNA, 19 nt, Human
uucaauaaaguuugaucuu

SEQ ID NO: 3463306 - RNA, 19 nt, Human
uucaauaaaucuuuggaaa

SEQ ID NO: 3463307 - RNA, 15 nt, Human
uucaauaagagauua

SEQ ID NO: 3463308 - RNA, 20 nt, Human
uucaauaagcaucaaacucu

SEQ ID NO: 3463309 - RNA, 16 nt, Human
uucaauacagauauau

SEQ ID NO: 3463310 - RNA, 17 nt, Human
uucaauacagauauauu

SEQ ID NO: 3463311 - RNA, 13 nt, Human
uucaauaggaaaa

SEQ ID NO: 3463312 - RNA, 15 nt, Human
uucaauaggaaaaac

SEQ ID NO: 3463313 - RNA, 20 nt, Human
uucaauaggaaaaacugauu

SEQ ID NO: 3463314 - RNA, 18 nt, Human
uucaauaguucaaggaac

SEQ ID NO: 3463315 - RNA, 16 nt, Human
uucaauauugaauuuu

SEQ ID NO: 3463316 - RNA, 19 nt, Human
uucaauauugaauuuuucc

SEQ ID NO: 3463317 - RNA, 15 nt, Human
uucaauauugacauu

SEQ ID NO: 3463318 - RNA, 17 nt, Human
uucaauauugacauuug

SEQ ID NO: 3463319 - RNA, 23 nt, Human
uucaaucucguauagaagucuuc

SEQ ID NO: 3463320 - RNA, 20 nt, Human
uucaaucuggauucauauuu

SEQ ID NO: 3463321 - RNA, 23 nt, Human
uucaaucuggauucauauuuaau

SEQ ID NO: 3463322 - RNA, 16 nt, Human
uucaaucuguaaacug

SEQ ID NO: 3463323 - RNA, 20 nt, Human
uucaaucuucaauccuugaa

SEQ ID NO: 3463324 - RNA, 12 nt, Human
uucaaugaucua

SEQ ID NO: 3463325 - RNA, 19 nt, Human
uucaaugccccugaauuua

SEQ ID NO: 3463326 - RNA, 22 nt, Human
uucaaugugauauaaacagcuu

SEQ ID NO: 3463327 - RNA, 19 nt, Human
uucaauguguauaaauugu

SEQ ID NO: 3463328 - RNA, 15 nt, Human
uucaauguuagccuc

SEQ ID NO: 3463329 - RNA, 14 nt, Human
uucaauuaaacgga

SEQ ID NO: 3463330 - RNA, 19 nt, Human
uucaauuaaacggauuauu

SEQ ID NO: 3463331 - RNA, 15 nt, Human
uucaauuaaagaaau

SEQ ID NO: 3463332 - RNA, 16 nt, Human
uucaauuccucuggga

SEQ ID NO: 3463333 - RNA, 13 nt, Human
uucaauuccuggg

SEQ ID NO: 3463334 - RNA, 16 nt, Human
uucaauuccugggccc

SEQ ID NO: 3463335 - RNA, 19 nt, Human
uucaauugcaucucccaga

SEQ ID NO: 3463336 - RNA, 14 nt, Human
uucaauugucacuu

SEQ ID NO: 3463337 - RNA, 19 nt, Human
uucaauuuauucaagaaaa

SEQ ID NO: 3463338 - RNA, 17 nt, Human
uucaauuuauugcacaa

SEQ ID NO: 3463339 - RNA, 19 nt, Human
uucaauuuccaagagcuga

SEQ ID NO: 3463340 - RNA, 16 nt, Human
uucaauuugauguggu

SEQ ID NO: 3463341 - RNA, 19 nt, Human
uucaauuuguucagucuuu

SEQ ID NO: 3463342 - RNA, 17 nt, Human
uucaauuuuaaacauau

SEQ ID NO: 3463343 - RNA, 15 nt, Human
uucaauuuuaaagac

SEQ ID NO: 3463344 - RNA, 16 nt, Human
uucacaaacuuuuaua

SEQ ID NO: 3463345 - RNA, 17 nt, Human
uucacaaacuuuuauac

SEQ ID NO: 3463346 - RNA, 22 nt, Human
uucacaaacuuuuauacucuuu

SEQ ID NO: 3463347 - RNA, 11 nt, Human
uucacaaauaa

SEQ ID NO: 3463348 - RNA, 18 nt, Human
uucacaagcugccucccu

SEQ ID NO: 3463349 - RNA, 19 nt, Human
uucacaagcugccucccug

SEQ ID NO: 3463350 - RNA, 20 nt, Human
uucacaaugaaaugcucucc

SEQ ID NO: 3463351 - RNA, 16 nt, Human
uucacaaugucaguau

SEQ ID NO: 3463352 - RNA, 16 nt, Human
uucacaauuauuccaa

SEQ ID NO: 3463353 - RNA, 21 nt, Human
uucacacacaggcaacugagg

SEQ ID NO: 3463354 - RNA, 14 nt, Human
uucacaccugacuc

SEQ ID NO: 3463355 - RNA, 21 nt, Human
uucacaccugacucugaaauc

SEQ ID NO: 3463356 - RNA, 20 nt, Human
uucacagaugggugcuugga

SEQ ID NO: 3463357 - RNA, 19 nt, Human
uucacagccuauaaccaga

SEQ ID NO: 3463358 - RNA, 15 nt, Human
uucacagcuccuccc

SEQ ID NO: 3463359 - RNA, 13 nt, Human
uucacaggcagcc

SEQ ID NO: 3463360 - RNA, 17 nt, Human
uucacaguagagccagc

SEQ ID NO: 3463361 - RNA, 15 nt, Human
uucacagugcucuuu

SEQ ID NO: 3463362 - RNA, 22 nt, Human
uucacaguguuucgacagcuga

SEQ ID NO: 3463363 - RNA, 20 nt, Human
uucacaguucuuugggccag

SEQ ID NO: 3463364 - RNA, 14 nt, Human
uucacaguuugaaa

SEQ ID NO: 3463365 - RNA, 17 nt, Human
uucacaguuugaaauaa

SEQ ID NO: 3463366 - RNA, 20 nt, Human
uucacauaagcucagaaucc

SEQ ID NO: 3463367 - RNA, 17 nt, Human
uucacauagagaucauc

SEQ ID NO: 3463368 - RNA, 17 nt, Human
uucacauagaugucccu

SEQ ID NO: 3463369 - RNA, 20 nt, Human
uucacauaucuaguaugaaa

SEQ ID NO: 3463370 - RNA, 18 nt, Human
uucacaucuaaccucauc

SEQ ID NO: 3463371 - RNA, 13 nt, Human
uucacaugaacau

SEQ ID NO: 3463372 - RNA, 18 nt, Human
uucacauguuuucaaaug

SEQ ID NO: 3463373 - RNA, 19 nt, Human
uucacauguuuucaaaugg

SEQ ID NO: 3463374 - RNA, 17 nt, Human
uucacauuaaaaaauga

SEQ ID NO: 3463375 - RNA, 22 nt, Human
uucacauuaauauuugcugaca

SEQ ID NO: 3463376 - RNA, 16 nt, Human
uucacauuagaagaca

SEQ ID NO: 3463377 - RNA, 16 nt, Human
uucacauucuuauaaa

SEQ ID NO: 3463378 - RNA, 22 nt, Human
uaggagaauugcuugaaccugg

SEQ ID NO: 3463379 - RNA, 19 nt, Human
uaggagacacauccagcaa

SEQ ID NO: 3463380 - RNA, 14 nt, Human
uaggagaccaaggc

SEQ ID NO: 3463381 - RNA, 21 nt, Human
uaggagaccaaggcgggagca

SEQ ID NO: 3463382 - RNA, 23 nt, Human
uaggagacuugccagagccgggc

SEQ ID NO: 3463383 - RNA, 16 nt, Human
uaggagauaccagguu

SEQ ID NO: 3463384 - RNA, 14 nt, Human
uaggagcagagcuc

SEQ ID NO: 3463385 - RNA, 13 nt, Human
uaggagcuaaggc

SEQ ID NO: 3463386 - RNA, 17 nt, Human
uaggagcuaaggcucua

SEQ ID NO: 3463387 - RNA, 16 nt, Human
uaggagggaaaccuuu

SEQ ID NO: 3463388 - RNA, 12 nt, Human
uaggagggacug

SEQ ID NO: 3463389 - RNA, 23 nt, Human
uaggagggacugucgcugcuucg

SEQ ID NO: 3463390 - RNA, 14 nt, Human
uaggagggagacac

SEQ ID NO: 3463391 - RNA, 18 nt, Human
uaggagggaguuaucuaa

SEQ ID NO: 3463392 - RNA, 18 nt, Human
uaggagugugugacauuc

SEQ ID NO: 3463393 - RNA, 23 nt, Human
uaggaguucacuucaucuucuca

SEQ ID NO: 3463394 - RNA, 17 nt, Human
uaggaguucgagaccag

SEQ ID NO: 3463395 - RNA, 23 nt, Human
uaggaguuuagggaacaauuugg

SEQ ID NO: 3463396 - RNA, 20 nt, Human
uaggauaaaaagccagggcu

SEQ ID NO: 3463397 - RNA, 22 nt, Human
uaggauaaaaagccagggcugg

SEQ ID NO: 3463398 - RNA, 21 nt, Human
uaggauagcuaacuguaaauc

SEQ ID NO: 3463399 - RNA, 17 nt, Human
uaggauaugccugcucu

SEQ ID NO: 3463400 - RNA, 19 nt, Human
uaggaucagcccucauuuu

SEQ ID NO: 3463401 - RNA, 18 nt, Human
uaggaugaaaagauucuu

SEQ ID NO: 3463402 - RNA, 17 nt, Human
uaggaugggcuucugug

SEQ ID NO: 3463403 - RNA, 22 nt, Human
uaggauucacaccccaccugcg

SEQ ID NO: 3463404 - RNA, 12 nt, Human
uaggauuuaaca

SEQ ID NO: 3463405 - RNA, 17 nt, Human
uaggauuuauuuaaaau

SEQ ID NO: 3463406 - RNA, 22 nt, Human
uaggauuuauuuaaaauagcaa

SEQ ID NO: 3463407 - RNA, 22 nt, Human
uaggauuuucacauucuuggcu

SEQ ID NO: 3463408 - RNA, 13 nt, Human
uaggauuuuuaga

SEQ ID NO: 3463409 - RNA, 21 nt, Human
uaggauuuuuuuuaauguuua

SEQ ID NO: 3463410 - RNA, 18 nt, Human
uaggcaaccuuuauuuuu

SEQ ID NO: 3463411 - RNA, 17 nt, Human
uaggcaagauggcacag

SEQ ID NO: 3463412 - RNA, 17 nt, Human
uaggcaaguuuucccug

SEQ ID NO: 3463413 - RNA, 21 nt, Human
uaggcaccuaccaccacgccc

SEQ ID NO: 3463414 - RNA, 17 nt, Human
uaggcaccuuuuacugu

SEQ ID NO: 3463415 - RNA, 18 nt, Human
uaggcaccuuuuacugug

SEQ ID NO: 3463416 - RNA, 12 nt, Human
uaggcagacaca

SEQ ID NO: 3463417 - RNA, 16 nt, Human
uaggcaggacaugcug

SEQ ID NO: 3463418 - RNA, 19 nt, Human
uaggcagggauuugaggag

SEQ ID NO: 3463419 - RNA, 17 nt, Human
uaggcagggugucugcc

SEQ ID NO: 3463420 - RNA, 20 nt, Human
uaggcagggugucugccccc

SEQ ID NO: 3463421 - RNA, 19 nt, Human
uaggcaguauaaagaauag

SEQ ID NO: 3463422 - RNA, 18 nt, Human
uaggcaguuagagaugcc

SEQ ID NO: 3463423 - RNA, 22 nt, Human
uaggcaguuagagaugccuccc

SEQ ID NO: 3463424 - RNA, 14 nt, Human
uaggcaucccaggg

SEQ ID NO: 3463425 - RNA, 14 nt, Human
uaggcauuguggga

SEQ ID NO: 3463426 - RNA, 20 nt, Human
uaggcauuugcugaauacag

SEQ ID NO: 3463427 - RNA, 12 nt, Human
uaggcauuugua

SEQ ID NO: 3463428 - RNA, 18 nt, Human
uaggccaagguguccuac

SEQ ID NO: 3463429 - RNA, 18 nt, Human
uaggccaaucagaagcua

SEQ ID NO: 3463430 - RNA, 23 nt, Human
uaggccagcaagcggggaugucc

SEQ ID NO: 3463431 - RNA, 13 nt, Human
uaggccaugggac

SEQ ID NO: 3463432 - RNA, 15 nt, Human
uaggcccacacacag

SEQ ID NO: 3463433 - RNA, 14 nt, Human
uaggcccuuucagu

SEQ ID NO: 3463434 - RNA, 15 nt, Human
uaggcccuuucagug

SEQ ID NO: 3463435 - RNA, 20 nt, Human
uaggccucaacuccucccau

SEQ ID NO: 3463436 - RNA, 19 nt, Human
uaggccucaggugaaacuc

SEQ ID NO: 3463437 - RNA, 22 nt, Human
uucauauugugccaauauguau

SEQ ID NO: 3463438 - RNA, 23 nt, Human
uucauauuguugcauugcuuuuu

SEQ ID NO: 3463439 - RNA, 13 nt, Human
uucauauuuaauu

SEQ ID NO: 3463440 - RNA, 21 nt, Human
uucauauuuacuucuuauaca

SEQ ID NO: 3463441 - RNA, 14 nt, Human
uucauauuugcacu

SEQ ID NO: 3463442 - RNA, 14 nt, Human
uucaucaagacugg

SEQ ID NO: 3463443 - RNA, 16 nt, Human
uucaucaguguuaaaa

SEQ ID NO: 3463444 - RNA, 19 nt, Human
uucaucauauuauacagac

SEQ ID NO: 3463445 - RNA, 19 nt, Human
uucaucauucacuucacug

SEQ ID NO: 3463446 - RNA, 23 nt, Human
uucaucauuguuucugcaugaau

SEQ ID NO: 3463447 - RNA, 20 nt, Human
uucauccaacuuauguuuuu

SEQ ID NO: 3463448 - RNA, 17 nt, Human
uucauccaaguuaaaug

SEQ ID NO: 3463449 - RNA, 20 nt, Human
uucauccaaguuaaauguag

SEQ ID NO: 3463450 - RNA, 16 nt, Human
uucauccaauccucac

SEQ ID NO: 3463451 - RNA, 23 nt, Human
uucauccacucugccugcuuaca

SEQ ID NO: 3463452 - RNA, 21 nt, Human
uucauccaggcccaacuguga

SEQ ID NO: 3463453 - RNA, 17 nt, Human
uucauccauaacugaac

SEQ ID NO: 3463454 - RNA, 21 nt, Human
uucaucccaugauguagugcc

SEQ ID NO: 3463455 - RNA, 14 nt, Human
uucaucccauucca

SEQ ID NO: 3463456 - RNA, 15 nt, Human
uucaucccauuccag

SEQ ID NO: 3463457 - RNA, 21 nt, Human
uucaucccucuggggcuguuc

SEQ ID NO: 3463458 - RNA, 19 nt, Human
uucauccuccucagaucuu

SEQ ID NO: 3463459 - RNA, 15 nt, Human
uucauccuuucacuu

SEQ ID NO: 3463460 - RNA, 16 nt, Human
uucaucuauuucugag

SEQ ID NO: 3463461 - RNA, 13 nt, Human
uucaucucauuua

SEQ ID NO: 3463462 - RNA, 23 nt, Human
uucaucucuagggaccagaacca

SEQ ID NO: 3463463 - RNA, 17 nt, Human
uucaucugacuaugaca

SEQ ID NO: 3463464 - RNA, 20 nt, Human
uucaucugacuaugacauaa

SEQ ID NO: 3463465 - RNA, 20 nt, Human
uucaucugagagaggcuaaa

SEQ ID NO: 3463466 - RNA, 13 nt, Human
uucaucugcucuc

SEQ ID NO: 3463467 - RNA, 19 nt, Human
uucaucuguaacucuaaaa

SEQ ID NO: 3463468 - RNA, 23 nt, Human
uucaucuguaacucuaaaagauc

SEQ ID NO: 3463469 - RNA, 14 nt, Human
uucaucuuccugug

SEQ ID NO: 3463470 - RNA, 17 nt, Human
uucaucuuccugugucc

SEQ ID NO: 3463471 - RNA, 20 nt, Human
uucaucuuccuguguccuga

SEQ ID NO: 3463472 - RNA, 11 nt, Human
uucaucuugaa

SEQ ID NO: 3463473 - RNA, 21 nt, Human
uucaucuugaauuguaaggaa

SEQ ID NO: 3463474 - RNA, 22 nt, Human
uucaucuuggucacauacaauu

SEQ ID NO: 3463475 - RNA, 15 nt, Human
uucaugaaaauacca

SEQ ID NO: 3463476 - RNA, 17 nt, Human
uucaugaaaauaccauu

SEQ ID NO: 3463477 - RNA, 20 nt, Human
uucaugaaaugcuaugucau

SEQ ID NO: 3463478 - RNA, 22 nt, Human
uucaugaacuucgcaucaaaag

SEQ ID NO: 3463479 - RNA, 13 nt, Human
uucaugaugcagu

SEQ ID NO: 3463480 - RNA, 15 nt, Human
uucaugauuagaaau

SEQ ID NO: 3463481 - RNA, 20 nt, Human
uucaugcaaggggaaaaucu

SEQ ID NO: 3463482 - RNA, 14 nt, Human
uucaugcaaugaca

SEQ ID NO: 3463483 - RNA, 15 nt, Human
uucaugcaaugacau

SEQ ID NO: 3463484 - RNA, 21 nt, Human
uucaugcaaugacaucuucaa

SEQ ID NO: 3463485 - RNA, 17 nt, Human
uucaugcacuuaaagaa

SEQ ID NO: 3463486 - RNA, 15 nt, Human
uucaugcagcugugg

SEQ ID NO: 3463487 - RNA, 19 nt, Human
uucaugccaccauggccag

SEQ ID NO: 3463488 - RNA, 22 nt, Human
uucaugccaccauggccagcca

SEQ ID NO: 3463489 - RNA, 21 nt, Human
uucaugccagcuacuuccucc

SEQ ID NO: 3463490 - RNA, 15 nt, Human
uucaugccuuuguaa

SEQ ID NO: 3463491 - RNA, 17 nt, Human
uucaugcucagcccuga

SEQ ID NO: 3463492 - RNA, 22 nt, Human
uucaugcuguucaugaaagauu

SEQ ID NO: 3463493 - RNA, 20 nt, Human
uucauggaauggacauccug

SEQ ID NO: 3463494 - RNA, 22 nt, Human
uucauggaauggacauccugua

SEQ ID NO: 3463495 - RNA, 19 nt, Human
uucauggcugcuguugcuu

SEQ ID NO: 3463496 - RNA, 19 nt, Human
uucauggugaaaauguacu

SEQ ID NO: 3463497 - RNA, 19 nt, Human
uucauguaaacaaaauuua

SEQ ID NO: 3463498 - RNA, 13 nt, Human
uucauguaauuuu

SEQ ID NO: 3463499 - RNA, 22 nt, Human
uucaugucaacuucuggcuccu

SEQ ID NO: 3463500 - RNA, 16 nt, Human
uucaugucccagaacu

SEQ ID NO: 3463501 - RNA, 17 nt, Human
uucauguccugugucag

SEQ ID NO: 3463502 - RNA, 23 nt, Human
uucauguccugugucaguuuaug

SEQ ID NO: 3463503 - RNA, 20 nt, Human
uucaugugggaucccaucuu

SEQ ID NO: 3463504 - RNA, 18 nt, Human
uucauguuaguuaccuua

SEQ ID NO: 3463505 - RNA, 22 nt, Human
uucauguugcacacccacucag

SEQ ID NO: 3463506 - RNA, 14 nt, Human
uucauguuugcuuc

SEQ ID NO: 3463507 - RNA, 18 nt, Human
uucauguuuuaacaaaaa

SEQ ID NO: 3463508 - RNA, 13 nt, Human
uucauuaaagcau

SEQ ID NO: 3463509 - RNA, 20 nt, Human
uucauuagaaauauuuuaaa

SEQ ID NO: 3463510 - RNA, 13 nt, Human
uucauuagagcag

SEQ ID NO: 3463511 - RNA, 22 nt, Human
uucauuagcaaaaaaaguugua

SEQ ID NO: 3463512 - RNA, 19 nt, Human
uucauuaguuuugaagauu

SEQ ID NO: 3463513 - RNA, 18 nt, Human
uucauuauuggaauuaac

SEQ ID NO: 3463514 - RNA, 21 nt, Human
uucauucaauauugacauuug

SEQ ID NO: 3463515 - RNA, 9 nt, Human
uucauucag

SEQ ID NO: 3463516 - RNA, 17 nt, Human
uucauucauacuuaaaa

SEQ ID NO: 3463517 - RNA, 14 nt, Human
uucauucauauuac

SEQ ID NO: 3463518 - RNA, 23 nt, Human
uucauucauggaccacuguuucu

SEQ ID NO: 3463519 - RNA, 15 nt, Human
uucauuccauugccu

SEQ ID NO: 3463520 - RNA, 18 nt, Human
uucauuccuaacacagca

SEQ ID NO: 3463521 - RNA, 12 nt, Human
uucauuccucca

SEQ ID NO: 3463522 - RNA, 18 nt, Human
uucauucucauaauuccu

SEQ ID NO: 3463523 - RNA, 15 nt, Human
uucauucuccugccu

SEQ ID NO: 3463524 - RNA, 14 nt, Human
uucauucugcauug

SEQ ID NO: 3463525 - RNA, 19 nt, Human
uucauucuuuuugaaaugu

SEQ ID NO: 3463526 - RNA, 16 nt, Human
uucauugacuaucaaa

SEQ ID NO: 3463527 - RNA, 16 nt, Human
uucauugcaauuaaac

SEQ ID NO: 3463528 - RNA, 15 nt, Human
uucauugccaguguc

SEQ ID NO: 3463529 - RNA, 22 nt, Human
uucauuggucuaauuuauucaa

SEQ ID NO: 3463530 - RNA, 17 nt, Human
uucauugguuaauuuuu

SEQ ID NO: 3463531 - RNA, 18 nt, Human
uucauuguaauguuacug

SEQ ID NO: 3463532 - RNA, 20 nt, Human
uucauuguaauguuacugau

SEQ ID NO: 3463533 - RNA, 13 nt, Human
uucauuguauaaa

SEQ ID NO: 3463534 - RNA, 17 nt, Human
uucauuguauaaaaaua

SEQ ID NO: 3463535 - RNA, 12 nt, Human
uucauugucucu

SEQ ID NO: 3463536 - RNA, 17 nt, Human
uucauugugguuauuuu

SEQ ID NO: 3463537 - RNA, 24 nt, Human
uucauugugguuauuuuuauacag

SEQ ID NO: 3463538 - RNA, 21 nt, Human
uucauuguuuuuaacuuugcu

SEQ ID NO: 3463539 - RNA, 17 nt, Human
uucauuuaaaaugauua

SEQ ID NO: 3463540 - RNA, 13 nt, Human
uucauuuacugug

SEQ ID NO: 3463541 - RNA, 16 nt, Human
uucauuucauccuuuc

SEQ ID NO: 3463542 - RNA, 16 nt, Human
uucauuuccucaaaaa

SEQ ID NO: 3463543 - RNA, 16 nt, Human
uucauuuccuccguca

SEQ ID NO: 3463544 - RNA, 15 nt, Human
uucauuuccuguguc

SEQ ID NO: 3463545 - RNA, 15 nt, Human
uucauuucuaauuaa

SEQ ID NO: 3463546 - RNA, 19 nt, Human
uucauuucugauauagaau

SEQ ID NO: 3463547 - RNA, 20 nt, Human
uucauuugaguuauuuuaau

SEQ ID NO: 3463548 - RNA, 16 nt, Human
uucauuugaugcuaaa

SEQ ID NO: 3463549 - RNA, 13 nt, Human
uucauuugcuauc

SEQ ID NO: 3463550 - RNA, 17 nt, Human
uucauuuguaugucaaa

SEQ ID NO: 3463551 - RNA, 23 nt, Human
uucauuuguggugauauagaauu

SEQ ID NO: 3463552 - RNA, 16 nt, Human
uucauuuguuauucuu

SEQ ID NO: 3463553 - RNA, 19 nt, Human
uucauuuuacaguuacuuu

SEQ ID NO: 3463554 - RNA, 22 nt, Human
uucauuuuauauugaaaaaaau

SEQ ID NO: 3463555 - RNA, 15 nt, Human
uucauuuuaugaaga

SEQ ID NO: 3463556 - RNA, 14 nt, Human
uucauuuuccaaua

SEQ ID NO: 3463557 - RNA, 19 nt, Human
uucauuuucuagauacaau

SEQ ID NO: 3463558 - RNA, 21 nt, Human
uucauuuucuagauacaauaa

SEQ ID NO: 3463559 - RNA, 13 nt, Human
uucauuuucucua

SEQ ID NO: 3463560 - RNA, 14 nt, Human
uucauuuucugcaa

SEQ ID NO: 3463561 - RNA, 18 nt, Human
uucauuuucugcaagccu

SEQ ID NO: 3463562 - RNA, 17 nt, Human
uucauuuugaaaaacac

SEQ ID NO: 3463563 - RNA, 15 nt, Human
uucauuuugcuuuaa

SEQ ID NO: 3463564 - RNA, 22 nt, Human
uucauuuuugaaacugcauuug

SEQ ID NO: 3463565 - RNA, 23 nt, Human
uucauuuuugauagcugucccau

SEQ ID NO: 3463566 - RNA, 14 nt, Human
uucauuuuuuucca

SEQ ID NO: 3463567 - RNA, 15 nt, Human
uuccaaaaaaauacu

SEQ ID NO: 3463568 - RNA, 21 nt, Human
uuccaaaaagauuuucagaaa

SEQ ID NO: 3463569 - RNA, 15 nt, Human
uuccaaaaauuauua

SEQ ID NO: 3463570 - RNA, 15 nt, Human
uuccaaaagccaaug

SEQ ID NO: 3463571 - RNA, 16 nt, Human
uuccaaaaguggccuc

SEQ ID NO: 3463572 - RNA, 21 nt, Human
uuccaaaaguggccucuuugu

SEQ ID NO: 3463573 - RNA, 12 nt, Human
uuccaaaauaau

SEQ ID NO: 3463574 - RNA, 13 nt, Human
uuccaaaauaauu

SEQ ID NO: 3463575 - RNA, 20 nt, Human
uuccaaacucuucccucucu

SEQ ID NO: 3463576 - RNA, 12 nt, Human
uuccaaagaaag

SEQ ID NO: 3463577 - RNA, 21 nt, Human
uaguuuguuuaaugugaacuu

SEQ ID NO: 3463578 - RNA, 23 nt, Human
uaguuuuaaaaaaauaaaacauu

SEQ ID NO: 3463579 - RNA, 14 nt, Human
uaguuuuaguuuuc

SEQ ID NO: 3463580 - RNA, 14 nt, Human
uaguuuuauuuaua

SEQ ID NO: 3463581 - RNA, 15 nt, Human
uuccagugcaacacu

SEQ ID NO: 3463582 - RNA, 19 nt, Human
uuccagugcaacacugaag

SEQ ID NO: 3463583 - RNA, 18 nt, Human
uuccaguggaucauaaga

SEQ ID NO: 3463584 - RNA, 18 nt, Human
uuccaguguccuuagaac

SEQ ID NO: 3463585 - RNA, 22 nt, Human
uuccagugucuauaaaagaaac

SEQ ID NO: 3463586 - RNA, 13 nt, Human
uuccaguguucua

SEQ ID NO: 3463587 - RNA, 17 nt, Human
uuccaguuacuuuccaa

SEQ ID NO: 3463588 - RNA, 15 nt, Human
uuccauaaacaccca

SEQ ID NO: 3463589 - RNA, 22 nt, Human
uuccauaaagaagauguuuaac

SEQ ID NO: 3463590 - RNA, 23 nt, Human
uuccauaaucuggacuccucugu

SEQ ID NO: 3463591 - RNA, 19 nt, Human
uuccauaauguauaaagaa

SEQ ID NO: 3463592 - RNA, 17 nt, Human
uugucauuagccugagu

SEQ ID NO: 3463593 - RNA, 13 nt, Human
uugucauuuugaa

SEQ ID NO: 3463594 - RNA, 15 nt, Human
uugucauuuugaagc

SEQ ID NO: 3463595 - RNA, 14 nt, Human
uugucauuuugguc

SEQ ID NO: 3463596 - RNA, 21 nt, Human
uuguccaaaguuaccuggaau

SEQ ID NO: 3463597 - RNA, 21 nt, Human
uuguccaacccgaggcccgca

SEQ ID NO: 3463598 - RNA, 21 nt, Human
uuguccaauuguauaacuuug

SEQ ID NO: 3463599 - RNA, 22 nt, Human
uuguccaauuguugacaguucu

SEQ ID NO: 3463600 - RNA, 16 nt, Human
uuguccagagcugcuu

SEQ ID NO: 3463601 - RNA, 18 nt, Human
uuguccagagcugcuucc

SEQ ID NO: 3463602 - RNA, 15 nt, Human
uuguccauuuguaaa

SEQ ID NO: 3463603 - RNA, 19 nt, Human
uugucccacuaucugggug

SEQ ID NO: 3463604 - RNA, 12 nt, Human
uuguccccacac

SEQ ID NO: 3463605 - RNA, 18 nt, Human
uuguccccaccgcagaca

SEQ ID NO: 3463606 - RNA, 20 nt, Human
uuguccccaccgcagacagg

SEQ ID NO: 3463607 - RNA, 15 nt, Human
uuguccccgacccuu

SEQ ID NO: 3463608 - RNA, 14 nt, Human
uuguccccucuuga

SEQ ID NO: 3463609 - RNA, 21 nt, Human
uuguccccugccugugccugc

SEQ ID NO: 3463610 - RNA, 18 nt, Human
uugucccgauuguaacuc

SEQ ID NO: 3463611 - RNA, 16 nt, Human
uugucccucugcuacg

SEQ ID NO: 3463612 - RNA, 18 nt, Human
uugucccugaagagaagg

SEQ ID NO: 3463613 - RNA, 18 nt, Human
uugucccuggcuuccuua

SEQ ID NO: 3463614 - RNA, 19 nt, Human
uugucccuggcuuccuuac

SEQ ID NO: 3463615 - RNA, 21 nt, Human
uuguccgguggaaggccuucu

SEQ ID NO: 3463616 - RNA, 15 nt, Human
uuguccgguuuacuu

SEQ ID NO: 3463617 - RNA, 15 nt, Human
uuguccuagcacaga

SEQ ID NO: 3463618 - RNA, 23 nt, Human
uuguccuagcacagauggccagc

SEQ ID NO: 3463619 - RNA, 17 nt, Human
uuguccuauuaguguua

SEQ ID NO: 3463620 - RNA, 15 nt, Human
uuguccucauuucuc

SEQ ID NO: 3463621 - RNA, 13 nt, Human
uuguccuccccuu

SEQ ID NO: 3463622 - RNA, 15 nt, Human
uuguccuccugcugc

SEQ ID NO: 3463623 - RNA, 19 nt, Human
uuguccuccugcugccagu

SEQ ID NO: 3463624 - RNA, 19 nt, Human
uuguccugaugcuuuuguc

SEQ ID NO: 3463625 - RNA, 20 nt, Human
uuguccugccugcaauauuu

SEQ ID NO: 3463626 - RNA, 17 nt, Human
uuguccuuucccuucag

SEQ ID NO: 3463627 - RNA, 16 nt, Human
uuguccuuuugucuuc

SEQ ID NO: 3463628 - RNA, 17 nt, Human
uuguccuuuugucuucu

SEQ ID NO: 3463629 - RNA, 18 nt, Human
uuguccuuuuucaggaga

SEQ ID NO: 3463630 - RNA, 22 nt, Human
uugucgaaaagagucuuccaau

SEQ ID NO: 3463631 - RNA, 17 nt, Human
uugucuaagaaacauug

SEQ ID NO: 3463632 - RNA, 20 nt, Human
uugucuaagaaacauuggaa

SEQ ID NO: 3463633 - RNA, 15 nt, Human
uugucuauaaagcau

SEQ ID NO: 3463634 - RNA, 14 nt, Human
uugucuaugggacu

SEQ ID NO: 3463635 - RNA, 11 nt, Human
uugucuauuuu

SEQ ID NO: 3463636 - RNA, 17 nt, Human
uugucuauuuuugucuu

SEQ ID NO: 3463637 - RNA, 11 nt, Human
uugucucagaa

SEQ ID NO: 3463638 - RNA, 13 nt, Human
uugucucagagca

SEQ ID NO: 3463639 - RNA, 11 nt, Human
uugucucagau

SEQ ID NO: 3463640 - RNA, 13 nt, Human
uugucucagauuu

SEQ ID NO: 3463641 - RNA, 20 nt, Human
uugucucagauuuuauuaug

SEQ ID NO: 3463642 - RNA, 15 nt, Human
uugucucaguuggaa

SEQ ID NO: 3463643 - RNA, 12 nt, Human
uugucucccugg

SEQ ID NO: 3463644 - RNA, 17 nt, Human
uugucuccuacuccuga

SEQ ID NO: 3463645 - RNA, 18 nt, Human
uugucuccuacuccugac

SEQ ID NO: 3463646 - RNA, 16 nt, Human
uugucucuccuuuucu

SEQ ID NO: 3463647 - RNA, 14 nt, Human
uugucucugaugca

SEQ ID NO: 3463648 - RNA, 21 nt, Human
uugucucugaugcagcuuaua

SEQ ID NO: 3463649 - RNA, 15 nt, Human
uugucucuucuccuu

SEQ ID NO: 3463650 - RNA, 18 nt, Human
uugucugaagucacugca

SEQ ID NO: 3463651 - RNA, 15 nt, Human
uugucuggaagaaag

SEQ ID NO: 3463652 - RNA, 13 nt, Human
uugucuguaaauc

SEQ ID NO: 3463653 - RNA, 19 nt, Human
uugucugugcauccggggg

SEQ ID NO: 3463654 - RNA, 13 nt, Human
uugucuuaaauaa

SEQ ID NO: 3463655 - RNA, 17 nt, Human
uugucuuaauauugugg

SEQ ID NO: 3463656 - RNA, 17 nt, Human
uugucuuaauggaugaa

SEQ ID NO: 3463657 - RNA, 19 nt, Human
uugucuuaauggaugaaau

SEQ ID NO: 3463658 - RNA, 13 nt, Human
uugucuuauauau

SEQ ID NO: 3463659 - RNA, 19 nt, Human
uugucuuuauaugaacaua

SEQ ID NO: 3463660 - RNA, 13 nt, Human
uugucuuucagga

SEQ ID NO: 3463661 - RNA, 15 nt, Human
uugucuuuggacccu

SEQ ID NO: 3463662 - RNA, 24 nt, Human
uugucuuuggacccugaggcccag

SEQ ID NO: 3463663 - RNA, 23 nt, Human
uugucuuuguaaugucaccaccu

SEQ ID NO: 3463664 - RNA, 20 nt, Human
uugucuuuguucuucuacca

SEQ ID NO: 3463665 - RNA, 19 nt, Human
uugucuuuuaaugcuucau

SEQ ID NO: 3463666 - RNA, 19 nt, Human
uugucuuuuuagaugccca

SEQ ID NO: 3463667 - RNA, 20 nt, Human
uugugaaaaaauuuacuuua

SEQ ID NO: 3463668 - RNA, 16 nt, Human
uugugaaacacagcug

SEQ ID NO: 3463669 - RNA, 19 nt, Human
uugugaaagaggucccaag

SEQ ID NO: 3463670 - RNA, 20 nt, Human
uugugaaaguuuugaguaga

SEQ ID NO: 3463671 - RNA, 14 nt, Human
uugugaaaugaugg

SEQ ID NO: 3463672 - RNA, 23 nt, Human
uugugaaccauggugaagugcuu

SEQ ID NO: 3463673 - RNA, 22 nt, Human
uugugaacucagccaagcacag

SEQ ID NO: 3463674 - RNA, 17 nt, Human
uugugaacuuuuuguag

SEQ ID NO: 3463675 - RNA, 19 nt, Human
uugugaagaaaaauaaagu

SEQ ID NO: 3463676 - RNA, 18 nt, Human
uugugaagcaaaauuuuu

SEQ ID NO: 3463677 - RNA, 13 nt, Human
uugugaagcccug

SEQ ID NO: 3463678 - RNA, 14 nt, Human
uugugaagcccugu

SEQ ID NO: 3463679 - RNA, 16 nt, Human
uugugaauaaugauuu

SEQ ID NO: 3463680 - RNA, 20 nt, Human
uugugaaucaagggucaggc

SEQ ID NO: 3463681 - RNA, 15 nt, Human
uugugaaugcuucuc

SEQ ID NO: 3463682 - RNA, 13 nt, Human
uugugaauggauu

SEQ ID NO: 3463683 - RNA, 21 nt, Human
uugugaauguauuuuucuguu

SEQ ID NO: 3463684 - RNA, 18 nt, Human
uugugaauuaggcuguaa

SEQ ID NO: 3463685 - RNA, 16 nt, Human
uugugacauuccuucu

SEQ ID NO: 3463686 - RNA, 17 nt, Human
uugugaccuuaguguuu

SEQ ID NO: 3463687 - RNA, 21 nt, Human
uugugacuauauagagauguu

SEQ ID NO: 3463688 - RNA, 23 nt, Human
uugugacuguauauaaaggaaaa

SEQ ID NO: 3463689 - RNA, 17 nt, Human
uugugacuuuugcuuua

SEQ ID NO: 3463690 - RNA, 21 nt, Human
uugugagaaacaucucaauaa

SEQ ID NO: 3463691 - RNA, 11 nt, Human
uugugagagcg

SEQ ID NO: 3463692 - RNA, 20 nt, Human
uugugaggcccaugguugag

SEQ ID NO: 3463693 - RNA, 20 nt, Human
uugugaguaaaucagauguu

SEQ ID NO: 3463694 - RNA, 22 nt, Human
uugugaguuuaccuuguauacu

SEQ ID NO: 3463695 - RNA, 14 nt, Human
uugugaguuuguuu

SEQ ID NO: 3463696 - RNA, 16 nt, Human
uugugaguuuguuucu

SEQ ID NO: 3463697 - RNA, 20 nt, Human
uugugauacaaugcugugcc

SEQ ID NO: 3463698 - RNA, 16 nt, Human
uugugauagcacuuuc

SEQ ID NO: 3463699 - RNA, 19 nt, Human
uugugauagcacuuucuac

SEQ ID NO: 3463700 - RNA, 21 nt, Human
uugugauagcacuuucuacaa

SEQ ID NO: 3463701 - RNA, 20 nt, Human
uugugauagcuaacauuuua

SEQ ID NO: 3463702 - RNA, 16 nt, Human
uugugauaugcacaau

SEQ ID NO: 3463703 - RNA, 18 nt, Human
uugugaugugaguugcac

SEQ ID NO: 3463704 - RNA, 18 nt, Human
uugugauuagacagaaca

SEQ ID NO: 3463705 - RNA, 17 nt, Human
uugugauuauuucacuu

SEQ ID NO: 3463706 - RNA, 17 nt, Human
uugugauuuuuguaauu

SEQ ID NO: 3463707 - RNA, 18 nt, Human
uugugcaauguaaauauu

SEQ ID NO: 3463708 - RNA, 19 nt, Human
uugugcaauguguauaaac

SEQ ID NO: 3463709 - RNA, 15 nt, Human
uugugcacaggcaga

SEQ ID NO: 3463710 - RNA, 18 nt, Human
uugugcagaaaacauugu

SEQ ID NO: 3463711 - RNA, 19 nt, Human
uugugcagaaaacauuguu

SEQ ID NO: 3463712 - RNA, 11 nt, Human
uugugcagaga

SEQ ID NO: 3463713 - RNA, 17 nt, Human
uugugcagcuuuugguc

SEQ ID NO: 3463714 - RNA, 17 nt, Human
uugugcaguaacuuggg

SEQ ID NO: 3463715 - RNA, 17 nt, Human
uugugcauuaucuagau

SEQ ID NO: 3463716 - RNA, 22 nt, Human
uugugcauuaucuagauacugu

SEQ ID NO: 3463717 - RNA, 23 nt, Human
uugugcauuggauaacaccacca

SEQ ID NO: 3463718 - RNA, 18 nt, Human
uugugccaaacaaaauga

SEQ ID NO: 3463719 - RNA, 13 nt, Human
uugugccagagga

SEQ ID NO: 3463720 - RNA, 12 nt, Human
uugugccaucug

SEQ ID NO: 3463721 - RNA, 13 nt, Human
uugugccaucugu

SEQ ID NO: 3463722 - RNA, 18 nt, Human
uugugccuaauguguuug

SEQ ID NO: 3463723 - RNA, 17 nt, Human
uugugccuuaaagacaa

SEQ ID NO: 3463724 - RNA, 13 nt, Human
uugugcuauaaag

SEQ ID NO: 3463725 - RNA, 14 nt, Human
uugugcugccauuu

SEQ ID NO: 3463726 - RNA, 18 nt, Human
uuccccaaccacuucauu

SEQ ID NO: 3463727 - RNA, 18 nt, Human
uuccccaacgaaaagcac

SEQ ID NO: 3463728 - RNA, 23 nt, Human
uuccccacccaccaacccucagg

SEQ ID NO: 3463729 - RNA, 21 nt, Human
uuccccacugacagccuccca

SEQ ID NO: 3463730 - RNA, 23 nt, Human
uuccccacugacagccucccacc

SEQ ID NO: 3463731 - RNA, 14 nt, Human
uuccccacugccug

SEQ ID NO: 3463732 - RNA, 18 nt, Human
uuccccacugccugccca

SEQ ID NO: 3463733 - RNA, 11 nt, Human
uuccccagaga

SEQ ID NO: 3463734 - RNA, 13 nt, Human
uuccccagcccag

SEQ ID NO: 3463735 - RNA, 15 nt, Human
uuccccagcccaggg

SEQ ID NO: 3463736 - RNA, 14 nt, Human
uuccccagccccac

SEQ ID NO: 3463737 - RNA, 15 nt, Human
uuccccagccccacu

SEQ ID NO: 3463738 - RNA, 20 nt, Human
uuccccaggaggccagccuu

SEQ ID NO: 3463739 - RNA, 18 nt, Human
uuccccauacaaauaagc

SEQ ID NO: 3463740 - RNA, 19 nt, Human
uuccccauggcccugagcg

SEQ ID NO: 3463741 - RNA, 12 nt, Human
uuccccauggga

SEQ ID NO: 3463742 - RNA, 23 nt, Human
uuccccaugggaagacgaggccc

SEQ ID NO: 3463743 - RNA, 23 nt, Human
uuccccaugguuuuaaucuguau

SEQ ID NO: 3463744 - RNA, 18 nt, Human
uuccccauuccuacccac

SEQ ID NO: 3463745 - RNA, 17 nt, Human
uucccccaaccucagac

SEQ ID NO: 3463746 - RNA, 21 nt, Human
uucccccaccccauuucucuc

SEQ ID NO: 3463747 - RNA, 20 nt, Human
uucccccagcccuguggaag

SEQ ID NO: 3463748 - RNA, 12 nt, Human
uuccccccacuc

SEQ ID NO: 3463749 - RNA, 20 nt, Human
uucccccuggccaccacccc

SEQ ID NO: 3463750 - RNA, 17 nt, Human
uucccccuucacaaagc

SEQ ID NO: 3463751 - RNA, 16 nt, Human
uucccccuuucuuccu

SEQ ID NO: 3463752 - RNA, 18 nt, Human
uugugggccugggcuccu

SEQ ID NO: 3463753 - RNA, 20 nt, Human
uugugggccugggcuccugg

SEQ ID NO: 3463754 - RNA, 23 nt, Human
uugugggccugggcuccuggacc

SEQ ID NO: 3463755 - RNA, 17 nt, Human
uuguggggaugaugaaa

SEQ ID NO: 3463756 - RNA, 14 nt, Human
uuguggggccuggg

SEQ ID NO: 3463757 - RNA, 17 nt, Human
uuguggggccugggagg

SEQ ID NO: 3463758 - RNA, 22 nt, Human
uuguggugugaguaucagaauu

SEQ ID NO: 3463759 - RNA, 13 nt, Human
uugugguuaaucu

SEQ ID NO: 3463760 - RNA, 15 nt, Human
uugugguuuuaugga

SEQ ID NO: 3463761 - RNA, 12 nt, Human
uuguguaaaaaa

SEQ ID NO: 3463762 - RNA, 22 nt, Human
uuguguaauaaaguguuuucag

SEQ ID NO: 3463763 - RNA, 18 nt, Human
uuguguaauauuacuuua

SEQ ID NO: 3463764 - RNA, 18 nt, Human
uuguguacucuggccucu

SEQ ID NO: 3463765 - RNA, 15 nt, Human
uuguguauauuugua

SEQ ID NO: 3463766 - RNA, 20 nt, Human
uuguguaucguaaccagcca

SEQ ID NO: 3463767 - RNA, 14 nt, Human
uuguguauuuaaca

SEQ ID NO: 3463768 - RNA, 19 nt, Human
uugugucauguuuaagaaa

SEQ ID NO: 3463769 - RNA, 22 nt, Human
uugugucccauucccccagugc

SEQ ID NO: 3463770 - RNA, 13 nt, Human
uugugucuguaca

SEQ ID NO: 3463771 - RNA, 18 nt, Human
uugugucuuuugcaugau

SEQ ID NO: 3463772 - RNA, 14 nt, Human
uugugugaaauugc

SEQ ID NO: 3463773 - RNA, 15 nt, Human
uugugugaaauugca

SEQ ID NO: 3463774 - RNA, 13 nt, Human
uugugugaacuug

SEQ ID NO: 3463775 - RNA, 19 nt, Human
uugugugauauuucagaaa

SEQ ID NO: 3463776 - RNA, 23 nt, Human
uugugugccucuagcugaauuga

SEQ ID NO: 3463777 - RNA, 14 nt, Human
uugugugcucucca

SEQ ID NO: 3463778 - RNA, 16 nt, Human
uuguguggauucuuua

SEQ ID NO: 3463779 - RNA, 13 nt, Human
uuguguguacuca

SEQ ID NO: 3463780 - RNA, 13 nt, Human
uuguguguaugca

SEQ ID NO: 3463781 - RNA, 14 nt, Human
uuguguguaugcac

SEQ ID NO: 3463782 - RNA, 13 nt, Human
uugugugugggag

SEQ ID NO: 3463783 - RNA, 15 nt, Human
uuguguguuauuuaa

SEQ ID NO: 3463784 - RNA, 21 nt, Human
uuguguguuauuuaaaugagu

SEQ ID NO: 3463785 - RNA, 13 nt, Human
uuguguguuucac

SEQ ID NO: 3463786 - RNA, 20 nt, Human
uuguguuaaguauguguaaa

SEQ ID NO: 3463787 - RNA, 20 nt, Human
uuguguuccuacagacacuu

SEQ ID NO: 3463788 - RNA, 20 nt, Human
uuguguucuguuuguuaaaa

SEQ ID NO: 3463789 - RNA, 22 nt, Human
uuguguucuguuuguuaaaacu

SEQ ID NO: 3463790 - RNA, 19 nt, Human
uuguguucuucuucauauu

SEQ ID NO: 3463791 - RNA, 18 nt, Human
uuguguugaagagcagcu

SEQ ID NO: 3463792 - RNA, 13 nt, Human
uuguguugacauu

SEQ ID NO: 3463793 - RNA, 16 nt, Human
uuguguugacauuaag

SEQ ID NO: 3463794 - RNA, 22 nt, Human
uuguguugacuuuauaaauuuc

SEQ ID NO: 3463795 - RNA, 13 nt, Human
uuguguuguaauu

SEQ ID NO: 3463796 - RNA, 11 nt, Human
uuguguuguca

SEQ ID NO: 3463797 - RNA, 12 nt, Human
uuguguuuacau

SEQ ID NO: 3463798 - RNA, 13 nt, Human
uuguguuuacauu

SEQ ID NO: 3463799 - RNA, 22 nt, Human
uuguguuuacauuuuauggugc

SEQ ID NO: 3463800 - RNA, 21 nt, Human
uuguguuuauauauaagccaa

SEQ ID NO: 3463801 - RNA, 18 nt, Human
uuguguuuauucuugaug

SEQ ID NO: 3463802 - RNA, 16 nt, Human
uuguguuugguuuaca

SEQ ID NO: 3463803 - RNA, 17 nt, Human
uuguguuuguguauuua

SEQ ID NO: 3463804 - RNA, 18 nt, Human
uuguguuuugcaagccag

SEQ ID NO: 3463805 - RNA, 17 nt, Human
uuguguuuuuaauuuau

SEQ ID NO: 3463806 - RNA, 18 nt, Human
uuguguuuuuaauuuauu

SEQ ID NO: 3463807 - RNA, 15 nt, Human
uuguguuuuuuaaga

SEQ ID NO: 3463808 - RNA, 17 nt, Human
uuguguuuuuuaagaua

SEQ ID NO: 3463809 - RNA, 15 nt, Human
uuguuaaaaauguca

SEQ ID NO: 3463810 - RNA, 16 nt, Human
uuguuaaaauuaugaa

SEQ ID NO: 3463811 - RNA, 17 nt, Human
uuguuaagauaugaugu

SEQ ID NO: 3463812 - RNA, 21 nt, Human
uuguuaauaaaaguacauguu

SEQ ID NO: 3463813 - RNA, 17 nt, Human
uuguuaauauucauuuu

SEQ ID NO: 3463814 - RNA, 14 nt, Human
uuguuaauauucuu

SEQ ID NO: 3463815 - RNA, 15 nt, Human
uuguuaauauucuuu

SEQ ID NO: 3463816 - RNA, 17 nt, Human
uuguuaaugaaaauguc

SEQ ID NO: 3463817 - RNA, 19 nt, Human
uuguuaaugguuugaauau

SEQ ID NO: 3463818 - RNA, 19 nt, Human
uuguuaauuuagaaaacuu

SEQ ID NO: 3463819 - RNA, 15 nt, Human
uuguuacaggaaguc

SEQ ID NO: 3463820 - RNA, 14 nt, Human
uuguuacauuuuua

SEQ ID NO: 3463821 - RNA, 12 nt, Human
uuguuacccaug

SEQ ID NO: 3463822 - RNA, 12 nt, Human
uuguuaccuuua

SEQ ID NO: 3463823 - RNA, 16 nt, Human
uuguuacguagccuaa

SEQ ID NO: 3463824 - RNA, 18 nt, Human
uuguuacuaacuaaacuc

SEQ ID NO: 3463825 - RNA, 17 nt, Human
uuguuacucugguucuu

SEQ ID NO: 3463826 - RNA, 12 nt, Human
uuguuacuguuc

SEQ ID NO: 3463827 - RNA, 14 nt, Human
uuguuacuguucuu

SEQ ID NO: 3463828 - RNA, 17 nt, Human
uuguuacuguucuugcu

SEQ ID NO: 3463829 - RNA, 18 nt, Human
uuguuacuguucuugcug

SEQ ID NO: 3463830 - RNA, 21 nt, Human
uuguuacuguucuugcugcua

SEQ ID NO: 3463831 - RNA, 16 nt, Human
uuguuacuucucuaau

SEQ ID NO: 3463832 - RNA, 20 nt, Human
uuguuacuucucuaauucuu

SEQ ID NO: 3463833 - RNA, 22 nt, Human
uuguuagcauuuucaaugugau

SEQ ID NO: 3463834 - RNA, 20 nt, Human
uuguuagcuuccuuaaguau

SEQ ID NO: 3463835 - RNA, 21 nt, Human
uuguuaguaugaggcauuugu

SEQ ID NO: 3463836 - RNA, 22 nt, Human
uuguuaguaugaggcauuuguu

SEQ ID NO: 3463837 - RNA, 12 nt, Human
uuguuaucaaaa

SEQ ID NO: 3463838 - RNA, 13 nt, Human
uuguuaucuguuu

SEQ ID NO: 3463839 - RNA, 18 nt, Human
uuguuaugaugugcuuaa

SEQ ID NO: 3463840 - RNA, 14 nt, Human
uuguuauggcuuaa

SEQ ID NO: 3463841 - RNA, 15 nt, Human
uuguuauuaaacaaa

SEQ ID NO: 3463842 - RNA, 14 nt, Human
uuguuauuauauaa

SEQ ID NO: 3463843 - RNA, 23 nt, Human
uuguuauugggcaagugauugaa

SEQ ID NO: 3463844 - RNA, 11 nt, Human
uuguuauugug

SEQ ID NO: 3463845 - RNA, 12 nt, Human
uuguuauuguga

SEQ ID NO: 3463846 - RNA, 13 nt, Human
uuguuauugugaa

SEQ ID NO: 3463847 - RNA, 19 nt, Human
uuguucaauaauaaauauu

SEQ ID NO: 3463848 - RNA, 22 nt, Human
uuguucaauaauaaauauuuuu

SEQ ID NO: 3463849 - RNA, 13 nt, Human
uuguucacacucu

SEQ ID NO: 3463850 - RNA, 15 nt, Human
uuguucagcaugcaa

SEQ ID NO: 3463851 - RNA, 23 nt, Human
uuguucaggaaaagguugaauaa

SEQ ID NO: 3463852 - RNA, 18 nt, Human
uuguucauacauauuuuu

SEQ ID NO: 3463853 - RNA, 15 nt, Human
uuguucauagcccag

SEQ ID NO: 3463854 - RNA, 17 nt, Human
uuguucauauuaagaau

SEQ ID NO: 3463855 - RNA, 19 nt, Human
uuguucauauuaagaauga

SEQ ID NO: 3463856 - RNA, 17 nt, Human
uuguucaucauccagau

SEQ ID NO: 3463857 - RNA, 17 nt, Human
uuguucauuuugagcug

SEQ ID NO: 3463858 - RNA, 17 nt, Human
uuguuccaagacauugu

SEQ ID NO: 3463859 - RNA, 12 nt, Human
uuguuccagcuc

SEQ ID NO: 3463860 - RNA, 16 nt, Human
uuguuccccacuggag

SEQ ID NO: 3463861 - RNA, 13 nt, Human
uuguuccccuccu

SEQ ID NO: 3463862 - RNA, 23 nt, Human
uuguuccccuccuccacucuccc

SEQ ID NO: 3463863 - RNA, 22 nt, Human
uuguucccugugucauuucaaa

SEQ ID NO: 3463864 - RNA, 17 nt, Human
uuguucgggugugcaau

SEQ ID NO: 3463865 - RNA, 15 nt, Human
uuguucuaguuuuca

SEQ ID NO: 3463866 - RNA, 16 nt, Human
uuguucuaguuuucag

SEQ ID NO: 3463867 - RNA, 13 nt, Human
uuguucucuggga

SEQ ID NO: 3463868 - RNA, 19 nt, Human
uuguucugcuguucucuag

SEQ ID NO: 3463869 - RNA, 20 nt, Human
uuguucuggcucuuccaggc

SEQ ID NO: 3463870 - RNA, 22 nt, Human
uuguucuggcucuuccaggcug

SEQ ID NO: 3463871 - RNA, 14 nt, Human
uuguucugucacca

SEQ ID NO: 3463872 - RNA, 21 nt, Human
uucucagaagcacagaauauu

SEQ ID NO: 3463873 - RNA, 19 nt, Human
uucucagaaggcaaaugac

SEQ ID NO: 3463874 - RNA, 23 nt, Human
uucucagaaucuacccaaaggau

SEQ ID NO: 3463875 - RNA, 13 nt, Human
uucucagaaucuc

SEQ ID NO: 3463876 - RNA, 19 nt, Human
uucucagagugguggggga

SEQ ID NO: 3463877 - RNA, 20 nt, Human
uucucagauuucugaggaaa

SEQ ID NO: 3463878 - RNA, 13 nt, Human
uucucagcagagu

SEQ ID NO: 3463879 - RNA, 12 nt, Human
uucucagcuccc

SEQ ID NO: 3463880 - RNA, 13 nt, Human
uucucagcucccc

SEQ ID NO: 3463881 - RNA, 14 nt, Human
uucucagcuccccc

SEQ ID NO: 3463882 - RNA, 15 nt, Human
uucucagcucccccu

SEQ ID NO: 3463883 - RNA, 16 nt, Human
uucucaggacacaggc

SEQ ID NO: 3463884 - RNA, 18 nt, Human
uucucagggcuccugccu

SEQ ID NO: 3463885 - RNA, 16 nt, Human
uucucagggucucugc

SEQ ID NO: 3463886 - RNA, 21 nt, Human
uucucagggucucugcugccg

SEQ ID NO: 3463887 - RNA, 22 nt, Human
uucucagucaguaauugccaaa

SEQ ID NO: 3463888 - RNA, 19 nt, Human
uucucagugccaacugugg

SEQ ID NO: 3463889 - RNA, 14 nt, Human
uucucaguuuuucu

SEQ ID NO: 3463890 - RNA, 15 nt, Human
uucucaguuuuucuu

SEQ ID NO: 3463891 - RNA, 16 nt, Human
uucucaguuuuucuua

SEQ ID NO: 3463892 - RNA, 16 nt, Human
uucucauaauuccuac

SEQ ID NO: 3463893 - RNA, 20 nt, Human
uucucauaauuccuacagca

SEQ ID NO: 3463894 - RNA, 23 nt, Human
uucucauaauuccuacagcacua

SEQ ID NO: 3463895 - RNA, 17 nt, Human
uucucauagcauuaacu

SEQ ID NO: 3463896 - RNA, 22 nt, Human
uucucauagcauuaacuaaucu

SEQ ID NO: 3463897 - RNA, 17 nt, Human
uucucauagccccggug

SEQ ID NO: 3463898 - RNA, 12 nt, Human
uucucauauuug

SEQ ID NO: 3463899 - RNA, 15 nt, Human
uucucaucacucccc

SEQ ID NO: 3463900 - RNA, 17 nt, Human
uucucaucugcacccuu

SEQ ID NO: 3463901 - RNA, 15 nt, Human
uucucaucuuucuug

SEQ ID NO: 3463902 - RNA, 22 nt, Human
uucucauguugaaacuuuaaga

SEQ ID NO: 3463903 - RNA, 15 nt, Human
uucucauuaaaagaa

SEQ ID NO: 3463904 - RNA, 23 nt, Human
uucucauugaauuauaaaagcca

SEQ ID NO: 3463905 - RNA, 16 nt, Human
uucucauuucaccccu

SEQ ID NO: 3463906 - RNA, 19 nt, Human
uucucauuuguuuuucuca

SEQ ID NO: 3463907 - RNA, 20 nt, Human
uucuccaaacugaagcagcc

SEQ ID NO: 3463908 - RNA, 16 nt, Human
uucuccaagagcuaca

SEQ ID NO: 3463909 - RNA, 21 nt, Human
uucuccaauaucagugcucga

SEQ ID NO: 3463910 - RNA, 14 nt, Human
uucuccaccccagc

SEQ ID NO: 3463911 - RNA, 21 nt, Human
uucuccaccuagacuguaaac

SEQ ID NO: 3463912 - RNA, 16 nt, Human
uucuccaccugccagg

SEQ ID NO: 3463913 - RNA, 14 nt, Human
uucuccacucaguu

SEQ ID NO: 3463914 - RNA, 17 nt, Human
uucuccacucaguugca

SEQ ID NO: 3463915 - RNA, 18 nt, Human
uucuccacugugcacacc

SEQ ID NO: 3463916 - RNA, 14 nt, Human
uucuccagccagca

SEQ ID NO: 3463917 - RNA, 19 nt, Human
uucuccagccucagccucc

SEQ ID NO: 3463918 - RNA, 11 nt, Human
uucuccaggcu

SEQ ID NO: 3463919 - RNA, 19 nt, Human
uucuccagucauuauguua

SEQ ID NO: 3463920 - RNA, 21 nt, Human
uucuccauccuuucugccucu

SEQ ID NO: 3463921 - RNA, 14 nt, Human
uucuccauuguaaa

SEQ ID NO: 3463922 - RNA, 16 nt, Human
uucucccacucuccua

SEQ ID NO: 3463923 - RNA, 17 nt, Human
uucucccacuuggccaa

SEQ ID NO: 3463924 - RNA, 13 nt, Human
uucucccaggaag

SEQ ID NO: 3463925 - RNA, 14 nt, Human
uucucccaggaagc

SEQ ID NO: 3463926 - RNA, 15 nt, Human
uucucccaggaagcu

SEQ ID NO: 3463927 - RNA, 23 nt, Human
uucucccaggccaggcuccuucc

SEQ ID NO: 3463928 - RNA, 18 nt, Human
uucuccccagcucccagg

SEQ ID NO: 3463929 - RNA, 20 nt, Human
uucucccccccggggcuggg

SEQ ID NO: 3463930 - RNA, 15 nt, Human
uucuccccugcacug

SEQ ID NO: 3463931 - RNA, 18 nt, Human
uucuccccugcacuguaa

SEQ ID NO: 3463932 - RNA, 21 nt, Human
uucuccccugcacuguaaaau

SEQ ID NO: 3463933 - RNA, 16 nt, Human
uucuccccugccccca

SEQ ID NO: 3463934 - RNA, 17 nt, Human
uucuccccugcccccag

SEQ ID NO: 3463935 - RNA, 18 nt, Human
uucuccccugcccccagg

SEQ ID NO: 3463936 - RNA, 21 nt, Human
uucucccguucacguugccua

SEQ ID NO: 3463937 - RNA, 13 nt, Human
uucucccucugga

SEQ ID NO: 3463938 - RNA, 18 nt, Human
uucucccugcacaagcca

SEQ ID NO: 3463939 - RNA, 21 nt, Human
uucucccuucgguggaagagc

SEQ ID NO: 3463940 - RNA, 23 nt, Human
uucuccgacugcuagggaguggu

SEQ ID NO: 3463941 - RNA, 16 nt, Human
uucuccgccagccucc

SEQ ID NO: 3463942 - RNA, 20 nt, Human
uucuccguuagcuccugugg

SEQ ID NO: 3463943 - RNA, 14 nt, Human
uucuccuauguuug

SEQ ID NO: 3463944 - RNA, 23 nt, Human
uucuccuccaugggagaaaauag

SEQ ID NO: 3463945 - RNA, 22 nt, Human
uucuccucuuguaaauaaagcc

SEQ ID NO: 3463946 - RNA, 21 nt, Human
uucuccugaggauguguccca

SEQ ID NO: 3463947 - RNA, 14 nt, Human
uucuccugccucag

SEQ ID NO: 3463948 - RNA, 21 nt, Human
uucuccugccugugcugugac

SEQ ID NO: 3463949 - RNA, 22 nt, Human
uucuccugccuuugccuccaga

SEQ ID NO: 3463950 - RNA, 16 nt, Human
uucuccugcugcuccc

SEQ ID NO: 3463951 - RNA, 20 nt, Human
uucuccugcugcucccucag

SEQ ID NO: 3463952 - RNA, 21 nt, Human
uucuccugcugcucccucaga

SEQ ID NO: 3463953 - RNA, 14 nt, Human
uucuccuggaugcu

SEQ ID NO: 3463954 - RNA, 12 nt, Human
uucuccugugcu

SEQ ID NO: 3463955 - RNA, 17 nt, Human
uucuccuugauaacagc

SEQ ID NO: 3463956 - RNA, 18 nt, Human
uucuccuugauaacagcu

SEQ ID NO: 3463957 - RNA, 23 nt, Human
uucuccuugauaacagcuaccau

SEQ ID NO: 3463958 - RNA, 17 nt, Human
uauccccaucucccugc

SEQ ID NO: 3463959 - RNA, 16 nt, Human
uauccccauuucuuuu

SEQ ID NO: 3463960 - RNA, 19 nt, Human
uauccccccccuguauagu

SEQ ID NO: 3463961 - RNA, 15 nt, Human
uauccccucccaguc

SEQ ID NO: 3463962 - RNA, 16 nt, Human
uauccccucccaguca

SEQ ID NO: 3463963 - RNA, 19 nt, Human
uaucccgagucugggacac

SEQ ID NO: 3463964 - RNA, 15 nt, Human
uaucccggcugcccu

SEQ ID NO: 3463965 - RNA, 19 nt, Human
uaucccuacuguaauuugu

SEQ ID NO: 3463966 - RNA, 19 nt, Human
uaucccuccuguugggaga

SEQ ID NO: 3463967 - RNA, 19 nt, Human
uauccuacaacaagaguuu

SEQ ID NO: 3463968 - RNA, 14 nt, Human
uauccuacuucccc

SEQ ID NO: 3463969 - RNA, 17 nt, Human
uauccuacuuccccuuc

SEQ ID NO: 3463970 - RNA, 20 nt, Human
uauccuagcacaugcuucaa

SEQ ID NO: 3463971 - RNA, 16 nt, Human
uauccuaucucuccaa

SEQ ID NO: 3463972 - RNA, 15 nt, Human
uauccuccagguuuu

SEQ ID NO: 3463973 - RNA, 12 nt, Human
uauccucuguaa

SEQ ID NO: 3463974 - RNA, 12 nt, Human
uauccugaauaa

SEQ ID NO: 3463975 - RNA, 11 nt, Human
uauccugccuc

SEQ ID NO: 3463976 - RNA, 15 nt, Human
uauccugccucagcc

SEQ ID NO: 3463977 - RNA, 21 nt, Human
uauccuggaacaauauuuuau

SEQ ID NO: 3463978 - RNA, 17 nt, Human
uauccuggcuuugccca

SEQ ID NO: 3463979 - RNA, 21 nt, Human
uauccuggcuuugcccaaccu

SEQ ID NO: 3463980 - RNA, 18 nt, Human
uauccugggcuuuuguuu

SEQ ID NO: 3463981 - RNA, 10 nt, Human
uauccugggg

SEQ ID NO: 3463982 - RNA, 22 nt, Human
uauccuggggcucccuucaucu

SEQ ID NO: 3463983 - RNA, 11 nt, Human
uauccuggugc

SEQ ID NO: 3463984 - RNA, 14 nt, Human
uauccugugacugu

SEQ ID NO: 3463985 - RNA, 13 nt, Human
uauccuucaucuu

SEQ ID NO: 3463986 - RNA, 16 nt, Human
uauccuuccucuccuu

SEQ ID NO: 3463987 - RNA, 15 nt, Human
uauccuuuucugugu

SEQ ID NO: 3463988 - RNA, 20 nt, Human
uaucgaaauaacaauguuaa

SEQ ID NO: 3463989 - RNA, 23 nt, Human
uaucgacuuguuuuugcacaugu

SEQ ID NO: 3463990 - RNA, 22 nt, Human
uaucgauguuuuauuauuucua

SEQ ID NO: 3463991 - RNA, 20 nt, Human
uaucgcaccacuguguauuu

SEQ ID NO: 3463992 - RNA, 19 nt, Human
uaucgcccuggcaggcagg

SEQ ID NO: 3463993 - RNA, 17 nt, Human
uaucgcugggaaaugag

SEQ ID NO: 3463994 - RNA, 13 nt, Human
uaucggcacugua

SEQ ID NO: 3463995 - RNA, 17 nt, Human
uaucggcucacaaagag

SEQ ID NO: 3463996 - RNA, 16 nt, Human
uaucgggggcuggggc

SEQ ID NO: 3463997 - RNA, 19 nt, Human
uaucgucacugcuuaacuu

SEQ ID NO: 3463998 - RNA, 18 nt, Human
uaucguuaucacugugca

SEQ ID NO: 3463999 - RNA, 23 nt, Human
uaucuaaacuggauucacagcuc

SEQ ID NO: 3464000 - RNA, 18 nt, Human
uaucuaaaguuauauuuc

SEQ ID NO: 3464001 - RNA, 12 nt, Human
uaucuaaaguuu

SEQ ID NO: 3464002 - RNA, 22 nt, Human
uaucuaaauauggacugcucag

SEQ ID NO: 3464003 - RNA, 14 nt, Human
uaucuaaauugaau

SEQ ID NO: 3464004 - RNA, 20 nt, Human
uaucuaaauugaauaauggu

SEQ ID NO: 3464005 - RNA, 19 nt, Human
uaucuaaccagugauucga

SEQ ID NO: 3464006 - RNA, 19 nt, Human
uaucuaaguuaauuuaaag

SEQ ID NO: 3464007 - RNA, 23 nt, Human
uaucuaaguuaauuuaaaguugu

SEQ ID NO: 3464008 - RNA, 20 nt, Human
uaucuaauaccucugugugc

SEQ ID NO: 3464009 - RNA, 21 nt, Human
uaucuaauauauaugaauaaa

SEQ ID NO: 3464010 - RNA, 15 nt, Human
uaucuaauucuuuaa

SEQ ID NO: 3464011 - RNA, 16 nt, Human
uaucuaauucuuuaau

SEQ ID NO: 3464012 - RNA, 16 nt, Human
uaucuaccaacuuuca

SEQ ID NO: 3464013 - RNA, 17 nt, Human
uaucuaccaacuuucaa

SEQ ID NO: 3464014 - RNA, 20 nt, Human
uaucuaccaacuuucaagaa

SEQ ID NO: 3464015 - RNA, 22 nt, Human
uaucuacuuccaaacuaauuuu

SEQ ID NO: 3464016 - RNA, 23 nt, Human
uuuauacagaugccauauagugu

SEQ ID NO: 3464017 - RNA, 12 nt, Human
uuuauacagcug

SEQ ID NO: 3464018 - RNA, 14 nt, Human
uuuauacagcugua

SEQ ID NO: 3464019 - RNA, 18 nt, Human
uuuauacagcuguauugu

SEQ ID NO: 3464020 - RNA, 22 nt, Human
uuuauacagcuguauugucuga

SEQ ID NO: 3464021 - RNA, 22 nt, Human
uuuauacaguagugagaagaau

SEQ ID NO: 3464022 - RNA, 16 nt, Human
uuuauacauuaguaaa

SEQ ID NO: 3464023 - RNA, 10 nt, Human
uuuauaccuc

SEQ ID NO: 3464024 - RNA, 17 nt, Human
uuuauaccuguuuaaau

SEQ ID NO: 3464025 - RNA, 15 nt, Human
uuuauacgagaacag

SEQ ID NO: 3464026 - RNA, 16 nt, Human
uuuauacguguagcua

SEQ ID NO: 3464027 - RNA, 20 nt, Human
uuuauacuuucccuacccuc

SEQ ID NO: 3464028 - RNA, 20 nt, Human
uuuauagcuauuacugucug

SEQ ID NO: 3464029 - RNA, 16 nt, Human
uuuauagcucaguuua

SEQ ID NO: 3464030 - RNA, 14 nt, Human
uuuauagcuuuauu

SEQ ID NO: 3464031 - RNA, 17 nt, Human
uuuauaguuuguacaug

SEQ ID NO: 3464032 - RNA, 17 nt, Human
uuuauauaaaguauucu

SEQ ID NO: 3464033 - RNA, 14 nt, Human
uuuauauaaaugua

SEQ ID NO: 3464034 - RNA, 12 nt, Human
uuuauauaauaa

SEQ ID NO: 3464035 - RNA, 20 nt, Human
uuuauauacaauaauggaaa

SEQ ID NO: 3464036 - RNA, 18 nt, Human
uuuauauagcaagacauu

SEQ ID NO: 3464037 - RNA, 16 nt, Human
uuuauauagcuugaaa

SEQ ID NO: 3464038 - RNA, 13 nt, Human
uuuauauauauau

SEQ ID NO: 3464039 - RNA, 16 nt, Human
uuuauauaugaaaacu

SEQ ID NO: 3464040 - RNA, 17 nt, Human
uuuauauaugaaaacua

SEQ ID NO: 3464041 - RNA, 15 nt, Human
uuuauauauggacau

SEQ ID NO: 3464042 - RNA, 18 nt, Human
uuuauauauuauauggaa

SEQ ID NO: 3464043 - RNA, 22 nt, Human
uuuauauauuuaacuacaauuu

SEQ ID NO: 3464044 - RNA, 17 nt, Human
uuuauaucccauuuuua

SEQ ID NO: 3464045 - RNA, 21 nt, Human
uuuauaucuuggcagguagga

SEQ ID NO: 3464046 - RNA, 21 nt, Human
uuuauaugcuucuguuuuaua

SEQ ID NO: 3464047 - RNA, 17 nt, Human
uuuauauguacaugaga

SEQ ID NO: 3464048 - RNA, 21 nt, Human
uuuauauguaccguaggcuuu

SEQ ID NO: 3464049 - RNA, 21 nt, Human
uuuauauguauguguuuagaa

SEQ ID NO: 3464050 - RNA, 21 nt, Human
uuuauauguguugaaaaccaa

SEQ ID NO: 3464051 - RNA, 18 nt, Human
uuuauauuacugacauuu

SEQ ID NO: 3464052 - RNA, 14 nt, Human
uuuauauuuaguua

SEQ ID NO: 3464053 - RNA, 16 nt, Human
uuuauauuuauccacu

SEQ ID NO: 3464054 - RNA, 18 nt, Human
uuuauauuucaaguacac

SEQ ID NO: 3464055 - RNA, 20 nt, Human
uuuauauuucaaguacacug

SEQ ID NO: 3464056 - RNA, 17 nt, Human
uuuauauuuccuuuaug

SEQ ID NO: 3464057 - RNA, 18 nt, Human
uuuauauuuccuuuaugu

SEQ ID NO: 3464058 - RNA, 19 nt, Human
uuuauauuuccuuuaugug

SEQ ID NO: 3464059 - RNA, 21 nt, Human
uuuauauuuccuuuaugugaa

SEQ ID NO: 3464060 - RNA, 14 nt, Human
uuuauauuuucaau

SEQ ID NO: 3464061 - RNA, 22 nt, Human
uuuauauuuucaauucaaaaau

SEQ ID NO: 3464062 - RNA, 21 nt, Human
uuuaucaaacccuagccuugc

SEQ ID NO: 3464063 - RNA, 14 nt, Human
uuuaucaaagcaua

SEQ ID NO: 3464064 - RNA, 22 nt, Human
uuuaucaaagcauagauguuuu

SEQ ID NO: 3464065 - RNA, 21 nt, Human
uuuaucaaagggugaaaauua

SEQ ID NO: 3464066 - RNA, 14 nt, Human
uuuaucaaaucagu

SEQ ID NO: 3464067 - RNA, 18 nt, Human
uuuaucaaucaguauaau

SEQ ID NO: 3464068 - RNA, 19 nt, Human
uuuaucaaugugucuuucu

SEQ ID NO: 3464069 - RNA, 15 nt, Human
uuuaucacacuucug

SEQ ID NO: 3464070 - RNA, 18 nt, Human
uuuaucacacuucuguga

SEQ ID NO: 3464071 - RNA, 14 nt, Human
uuuaucacauguau

SEQ ID NO: 3464072 - RNA, 19 nt, Human
uuuaucacuuuuugaacua

SEQ ID NO: 3464073 - RNA, 22 nt, Human
uuuaucacuuuuugaacuaaga

SEQ ID NO: 3464074 - RNA, 17 nt, Human
uuuaucagaacuauguu

SEQ ID NO: 3464075 - RNA, 18 nt, Human
uuuaucagaacuauguuu

SEQ ID NO: 3464076 - RNA, 14 nt, Human
uuuaucagaauucu

SEQ ID NO: 3464077 - RNA, 13 nt, Human
uuuaucagauaca

SEQ ID NO: 3464078 - RNA, 21 nt, Human
uuuaucagauacaucacugcu

SEQ ID NO: 3464079 - RNA, 14 nt, Human
uuuaucagcaaaaa

SEQ ID NO: 3464080 - RNA, 16 nt, Human
uuuaucagcaguuguu

SEQ ID NO: 3464081 - RNA, 14 nt, Human
uuuaucaugacaug

SEQ ID NO: 3464082 - RNA, 15 nt, Human
uuuaucaugacaugu

SEQ ID NO: 3464083 - RNA, 23 nt, Human
uuuaucaugcauguccuguaaag

SEQ ID NO: 3464084 - RNA, 18 nt, Human
uuuauccaaaauguguau

SEQ ID NO: 3464085 - RNA, 15 nt, Human
uuuauccaaucuugu

SEQ ID NO: 3464086 - RNA, 16 nt, Human
uuuauccaaucuuguu

SEQ ID NO: 3464087 - RNA, 18 nt, Human
uuuauccagaaaacugug

SEQ ID NO: 3464088 - RNA, 17 nt, Human
uuuaucccacggaaaau

SEQ ID NO: 3464089 - RNA, 18 nt, Human
uuuauccucuuuagaguu

SEQ ID NO: 3464090 - RNA, 19 nt, Human
uuuaucgcugggaaaugag

SEQ ID NO: 3464091 - RNA, 21 nt, Human
uuuaucuaccaacuuucaaga

SEQ ID NO: 3464092 - RNA, 14 nt, Human
uuuaucuauaauuu

SEQ ID NO: 3464093 - RNA, 19 nt, Human
uuuaucuauaauuuaccua

SEQ ID NO: 3464094 - RNA, 15 nt, Human
uuuaucuauauaaaa

SEQ ID NO: 3464095 - RNA, 14 nt, Human
uuuaucuauuguaa

SEQ ID NO: 3464096 - RNA, 17 nt, Human
uuuaucuauuguaagau

SEQ ID NO: 3464097 - RNA, 16 nt, Human
uuuaucucagauguua

SEQ ID NO: 3464098 - RNA, 14 nt, Human
uuuaucucuauuua

SEQ ID NO: 3464099 - RNA, 17 nt, Human
uuuaucucuauuuaaua

SEQ ID NO: 3464100 - RNA, 13 nt, Human
uuuaucugauuaa

SEQ ID NO: 3464101 - RNA, 19 nt, Human
uuuaucuguaguaaacuau

SEQ ID NO: 3464102 - RNA, 14 nt, Human
uuuaucuguuuccu

SEQ ID NO: 3464103 - RNA, 17 nt, Human
uuuaucuugaaggaaaa

SEQ ID NO: 3464104 - RNA, 21 nt, Human
uuuaucuugaaggaaaaauuc

SEQ ID NO: 3464105 - RNA, 15 nt, Human
uuuaucuugggacug

SEQ ID NO: 3464106 - RNA, 12 nt, Human
uuuaucuuuaua

SEQ ID NO: 3464107 - RNA, 16 nt, Human
uuuaucuuugauaaca

SEQ ID NO: 3464108 - RNA, 19 nt, Human
uuuaucuuugauucuccuu

SEQ ID NO: 3464109 - RNA, 15 nt, Human
uuuaucuuuucuaca

SEQ ID NO: 3464110 - RNA, 21 nt, Human
uuuaucuuuucuacagcaaau

SEQ ID NO: 3464111 - RNA, 19 nt, Human
uuuaugaaaaagaagaauc

SEQ ID NO: 3464112 - RNA, 19 nt, Human
uuuaugaaaauaaauagcu

SEQ ID NO: 3464113 - RNA, 18 nt, Human
uuuaugaaagguuuacau

SEQ ID NO: 3464114 - RNA, 22 nt, Human
uuuaugaaaugguuaagaauuu

SEQ ID NO: 3464115 - RNA, 18 nt, Human
uuuaugaagaaaaaauac

SEQ ID NO: 3464116 - RNA, 18 nt, Human
uuuaugaagaaaauacuu

SEQ ID NO: 3464117 - RNA, 23 nt, Human
uuuaugaaguuuaaaacaguauu

SEQ ID NO: 3464118 - RNA, 14 nt, Human
uuuaugaaugggug

SEQ ID NO: 3464119 - RNA, 15 nt, Human
uuuaugacaguaauu

SEQ ID NO: 3464120 - RNA, 20 nt, Human
uuuaugacuucauuaauaau

SEQ ID NO: 3464121 - RNA, 22 nt, Human
uuuaugagaaacuggcaaagca

SEQ ID NO: 3464122 - RNA, 14 nt, Human
uuuaugagaaacuu

SEQ ID NO: 3464123 - RNA, 14 nt, Human
uaucuucacauagu

SEQ ID NO: 3464124 - RNA, 13 nt, Human
uaucuuccaaaug

SEQ ID NO: 3464125 - RNA, 17 nt, Human
uaucuuccauauuugga

SEQ ID NO: 3464126 - RNA, 15 nt, Human
uaucuucguucuugu

SEQ ID NO: 3464127 - RNA, 20 nt, Human
uaucuucucaaguucuaaga

SEQ ID NO: 3464128 - RNA, 14 nt, Human
uaucuucugauuug

SEQ ID NO: 3464129 - RNA, 21 nt, Human
uaucuucuggacuauagcugu

SEQ ID NO: 3464130 - RNA, 22 nt, Human
uaucuugaggugguaguaaaac

SEQ ID NO: 3464131 - RNA, 19 nt, Human
uaucuugauacauucaaau

SEQ ID NO: 3464132 - RNA, 22 nt, Human
uaucuugcaguaucggcacugu

SEQ ID NO: 3464133 - RNA, 17 nt, Human
uaucuugcucuguaauc

SEQ ID NO: 3464134 - RNA, 19 nt, Human
uaucuuggacaaaucacau

SEQ ID NO: 3464135 - RNA, 23 nt, Human
uaucuuggugaauuuuuuuuucc

SEQ ID NO: 3464136 - RNA, 21 nt, Human
uaucuugguguguuaagaguu

SEQ ID NO: 3464137 - RNA, 17 nt, Human
uaucuuguucaggaaaa

SEQ ID NO: 3464138 - RNA, 15 nt, Human
uaucuuuaagaaaaa

SEQ ID NO: 3464139 - RNA, 14 nt, Human
uaucuuuauuaauc

SEQ ID NO: 3464140 - RNA, 12 nt, Human
uaucuuucuaca

SEQ ID NO: 3464141 - RNA, 17 nt, Human
uaucuuuuauguuugaa

SEQ ID NO: 3464142 - RNA, 15 nt, Human
uaucuuuucuuuaga

SEQ ID NO: 3464143 - RNA, 13 nt, Human
uaucuuuugaccu

SEQ ID NO: 3464144 - RNA, 19 nt, Human
uaucuuuugaccuguggug

SEQ ID NO: 3464145 - RNA, 14 nt, Human
uaucuuuugagaac

SEQ ID NO: 3464146 - RNA, 15 nt, Human
uaucuuuuuauugau

SEQ ID NO: 3464147 - RNA, 22 nt, Human
uaucuuuuugcuuacaguuuua

SEQ ID NO: 3464148 - RNA, 14 nt, Human
uaugaaaaagaaga

SEQ ID NO: 3464149 - RNA, 14 nt, Human
uaugaaaaauauga

SEQ ID NO: 3464150 - RNA, 21 nt, Human
uaugaaaacauggaacagugu

SEQ ID NO: 3464151 - RNA, 17 nt, Human
uaugaaacuuaggaagg

SEQ ID NO: 3464152 - RNA, 14 nt, Human
uaugaaagaauaua

SEQ ID NO: 3464153 - RNA, 19 nt, Human
uaugaaagaauauauuuau

SEQ ID NO: 3464154 - RNA, 14 nt, Human
uaugaaauaaagaa

SEQ ID NO: 3464155 - RNA, 19 nt, Human
uaugaaauaaagaaauugc

SEQ ID NO: 3464156 - RNA, 15 nt, Human
uaugaaauauaugug

SEQ ID NO: 3464157 - RNA, 16 nt, Human
uaugaaauauauguga

SEQ ID NO: 3464158 - RNA, 20 nt, Human
uaugaaauauguauaacuuu

SEQ ID NO: 3464159 - RNA, 22 nt, Human
uaugaaauuuaauauagcuauu

SEQ ID NO: 3464160 - RNA, 21 nt, Human
uaugaacauagacuagagaaa

SEQ ID NO: 3464161 - RNA, 21 nt, Human
uauuauacaugugauacauuu

SEQ ID NO: 3464162 - RNA, 13 nt, Human
uauuauaccuuuu

SEQ ID NO: 3464163 - RNA, 18 nt, Human
uauuauacuuguaauuau

SEQ ID NO: 3464164 - RNA, 16 nt, Human
uauuauagagcagaaa

SEQ ID NO: 3464165 - RNA, 20 nt, Human
uauuauagagcagaaauucu

SEQ ID NO: 3464166 - RNA, 20 nt, Human
uauuauagguaaucaaugaa

SEQ ID NO: 3464167 - RNA, 13 nt, Human
uauuauauauaua

SEQ ID NO: 3464168 - RNA, 13 nt, Human
uauuauauggaaa

SEQ ID NO: 3464169 - RNA, 21 nt, Human
uauuauauguacccucugaaa

SEQ ID NO: 3464170 - RNA, 15 nt, Human
uauuauauuuggaug

SEQ ID NO: 3464171 - RNA, 16 nt, Human
uauuaucaugcaaaug

SEQ ID NO: 3464172 - RNA, 13 nt, Human
uauuauccauuca

SEQ ID NO: 3464173 - RNA, 15 nt, Human
uauuaucccagcugc

SEQ ID NO: 3464174 - RNA, 16 nt, Human
uauuauccccauuucu

SEQ ID NO: 3464175 - RNA, 14 nt, Human
uauuaucugggcuu

SEQ ID NO: 3464176 - RNA, 14 nt, Human
uauuaucugucagc

SEQ ID NO: 3464177 - RNA, 20 nt, Human
uauuaugaaacuuguguaaa

SEQ ID NO: 3464178 - RNA, 15 nt, Human
uauuaugagaugcug

SEQ ID NO: 3464179 - RNA, 14 nt, Human
uuucccuccuuggu

SEQ ID NO: 3464180 - RNA, 12 nt, Human
uuucccucuuuu

SEQ ID NO: 3464181 - RNA, 22 nt, Human
uuucccucuuuucuuacuccuc

SEQ ID NO: 3464182 - RNA, 13 nt, Human
uuucccugugcug

SEQ ID NO: 3464183 - RNA, 12 nt, Human
uuucccuuccuc

SEQ ID NO: 3464184 - RNA, 15 nt, Human
uuucccuucuucugu

SEQ ID NO: 3464185 - RNA, 19 nt, Human
uuucccuugcuuuucccuc

SEQ ID NO: 3464186 - RNA, 17 nt, Human
uuucccuuguagcuccu

SEQ ID NO: 3464187 - RNA, 18 nt, Human
uuucccuuguagcuccuc

SEQ ID NO: 3464188 - RNA, 16 nt, Human
uuuccguggcacugca

SEQ ID NO: 3464189 - RNA, 17 nt, Human
uuuccguuaaaauacca

SEQ ID NO: 3464190 - RNA, 14 nt, Human
uuuccuaaaaguuc

SEQ ID NO: 3464191 - RNA, 18 nt, Human
uuuccuaacaggauuaga

SEQ ID NO: 3464192 - RNA, 22 nt, Human
uuuccuaacaggauuagacagu

SEQ ID NO: 3464193 - RNA, 15 nt, Human
uuuccuaaggcugca

SEQ ID NO: 3464194 - RNA, 15 nt, Human
uuuccuaauaucaaa

SEQ ID NO: 3464195 - RNA, 13 nt, Human
uuuccuaauuuau

SEQ ID NO: 3464196 - RNA, 21 nt, Human
uuuccuacaggcagucucucu

SEQ ID NO: 3464197 - RNA, 24 nt, Human
uuuccuacucucaggaucaagaaa

SEQ ID NO: 3464198 - RNA, 15 nt, Human
uuuccuacuuuuccu

SEQ ID NO: 3464199 - RNA, 15 nt, Human
uuuccuagccuguuu

SEQ ID NO: 3464200 - RNA, 16 nt, Human
uuuccuauaccauuuc

SEQ ID NO: 3464201 - RNA, 16 nt, Human
uuuccuauaugaugau

SEQ ID NO: 3464202 - RNA, 15 nt, Human
uuuccuaugggaaca

SEQ ID NO: 3464203 - RNA, 17 nt, Human
uuuccuaugggaacaau

SEQ ID NO: 3464204 - RNA, 22 nt, Human
uuuccucaaaacuucagacaua

SEQ ID NO: 3464205 - RNA, 18 nt, Human
uuuccucauuuuuauaau

SEQ ID NO: 3464206 - RNA, 12 nt, Human
uuuccuccccag

SEQ ID NO: 3464207 - RNA, 16 nt, Human
uuuccuccccagcagg

SEQ ID NO: 3464208 - RNA, 20 nt, Human
uuuccucccucugccccucc

SEQ ID NO: 3464209 - RNA, 11 nt, Human
uuuccucccuu

SEQ ID NO: 3464210 - RNA, 20 nt, Human
uuuccucccuucugcuacug

SEQ ID NO: 3464211 - RNA, 16 nt, Human
uuuccuccuuuaucac

SEQ ID NO: 3464212 - RNA, 18 nt, Human
uuuccucuauacaucucu

SEQ ID NO: 3464213 - RNA, 19 nt, Human
uuuccucuauugauguaca

SEQ ID NO: 3464214 - RNA, 22 nt, Human
uuuccucucuuuguucucagcu

SEQ ID NO: 3464215 - RNA, 22 nt, Human
uuuccucuuagucgagccaagu

SEQ ID NO: 3464216 - RNA, 21 nt, Human
uuuccucuucuauuuuguaaa

SEQ ID NO: 3464217 - RNA, 22 nt, Human
uuuccucuucuauuuuguaaac

SEQ ID NO: 3464218 - RNA, 12 nt, Human
uuuccucuugug

SEQ ID NO: 3464219 - RNA, 20 nt, Human
uuuccugauagcauaugaca

SEQ ID NO: 3464220 - RNA, 16 nt, Human
uuuccugccuucuucu

SEQ ID NO: 3464221 - RNA, 22 nt, Human
uuuccugccuuuuaguuccugu

SEQ ID NO: 3464222 - RNA, 22 nt, Human
uuuccuggguggcuacucugug

SEQ ID NO: 3464223 - RNA, 14 nt, Human
uuuccuggugccaa

SEQ ID NO: 3464224 - RNA, 19 nt, Human
uuuccuguagccuucugua

SEQ ID NO: 3464225 - RNA, 22 nt, Human
uuuccuguggcauaaauugcau

SEQ ID NO: 3464226 - RNA, 22 nt, Human
uuuccugugucagcgccuggcc

SEQ ID NO: 3464227 - RNA, 15 nt, Human
uuuccuguucagcau

SEQ ID NO: 3464228 - RNA, 18 nt, Human
uuuccuguucagcauucu

SEQ ID NO: 3464229 - RNA, 17 nt, Human
uuuccuguuucugaaaa

SEQ ID NO: 3464230 - RNA, 21 nt, Human
uuuccuguuuuuguuaacuuu

SEQ ID NO: 3464231 - RNA, 19 nt, Human
uuuccuuaaauuaucuaaa

SEQ ID NO: 3464232 - RNA, 23 nt, Human
uuuccuuaaauuaucuaaaaucu

SEQ ID NO: 3464233 - RNA, 13 nt, Human
uuuccuuaccuuu

SEQ ID NO: 3464234 - RNA, 18 nt, Human
uuuccuucaaaguuuaau

SEQ ID NO: 3464235 - RNA, 13 nt, Human
uuuccuucagugc

SEQ ID NO: 3464236 - RNA, 15 nt, Human
uuuccuucagugccu

SEQ ID NO: 3464237 - RNA, 15 nt, Human
uuuccuuccagccca

SEQ ID NO: 3464238 - RNA, 14 nt, Human
uuuccuuccauccc

SEQ ID NO: 3464239 - RNA, 15 nt, Human
uuuccuuccaucccu

SEQ ID NO: 3464240 - RNA, 14 nt, Human
uuuccuucccuuuu

SEQ ID NO: 3464241 - RNA, 18 nt, Human
uuuccuucccuuuucugu

SEQ ID NO: 3464242 - RNA, 12 nt, Human
uuuccuuccuaa

SEQ ID NO: 3464243 - RNA, 18 nt, Human
uuuccuucucaucuguga

SEQ ID NO: 3464244 - RNA, 13 nt, Human
uuuccuugaagcc

SEQ ID NO: 3464245 - RNA, 19 nt, Human
uuuccuugcauacaaacaa

SEQ ID NO: 3464246 - RNA, 12 nt, Human
uuuccuugcuca

SEQ ID NO: 3464247 - RNA, 18 nt, Human
uuuccuuguggcagagga

SEQ ID NO: 3464248 - RNA, 21 nt, Human
uuuccuuguggcagaggaugu

SEQ ID NO: 3464249 - RNA, 19 nt, Human
uuuccuuguuuaucagaua

SEQ ID NO: 3464250 - RNA, 17 nt, Human
uuuccuuuaauaugaaa

SEQ ID NO: 3464251 - RNA, 13 nt, Human
uuuccuuuaugug

SEQ ID NO: 3464252 - RNA, 14 nt, Human
uuuccuuuauguga

SEQ ID NO: 3464253 - RNA, 19 nt, Human
uuuccuuucauuuacugug

SEQ ID NO: 3464254 - RNA, 16 nt, Human
uuuccuuugucaucau

SEQ ID NO: 3464255 - RNA, 14 nt, Human
uuuccuuuguccuu

SEQ ID NO: 3464256 - RNA, 21 nt, Human
uuuccuuuuuaaggucuuuca

SEQ ID NO: 3464257 - RNA, 13 nt, Human
uuuccuuuuuaau

SEQ ID NO: 3464258 - RNA, 22 nt, Human
uuuccuuuuuaauaugcuuaaa

SEQ ID NO: 3464259 - RNA, 21 nt, Human
uuuccuuuuuuaaaaaugcaa

SEQ ID NO: 3464260 - RNA, 22 nt, Human
uuuccuuuuuuauacacauaau

SEQ ID NO: 3464261 - RNA, 16 nt, Human
uuuccuuuuuuguuau

SEQ ID NO: 3464262 - RNA, 14 nt, Human
uuucgaaaaucaaa

SEQ ID NO: 3464263 - RNA, 16 nt, Human
uuucgaagucauuaaa

SEQ ID NO: 3464264 - RNA, 19 nt, Human
uuucgacuugcauuuuugc

SEQ ID NO: 3464265 - RNA, 15 nt, Human
uuucgagaagcugcu

SEQ ID NO: 3464266 - RNA, 20 nt, Human
uuucgauaaacaacaaggug

SEQ ID NO: 3464267 - RNA, 19 nt, Human
uuucgccguugaagaggaa

SEQ ID NO: 3464268 - RNA, 18 nt, Human
uuucggacaguuuauuug

SEQ ID NO: 3464269 - RNA, 16 nt, Human
uuucguaacacagcau

SEQ ID NO: 3464270 - RNA, 13 nt, Human
uuucguaugaaaa

SEQ ID NO: 3464271 - RNA, 15 nt, Human
uuucgugagccccau

SEQ ID NO: 3464272 - RNA, 18 nt, Human
uuucgugagccccaucuu

SEQ ID NO: 3464273 - RNA, 13 nt, Human
uuucguggcuuca

SEQ ID NO: 3464274 - RNA, 12 nt, Human
uuucguuuguuu

SEQ ID NO: 3464275 - RNA, 15 nt, Human
uuucuaaaaagauua

SEQ ID NO: 3464276 - RNA, 15 nt, Human
uuucuaaaaagucag

SEQ ID NO: 3464277 - RNA, 17 nt, Human
uuucuaaaaagucagau

SEQ ID NO: 3464278 - RNA, 19 nt, Human
uuucuaaaacuaaauagca

SEQ ID NO: 3464279 - RNA, 15 nt, Human
uuucuaaaagaauau

SEQ ID NO: 3464280 - RNA, 13 nt, Human
uuucuaaaagacu

SEQ ID NO: 3464281 - RNA, 13 nt, Human
uuucuaaacaaga

SEQ ID NO: 3464282 - RNA, 17 nt, Human
uuucuaaacaagauuuu

SEQ ID NO: 3464283 - RNA, 15 nt, Human
uuucuaaacuggaga

SEQ ID NO: 3464284 - RNA, 12 nt, Human
uuucuaaagacu

SEQ ID NO: 3464285 - RNA, 12 nt, Human
uuucuaaaguaa

SEQ ID NO: 3464286 - RNA, 14 nt, Human
uuucuaaaguacug

SEQ ID NO: 3464287 - RNA, 13 nt, Human
uuucuaaauguuu

SEQ ID NO: 3464288 - RNA, 21 nt, Human
uuucuaacaaaaaaauauauu

SEQ ID NO: 3464289 - RNA, 22 nt, Human
uuucuaacacuagucugugugc

SEQ ID NO: 3464290 - RNA, 15 nt, Human
uuucuaaccuugaau

SEQ ID NO: 3464291 - RNA, 23 nt, Human
uuucuaaccuugaaugcugccag

SEQ ID NO: 3464292 - RNA, 13 nt, Human
uuucuaagauucu

SEQ ID NO: 3464293 - RNA, 18 nt, Human
uuucuaagauucuaaagg

SEQ ID NO: 3464294 - RNA, 20 nt, Human
uuucuaagcauaaaagauga

SEQ ID NO: 3464295 - RNA, 19 nt, Human
uuucuaauuggcuuuacua

SEQ ID NO: 3464296 - RNA, 14 nt, Human
uuucuaauuugcug

SEQ ID NO: 3464297 - RNA, 17 nt, Human
uuucuaauuugcugcug

SEQ ID NO: 3464298 - RNA, 23 nt, Human
uuucuacaaagcacuagagaaug

SEQ ID NO: 3464299 - RNA, 18 nt, Human
uuucuacaaugugaacuu

SEQ ID NO: 3464300 - RNA, 15 nt, Human
uuucuacagcaaauu

SEQ ID NO: 3464301 - RNA, 17 nt, Human
uuucuaccuuaaaggga

SEQ ID NO: 3464302 - RNA, 16 nt, Human
uuucuaccuugagguc

SEQ ID NO: 3464303 - RNA, 19 nt, Human
uuucuacuuguuauaaacu

SEQ ID NO: 3464304 - RNA, 17 nt, Human
uuucuagaaagaauaaa

SEQ ID NO: 3464305 - RNA, 13 nt, Human
uuucuagaaagag

SEQ ID NO: 3464306 - RNA, 20 nt, Human
uuucuagaaguuucccuucc

SEQ ID NO: 3464307 - RNA, 12 nt, Human
uauucucuuugg

SEQ ID NO: 3464308 - RNA, 13 nt, Human
uauucucuuuuca

SEQ ID NO: 3464309 - RNA, 17 nt, Human
uauucugagaaaacaag

SEQ ID NO: 3464310 - RNA, 15 nt, Human
uauucugagaugacu

SEQ ID NO: 3464311 - RNA, 23 nt, Human
uauucugagcauacucaacaaaa

SEQ ID NO: 3464312 - RNA, 19 nt, Human
uauucugggaauguauagu

SEQ ID NO: 3464313 - RNA, 23 nt, Human
uauucugggaauguauaguauuu

SEQ ID NO: 3464314 - RNA, 19 nt, Human
uauucugggggcugcaguu

SEQ ID NO: 3464315 - RNA, 18 nt, Human
uauucugggguauggcgu

SEQ ID NO: 3464316 - RNA, 11 nt, Human
uauucuguccc

SEQ ID NO: 3464317 - RNA, 12 nt, Human
uauucugucccu

SEQ ID NO: 3464318 - RNA, 17 nt, Human
uauucuuaaaaugcaau

SEQ ID NO: 3464319 - RNA, 21 nt, Human
uauucuuaaaaugcaauauuu

SEQ ID NO: 3464320 - RNA, 14 nt, Human
uauucuuauucaaa

SEQ ID NO: 3464321 - RNA, 17 nt, Human
uauucuucuagaguuca

SEQ ID NO: 3464322 - RNA, 14 nt, Human
uauucuugaaagaa

SEQ ID NO: 3464323 - RNA, 19 nt, Human
uauucuugaucaguaguuu

SEQ ID NO: 3464324 - RNA, 18 nt, Human
uauucuuugauguuaaca

SEQ ID NO: 3464325 - RNA, 14 nt, Human
uauucuuugcacuu

SEQ ID NO: 3464326 - RNA, 13 nt, Human
uauucuuuucuca

SEQ ID NO: 3464327 - RNA, 15 nt, Human
uauugaaaaaaauug

SEQ ID NO: 3464328 - RNA, 19 nt, Human
uauugaaaauugaaaagua

SEQ ID NO: 3464329 - RNA, 21 nt, Human
uauugaaauauuauagagagu

SEQ ID NO: 3464330 - RNA, 16 nt, Human
uauugaaaugauuuca

SEQ ID NO: 3464331 - RNA, 18 nt, Human
uauugaacuuggaaagaa

SEQ ID NO: 3464332 - RNA, 19 nt, Human
uauugaacuuuuguacuga

SEQ ID NO: 3464333 - RNA, 21 nt, Human
uauugaagacaauuugauaca

SEQ ID NO: 3464334 - RNA, 20 nt, Human
uauugaagcagaguggcagu

SEQ ID NO: 3464335 - RNA, 12 nt, Human
uauugaagcauu

SEQ ID NO: 3464336 - RNA, 15 nt, Human
uauugaagcauuuua

SEQ ID NO: 3464337 - RNA, 20 nt, Human
uauugaaggaagccaaauuu

SEQ ID NO: 3464338 - RNA, 20 nt, Human
uauugaauacuuacauucuc

SEQ ID NO: 3464339 - RNA, 21 nt, Human
uauugaauauaauauauuugu

SEQ ID NO: 3464340 - RNA, 15 nt, Human
uauugaauauugugu

SEQ ID NO: 3464341 - RNA, 18 nt, Human
uauugaauauuuuauauu

SEQ ID NO: 3464342 - RNA, 18 nt, Human
uauugaaucauguaguau

SEQ ID NO: 3464343 - RNA, 11 nt, Human
uauugaaucua

SEQ ID NO: 3464344 - RNA, 18 nt, Human
uauugaauucauuucacu

SEQ ID NO: 3464345 - RNA, 13 nt, Human
uugagaccagccu

SEQ ID NO: 3464346 - RNA, 22 nt, Human
uugagaccgugaagauacuuug

SEQ ID NO: 3464347 - RNA, 18 nt, Human
uugagaccuacaggcuga

SEQ ID NO: 3464348 - RNA, 15 nt, Human
uugagaccucagcca

SEQ ID NO: 3464349 - RNA, 14 nt, Human
uugagacuaguuuu

SEQ ID NO: 3464350 - RNA, 16 nt, Human
uugagacuauuuaaac

SEQ ID NO: 3464351 - RNA, 23 nt, Human
uugagacuauuuaaacuuauaaa

SEQ ID NO: 3464352 - RNA, 23 nt, Human
uugagacuuuuugguggauguaa

SEQ ID NO: 3464353 - RNA, 18 nt, Human
uugagagagauguguaau

SEQ ID NO: 3464354 - RNA, 21 nt, Human
uugagagagauguguaauuuu

SEQ ID NO: 3464355 - RNA, 12 nt, Human
uugagagagcaa

SEQ ID NO: 3464356 - RNA, 19 nt, Human
uugagaggcccugggguuc

SEQ ID NO: 3464357 - RNA, 18 nt, Human
uugagauacuuuuucuuu

SEQ ID NO: 3464358 - RNA, 23 nt, Human
uugagauacuuuuucuuuuguaa

SEQ ID NO: 3464359 - RNA, 22 nt, Human
uugagauaguuuucauccauaa

SEQ ID NO: 3464360 - RNA, 22 nt, Human
uugagauggggauaaaaugacu

SEQ ID NO: 3464361 - RNA, 17 nt, Human
uugagauguauuucaac

SEQ ID NO: 3464362 - RNA, 20 nt, Human
uugagauugccccaggucug

SEQ ID NO: 3464363 - RNA, 18 nt, Human
uugagcaacuuucuuaca

SEQ ID NO: 3464364 - RNA, 22 nt, Human
uugagcacuuuucaaacaauca

SEQ ID NO: 3464365 - RNA, 22 nt, Human
uugagcaguggccuacaaauca

SEQ ID NO: 3464366 - RNA, 16 nt, Human
uugagcaucacagaau

SEQ ID NO: 3464367 - RNA, 13 nt, Human
uugagccagcaga

SEQ ID NO: 3464368 - RNA, 17 nt, Human
uugagccagcagacauu

SEQ ID NO: 3464369 - RNA, 18 nt, Human
uugagccagcagacauug

SEQ ID NO: 3464370 - RNA, 13 nt, Human
uugagcccaggag

SEQ ID NO: 3464371 - RNA, 14 nt, Human
uugagccccaaguc

SEQ ID NO: 3464372 - RNA, 14 nt, Human
uugagcccuggcug

SEQ ID NO: 3464373 - RNA, 19 nt, Human
uugagccgggccccugggc

SEQ ID NO: 3464374 - RNA, 14 nt, Human
uugagccuaaaaau

SEQ ID NO: 3464375 - RNA, 17 nt, Human
uugagccuaaaaauaaa

SEQ ID NO: 3464376 - RNA, 19 nt, Human
uugagccuugaacuuugac

SEQ ID NO: 3464377 - RNA, 20 nt, Human
uugagcuacuggauucuuau

SEQ ID NO: 3464378 - RNA, 11 nt, Human
uugagcuauga

SEQ ID NO: 3464379 - RNA, 16 nt, Human
uugagcuaugacuuaa

SEQ ID NO: 3464380 - RNA, 23 nt, Human
uugagcucagacccccacucuca

SEQ ID NO: 3464381 - RNA, 14 nt, Human
uugagcugaaaugc

SEQ ID NO: 3464382 - RNA, 16 nt, Human
uugagcugauauaaau

SEQ ID NO: 3464383 - RNA, 16 nt, Human
uugagcugccuucccu

SEQ ID NO: 3464384 - RNA, 18 nt, Human
uugagcugcuuuuuuuga

SEQ ID NO: 3464385 - RNA, 12 nt, Human
uugagcuggccu

SEQ ID NO: 3464386 - RNA, 18 nt, Human
uugagcuuggcagcugaa

SEQ ID NO: 3464387 - RNA, 21 nt, Human
uugagcuuuccauguugcugc

SEQ ID NO: 3464388 - RNA, 15 nt, Human
uugaggaaaaauaug

SEQ ID NO: 3464389 - RNA, 17 nt, Human
uugaggaaaaauaugug

SEQ ID NO: 3464390 - RNA, 21 nt, Human
uugaggaaaaauaugugaagg

SEQ ID NO: 3464391 - RNA, 13 nt, Human
uugaggaaaacaa

SEQ ID NO: 3464392 - RNA, 15 nt, Human
uugaggaaagcaaga

SEQ ID NO: 3464393 - RNA, 17 nt, Human
uugaggaaauuugcagc

SEQ ID NO: 3464394 - RNA, 13 nt, Human
uugaggacacaug

SEQ ID NO: 3464395 - RNA, 15 nt, Human
uugaggacacauguc

SEQ ID NO: 3464396 - RNA, 16 nt, Human
uugaggacacaugucc

SEQ ID NO: 3464397 - RNA, 16 nt, Human
uugaggagcacugaaa

SEQ ID NO: 3464398 - RNA, 19 nt, Human
uugaggagcagcuucaguu

SEQ ID NO: 3464399 - RNA, 23 nt, Human
uugaggagcauguuuuguauaca

SEQ ID NO: 3464400 - RNA, 12 nt, Human
uugaggagcccc

SEQ ID NO: 3464401 - RNA, 13 nt, Human
uugaggcaagugu

SEQ ID NO: 3464402 - RNA, 13 nt, Human
uugaggccaggag

SEQ ID NO: 3464403 - RNA, 14 nt, Human
uugaggcuuugugu

SEQ ID NO: 3464404 - RNA, 17 nt, Human
uugaggcuuuguguugu

SEQ ID NO: 3464405 - RNA, 20 nt, Human
uugagggacgcuuugucugu

SEQ ID NO: 3464406 - RNA, 21 nt, Human
uugagggacgcuuugucuguc

SEQ ID NO: 3464407 - RNA, 18 nt, Human
uugagggacugccucugc

SEQ ID NO: 3464408 - RNA, 15 nt, Human
uugagggcccagagc

SEQ ID NO: 3464409 - RNA, 16 nt, Human
uugagggcccagagca

SEQ ID NO: 3464410 - RNA, 15 nt, Human
uugagggcugcaguu

SEQ ID NO: 3464411 - RNA, 19 nt, Human
uugaggggagagggaacgg

SEQ ID NO: 3464412 - RNA, 15 nt, Human
uugaggggauuaaua

SEQ ID NO: 3464413 - RNA, 22 nt, Human
uugaggggauuaauaugaaaac

SEQ ID NO: 3464414 - RNA, 22 nt, Human
uugaggggcuggccuuccugcc

SEQ ID NO: 3464415 - RNA, 18 nt, Human
uugaggguaauaaacuua

SEQ ID NO: 3464416 - RNA, 13 nt, Human
uugaggguugggc

SEQ ID NO: 3464417 - RNA, 18 nt, Human
uugaggucuuuugacaug

SEQ ID NO: 3464418 - RNA, 19 nt, Human
uugagguggaagcccuccu

SEQ ID NO: 3464419 - RNA, 14 nt, Human
uugaguaaaauaaa

SEQ ID NO: 3464420 - RNA, 20 nt, Human
uugaguagauauuacuuuau

SEQ ID NO: 3464421 - RNA, 18 nt, Human
uugaguauauuauaauag

SEQ ID NO: 3464422 - RNA, 20 nt, Human
uugaguauuguuuaaaaugu

SEQ ID NO: 3464423 - RNA, 22 nt, Human
uugagucauuauccuugcuaug

SEQ ID NO: 3464424 - RNA, 17 nt, Human
uugagucuguacuaaac

SEQ ID NO: 3464425 - RNA, 14 nt, Human
uugagucugugcca

SEQ ID NO: 3464426 - RNA, 15 nt, Human
uugagucuguuuugu

SEQ ID NO: 3464427 - RNA, 22 nt, Human
uugagucuguuuuuuuauaguu

SEQ ID NO: 3464428 - RNA, 14 nt, Human
uugagugacucgag

SEQ ID NO: 3464429 - RNA, 20 nt, Human
uugagugacucgaggguugg

SEQ ID NO: 3464430 - RNA, 15 nt, Human
uugagugcucugauc

SEQ ID NO: 3464431 - RNA, 13 nt, Human
uugaguguuuaaa

SEQ ID NO: 3464432 - RNA, 18 nt, Human
uugaguucuuccuguaau

SEQ ID NO: 3464433 - RNA, 18 nt, Human
uugaguuguuuuuguaua

SEQ ID NO: 3464434 - RNA, 20 nt, Human
uugaguuuguagguaaaaug

SEQ ID NO: 3464435 - RNA, 23 nt, Human
uugaguuugucgcucaugugugc

SEQ ID NO: 3464436 - RNA, 18 nt, Human
uugaguuuucuucuguga

SEQ ID NO: 3464437 - RNA, 19 nt, Human
uugaguuuucuucugugau

SEQ ID NO: 3464438 - RNA, 21 nt, Human
uugaguuuuguuuuaaaauua

SEQ ID NO: 3464439 - RNA, 20 nt, Human
uugauaaaguaguaaaaauu

SEQ ID NO: 3464440 - RNA, 12 nt, Human
uugauaaaguuu

SEQ ID NO: 3464441 - RNA, 22 nt, Human
uugauaaauaguguuauugaga

SEQ ID NO: 3464442 - RNA, 18 nt, Human
uugauaaaucauuuuaug

SEQ ID NO: 3464443 - RNA, 21 nt, Human
uugauaaaucauuuuauguca

SEQ ID NO: 3464444 - RNA, 18 nt, Human
uugauaaauuccacugga

SEQ ID NO: 3464445 - RNA, 13 nt, Human
uugauaacagcua

SEQ ID NO: 3464446 - RNA, 22 nt, Human
uugauaacagggauugauuuua

SEQ ID NO: 3464447 - RNA, 22 nt, Human
uugauaagagggcacacacugu

SEQ ID NO: 3464448 - RNA, 16 nt, Human
uugauaagaucuuuua

SEQ ID NO: 3464449 - RNA, 16 nt, Human
uugauaaguucauaca

SEQ ID NO: 3464450 - RNA, 17 nt, Human
uugauaauaaauugaaa

SEQ ID NO: 3464451 - RNA, 19 nt, Human
uugauaauaaauugaaauu

SEQ ID NO: 3464452 - RNA, 15 nt, Human
uugcuuuuucugacu

SEQ ID NO: 3464453 - RNA, 15 nt, Human
uugcuuuuuuccaaa

SEQ ID NO: 3464454 - RNA, 17 nt, Human
uugcuuuuuuuuccuuc

SEQ ID NO: 3464455 - RNA, 15 nt, Human
uuggaaacacuaaau

SEQ ID NO: 3464456 - RNA, 16 nt, Human
uuggaaacacuaaaug

SEQ ID NO: 3464457 - RNA, 19 nt, Human
uuggaaacacuaaauguua

SEQ ID NO: 3464458 - RNA, 15 nt, Human
uuggaaaccugcccu

SEQ ID NO: 3464459 - RNA, 16 nt, Human
uuggaaacuaauaaaa

SEQ ID NO: 3464460 - RNA, 19 nt, Human
uuggaaacuaauaaaauau

SEQ ID NO: 3464461 - RNA, 18 nt, Human
uuggaaagaguaggaaga

SEQ ID NO: 3464462 - RNA, 17 nt, Human
uuggaaaguacacucug

SEQ ID NO: 3464463 - RNA, 14 nt, Human
uuggaaauauuaaa

SEQ ID NO: 3464464 - RNA, 17 nt, Human
uuggaaauauuaaaaga

SEQ ID NO: 3464465 - RNA, 13 nt, Human
uuggaaauauuca

SEQ ID NO: 3464466 - RNA, 21 nt, Human
uuggaaaucaaauguaaaguu

SEQ ID NO: 3464467 - RNA, 15 nt, Human
uuggaaaucuuuaaa

SEQ ID NO: 3464468 - RNA, 18 nt, Human
uuggaaauuuagcauugu

SEQ ID NO: 3464469 - RNA, 13 nt, Human
uuggaaauuucac

SEQ ID NO: 3464470 - RNA, 15 nt, Human
uuggaaauuuguuau

SEQ ID NO: 3464471 - RNA, 16 nt, Human
uuggaacaaagugaag

SEQ ID NO: 3464472 - RNA, 19 nt, Human
uuggaacaguaaucaguuu

SEQ ID NO: 3464473 - RNA, 20 nt, Human
uuggaacaguaaucaguuug

SEQ ID NO: 3464474 - RNA, 14 nt, Human
uuggaaccagacuc

SEQ ID NO: 3464475 - RNA, 16 nt, Human
uuggaacuggaggcag

SEQ ID NO: 3464476 - RNA, 22 nt, Human
uuggaagaaaaaaaucuucucc

SEQ ID NO: 3464477 - RNA, 20 nt, Human
uuggaagaccccacccaagc

SEQ ID NO: 3464478 - RNA, 13 nt, Human
uuggaagagaauc

SEQ ID NO: 3464479 - RNA, 17 nt, Human
uuggaagagcagcaccu

SEQ ID NO: 3464480 - RNA, 21 nt, Human
uuggaagagcagcaccuccuc

SEQ ID NO: 3464481 - RNA, 18 nt, Human
uuggaagcagguuaaaug

SEQ ID NO: 3464482 - RNA, 20 nt, Human
uuggaagcagguuaaauguu

SEQ ID NO: 3464483 - RNA, 21 nt, Human
uuggaagcagguuaaauguuu

SEQ ID NO: 3464484 - RNA, 21 nt, Human
uuggaagcuagcuccccuccu

SEQ ID NO: 3464485 - RNA, 23 nt, Human
uuggaagcuagcuccccuccucu

SEQ ID NO: 3464486 - RNA, 17 nt, Human
uuggaagcucugaaguc

SEQ ID NO: 3464487 - RNA, 21 nt, Human
uuggaagcuguuuggaaaaga

SEQ ID NO: 3464488 - RNA, 19 nt, Human
uuggaaggagacacagaug

SEQ ID NO: 3464489 - RNA, 20 nt, Human
uuggaagggcuuuucaaaau

SEQ ID NO: 3464490 - RNA, 20 nt, Human
uuggaagugaaaacuuugua

SEQ ID NO: 3464491 - RNA, 19 nt, Human
uuggaaguuuagcucugag

SEQ ID NO: 3464492 - RNA, 20 nt, Human
uuggaaguuuagcucugaga

SEQ ID NO: 3464493 - RNA, 16 nt, Human
uuggaaguuuucagga

SEQ ID NO: 3464494 - RNA, 15 nt, Human
uuggaauaggaauaa

SEQ ID NO: 3464495 - RNA, 17 nt, Human
uuggaauauuaaaaaac

SEQ ID NO: 3464496 - RNA, 23 nt, Human
uuggaauauuaaaaaacuucaug

SEQ ID NO: 3464497 - RNA, 23 nt, Human
uuggaaucuagaagaaaugaaau

SEQ ID NO: 3464498 - RNA, 16 nt, Human
uuggaaugcuucuucu

SEQ ID NO: 3464499 - RNA, 17 nt, Human
uuggaauguucucagau

SEQ ID NO: 3464500 - RNA, 15 nt, Human
uuggaauuaaaacaa

SEQ ID NO: 3464501 - RNA, 18 nt, Human
uuggaauuaaaacaaugu

SEQ ID NO: 3464502 - RNA, 18 nt, Human
uuggaauuaaccuggugc

SEQ ID NO: 3464503 - RNA, 20 nt, Human
uuggaauuaaccuggugcug

SEQ ID NO: 3464504 - RNA, 17 nt, Human
uuggaauucgcuuucua

SEQ ID NO: 3464505 - RNA, 13 nt, Human
uuggacaaaauga

SEQ ID NO: 3464506 - RNA, 17 nt, Human
uuggacaaccucauuuu

SEQ ID NO: 3464507 - RNA, 16 nt, Human
uuggacaacugcaugg

SEQ ID NO: 3464508 - RNA, 16 nt, Human
uuggacacacacagcu

SEQ ID NO: 3464509 - RNA, 17 nt, Human
uuggacacacacagcuu

SEQ ID NO: 3464510 - RNA, 22 nt, Human
uuggacagcaaaaccauugcuu

SEQ ID NO: 3464511 - RNA, 15 nt, Human
uuggacaguuuacca

SEQ ID NO: 3464512 - RNA, 22 nt, Human
uuggacauaacugacuuaguuc

SEQ ID NO: 3464513 - RNA, 14 nt, Human
uuggacauccuccu

SEQ ID NO: 3464514 - RNA, 17 nt, Human
uuggacauuuuaugucu

SEQ ID NO: 3464515 - RNA, 18 nt, Human
uuggacauuuuaugucuu

SEQ ID NO: 3464516 - RNA, 14 nt, Human
uuggaccagaucua

SEQ ID NO: 3464517 - RNA, 15 nt, Human
uuggacccaaggaaa

SEQ ID NO: 3464518 - RNA, 14 nt, Human
uuggaccccagaga

SEQ ID NO: 3464519 - RNA, 15 nt, Human
uuggaccccagcugg

SEQ ID NO: 3464520 - RNA, 16 nt, Human
uuggaccccagcuggg

SEQ ID NO: 3464521 - RNA, 17 nt, Human
uuggaccccagcuggga

SEQ ID NO: 3464522 - RNA, 19 nt, Human
uuggaccccagcugggagg

SEQ ID NO: 3464523 - RNA, 22 nt, Human
uuggaccccagcugggaggcaa

SEQ ID NO: 3464524 - RNA, 17 nt, Human
uuggacccgcucuggac

SEQ ID NO: 3464525 - RNA, 19 nt, Human
uuggacccugaggcccaga

SEQ ID NO: 3464526 - RNA, 14 nt, Human
uuggacccuuccau

SEQ ID NO: 3464527 - RNA, 23 nt, Human
uuggaccuaaauggccucaugug

SEQ ID NO: 3464528 - RNA, 13 nt, Human
uuggaccucugcu

SEQ ID NO: 3464529 - RNA, 14 nt, Human
uuggaccucugcuc

SEQ ID NO: 3464530 - RNA, 17 nt, Human
uuggacgcacacagcuu

SEQ ID NO: 3464531 - RNA, 17 nt, Human
uuggacggcugggcaca

SEQ ID NO: 3464532 - RNA, 20 nt, Human
uuggacuucaaagcaagcug

SEQ ID NO: 3464533 - RNA, 16 nt, Human
uuggacuugucccggg

SEQ ID NO: 3464534 - RNA, 14 nt, Human
uuggacuuucaaaa

SEQ ID NO: 3464535 - RNA, 22 nt, Human
uuggacuuuucguuaacauuga

SEQ ID NO: 3464536 - RNA, 16 nt, Human
uuggagaagucucagc

SEQ ID NO: 3464537 - RNA, 18 nt, Human
uuggagacacaacuauuu

SEQ ID NO: 3464538 - RNA, 20 nt, Human
uuggagacacaacuauuuuu

SEQ ID NO: 3464539 - RNA, 22 nt, Human
uuggagacccugcaaacagaac

SEQ ID NO: 3464540 - RNA, 23 nt, Human
uuggagacccugcaaacagaaca

SEQ ID NO: 3464541 - RNA, 15 nt, Human
uuggagacucugugg

SEQ ID NO: 3464542 - RNA, 22 nt, Human
uuggagacugucuggccccccu

SEQ ID NO: 3464543 - RNA, 22 nt, Human
uuggagagcuagaaccuggaga

SEQ ID NO: 3464544 - RNA, 13 nt, Human
uuggagaguaaaa

SEQ ID NO: 3464545 - RNA, 17 nt, Human
uuggagaguaaaaacug

SEQ ID NO: 3464546 - RNA, 16 nt, Human
uuggagaguuuccuga

SEQ ID NO: 3464547 - RNA, 15 nt, Human
uuggagcacaaaauu

SEQ ID NO: 3464548 - RNA, 13 nt, Human
uuggagccugcag

SEQ ID NO: 3464549 - RNA, 18 nt, Human
uuggagccugcagagcug

SEQ ID NO: 3464550 - RNA, 22 nt, Human
uuugucaucagauggaaauauu

SEQ ID NO: 3464551 - RNA, 22 nt, Human
uuugucaugcugggauuuccaa

SEQ ID NO: 3464552 - RNA, 23 nt, Human
uuugucauuagccugaguagaaa

SEQ ID NO: 3464553 - RNA, 12 nt, Human
uuugucauucag

SEQ ID NO: 3464554 - RNA, 13 nt, Human
uuugucauucaga

SEQ ID NO: 3464555 - RNA, 15 nt, Human
uuugucauuuucauu

SEQ ID NO: 3464556 - RNA, 19 nt, Human
uuugucauuuugaagcuaa

SEQ ID NO: 3464557 - RNA, 15 nt, Human
uuuguccauuuguaa

SEQ ID NO: 3464558 - RNA, 16 nt, Human
uuugucccaagugcca

SEQ ID NO: 3464559 - RNA, 12 nt, Human
uuugucccaggu

SEQ ID NO: 3464560 - RNA, 16 nt, Human
uuugucccccaacuug

SEQ ID NO: 3464561 - RNA, 18 nt, Human
uuugucccccaacuugag

SEQ ID NO: 3464562 - RNA, 13 nt, Human
uuugucuaagaaa

SEQ ID NO: 3464563 - RNA, 20 nt, Human
uuugucuaagaaacauugga

SEQ ID NO: 3464564 - RNA, 22 nt, Human
uuugucucagaagugaaaaucu

SEQ ID NO: 3464565 - RNA, 13 nt, Human
uuugucucuccuu

SEQ ID NO: 3464566 - RNA, 22 nt, Human
uuugucucuccuuuucuuuugu

SEQ ID NO: 3464567 - RNA, 14 nt, Human
uuugucucuucugg

SEQ ID NO: 3464568 - RNA, 14 nt, Human
uuugucuuaaaaag

SEQ ID NO: 3464569 - RNA, 23 nt, Human
uuugucuuaaaaaguggaaaaau

SEQ ID NO: 3464570 - RNA, 14 nt, Human
uuugucuuauauau

SEQ ID NO: 3464571 - RNA, 19 nt, Human
uuugucuuauauauauuuc

SEQ ID NO: 3464572 - RNA, 20 nt, Human
uuugucuuauauauauuucu

SEQ ID NO: 3464573 - RNA, 17 nt, Human
uuugucuuuuaaugcuu

SEQ ID NO: 3464574 - RNA, 18 nt, Human
uuugugaaacagacuugu

SEQ ID NO: 3464575 - RNA, 22 nt, Human
uuugugaaaugauggugaaagu

SEQ ID NO: 3464576 - RNA, 20 nt, Human
uuugugaaauuuuucauauu

SEQ ID NO: 3464577 - RNA, 21 nt, Human
uuugugaaauuuuucauauuu

SEQ ID NO: 3464578 - RNA, 20 nt, Human
uuugugaacucagccaagca

SEQ ID NO: 3464579 - RNA, 17 nt, Human
uuugugaagcccuguug

SEQ ID NO: 3464580 - RNA, 18 nt, Human
uuugugaaggugauuuau

SEQ ID NO: 3464581 - RNA, 23 nt, Human
uuugugaagugaaggauuugugu

SEQ ID NO: 3464582 - RNA, 16 nt, Human
uuugugaaucuuugug

SEQ ID NO: 3464583 - RNA, 19 nt, Human
uuugugaauggauuggauu

SEQ ID NO: 3464584 - RNA, 22 nt, Human
uuugugacuaauuguauaacag

SEQ ID NO: 3464585 - RNA, 18 nt, Human
uuugugauggagugcugu

SEQ ID NO: 3464586 - RNA, 19 nt, Human
uuugugauggagugcuguu

SEQ ID NO: 3464587 - RNA, 16 nt, Human
uuugugauguacugua

SEQ ID NO: 3464588 - RNA, 15 nt, Human
uuugugauucaaucu

SEQ ID NO: 3464589 - RNA, 21 nt, Human
uuugugauucuuccagaugug

SEQ ID NO: 3464590 - RNA, 22 nt, Human
uuugugcauuaucuagauacug

SEQ ID NO: 3464591 - RNA, 13 nt, Human
uuugugcauucug

SEQ ID NO: 3464592 - RNA, 14 nt, Human
uuugugcucauuua

SEQ ID NO: 3464593 - RNA, 21 nt, Human
uuugugcucauuuaaguuuca

SEQ ID NO: 3464594 - RNA, 22 nt, Human
uuugugcugaauguugggacug

SEQ ID NO: 3464595 - RNA, 20 nt, Human
uuuguggaaagucacagguc

SEQ ID NO: 3464596 - RNA, 19 nt, Human
uuuuaaagugauuaaacgu

SEQ ID NO: 3464597 - RNA, 13 nt, Human
uuuuaaagugcaa

SEQ ID NO: 3464598 - RNA, 18 nt, Human
uuuuaaaguguuucagcu

SEQ ID NO: 3464599 - RNA, 18 nt, Human
uuuuaaaguucauugcaa

SEQ ID NO: 3464600 - RNA, 11 nt, Human
uuuuaaauaaa

SEQ ID NO: 3464601 - RNA, 21 nt, Human
uuuuaaauaaaaauuacugug

SEQ ID NO: 3464602 - RNA, 15 nt, Human
uuuuaaauaaaagca

SEQ ID NO: 3464603 - RNA, 22 nt, Human
uuuuaaauaaacuuuuuuucaa

SEQ ID NO: 3464604 - RNA, 17 nt, Human
uuuuaaauauuuucuau

SEQ ID NO: 3464605 - RNA, 14 nt, Human
uuuuaaaucuaaau

SEQ ID NO: 3464606 - RNA, 11 nt, Human
uuuuaaaugca

SEQ ID NO: 3464607 - RNA, 21 nt, Human
uuuuaaaugcaccuggaauau

SEQ ID NO: 3464608 - RNA, 14 nt, Human
uuuuaaaugcaguu

SEQ ID NO: 3464609 - RNA, 20 nt, Human
uuuuaaaugcaguuacaaau

SEQ ID NO: 3464610 - RNA, 19 nt, Human
uuuuaaaugcauaaaugca

SEQ ID NO: 3464611 - RNA, 19 nt, Human
uuuuaaauggguagagaaa

SEQ ID NO: 3464612 - RNA, 16 nt, Human
uuuuaaauguauacua

SEQ ID NO: 3464613 - RNA, 22 nt, Human
uuuuaaaugugugagugcaugu

SEQ ID NO: 3464614 - RNA, 21 nt, Human
uuuuaaauuauaacuuaaaau

SEQ ID NO: 3464615 - RNA, 23 nt, Human
uuuuaaauuauaaggacugcaug

SEQ ID NO: 3464616 - RNA, 20 nt, Human
uuuuaaauucccguuuuguc

SEQ ID NO: 3464617 - RNA, 20 nt, Human
uuuuaaauucugagacaugu

SEQ ID NO: 3464618 - RNA, 24 nt, Human
uuuuaaauucugagacauguguca

SEQ ID NO: 3464619 - RNA, 12 nt, Human
uuuuaaauuguu

SEQ ID NO: 3464620 - RNA, 13 nt, Human
uuuuaaauuuuau

SEQ ID NO: 3464621 - RNA, 20 nt, Human
uuuuaaauuuucuucaguug

SEQ ID NO: 3464622 - RNA, 15 nt, Human
uuuuaaauuuuguaa

SEQ ID NO: 3464623 - RNA, 21 nt, Human
uuuuaacaagaagaugaaugg

SEQ ID NO: 3464624 - RNA, 22 nt, Human
uuuuaacaauaacuacuguguu

SEQ ID NO: 3464625 - RNA, 17 nt, Human
uuuuaacaccugaugug

SEQ ID NO: 3464626 - RNA, 14 nt, Human
uuuuaacauuuugu

SEQ ID NO: 3464627 - RNA, 19 nt, Human
uuuuaacauuuuguucuua

SEQ ID NO: 3464628 - RNA, 12 nt, Human
uuuuaaccaaag

SEQ ID NO: 3464629 - RNA, 20 nt, Human
uuuuaaccccgucaacaaau

SEQ ID NO: 3464630 - RNA, 24 nt, Human
uuuuaacuaaauuuuaaagccauu

SEQ ID NO: 3464631 - RNA, 16 nt, Human
uuuuaacuagaauuua

SEQ ID NO: 3464632 - RNA, 19 nt, Human
uuuuaacuccccuguuuca

SEQ ID NO: 3464633 - RNA, 18 nt, Human
uuuuaacuuagagcuuuu

SEQ ID NO: 3464634 - RNA, 16 nt, Human
uuuuaacuuuaaguuu

SEQ ID NO: 3464635 - RNA, 19 nt, Human
uuuuaacuuuaaguuucag

SEQ ID NO: 3464636 - RNA, 14 nt, Human
uuuuaacuuuguuu

SEQ ID NO: 3464637 - RNA, 15 nt, Human
uuuuaacuuuguuuu

SEQ ID NO: 3464638 - RNA, 13 nt, Human
uuuuaagaaaugu

SEQ ID NO: 3464639 - RNA, 19 nt, Human
uuuuaagaauugaguaaug

SEQ ID NO: 3464640 - RNA, 19 nt, Human
uuuuaagacguguuugugu

SEQ ID NO: 3464641 - RNA, 15 nt, Human
uuuuaagauagugua

SEQ ID NO: 3464642 - RNA, 18 nt, Human
uuuuaagauuccuuuucu

SEQ ID NO: 3464643 - RNA, 21 nt, Human
uuuuaagauuccuuuucuugu

SEQ ID NO: 3464644 - RNA, 17 nt, Human
uuuuaagauuuuucuca

SEQ ID NO: 3464645 - RNA, 15 nt, Human
uuuuaagcaaaauau

SEQ ID NO: 3464646 - RNA, 16 nt, Human
uuuuaagcauuacucu

SEQ ID NO: 3464647 - RNA, 22 nt, Human
uuuuaagcuguaaaaagagaga

SEQ ID NO: 3464648 - RNA, 22 nt, Human
uuuuaagggcccuuuuucaaua

SEQ ID NO: 3464649 - RNA, 17 nt, Human
uuuuaaggucuuucagu

SEQ ID NO: 3464650 - RNA, 16 nt, Human
uuuuaaguaaggaauu

SEQ ID NO: 3464651 - RNA, 14 nt, Human
uuuuaaguaaugug

SEQ ID NO: 3464652 - RNA, 21 nt, Human
uuuuaaguauugcaucuguau

SEQ ID NO: 3464653 - RNA, 15 nt, Human
uuuuaagugaaauuu

SEQ ID NO: 3464654 - RNA, 21 nt, Human
uuuuaagugcugcauuuaaaa

SEQ ID NO: 3464655 - RNA, 17 nt, Human
uuuuaagugcuuuguaa

SEQ ID NO: 3464656 - RNA, 15 nt, Human
uuuuaagugguuuga

SEQ ID NO: 3464657 - RNA, 20 nt, Human
uuuuaaguuucucugcagaa

SEQ ID NO: 3464658 - RNA, 13 nt, Human
uuuuaaguuugca

SEQ ID NO: 3464659 - RNA, 19 nt, Human
uuuuaauaaacuacucuuu

SEQ ID NO: 3464660 - RNA, 12 nt, Human
uuuuaauaaauu

SEQ ID NO: 3464661 - RNA, 13 nt, Human
uuuuaauaauguu

SEQ ID NO: 3464662 - RNA, 12 nt, Human
uuuuaauacagg

SEQ ID NO: 3464663 - RNA, 12 nt, Human
uuuuaauagaac

SEQ ID NO: 3464664 - RNA, 18 nt, Human
uuuuaauagaauaaaaua

SEQ ID NO: 3464665 - RNA, 21 nt, Human
uuuuaauagucauuccaaaua

SEQ ID NO: 3464666 - RNA, 13 nt, Human
uuuuaauauguaa

SEQ ID NO: 3464667 - RNA, 20 nt, Human
uuuuaaucaugaaauuacuu

SEQ ID NO: 3464668 - RNA, 22 nt, Human
uuuuaaugaaaaggaaucacgu

SEQ ID NO: 3464669 - RNA, 15 nt, Human
uuuuaaugaugacaa

SEQ ID NO: 3464670 - RNA, 20 nt, Human
uuuuaaugcuauuugaacaa

SEQ ID NO: 3464671 - RNA, 20 nt, Human
uuuuaauggggguagcagcu

SEQ ID NO: 3464672 - RNA, 12 nt, Human
uuuuaauguaaa

SEQ ID NO: 3464673 - RNA, 11 nt, Human
uuuuaaugugc

SEQ ID NO: 3464674 - RNA, 15 nt, Human
uuuuaaugugcugug

SEQ ID NO: 3464675 - RNA, 19 nt, Human
uuuuaaugugcuguguaaa

SEQ ID NO: 3464676 - RNA, 13 nt, Human
uuuuaauuaaaug

SEQ ID NO: 3464677 - RNA, 22 nt, Human
uuuuaauuaaugaaauaucugu

SEQ ID NO: 3464678 - RNA, 16 nt, Human
uuuuaauuauuauucu

SEQ ID NO: 3464679 - RNA, 19 nt, Human
uuuuaauuccaauaugaug

SEQ ID NO: 3464680 - RNA, 22 nt, Human
uuuuaauuccaauaugaugacu

SEQ ID NO: 3464681 - RNA, 21 nt, Human
uuuuaauuccaugaaucgcuu

SEQ ID NO: 3464682 - RNA, 19 nt, Human
uuuuaauugaaaagaagua

SEQ ID NO: 3464683 - RNA, 13 nt, Human
uuuuaauugucau

SEQ ID NO: 3464684 - RNA, 15 nt, Human
uuuuaauugucaugg

SEQ ID NO: 3464685 - RNA, 15 nt, Human
uuuuaauuuaaagcu

SEQ ID NO: 3464686 - RNA, 16 nt, Human
uuuuaauuuaaagcuu

SEQ ID NO: 3464687 - RNA, 17 nt, Human
uuuuaauuuaaagcuua

SEQ ID NO: 3464688 - RNA, 17 nt, Human
uuuuaauuuaacaugaa

SEQ ID NO: 3464689 - RNA, 17 nt, Human
uuuuaauuuacaaaaau

SEQ ID NO: 3464690 - RNA, 18 nt, Human
uuuuaauuuaguaaaugu

SEQ ID NO: 3464691 - RNA, 23 nt, Human
uuuuaauuuaugaguuuuugaua

SEQ ID NO: 3464692 - RNA, 22 nt, Human
uuuuaauuuauuuauuaagaug

SEQ ID NO: 3464693 - RNA, 21 nt, Human
uuuuaauuugaugaaagcuga

SEQ ID NO: 3464694 - RNA, 17 nt, Human
uuuuaauuugguuuuca

SEQ ID NO: 3464695 - RNA, 22 nt, Human
uuuuaauuuuguaaaggugaaa

SEQ ID NO: 3464696 - RNA, 15 nt, Human
uuuuaauuuuguauu

SEQ ID NO: 3464697 - RNA, 16 nt, Human
uuuuaauuuuguauuu

SEQ ID NO: 3464698 - RNA, 10 nt, Human
uuuuacaaaa

SEQ ID NO: 3464699 - RNA, 19 nt, Human
uuuuacaaaaaagaaaaga

SEQ ID NO: 3464700 - RNA, 12 nt, Human
uuuuacaaagcc

SEQ ID NO: 3464701 - RNA, 11 nt, Human
uuuuacaaagg

SEQ ID NO: 3464702 - RNA, 18 nt, Human
uuuuacaaaggcuguauu

SEQ ID NO: 3464703 - RNA, 23 nt, Human
uuuuacaaauuggagcagggaca

SEQ ID NO: 3464704 - RNA, 15 nt, Human
uuuuacaagauguau

SEQ ID NO: 3464705 - RNA, 17 nt, Human
uuuuacaaguaacaaaa

SEQ ID NO: 3464706 - RNA, 23 nt, Human
uuuuacaauguaauuauuuaugu

SEQ ID NO: 3464707 - RNA, 14 nt, Human
uuuuacaauugaaa

SEQ ID NO: 3464708 - RNA, 18 nt, Human
uuuuacauaacugccuug

SEQ ID NO: 3464709 - RNA, 16 nt, Human
uuuuacauacugcugu

SEQ ID NO: 3464710 - RNA, 18 nt, Human
uuuuacaugaaguauuuu

SEQ ID NO: 3464711 - RNA, 17 nt, Human
uuuuaccaaguuauaua

SEQ ID NO: 3464712 - RNA, 13 nt, Human
uuuuaccagcuuu

SEQ ID NO: 3464713 - RNA, 18 nt, Human
uuuuacccauauccccuc

SEQ ID NO: 3464714 - RNA, 22 nt, Human
uuuuacccuaaugucuucauaa

SEQ ID NO: 3464715 - RNA, 18 nt, Human
uuuuaccguuucuucccu

SEQ ID NO: 3464716 - RNA, 17 nt, Human
uugggaggaagcagaau

SEQ ID NO: 3464717 - RNA, 19 nt, Human
uugggaggaagcagaauaa

SEQ ID NO: 3464718 - RNA, 21 nt, Human
uugggaggaagcagaauaaag

SEQ ID NO: 3464719 - RNA, 15 nt, Human
uugggaggcugaggc

SEQ ID NO: 3464720 - RNA, 14 nt, Human
uugggaguccaggc

SEQ ID NO: 3464721 - RNA, 17 nt, Human
uugggaguccaggcaca

SEQ ID NO: 3464722 - RNA, 20 nt, Human
uugggaguccaggcacagga

SEQ ID NO: 3464723 - RNA, 16 nt, Human
uugggauacugcaggg

SEQ ID NO: 3464724 - RNA, 22 nt, Human
uugggaucgcauugcauaccuu

SEQ ID NO: 3464725 - RNA, 18 nt, Human
uugggaugaugccucaug

SEQ ID NO: 3464726 - RNA, 23 nt, Human
uugggaugucuuauuuuuagaug

SEQ ID NO: 3464727 - RNA, 16 nt, Human
uugggauuccugaccc

SEQ ID NO: 3464728 - RNA, 18 nt, Human
uugggauuccugacccag

SEQ ID NO: 3464729 - RNA, 14 nt, Human
uugggcaauauaac

SEQ ID NO: 3464730 - RNA, 20 nt, Human
uugggcacaucauuucaaga

SEQ ID NO: 3464731 - RNA, 20 nt, Human
uugggcacccccagccuggg

SEQ ID NO: 3464732 - RNA, 22 nt, Human
uugggcacccccagccugggcc

SEQ ID NO: 3464733 - RNA, 23 nt, Human
uugggcacuauuuauuuacaaau

SEQ ID NO: 3464734 - RNA, 20 nt, Human
uugggcagaagggagaagga

SEQ ID NO: 3464735 - RNA, 15 nt, Human
uugggcagagaggcu

SEQ ID NO: 3464736 - RNA, 12 nt, Human
uugggcagagcu

SEQ ID NO: 3464737 - RNA, 21 nt, Human
uugggcagagcuggcucugag

SEQ ID NO: 3464738 - RNA, 23 nt, Human
uugggcagccagaccagcaggcu

SEQ ID NO: 3464739 - RNA, 18 nt, Human
uugggcagcgcccuuccu

SEQ ID NO: 3464740 - RNA, 21 nt, Human
uuguggauguuuuaauuccau

SEQ ID NO: 3464741 - RNA, 16 nt, Human
uuguggcaagugaauu

SEQ ID NO: 3464742 - RNA, 18 nt, Human
uuguggcaagugaauuug

SEQ ID NO: 3464743 - RNA, 19 nt, Human
uuguggcagaaguguuuca

SEQ ID NO: 3464744 - RNA, 11 nt, Human
uuguggcagag

SEQ ID NO: 3464745 - RNA, 19 nt, Human
uuguggccaaggagcugcu

SEQ ID NO: 3464746 - RNA, 17 nt, Human
uuguggccuaagaggcu

SEQ ID NO: 3464747 - RNA, 18 nt, Human
uuguggcuccuaucugug

SEQ ID NO: 3464748 - RNA, 20 nt, Human
uuguggcugucagcaggaag

SEQ ID NO: 3464749 - RNA, 18 nt, Human
uugugggcauaaacuguu

SEQ ID NO: 3464750 - RNA, 13 nt, Human
uugugggccuggg

SEQ ID NO: 3464751 - RNA, 20 nt, Human
uuguggggacccaggcuccg

SEQ ID NO: 3464752 - RNA, 19 nt, Human
uugugggggacuguaaguu

SEQ ID NO: 3464753 - RNA, 18 nt, Human
uuguggguuuuuauuucc

SEQ ID NO: 3464754 - RNA, 20 nt, Human
uuguggguuuuuauuuccua

SEQ ID NO: 3464755 - RNA, 11 nt, Human
uugugguccaa

SEQ ID NO: 3464756 - RNA, 14 nt, Human
uugugguccaaaua

SEQ ID NO: 3464757 - RNA, 15 nt, Human
uugugguccaaauag

SEQ ID NO: 3464758 - RNA, 14 nt, Human
uugugguuuauguc

SEQ ID NO: 3464759 - RNA, 13 nt, Human
uugugguuuguug

SEQ ID NO: 3464760 - RNA, 17 nt, Human
uugugguuuucaaauug

SEQ ID NO: 3464761 - RNA, 19 nt, Human
uuguguaaauacaauuuug

SEQ ID NO: 3464762 - RNA, 18 nt, Human
uuguguaagaaauacaga

SEQ ID NO: 3464763 - RNA, 16 nt, Human
uuguguaauaaagugu

SEQ ID NO: 3464764 - RNA, 21 nt, Human
uuguguaauaaaguguuuuca

SEQ ID NO: 3464765 - RNA, 14 nt, Human
uuguguaauauuac

SEQ ID NO: 3464766 - RNA, 23 nt, Human
uuguguaauauuacuuuaacaug

SEQ ID NO: 3464767 - RNA, 23 nt, Human
uuguguacagacuuguugugacu

SEQ ID NO: 3464768 - RNA, 15 nt, Human
uuuugccuuuugcaa

SEQ ID NO: 3464769 - RNA, 13 nt, Human
uuuugcucuaaaa

SEQ ID NO: 3464770 - RNA, 16 nt, Human
uuuugcucuaaaauau

SEQ ID NO: 3464771 - RNA, 13 nt, Human
uuuugcuguauau

SEQ ID NO: 3464772 - RNA, 10 nt, Human
uuuugcuguu

SEQ ID NO: 3464773 - RNA, 18 nt, Human
uuuugcuguuuccuuuua

SEQ ID NO: 3464774 - RNA, 19 nt, Human
uuuugcuuuaauuccauga

SEQ ID NO: 3464775 - RNA, 20 nt, Human
uuuugcuuuuucugacucca

SEQ ID NO: 3464776 - RNA, 20 nt, Human
uuuuggaagauuuucagucu

SEQ ID NO: 3464777 - RNA, 20 nt, Human
uuuuggagaagguuaucaaa

SEQ ID NO: 3464778 - RNA, 18 nt, Human
uuuuggagauuauaauaa

SEQ ID NO: 3464779 - RNA, 13 nt, Human
uuuuggaggugcu

SEQ ID NO: 3464780 - RNA, 15 nt, Human
uuuuggaggugcuua

SEQ ID NO: 3464781 - RNA, 17 nt, Human
uuuuggaguguuaugua

SEQ ID NO: 3464782 - RNA, 16 nt, Human
uuuuggaugcagugcu

SEQ ID NO: 3464783 - RNA, 11 nt, Human
uuuuggaugcc

SEQ ID NO: 3464784 - RNA, 19 nt, Human
uuuuggauugacaguaacu

SEQ ID NO: 3464785 - RNA, 20 nt, Human
uuuuggauuuggagagaaau

SEQ ID NO: 3464786 - RNA, 21 nt, Human
uuuuggcauaacauaaaucug

SEQ ID NO: 3464787 - RNA, 15 nt, Human
uuuuggccaaagugu

SEQ ID NO: 3464788 - RNA, 16 nt, Human
uuuuggccaaaguguu

SEQ ID NO: 3464789 - RNA, 19 nt, Human
uuuuggcccccgagcuggg

SEQ ID NO: 3464790 - RNA, 22 nt, Human
uuuugggcuccuuuuucucccu

SEQ ID NO: 3464791 - RNA, 18 nt, Human
uuuuggggaagugaggaa

SEQ ID NO: 3464792 - RNA, 15 nt, Human
uuuuggggagccaga

SEQ ID NO: 3464793 - RNA, 18 nt, Human
uuuuggggauaugcuuag

SEQ ID NO: 3464794 - RNA, 23 nt, Human
uuuuggggauuuucaaaagauaa

SEQ ID NO: 3464795 - RNA, 18 nt, Human
uuuuggggugugaccuca

SEQ ID NO: 3464796 - RNA, 13 nt, Human
uuuuggguagcug

SEQ ID NO: 3464797 - RNA, 18 nt, Human
uuuuggguuuauuuggaa

SEQ ID NO: 3464798 - RNA, 19 nt, Human
uuuugguaaagacuggcuu

SEQ ID NO: 3464799 - RNA, 14 nt, Human
uuuugguagagaug

SEQ ID NO: 3464800 - RNA, 21 nt, Human
uuuugguccaaguugugcuua

SEQ ID NO: 3464801 - RNA, 20 nt, Human
uuuugguccacuuuuccagu

SEQ ID NO: 3464802 - RNA, 21 nt, Human
uuuugguccacuuuuccagua

SEQ ID NO: 3464803 - RNA, 14 nt, Human
uuuuggucuuuuug

SEQ ID NO: 3464804 - RNA, 17 nt, Human
uuuuggugauucaaaug

SEQ ID NO: 3464805 - RNA, 19 nt, Human
uuuugguuaagcuuugaca

SEQ ID NO: 3464806 - RNA, 16 nt, Human
uuuugguucuuaguuc

SEQ ID NO: 3464807 - RNA, 15 nt, Human
uuuugguugaauaaa

SEQ ID NO: 3464808 - RNA, 15 nt, Human
uuuugguugcuuuaa

SEQ ID NO: 3464809 - RNA, 14 nt, Human
uuuugguuuuguuc

SEQ ID NO: 3464810 - RNA, 15 nt, Human
uuuuguaaaagaaau

SEQ ID NO: 3464811 - RNA, 14 nt, Human
uuuuguaaacuuug

SEQ ID NO: 3464812 - RNA, 17 nt, Human
uuuuguaaacuuugaaa

SEQ ID NO: 3464813 - RNA, 19 nt, Human
uuuuguaaacuuugaaaua

SEQ ID NO: 3464814 - RNA, 16 nt, Human
uuuuguaaagaaaaau

SEQ ID NO: 3464815 - RNA, 19 nt, Human
uuuuguaaagaaauuuacu

SEQ ID NO: 3464816 - RNA, 13 nt, Human
uuuuguaaagauu

SEQ ID NO: 3464817 - RNA, 16 nt, Human
uuuuguaaagauuucu

SEQ ID NO: 3464818 - RNA, 21 nt, Human
uuuuguaaaucacauccuuau

SEQ ID NO: 3464819 - RNA, 15 nt, Human
uuuuguaacaaauga

SEQ ID NO: 3464820 - RNA, 18 nt, Human
uuuuguaacuuccaugug

SEQ ID NO: 3464821 - RNA, 13 nt, Human
uuuuguaaugaau

SEQ ID NO: 3464822 - RNA, 14 nt, Human
uuuuguaauuuucu

SEQ ID NO: 3464823 - RNA, 11 nt, Human
uuuuguaccaa

SEQ ID NO: 3464824 - RNA, 13 nt, Human
uuuuguacuguaa

SEQ ID NO: 3464825 - RNA, 16 nt, Human
uuuuguacuguaaaga

SEQ ID NO: 3464826 - RNA, 19 nt, Human
uuuuguagcacugacagau

SEQ ID NO: 3464827 - RNA, 21 nt, Human
uuuuguagcuggggcuuugau

SEQ ID NO: 3464828 - RNA, 22 nt, Human
uuuuguaggggucaaagaaaug

SEQ ID NO: 3464829 - RNA, 19 nt, Human
uuuuguagguacuuuugga

SEQ ID NO: 3464830 - RNA, 24 nt, Human
uuuuguauaauuggauuuccuaau

SEQ ID NO: 3464831 - RNA, 16 nt, Human
uuuuguauaauuguau

SEQ ID NO: 3464832 - RNA, 13 nt, Human
uuuuguauacaaa

SEQ ID NO: 3464833 - RNA, 13 nt, Human
uuuuguauauauc

SEQ ID NO: 3464834 - RNA, 14 nt, Human
uuuuguauauuggu

SEQ ID NO: 3464835 - RNA, 19 nt, Human
uuuuguaucuacaucuuuu

SEQ ID NO: 3464836 - RNA, 13 nt, Human
uuuuguaucuuaa

SEQ ID NO: 3464837 - RNA, 13 nt, Human
uuuuguaugcaag

SEQ ID NO: 3464838 - RNA, 20 nt, Human
uuuuguauguaaaugugcau

SEQ ID NO: 3464839 - RNA, 19 nt, Human
uuuuguauuuuccaagugu

SEQ ID NO: 3464840 - RNA, 18 nt, Human
uuuuguauuuuuaauggg

SEQ ID NO: 3464841 - RNA, 18 nt, Human
uuuugucauuuucuccau

SEQ ID NO: 3464842 - RNA, 16 nt, Human
uuuugucccccaacuu

SEQ ID NO: 3464843 - RNA, 10 nt, Human
uuuugucucu

SEQ ID NO: 3464844 - RNA, 17 nt, Human
uuuugugaaauuuuuca

SEQ ID NO: 3464845 - RNA, 17 nt, Human
uuuugugaagcccuguu

SEQ ID NO: 3464846 - RNA, 21 nt, Human
uuuugugaaguuuaauugacu

SEQ ID NO: 3464847 - RNA, 23 nt, Human
uuuugugaauggauuggauuauu

SEQ ID NO: 3464848 - RNA, 23 nt, Human
uuuugugacuauauagagauguu

SEQ ID NO: 3464849 - RNA, 23 nt, Human
uuuugugaguuuguuucuuugaa

SEQ ID NO: 3464850 - RNA, 20 nt, Human
uuuugugaugcaaauaaaua

SEQ ID NO: 3464851 - RNA, 21 nt, Human
uuuugugcaaaagcuucaaau

SEQ ID NO: 3464852 - RNA, 20 nt, Human
uuuugugcauuaucuagaua

SEQ ID NO: 3464853 - RNA, 22 nt, Human
uuuugugcauuuguaaaugcug

SEQ ID NO: 3464854 - RNA, 15 nt, Human
uuuugugcugcuucu

SEQ ID NO: 3464855 - RNA, 22 nt, Human
uuuugugcuuaguuaaaucuuu

SEQ ID NO: 3464856 - RNA, 16 nt, Human
uuuugugguuuggaau

SEQ ID NO: 3464857 - RNA, 11 nt, Human
uuuuguguccu

SEQ ID NO: 3464858 - RNA, 15 nt, Human
uuuugugugaaauug

SEQ ID NO: 3464859 - RNA, 20 nt, Human
uuuuguguguauuugcuaau

SEQ ID NO: 3464860 - RNA, 15 nt, Human
uuuuguuaacugauu

SEQ ID NO: 3464861 - RNA, 21 nt, Human
uuuuguuacuguucuugcugc

SEQ ID NO: 3464862 - RNA, 22 nt, Human
uuuuguuacuguucuugcugcu

SEQ ID NO: 3464863 - RNA, 16 nt, Human
uuuuguucaaagccag

SEQ ID NO: 3464864 - RNA, 14 nt, Human
uuuuguucauacau

SEQ ID NO: 3464865 - RNA, 19 nt, Human
uuuuguuccccuccuccac

SEQ ID NO: 3464866 - RNA, 13 nt, Human
uuuuguucccuau

SEQ ID NO: 3464867 - RNA, 14 nt, Human
uuuuguucucuggg

SEQ ID NO: 3464868 - RNA, 17 nt, Human
uuuuguucucugggaga

SEQ ID NO: 3464869 - RNA, 15 nt, Human
uuuuguugauuaaaa

SEQ ID NO: 3464870 - RNA, 16 nt, Human
uuuuguugccccagaa

SEQ ID NO: 3464871 - RNA, 15 nt, Human
uuuuguuguaaaaag

SEQ ID NO: 3464872 - RNA, 19 nt, Human
uuuuguuguaaaaagaaaa

SEQ ID NO: 3464873 - RNA, 13 nt, Human
uuuuguuguuucu

SEQ ID NO: 3464874 - RNA, 18 nt, Human
uuuuguuguuuguuuagu

SEQ ID NO: 3464875 - RNA, 16 nt, Human
uuuuguuuaccagaga

SEQ ID NO: 3464876 - RNA, 16 nt, Human
uuuuguuuauuucauu

SEQ ID NO: 3464877 - RNA, 13 nt, Human
uuuuguuuccuuu

SEQ ID NO: 3464878 - RNA, 22 nt, Human
uuuuguuuccuuuuuucccaua

SEQ ID NO: 3464879 - RNA, 14 nt, Human
uuuuguuugaugca

SEQ ID NO: 3464880 - RNA, 15 nt, Human
uuuuguuugccagga

SEQ ID NO: 3464881 - RNA, 22 nt, Human
uuuuguuuggaccaaaaaccag

SEQ ID NO: 3464882 - RNA, 23 nt, Human
uuuuguuuggaccaaaaaccagu

SEQ ID NO: 3464883 - RNA, 14 nt, Human
uuuuguuugguauu

SEQ ID NO: 3464884 - RNA, 16 nt, Human
uuuuguuugguuauau

SEQ ID NO: 3464885 - RNA, 20 nt, Human
uuuaaaaguuacuccuuuua

SEQ ID NO: 3464886 - RNA, 17 nt, Human
uuuaaaauaaaaugaaa

SEQ ID NO: 3464887 - RNA, 18 nt, Human
uuuaaaauaaaaugaaaa

SEQ ID NO: 3464888 - RNA, 16 nt, Human
uuuaaaauaagucuga

SEQ ID NO: 3464889 - RNA, 19 nt, Human
uuuaaaauacacacucaaa

SEQ ID NO: 3464890 - RNA, 15 nt, Human
uuuaaaauacuguag

SEQ ID NO: 3464891 - RNA, 18 nt, Human
uuuaaaauacuguagaua

SEQ ID NO: 3464892 - RNA, 11 nt, Human
uuuaaaauaua

SEQ ID NO: 3464893 - RNA, 16 nt, Human
uuuaaaauauuuaucu

SEQ ID NO: 3464894 - RNA, 20 nt, Human
uuuaaaaucacuaacauuau

SEQ ID NO: 3464895 - RNA, 22 nt, Human
uuuaaaaucagcuauuuuguga

SEQ ID NO: 3464896 - RNA, 16 nt, Human
uuuaaaaucauuucug

SEQ ID NO: 3464897 - RNA, 18 nt, Human
uuuaaaaucuccuaaaug

SEQ ID NO: 3464898 - RNA, 15 nt, Human
uuuaaaaucugucac

SEQ ID NO: 3464899 - RNA, 20 nt, Human
uuuaaaaugguuuguccuga

SEQ ID NO: 3464900 - RNA, 11 nt, Human
uuuaaaaugua

SEQ ID NO: 3464901 - RNA, 12 nt, Human
uuuaaaauguaa

SEQ ID NO: 3464902 - RNA, 20 nt, Human
uuuaaaauguaaagccaugc

SEQ ID NO: 3464903 - RNA, 22 nt, Human
uuuaaaauguaauuuaaaugaa

SEQ ID NO: 3464904 - RNA, 21 nt, Human
uuuaaaauguacauguauuaa

SEQ ID NO: 3464905 - RNA, 18 nt, Human
uuuaaaauguauaaguug

SEQ ID NO: 3464906 - RNA, 20 nt, Human
uuuaaaauuuauauuguaaa

SEQ ID NO: 3464907 - RNA, 19 nt, Human
uuuaaaauuucuuagaaaa

SEQ ID NO: 3464908 - RNA, 14 nt, Human
uuuaaaauuuuaag

SEQ ID NO: 3464909 - RNA, 12 nt, Human
uuuaaacaaauu

SEQ ID NO: 3464910 - RNA, 23 nt, Human
uuuaaacacacagauacacacac

SEQ ID NO: 3464911 - RNA, 14 nt, Human
uuuaaacacauuaa

SEQ ID NO: 3464912 - RNA, 16 nt, Human
uuuaaacauagaaagu

SEQ ID NO: 3464913 - RNA, 22 nt, Human
uuuaaacauauccaaguuugaa

SEQ ID NO: 3464914 - RNA, 19 nt, Human
uuuaaacauuaaaaaugga

SEQ ID NO: 3464915 - RNA, 17 nt, Human
uuuaaacccauuuuagu

SEQ ID NO: 3464916 - RNA, 17 nt, Human
uuuaaaccgcuaaaaga

SEQ ID NO: 3464917 - RNA, 21 nt, Human
uuuaaaccgcuaaaagaaacu

SEQ ID NO: 3464918 - RNA, 11 nt, Human
uuuaaaccuuu

SEQ ID NO: 3464919 - RNA, 18 nt, Human
uuuaaaccuuuuauuaua

SEQ ID NO: 3464920 - RNA, 16 nt, Human
uuuaaacuacagguag

SEQ ID NO: 3464921 - RNA, 12 nt, Human
uuuaaacuagau

SEQ ID NO: 3464922 - RNA, 19 nt, Human
uuuaaacuagaugaccuca

SEQ ID NO: 3464923 - RNA, 20 nt, Human
uuuaaacugaaugaacaacc

SEQ ID NO: 3464924 - RNA, 13 nt, Human
uuuaaacuguaca

SEQ ID NO: 3464925 - RNA, 15 nt, Human
uuuaaacuguguaca

SEQ ID NO: 3464926 - RNA, 19 nt, Human
uuuaaacuguguacauaac

SEQ ID NO: 3464927 - RNA, 22 nt, Human
uuuaaacuguguacauaacuga

SEQ ID NO: 3464928 - RNA, 14 nt, Human
uuuaaacuuauaaa

SEQ ID NO: 3464929 - RNA, 18 nt, Human
uuuaaagaaaaaaauguc

SEQ ID NO: 3464930 - RNA, 15 nt, Human
uuuaaagaaaaguuu

SEQ ID NO: 3464931 - RNA, 12 nt, Human
uuuaaagaaagu

SEQ ID NO: 3464932 - RNA, 23 nt, Human
uuuaaagaaucauuauuuauuaa

SEQ ID NO: 3464933 - RNA, 18 nt, Human
uuuaaagacaauguuaaa

SEQ ID NO: 3464934 - RNA, 16 nt, Human
ucacaccugcccuaaa

SEQ ID NO: 3464935 - RNA, 13 nt, Human
ucacacucugggu

SEQ ID NO: 3464936 - RNA, 11 nt, Human
ucacacugaga

SEQ ID NO: 3464937 - RNA, 12 nt, Human
ucacacugagaa

SEQ ID NO: 3464938 - RNA, 18 nt, Human
ucacacugcaagagccuu

SEQ ID NO: 3464939 - RNA, 21 nt, Human
ucacacugcaagagccuuggu

SEQ ID NO: 3464940 - RNA, 16 nt, Human
ucacacuggcuaucaa

SEQ ID NO: 3464941 - RNA, 11 nt, Human
ucacacuggga

SEQ ID NO: 3464942 - RNA, 17 nt, Human
ucacacuggucugcugu

SEQ ID NO: 3464943 - RNA, 19 nt, Human
ucacacugguucucaauga

SEQ ID NO: 3464944 - RNA, 21 nt, Human
ucacacugguucucaaugaaa

SEQ ID NO: 3464945 - RNA, 20 nt, Human
ucacacuuccaccagccugc

SEQ ID NO: 3464946 - RNA, 12 nt, Human
ucacagaaauga

SEQ ID NO: 3464947 - RNA, 11 nt, Human
ucacagaagaa

SEQ ID NO: 3464948 - RNA, 20 nt, Human
ucacagacaggaccccugca

SEQ ID NO: 3464949 - RNA, 18 nt, Human
ucacagaccuggagcccc

SEQ ID NO: 3464950 - RNA, 14 nt, Human
ucacagacuggaga

SEQ ID NO: 3464951 - RNA, 22 nt, Human
ucacagagacacagggcaucca

SEQ ID NO: 3464952 - RNA, 22 nt, Human
ucacagagacauuccuccgagc

SEQ ID NO: 3464953 - RNA, 17 nt, Human
ucacagagucaaggccu

SEQ ID NO: 3464954 - RNA, 20 nt, Human
ucacagaugggugcuuggag

SEQ ID NO: 3464955 - RNA, 21 nt, Human
ucacagaugugugauucacag

SEQ ID NO: 3464956 - RNA, 16 nt, Human
ucacagcacacucagc

SEQ ID NO: 3464957 - RNA, 17 nt, Human
ucacagcacagagaaga

SEQ ID NO: 3464958 - RNA, 15 nt, Human
ucacagcagcuucua

SEQ ID NO: 3464959 - RNA, 18 nt, Human
ucacagcagugagacugg

SEQ ID NO: 3464960 - RNA, 23 nt, Human
ucacagccagacuggcacaguuu

SEQ ID NO: 3464961 - RNA, 20 nt, Human
ucacagccagcgaacugaca

SEQ ID NO: 3464962 - RNA, 22 nt, Human
ucacagccaggcgcuagcacag

SEQ ID NO: 3464963 - RNA, 20 nt, Human
ucacagccucaagucacucc

SEQ ID NO: 3464964 - RNA, 14 nt, Human
ucacagccuccucu

SEQ ID NO: 3464965 - RNA, 15 nt, Human
ucacagccuccucug

SEQ ID NO: 3464966 - RNA, 22 nt, Human
ucacagccuccucugucugccc

SEQ ID NO: 3464967 - RNA, 16 nt, Human
ucacagccucugaccc

SEQ ID NO: 3464968 - RNA, 13 nt, Human
ucacagcggaggu

SEQ ID NO: 3464969 - RNA, 14 nt, Human
ucacagcuccuccc

SEQ ID NO: 3464970 - RNA, 23 nt, Human
ucacaggacagcccuucuuucca

SEQ ID NO: 3464971 - RNA, 23 nt, Human
ucacaggacucugccuccucuuc

SEQ ID NO: 3464972 - RNA, 23 nt, Human
ucacaggcagccagugcccugag

SEQ ID NO: 3464973 - RNA, 17 nt, Human
ucacaggcagguccagg

SEQ ID NO: 3464974 - RNA, 19 nt, Human
ucacaggcagguccagggu

SEQ ID NO: 3464975 - RNA, 14 nt, Human
ucacaggcugggcu

SEQ ID NO: 3464976 - RNA, 20 nt, Human
ucacagggcaugccccggcc

SEQ ID NO: 3464977 - RNA, 17 nt, Human
ucacagggugggccucg

SEQ ID NO: 3464978 - RNA, 14 nt, Human
ucacaggguugggc

SEQ ID NO: 3464979 - RNA, 23 nt, Human
ucacagguagacaguauauaacu

SEQ ID NO: 3464980 - RNA, 21 nt, Human
ucacagguuggaagagaauca

SEQ ID NO: 3464981 - RNA, 18 nt, Human
ucacaguacagcaugugc

SEQ ID NO: 3464982 - RNA, 19 nt, Human
ucacaguagagccagcuug

SEQ ID NO: 3464983 - RNA, 15 nt, Human
ucacaguauugcuca

SEQ ID NO: 3464984 - RNA, 23 nt, Human
ucacaguccuuaccagcagagca

SEQ ID NO: 3464985 - RNA, 21 nt, Human
ucacagucuaauuuuuauuca

SEQ ID NO: 3464986 - RNA, 18 nt, Human
ucacagucucuuuaaucu

SEQ ID NO: 3464987 - RNA, 17 nt, Human
ucacagugcugugugcc

SEQ ID NO: 3464988 - RNA, 18 nt, Human
ucacagugggagccaggg

SEQ ID NO: 3464989 - RNA, 17 nt, Human
ucacaguguugcccagg

SEQ ID NO: 3464990 - RNA, 16 nt, Human
ucacaguguuuacacu

SEQ ID NO: 3464991 - RNA, 22 nt, Human
ucacaguguuugcaaugguguu

SEQ ID NO: 3464992 - RNA, 17 nt, Human
ucacaguuauuacauac

SEQ ID NO: 3464993 - RNA, 18 nt, Human
ucacaguuccucgcccug

SEQ ID NO: 3464994 - RNA, 15 nt, Human
ucacaguucucuccu

SEQ ID NO: 3464995 - RNA, 17 nt, Human
ucacaguuggccuucag

SEQ ID NO: 3464996 - RNA, 16 nt, Human
ucacaguuugaaauaa

SEQ ID NO: 3464997 - RNA, 17 nt, Human
ucacaguuugaaauaag

SEQ ID NO: 3464998 - RNA, 15 nt, Human
ucacaguuuuuccug

SEQ ID NO: 3464999 - RNA, 17 nt, Human
ucacauaaaaccucauu

SEQ ID NO: 3465000 - RNA, 18 nt, Human
ucacauaaaauagauuuu

SEQ ID NO: 3465001 - RNA, 19 nt, Human
ucacauaaaugcagcccau

SEQ ID NO: 3465002 - RNA, 16 nt, Human
ucacauaacagaaugc

SEQ ID NO: 3465003 - RNA, 16 nt, Human
ucacauacccuccccc

SEQ ID NO: 3465004 - RNA, 16 nt, Human
ucacauagaugucccu

SEQ ID NO: 3465005 - RNA, 19 nt, Human
ucacauagcccacuuacau

SEQ ID NO: 3465006 - RNA, 20 nt, Human
ucacauauugauuuccguua

SEQ ID NO: 3465007 - RNA, 23 nt, Human
ucacauauuuuauuaagaacuca

SEQ ID NO: 3465008 - RNA, 13 nt, Human
ucacaucacagga

SEQ ID NO: 3465009 - RNA, 16 nt, Human
ucacaucagauaagac

SEQ ID NO: 3465010 - RNA, 17 nt, Human
ucacaucagauaagaca

SEQ ID NO: 3465011 - RNA, 16 nt, Human
ucacauccuugacuuu

SEQ ID NO: 3465012 - RNA, 19 nt, Human
ucacauccuugacuuuuua

SEQ ID NO: 3465013 - RNA, 21 nt, Human
ucacaucgcuucuguguaucu

SEQ ID NO: 3465014 - RNA, 14 nt, Human
ucacaucuuaugcu

SEQ ID NO: 3465015 - RNA, 22 nt, Human
ucacaucuuucacacuuccacc

SEQ ID NO: 3465016 - RNA, 16 nt, Human
ucacaucuuuuucacu

SEQ ID NO: 3465017 - RNA, 16 nt, Human
ucacaugaauuauuac

SEQ ID NO: 3465018 - RNA, 14 nt, Human
ucacaugaccacau

SEQ ID NO: 3465019 - RNA, 13 nt, Human
ucacaugaccuga

SEQ ID NO: 3465020 - RNA, 21 nt, Human
ucacaugaugcacuucaaauu

SEQ ID NO: 3465021 - RNA, 17 nt, Human
ucacaugauuccagcca

SEQ ID NO: 3465022 - RNA, 19 nt, Human
ucacaugauuccagccauc

SEQ ID NO: 3465023 - RNA, 13 nt, Human
ucacaugcuggac

SEQ ID NO: 3465024 - RNA, 14 nt, Human
ucacaugcuggaca

SEQ ID NO: 3465025 - RNA, 23 nt, Human
ucacaugcuggacaggucuggga

SEQ ID NO: 3465026 - RNA, 18 nt, Human
ucacauggaaugaggguu

SEQ ID NO: 3465027 - RNA, 15 nt, Human
ucacaugggacaaag

SEQ ID NO: 3465028 - RNA, 23 nt, Human
ucacauguauguuuugguaucug

SEQ ID NO: 3465029 - RNA, 18 nt, Human
ucacuucugaccacacuu

SEQ ID NO: 3465030 - RNA, 15 nt, Human
ucacuucuucugucc

SEQ ID NO: 3465031 - RNA, 21 nt, Human
ucacuucuucuguccaagcag

SEQ ID NO: 3465032 - RNA, 20 nt, Human
ucacuucuuucccuuccucc

SEQ ID NO: 3465033 - RNA, 21 nt, Human
ucacuugaauccuagggccug

SEQ ID NO: 3465034 - RNA, 12 nt, Human
ucacuugagacc

SEQ ID NO: 3465035 - RNA, 14 nt, Human
ucacuugagcccag

SEQ ID NO: 3465036 - RNA, 22 nt, Human
ucacuugaggucaggaguuccu

SEQ ID NO: 3465037 - RNA, 14 nt, Human
ucacuugaugauac

SEQ ID NO: 3465038 - RNA, 15 nt, Human
ucacuugauucauaa

SEQ ID NO: 3465039 - RNA, 11 nt, Human
ucacuugcagu

SEQ ID NO: 3465040 - RNA, 17 nt, Human
ucacuugugcaguguug

SEQ ID NO: 3465041 - RNA, 19 nt, Human
ucacuugugccaacacuca

SEQ ID NO: 3465042 - RNA, 21 nt, Human
ucacuugugccaacacucaag

SEQ ID NO: 3465043 - RNA, 16 nt, Human
ucacuugugcuuugcu

SEQ ID NO: 3465044 - RNA, 23 nt, Human
ucacuuguuguuuuacuaaagaa

SEQ ID NO: 3465045 - RNA, 20 nt, Human
ucacuuguuuuauuuaaccu

SEQ ID NO: 3465046 - RNA, 18 nt, Human
ucacuuuaauucucaugu

SEQ ID NO: 3465047 - RNA, 20 nt, Human
ucacuuuaauucucauguga

SEQ ID NO: 3465048 - RNA, 21 nt, Human
ucacuuuacacaauagaauua

SEQ ID NO: 3465049 - RNA, 14 nt, Human
ucacuuuagaugcu

SEQ ID NO: 3465050 - RNA, 13 nt, Human
ucacuuucauuuu

SEQ ID NO: 3465051 - RNA, 17 nt, Human
ucacuuugcucugggug

SEQ ID NO: 3465052 - RNA, 13 nt, Human
ucacuuugucuaa

SEQ ID NO: 3465053 - RNA, 22 nt, Human
ucacuuuuagggagagucauau

SEQ ID NO: 3465054 - RNA, 22 nt, Human
ucacuuuuauuuagcaccaggg

SEQ ID NO: 3465055 - RNA, 14 nt, Human
ucacuuuucccacu

SEQ ID NO: 3465056 - RNA, 12 nt, Human
ucacuuuuccuc

SEQ ID NO: 3465057 - RNA, 13 nt, Human
ucacuuuuccucc

SEQ ID NO: 3465058 - RNA, 18 nt, Human
ucacuuuuccucccucag

SEQ ID NO: 3465059 - RNA, 13 nt, Human
ucacuuuucugua

SEQ ID NO: 3465060 - RNA, 21 nt, Human
ucacuuuugcuccgaagcuac

SEQ ID NO: 3465061 - RNA, 17 nt, Human
ucacuuuuugaacuaag

SEQ ID NO: 3465062 - RNA, 16 nt, Human
ucacuuuuugaggcaa

SEQ ID NO: 3465063 - RNA, 10 nt, Human
ucagaaaaaa

SEQ ID NO: 3465064 - RNA, 17 nt, Human
ucagaaaacagaaaaaa

SEQ ID NO: 3465065 - RNA, 19 nt, Human
ucagaaaauauuauguguu

SEQ ID NO: 3465066 - RNA, 23 nt, Human
ucagaaaauguucuguuugcugu

SEQ ID NO: 3465067 - RNA, 16 nt, Human
ucagaaacaauuucug

SEQ ID NO: 3465068 - RNA, 16 nt, Human
ucagaaacuaaaacaa

SEQ ID NO: 3465069 - RNA, 16 nt, Human
ucagaaacuugugaag

SEQ ID NO: 3465070 - RNA, 16 nt, Human
ucagaaagcuuuauuu

SEQ ID NO: 3465071 - RNA, 12 nt, Human
ucagaaaggaau

SEQ ID NO: 3465072 - RNA, 21 nt, Human
ucagaaagggagggcucugag

SEQ ID NO: 3465073 - RNA, 22 nt, Human
ucagaaagggagggcucugagg

SEQ ID NO: 3465074 - RNA, 15 nt, Human
ucagaaagugccuga

SEQ ID NO: 3465075 - RNA, 18 nt, Human
ucagaaaguguauaauaa

SEQ ID NO: 3465076 - RNA, 13 nt, Human
ucagaaauacaga

SEQ ID NO: 3465077 - RNA, 16 nt, Human
ucagaaauacagauuu

SEQ ID NO: 3465078 - RNA, 19 nt, Human
ucagaaauauaacacauuu

SEQ ID NO: 3465079 - RNA, 16 nt, Human
ucagaaaugcugccug

SEQ ID NO: 3465080 - RNA, 17 nt, Human
ucagaaaugcugccugc

SEQ ID NO: 3465081 - RNA, 21 nt, Human
ucagaaaugcugccugccugu

SEQ ID NO: 3465082 - RNA, 15 nt, Human
ucagaaauguguuau

SEQ ID NO: 3465083 - RNA, 21 nt, Human
ucagaaauuggaacagaaugu

SEQ ID NO: 3465084 - RNA, 16 nt, Human
ucagaacaaauucagg

SEQ ID NO: 3465085 - RNA, 14 nt, Human
ucagaacagcagac

SEQ ID NO: 3465086 - RNA, 12 nt, Human
ucagaacagcug

SEQ ID NO: 3465087 - RNA, 20 nt, Human
ucagaacccagggcucugcc

SEQ ID NO: 3465088 - RNA, 13 nt, Human
ucagaacccugcc

SEQ ID NO: 3465089 - RNA, 21 nt, Human
ucagaacccugccauggaacu

SEQ ID NO: 3465090 - RNA, 15 nt, Human
ucagaacccuuggcu

SEQ ID NO: 3465091 - RNA, 16 nt, Human
ucagaacccuuggcuu

SEQ ID NO: 3465092 - RNA, 15 nt, Human
ucagaaccucuuccc

SEQ ID NO: 3465093 - RNA, 17 nt, Human
ucagaaccucuucccca

SEQ ID NO: 3465094 - RNA, 18 nt, Human
ucagaaccucuuccccag

SEQ ID NO: 3465095 - RNA, 16 nt, Human
ucagaacuauguuuuu

SEQ ID NO: 3465096 - RNA, 21 nt, Human
ucagaacucaaauggggccag

SEQ ID NO: 3465097 - RNA, 20 nt, Human
ucagaacugucggaggaaag

SEQ ID NO: 3465098 - RNA, 13 nt, Human
ucagaacuugcug

SEQ ID NO: 3465099 - RNA, 12 nt, Human
ucagaagauaac

SEQ ID NO: 3465100 - RNA, 14 nt, Human
ucagaagauaacuu

SEQ ID NO: 3465101 - RNA, 20 nt, Human
ucagaagauagucuuggaag

SEQ ID NO: 3465102 - RNA, 18 nt, Human
ucagaagcacagaauauu

SEQ ID NO: 3465103 - RNA, 22 nt, Human
ucagaagccuauuguaaauaca

SEQ ID NO: 3465104 - RNA, 23 nt, Human
ucagaagccugggggccuggcug

SEQ ID NO: 3465105 - RNA, 14 nt, Human
ucagaagccuuugg

SEQ ID NO: 3465106 - RNA, 13 nt, Human
ucagaaggagaag

SEQ ID NO: 3465107 - RNA, 14 nt, Human
ucagaaggagaagg

SEQ ID NO: 3465108 - RNA, 12 nt, Human
ucagaaggcucu

SEQ ID NO: 3465109 - RNA, 13 nt, Human
ucagaagggcuau

SEQ ID NO: 3465110 - RNA, 15 nt, Human
ucagaaggggagggg

SEQ ID NO: 3465111 - RNA, 20 nt, Human
ucagaaggggaggggagaca

SEQ ID NO: 3465112 - RNA, 15 nt, Human
ucagaagucaucuug

SEQ ID NO: 3465113 - RNA, 18 nt, Human
ucagaagucuuucagcaa

SEQ ID NO: 3465114 - RNA, 19 nt, Human
ucagaaguuucucagcucc

SEQ ID NO: 3465115 - RNA, 23 nt, Human
ucagaaguuucugccgcagcccu

SEQ ID NO: 3465116 - RNA, 20 nt, Human
ucagaauaaggcaggcauug

SEQ ID NO: 3465117 - RNA, 21 nt, Human
ucagaauaaggcaggcauuga

SEQ ID NO: 3465118 - RNA, 23 nt, Human
ucagaauagccacauuuggaaua

SEQ ID NO: 3465119 - RNA, 18 nt, Human
ucagaaucccuuaacagu

SEQ ID NO: 3465120 - RNA, 14 nt, Human
ucagaaucuaccca

SEQ ID NO: 3465121 - RNA, 19 nt, Human
ucagaaucucaaauaacua

SEQ ID NO: 3465122 - RNA, 18 nt, Human
ucagaaucugaauguaau

SEQ ID NO: 3465123 - RNA, 22 nt, Human
ucagaaucugaauguaauuugu

SEQ ID NO: 3465124 - RNA, 15 nt, Human
ucagaaucuuuccuu

SEQ ID NO: 3465125 - RNA, 14 nt, Human
ucagaauguaaaag

SEQ ID NO: 3465126 - RNA, 16 nt, Human
ucagaauuaaacuuuu

SEQ ID NO: 3465127 - RNA, 18 nt, Human
ucagaauuaaacuuuuaa

SEQ ID NO: 3465128 - RNA, 18 nt, Human
ucagaauuagcugcuucu

SEQ ID NO: 3465129 - RNA, 14 nt, Human
aaguaucaugcauu

SEQ ID NO: 3465130 - RNA, 15 nt, Human
aaguaucaugcauuc

SEQ ID NO: 3465131 - RNA, 16 nt, Human
aaguaucauggaaaua

SEQ ID NO: 3465132 - RNA, 17 nt, Human
aaguaucauggaaauau

SEQ ID NO: 3465133 - RNA, 23 nt, Human
aaguaucccuacuguaauuugug

SEQ ID NO: 3465134 - RNA, 21 nt, Human
aaguauccugagagcccagaa

SEQ ID NO: 3465135 - RNA, 15 nt, Human
aauaacaaaauggac

SEQ ID NO: 3465136 - RNA, 22 nt, Human
aauaacaaaugccaaauuaaaa

SEQ ID NO: 3465137 - RNA, 16 nt, Human
aauaacaagucgauga

SEQ ID NO: 3465138 - RNA, 13 nt, Human
aauaacaaugugc

SEQ ID NO: 3465139 - RNA, 20 nt, Human
aauaacacacauauaaacau

SEQ ID NO: 3465140 - RNA, 22 nt, Human
aauaacagaagaaaauagaauu

SEQ ID NO: 3465141 - RNA, 14 nt, Human
aauaacagauuucu

SEQ ID NO: 3465142 - RNA, 13 nt, Human
aauaacagcugca

SEQ ID NO: 3465143 - RNA, 21 nt, Human
aauaacaggcauuuguucacu

SEQ ID NO: 3465144 - RNA, 17 nt, Human
aauaacauaacaaauaa

SEQ ID NO: 3465145 - RNA, 22 nt, Human
aauaacauguaauuaaguacua

SEQ ID NO: 3465146 - RNA, 14 nt, Human
aauaacauuaccuu

SEQ ID NO: 3465147 - RNA, 20 nt, Human
aauaaccaaaugcaauguga

SEQ ID NO: 3465148 - RNA, 23 nt, Human
aauaaccaacccuucccugaaaa

SEQ ID NO: 3465149 - RNA, 17 nt, Human
aauaaccaaucuacaau

SEQ ID NO: 3465150 - RNA, 14 nt, Human
aauaaccacuuaaa

SEQ ID NO: 3465151 - RNA, 21 nt, Human
aauaaccacuuaaaaaauguc

SEQ ID NO: 3465152 - RNA, 18 nt, Human
aauaaccucaaagugacu

SEQ ID NO: 3465153 - RNA, 15 nt, Human
aauaacuacuguguu

SEQ ID NO: 3465154 - RNA, 16 nt, Human
aauaacuacuguguuc

SEQ ID NO: 3465155 - RNA, 17 nt, Human
aauaacuacuguguucc

SEQ ID NO: 3465156 - RNA, 18 nt, Human
aauaacuacuguguuccu

SEQ ID NO: 3465157 - RNA, 15 nt, Human
aauaacuagaacaaa

SEQ ID NO: 3465158 - RNA, 19 nt, Human
aauaacuaguguugcuugg

SEQ ID NO: 3465159 - RNA, 19 nt, Human
aauaacuccucauuguaaa

SEQ ID NO: 3465160 - RNA, 14 nt, Human
aauaacuccuccca

SEQ ID NO: 3465161 - RNA, 22 nt, Human
aauaacuccucccaggguuuua

SEQ ID NO: 3465162 - RNA, 16 nt, Human
aauaacugaauuugga

SEQ ID NO: 3465163 - RNA, 18 nt, Human
aauaacuggaaaacagaa

SEQ ID NO: 3465164 - RNA, 20 nt, Human
aauaacuggaacaaauuauu

SEQ ID NO: 3465165 - RNA, 15 nt, Human
aauaacuguaauuau

SEQ ID NO: 3465166 - RNA, 22 nt, Human
aauaacuguaauuauuugaaug

SEQ ID NO: 3465167 - RNA, 13 nt, Human
aauaacugugaag

SEQ ID NO: 3465168 - RNA, 14 nt, Human
aauaacugugaagu

SEQ ID NO: 3465169 - RNA, 12 nt, Human
aauaacugugua

SEQ ID NO: 3465170 - RNA, 13 nt, Human
aaguuugaacauu

SEQ ID NO: 3465171 - RNA, 18 nt, Human
aaguuugaauguuaaaua

SEQ ID NO: 3465172 - RNA, 12 nt, Human
aaguuugauaaa

SEQ ID NO: 3465173 - RNA, 20 nt, Human
aaguuugauaaauaguguua

SEQ ID NO: 3465174 - RNA, 12 nt, Human
aaguuugaucuu

SEQ ID NO: 3465175 - RNA, 15 nt, Human
aaguuugauuucauu

SEQ ID NO: 3465176 - RNA, 11 nt, Human
aaguuugcacu

SEQ ID NO: 3465177 - RNA, 20 nt, Human
aaguuugcacucaaaucuua

SEQ ID NO: 3465178 - RNA, 14 nt, Human
aaguuugcacugua

SEQ ID NO: 3465179 - RNA, 21 nt, Human
aaguuugcacuguaugcugga

SEQ ID NO: 3465180 - RNA, 15 nt, Human
aaguuugcuuagaaa

SEQ ID NO: 3465181 - RNA, 19 nt, Human
aaguuuggcaauaguuugc

SEQ ID NO: 3465182 - RNA, 20 nt, Human
aaguuuguccauuuguaaaa

SEQ ID NO: 3465183 - RNA, 21 nt, Human
aaguuuguguucuguuuguua

SEQ ID NO: 3465184 - RNA, 13 nt, Human
aaguuuuauauau

SEQ ID NO: 3465185 - RNA, 14 nt, Human
aaguuuuauauauu

SEQ ID NO: 3465186 - RNA, 16 nt, Human
aaguuuuauauauuau

SEQ ID NO: 3465187 - RNA, 21 nt, Human
aaguuuucccuugaggaaaca

SEQ ID NO: 3465188 - RNA, 13 nt, Human
aaguuuuccugag

SEQ ID NO: 3465189 - RNA, 13 nt, Human
aaguuuucuguag

SEQ ID NO: 3465190 - RNA, 22 nt, Human
aaguuuucuguagucauuuacu

SEQ ID NO: 3465191 - RNA, 12 nt, Human
aaguuuugaaaa

SEQ ID NO: 3465192 - RNA, 13 nt, Human
aaguuuugaaaag

SEQ ID NO: 3465193 - RNA, 18 nt, Human
aaguuuugaaaagcuauu

SEQ ID NO: 3465194 - RNA, 20 nt, Human
aaguuuugacaagcuggcuu

SEQ ID NO: 3465195 - RNA, 23 nt, Human
aaguuuugaguagauauuacuuu

SEQ ID NO: 3465196 - RNA, 16 nt, Human
aaguuuuguaaaagaa

SEQ ID NO: 3465197 - RNA, 11 nt, Human
aaguuuuguga

SEQ ID NO: 3465198 - RNA, 12 nt, Human
aaguuuuguugu

SEQ ID NO: 3465199 - RNA, 13 nt, Human
aaguuuuguugua

SEQ ID NO: 3465200 - RNA, 20 nt, Human
aaguuuuuauggcuuuugug

SEQ ID NO: 3465201 - RNA, 12 nt, Human
aaguuuuuguac

SEQ ID NO: 3465202 - RNA, 14 nt, Human
aaguuuuuguauua

SEQ ID NO: 3465203 - RNA, 23 nt, Human
aaguuuuuuugcugcugccucuu

SEQ ID NO: 3465204 - RNA, 14 nt, Human
aauaaaaaaaagaa

SEQ ID NO: 3465205 - RNA, 17 nt, Human
aauaaaaaaaagaaaaa

SEQ ID NO: 3465206 - RNA, 18 nt, Human
aauaaaaaaaagaaauga

SEQ ID NO: 3465207 - RNA, 17 nt, Human
aauaaaaaaagaaaaaa

SEQ ID NO: 3465208 - RNA, 17 nt, Human
aauaaaaaaugaaaaga

SEQ ID NO: 3465209 - RNA, 19 nt, Human
aauaaaaaauuaugacaau

SEQ ID NO: 3465210 - RNA, 21 nt, Human
aauaaaaaauuaugacaaugu

SEQ ID NO: 3465211 - RNA, 12 nt, Human
aauaaaaacaaa

SEQ ID NO: 3465212 - RNA, 14 nt, Human
aauaaaaaccaaga

SEQ ID NO: 3465213 - RNA, 19 nt, Human
aauaaaaacuauucgaaug

SEQ ID NO: 3465214 - RNA, 20 nt, Human
aauaguauuugagaguucua

SEQ ID NO: 3465215 - RNA, 23 nt, Human
aauaguauuugagaguucuaaau

SEQ ID NO: 3465216 - RNA, 17 nt, Human
aauagucaagaaaaauu

SEQ ID NO: 3465217 - RNA, 18 nt, Human
aauagucauuccaaauau

SEQ ID NO: 3465218 - RNA, 14 nt, Human
aauagucuagaugg

SEQ ID NO: 3465219 - RNA, 21 nt, Human
aauagucuagauggcuccucu

SEQ ID NO: 3465220 - RNA, 15 nt, Human
aauagucugugugaa
